United States Patent 7,468,248 (METHODS AND SYSTEMS FOR INFERRING BOVINE TRAITS) - sequence listing, part 22

SEQ ID NO: 62688 - DNA, 1093 bp, Bovine  19866880797127
aaaacttcccttgatcttgcctctaaaatagtagcacctggcattttctgtcttcttgctggttttaatcagagtgcagtatattgcatatctatttatatatctctttgtttgctgtatgtctcctgagtgacatatcagctccatgaaggcagagacattattgtggtattcctagtgcctggaactaggtgcttgataaatatttgtttaatttttggaataggggcaggtattaaatcctatgaaggtaaaggatatataagaatgaaaaagattagaagtaatatttttaagttaagaaaatctgtaaatgatagctgaaaaggagaaaattgtctggaagaaggagagtctccgaattcttaggtggctttaatcctctgttttctcttcagcctttgaagagagttccatgttacggtcaccactgtgttcagagccaagagggagaacaaggaaaaggccttcagtggattttgtgggcccttatggagggtttcaggggtgccttcataatgtggatgggagttcagagtattcctagaaaattaacatacgtgaaataaaatgaaattggggatcttatgttccttaaacctacacctcttgaagtgtcacagatggacatattatgtacttaactcatatgatgctggtaatgatagtgattttttctcacgtgtttcttttctgactgtccttgaccaatgtgtcatttcctgatcccctttagaattggattgagaacgctcatgtgacctttccccgtttcttgggtccctcctgtgtaaggagaacagatgcaggagtggattaatgtacctctcagttaacattgttgtgagttctattcactgatgtggaagaagagcagaaagaaaactatgtcaacatagtgaattctcttgtttagtattatgagatagaaaaagactggaacacttcttttaaattctgttagtatttcagtgagctttctaacagacagatctgtaatgatctccagaaaacaggaagatgatgtttgctacccttttaattataaatagacattaacaaaaatccctattacctaactttaactcccaat

SEQ ID NO: 62689 - DNA, 1716 bp, Bovine  19866880858364
aaaaatatgttattaataaataaaaaataatgcattattgaaagtaagctgattatcatgtttacttatattatttttaagtgtgagtttgaataataaaactaagaaattaacatttattatgttcagttagaaaaatgctaataacctttataagtgacaagaaataataatttgttttagatccttatagtattatagtaaaagtaagcagaaatgttaagtataagctatcgtttttggaattatataaatgtattcaatcttgtcctggacatatttaaagactcttaagtaatttaaaaaatataatctttattaagtaaaccaaccttaaccacccaaaaaaattgataagtagtctcattaaagatgaggctaaaagaaagattcaaccaatactagttaaagaaactgttaaatctcccttttactgtttataaaaatatttctgtatacagggctttcccatgatgttacttctcaatcatactcttttttcttctgtaatggaaattaattcaggcctaaacttttataagtatagtttctgtgagttataaatatttagtttttgatgtatatgtagtctaccttgtagagtgaaatgagtagatcattaccatgtgaaactaatttagtacaaatatgtgtgagctattatataaaagagaaatgaattagtacttgaaaaatgatactatatttcttgtattgtaggaagtgtaggattcttggagcaaattctgaataaccatgattctttgacaagaataagtgaatcttcagacaaaacctcactagctaggtcaaaaatgggatggaatcctgagaggagaaacaggtaaaaatgagattggaatacaaactaaattgaacagaatttttttttttaatatttctaaaattttttcaggaattttaatggatttataagatcgcttttaaaaattgtcttaggtttagttaccatttttttctgctaatatatcttttcctcttttctgtaattatacaatgtgtgtgtttagttgctcagtcgtgtctgactctttgtggccccatggactgcagcctgctagtttcttctgtccatggagattctccaggccagaatgctggctggcgtgggtagcctttgccttctttagggaatctttccaacccagggtttgaacccaggtctcctgcactgtaggcagattctttaccatctaagccaccaaatgaatacatctaattttctcaaaatgtaaattatttactattcatttctgattaaatgatatctgggatttgcttcaataataatccattgcagggtggggaaaaccaggttggaagtataaatgaaatgaagacagccatgagttagttattgatgtaggtaaataggggtatatagaggtcattatactactctttctacttttgtgtttgaaactttacattataaaaagtttttaaaaagtcaagtaagtagtaaaagtcaaggtatagtcagccaatataaatttttcttgaatgtcatgaaaactacagtaacaaaaactaaacaagctacattttgtgtaatctcataaggagatattgtacaattttagtctgttaccagtagttgtaattgctgataaagtaagatttatgtctgtcatgttggtatatgtttttatatatcttaggtcttttttttattccactattcctccatagtgt

SEQ ID NO: 62690 - DNA, 1223 bp, Bovine  19866880884547
aaatggttaagaagatttcatcatagttttcttacagatggcttattttagttatgttccctaggacacaacaagttataaatgctatgaatggtacagaagtagagcaaaatacaatgtgaaaagagaatattatctaagctcctctgttctcaagtcactttctatgtatttctgttagacacacagtgtgatatttatctatattatattcccagtaaactaagctctgggaaacagagaacaagccttgctcttcctggctttcctagaacctggctcttaggagatattcaaatatttattaaataaatatgaatcaagtaattcacttcctttgttagttgtcaacaggactaaaattgaaaaacataaatgaattgaatacatttttatcttgtctagtaacaagatgaataaaagccatctcaggaaaataactgagaatgtgaagatcagcccttcacaaccaggattcttcaagagaattaattcctgcaggaagtgatttaagtaactgcttacttccaaggatggtacattctagatgcatagaagagaaattaattcattacatactataggtgccttaggaattaaggggttaattctgttgaactacggttgagaagggctggtattgactgttactgcacaaattgaaactatgaatattaaaaagacttaaattagttttcagtctgaccttaggaaggataatgtcacatattgattaggcaaatctgttaatgagctggtaaaatgtttaatgattagcctagtatctaaagccatgatatcctagaaggcagagcctcctaacacattgaaagtgctaacactttctttgggagatggaagcccaggacagtaagggaaagaagaaaatgagtttcaaggaacaaagcactgcagtataatgcagtttgccacccgcctctcccacagttatgacccaggaagagatccagcaggtcccttggcagccattttcacatggcacatgggatttctccagaagggctgtaaggagtaactataccccagagcagttcttagacgatggaatggaatcagaatttatctttccagcccctctttcaactccatttctctctatttaaggctcacccccaggggaagcttaccccccgttcacttcttggttgcataatccagcccttcaggagtctccctcaggatttcagatctcccatctgtag

SEQ ID NO: 62691 - DNA, 1613 bp, Bovine  19866880920645
tggtcccccaaatacattctttccctcttccgagtaacagagctcctgattttacctaaggcatatagcccccaaaacaaagcccacatttcgtcgcctcctcaccctagaattgacaatgtgactaagttctggccaatatgacataagtaaaagggctgtacgcaatttaaagagagggagcatgctcttcttttcttttttcttagaaatgttgatgcaatggccggagctcaaacagtgagttgggaccctaaagtaagttaacatgccaaggaatacaaagttataagacacaagtaactgggccctgatattatgaaccttccttaaacagcctggactgcttttctctagatttattttccgtaagaaagaaacttttccagtttgcgtgcatgctaagtcacttcagtcatgtccgactctgcaaccctatggactatagcccaccagggtcttctgtccatggattccccaggcaagaatactggagcaggttgccatgccctcctccaggggatcttcctgacccagggattgaacccaagtctcttatgtctcctgcatttgcagatgggttctttaccactagcttctcctgggaaccccttatccagtttaagccactattattttggggtttctgtcactcactgatgacccaaattcgaactgataaaattttcattcattctacaaacattttctgagcacctaccaagtgtccagcactgagcatcctggctctggaaacaccaaagcagacagggtccttctcttgtcctccatttgtgaagcctacattacagctcaatatctacacagttaggcatctactaggtgctgaaatacctgatcaaccaagatccctctcctgcttttcttgtggtttaaaacagattttgtcttcatgtctgaggatcttttgtacgaataatgctcaaaaaaaaaacaaacaaaccccaaacacagttcttttttaaaagaaataaaattacttgatgaacctattctgctactatacctactccccacgccctgaattaagcaaacacattaacaaagcctattgttgccttttaaattagaataaacaaagatgatgccacgatgacagcccaaaacaatgcactgtagtgttacccataccatatatgtcttctcaatagggaggtgcacaaaactggtataaaaattagatgagatattgtctcagaaatggttattaaatattagctataacagctgataacaaatattagcagctttaaaaacagtcataattttaaattcagtaattccatttctgggattctatcctaagaaaataatcctaagtatgaggggaaattttatgaaaaaatgttcatcccagagtcatttataataggcacaaactaaagatccagtgaccttcccctgccaccttccttcccatccaatggtgagctgaggccgagcactctggcccaggcgagagttataaacccgggactagatgggaagacgcagacggatttgggaagaggcagagaagagcgcagaacttgagtccgacttcctggcaaggcagactgaacgagaaagaagagttcaaaatgtcaagtcca

SEQ ID NO: 62692 - DNA, 1721 bp, Bovine  19866880961460
gtgtgaactgttgcagtctgggtttgccttttttttttttttttttttttaaacattcaagttaggatcttatattggaaaatactgaaatacattagtctctttatttttgttaatacttttaattggtatccctttcaaaatgcaatttccctactccctccctccccctctccccaaaaaaaccctgaaattttaaacaaagaggtttaaaaaggctttgtagtaaggttaaagatgatggccataaaatagtaagtaataaatagtgttcttattatagctattaatttcataaaggtcataatgttttatttaagctgtgagtaaatgttagtaaaaaagactaagagcagaggcaggctacctattgtttgcaggtagtaagtaaagaaatttaaaaaggtaaggacctttgtaaggagaatgtcttcttaaaatctattacttaaattatgaacctgttaaaattaagtgaaccaagatgcttttcgtctactgaaaaagaaaaagcaaaatcacaaaatgtggttactgattatatgataatttaaaactatatttcatattttaattttcttagcatatgctttattgtattgcctaatgaaactaatttcttcattttctgtggctatacaagtagattttcttgtgagattttggttgctttgggaaaaaaaatcagctgcatttcatgctcttggatttaagatttggatgctgaatcattctaacctgtcttgaacagtaatttttaaaatttgatgtattgtaaaactgaaaaagcattttaatctgtatttagcaaaggaaaaaagtgggtatggtatgaaagggaattaaaatctgataagccagggcctacctggcttagtcattataggcctttactacatgagtgaggctaggctgttacattacattgtatttcattcttccaaaatttagttatactgtgcttttcatgaagatttaatattgcttcacaatgataaaaaagagcttttataaccactataacagtactttagcctgccatttggtgtttgtaaattttatgcagtagaatcaaacaagtgttagacacttctgcagcgctaatgggcagtggaccttgtttttatatttgatactttgagtgccctaacattgccttaataaggaaatttgagatttaccatggaggagcatcttttttacttaatattattttgaatttctgagcattagtggtttaggatttgagtacaagatacatatttcatgcttgaggcttgaggaagaggcttgagagtctgataggaagttttgatgactttaacttattgataattatattgaaaaagattctgaagaatatttttgtgggtattatattagaaaagatattactgaatttccttttgaattttgaaactgaaaagtcagtgtaaacataaacaatgatatcaggtattcatatactcctgatttatattcactttggatcaatgtaggacagttgtctaagaataaaataaataggtgattgtttagaagactgaatttgactagtcttagctcttttatccttttgatttgctataggtaggcttatatgttggaacctcccaaaaatcttctctgctttcatacttaggaatgaaaatttgaatttagtgaattttttataaaaaatgctcttttttgtttaaaagtattgattcacatttttccaa

SEQ ID NO: 62693 - DNA, 867 bp, Bovine  19866881004497
ccaggatctttcgtttcaactttttttcttttgcacattggtcagtttcatcttccagtagcagaagaaaagtttttactgtctaaagaagaaaattctggactctgagcatcaatatgaggttcagttcctgcttcatcctgggtaaatgatgaaatttttataatttctaaagaaagatcttttgtcttgcttcgtcttccctttcctttaggagatttttctgcatctttcttaacttcttcttgctccactttatttcctaaaatctgtactatttgttcattctctccagcttctaactttaaggtttctaaagactgcatttgagtcctatcattttcttttaatatatgtggagcagtctttggattttcttcatctagcttatcatcatttaaattttcatttttttctaattcttctttaatatcaggagaaagttcttcattcatcaaattcttttctaaaaggtcttctgtttcactatcagatgaacaggagtctgcaagagaaaatattatattacacaagtttctacttaattaccaatgtaatttataataaaaattctgccaaagacaaaactcttaatcatgtacctctgaatacctccttgtagaaatttctcatataaaataaaccatatatttgtgccaaaaatgggggaggggagatctcaaataaactccatgtgaaaatatattacatagaaaaatattactgtctcaattctgtaaaagagttcttttccaatttttactagtatcatatttaggctacagtaacccttagaaacggagaagacaatgggcaccctactccagtactcttgcctggaaaatcccatggacggaggagcctggt

SEQ ID NO: 62694 - DNA, 871 bp, Bovine  19866881085547
cttggtctcgtcctcgcctctggtgacctcgagggtggcaacctgctgctcctgcgtcaccaaagacaccgtggcttctgctgcttgaacagctgttgtcatctcttgagtgatgatgtcttaaaagcgaagaaacaacatttttaaatagactaaatccctatacctgaaaaagtcactatataactaataatttaaagaaaagcagactgtcatttcagggaatgagaaggcagagggatggctcagaaatgaactgccagtaaataaaagtttccagtgttgctgttttcaggagtggtgaatcaatctaagaagtggtgaatcaatacaagacagagataaagacaataatacaaaacacataaaataaaatataaaataagaaatcaagttaagtttccctttatgaatatcaacataatcagtttatttagaaagacattatacagaactaagttcaaaaactctccgaagcatttatatatatcaatattcacatttgcatccctgaaggggacagaaagttggcattttgaattaaaggaatactagttacaataactaatgtttactgagtttctattatatgccatacacacacattgctaagcacatgatgggcattatcttatccttccctatgtaaggggaggaaggtactaacatcattccatggaagccgtgtatcatagtggccaagaacacaggctccagatccaatttgcctgagtatcgattcagattcagccatcttctatctgcgtgactctgaatgaattacttaatgtttctggaccttgagcttccttaagttgtaaagtggaaataataacagtatctaccccatagagtttttacaaaaattaaa

SEQ ID NO: 62695 - DNA, 1281 bp, Bovine  19866881114363
ttcttgcctggaaaattcccagacagagtagcctacagtctatggggtcacaaagagtcggacgtgactgagcacacatacgcacagtatacatattttccgaagggatgatggtttcatctatggtggaacttctaggaaaagatatcccataagaggagaataccatttattctctgagagatgtttgcagtgtatgaggtagaagggtgtagatgctgctgctgctgctgctaagtcgcttcagtcgtgtccgactgtgtgtgaccccatagtcggcagcccaccaggctcccctgtccctgggattctccaggcaagaacactggagtgggttgccatttccttctccaatgcatgaaagtgaaaagtgaaagtgaagtcgctcagtgtccgactcgtggcgaccccatggactgtagcccaccaggctcctccatccatgggattttccaggcaagagtactggagtggggtgccattgccttctctgagaagggtgtagatagtgacctaataaaaaaccaaaatttgagtcttctaaaatatggtcttctaaacaacaggatatagtgtgttggaaatatttagtaaaaacggtcctataaaattagccagcacgaatcagaagagcttaagtggtcaccagtaagacattcaggtagtctcattgtagaaaagctgggtccagtggtcacataatggggcacctgcaatgtgagggaaatacatcagtattttgctcaaatcatatgagaaggtaagtgggtgctgattgcattgcatcatttgttgggaaagtctgtgccaagaactctgcaggttctttgtatgatgtgatggaggaaatgatcagagttgtgaatgttcttctcatttgtgctcttagtgcttgccaggttatgagaggttgggaagaaattggttggttcagggtatggaaacttagtttatttctccgcaagcagatggctaggtcatggaaacttggtggaaaaatgggatttattgagttgctttcttagatcaagggctttgggggattaaatggctccaagagacccactttattggatcccatagactcacgaggctgtactttcttcctgaggagagaagacatctgaacccattctacttgaaattgcagaggaaaaaacccccaagactttctgatatgggtaagaaagggtagctattcacactcatacaccacaggtaactggttaaacactcattatccattgttgaactgttctgagctccccagaatcataaagt

SEQ ID NO: 62696 - DNA, 642 bp, Bovine  19866881135755
agtttttgttttgttttgtttatttttgtttagctgctgtttcttggaataatgttttaaaaggaatttactatatatatgtatatatagatacatatttatatagaatttagtatttcaaaattttcttatcttttttttttcttaaaagtcaaaacaactctgaagatgaaaagaatctcttttccagattatccaggagtagaatttgggatttttatcttaggagaaatacattcagaaaatagaaaaagaaaaacaacaaaactcccagctggagtgagaaaaatcaaacccttacagacatttctgtctctggctaattggtgactttccaacaggctctgtcttttgaaatctgtttttttttttttttttctcttcaaaattaaacctcagttgtgtcttaaatagaaagtctccaccgttctgtccatcatgactctctataaactttctttcatggaggaaaaagagagtgtttctgagagtcttgaaacagtcatccaggtgatttcactgttgaattcatattgcttgcattctcccctataatatttccttagcataaaataaattctatagtgaaacctcatagcaaaagaaacctttctggagaaaaagaagtctcactaactgttt

SEQ ID NO: 62697 - DNA, 2350 bp, Bovine  19866881136743
actgatctcctttagaatgactggttggatctccttgcagtccaagggactctcaagagtcttctccaacaccacagttcaaaagcatcaattcttcagcgctcagccttcttcacagtccaactctcacatccatacatgaccacaggaaaaaccatagccttgactagatggacctttgctggcaaaataatatctctgcttttgaatatgctatctaggttggtcataactttccttccaaggggtaagtaaacaataataaatagccttaaaaaaaattaaagagcttaataagttagagaaggagacatatagtatgacatccctttatgtggaatctaaaaagaaatgatacgaatgaatttacaaaacagaacgagactcacagacttataaaatgaacttatggtggctggagggaagggatcattaatgagtttgggatggtcatgtacacactgctatatttaaaataaccaacaaagtcctactacataacgcagggaactctgctcagtgttacatggcagcctggatgggaggggggtttgggagagaacagatacatgtatgtgtatggtggagtctctgggctgttcacctgaaactatcacaacattgttaattggctaataaaaataaaaagttcaaaagaaagaaaggacttaagttaaaaatacaaaaaactttttcttaatgtccttccaagtcttccatgaaagcggaggaggcatataaggcacaagttggctgcttgctctggatggaattattattgttattatttttgtctgaatgaggaatattctatttctaggtaagacaacagcaagtaaagttttttttaaaataaatagtttgtattttcacagtgttgtcttgcatgcattctgcgcaacttttaaatgggcagcacttggtgttcccaccactgtctgcattagtcatcccaacagcacttcatgggaggggaatggctgagaccagcctgtctggatcttctgacaagtcccaaatgatcctctgaccatcaagtggggtggtttgcttcctattcagtacaaggggcatcaaggcttttgagatagccagttattaatcactgtgaacacatcagcacatatttgtcaaaggggttaaagctgttacacaatgtaagcagacatttttgagaaaatttgtgtaatgccatgaactaatggtattggtttatactgtgtgatttttcctttccatttgctggcctcttcagttcacatccaggtgaggatctcttaagtcgattaacttaaatccaagagagataacattattgtctgaagcattacaaacaagcaggggaaggcttcatcttttaggcttcagttagtttacaataagttgtattcaaatcagttgattgcatacaaatcaagtgcatcaaatactgttctttgacagttttcaagttgcttcatcatctttcaactgcagcatttgcccttagtcctccagggttaagagacagatcaatgagatgtttaataatcgttatacctccttggatgctccaagagaaaaagttggtaaaaacatctgtggagaatccagtccttaactgcctggaaggattaaccacatgagacaacccttatgaatcatgtttattcctctttcaggcactttttgtatccaagctttgcaaaagcccaaattcaaaagataagtttcctttcctgagtattgtcatttacataactctagaccttggagtttaagctcataaaagccagtacataaatgttcttcttaagctttttaaaattggagatgatctttagagcatttgcattctgggcagggaagtctattaaatctctgctttcagctgtggaatataactgagtttggctagctgcttgatgattaagactgaattctctctgggcagagagaatttctgctggggtctctgacccatggttaagtaatgcaaatatatgtgggcttgtatggcaaattattcctataccaatggagaaatgtgtggaattgattttgcttgtttcttagtttccatgtggatgaatcttttctatttctcctgcctttttccttcctgtcttgtttcccaccatttctgctaacgcattgacctgatgttgagtgatttcctagttaaaaaaaaaacagactacaatgctacttctagttgcagatggacttgcttggtcacattttttactctgacttaaaaaaaacagttgtgcttggaagcctttggtttgataggaaagccttctcaaagtccatactactgagtgtccttgggttatcttagaaattcccattggaacttttacagtct

SEQ ID NO: 62698 - DNA, 1789 bp, Bovine  19866881164742
cagcaaccctaatcccaggttttgtttagaaaacgacaatcttctccgttcctctgaataacccaaaccaaccactgaacaccactgttccacagccacaggcagcgaggaaaacacactagctgagcgatccatagaaccttccactcaacccaggtgtttaaatggcttcgtatagcaaaccgctaggatctaagtaatctctttctctttaaacagtcacctgcccccataagaactgcagagacatttctgtttaagcctaaaggcacaaacaagtcaccatagccctctggacaagtgataatatacgtctgtcactggtgactttattatactacagtttgaaggttcaacctatttacccgtgatcttcagtctaagagtagcccgaggcaggagtggctatcagtatcacccacgggatactgcatagacaggcctattgtgttttctctacaaacagcttgtcaagaacacaaaggcagtaatgatacattgtgctcacctcctccttaccttaggaacacttacagcaagaggctgctctcagaaagggcaaacgtaccctctgtagtgtcagaatgtctctactcatgaaataacaaaatcctgaagtgtcacggttctgagctctatttttaaaacctgaccctgagcatgtgtgtctattctaacatctatttgactatacagagcttttaaattctccttatcaagttagcccatttgcttgtatttcttggcaaaaaaaattatttaataaaatcattcatgtaagccagctctctctctcaagaatgaattcaagaaaggtttctctatgagttacctacaagtgatacttaaatttatgtgattataaggaaaacagctgatgtgggagagaaaaagaaacaaaggtctgtctggtcaagactatggtttttccaggggtcatgtatggatgtgagagttggactgtgaagaaggctgagcaccaaagaattgatgcttttgaactgtggtgttggagaagactcttgagagtcccttggactgcaaggagatccaaccagtccattctgaagatcagccctgggatttctttggaaggaatgatgctaaagccgaaactccagtactttggccacctcatgcgaagagttgactcattggaaaagactctgatgctgggagggattgaggacaggaggagaaggggatgacagaggacgagatggctggatggcatccctgactcgatggacgtgagtctcagtgaactctgggagttggtgatggacagggaggcctggcgtgctgcgattcatggggtcgcaaagagtcggacacgactgagcgactgatctgatctgatgagagaaattagtaagacgtcgttcatttaacaaagacagaaacttgtgttccgtgttcctgggtcaagaagctatttccttagaatcttggttttgaaggactctgcaatgttgttggttcttctaaagcatgtggaaagggcactgagctgaagataggggtgcatggtgtggggtccaagtgggttctagtcctgattctttctgggtacaattttggataatcatttcacttctctgcttcagttctgtcttcagtcaaatgggagaagaaaaacatacacagctttgaggaataactgtgtagctttccttgcaaacagcaaagcaggccccattacatttgaacaagttctccatgctgtaaaacatcatggacagtgttattagtaacctttattcttccacgctaatgagccaagtcttca

SEQ ID NO: 62699 - DNA, 1205 bp, Bovine  19866881178328
tgtaaaggtttgtttttcctctttgctgatggttaatatttgtgagtgattctttggtacagtgtgtatgtatatcctattcttcataactttggacttaatggcttgagtttactttgctgatacttgcctgaatcagttattgccttggggatgcaacatggtggttttgtaaatatctttccttctacttttattgggtgacatgatacaaaaaggaactttcccttatttttttccctttgtctctttaaacgagcatggtgaattcgtggatttttactcatttaatactttataatcacttatgtgtattgttctttttgatgctcaacatgtcccaaatttgaccagtgagaggataaatttcattaaaagactgtggagtcagctcagtctcatctatttgaaatatgagaaattgtactctattaaaatgatttttcagatgctaaatttcaatgtaacaaagatctggtaactatccattttttattctgtcttggaaatggtctctttttctgtatttctctcttatctctaagaaggcttttaactttgaaactatagcaaattatttctctgaggcttataaagataaggctttttttttttttcccaacaagagttctttttttaagaagacacctcagacaatttttgaaaatgtagagttgctagtcttttcatatttgtatgtttttacatgtagtcattcttctttgactagaatttctttggttgcctgattaaatctaagccaaggacaaacaagcagatgatctgatcatcttttctaatgctatgtgtgatccaatcttttggggggcaagttataaagtttattgtgtaaggcagctgtgacctacagtcagttcttgaatcatgtccaggttgttctcaataagcacagaagggggactctttctaaaaaccagcttctgaatcattaaattttaggtgacagaacaccaaagaaagagaagtgagaaaaacaggattttcaaagaaccttgggtttgtccacttctgtctgttgcttgacttgtctgtagctaacagttgtactactcagttcagttcagttcagtcgctcagtcatgtccgactctttgcgaccccatgaatctcagcacgccaggcctccttgtccatcaccaactcccggttgtagtactagaaaatggaaaatggattttagaaaa

SEQ ID NO: 62700 - DNA, 464 bp, Bovine  19866881222729
catcctcttaccgtgtcctcggggaccggcaaggaggttctgtgacatccctgcgctaaacactcaactgtttgttctctgcaaagtaacacatttcggtgaccaccgcagcccccactcgctcctaggctcctgaccactgactggcatcggggacattgcaatcaaagctttcaaaggagcagatcttagtcttcgggaacttctctaccaccgctgtgagacggagaggggagggagagaagaaagaaaagcccacacaaaagcagccagccctgcaagctccggcagcacaaaggcccgctcgctggtgcggagccgtgaggctgggctggagcggggaatgaggctagtcctcggaggcctgcgcgccgcgccccacgctctcggagcagcccccgcgcaccccgagccggggcaccgcgttctggcggcggcgcggggcgcacgcttcgcgcgcccgg

SEQ ID NO: 62701 - DNA, 1263 bp, Bovine  19866881235444
tcctttgaccctttcagttgtacaggctgacaagtaaatgggcttggattccgaatactcagatcataatttgccaagagatttaaaaataataaatgcctttactcaacaggcttatcatttctgaggtgaaaaaagatgagtaagagtcaatcttacatttgatgattttagtgtaatgtagggataatccaagtaactgtaatataagatagtttgcattcaatactaggtcttcttgtcccgagaccttgcatttatttgaaagaaatccaaaaaaaaaagtcttcatgaagctggtgcttttgagctgagacttgaagcatttaaagttagtcagcagaaaactttgcgagaggattttcttagaagaaacaaaataagaataacaggaaagaaggggtttcttcacgaaactgtgctctgggaatccattttggctaaatattagatgtgaataggggcataataggaaataagactgggaaggtaatttgtatcaagggcagaagataatttggatcttcctcctagttatttttattttatcttatgcctagtggtatcactgtccctctcctcggttatattcttcttgtgtatctttttgtatttacccctccatttcagtgttagctccttgagggcagactatattattagtctaataatttccaacaccaaacaaaaaacatttaataccatctgatattaaaacagctgatattccttccaagactttttaattgtctggagatacaatgtttaatatgatagccatgagtcctatgtggctatttaagtttaaactgttaactaaattaatattaaatagaataaaaacttcagtctttcagttgtactggccacatttaaggtgctcacccccatgtgattcattgtttctgtattggtcagtgcacacagagaacatttccatcttgcataaggttctgtggttggtgctagattatcacagaggggctactgttgagcaggtacatttcagcaatttattagactttaattttttttaatactaaactgcagaaaaatagattggttaattactaatgttaagacatttgttatttttaaatgttaaaaactttgaaagttcattactcaaattttctctggtctgtttaattaactaaaaattgtgcatgccttggtaagaatgggaacttaggtgcttattttaaacagccagatttcaaaatagatcctgattcaagcatattttaaaaaattataatatgc

SEQ ID NO: 62702 - DNA, 837 bp, Bovine  19866881383190
atttttaaaaaataaatgacagataattttccctggttaaatttatggaaattcaataccagtgccaagatgtgattatttaccaaaaatgtgattattttaaagactttgctacctattgccctgaagaaagatgagatgcatttacagtatactcctgccaaaagtatatgtatatttatggcttatggcttccctagtagctcagctggtaaagaatccacctgcaatgcaggagaccccagtttgggaagatcccttggagaagagataggctacccactccaggtattcttgggcttccctagtggctcaactggtaaagaatccacttgcaatgcgagagacctgggttcgatccctgagttgggaagatcctctggagaagggaacgaatacccactccagtattcttccctggagaattccatgaactatatcatccatgggattgcaaagagttggacacgactgagcaactttcactttcactttcctgccaaaaaaggcacatgggtttcactgaactctgaaagcatgaatatttttcatttaaaagagatgtttgtcattctgatagttgaaaaacagtgtcttgctttaatttgtatctctctcggttatatttttagtgtgaacatttgaacagttttacacaatgtgttttgccacttttctctgctcacttttctgctccacatttcctcagtgcttccaggctctgtctttactctttttgtaaatgtgacagctgtcccctcagtggttgccaggattagtttggctactctcctttgctgccactttcttcctttacaaacccacatgcaggcctca

SEQ ID NO: 62703 - DNA, 743 bp, Bovine  19866881641149
tcacatccttgcttccttttagcccctatgtcacatccattatcatcctgaaaagaaaaatcattcagaccacttaaatgatgtttcaatgacacacaatccattagaattcagaaaaagccagcactttccaaagagaaactctatttcacttatcctttctctcgtttctttacttgaggtgaaatttcagcttctattgggatttcttattttatacatttttatgagatcattatattttcctataatgacctgaccccttctaaaaccacctgcttagttggctaaaaggagcaacgtaggggttaatagaagtctatttcatccatttttgtttgtttactgtgaagcagtatatgctcaaagcaaaaattttgggcaaaatatataatcctggcgttatgcccagaaacagctgggcaggcttctagctctgtccaccaccacaaaaaacctttcttcagagaaggccacaaaataattagaggccagagaatggggcacacatttttgctaccatttcctctgggttgccagtcaggctgtgctgactccttacacgagtgatgagaaatccctctttcttggtctcctcccccttcccctttgtcgttcttccattggtgttctagctgtaccctgtggttgtggctggaagctccattgtcagagatttttcatatttacaactgtcttcctggtgtctagaatattgcctaccacataatagacctgccata

SEQ ID NO: 62704 - DNA, 884 bp, Bovine  19866881825539
tgcctgatcattgtgacttttgttcctgcatttacttctgatgtttattagatagtagaacttaatttctaccaactgtgctcatgatctgattgccttcattaatttttgcttttcaattggtttgtcagatttttttcctgaatgatttatatgaactctttggcaaactggccctttctatgttcctagtttgttgtcatttggcttttttttttatatatttttatccaaaggtgtttatatatatataacacctttatatatattacttagaaagcatttcttattctaagatgatgaataaattgatctatattttcttctgttcctatcataggtttattatttttaaatcactgattaatctggttttttggtatcagttaataaatctctgattaagctggatttacttggtgtgaagactgaggaaggcatttatcttcttcttaatggttagctagttttcctgttgtcggagaaggcaatggcaccccactccagtactcttgcctggaaagtcccacgaacggaggagcctggtgggctgcagtccatggggtcgcacagagttggacacgactgaagcgacttagcagcagcagcagcagcggttttcctgttgtaacttacagattaattcatttttcctattttgattttaatatgctaaattgtcatgtgagttagtctatttctagattcctttgatattctcatttcctcttcagcaccaaactgttcttaattattatagttccataatatattttattatatggtagggccatccccttcattgctttcctatgtataaataagatcaagtaagagaatataaggaagaaaagattccatttacaaaagggtaaaaaaaaaag

SEQ ID NO: 62705 - DNA, 572 bp, Bovine  19866880414070
tttaagatactatcatccaaaatagtttcaaaaattcttgagtgcataaaaggtgaaccttccactatataaatataaaaccataatgtctaatctgaaacttcattcatctaatatgtaagaaataaaggacacaaatgtagaatgaaataatactcacactaagtcattaaactaatccagcagtgaaaataggaaaaaattaactttttaataatagttacacaattaatcttcttaaagaacatatttataaagactgtctaaaatgctaactaaaatcagattcaagaatttataatctcaccctaatgacttggacagttaattaaaacctcttttactttttccctgaataatgagaataattcctttatagctttcaaaagaccataacctatttctaccaataagtgaataattgtcatactgttaaatataaattaaatttagagagagcagccagcttacttttgacattctgctgaaagttttagttctttgggttctagaaaggaagaccttaattagtgcaccaaggtttcctgttcgaggattattttcaactgcaa

SEQ ID NO: 62706 - DNA, 2000 bp, Bovine  19866880587842
tccaggctccctgtccatggagttctgcaggcaaggatactggagtgggttgcccatatgctcctccaggggatcttccagacccagggatcaaacctgcttctctcatgtcttgtggcttctttaccactagtgccacctaggaagcgtatttacttttattgaaagatttattttaaggaattggctcatgaaattgtggcgtctggtgaatccaaaatctgcagggcaggccagcaggctagataaccagggaagagctgcagcccaaagaccatctgttggcagaatttcttgctcgggtagatgagtcctcgttctagtaagcaaggccttcaactgattaggtgagacccactcacataatggagagtgatctacttcgctcaaactccaccaatttaaatgcttttatttaattactttttatgggctatcctaggtcttcgttgctgcacatgtgctttctctagttgcagtgagagggcttctcattgtggtggcttctcttgctgcagagcataggctctagagcacaggctaagtagttgccctgggggatgtggcatctttctggaccagggatcaaacccatgtcccctgccttggcaggtggattcttaatcagtggactaccagggaagtcccaccaatttaaatgttaatctcattttaaaaacacacttgcacagagacatccagagtaaagtttgacaaactatcagggtattgtgccccagccaagttggcacataaaattaatcattgcaaactgaaagtgcatggctgaggttactggtctgcggaaggactctcttggctgtgaaaggcttgggaacatgagagtagtctctgatgacctccaggtgcccttgtgtttagcctttcactgggtaggagataggagcacatttccttcatctgtgttttaaatgtcccagttcatgttctttcctcttgatttaggatggtaacagaaacctgagtttactcagtaagttgtccataaagcttccatctctttcttgagcttgaaggtacagtgctaatgaggtatttggaactgattttctctgccaatataacacatggccaccactgaacagtaattttatgcttatgtacactccaactgagaacaatgtggtcagtgttgtgaattcatgaatagaagccctggcactcttactgcccagtgttcagctcccaggcttgggaaaatgagcccttctttggggtagacgtagtggaacagtcttagcaattctactcacagggctgagggtggaactgctctggggggttctcatgaccttataactcctgaaaccaagcttggaataactctgcagtgttgcctgagggccctggggagcaacatagacagtttcatagggggcaggttcctggccaatcaaaaagtttcctgtgaagggtaaaagctgcatgtgagagatactgatgtagttaacatccgatcacgtcaagagccagtcatatggctaggagaacagcatcaagctgatggtttcaccaaatggtcatttcagtgaccacagagttggctctaagctgggtctttcagcctaaaattcaccgggcagtgagagacccatcaacctctctcccaccaacacttccatcaaagcctacccaagaggcttggtctggctactgggaagccctcctttaaggctggtgtggagggcagacctgccccctgtattgatggacagtcccatttgatcaggcattcatggggcagggttatatttcaagaatgacagggtgactcggggaccaggagatggtggttacaacatgctctggaaatcagaagatgtactgcatacccctcatgcccacctgccattgttatcctctttaaaccagcgttcaccatcttggagtgctaccctctgaaggctgctttttcacgtggagggcccgagaaaggtgtctgcccactacacacagccaggccaaaggccccatgcttg

SEQ ID NO: 62707 - DNA, 909 bp, Bovine  19866880727121
aatacctaaaaatattagactaagcagatagcaacttacatggcactcattaagtataacatcacccccttgttttaaagatgatgttacaatctatatttataggtgtggataaacaaatcgatttattaccagagttcctttttacatggcatatgtatttttaaaagtcttttgactttagacaaggcaactatttaaaaagaatgtcaccgtggctctccatcacagtttactctccaagtgcccagtaaggccacgcagcaatgtggagctggcttggttcccagcaatgcagttatgctatatggcctgaaactgtatttcaatgtgttaatagtgctgctgtctatcctacttgtagtctaataacaaggtctaagaaatccacaaatgcagacattcatctcaagttcctttattcaaggaaataaaatttacttgaaaacaatttcttgattagatttgtttacaatttatattttaaaagaaacatttttatatgtcattatgttcctctttatgtcaagggaaatgattgacacagcacacatttaagcgatgccacccacagatgccaaattggttccagtgggggtggagttaactcaaggaaagaaagacctaaagcacttctctttacagaaatagctattaaagacagagaacttagcctgaattttttaaaatttatctttacacatcaccttgggaaattaagagacttgtttctaaaaatctagtcttcaagagacattcatgatgactatacgctacattcaagtgttgctcagttcacaaacatctgtctacactaagtcgtctgggtataaacactaagaatgtaatggaaagacgagttcacaagaactaggtacaaaatagcatattcagcacattttaggccat

SEQ ID NO: 62708 - DNA, 1762 bp, Bovine  19866880798188
cgggactgtcccctgcctccctaggacaacctcacttgagcataattggactatgcctccaatcactttgaaccccatggcagtcagacatttgctagtggagcaaaaacacctaaccttcagaggtacacggagactcaggggccctgaggaagaggcaggagccccttggggattgggcagggccgggcagcaggaagccaaggctgtgtgagtgcctccatctcagcctctcacctcctcaggggcgctgcgctcttgcccagggcacccggcgggcagccacctgggcgggggccacacccacagggttgttaaaactacctgggcctggcctggccttggggaacaagctcaccagctcgctgtcctctgaggggccgagttcagatgtgactgccgggctggtgggaaacgaaagcaggcgcagagccaggctcccgggggctgagctgaggctgagctgaggctgagctgaggctggcccaggatggccgggctctgggggacccccgccaacagagttcgccccccggggcgtcacatccttcaggctccaaagagaacttgggaaacgtgagcagggcttttctgaatgctcggtctgccccttggctccggcttgccccggagagggcggagggcccggaagaggcccatgtgaggtccacgcagagggccagggttccaacccgggcacaggaccatctgaggccctgtcacctgccgccatgtcacccgggcaggcctgccttcttcttttttttttttttttcctgacttcttcttgagcccatttccactggggccagtgggagtcatgatgtttgccctccctcccttcggggttattgtgaggatcaaatgagatcacaaagataaaagaatagaaaagaagaaagctcggaacacacgtaagtggttgttattgtcattgttgttatccttagctcctcgccaacccctctcggaacagagccatccggcaggttctcagccctacctggggtcaccagagggtgccaggctggcctgggccctgccacacccaagctctctccagggggcaccttgggggtccagaacctcctctgtccctcccagttctccagcacagccctgctggaggtggacaagcgaggggagagaggcctcagactgtctgtgtgtgggccggtccctctgggcactgctggggtcacatggacacacacactcccaaatacatacacacgtgctgacacggactcatcaacacacacaaaccagcacccgcccacgagcattcaccaggtcttgactcaacacaaacatacacacacacgcacataccacacacaagcagatgcctcctccaaagcaaattccatgatcttggccttccatccagaggccaacgggcaggcagggatattattaccttgttgtcattatgatcgtccttagaaaagtctcaactcggcagaaaacatcaaacagcggccagcagcctcagatagcagaggcgacaggccctatggggctctttccagtgcagacctgcctcctcgtttgcaaaaatgacttattattaatctgtgattgaaactgtaattatgccatcaccgtgtcaacaagccggaacacggcgaggactggcagcgctgtctggaaatgtgttcttactctccaccacgaccaggctggcatctgcctcatgccatggacgaggatgcacacacctgccaagcgcagggcccagctccccacaggatgccagctg

SEQ ID NO: 62709 - DNA, 1145 bp, Bovine  19866880895343
cctggatgggatgggagtttgggagagaacgcatacatgtacatgtatggctgagtccctttgctgttcaccccaagctgtcgcaacgttgttcatcggctacacctcaatatgaaataaaaaggtttttaaaaaaaggaaaagaaaatcgtaggccagtttcagagaattgcttattggcgtggcacaaaagacaaaaactacaaatagcttcaggtaaacaagctctctttttaccatgaaaaaatgttttgaaatatcactgggcaaaaaggcccaccaaaatctaatttgctatcctcaatcatctattcttctagaaatttcagaggaaggcatatattttgaatgttaaatgaaaacagggaaggatgacaaataaccggaataccaggaaacaagcttctctactgtgaaggccaaaattgtctctaagtacaatgactgtgctcccagtgaggacagccaatttatctccaggtcaatggaatctggaatgaatgctccatacaaggtatttctagagactcgaagacgaataaaaggtcatgaaactcggcagaacagtatgttcgggagctgtttcattttttgagtgttttttatgtggaagaccttgttaggttaggatacatttattggagggaaaagtacccaagaaaagtagatgggccacatgggaaaaccttaacttcattagccccagacaccaagtaccagagccaccctacaatttggagcctgttcttgggagctggccctttcccagatgttttcttttgtggtataataattaccacaaacagcatttaaaatgacactgagatttattatattacagtttctgtgggtcataaattagtagaagcatatatcagagctatttgggatttggttccagattaccgcaataatgcaaatatcttgataaattgagtcccataaatttcttggtttcccagatcatataaaagttatttacactatgctatagtctattaagtatgcgatggtgaaacagagtaggttcctatggtccttcccctcacatcctctgcctgccttctgtctgtgaaaaactcaagtcaaagactaagtttaatcagagacatgagaacatacgaaaaaaaaaaaaaaaaggaaaa

SEQ ID NO: 62710 - DNA, 2081 bp, Bovine  19866880898293
tgtctctgctttttaatacactgtctagggttttcatagcttttcttccaggagtaagcttcttttaatttcatggctgcggtcaccatctgcagtgattttggagcccaagaaaataaagtctgtcactgtttccattgtttccctatctatttgccatgaagtgacgggactagatgccacaaccttcgttttttgaatgttgtggacctgagtttgagcaaactccaggagatagtgaaggacagtgaagcctggtgtgctgcagtccaaggggtcacagagttggacacaacttagcgactagacaacaacaacaattggtatttagaaatttccataatcagatcaaatttcaaatgatggttctttttgacacctccccccactttacttacccttctccttagtatcctatggctatgtgtcttgtaaaggtgaggattgaatacactttgatcagattttcccagagggccagtcaaaccaggaaacagacatgtgagaggaagtagcctaaaagaactttataagaggtctgccttctctaagaagcagtttgttaaatactggtagctcaaacggtaaagaatctgcctgcaatgcaagagacctaggttcaatccttgggtcaggaagatcccctagagaagggcatggcaacccactccagtattcttgcctggagaattccatggacagaggagcttggcaggctacagttcatggtgtcacaaagaatcagacacgattgagcgactaacatatgagatatactttaaaaattccctagtctgtatccttatacgtaaaaattacgtatacattatttttcctgtagctgaattcctaaatggacgtacagttcaaagggtatgcatattttaagcttttgatttacattattaaatcacaagagaccattcactttggaaaccaaataaacacaaacacaatctcgtacttcgccaagcataacaacccttttctgaggctctggaagctttatcccctgtatcctcatggctggtaccatcttttccttccagattttgctgaaatctccccttattagagaggtcttggtgcctcccacacacaaaatcacatgtgcccttccctttcaacatcccttttgcagaggtgttttcctcagctgcgtccagcacctctgacaggttttctatttgtgtctctctcttcccagatccaatgagagcagggctttgcctatcttgttcttcctatattcccatgtcttccccatgcccagcatagagaaagtattcagtaggcagattcactttatgcatcaatgactgagggttgatacttttagtttcaaactaagagtgatgataatactcagggcttcataggggctattttcagcagtagaggctatctatagataagagataagaaaatagaccaataaagtgacttcttagtgtagtaagcgtcatgaaggggggatgtgattaaggcaggaccatccgggacatctcttctgagacgggatgcttgagctaagacctgaaggatgactaggatgtgagaggagcgtggacgaatgcctcccaggcacacggaacagcttgtaaaaaggcctggaaagggagaagaggttggcaggttgcagagtaaacaggagacgggtgactgctcagagaagccagtgggtgagagccacaggtgggaagtagggaggtcacccgtgcgctgtgagtcaaggactcaagtaaggattccttcctcaaagttcctctcctcaaaggcctccctgcctctgaggtcccgccatctgagagtcactcctgggaattaagtgttgccctcttctgtgttgtcccctccgaaacactccaggaatgacttactaggtgcaaatgaaaatattgacccaaatagcataacctatctgaggttagagtgcatatgtaaaactgctctgtcttgcggtaggggctgaaaggttttttgtctcctgcaatggggtggggaatctaaaatctagacacctccctggaggaacagctccaggtctggagacagatccaggggaagtcagctccgacaac

SEQ ID NO: 62711 - DNA, 1266 bp, Bovine  19866881039920
aaatctagtataatagaatatataatggaatattattcagccttgaaaaagaagaaaattctgataggtgctataacatgcatgattcttgagaacattatgctaagtgcaataagccaggcacaaaaggacaaattttgtatgattccacttatatggtgcttccctggcggctcagagagtaaactatctgccatatagtgtgggagacctgggctcaatccctgggttgggaagatccctgggggagggcatggcaacctactccagtattcttgcctggagaatccccatggacagaggagcctggtgggctacagtccatggggtcgccaagagttggacatgactgagcaactaagcaccacttatacgaggtacctactggagtcaaattcataggacaaaaagcagaatggtggttgccaagggctgcagagaggacagaacagggagctgttgtttaacgggtgtagagtttcagttctacaagatgaaaagagctctggagatcgatggatagtagtgatggccacacaacaatgtgaatgtatttaatgccactgaagtgtgtgctcaaaaacgattaagatggtacattttatgttatatgtattttacctcaattaaaactttagaaaaataaaagaaataacaggaaaggattagctgaagttaaggcactatttattcaatttccctgcaatcatattatttaaggtgtaagtgatggttatttggcaagaatacaattccctttaaagcctacattagttggatttcagttcagaaatgctgcatatttggtacaaatttgagagaatttattctggcatgggctcttgtttatgataaatgggtctctgctttaccatgccttgcccaaacccagtcactctcagtgcagagcatggctggctttgcatctgctctgaaggtcacctggttcactgtggcctagtcaagtcatgtgagcatggaccagggcaggctgcctgctcttctcaggctgtgttctcgatgatgaccgcaattccttggccacctccaatgcaggctgatcctacagcatattttccaccccgacgcctgagaaagaaagcagtggctgaaaactagttgaataaagaatgtacagaattagataatcaattaaatagaatttataatggtcacatttgcaatattcattctcgttcagctcatcagctcaatgttttctccagtcctcaatatttggggaaaagaggagaaaggatttggaaa

SEQ ID NO: 62712 - DNA, 930 bp, Bovine  19866881103708
gcagcagctggtgacagcctgccttactgcctagacagcaggctgctacccaagggaacaattgggcagaaaggggggtggccagtcagggaacacgggccagtggaattctgaacaaggtcagagtccaatctggtacagtgcttgattaccaatttaaatctcgtctttccttccagggtggctgccacccctgcagaagaggccaaggctgccacaagggacatttgcatttaaagaggccaagtgcccggcatcctggcaaggctgaggcctggcctgcacgttcatcccaacaccagaaggttgcacgctgagtatgctcggatttcacccacatatggatgcccacttgcttggggggaaaagactccaaattcttcttatttcttccaatctgaaggggaatcctggagtgtgcagagtggaggcagtggagtctggaagctggtgatcgtatggttttcttaacagggtctgaaatgaagtcctaacggaatggcaggcagtggatgacagggatagtaaaggggctaaactggaatcaggctgggcgggggagatgtggaaggtggctgacagaatgacgcaagaatctgggttaggggacttccctggtggtccagcggctaagcttccatgctcccaatacagggggccgggtttcgatccctagtcagggatctagatcccacatgctccaatggagatggaagattctgcatgctgcaactaagacccagtgtggtcaaataaataagtaaataaataaatattttttaaaaagaatctgagttacagtgagggtccagtaggtggattcgacagcagtgtggattgatttattctgggcacatgattcaacttgaaagaaggctcctcttcatgtctctctccttgaggcagctgattcgcaatctttttctccat

SEQ ID NO: 62713 - DNA, 1677 bp, Bovine  19866881178120
cagacagcagcttagactcttggcctcttctgcaagccttgaggtcatgcactcaaccctggagaagggctcactgttaaactccctttgtcctgaaaagaatgaggcagtcaggcaggagttaaatgcagggtgacagcatttaaaggctctggagcaaattggggctgccctgccggccagactagatgggctgctgcctcatgcatcctgtcaccgagacagaacctggccagctgtggagggggagggggtcaggtgagggtcaggttttggtgtgtctcttgccacagtctgggacactaactccccctccccaggtaggctttgccttagcagagcccagctgttggcctctggacctgaagaaatgtcaaaagagttacgatccagttgggctccctgggctacttccttgctgctgttactgtcccacgacgctgctcctgcatacagtgctcgaattaacgctcccttcacggccggtgtctgaagccagtgggagaaaaaaaaaaagcacaggcgggggtctccagacctgcctgcacgttaggacccctggggtctttcacctcatggtctgctggcacgatcccagcatcaagtgttttttgaggcctgccgggtgatttcaaggtgcagacaagttggggagcctctgatgtagggggtaaaaggatctctgttcccatggggagtatctctggtagcttctcttggtggctgtgcacagattctgtctgtgctcctatggtgaagaattcaagtgtcttgcttgttgagcctcttctcagctaagacatttgctcggttgtaggggtttccctggtggctcagcggtacaggatctgcctgccaatgcaggagacgtaggctcaatcgctgggtcgggaagaacccctggagaaggaaatggcaacccactccagtgttcttgcctggagaatcccagggacgggggagcctggtgggctgccgtctatggggtcgcacagagtcggacacaactgaagcgacttagcagcagcagcagcagcagggggtttctctggtggctcagcggtacaggatctgcctgccgatgcaggagatgtaggctcaatcactgggtcgggaagaacccgtggagaaggaaatggcaaccactctagtattcttgcctggaaaatcccacggacagaggagtctggcaggctacagtccatggggtcacaaagagtcggtcctgatgtagcaactaaacaaccgcaagaaatttgacaagatgtattaactctgccccttcctcctgttggctttgctgtagtgaaggacattataaaagtgaccctgagacagggtttcctttcaggatgatgaaggtgttctggaacgtggtaatgatgttgctcagctctgcaggtgctgtcagtgtcgttaatggtaaatgttatgtgatgtgtatcttgccacaatcttaaaaaatagtgacctgcggtagcttttaaatacatgcaggtatttagatagtgcctaagaaacaccggctctgaaggataaaacactgggagctattggaggcagacacttatttccaaagcatctctgaggtctcacagggtgggggagtggggtgcagggagtgggagggattgatcaagggcctgtctctgtgatttttcagcctttccttttcca

SEQ ID NO: 62714 - DNA, 1699 bp, Bovine  19866880289281
tgtgctggttggatctccgtgcagtccagggactctcaagtcttctccacaccacagttcgaaagcatcaattctttggtgctcagctttcttcacagtccaactctcacatccatacatgaccgctggaaaaaccatagctttgactagatggacctttgttggcaaagtaatgtctctgcttttaaatatgctatctaggttggtcataactttacttccaaggagtaatcatcttttaatttcatggctgcagtcaccatctgcagtgattttggagcccagaaaaataaagtctgacactgtttccactgtttccccatctatttcccatgaagtgatgggaccagatgccatgatcttagttttctgaatgttgagctttaagccaagtttttcactctcctctttcactttcatcaagaggctttttagttcctcttcactttctgccataagggtggtgtcatctgtatatctgaggttagtgggctagttaagaggttttaaaaatggccaacgtgatgatttgtccaaaagggtgtagggatttgaagccaggtaggctgactcagaggtttgtgagaagaagagagacagctgaatatttacagaagccagtcgctgctcactccaggatgctaatcaggcctcccttcttcctgcctctctccagcccttcatgggagacaattactgtgatgccatcaacaaccgcgccttctgcaactatgacggtggagattgctgcgcttctacagtgaagaccaaaaaggtaggtaggccagtgcaccgccctctgcagccacccctgcaggtgtctccaacttactggcccacgatcacccctgggtgttggacaacctactgtcctggttgcgtcagcactcccctacaagcttcactgttttctattgcattgtatttctcattcttttactcagtggtggtgggggtttagtcactaagttgtgtctgactcttgcgaccccatgcactgtatcccctccaggctcctctgtccatgggattctccaggcaggaatactggagtgcattgccaagcccttctccattttactcagtagttgagctcctatcatgtgctgagccctgaactagatgtggaggttcttggatgatctttgtagacgaggtcccttaacctcagagcttagagtcaggtatggaagctggcaagttgaagagcgatgctttttaaaggaaaggacagagttccctgagggtccaggcaaagggttggagaagactctgtggagggatcttcatcaatgcacagaactgagggatgagaaggggcagggaggtggccaggagaagtgtctggggcaggaggctggcatgtaaaatcctagagagcacacacgtttagagagtatggctaaagcctaggggaagatggaagatgagacgttcctgacaaggtaagttatgacctttaagcatttaataatctctttcgttgtccacacctggaaaattagtgggtgtggtcttggtcaccattttcttcttagcacactcggatgtagcgggagtgattcgagtgtttatggtaaaactggagcatccagttgggatgtggtggcacccacccacagaggagtggccgcctccactttcctcccggtgagagctgcaaccacagtttggggcctgagccaagagttgggagaga

SEQ ID NO: 62715 - DNA, 2887 bp, Bovine  19866880351043
agcagtgagaggtactcatgccatcccgagaacgtgtgtctaatttattccttgacattgattctgagtttcactgtaattcagatagtacaacaacattgtcctcagttttctaggaagccttggtgcacgtggggatccgtcagtccgttgtgatggtctgtgtttaagatgccacgagcggagctgacagcaaggctcagaaccatacatgctccacattctttgctgctacgagtcactgccactaggtccatgacagacccgtggagacacctcctagccctggaggaaggtcagcactaacgtcctaccaggctgctgccatggcgactgaggggatgggtccagcagggaacaggtcacccagagccctgacgcagccttgtagcccgatcaccatctacgcaaacctcaggtctgaggttcactagatgtgtgaccttgggctagttgattatcctctctgagcctatgtctcaaatgtaaaataaaggaaacaagttcctccttgcagaattgctgggccaagtgccggaaccctcgttcagcgcctgaacatcatgtgaggcgtgactgccgtctagtgcgtgctcatcagtgcctgtcctctacatgcatattccagttaatctttaaatgtatcactcgggtgggattgcttgcattttaatcgataaggatgttggttccaaagaggtcaagtaattgatctatttttacatattaactaagcagcagtgaggcctgtctgaattcaaagatgatgttcttcagttcagttcagttcagttgctcagtcgtgtctgactctttgcaaccccatgaactgcagcatgccaggcctccctgtccatcaccaactcccggaatttacccaaactcacgtccagtgagttggtgatgccacccacccatctccttctctgtcatccccttctcctcctgccctcaatccttcccaacatcagggtcttttcaaatgagtcatactatattgtcaaatctaatttcaccttttatcttgcatcagctaacttggagtgctaacaagtgtgggtctaaacttcatatatgtgactttagagacctaaatatgggatattttggccccatcttcagacagaagcccgactatccatatgctttctgggtcttttggcttcagccttcgtcatgagaacaacagcactgtgatatgtgggcatcatctctttccacctgttacatctcagcactgtgagcagagctctgttctagcccttactatatccagttattgtctcagtcaagggaagcagaaagtgatggaggaggaagtctggtcttggagatggccaggcatgggttcattttccattctattcccttgctctgtgacaggggactagtcacttacccctctgtgcttaggtcacctctctgcatcatgtgtctggggtggggaggctgctgtccacttcctaggtcaatgtggatgaatgtgaagtacaagtgcttaacgaggtgagttctgactaaggagccttgcagaagggctggaagcaagatcatagtgaaactcgggggatgtgagaataagcaaggggcaaaggagagcggtaaggaccacatttgatgccatggcgtaagcacttactacatacgcggcatctagaaagtggcagaggcagacaccaaaccctggcctgcagcttgggtagagcgacatcctggcactgaacacagtactaggatcatgaaaggcgcttttaactatgtgagtaaatgaatgaacttgaatgtaccacatctcattgctgaatttccgtttctgcatcaacaaaatggggataactgtacagacagtgtgtggcagtctcaaggattacacagagtggctttgtaagttgcagacttttataaaggtcatataaagagcacttatttgggtaagagtactttcttggagtagaagagaaagagagacattttatctgaggggaacatggaaggctgtagttaataaaacatgtgaatgaatctccaaatatgaggagctggaaaaaaatttaaacaatgctttttccgtcagcaacttatgtttccaaggtattcctgtaatatatttcctccatcaagagagtacggcgttacctctctgcttagccaagcagcatgaataacagcatgctgggaaagaagtagtcttaggttttcaaatgataaaacctgggtagaatcttgcttccccaattgccagctaagtattcttgggaagtcacttccctgtctctgagcctcagtctctgcatctgtaaaacagggtgaaattaactgtatctcacaagttcaggatccagagtcaatgatgttaatgattgtggccggcctggtttaatcttcgttccctaaaaggtagtttctgtttgtgttagtagagtgacccaacgtgtcagtagaggtctcaggatggaggagtctttgggccaccctgccagtgggggtggagcggcggagaaagaggaagatgttagcttcacgggcctgggtcagaagtcacaaggccatgcgctctctgtctgtctcagctgtaattgtagaactgttccagagccacatctgaaagctgttaggggaccaggcagccctggaggggaagaaagtgacagcccctgatgtggggaaggaggagagaatgagaagggagagagactgagaaacagatacacacatgcacacccacaaggcagagtggaaagggcaagacagacacaccaggaggggacacagtcagagcctgtgttcctccgggttcagggagctgctggcaacctcggctcggttctttcatctttacctgtgcaggtgggctgagacccactgataatgtgaactagagggcctg

SEQ ID NO: 62716 - DNA, 2576 bp, Bovine  19866880397212
ctgctaaggtgttccttattgaattctcatgcagatctacaacctgagttttattatttcagctttactgaggttcatagaagcaaagtgacttaaggccacacaactaaaaatgtcaaacccggatttgaatccatggtctgtggtctttcatactaccattagattttaagttatctgaggatagagattttgtcttgggcacatttatacttgctttctaacagtgccaagacataggaaatatttagacaggtctattgagtaagtaaatgagtataagtgagtaaataaaaatgtaagtgaattaaaggatgaataaataagtgaaagaatgatggagtataagaatgaatggataggtagatgaatgggatggatggatggataaaggaaagaagaaagggggagatagatggagagataaacagtggatagatggatggataagcaaatgaatcaatgaataaaagaaaaaatatgagtgagctgaataattaattggtcaacagtgccgtagtcaacaatggcagctttctagatgggagagggaggtggcttacagcttcataatcagagaatgaagacagcaggtctctagaactctctgttacagctctgtggccgcatatgaatgaagaaacactcactgagttgggaaacaaagacaatgagcccctttcccctcggagatgaacaggtgagtctcagatgagtcagcgtttgcatctccagacattgggatgcaatgactctgtgcaatactctatgaaacagttataatggtactattactaagggtctggatggacctaatagtgaaagagtatatgtatatcctacaaatgtatatagactttagatatgctgatctaccatctttcagaggggatgtcatgaaattgagaaaagaacaccacgcagagactcctgtctctgccctccttgcagacttgctgtgccccctctctggcctgctgtttcttcctcagtaggaggaatggttctgagtaactggcttcctagggccctttagcactagcagtgtatgattctgtgactcactgtggtgatatttctaaatcttagcctatcaaggtgcacacacagactggtctataaaacacttggctggcctggacagattactcatgccttgcctcccagactacttaaacttttcctgtctgcttcacgctccccacatacaaagtacgtcttacttgtagagaccgtcgggctccagacacttgaagatgacggagtagatactgacttcagggacctctccatggcttcgaccagctgctacacaagatgtgcccaggccagagagtaagtcatcggcaaaactcaggaattctcctggagggagacaaagagagatgagctccccagctcaggccttggtgagcagacattcttgctgttgtccaaacccatctaacgtctggataccattattaagaggattaatggacagaacaagcacaggatatgaaaatgacacagatcagggtctactcctgatgactctttgcttaaatttctgtctgcattttctcaagtgtgacatgagatactaatacctacctttataagattctagcaaagctcaaatgagcttactgtgcaatgaaaatgcttgacaaggcaacaggaggacagtgctctctgtctagagtaactattttggccttgtcactgccatttacttcctctccccttcttcagcaagcttctttggagttgcagtttccttgctcgcatgatgaaggtgttggactaaggatgtcaaacaggcctcatgtcacatggtcactgttacacatcggtactggcttcatggtgtgttatgctgagctggactgagactgttacagctaacagggaaagagttccatgactgattagtgatgaagctcatgagacaggaagggacagtagacgagcaagtgctttggaccccgtgattcccaaatgttggtctagccattggattttaggaggctgctgaagtttactagaaatagggctaatcagaaagatgagatgggcattcctggtggctcattggcaaagactccacctgccaatgaaggggacacaggtttgatccctagtctgggaagagcccactgccctggagaaactgagcatgcgtaccacaactattgatcctgtgctccagagcccaagggcagcaactactgagcccgtgagccacagctatgaaagcccacgcacctagagcccacgctccacgacatggagacgcacagcgagaggcccgcgcactgcagcaacaagtagaccctgttctccacaactgaagagcccatgtgtagcagggaagacccggcacagtcaatagagtaacaattttaaaaaagtgagcagatacgtcttcctataaaataaaagaagggaagatgaagactagaaagaataactaaacatctgaaatcttgggatctaggcttagcctagaatttgctgtataactttggacaactaaattcccatctctgtactccagttctctcctctgaaaagtgaaggtactacagtcactg

SEQ ID NO: 62717 - DNA, 1012 bp, Bovine  19866880397771
cagcccaccagggtcccccgtccttgggattctccaggcaagaacactggagtgggttgccatttccttctccaatgcatgaaagtgaaaagtgaaagtgaagtcactcagtcgtgtcctactcttagcgaccccatggactgcagcccaccaggctcctccatccatgggattttccaggcaagagtactggagaggggtgccatcgccttctcctacttctctccaaatgatcctagatgctcattcttctcaggaccagtgggactcccagcttgcctcttagagagtagctcttcccagattatcctggggaaaaaagagacactgaaaaccagcaactgggtcaaagagaatgaaagaggaagaagaaaaagaaactaacatttcctgcagacctcccccacatgccgtgcattctggtaaaccccattcatggagtttcttcatgctcttccctacaggtctatgagatcagaagattcccagccccctttcccagggggaggaactgttgtctagagcagtaacccagggccttcccaggggccagccgtgggtacaggacagcagcaggatgtacacccagctccgctcatctccgaagcctgagctctttccactgccacatgtggcctttttggcccaagaggaagaaaactcattttggttagcaatgagcaagcagaaaatgcaaaaccccaagaactgacattgaaactcttttaaaactggagacttgagtcggtcagacttcaggggaggagagccgccagtggggtgagagacgggtccaaacaacacgctggctccttgtcagagcggcccgcatcccaggcgcgttaataaaactggtttcagaaagaaaataaagaagtgttcagcgttagggatgacaggctcatgacaagcacatttccaggacaggagaagaaatgatgctcctgctttgagaggtggggggggattgttggtaaagaggaacggaagaggttagggaaggtactcatca

SEQ ID NO: 62718 - DNA, 896 bp, Bovine  19866880402721
agctctctctcttctatgtgactctgaacaaatgtttagtccctgaaatcccagtttccccacctgtgatacgaaatatgatgatgaggatgccagatctatagggttatggtgaggacggagtgagacagcacctggaacatcctgggcctggttcctgacactgagtgcccaatacatgcttaccattgcttcacccctgttatccaggaggccctggggcctctgagaattgggccattggtccggagtctccatcactgcctcagtatgcaagtcacagaacccactgagtttaacctttccatttcacaggtgagaacatcaaggccagaggcaggggaggagcttgggagaactcccaggtcttgctgggagcaagtatgggaactgctcccagtccaactcctgacctcaggctcttccctcaccctgagcctctggtccccctgtgggtgtgggcatggggttgcaggaccccggcttccttggcattcctctcacagagctgaggcccagaaggggagggcaggcctgtggcgagcctccgaacgtgtggagatgagcccccaccccaggaattaggcctggctgctgctgtgtttgctcaggaccctttggcagtcgtccatgctcagagaaaggcaaggcggccaaacaagacagaggctaattacctcggataataggaaattggggagccgcgacaaaaagggtgtctaggcctctggccaggcgagggcagaagcgatggatgcagctgggtctgacccttccgccttgagccggcagtccctgctcagggtcaccctccgactccagcagcccaaaggcgccggagctgggcacagtcagagctgctggggacccgcgccctctgctgctctttgttttca

SEQ ID NO: 62719 - DNA, 1893 bp, Bovine  19866880508613
gtacagtttaactggcagaaagcagcagagcacagattgtttcctttagggaaggggaggctcgtgatccttcgcagaaccttgcagaatctttttgcatgctaggcgcatgctatgcattttctatacagcttctcatttttatcctcctaacgtctgggaagagtcattatttcaccaactgccaaagaagaaactgggaatccgagatgaagcacgctgctgatcaacacccagctaattagtggagagcggggatgtgaccgcagctccgtgagacccctgagcccccaagtaccacagaattgcagggcatctcagagagaatcagatcagcttggctcattagctcctcctcagcactcacatccacacaaaagacgggaactgggcagcaggggcggatgggagggtatggattttggaatcacgctaatcagggtttgagccttaaaaccttaggtaatgccttaacctttctgcacatcaatttccttgtctgttaaacggggataataattgcaccaagggctcttctaggattaaatgacgttgcatatttaaaaacatctaagtatgtcattcacttagcaaatactcttactgcatggtggctgtcattttctacttgtttttactgaagtgtagttgatttacaatgttgtattaatttctactgcacagcaaagtgatttggttttacccacacacacatatagatacacattctttttaatgttcttttccgttatggtttaccataggatattgaatacagttctctgtactataagttcttattgtttattcattctctatagaatagcttacagctgcatggtttgttgttgtacagttgttaagttttgtccaactctttgtgaccccatggactgcagcacgccaggcttccctgtccttcactatctcccagagtttgctgaaactcatgtccattgagtcaaggatgccatccgatcatctcatcctcggtcgctgtcttctcctcctgcatgatagctattattttaattagagaagttgaggaatcctgagtggattgctggagagattttccagagaaatgtctggttaaatatggatacagaatggagactaataacaaaaacaagcagggttaggaatttgggcggggggtgggtgggcttctgcacggcagggagtggggagagcaaagggaatctggcccatttaggagatggccatggtctcagcctgcctagagctgaaactacagtacactagaaagaaggccgcagatgcagactggaaccaggttatgcctcatcagctgttatcaagcctctgtctcagtgccttctgaggtagccaattttattctcaaaccacctgcaatttgttggaagagttttctgctgtgtcccctctgagcctcctctccttcagatttaagcatcttacctgtgtgagcactgcttcctgatgacgcctgccttgggccccatccactgactgtgtcctggttcatcaagtcagtggtccagaactggggctgtccagccatctctaggaccagatggggcttctctgacctctgttctggaatcttactacctttttgtcagtaaggtaatctgcaatctcacattcttgtttgggccaacaccttctccagttggtagaaacggatcccagggtgactcctactctttgaaactttctttgagcatgaatagttatgctgaccattatctgtcatctctgatcaaaaacaacaggggttttgattgatattttcaaatattccaagttagctcttaagattgaggaccaatggccctccttttctttctttcttcctccttccatctcttcttcccatctttccttccttcttccccctcttctttc

SEQ ID NO: 62720 - DNA, 912 bp, Bovine  19866880580729
ctccaggcgagaacactggagtgggttcccatacataaactaggtaagcaataacgatttactgcgtgagacagggaacaatattcagtatcttgtaacaacctataatggaaataatctgaaaaaatccatatgtaactgaatcactttgctatacactgaaaactaacacagtattgtaaaccgaatatgcttcagtttaaagagaaagaaaaaagactatcctcaaagacataatttttaaaagggacatttcattaaaaagtaataagtaggattttgaaggatcctacttatggaatcagtaggctggaaagtgaacatatcataagcaaaggagtgggggaagttagtggttttacagatagtgtaaaaaagcactgtggggactggcgagtaaagaggcgttacagaaccagatgtcaagtgccacgctagggagggtgtccgtgaggaagggcaactgcagtggaggtgagcatcagctgcggtgctggaggcctctgtcagctgctcactgttcagcagagcagaagcccagggtctcctgccgcatccattccctgcctgtagctcgagtcctttcccaaaggttccagggccctctctgctgggatcaccttgcaaaagagcatccatcccagcctctgcctgggttgagcaagaggctgggagtgaggaggcagcagctgtgagtcagactgcccccatgcaggctccagcccggggccccagcggggacagagctcttgctctcggctgggttgcgttttgccgaatacgcgctgtacagccaagcgtggctcaggacggcccggcctcgctgggagccagccaagtggctcatgcccctgttctcctctcctcatccccgcttcttcttcccttgctcccgtttcttgcctttcactt

SEQ ID NO: 62721 - DNA, 987 bp, Bovine  19866880723033
cttttctgcggatggtaacgagagcaaggctcgggcctgagtggatcaagaaatgtgtgggggtctggcccgagcccactgcaggttacagccccagaagggccataatggggaacaggcacattcctgttcagcggctcccaactccctgtctgttttcaaggaaaggaaacagaaaaagaatgttagggtggtctggcacaggcatgggccgggtggcagtagccgcctgggtctagaaggcttctgccatgcggccgtgacaacgttccgggaaagaggggaccgaggtagcccgagcagtgtcctgggggaaggcgcacagcgctcagaggtgggggagccggactggggttctggactctgagcgaaggtagctgcaaatcctcaaacgggggtgtattaataacattcccgagcctctgaatttctatcagggaatgcggcagggttttaagagtcaaacattttaagcaataaaacttttaagccaagatttttaaaagacagtctttattcccaacctaaataaaacatgggccattggtctataagatagatcaaactggagttgatctggttgcagtttgggttgggtacacaggagaccaacttcagcccccaccacatccactgtttcttcctcctgcctggaggtctagatgctctaattcacaaaccaccggactgcattacatacgtgaagtctatggaatgccttctgtctttcctgggctttctattgtcctcggaggtttcaagtgtgagacgatggcagggtggagctgtgcgccatgtaaagggcccggcacataggcaaagcccagcgtatgtggttcacatgcgtgttgattaaagctggtcacaaactgaggcgctcaggctgcttgagcagctgcagaagctcttctgttctcagtgattttatcacatatgctcaatggcaggacttgtcccataggctccaggagttgagattttattgca

SEQ ID NO: 62722 - DNA, 1003 bp, Bovine  19866880727462
atcactgggcatagttatgttgggggctcacattcagatttcactcctcaatggtcttatgaccttgggaacgttatttaaaatttcttgcctcaagtcctcatgtacaaagtgagaatatcgtgtcaggcatatagtgagcctgtgatcagtgtaaatgatactaataaatattaatatacttacctaagttgaggcctaaaggatgaatgggaatgagctctgtgtagtcaaaggagagtgttccaggtagtacagagctcgagtccaaagctcagatctcagagaacattttgttgttgttcagtcgctcaatcgtgtccaactctttgaccccatggattgcagcatgccaggcttccctgtccttcactatcccctcaagtttgctcaaactcatgtccattaggtcggtgatgccatccaaccatctcatccatcacccccttctcttgccctcaatctttcccagcatcaggtcttttccaatgagttggctcttcgcatcaggtggccaaagtattggagcttcagcctcagcatcaattcttctaatgaatattcatggttgatttcctttaggatgggctggtttgagaggacatggcatgttacaggaaccaaagagagttcagtttggctggagcataaagtgaggggtgggtaggtagcagtggggttgggagcagaagccaagtcttgcaaggtaggcggaatctgaaactctgggctgctgtatccttgagatgtgagcctatttccaaatctcaggctctgaagacaaatttacaggtgaacagagtcccaacaactgacgctttgtatgtgttaacatgagttacaagagaaccacagatgtttgagatgaaagactttggcagggagctttgtggaaaatatttttttaaaaatatcatcgcagagaaaaattagcaatgacttgacagaaagccattcccctagcggaagggaaatatcaaggttttgggtttgggtcttggat

SEQ ID NO: 62723 - DNA, 2373 bp, Bovine  19866880875277
taacatcatttaagcaaaacagcagtcccttgaatatttactacgaaaagtttttaggtgaggaaacaaatatctagagaggtgaagctacctgcctatagtcacactgcttttgtcacaggacaggaacttaagcaagtctgactaattccatcccaagacactgctctctggaggtgaggaccctggctgttataaaccagaaaagagagcagaggtgaaaagatcaagtttttgaatctgcatacaaagaccagttggaaagttctagaagtcaggagagacacacattctcttaaacaccatgaatggctcactcatcatgggcaagccattcctcctctctgatcatccatttcttcatctacaaaatgggcatctgggaagaatgtgacaagcagctctaatttaacgaggaatgtggtgttgcatcttcctgccacaggcttttctacaagctagaagctgcctcagcacttaaaattctgcgctgagaaggatgtagttctaaatctgccacccagattgactaagctgggagacatggtagccgggaccacctaggatgcctctggctcaggaagagcccaagtattccagggctgccttgggctaaggataagagggtaatccctgggtacttcatacaccagcttccagccacgggaagagaaggaaacaatcacttttggagcctgagaggatgtgcccaggcacactatacataccattagtattgtgttgattagaaaatatattaatcatacagagaaatacaaagaacattataacaaatccccttaggcttaccacccagctttgtcaaattaaaacatttcgtcatgttttcttcctctttttttgtggggcggttggcgggggggggggggcggggaataaaatatactgttttgtattttttgttttcaatccaccatttctctctcacatgagtatttttatatttcttgtgcctatgtgttgctctgcatgttttacaattcctaggtgttttaatactatatttattcttgtgtagcagtttttttttaaacccagcattgtttttgaggtcacatagattgatcatatagatcaatgcagtaatatatttcctttgatcattcttttcctgatagacacccagattatatctctgtcattattactatcatcgttggtaatctttttatttgttatttccaacaacattgctctaaacacacatgttcatgttcctttgcacataaagcatgggtgtctgcaggaaatacatctaaagtggaattgctaggctgaagatagttgcatcttcaactttattagatattgctaaattactctccaaaggtgtactgattagcacacctaccaatagactttccattgttccaggtccctggcagcactaggttctcccaaacatgtaactttgtagctaatctgatgggtattaaatgatacttgggcttccctggtggctcagatggtaaagaatctgcctgcaatgcaggagacatgggttcaatccctgggtcggaaagattccctggagaaggaaatggcaacccattccagtactcttgcttggagaatcccatggacagaggagcctggtgggctgtagtccatggggccacaaagagtcagaaatgactgagagactaatgctttaggggcttccctggtggtagtattctactttgcctttccctgattactaacaagcctgagtatcatttcaggtgtttgttgaaaacatatgtttctacctatgttgactgttcatcactctggcctattttaaattgggttcttttgtcgttattgatatgccatgcatttatagatactggatactgattctttgcaattttttttttcattctgtttagcttgttttgttgaataaaaatttttaatcatttccttcatgatttgatcttttcatggcttgttaaataaacgtttgtttactccaaggtattcacaaactcaaataagtagtctcccctattttcttccaatagttttaagtttttatgtttacatgtatggcttcaatcaactacaaacagtttttaaaatgatggtgataaggattgtttccccccaaatagagatgaatcatttgtctgacattatttatgtaaaacttaatcctttcactactgaattgtgacacattctttgccatatatcactcagaacttagataagctttcttttttttggggggggggttgtcttgtttcattagtttatttttttcctattatcttatcaatagcagtttatcttaatttccatagttttagaaaagtcttattatctacaagtccactctatacttggtttgtccatcaaaagacc

SEQ ID NO: 62724 - DNA, 1151 bp, Bovine  19866881010536
gaagcagcgttgcaggaagggtaagtgaaaccatttgacagaagggctcctggcacagaggttggtccagtggggtgcctgataaatgaagtaatttcacggtcaagtgtgcagactttgcttagatactgtgaatcccatctctgcctttcctagctatgtgaccttggacaagttatttaacctctccgaacctctacacaactgggatcaacatcatttatgtcattgggttcctgggaagatggatataagtttcaaattaatgatatccatgacaacaatagcagcattagcaagcacatacatatcacctgctaggtatcacttataaaatgttttacatgcttaaccctcatttcatcttaacaactgtgagaggcagggactattactaacccatttcactgatgagcaaactgaggcacagagaaaatttgtgtttggatcttgcttctcaccccaaatccatgcccataatcatgatacccattctagctgacagatcaccaccattatcaccacctccatgactaccactaacacttctctttccctcttttaaagacaggtctccaagttaaaagaagttttatctcaagaaggtattttggcaacagtcactgtgttttccatggagggaggtctgaaaaactacatatgaccaggagacgttttatttttttatttcaatttttttttttgtaaggtgagaggtgggtcatgtattatgatttcatgttgttagaaagaaaaataataataaacacaactcccagcagagcccatgcttccgcttcttcccctccccctaccagatgctattttcctttttagtcagtgttgtcctaaactctcatcagaatatccaccaagaagacacagcgattcatcttcttgttttcctttctcaccttggctgggagcaggccagggcagcctgacagaggggccacaaggtgtggtgacccccacccctcccagggactggtggggaaatggattgatccctccccgccgcctccccccttatctgctcacagataatttagttattggccctggctctaggacagggctggggatgctgtgtcctgagcagagacaaagcgatgctaatggcaggggtgggggagaggaaggggaaaaag

SEQ ID NO: 62725 - DNA, 1757 bp, Bovine  19866881043256
tgaggatgctacatttgagcatacccttagagagtaagcaagcatcggttaagaaaggctactggaggtcattcctggttgtcaaaaaaaacttccttgtctccccatctttttcccccatggatcatcatttgtacggtattgtagaaccacttcaccagttttaattggcctgtggcatggcggtttgtgtatacatctggctcctcccagagctctttagggcagagattgtgcttcattcctctacatatccatatagagtttcacagaagggaatacactgcaaaggttcagaacacgggctctgagatgccatctttactttcatagactatcaagtctaatcgggggcacacattagcacacataaatatgtcactgaaaagtttaacaacggtaacaaaggaaagggatggggaatctcatttagattacgggttctggggaggccattccaaggaagcaacatcgaggctgagaactgaataagtggcgcagcttacgccaaggccctgtgatgcgccagagcacaagatctgcagtgcattggctcattaaatgctaacgtggcttctggggaggctgggctggttaatgattaggagcctgagctctggagccaacctgtctgaatgtaaatcctggctcttgactggtgtgtgagtttaagcaaatttcttaacttctctgggctttggttttctcatcagttcaatgggaatcataaaccactatcctcattgggttactgagaagattggataagttaatttgtgtaaagcatttaaaacagtgcctgacgtattgaacgcactccaagtacaaaacatatgtatcgttgaatcttttattttccctcaagtgtttacatggatagtattaaaaaggacgaggcaaaagtcttgcctggagaagacatatccaggctagcaactgagaaaaatagtggggaactatgggaagatacccaataaaataccagggactcaattcccttctccataaatggtataatccttgcctctagagtagcctgtgtcatggtggcagtagcactcttgagacaactacaaagagcttcctttggcttgcaactggttatctggctttggacacagttactgagattcctgggagaaagtgtaactccatgacatggtattattttaaaaattcacaggagtaaagcaagaacaaataaaaagctccagggattaccactgcttattttaaagatgcttttgtgggtttaatatccatctagaagccagcaagattgctgtttatttatcctgtagcttctgcgtgtcttccttgcccctgtgcactctcccccccactccctgttacaggccacagataggattaagaaaggtctatttatggtcttaagttattacacatgttgaaggagagatttctagggggcaggcctgtgataaggatgagaggagctgggtatagttttgggagtccggcaggcagctcacccacccaccaacctcttcacaagtgagatggctccccgggccttccttgcttgtttgagtctgtgaatgtttcccagaaagacatagtaacttctcctttttctggcaagggcgcctgatgaaactccctgaaaacaaggcctctccttccccttcaggctggcctcacacatgctaatgcaaatgagtcctgacccagcctggggtctgcgggaaggcggccagaagttttagaacaaacacgcaaagaatgttatttcattt

SEQ ID NO: 62726 - DNA, 1248 bp, Bovine  19866881182747
cagatatactagtatgagactccgaggcttcttccgctcaactctaagaactttatgtggaattctgcacagaaaagcatcagcatcacatcagcaagtggtgataaacactatgaacacattatctgtgcacagttcctgagagtttccaggaacacttgcatctgcagcacatctttaactctcatgaccaccctaccgggtagatattactccaaaggagacaactgagactcacccaagtgcagtgggacagtcgggaaggggcagattcaaatccaggtcagagtgtcactacagctcatattttttccaggaaggatccccctctcctagctccacactaggtatattaacagatacagatcaaaggcaccgcagagccgtgcggttaaaagacagacaccaggaccactggggacatctcccaggagggttatgcctcttgcctgtgctacttaggaagcagaatgttccagtatttcagagctggaagacagctaatccaccacccctcactttattcagatgagggtgctgaggtccagagagggaaagtgactctcccaaggtcaccctgcaggtcggcgtcagcactgggacctcgaacaaggtgaaagaggtcctcctcccacagccatgtctctactgccctcccacaccccctggagctcagagtcatggggtcctctcaagccccaaggcagagccggccagaggccagacgatggagaagggagaaacacacagactttttcctgtaacacccatggcctcccggctccagggtccaccccggcacgcagacccagggtgccttacctctgctcggcagagctgtaggtctcccctctctggcagctgctcagggtgacggggtcaaagttgtcgaaggagcggagggccacccccgagatggcgaccaggggtgaactgaagctcacgcgtaccgcctggctgtggtagaagggctggctgaggtcatggaccacagggataatcaggggattgttccggcagctcaggacgtggaagcctgtcaggggagacagagggccggggggccaggctcattactcaaggccagtcacgccctccccaacgggcccttcccgaagcccccagaccctttcatgtcactgcacaaaagcaccattgggtggccagtggggattttgagtttgattgaaagtttctttgtctgctttttctctggctccaaatctttccaatcccctcgcctcgccg

SEQ ID NO: 62727 - DNA, 1081 bp, Bovine  19866881236141
agaacgaatcacctaagaacaactccctatccacagagaaaagctttatatgttgtcccctcactttacaggcaggaaaaaaataaacaaaggtgaagcaacgtgccttcacgtcacatagtgagttaggagcggagtcagcacgggtccccttttcctctgtcagtctcagacctcacttaatggagagcttccacttacgggagacagtctgcagttctgcctcgcgctggccaagagcaatcagtctacgagcagcgcccatcgggtaagcacagaagcctctcccttcatcaatgtcataccttgggaaactatctgcagtatagataacagaaagaataaatatttttgttgagagaaaaaaatgaagacaaaggtcaaagggaatcatgtaatgggttgagtcagggaagaaaaagaaagcattttttctctccctcctctttttctccaaaacagtctttatatagaacttgtctaagagccaatttatttgatatggaaaaaatgtgaaagcagtgaaacaacacacacacacacacacacacacacaaagaggtatttgtgttggagtttagaactcgaattaccaagagataaaggagttgaaatagtaggttgacttggaacgatattttattttttcagagtctcagagaactttcaagtcaggaaacggaacccggcccagcccaggtctccaataaattccttgggactcgagaaagacaaagaggaaaaggtcaatgaaggactcagtctagcccttgtgcctgcaacatagtcggggccaaagacacgtttgttgaggatgaaggggcaaatggtacacagtctggacctgaagagtggtgatttgggagcaaatcggcctaggacttggcatttttaccaagcagttaaggtcttcagcaatacagtgtgagtgtctaaggaaagaggaccgagtcatctctgaaatctacggctcccagcacagactatggcacctcgaatgttctcagtacatacttgtaaattgaatgagcagtcagtcgtgtagtaaagagaacgggagcttcctgggcttagagatcag

SEQ ID NO: 62728 - DNA, 1639 bp, Bovine  19866881244936
gctggtttggaaagcgaattgctgcatagtaaggagcagaattaatgaatgagcgatgaacaaatgtgaaggtgggagtgaaggaacaagtaagcatatgaaagaatgagtgagcaaatagacaggacacgagtggatgactgagagatattgactgattggctggaacttactgacctgtggatgggggcccgtggaaagcggctcgtcttgcccttgtccttacccatgacctccctctccaggctcagacgtgccttttcaggcccatccgccctccccctcctaatgctccctctcacctgtctgcagaagtgatgactgcactaatttgttcacagaccattaactctcgagcactggaagaggccagctcccagttggcaagggccggggtgctggcttccgggccgcccgggaggcatcatcattctcttgcctgtcggtccgtgcaacgaggtgcttatctctccctctgcctgcttgcagatgacgactgcaccgactccttcacacccaatcaggtcgccagaatgcactgttacctggacctggtgtaccagggctggcagccctccaggaagccagtgcccatcgccctcgccccccaggtcgtgagccacacgcccgactctgtgatgctggagtggttccctcccatcgacggccacttctttgaaaggtgagtgtggcctgtgaagtgttgatccctctctctctctcctgccaagaggagggaaacttggaagggaaacagccttggagagggatttctcagtgtcttttattgttgctcttgtttaacaagtgcccacaagtgcccagatggtaaagaatctgcccgcaatgcaggagaccctgggtcaggaagatccctgggtcaggaagatcccctggagaaggaaatggcaacccactccagtattcttgcctggagaatcccatggtcagaggagcctgcctggtgggctacggtccatggggtcgcacagagttgaacacgactaagggaataacacacacactcgaggactaactggtacagcgactgctccatgtagacgttgtagatttggggatcagggaatacataaatgattgctaacagaaattaatgagtaatgatgcataatttctgtggtgaatattaagctttgctttattgttaaaagcctggaaacttctgtctcctgaacctcgtctggaatggaggtactggtcacatctcatgagcttgggcatttacctgcctctggttaatgagctaactcctttgtatacacgtagtaccatataagaagggcacattatatatggatggtacacatgcatatatatatatatatatatatatatatatatatatacatgtatttttgtataacgagcatctttgcctctgttgtttaatagaactgaaggtagaatttttagaagatcagatcagatcagatcagtcactcagtcctgtccaactctttgcgaccccatggattgcagcacaccaggcctccctgtccatcaccaactcccggagttcactcagactcatgtccatcgagtcagtgatgccatccagccatctcatcctctgtcgtccccttactcctcttgcccccaatccatcccagcatcagag

SEQ ID NO: 62729 - DNA, 1728 bp, Bovine  19866881300050
ataatttagctttaatagtaacaggttaacatttggttaactatttatcgctggctaggcacagaggtgctttatgtgttctcatgttcaacctgtgggaaaatgctgtgaaacggggcttctgactaatttgaaataagctcagagcactggaacacccgcctatgacttctcagcgagcaagtgaggaagccaggatggaaacttatgtttgctcacctcaaagtggtgtttactgagacggaggagcagggagaggggaggagaccaggcaaggtgggggagaaaacagtcacgaatattagcagagcccctaaatatcatcaggcataaatcatttggatgcacaccacgaatgagaaaacacgagatagagacgtaatcttcacagtctcacgcttttccacccaagtgctccatctgcttcagacagtgaccatatgccccagtagcctgggaggtagcctgtagaatttttttaaattgtattccctaattgggccataattgtttaatataaaacatacctttatatatatatattttaattttatttatttgactgtgtcaattcttagttgtggcatgccagatctttgttacatcatgtggaatcttttgtttgtagcacacgcactttctagttatgctgtgtgggcttggaagtgcacaggctcagtagttgctgtgcatgaacctagttgccctggggcatgtgggagtttagttccctgaccagggatcgaacccacgtccttggtattgcgaggtggattcttagccactggacctccaggaagtcccagcctccatattttaaagcaaaattaatgtacaatagagcacatgtcatctttatcttgggccttcatgcatcccccgggaaagccattcttccccctgccccaatattccagtttcagaagcaccatctgaaaatgtatacattcattggtctagaggtggtcaaatagccaataaacttttataaaagcctctaattatatcaacaaattagcattccagaggtttacaaggcaatcattattcatacagttatccatataatatatgtatatgcatcttgcctacccagctttcattgacagagcactgctagaatctccagggacttctggtctaccctcaatattcttacctgctccagcagtgctaaaacaagctgtctattgggtcataagtccagcattctcagagggtcgtgttcttcgggagccttcttcagtgctcataaactctaacttgtcactgtgttgagagtcaggagataatgtctgttgtcgctgcacctgttatcttattggccttatccaaacagccccagcccgatcagcagctgaaacaacagatgggcaggagaacttgagattttttgacaccatccttttgtttatgaatcccccctcaccccaactctggaatctgataggaattctcttcattaccattttgtgcattcttttttcccatgacacatttttattattaaaaaataattaattggtgcagagggagatgaaagagaagaataacatttccctttgaaaacggtcaaaaagaaaatggggatggtgatttggtcatgtggataaatatatctttgccctggaagataattgccagtatccagtttccttccatagcagggaattcaagtaaggagctaagaagaaatcagaaagggaggaaaggtgatctggtgtaagg

SEQ ID NO: 62730 - DNA, 1311 bp, Bovine  19866881353010
acagtacagtgagcctccatgtgcccgccacgcaggattaatacatgtcaggcctctgtcacatttgtttcagagctcttttctcctgaaagaaattaaaattaaagatacacttgaagattactttgcctccctatcaccagtcttatcctgtttcctccttccctcctaagacataaccactgtcctaaatttgtatcagtgtagtctgaagaacagagtgagtttatgggtatttgttttacttttttaaaaaatgtgtgtattttttaattggaggacaattgctttacaatattgtgttggttttatatatcaatatgaatcagccacaggtgtacgtatgccccgccctcttgaacctccctcccacctacctccccatcccacccctctaggttatttggctttttaatttccaccggcattcctcacttcgtatgttagaaaattgaaactgcagcttcctccaactgacactgtggagtttttgttattatttattattaatattaacttaatttctgtagcaaccatagtcacagaaagttccactgtgttttatctcccttgggaaacttttttcccccctcttcttatgtcactacctgaaagaaaataaataagtatctttaaaatgtattcttctaatctcgtgcttacgcaaagccttacgtctctgagagcttgtccagccgtggcgaggtcttatcagggccggatgccccaaccgtgcccagccagcctgttcccttattctggtggctcaaggtttctaaggccgatgtgtccagtcgaccaaagaggcttatcttcatggggcaaagggagccggatggcggttggggctctgagatatgagatgaaggctgtgtagggttgcctgagttcacagcagagatcagaaccgctggctaaagcaaagagctccatagtggggagagtgcagccatagatacggatttgaatctagtcttctgcctgcctcatcaccgcagggctctgagtcccaagtctgcacatgggggagggagaggaacctcttttgcgtgtttcttggggagtcaaggatcaggcttacagcagccattgcacttggcacttacttaccaccaataatggctgatgggaagaagtggtgatttgggccctcctggcaagcagagaacagggcatgtggcccagagaagggtcatcaaaggagtaagaggaggggggaaaaaaatcaaagcagcaacaactgcccagtgtaagggctctctggagaccccacctacagctcagactaaatgggtagagacagtgcgatcc

SEQ ID NO: 62731 - DNA, 1436 bp, Bovine  19866881369203
ggaaagacctgccctctcatgtcgaagatacctgtgtcctcagttaatggtaattttgatgatgaacgtttggaggggggcagggggtgctgtcataaggtgagtaacttgactagacacagagggcttctgggctgcttcctgtctcctatctggggacattccatttttcatggcaaatatctcacttctccccagacactgcatattccttagtatgactgcttcagtgcaagttgcacggttgattcatcactgaatactaggatgtcagccataaagtgtccttggagagttttgagtgcaacccccttggttttgtaaacgagggccctttttggaagctcctgcccaagtacttcctccgggaatacgatacgactaacccatcccctgttctctctcttacaaccagactctgtcacgttataatggggaggaaagacagtggagggctcagtcatccagcccatgtcacactgactttgcaacggtcagtgacaaagctcgaactccaagttctcattaatgtcatccaggggccccatagctcggcagaaggtaccaacgggaccttcaggagcatcatcctgacgtcacagctagttctggggccagcgggtttgtcagcaggccccagcaaggggctgagaagcttctatcagctccaaattcacacaagaggaaaacaaaattccatcataatgttgaccatctgtggatgaggataatttttcaaaagaggccactggagagggaggatgcggaaaataaaaactattgtcttaagggaacatgatttgaagcggatcgctgatgcaactgagcaatagtgattatggcatagcaatatatgttactctaccttcccgggcttttggtttttaagtgattgtaagcttctttttataaaactgagggtttttttttaatgtttaatttttatttatctatttttggctgtgctgggtcttggttgctgtgcaggctgttctccattggggtgcacaggcttctcactgcggaggcttctcctgttgcagagaacaggttctagggtgcacgggctcagtggctgtggctcctgggctctagggctcagcagttgcggtgcaggggcttagttgccccaaggcatgtgggatcctcacagaccaggaatcaaacccttgtctcttgcattggcacgcggattctttatcaccaggagaagcccttaaacaccttttaattgtttgaactttattttattgtggtaagaatatttaacaggatctctaccctcttggcaagtttacaggctttcagtatgtaacatagtattgttaatacagggacagcatggcccaacagatctctggagctttttcatcttgcaaaattggaactttaaccccattgagcagcaactcctcatatcccttccccacccaccg

SEQ ID NO: 62732 - DNA, 783 bp, Bovine  19866881396583
aagatcccctgcaggagggcatggcaacccactctagtattctggcctggagaattctcatgcccagaagagcctagtgggccacagaccatggggttgcaaagagtcggacacagctgagcaactaagcatgcaaggtcctatcagaatcgactaggcgctctgatttcagggtgctgtgtgaccttcaagctgccactccctcgctgggccccgcatccctgaatttgtctgagtcccccttatgcctggaagtggtagcctcgtggtatctggaggctggattttcttctcaggccccagtatttagtgaagctttgccaaagcagctgagagatgagcacttctccgcagcccatgctagctctaggagacatactgactgccacggggaagctggcctgatgggaaatgtcacaagtaaaagtgaaacacggagaggcaggcttttctctgacgggtcgtatgttattgacacacacagcctgcccagaatctccccaagacaactggagatggacctgaaacttggggctcccaaccaaactttcctcttcccagttattcctgacaggtgttgacaaccagggctggacacacgtgggaggctcagggattaggaattggaggggtgatcagggtgagactgacatttaccgatcagttacaaccgactgagcacttctgctacgtgatctcatttatcctcacacagtactcttagtagggcgacaacttgtatttaaagcagagatttagaaaggcaagtactgcccaagttct

SEQ ID NO: 62733 - DNA, 1450 bp, Bovine  19866881423370
tcatattcaaagttcactccagaggactgtttactatttatggtttcagcattacagagagttgaaatattttgctgtttttatgagactctgacccgttttgtaaattgttgatataacacaatagaaataacaaataaactttcagttttaataaatgtaaatggtaaccagcaaagaacgtaaaagtgttctcacgtaggtgccctgtgtcctgttaactgaatgtggactgaggtggaaaacactaatagaatctttgtcgcacacaggacatgcttaggaacaagagcacagtggtagtcagtgcagaatggtagctctgtggaaatcttacattattacacagttgagaactgtgtttactcaaaaaagagtcactgcttttcttctgaggcctgcaaactacttgcagatgaatcgagttgcagattgctggggctccctcacagctcacaccctgaagggtagcccgtaagctcttctctttggtatcctgaccaccttctgaccgagttagcattacccccgccccgtctgtagctagacctgctcacctctgaatgatgccatcaccgcagtacccacttccatggatgtatgtggcagcaggtgacggctcactctcttcatttcctgaaatagcgatgacccaatactggtacctactgccaagatgtacatcgctggaaaacataaaaacataaggaagactattaactatgcagacgcaaggctgcggacagacaaaatggatccccttgagtacatttctactagtctggcttgtttttgataccacccgcatatttaattattcaataatttttatttgttttttatacattttattggagcatagttgatttacaatttatattaatttctgctgtataccaaagtgactcctttgtacacatataaacattctttttcatattattttccattatggtttgttataggagactgaatacagttccctgggctgtgcagtaggaccttgttgttcacttatcccatacatactagttggcatctgataatcccaagtttgcaatccttccctcccccatcccactctcctttggcaaccacaagaatgttctctatggctatgagtctcttgctgtttggttgatatgttcatttgcgtcacattttagaatccacacataagttagttatccaggaatttttcgtgtcttctgtgattaagccactctcccacctatgatgggctatactaaaatgtagcatcaactgacatacaaccatgaatattaccaggtggcgctagtgggaaaagaatctgcctgccaatgcaggagacacaagagatgtgagttcgatccctggctggagtagaaagtggcaaccactccagtattcttgcctggaacattccaccaacagaagagcctggcgggctacagtccatggggccgca

SEQ ID NO: 62734 - DNA, 835 bp, Bovine  19866881463483
tccttaacaaagaccattggcttaaatgccccttaaaccagcgttatttacacagtttctctacttccctttgaattctctgcctggggggggggggtggcctacctgcagtcctttccagctactagttaattaggctccctcccagaaaggaagctagtggaagctgggacttggtttttgaaaagcagctcaattcggaggttatcagagagttcacacgagctactggactgcccgctgcttctgctgacgttctaaaacgtgtggacctcatcagagttatgaccacagttggcattgtgagatagcagaggagtgaccattccagccgtcccagctttgcagggaaggtataataaaactccaagaacattcctggcaaacgctgccatggtgctttctagctctgtggcctgtcagccttgcaaacctgccgttttcatagatgaagaaactgaagtgacccccacccctttttttgtgggagaactggaatttgaaccaagcaacccagctatggagcctgagcacagaacctccatcctaagctcctcagactgagatgtctggcctgagatgatagctgggaagtggagaggctgtgagtccaactaaggtttgtctgactctaaagaccaacaaagttctaccacagtttgttgcctcaggaataaaaatgtctcttaagaaatatatcctcccttcactcatttctcctatatttactgagctgcaaattatgtgccaggtcctggacagattgctgggaagtgagatgaatggaccccgggctcagcactccaggagctcaggggttgcagagagaggcagg

SEQ ID NO: 62735 - DNA, 2354 bp, Bovine  19866881705735
ttgtctttactgtggctctgaaactcagccctggaaatgcttagtttaaatgttgccctcaaaggatcaaccaagtaaattggttggttgactgcaggtccataatccctgggagagcactgtgcattccgatagcctttgcatctccaccacctcctgtgcgggaggaggaaggggactgtttggacaggaggaacctggcttgggtagaaatgcagtggggggcgggggggtgcaggatgaaggaatctctgcagctcactttggcagcctgtggtgtaaagcaccggagaaatgtgagacctggaaaccaaatgagaacaagacgggatctttgcaaacacttaaaccaaactgtgctgagtttcccagaagagagataactctgtactttcaacttgttccatttttgttctgtctcagggaccttttgaattccagcagggctgggaaggtgcacagccaaaacatcccaagaatgtctcttgttataggatgttcagcccgatgcgcacagccagggaggtgtgatgcttctgataacatttggatattagactcgatgttcgggcggaggagcttagtgctaaccaaatttgggcatcttatttgagggggatggacaagcaagactggggactttgagaactgcagcattcacgcaaaaatggaaatgaaaattttaatcattttctagactcatctaacacagagagggtgctgtctccgcagtagccacagtgacagcctggtggtgataccatccaaccatgtcatcctccgtcgcccccttctcctcctgccctcaatctttcccagcatcacggtcttttccaatgagttggctcttcgcatcaggtggccaaagaattggagcttcagcttcagcatcaatccttccaatgaatattcagggttgatttccttcagaattgactggtttgatctccttgctgtccaagagactctcaagagtcttctccagcaccatagtttgaaagcatcagttctttggtgctcagccttcctgatggtccaactctcacatacctacaaaactaccggaaaaaccatagctttgactagatggacctttgtcagcaaagtgatttctctgctttgtaatctgctgtctaggtttgtcatagctttccttccaaggagcatgcatcttttacttcatggctgaagtcactgtctgcagtgactgttggagcccaaggaaataaaatcggtcactgcttccgctttatcccttccatttgtcatgaattaatgagatcggatgctatgatcttaagctttttgaatgttgagttttcagccagctttttcactctcctcttttaccctcatcaaggggctttttagttcctcctcaagcacctcatggagtgtgcatggtaccaccaacacaaagatctatccatcatggctctttccacctgattcacagtgacatttttcaggaacccggctacacccagttcctgaacaagaccacacattcacacactcccagtatcgtcttccaggagaacctttccatcctaaatttcccactatgggctgtgtgaccttggggaaaccactcccacggtctcagtttctccaaggtaagtagtaattcttcccttgaagaatggcaagggggttggggcccagctccatggctggtggacctcgacaaccactggttccctccccactctcctccctgtgcttcgggatcactgtctggacctgggctgctggatctgcaaggcctgttcctggaggatgctcgcgtgtgtgtgcctgtctgagtgtgtgtaaaacagacagagagagagaggaggaggaggaaagtggaggaggaatgcataattgggttaagggaagggaaggtgctcacagtgcacctaagaagcccacagccccctctctcaggccatcagcctcttgcctggaggccctgacagggtgaaaattaaccaccagcctcctctagtcaccgcgcagtgtgatgacggccacagccacacttcctcctcttctctgctctcaggagggagccgtgtctacactccaggaagaggctcgacgcagtcacgcaggctgtgcgtgtggtgtctgcgtgtgtgcatgttggcccacgcacaatggggttggtgtgggaatggcttccaggcactcgctttgagacagggaatcggggggacttttgttctgccggcccccagaccccctgtccagccctgcaccaggcggcatacacctccccacccctgaccctgtatcctccagtgagctgatctcattatggcaaatttagttacagctgaagtctccttgtaacaaagattatgtccaag

SEQ ID NO: 62736 - DNA, 1047 bp, Bovine  19866880400941
acagatccttatgtggtacacagcaattattgttacagagaacacactggaaacaggtcccataattgcatgctagtcaagtctataaacagaatcattcactctcttattacctcttttacctttctctatattctctgtctgttgactgaagatattttcttatgcttgactttctttttaattcacgaatagcagtatacttttcagtccagatatcctaaaactttagaaatcgcttaagatgtttccatacctcatgcttacttgcttgcttcctatactgacagttaatgtaggaaagccattactgagacaatgaacatcaggccagaattatgttgctaattagcagattcagatggtgctaaggaagtcagtttttttctttactactgaaatgagtgggagggaattagagcagttattcccaacagaaccacatctttcttttattactctttcttgctatcagtctatctccattggttctctatgttcttattttatgtatagcaggttaattttatttgatacatatagactctgcaagttaaagttctaagttttaagtaaaactgtgttaacttacattgcttcatttctgatttttctcctgatatcaccctgtggtcattttatatgctctgtattttagaatatccaccttgatttcgaactatgttcgtgacttttgcctcatcccttccctgccacttatccaagttctatttgttacactttctgagactttcaaaactcactgtgagttaaacaatagcaaacatggcttttctgatcaaagtgtgaagtctaccaaatcttgcagtttcagaaagtgttaatcactcagttgtgtttgactctttgcgaccccatgaactttagtacactaggctcctctgtcaatggaattctccaggtaaggatccttgggtgggttgccatgcccttctccaaaggatcttgccaacccagagattgaacctgggtctcctgcattgcaggcagattctttactatcgagccaccagtaaagcctcaaaa

SEQ ID NO: 62737 - DNA, 1485 bp, Bovine  19866880414606
atccattaaactcttaactaaaaaaatgatgtatttttaatgtaaatacacatctctagatagaaaaatagggtaaaatgttaataaatattgaaagtgtagtttatatgtgtgctcaaagttgcagtctctcaattttttccactatcttcaaaactctgctctaataaatgaggaccgtggagctttggagtccagaatactttcattcaattccaaaacaacttaatttattaacaattgcttaagcttgaatcatattttccctactgcaaaaataaagaatacaaggtctaactagtaggatatgcagattaaattaatcaacctgtgtttgagttcttttccatgtaaaatcacagatctccatgtctttggagtcagttattggaagattaatgtgctcctttggcactgtcacagttgcttggttttagcgttcctttcatgtttagtgttgacccaggatctggtcaaagacttttcattacatttaaatgttatatctctcaagtatctttgttccaggacattcctcttttttttctttatgacactgttctgttgaagtcagctgttttacagaatatttctcattttggatccacctgcttacaggtgtccttgtggctgggttcgggtgaagcatctttggtgtcaaaatgcaaaggcgcagctctgtcccagtgcccctgtgcacacgaggggctcagggttcactttgcccagtaactggcattgtggcccctgggctgagaagatgattactggacttttccagtgtatgcacttctcatcctcttgatagatcctcacttatctgtgattctttgagactgtgtgtgaaaaatgcagttccccaacaatctttcacccagcagctcacagtaatttgctgatatggttctcacactgtcatctgtgtacatccatgcagtctgggtgtatctatagactcctgggggatgtgaaactagtgacctagtttaatcatctcagattccactcaagcacgctggcacttagagttgtagagtaacatttcctagatcatccctaggaagagctgactcttcattagaaaagtccctgatgctaggaaagattgaaggtgggaggagaaggggatgacagaggatgagatgattggatggcatcactgactctatggacatgagtttgagcaagctctgacagatggtgatggacagggaggcctggcctgttgcagtccatggggttgtagagtcagacatgactgagcaactgaacaaaacagcaataaagtacctgtaatataatgaatgccaaatacatggtccactaaattttctataaaatgttttagtttcttaattcactttatcagtgataccttactaccatggaacataaaaaacattgtctcttgttggataagtagtctgcaggacatccatttaggtatttcggagagcaacctaatacctaaatattcttttcatg

SEQ ID NO: 62738 - DNA, 1572 bp, Bovine  19866880441147
ggactgcagcccaccaggctcctccgcccatggtattttccaggcaagagtactggagtggggtgccattgccttctccaattttaaggtataattcatcaaaaaatatatgctgtcctcacttccaaaactgtcctcacttcctcgtcttcctcctccgctacctgacacgtgcaaatacagactcagagatacacgtgttccatttgtactcacttcagttctataaccatagagataccctttatctggtgacaaaaagaaagaaagagcctcttgaggcccgagtttgcaagcctaaacttaacaggtgacattcatgccataaaaaatgaatatactttcttatagaaggatcagagtgcaagatatatcatcaaatgaaattgggccctcgagggctcttcatagctcatacttattgattggtatggcaaatgtagtaatttgtaggcagctagcttgtgacacattgtaatgaaggagacatatgtaaaagtatgtggaattaacaggagcaatgttactccttcagcgttttagatgaaaaacacatgcaattttgaaacctcagctttgctgtttcaaagaccctaagagcatctgttaggtattgtatgatctcatctctaacacagcacatgcagtcagcttttcagcatgtcacaccattactaagtaaggagccagaaaatgagcaggcaggtcacttttcacctcattagcacagcaggagggggctctggaaaacaagatgctagcagaagccgaggggcttgctgatattttttttgaataacagaggaaggacccagctgtgtactccttctaactctgtacttctgttctttctcacgtaaccccttcctttttcttctgacctttaatcagtttgacccctgaagtgttcataaaccaccacaaagttatttctctggaatatataatttgtctctatttttcctcatggtagatcttggttttagcacaattctattgcaatatgatatggatacacagtctttaatgtccttgaaaagattgaacttaagggtcctttggacacaaacagagaaaatagagaagataatgggaaatcagctatcatttcattctctgaactgctacttgcatttataaagttactaaataaaggtttactttctgttctgaaatttgttttctatttattcatctttccatcatcaatcttattttcactatgttgactcctttatcagtcttaatttctgggttgctacagtgatcagatcccttctgccaacccatgatgcacaaaatatatataatttcttttttttaagccattaaagtttgggattatttgttacacagcatattgtagctggtcctgagcaatcaaaagaccttgcccttgtactgggcaaggacattgtaccaggcagtgtgctaaacactttatgcatgcatgctaagtcacctcagtcgagtccgactctttgagaccccatggactctagcccactgggctcctctgtccatggctccagggaagatacggaggggttaccatttcttcctccaggggat

SEQ ID NO: 62739 - DNA, 732 bp, Bovine  19866880835830
tgtatataatttcttatgttaaaagaataacctggaatttggtgtcaaagaaattttgctcctgaattccacagcactcttaagaaaagagtattagcatggagggatgctctctccatctttctcttccaagctagaaatagttcaccaaaacttccttcagcgtattgtctattactcttatttgaaagtcacaaatcttgacagttttttatctaaatttaaaactagatattttatgatagcaatctaattgtatccaacattctttccagagtcttgggagccatgttgctttggggagataaacttaaccgtcaagcttctcaaaatcataaccattggctcacgaactattttactgaacaaatagctctgaagtcctcacaaacataaacaacaatatctgcacactttacattctattctgaacatttcaaatctccaagcttgtaaacgttgaggtttttgttccaaagggatcataaaattgtataatataaagggagagaaaaggtataggcaatttcaacatagggatagttgataccactcttttcatgacattagaaagagagaagagggctggttattaatattgaaaatacagaactaagggataaagagaaagcaaaggctgcctgaaaagtctcttgaagtagctcatagcaacagaaaataatcatgtctatactgacttagttctacccccaagcaagaagggattgttat

SEQ ID NO: 62740 - DNA, 2247 bp, Bovine  19866880963333
tatttaatgagtgctatgttacccctacttttcttcttttttgttttgttgtttggttttgctttatatatgtgtatctatatatatagatagatacacatagatatgttatatatgttactttcatataacatgattttaaatcttaccagagcttagtctcttttcattttaaatgtagtacctttgaatggaaataatactttacatgtaaatttgcattgtttagcagtataagcatatatttattaaataaaagtagaatttacttcactaaatcagttcccttttatcatgattttttccagtctatttctacttgtattttgtgcttgtttgtcctttctatgtctctcttgctctctcttttctcctctctttcattgcagtgttgattataaagttaaggaataggaatgcaagagtgattagctcagtataggatacctagtttttatttaatggtaatgtttcttggctactttagtagatatggtaccaacttttctatactatttcccataaattggagaaaatattgcaaatacaaatgtcttaaataaatattaaattattcaatagcttgactaatcatatgagtttaatataccaacaaataatatatgtataatgaagattttatctgtaaattcacctggacattatcccccctgaggaaaatccctgatcaactatgtttcatgctacctcatttccattctgagttgaaacttttcaatttcacttattcattcagtaaatatttatctcagaaaaccaagtttgtgacaggctgttttctaggtactgggaataaatcagtaaacaaaatgactcaatattcttatgctcatggaacttgcaacctagtaggagaaacagacaataaacaaaccattgaaatctatagtctgtagtatggtgataaagactgaggaataaattgagcagtgaggagctttagaaaatgtgaagactgggatccaattgttaacaaggtgagcaaacaaaccttaccatcaaggggtcatttgtgtaaaaacctgatgtagaaacagggaaatgagccatcctgagatctggctaaagaggcttaggaaagagctggtgcagactccatgaggtgggtgcttgccaggtgtgatttgggagagtatggcctgtgtggttagaggggtgaaagaagtctagagtacacatccctgtaggtgacttgctgtaaagtctttggttgttactctttttcagatgggaatctgttgggagtttgagaagcaaaattatactttttaaattttttattcatttatcctttttcagttttagtgaggtgtaattcagaaagttgcaaattgtatttaaagtatacaatgtgaagatttcatatatgtatccatattaaaaggcttccctggtagctcagacagtaaagaatctgcctgcagtacaagagaccaggattccatccctgggttgggaatatcccctggaaaagggaatgagaacccactccaatactcttgtctggagaatcccatggacagaggagccttgtaggatacagtctatggggtcacaaaaagtcagacaaaactgagtgactaacacacacatacactttaaaaggatttaaaagtgtgcatttccccatcaagttaattaacacacctggcacttcaatttgtgtgtgtgagagagagaaactgagagacagaagtcttacatccttaaaggatcactccagcactgtcctcttgggaataggccctagaagggtaggggaagggtaaaagctgactcagtgacaacttctggtgttgtagacataacatttttgcaggatttctatgcttggaattttatcttgcctagtgttgccttatgatgctgcttatttaaggctacataaaatccttccccatcacaattacaccacgtggctttcttcgacattacaactgacaaaaggcatggtccccttgaggaaggctaaatgacaaaggtgagtggcaaggtaattacataagctccctctatgttttacaagctttaattaagtcctacagcatctttctgtaatgtacaaataccattaaacctattttgcagagggtgaaaatgaggcaagctgaaaaataaccaattaaaaagtttcaagatcagaattatttttctctgtaaaaaagagatcatactttctcacagatgacaaattgtgtttatctgcatcatatatttcttactgtt

SEQ ID NO: 62741 - DNA, 1723 bp, Bovine  19866880966576
ttctgaatcttttgaaatctcaaaagcctttcacagtaattattcactggcaaagctccattctgtaatcatcttatttagagcatggaatgtaaatccagactcaagtggttacaacaatatttagtaatttatgaactacgaagaaaataaaccatggacattcagtctgtcagtggtctgcttaggaaagtagccgaatgaaccacacatagggcctggagtctcacctctaatcagtgaagtgatctagatatatctacatatcaactgaccaaattctactgaaaatggaagaggaaattatccagctaaaaatagaaaatcattgtaacaaaccaaaatataaagtgatattaaaattataactaaaaaacagcgtatagagagtaaagtcttagtcattttttaaaaatctaacttcatatggaaaacactttctaatttaaaaaatgctgacaatggctataaatttgactcttaaactttcatgtatttatcaaaaatgaaaaatattacttatcaacctccaaaattacattttaaatgactgtgtactttttcaataatgttttacacataaagaagttttgtttatctacagtgtctaaattagagagaatctgatagctaaaggatcactttacaggatcttagttctctcttacagtaaatgaagttccatttgtccatttaaaatactgaatttttaatatgtccctctgctcttcctctgtctcctatcccctttctctgtctcctatcccttcagcccaagagtccagttcacatctaaaaatccattaacttccacatgccacagtattggaatggtctttcctggctcggataaagaaggaactcttgccctaccattgacctttatgtcaaatggaaagataacttcacagtgttatcctttcttaccatgcccttttcacataatttaaattctctcatgttacccttactattttcaaataaagatttgagtttgacctgaactctctgctatagagacaatctttcttacaatggtcatttaggacaagtctccaccaactaaaaactggaggaagtctgttaaggataatttgggaaaatgaattcaagcaaaatggtgtttttaaaaagaaacatgaaatattattttcacatacttttttagtttggttacagaaaattattcatattttaatgagtactttgaagcacagatctttccattaaataataaattatggaaatgtgtccccaaaaacatgaatataaaattttattttaaaataattgaggagaggatgatacagtaagaagattagtaatagctattgtgtaattaatgcttacaacgtgatagctattctaacattttacatattttatataccatttaaacctgacaataacagactattggtagctatcatttctttatttccagatgttaaaatggaagctgaaagaaggtaagtgacttagtgataataacagagtcagaaattctacctagttacctgtcattccaaagcctgctttcctaatcacttttctaatatgcttgtgaataaatgttgtttagaaatgaatttcaggaacacagatgtttaacagagatttgaaaattaaaaaaaaaaatgatacttctcttatagaccaaaatttaagttagataatgcaaaacaagagcactaaaacaacttagattactggtatattatta

SEQ ID NO: 62742 - DNA, 1088 bp, Bovine  19866881052131
tcagttcccaggtgatgccaattctatctactattccagagacaacactgagaactatggctctaaacccaactcccatctgattttctcatgatatgtctactcacacttgatggaatggatttttaggggaaggtggggggagttatatctgatagatttagctaatgcacaaaatcaatgttttatttccaatgatattctcttatctgatggcttactaggaggaaggaaggtagttttagcttaggaatgaagtttataaacttttccatgtgtttcctatagtcacagacacttgacttggaatataagttggttcagttgttgttccctttcaggcaggaataaatatccaggtgttggaatcacagaaaatgcacctgactcagagccagcttttgtgtttggctttgaggtaacttccaacttttgccagagatgctgaccacctgtgaaatatttgatcaatctgctgatccagctgcagcctctctgtgctgtaaattccagctctcctatgggaggagagggtgcttagtgacaggacagcctaataatatgggccaattcagaagaaaggagttgactcaggtctagctggcaaaaataatttgtttgcccctattgtctctacagccaaagcatcttattgcacagtggtatagcctttcttttatgtgataccgagtcagatgctggggtaactgactcacatgcaaatgcctgagattaatacaccatgattattttccctttatactttatagggcctaactattagagtgcatgtctgtgaaatttgacaataactgctgttggcccagaaaatgtcatatgacttcccatttgtctcacagattgtgggactggatatggatcaaaagagaatttattaaagggttctgaggttagtttaaaaaacaaacaaacaaaaacagccactcctgaagagaacagaaacttgcagaatttcagagaagtaagtaattaaagacatcaacaagcctagggaatctgaaacatgtctggtcatcagaattcaaaatcacccaaaaaatgtaaaaatagagatggccgatgtccat

SEQ ID NO: 62743 - DNA, 1398 bp, Bovine  19866881064468
aatgtggtctgagagactctgctctctttatatacttataagcctattggatttttatactgcaaaactctagcatgtctagggaaattaatcctcattaataaaatattctaaatttcatttttatatactatcatttaaaagggaaacataacacaaaaactgttacatatatctctgttattaataccaaggaatcaaacctagattggttatttcaaaattatctggccacaataaacaacaaattttatattttcatttttccatggcaaagaaggtttgctgttcctcatgctgacacagacatacactcgggcagttaaactatagccagtcttctatttggctccaggtaaaggaattaacagcttgtagggaagctaattagatccaattattattcaactgacctaatttgacattcaatgtctgggaagaagtcatatgaattaactgaatagagatttaactactatatacatatgagctccatggataatttattcctaatgaaactcatttggagaagaggaatgtactgattgagacaaaacaataaaaaaaaaaaaaaaaaagagggagatgatctaatgcaaaactcctaaaggaatatgagagtgtaacataacttgtattcattcattcttctactcatttatgtattttttcaaagcaaactctttctgtgagtaaaacaaaagcctttaattttatttttaaaagcctgagcctcaatttgcttatttgataaggtgattagatgaactgatcaataagtcctttcttctatggcatttttttctcccaatatgtcatttatttaaaatggtaactagatgtaagacacgcttcattttgtgggttccagttggtaagtaaaatctatactatttacatagatgatttctggggaatggcaacagcaagatattttaatatctgctaagtgcagggcatagtgcattaggcaacataaaataacctatgggatataacttttgaagtgggaagcctgagcatgaagaagccaccacactggcataatattaatgggagatttgtcaggagaaagttggtgagcagaaggaagaggatccagaagtatttgctcctatttattgaatcattcttattaattagtaggaaaacatatattctaaccaagaaaactttatcaagttgtgctgagaaatgactaaagtgaaaatgaattaaaatatgaaaaatattaataaataaaatctgaaattcctatactttggccacctgatatgaagaactgactcatttaaaaagattctgatgctgggaaagtttgtaggtggaaggagaaggggacaacggaggatgagaggtggaggcatcatcgactcaaggacagagttagagcaaact

SEQ ID NO: 62744 - DNA, 920 bp, Bovine  19866881087906
cctggagaatcccagggaccaggggagcctggtgggctgccgtctatggggtcgcacagtcggacacgactgaagcgacttagcagcagcagcagcagcagcatgtatgtatgtataattcaaccaacactggagatctgctacccttatgataaagtctgacttagtactttactcttctgtcctctagttggaggaaataagactcccattttaggttgtcaaggaggctttcacacttagcctttaattccaaattattaccccaatcttttattttcttttatgaaggcatttatggcccttagcaacaaccaactagttctacagtctctataataacttttcctcacaattctgaagtttgatgtattttacctccaaggcacatccactttccctagtacactatctctacttaacacctttaaacttctaacaattgcaccactgctggataggaaaccatgggtaattcagctccagaaactcattttgcaatgtactttcttagaacttctggtaccaaatgtcataggtctggttctttgggaaacagactgagagggagatttgtgtccatgacattaaatggggagagcactcagaaacaacaaatgtaatgaagtcagggaagcagaagagttctgaagatgagagggccctttagatttgtcacaactaagacaaacaggatgaatcttttactcctgcatggatcactcatttttgtgggttgactccctgaggtagtgcatccttcaaaaaagcagatcctctgggcagggtcctggggagagacttagctgtggcctaccaacaggtaacattccaataagctggggaagataagtgtttctctcctgaaggggtaatctggtagtgctctacaacatctgttagaaggttggacaccaata

SEQ ID NO: 62745 - DNA, 979 bp, Bovine  19866881143726
atggaaagtattccctgtgcagagacctcagtatgggctaaaacttgaattcatatcttagttaaatacaaggagtctcattttgaggatgtggatcttgaaaaatcaatgaaaaatccatccagagtttatgaaattagctcagatttgcaagctgtatatagtgatgaatgagaaagaatgttgagttgatttatgattcttgcaaaggctcatcttcatctgtaaaacagcaaaagatgaaccaacagtatctacatatttagcataatttagcatataaagagttttgacatttaacagtaactgatcagaaaattatatgaagtaatgttattaaaaatgaaagaatctgactgatgaagatatataacaaagataatttttgtcaacaacaaacaacttaattttttgtagtgaatatatgttattcagaaatagtaggcttcagtgtgctaattaaaagccattggcttcccagctatttacatggctttcagctctccaaagccagtgacctagtcaaattaatgttgacctcaacttaaaagtcatctgtatgaataaataattcacaccctctgcatacttattgcatttagcagttgcactacaggattttgctggtattaacaaaatattcagtagggttaaaactgagaaggcttgaataaaatatattttagaccacccatttagattagagcatgaaattgtaaaatcaaagtcatttcataataaagagtcacaagtatatataaagacttcttttggttatattgtcagcctaagactgaaagatttaaatatatgcatgtgtaaatatattttacaatccagtgacagcattaaaatagcaaacatgacttggatagtgtgaaattaaggaaacattgcaaaatccttggtagaaaatagaatcatagtttgaaatagaaattaatgtcatattttgttttcactgttttatatttccagt

SEQ ID NO: 62746 - DNA, 1551 bp, Bovine  19866881331685
aattctatgagccccttttaaacatgaagacactgtggcacagagaagttaaacatttcactaggacataggtgctacaataagtctgttttgggcatacactctatgtttgctatcctgtctcactgaaaagacaaaataaacatggaatcagaatatgaaaataaaaagttatccaataataaataagtacatttcaaaaattttagaaagagaacatatttttgacaaaacaatcgaaaatgatatgtaatttgagagcctcttaacataatacattcattttcctttatacaacagcagatttcttcctgtctttatattagatggatggaaaatttcagcaacctaattttggctctgagtcactctcagaaaactgaccagcagtttccttgatatgatcaactcagcaggccagcacagatggggcttcgtcacctcctgtcactgagtgcattaatgttgtctgcccctagatccaattacatgaatgatgcctggccaaacacgacccacccttccttgtctctggtgtctcttttttgaagtgtatacaatatcactttgcctcctggtgctggaggtggcctcctggctaatttgatagagaacagaaaaaataatgtgacccaacccaatgctggcaactgactcagggttcataatatatgtttttaacatttgtaatcctatctcttaataaataagacacagcgctttttccttggcaactgagaccctaatgcattgggttaatatttctaacagaattagcagcacagtatatgtatcttcattctgcagacaagactcatcacacaagctttattgtgaatgtatttattccctaacctcaacacattatcctaccactaagacaggattagaggtttcctctggtataatttcagtttcaatttttaagttataactttgtttttgatttctacaaagtaagtgtcaccattaacagaaaagcttcaggattaaataaatacagagttatttttttaaatttgtttagaatatatgtaaaccatatatcaccaactaaagcaacatttctattttcataataaaagaactcaacagttaaagaaatccagaaatgcatgacaggtgatattccctgttgatagttctaaatatatgctttacttttcagattcttcactgcagaaataaaacacaatcatgatagtggcagaagtaacttaggctatgattgtcagtccactttccttaattgatattcatctcttaactatctatcttctcttttacattgaaggtaactaaaaaaaaaaaaaaatcaagaaccatgaaacctaggtaaatacttggagatctaaatatatgcttcaatacttgatcatttagtatgtgtagagtaatagtagtggctttgaaaggagaagtttttagttgatgaaagatcaccaatatctgctcaattagtgagttcatacaagttctgtattctttggggggggaaaaataatatccagggatattatgcaagcaaattagtcaaagcagaggtcagag

SEQ ID NO: 62747 - DNA, 1145 bp, Bovine  19866881362671
acaatgtgaatatgatactaatgtttagaacctttagttttctttccttaatcaaagagtactcctactttaaaaacatctttttttatgtcattgaagtgtttactaggaaccagtgttaaacacaggtgaccctatgacatggataggcataaaagattgaagtgtacatgacactgttcattctaacagcttgtttttattcacagaaatgtaacagaaaaactgactatacagataggaatttcagagttactgaaagactttgaggacaagcagtctgaaatactcatctgttaatgaaatggagattctcaagatggttaagaaagacatactcagattagttaaatgtccctgggctctatctgaagacagaaatgaacaaagtaaaagtccagtacccatgaaaacaattttcattcaaaatactacagaacgtcaataccaccaccaaaacagttatttatagtttatgaagcattggctttcaataggggaatacctcagtggcctgagggtggatttattattataatatctatgggaattatgttatttttaacagttattaggtgaattatgttgaaagtggttcaggagaaggcaatggcaccccactccagtactcttgcctggaaaatcccatggacggaggagcctggtaggctgcagtccatggggttgctaagagtcctgagcggcttcactttcacttttccctttcatgcactggagaaggaaatggcaacccactccagtgttcttgcctggagaatcccagggacaggggagcctgttgggctgctgtctatggtgtcgcacagagtcagacacgactgaagcaacttagcagcagcaatgttccattgtatacatgtaccacaccttcttgatggacatttaggttgttgcaaatagtgttgctatgaatgtgcaggtatatatctttttgttgattcttcttatttgttgtaggaccttttgtttctgtgtccagcattcttttggataacattctctctcccattcagtgcaatccaattagattgtatgatcaatgggatgattctcttctccactctcacctcatcacaaacccacaaacacctgggcatatgacccaggccaggccaatcagaacg

SEQ ID NO: 62748 - DNA, 1210 bp, Bovine  19866881502539
atgttttatcctcttaaggttttgaaaaagtgtctattaatgtagtctctattttccttttatttttgtttagttatttatattttcctaaatcactgaacatggtgactgcatccatgaaattaaaatacgcttactccttggaaggaaagttatgaccaacctagacagcatattgaaaagcagagacattactttgccaacaaaggtttgtctagtcaaggctatggtttatccagtggtcatgtatggatgtgagagttggactgtgaagaaagctgagtgccgaagaactgatgcttttgaactgtggtgttggagaagactctttagagtcccttggactgcaaggagatccaaccagtccattctgaagaagatcagccctaggatttctttgggaggactgatgctaaagctgaaactccagtactttggccacctcatgcgaagagttgactcattggaaaagactctgatgctgggagggattgggggcaggaggagaaggggacaacagaggatgagatggctggatggcattactgactcgatggacgtgagtctgagtgaactccgggagttggtgatgaacagggaggcctggcgtgctgcgattcatggtattgcaaagagttggacatgactgagtgactgaactgaactgaacattccttcttaactattacaaacaggaagtggaaaaacatttgtattgactgccatttttgttacaacttaggaggtacaaataatttttcatcaatactcagcaactacttatagttgcctcatattaaatatagaacattttaaatttgtaaatattttacagtgcaaaaccaaacatttatttatttaatattttgaactgaattcaggtaaacttttaatatatttttacacaagtgatttaagtattgttttttaaattaattgctgtatatgattatatccagcgtgattatatatatgccctatatccactcatgtattgtaagtaaaagaacaaagtgttttcctttgacatttatttataatttggtctttaataaaaagtaatctgtgtaactaagtaaggcaatttttattactcagggagacaaatgagtatagatcataggtttactgtcagacaaatttggatatttcctttaattttgctaataaaagctaagacatctgagaacatgttatttaatatttctaa

SEQ ID NO: 62749 - DNA, 1539 bp, Bovine  19866881504095
acaaattttttaaattgttttttaatatggtatgtctcatggttaacaaatagttcttagaacgtgtatttttgccaagtaaactctcatggaatctctaataagtgcaagtatattttgattttgatattaaatttagtacatatactccataagtatatttcaaagctagagaaaaaataatttgggttttatttttcaaatggtcagataatagacgctattactctggaaaaattcttctgtttctactatagctctatgtaaacctgcccctttatggcagataagtaatatatgagaaaaaaaagtactgtttaaaaaatttcttacaagtaaagaaaactttttatccagttcttatatgtgttcttgaactttctaaatgctgtacatgtttgtgtaaaatttaagataacatacaaagtatatattaaaggtatattttctcttccaaaaggctttatttataaaagggggatataagactttcaaagaaattacatttttaccaaaaagcttgatcttttatgacatgtcatctaactttgatagtgagtataatttaccaaattggtttgaaggcattgcaataactacaggaaccatggtctgcattactgatagatttatccaagtacttgatagtccattaggagaataattcatctgagagcaagcagacaaaaatccagacagtgcttcaaacacacaaacaatttgagaagtaaccagacagcaattacctagttagggtctgcttttgaccattgtaagtaatgcctcaggttgccacttgtaacaagattatatttgctactttaaaacttgctattttcttttaactagatgaatgtcacacatcctgtaattagaaggcagctaaagaatatccaatccagtgaaaagggtatggaggaggagaggaagagctataatacaaacagaaacattggaaggaatgaatcaaggttgcttataaagtcttaggtactatcattaatgtatcttaaattacagtgtcctaaaatctctgtgccttattttttccctactctctatcctgtaattcccctggtaatttcatgcagacactcaaacttccatttttattttatttttttttccatttttaaatattttatcataacaactccatgctcagggtggtcctacaaatatacttaggcatatttgtgacttgttttaagtgctaaaatatttattcaggctcaatggtgactaaaccctgaagaaataatatgaataaattcaaattctatttttagctttggtattactattttcaaaataatttataattacctatttttaatcttattgatctaattaacgttcttgattttcatattaataatttgggtttcagtcttgaaattaaaagatgcttgctccttggaagaaaagctatgacaaacctagacagtataatgaaaagcagatatcactttgccaacaaaggtccatatagtcaaagctatggtttttccagtagtcatgtatgggtgtaaaagttgg

SEQ ID NO: 62750 - DNA, 1084 bp, Bovine  19866881518246
taagtttgacagccaggaaggaaggttcacaatttcggcagctgttatttgtttttttcctttactaagatgagcagcaagaccacaatgtctagagatttgtttgattactcagcaggacagtaggagctaaagcagaaagatgagagaaagcatgagaagggaggagaaggcatgatgtgagcaaacatcaaaaaagcacagtttgataagtaggatctcaaaataaagtttactccagtgacatggtgaccagagggaagattactgatgcaaaatagctaaaatcaagggctgactcaatggcacatattaacatttatagtgtataaactgagtcccagacatctttatttccaagacagatttttatgttattagacagtaggttacaaaccttctgtatctcataatgcccctctctttataactactcttagtaaattttcaagtgggagactgtttccaaatggctttaagatagaatatttgctgcctggcttaacaagtgattgagagagaagcatgaagcccaagatataaaaaaacaaaagcagagaataaaaacacagagctgagatgagcagaagtttcaggaaagatacagagaaaagcacggtacaaaaatcggcatccagaaaatgcaagcaaataagcctgctagaaagaaacagaaccgcagcccactcagctttctcagaggaaaacatacacataacattcagtgaagtgtgaggaactaatggcctattcttcaggcatggagagcttcagcatgaaatcacaacatttattttctgtgcagcagcccaactcatgagccccggaaaagcagtctatctctgtgaagattagaaggaaaatttgaagagtgcaagacagacagggaaagaaggtccaaatcaaagtggcaaatttatgaaagactgtgtcttctggaagatgtaacagagaatgctgagaatatgttttataagcaacaatattattacaaggtatagttaatataaagaattccattttcaaacaattataaactaaacaattaatgggttgtttgccaattgccagaggtagaaaaaat

SEQ ID NO: 62751 - DNA, 804 bp, Bovine  19866881630123
acttgatttgagcccaaaaataagtgtaggaactggatatcacccatatctctgaatataacctctttagagatagtctgtaaatattggtttatcatcagtgcttccctgatagctcagttggtaaagaatctgcctgctatgctggaaaccctggttcgattcctggatcaggaagatcttctggagaagggatatgctacccacttcagtattcttggtcttcccttgtaactcagctggtaaagatccaccagcaatgcgggagatctgggttcgatccctgttggaaagatcccctggagaaggcaaaggctactaactccagtattctggcctggagaattccatggactgtatagaccatggggacataaacagttggacatgactgagcgactttcactttccttatttataagactgggattaaagtattctgtgtaggatttttgtaaggatcactgagatatagtatttaaacttcatataacattatagccagctgtagctgtacccatcaagcccacattcatctcctactgacttcttttcttaccctctacttctctataagcaatacatataatacgaatctagccaaaaagaaccagcttcctctgtgcttttatctgagaatttaatttggctgatgctatagcatcagactggatacccttgggtttgaagaacatgtgttaagtattcttttagcagtctgccaaatcgattcactgcatgttttggaacactagatttctatttacctaaagtaaaacagatcaacgaatcatctctaatcaa

SEQ ID NO: 62752 - DNA, 921 bp, Bovine  19866880378451
aatggacttccctggtggctagtggtaagaatctgcgagcatgtaggagatgcgggttcatccctgggtcaggaagatcctcctggagaaagaagtggcaacccactctagtactcttgcctgagaaatccatggacagaggagtctggcgggctacagcccatgtggtcacaaatagttgacttagtgattcaacaacaacaataacacagttcttaaaacagtgtatatgtgctagctaagtttattgtcattttgctgaagcaccatcaatcacaaaacttgacatgggggccaaaataggtatttttcaaaattgacacttttgtagagagtcctgtgtggaggctggaagatgaactagttgaactccccaggttttcttagcaataataggcgcctgtgaaaatgctgatttcaatctttgttaccttcacaactagttattgaactattcttggctctcatatcccaggttctttatagagcaaactgtactagtgctccatataatctccaggcaatttgagtacattggttaatatttttgaaatcctcaagtgaaaggctcaaagcgtcttttcaagaacacatctctgtgcatctcttctgctttgagcgccagttatgaaactgaagctgggattaaactgtagaatgtcagcaaatggtttggagtcttctggagtaaattcttgcactgtaagcacttgtctctaaattattttttagaaaggtgggagggagttggctcacatcacccagggaaggcaattttccatgaacactgctatcccaatgcacgacaggaaacttattgaaaagttagtgggttggagaaaaacagtagctagctcgacagagagtgtcaagagaagacagggaaagaatgaagagggcacgacattacccagagagcaa

SEQ ID NO: 62753 - DNA, 842 bp, Bovine  19866880379942
caatgatacattctattactaaataatatgcttaggaagaaattctctgacaggtgacactaaatctagattcattcaagtcatcactaggagcagaggaaatccttccctttcccctttcctgttccttttcccattttgtgttaggatatttcctaaagaaaactggattctctctgtaacatcttttcttctttgcatgaaatagacgtggggaagttttggtaattctggtatggacttcaaataattacaatagagaagctttctcaggcacatataaaagtcttataatttgatagcactgctcatttaaacactccttccaccaccctaaataatatattttaattgagctgcactaaattttcatattttatgtttgattccttattgcttaatgtgattttatgaggcatgaaactactattaggaaatcctaggatggaaacagatctgcttgtgcctaggtaggctgaattttagctctactacctgagtggttaaaattacctaacttggaacaagatagatgttaaaaattaattttccttgggaagttatagctaaaaggggagttacatacatgtgtgtttccctcacctctctcccaaagctgtatagatatacactgtgttgctttttttctgaaggaaaacggggaaatggtaataacccactttaaagtttggcattttccaaagttcacctgggtcaatctggtttagttttgtacttattgaaattaaacatgtacattattcactaacatatatgtaatatgtacatactatatgtatgtaatatatgcatgtatatatgtatgtatggccgtgctggaa

SEQ ID NO: 62754 - DNA, 1480 bp, Bovine  19866880415458
catttacaaagcttgtccttcaaccatctccaagcagagcagttattttttaaaagaattcttcactttcaagggatgttggttgcattttatgatcatatatgcctattagttaaagaactgtcaccaaatctcaatgtggttcttccatctagagtaagaaataattacatttattttttctgtcctgtgtaaatatttcttttttagctgcctggatgtacactggtttgtcccccagacactgctgttctgtccctcagtgagcagcaagtgacagaaaactttccagtgtgcctggatgttagcagaaaatgtttaaaaatgttggctttatatatttgtcccaaaacatgagtgtaggttattctctctttctgttcctttggtttcctttcagagatgccttatataaagaccagggaaggcccaggctgaatccgctcgagttcgtgcagccctcaacaccatcaggatctctcttgccccggaatgaggagttcattgtgctccaagacattatgttgaagcccttaactgtgaactctcattcaagatgctagacttgccagttagttacacagaaactattctgtctgggctggaatgtggcagttaaggaagggaactttgatcttcaagataaagtggatacagacactagcgcactgtggccatttcaccacagctttaatttgtatagtttttttctcactttaatctaagttcattaaacctgtatctagtgaatggtgggatggcacaaatcaatgagtattttgttaggaaacattaaggacagccaatgcagttcatcccccaagacctgcccacccccacccccgaccccagtcaagaattacagggatatttagtcatgtcagttagttttcttttagaatgtgtgccagactttaatctctggatttgatatttatgcggttatttatttaatcttttaaccctgtcaaagttgttttagccagctctaagatggcggtaaccataacaaagtcacaacatctatctttattaagcttttactatattcctggcaatgtgtttaagggctctgcttactgtatctcatttaatcctcactagtacctgatgtggaagccatcactcttagcatcatcatcttcctgttagaaataaaaataatcaggtggacagagagtcagccatgacccgaatttgtacaatagtgggtaagagaaaacacagggctttgaacctgggtatttggacttgggagccctgttcatctggctgcctggctcctcatttgttctgtggtttggggcaaataagcccaccttcaggaacttgtttcctgatctgtggaaaaaaaatgtactcttgtatttcagcttattaaggagaccaaattagcatatgtaaaaaaaaaaacaacaaatccctgtacactttttaagaaatatgcaaatagatgagatgattttaatggcatcaacac

SEQ ID NO: 62755 - DNA, 1150 bp, Bovine  19866880532499
tgttaacggcatccaagtgtcagattcccctaaggttttgtgacatcctaggaatgggaagatttggggctcaaactatgtctgtgtgattcccaagttagttcttcataatgaaggagttgttactaatgtcacagctgactttagaatgaggtagtttattaggtagaaggctctctctgttcccatacttctttcacatcaacttcagggatccagtcacaggagacaggatttaccctaccgtgtctgactaaattatgaatttcttgagagtatgcatcatctccttgaaaactcctagtatattgtctgaagctaaaatgagctcaaataaatactgggtaaatgaataagtgaatatgtgtttctggaagtattaacattttatatcccagtacctgtatgcaagttttcattaagtggaccccttgatgacctgtatcacattcacctcacatgcttaaaaaaaatgatgcatcaacgcatcccagatctcatgaatcggaatctttgaactcagtctcatgaatgtctgcattttaagaggtgatgattccaaagctatgaagttggtaacatttgcagggggacaaataagcttagcaaaaatttcctttgggaaacgggaagttggagtaagcctcaggtctcccctctttggacaggtcttacaaaggggtaaaggagagtggaaaagggaatttctatattcacatctaacctgtgcccaagctgataagcagggtggaatactggtagatttccttgaggtattttttaaattaattatattaatatcttaattttgagtacaattgatgtattatgttttgttagttcaggtgtatacagccaaatgattcagttatacatatattcatttattttttagattctttcctcacataggttatcgcagaatattgggtagagttccctgtgctatagaataaattcttaatggttcagtcaagttcagttcagtcactcagtcatgtccaactctttgtgaccccatgaatttcagcacgccaggcctccctgtccatcaccaactcccggagttcactcagattcacatccatcgagtcggtgatgccatccagccatctcatcctctgtcgtccccttctcctcctgcccccaa

SEQ ID NO: 62756 - DNA, 1588 bp, Bovine  19866880618471
tttgggaaaattagaaataaattggaggataatgtgggaatcattaaatatatttactaagattttataaaaagtgttttagggcaaaaaaaaaaaaaaaagaggggggggagggagaagaaaaagaaaaaaggtaaggatatgggaagaagggaaacagttctaatttcagcattaaatctagttagcaggcatgaggcaaaggacagaaataaataaccaagttttatacaaaaggaagtcaaaagggtgtccttgcatttaatattagaagcagcagttgcagtatgttaataacttcaatggaagagcagagtagccctgctgaaaaacaccagcatgtttctgcttaaattagactggatccctgtcttaggtgtaatggccaggtttggggaaagagacttttgtctgtggccacctgtcacatttgttgaaattcactatcaggttcaaaattgcctttcctaggcaagcaaagaaagcttgctgaatctgagccatccagcccagtgcattcacagccgtgaacagcacattgaggaagacacaaaagaagtagacagaatctctgcctctgcttaggagcatgcaatttagttggggagacaaaactaaacactagaaccaataaaagaagattacaaagcaacctacaagtaagtgtataataatatggcacaaatgacacagataaatgcagaggggacatagaggaaagaggagtgagccaaacacaacagtgtcagattagttagggaggcatgttgcctaacagtactgtagcttctatgtccctttctgtatcattgatgaggaataacgtgggataggaaattcagatgttccgcattgatctctttctccttatctgccgagtctgtctatcacagatggaaattaaattgatccaacaatttactctccacaaagccatgttggtttctacctagtaatttatgcttttcttggtgtttgtaaatcgattgctattatgggatgcagtcaaatctgggcctggatccagtaggttgggggattattggagtggatatgtatgtatgcacgtgaaatcctggaaaaatggactctagtttctgtgtatttttactcattggataaaaaccctttcaggtttttttaaaaaagcatgtttcactgcactcaaattgcatttttagggaatatgtctgatttgtttcatattgctcctgacaggcccagccttcaagtcaccttcagtggcgttttctccagaccttttgttttaaaaaagcctttccctaccccatgaatattacagatctctacattttttttctctcgacaaagaaatatatatatacacacacacacctatctacagatgttcatgtagtttaataaaatattgctgctgaaaggcttaggaaagtatgctttatttaaacacttgacttcattgttctaccttaaaaaatttttttaagtccttctgcggattgtgaaattctttcaaaacaaattaaaaagaaaacattttctggatttctttacagattctggacaatcaggaagtccaagccacaatgatccgccaagaatcctc

SEQ ID NO: 62757 - DNA, 2581 bp, Bovine  19866880651101
ttcgttctttttctccccctgccctgtaaactctccgagatatcttgcatgtagctgaatgcctgctgcatagctgatgctcaatacacatttgaggggtaaataaataaactagcagagtcatcctaaacatgagaggaatgctgtctcagagatgtcagggaagacagatgagcatctaaagagaaggacacatagtcaacataagggtgatgatatgcctcctgtctcagtcaccttagctgccatcatcaaatactatagactgggcagcttaaccattatttcccacagttctagaagcccagaagtctaagatcaaggtgtcagcaagttagttttcattctgatgcctcttttcacggtttgtaggtgactgccttctcatggtgtcctcatgtggcagacagaacaagcaagatctctggtgtctctttttataaagacactaatcttattggatcttaatagacttccctgtagctcaaatggtaaagaatctgcctgcgaagcaggagaccagagtgtgattcctgggttgggaagttcctctggagaagggaatggcaatccactcctgtattcttgcctggacaattccatggacagagaagcctggcaggctacagtccgaggggtctcaaagaggcagacaggactgagtgactaacacacacacacacacagtcttattggatcaaggccacaagggtggggccgggacttcaatatatgaattttgggcatgcacacaagttttaagtccataatacctccctcatgctgggtactatttgtagtttgtacatagatagatagataagtagatattcctagttgaaagtataacatcggatccatagtggaaagtatgtacctttgctctgaattctgatccaaaggacgttgctgggacagcccacatatatacctagtcacagtaaggcagttctgatccagtaatttttatgactgatcctgcagagttgctcatgatatccactatatctgtctttttattcacttggtgatgactgaatgtgcttagactgtagcttgaaaggaatttcatgagtaaaagggtgttaggctcaggaatttagggagggaatttatggagcctgatttattttaaaattagatgattatctgcttaggttgctctaggtgtggctttgccttaggtgtggggatagcccagatttccttttaagtttcttactggctttcacatcctctggttggaatttaaaaattcttatttttcagaactatttgaaattcttgtcctctccatctcctagaaatactgtctgttgaaaataaggcatagtcaggaaagagtatctctatagagttgtagcagaagacataacagaatctttgaataattaatgaaaatacttgtcttattctataatggataatactgagacacataaaaactcattgctgatcatttttatttttctgaagaaaccgataatgtgtaatttattctcaactaaatgctcctatgtacacagacattagcagttcctttggtttctctattttgataattatttaacctcttgtagttactttctttattcttaataacgttattattgggcatacacttttgagttttgaaaagtcacttaagtatagaaataaccttctctggatataagaatggctgttgactgggcggatggaataagtccagggtatgtgatggatcatgtctcctagtatcagagagggaggaaaaaaagcatttgactttttgtatacaacatctatctagtcttagtagaaagatttgttggtttttttttttttttttttggtctatttaaaatgggcatttctatatttctataatgtttgctgggaaatttgtttccctaaggccggaagtctgggccagaggcaaaccctttgaagtgtgtctcctttcttcctttgtacattaaaataaatcaaaacaaaactctaatccctttatgatacttgacagccatggactattgttctgtactgcatcagcaaaatcactctttcgcacttgaactgggagctttttagggttgcctctttacctcctgcctgttttaggggcagagacgtgacacaggagcaatactagtttctggggggtgagtacttgagtgtagacactgatacttgagctcatagcttgcactgttcgctttcacttttcacggaatgggctgctccgtttgtctaagactcactttcccttttgctctccctaagctcttccaccactgagatccataattgttctccataatgaatacataacagatcctttgggtgaccggagctgtaaataggagggatctgggtgacaaacctgtgtatggccctcagtgccctttattgtcaccagtgctgaatttcatatatatgtatttctgaggtttcagccaggccacatgggaagctgtgtccctcttctctccccctgcccccacccccatctttttggaatgagtttatgttttaatattttaaacacagttttttatccaagtcaaatttaagtgtgaactgactaaaaatcagggat

SEQ ID NO: 62758 - DNA, 1793 bp, Bovine  19866880659878
ttgaaccctttttttttttggtcttttttttgtagcattcctagagttatgcccaggttacctttgtaattttgcctttttcttccccctaaactgtttccaaaatttgctgaaaagctgtagcctcagggacacctctgcttttctgacatgactgacaatcactccggtaatgtggaacacacgttctgtgagagtttgcccatagccttggattccaaatttgcaacttcagcatcttccattgaaaagaaacagcatgttttttcttaaacttcccctttgcttccccttaaaccatagtcttttatgacagtaataaggaaatgtggttctgggtataattgccaagaggcaattgcaccccagaggactggcagaattttcttttctatatctgaaggctgggctccatcaagaagctccatttgcaaataactcaattagaataatcacaacaatgtctttatttttgtggcagctttccccatagagatcaaagtactttggagacatcctatcaaattcattgttgtaatacccagtggactaggataaaaaagttttattatagtttgtttgaaataggtgattgaggcaaagagagggtaagtaacatcccagaggtcacaaaaaaagtcagtagggcatgcaaagaattcaggtttcctgttactctgcaagttatcaagctacattctttcctggccattggaaagattgagaataaagaaaacctcttttcagattgcataacaatgtaggtgaaagtgctttgaaaattgtaaggcattgttgctatctttatcacttagtacaagtggaaggtaagaaagagcctcactgtcaatagctagctgttccaactcatgtgacatgggtttttacaaattcttggttgaccgggcccaaattatcattcatctccatcatcagtgaaagactaatgaaaacttacatctataattctgaattaaataatgcacttaaacattttatagctcgttacagattcttaaactgcctaagttccgtgggatcgatagcaaactttgaatcagttaagaggccaatgatcaaaattgctatggttggataaaccacctaacgaagagctcatctgagcgttccgactttgcttagagtttttactcatagattctatagtcctgagggtgggtctaaggaatttcagccctattttttaatgggaattggagatttgggagtaaaattgctgctgctgctgctgctgctaagtcgctttagtcgtgtctgactctgtgcgacgcaatagatggcagcccaccaggcccctccatcttaggggattttccaggcaagagtactggagtggggtgccattgccttctccgtaaaattgctactcatcttctaatctaatttcaaattgctactcatctttcgatctgatttcaaagagccttggaggacacaccctctgggaaagagacacaattaatgtgatgttcttaattattattgtttgcctagtgattaaagtggcatattttggtgtagctttataagtgtcctctgtactggtattggggagggtcaggagtggtaggatatcctcctgtgaacaggattttcttttcccaaccaggagctgaaaactcagaaacatcccccagttatcagaccttgccttataatgggaaaaatgagaagttaggcataagacaaatacgtgatgttttgaagctctctctttgattttcaaagttctagagtaagttccgagttcttccctctaacccacataaatg

SEQ ID NO: 62759 - DNA, 1171 bp, Bovine  19866880661071
cccacaaaagctacagcagcgccaggggtgatgaagcagcaacagacccaggtaagatcccccgagacctaaagatgtctggggcctcccaggcctatcactaaggggttcaaacctctccctgtctgtagggcacttatggatgagcatggaggatacttggtggtgggggttttgatttgtttccaagaaaagggaaaacaagaaaggagggggaaactcaaagggaggaaaaaatgagcaacagagacatggggtgctcagtatggggtgcttagtggatttggctttgactgtcttcttaggccttggaaccatgggtgaaatggctgacatccccccaacctcaccccacccagaactctgcttcttgtgcagccaataccagggtcactgcaagtcttctcgagatgaactctaagagagccttttgtaaagagggactggggtggggggacaggtagagcatgacttctctcagcaggacacttcactgtctgtggtttcagaaacgcctttctttcaaactccaggtagagaaaaaaaaaagagaaagtgagtaggtacatacagtattttagccactttcccttttacccagcatttctgtggcatggcattaagagtggtttgaaagtatctctgaaaagcatctgatgctatcaaagtgggcgaaacacttcttagactggtacttacctctcctaaacttcttctctctctcatactcactgaaagagttaaactaatttcattcaccccaaaacctggctggaagaaagaagtgaaaaccttctgtagcaacaggaaaatctgatatttcagaatccctaaagacctcctccctagatcacctattccctgccatcttatagagaagaagagttcttttttctgacagtttaatttcaagaagtgctggagtgtctgttcttcaggtgactggatttttcaaaactcagttgtatatttgaaaaagtaagcagtattacccaattggagcctttcactgacctccagagaggagcataacatctcaagggtcttccaatactgatttccttttaatcttctcctttctaaagaaattcagtgacagggtgtgaatcttgagtagtttaagggaaaagttcttggagcttaacaaagctggcattttcaatacactgga

SEQ ID NO: 62760 - DNA, 1940 bp, Bovine  19866880702091
ttaggaggactggttcccttagcaatgtgtgacctttctaactatatctcttatctcacgcagccttccactgtcttctgctaaaaccaggccatcgctctgtttcatgttaaagattgtcctcgattctttcccagatttactagctggagcataatcttgctaagaacagttttgtcctcatcttttatggatactcttggtatggatgctcttgaccagatcagtgtctgcatatgccagcttctgagaatgttcactatccacttatagctgtcccttctctgtagaatcccccttggctaatgggaacctctggactatggaagatacacccacacaccacttacagccaatggctagaaaagtcagcccttctctcaaggtatggccaattctgaagttaaattcatgctccagagtttgtcataggtttggggtaaagtcagactccagcctagtttactgatttttgcaatatggttattaaaatatcagacttgtttcagtacaaatcattgtaccttaaggttagacttgcaagactcctagaagctgaattcagaggagtggggtgtgtttggttcttgacctttttcccttcctatctcaagctgttatgatgatgagggagttaagtaggtaagggtaagtgaggggaattcactcttgattggcagcatattggagatagcaagctcgccatttttgccttgttgttggcagatgccttacctgggtctaacttctcggtattggtaaccagcttccagttatgcagtgtggtgtcttcggtggtcttggatgtccagccagaagtctcagggggctgatgctgtgtgagcggctcttggtaggctctctgtaccctccttacaccagcccatcacgatcagtatgagccgctagttgtgcctacccctcatctggtgagcttggcttagtctgtaggaaacttgcctcactctgagtgaaactgggaggaagtggagagcaaccttaacatcttctgactaccacctctgtctgaagatctaatagtcaaatgcagcaaaagttggtaacattcttccaatcccaataatgctttcagtacactgactgattctctgggggacatctggcttggttgggaaggaaagaaggaagccgaactgtaccccacccatcccagttgtacagaagacagagtaaatgctgattcacaaactttaccccaaaagatggttcttcttccactctctacccactgcataggaggttgctttattgattcttctcaaagtcctcattcttagaaagttgtacttgagtgatgtcaagtatcattgttgttcagctaaatcgtctccagttggtaactccattaggaaggggtctccatgcatacagcaaccttatgttactaacttcttaactggtacacatgatagaacttcttgtccttcccatacatcctttctattatttctaagttcagcaactctctatggtcaaaaaaaatctccttagactggtctctaaagtctttgacaacactgacccaaaacaattgtagttttggctcctaccatgagctcacccaatgatatgggcctattcaaagaagttttactctatcacgtctctggggtgtttctcatactgtactttccatctgcaatatcctttaagtttgactgaaaaaaaatctctattcattctttaggtcatcctcaacctgtcctcttctccataatgtcctaccccttccttcagtaggaattaatgctttccatgccattcacattatactttacttctctggttctgccttattatactgagagattgtaagaaattgtaaagcgaatgtgtaccttattcaccacattttcaccacgaacctggcaaagtaccttgaacctagtaaacattcaacgatatagtgagactgaaat

SEQ ID NO: 62761 - DNA, 1168 bp, Bovine  19866880735351
aagcagggagtcttaaccactggagcaccagggaagtccctccacaatcaattttagaacatgttcatcacccatggagaaacaccttcccattagcaattactttccatgtactctctaccctaagtccctactccactacaatccagttcctaggcaactactcatctattttctttttttttatggattgcatattctggacatttcatgtaatggaattgcatattttgtgatgttgggttgcagcaaaaaaggggctcagggcagagagtgactgctaatgggtatggcattttctgtttctcagtggatgatgcccatgttctaaaactgattgcagatatggtgacacaatttgtgaatattctaaaactactcaatcatatacttaaaaatggtgaatttcatggcatgtgaattaatctcaataaagttgttattttattttttttccccactggaaaataattttattgcgattctaccagctatacaatctgttttattaggccccttcttcctttgcaattcggtccttcttaagtggtcccatgaaggctttcttctcctccacagtctggaagcgaccatgaccaaatatggaggtggtgtcaataaatttgaggtcaatcttctccagggcccgccatttggtctgtaccagcaaggacttgagcagagtgagcactcacttcttggttcccaccatgcagcctttgagcatgacagtcattggtcacctcaccgcagtggacaaagccacccagagggttgatgctcttgtcagacagatcgtaatcagtagaggcattgttcttgatcagtttgccgtccttgatgaggtagccctgacccatcttgtagatcttcttgttgatctcagtgcggtgatggtagcctttctgcccagctggagccacagagaaggccacccaggcaggatgccacgccccaatacaggcaaccttgcgcagccctcaatgggtcttacagggcagcttcttggtgtgccaacggctggtgacacctttgtagccttggcccttggtcaccccaatgacattaatcatctcatcctggccaaacacttggctcacagggacctgctgctcaagcctctcgcgggcccagtccagtttctcggcctctgaacagtgcctccgtt

SEQ ID NO: 62762 - DNA, 2711 bp, Bovine  19866880740241
ctgggcagctctccttagggttgtgttaaggggagggtctagtctctccagggccagccctgcacccacataaaactctcagcctaggagactggactggggctaaccctggctgggccttgaatttcatcccctgtgccaaccaatgacaactctttttgtcaggaaatcatcatggtgccaactgcacccaaagaagagcctaaactatcttttcccacctcccccccacccacccccttaagctgatggccttcccagagtgttgatgtatttttgtttcctaatttaattcctgtattattttagaactttttcagctgtgtctggccctttccacctaccctttagttgacaacttttagcaagggtctctgatgaactcaagcttaagagacctcctttgcaaagtgtgtagctgagttttaaaaggtgcctcggtcactttggagggggaggtgagccctgctctgtcctccccatagttttccaaatcaactggcctgtaccttataattttacagatgaggaaacaaaggctcagagaaggtagttgacttcctaagagcacacagtgagctgagagcagagtctgcattatactccaagattcttgattttgaagtccgtttgctcagttttgagggtttgtgatcgctaaagtaaactactgttcaggaagcatcaacttcgtgccagaccacgtgcatgccagacactttatgtaagtcatcactacagcagttctgaagagcatcattagccccaataaaaattttaaaatcaaattatgaaagtaataatatgcataaatcaaaatacaaagggacataaaatgaaagtaaaagtctcccactctattcttccctcctgcccagaataccactgaccttttttgtcctttagtgactctcttccatatcgggcagaccttatcattactttatgaagaagaagccagctcacattaggtgggctggctggggctacctgtccccaggctcagcacttccattcttctgcattagctcaggtgagtggggagaaaatggaagtgaagaaagccagagataaaaagaaaggtcaggttagagttaatatcaccccttcctttcttctcttcctgccccatctaggcacttactcacgctacagtttttcaggagaccaaaccatggctctctcggtgcagatatcctgaggttcatctgtgacagcaattggacccgcagctctcctcaggccccggtcacctgagtactgcctccaaagtgctgcccctaccctgtactagctccaggactggagcagatgtcctgggcttgagactttcctgaacaactctgagagttgttctgaggctaaaatgagaggcagggaaaagactctgtaaacttgaaatctttccatgtaaatagagcagctgcctttcaaagacctggataggaaccctgcgccctactcctgtagaacagtggatttttagggatctaagggtttgcattttgtctgtgttctgtctgtatgtaggggcagggctacaagtgtgttttaaagtagaaacggctgtttttttatccctgaaagatgacaacactgagtctttggtatctgggtggatttctttctactggagaatagatacagccaagctgttgagggtaggaggaggcagttgccttgcttggggtgcacagtggagtggtaagaggtgtggctgaaaggatgcttcagctggtccccgtgggtaggtgtcttcctgcaaaggctgacctgagattgttcaggggcaggaagggtggtgaagctgaacactgccgggtgcggggtcggggggaggggccacggggtgggggtcattttcatttgtttgttattatttcttgagaggaaggggagggctattagagaatgaatttaataagtcttgcaggaagctagtcttgtctttgaggctccttcattctggaagaatctttagaaacatcctcaactgaggggcctccaagtgacagcaaatgataagctagggccccggtctcctaagctttgcagaggaagagcagctggggttgggctggtgcctctgaaaagcccttttagaaacttgcccagagtccagtaacatgcccagatctgagatgagatggagggagactgtgagcatcagggaagaagaaacggttttaaaatgaatgaagcgggccggggagtgggctggttccagagagaaaccatgaaaggagtgaaagttagattttcggggaggcccagccagctgcatagcctgctttcaatgcctgtgtcaggacaaaggatgctgcgccccctggtggcagactggcggtcggcgcccgcgcactgcggcggagaccggcgaccagacccaagtaccagctgaaaaagtcggcgggtcagatgccttttcttctgtttgctaagggagttgaagttgaaatagcctttgctttctcaactctgcagtctaaatagagacgttggtgtaaagtgagcgggttttgtaattctggcatgcaatttaggccgacaggacaatgcctgtttagaagaaacctagtggggtgggaattgccctggctgggagaaaagatcggcatttaagcgcagagctggtctgaggagagtctttaaaaatttaagaacctccctttctcagttttaacacaaaaggggctacagtaagatgtttt

SEQ ID NO: 62763 - DNA, 770 bp, Bovine  19866880810798
aagaatgtacaaacttcagggattcatgaatacagtccttgggctgaactcagcttaagcgtctcttttccttctgataataagatgttgttaataaataatcctaaagtctagaatgtctttagtagaggtgtgtgatatgcattcagtttgaaatgagctaggtgtatcaaaatttaagaattacatttaattgaccaggaaattgtaaacagtggtatggccttagacaaatcactgaatgtcagtaaactgagttttttcatctatgagatgccaaagttggatactaaggtaacagtgtgttctaatgttctggattttaaattaattgaagtcagagattttatagatatttaatatttgagtctttaagctttcattatcctgaatctttttgaaaactctgaaggttttcaatttcctaaattattttttagatgtttgttttaaatattcttattgaataacatgataattggctctgtaggtgcttggaggcatcatatgttttgccttatacctgaggaatgtgcagttcttacaaatacatgccttgtcctgcaccattctggtacaacaaatgattgagagagactgagctattataacagaaccttgttatgggatcagtgtctcctactttgaaaataaatgactcagccagacggcaacatttattttctctaaatgactagggatgtagcaataggagaccattatcctgtgacaatattctgtttcattgacattatctcacaaatgtaatt

SEQ ID NO: 62764 - DNA, 1071 bp, Bovine  19866880849837
taatttatctgaggtcaaacagctaaagactggagctgggcatgctttgcaaacttagaaatattgcaaaacatgctaagcagttaattttattttactttttgctggaagcaagtctgcagatagtatggagatgaaagttatctgaaaaacttactttagtcattctcgttaactcaaaagagatgtaattctttctttcttgggtaagagggtaagttgattagtaacattttttgaacttctcatgttaaatcagctgattgaaaatatatccatccagttgcatatatgtgtatatatacacatttttggagtatagttgatttaaatgttatatcagtttcaggtgtatattcagttatatacatgtggtatttattttaactttgttttcttatttatttggctgtgccggaccttagttgcagcacaggggttcttctgtctttgatgcattgtgtgaattctttgttgtttcttgtgggatccgattccctgactagggatcgaaccctggccctcctgcattgggagtacagaatcttagctactggaccaccagggaagtccctaactttgttttctattataagttcatttaaaaatagcccttatttgtcatttcctctacagcctggcttttaatataataaagggcatcatttaattggaaagagaaacctgtatatatttttagcaattatgtggtgtagtgcttttatgtagagttgtatacttaagacacacacacaatagcaattcctgaaaatattggctcataattgctgcactcttatggatgtattttcatatataattcaggaaagaaaaattattgcatatgatagatagtattaccacataaaactacagatttgtgtatcctattttagtgcattgctaattctcaagagatagcaatacagtaatttctaagaagccagacagtttaattttgctactggtgtcaggttaaagcattggcatatatttgcagctgtagctgggctccatctcatcctttgcaggacaccttgagtagcaaggatcaggtcgggctcacccaga

SEQ ID NO: 62765 - DNA, 1988 bp, Bovine  19866880861987
ttttgtgggtttgtaaaaaacaagaaccaagaaatcctgtaccttagggacactggtagaattggcaaaaaccgactggagacagagaggggtgtaaaatgatgaagaaagcagcaactggggtcagcagaattgaggtgagagttttgggtggctggatgaactgatcagaagcttctagaagcactggtggcagctgctctggaaaagtcatttcctgaaactgaaagtgatcttaattgatgcagcaggaagcttaatggagaaatctgacctgcagattcatggatgtaagttgtcattgttcatttggtcagtcatgtctgactctgcaacctcatggactgcaaacatgctaggcttccctgtccttaactatctctcagagttggctcaaactcatgtccactgagtcaatgatgccatccaacaatctcatcctctgtctcccccttctccttttgccttcagtctttcccaggttcagagtcttttccagtgagtcagctcttcacatcaggtggccaagaagtggagtttgaacttcgggcatcagtccttccaatgaatattcttggttgacttcctttaggattgactggtttgatttccttgctgtccaagagactgtcaaggggtagttatatcgaaatgccagcttttgcaggtgtagtagttctagagaagcagcttcctgagagagtatgtttcttccctgatgtggtgtgagctgctggtaagaatcgagcctgggatcttcaggcactggatgcagagggctgacataaatggtaaaggaactctccttgaacagttagggagattattcctgttcctggaaggatgtagcctcgcagctggtctgatcttggaataacagccttaccaggaactcagggttgaaacccattcccctacctctgtcactatgaccttcaagcccatcacctggaagtctgaaatgtatcctctaactgaagcggagacaaatcctccaccctatttctgagggaaatatcagccctggataggcttcttactatttcaatatgagaaactagagggaaaaatggatcctgtaaataattctgaatcataaagaaatgagcatatagtttaaataatctgaatcttaaatctgaatgatctgaatcttaaatattttgagtgtgttctttttagctttcctttattgtaaatttaaatttttgtctaagtaatgtatttagtgatagtttaaagatttataattcccctctcctttcctcctttgccaattctcattcctctaagtcaagcgcctataactcttactagctgcgtccaaatgtaaccaccacattatgctgttcatttttaaggtttagatattatttcctattgttggatataagttctttcgcccacatctctcactgcagtcatagcagtgctttattaaccaggattcacactattctgagtatgtaaataatgttcaccgtggagccacttttgtatcgtttgtattcttttcttttttgtacaactttgtgtttcagctagaggtaataattaccttctttccgtttatttgcttagcatctatgtgtctatgattaagttatcactaaactctccaaataaaaagtaaatctccttattttaggcaagtagttttggcacagggtttctggtcactccattctcctgtccccatctaggttccttgtacagttgtcatcctgggctccccctctaccatttttctggatttcccatagtttctaactgtatgggacttccagtttcctaatttccgtttctatctttcatggtttatgtctatgttttgatggagcacacccacaaatgacttcttgcaaagaacaagagagagcattttttttgaggcccagagagtctgaaactgtctttatttggcttcaacaaatgatttataatttggctggaatgaaggttctgacttgggaaataattgccgaaag

SEQ ID NO: 62766 - DNA, 1538 bp, Bovine  19866880927189
tgttgaacttgacttaaaaatcagggtatctgctcttttttgtcagagtagtgaaggagaatgctgagagaaaaaaatctatcctggaagagattttctgcacagggaagaactgatggcaaccatttcttcatgctcatctttgagtctgcagcttttgtgaaacaaatctcctcatgccatacagaatgccatcgaaacatcaaaacacttaaatagtattttaaaggaaaagcctaccttgtttaatggtagtttatttagaggctgcacaaataacaaaatcatgttataggttaaaacaaaaagccacggcaatctaccctatcacgcctttccttttaggggaagagggccagatgtttaaacaatattgcaagcggtgtgcagactgcagctcttagaggccttgggaaagaaatcatgtctgcacccctagtgtttcacagttttagacccctgacctagaaacagtttaaacagatgtttagttcaagggatttatgtcgacattgaaatttttttcccctttggaaatggctgcctctaaaactggagctttttcttagaaaaaggaccagagaaacaaggacatctcacaacttcgtagtttcatgttgcatgtgtcccggtgcaacagaaacagaacaaataggtacaaaccacctcatcagccactactgttcatgtgtatggacatttttgtagcccccactttcagttctgtgtaggtgatcacagacttgcaacaagaagtttgctaaagcaaagaagacttttggaaaacccctttggattatgaaccaactgaaattatagcttctcttcctctccttatttccttccctctctcccttccaaatcttcctttacctcttctcccagaaataattcctttcaactttgatcctggtgtgtggagttcattccatgacttgggtcagtcaggaacagtgcattgcatcatagctgcctttatgaaagtgtttatttcatatctgaaatgttttcatgtgcattcgctctgctttgacttgcagaaggggaaagaaagtagttttactggaggcaaaacagccacctgtgaaaactaattgcgtaggtagacgtttgatggtatctctgggagggacccagcaggaagaaagtaaatgttcttaatctacagggaaattacctgtgtgccaagctgaccctcttcatcaaagccagagttgaaatataccatcaagttggtggcctctgtttaggaggccgaggtggggagggtgacaagaaggaggagtcctggaaggtggatacagttcttcgagatgaactgaatagatagaggaaaaatgacaaatgtgatatactcaactgaaccacctcgttaagggctgacatgtgatgtgaatgttctgtagtcactttcaaacaaaaacttgagatgtggttccttctttcttccccttcatcaagttttctttttagtcttaagttctgctgtcttggctttttaaaaaaaaaatctttcctctccttgattcatcagtcta

SEQ ID NO: 62767 - DNA, 2630 bp, Bovine  19866880930116
atctgctacctgatcggtcgagtctaaagcctaaaacatagggttggcaacatgcaaaccacccggactgcaaatgaggtgggtggttcctcaagagaacgctggggtgctattagttaagaaagagaaaataatagggaaaagacaaaaaagacaaagccacttcccatcattgtttacagacatattaatgatttcaggcttagaaaaaaaatttagcagtttgaaactgttacaggtattgtggctatgtgtagttcttcaaatcagtatctctacctaagataaaaatcagttttcacattctcacttttcttggttcatacaatctgtttttaagcctagacatatctatcccaaggcttccctgctggctcagatggtaaagaatccacctgcaatgcagaagacctgggttcaatccatgggttgggaagatcccctggattttatacccactccagtattcttgcctggagaatcccatggacagagaagcctggtgggctacagtccatggtgtggcaaatagtcagacatgactgagcaactaacactttcatatctatctcaaggcaataagcttcagaaaaagacataacccaatggtcttttttagagtatctttaaaaaaaaaaaaaaggttaaaacctttattgagacacaatttatacatcatgcaatttacccatttaaagtgcaaaattcactgttttttggtatattcacagagttgttcaaccttcaccacaattaattttagaacatttccatcactcccccaacaaaaactctgaaccactcaactgtcatcttccagtgcctgcactctgacctattccccttggtgaccactagttattttcttctctctagatttgcctagtctaagaatttcatatgaatagaatcatgtactaattgttcctttgtgactggctttttcaattaacataatgttttaaaggctcatccatgttttaatatgtgtcaatatttcattccttttttttgccaaatggtattccattgtaaggataaaccacaagttgtttatccatttatttagttggtggctgtctgaactgtttctcctttttgcctattatgaataacgctgctgtgaacatttgtggacaagttttcatatggacataattttcatctgtcttaacccagtggccttttaagttaaaaattttagtgaggtttcttatattccacacgctgaagggaactaccatttaggaatgaaatcagaaatgccacataccgaattccagttctcttagattttggatcactacctcaaccccttaagaatcctgggacgggttcagtccagaggaggactctgcttgccaactccaggatggaggagggtgctgtttgtcagaagaatgtagcaggtgactttgggcaaatcgccgagtaggtttgatagaatttcctctcacacccaaggcttggccttgcccagagaaggcttataatcattagtccatcacaatgccatttgggcactctccataagccaagtataaagaataataaaaataaaatcttagtctctgacctggaaataagagtcatggggtttgggacacttgcaggaaaaagggaaatttttagcttctctgatagaggccagtagagagcttcattttctcccatgagtgatgggaggagttctttccagttctgtcttgcagacctgggatgggggaaaaaaaaaacaaaactccatattaatttatacagcagctttcttccaaaaaattcagagtgtctcaaacagtctttcactcattcccctgagggagtttgcataaatgtgcatatgaaattatttcttttaaaatttacactctccagttagccagtactgggcagaaatagaaccagaaaagcagacctcctgactgaacattccactataatattttcagtgagcttctgtaaatcagtgcagagccttaaaaacaggatctctcccataatatccctgggactctgctccctgatgactgatgttcatttccacaggggcaaaattttcccttccaaatgagagtcaaccagcatggcgtgcaccacgaccctcaggaatcacaagtcacgggcttaggcccaccttgaaacaggcagcccagattccctcgcagctcagccctcctaacccaactggaaacctctcaagaaccttgagactggctcagcccaaaggagaaagagtcctgctccccaactgtgggcagaaaactgtggtctagccagtccctctcctcctgtcactgtcgtgtctccacgttgcttgtccagggagctggactacccctcagagtcatggaggtcacagtggggcacatactcagttccagtttcccagagcccaactaggtgcccgggtgcaaggctctgggagagcttccagcatcaggcatacacagggccagcctggctcttcaccctaaaccaaacacttaattcctcctcttggacctcttctcaacatattcttattttgaggttctgataactcatccctgaaaaaaaaaagttgtgttgttgttattgatgttgttagagtcacactagctcatgtattctagagaaggcaaggcacccca

SEQ ID NO: 62768 - DNA, 800 bp, Bovine  19866881000617
ccgacaggtccacttttataaataaccgctgggtaggaaaacaacaaaaaacgggccttggctttcgctcctatgacattatttgaggtttaataggcaagccgcacacattctgtgggatttagtcagctttatccacatgtgcccgcattccctgcacggtgctgtgctgtgtttagtcgctcagtcatgtccaactctgtgaaccctgggctgtagcccaccaggctcctctgtccatggggattctccagggaagaatactggagcggattgtcatgccctcttccaggggatctttccaacctagggattaaacccaggtcacctacactgccggcagattctgtaccatctgagccatcatgcatgcgtgctaagttgcttcagttgtgtccgaccctgtacaaccccatggactgtagcctgccaggctcctctgtccatgggattcttcaggcaagaaaagcagaatgggttgccatttccttctccagaggaacttcccaacgcaggaatcaaaccagggtctcctgcattgtaggcagattctttatcagctgagctatcaggaaagtcctccctgcatggcagtaagacattaattcgtttttacatctacctgggaggtttttcagttgttgcaagatttgcaagagtgcctccatctaaggggcagccagttttaaaaactgtggcaacccttagctctcagtaagagaccatttcacttcccaaaacacaaggtagaaaattaaaaatgagacccactttttaacctttcctttcttcagggagaa

SEQ ID NO: 62769 - DNA, 2368 bp, Bovine  19866881018991
ctgatagagttttgtctatctaatgccacagaacagagaagcattatagcatagcaattaaaatggcttccctggtagctcagctggtaaagaatccacctgcaatgcaggagactccagtttgattcctggatcgggaagttccactggagagggatagactacccactccagtattcttcggcttccctggtggctcacatggtgaaaaatcttccagaaatataagagccctgggttcgatccctcagttgggaagattccctggagaagggaaaggtaacccactccagtattctggcctggatggggttgcaaagagttggacacgactgagtgactttcactttcactaaaatggtggctctggtaccagtcttacctcacttttaattccaattttagcttttcctggatgtgtcctcaggcagattgttaaatctctgtgtttcagtgttgtcatctgttaaatgagggagggtggtttgtagattattatatgaatcgatgtatgtagcacttagaagagtgcctggtacgttgtcagtcctcagtaaatgtcaattaccgtttttactgttacagtgtagttacatacagtacctgcatcacagtgagcattcaagaacttatagctgtgatcatcaccatggcagtgaccagtatatgaaagacatttgtggtatttaggataagtaggcagactggttccaaataggaaaaggaatacgtcagggctgtatattgtcaccctgcttatttaacttatatgcagagtacatcatgagaaacgctgggctggaagaagcacaagctggaatcaagattgccgggagaaatatcaataacctcagatatgcagatgacaccacccttatggcagaaagtgaagaggaactaaaaagcctcttgatgaaagtgaaagtggagagtgaaaaagttggcttaaagctcaacattcagaaaacgaagatcatggcatctggtcccatcacttcatgggaaatagatggggaaattttggggggctccaaaatcactgcagatggtgattgcagccatgaaatgaaaagacgcttactccttggaagaaaagttataaccaacctatatagcatattcgaaagcagagacattactttgccagaaaaggtctgtctagccaaggctatggtttttccagttgtcatgtgtggatgtgagagttggactgtgaagaaagttgagagccgaagaattgatgcttttgaactgtggtgttggagaagactcttgagagtcccttggactgcaaggagatccaaccagtccattctaaaggagatcagtcctgggtgttctttggaaggaatgatgctaaagctgaaactccggtactttggtcacctcatgtgaagagctgactcattggaaaagactctgaagctggagggattagggacaggaggagaaggggatgacagaggataagatggctggatggcatcactcactccatggatgtgagtttgagtgaactccaggagttggtaatggacagggaggctggacttgctgcaattcatggggtcacaaagagttggtcacgactgagcaactgaactgaagttgttttaatccaattgatttaaaaagtaacataattatttaaaatgatgctcttttgcaaactaatatggaagtagaaaaagaatcattgtacttatagcttagtgtctagtttgaaaagtatgggacttttgtgtgtttaacaaaaggttaaaaaaaaagttgattgaaaatatgtatcaaaatgaatcatttttatatatggcaaaaccaatacaatattataaagttaaaaaattaaattaaatttaaaaaaaaagaaaaaaaattcccagttagagactaagaagctaaaatcaaacatctgttatccatagaattttacatgaaagacattaaaaaaaatttttttttaaagtaaatatgtaaaaaaaaagcctgtattaagaaacatgctagttatgtttgggaaattaaggctattgtttttaggaaaaactcagtgcaatcaaatattggatatagtcaggagatgctaaggtgttataaccatatacttacagccaaaatgtacctgtattattgaaattcctgtattcacaataataatagtaattttgctgctgtgcctctgaaatgcataacccttgatcctttcttttcccattgaagcatttgttctatgatgcatgatttccagagagttctcctattgctccttggcaaaacatactgcattggaggacatggtttgcatcaaaaaatgttatttttgctccaattaggggttgtaatattttatattgagccttctctggca

SEQ ID NO: 62770 - DNA, 1577 bp, Bovine  19866881038156
ttatatcttaagttgaggttaagtacgtatttacataaatcaactcagcactagattctgatacagaattgttttactgagagagagagagaaaaaatgaattgtattgcttcctgagatttgctttcattttatattaaacctcaaaggatttatcaatttaacatgttctgtgttaaaatgaactcttctgtgggttttgcttcttataaaagagaatgaaaagaagtttatttgctacagctggttatatagcttttgctacaatgggatgacttttctagaggtagaatgtaaaatatagtaagccgatatcatttagcaaaaatatcaatatatttttaaggaaggattcgtgttttcttatgggcagcacaaggactccaaaaaatttaaaaagttctttcagtaataaagatactgcagaaaggtaaagatgttttaaatttatggttgccagtatttaatgggagtactttttattgtgattcatgcaaatgtctttccagaattttatttcttttaaaataatggcaaagaatatgtctggctgtattggatgggtcatctattaattcatactctaaaacagtttttacttttgttaaaatatacttgtacatatttctaaatcataatgaaggtgttcagaatttggggataagatattttaaaagatatcttatcattgcaaatgccagaaatatataggatgagcaagagattgctggttattttaagtttattgaaaaacaacactgaaaacttgctactttcaatactgtgaaatactagcaaaacactactgactgtgaaatataatgttaaatgtctgactttaaattttaatatttttatgactactgaacagaatttgcctaattttaacaatgatagtttcatgctttcataaaactaggaaatgctaagtaacttcatgacaggtttttgttttcatcttgaatatattttcttcctagactattattagcattgctaaaatatccttctgtacctaggggagatattctgtctcctgggttcttgcaagtttatctaagatggcccaagtggagggggttgcattaattttgaacagcatagttttcttggtgggatggctttgtattgtgttttgctttgtttaaagaaattattattgactccttaagtgttcttcttgaggttccatattccctgacttcatctcattttgcaccatttaacgttagtgtggctgtctggccaaccactccttctctttcatccgttcacttgagaagataggatccatatttccagtctctgcaaggtggaagcatgtgttttgtccagctgagtctcttggtctggttttttttcctggtcctaatacatgtttattcctacatgtgacaaatctgcagtcatgttttctttctgagttataatgactcagatgtcataattaatttgatgagcaggtgggggttattagccttgtgcttcacttgctaatagctgcacagtttttctaaagtactctttcaactaaggaggcatttcttcacatagaataaacagtacggcacaaaagc

SEQ ID NO: 62771 - DNA, 924 bp, Bovine  19866881101031
tccctgcataaaaagggagaatgctttgcaagctggccgattttaagctccagttaacaaaaaccctttttgttggagcctaaaacaagaatgggttaacaaaagcaaggagggaaaaaaatcttatttttttcccttcttcccaaaatatagtattacaggacttaaaggttttgaaaggccacgatgcggctgaaagacttgagaaaggggcgaggtctgggccagcaacaacaaactgaaaagatcccaaggaaaagcagaacctcttatcagtagggaacgttatgatgtgattccagtttatggctgttttggtttcgtttttttttaacgagttaaaggtgtagagaccaggaaggtgccaatgttccctgtctaggtagacgaaacctagggttcatggatgttaaaaaagaaaaaccataagccacggtgggcgagtcaatagcgtgtgtgccgtttctgcatggctgcattttctcatacaagagccacttctggacaataacaagaccccggaaagcatctgcttagggattacgacccggctacactgagaaatgttccgttaacatagagcgaccatgggcttaactctgtgcatgcctggcctgcccactggcacacacacaatgcacaccgtggtcctagatgctttctgaagaagacactcagctgtgggcaccactcacctgctcaagggaaggaaaggaagaaatgaaagccgccacatttattccacctgatgagcattaagaaatggaagaccaaggctggcaggtgccaagaaggaagcccagagaagcagatcatgtctcagaggatgagggagcaagccccagtattgaattatttcctaagatggacatcacctgagaaaatctcaaattagaaatttaaggaacagaatccttcattcat

SEQ ID NO: 62772 - DNA, 1469 bp, Bovine  19866881110153
acagttctttagacataatttctttaaaaataaagtgcatataattttccacattcaagacttctctatttgtggaagattctgaaaatagaagcatctgccataatatcaggggctttggagctgaagcgtctgtccaaactcacagacaggtatttcaaaatattgaggtagtctccggcatagccgtgatgaattttgtcaggagaagggggccattttcagtcttggacccccacctggttttgcctcactgttgactcacatacctgcctacagcaatacacactggttttggcctgtgctaggccacgcaccatcaatggagtccattgttttccagcaaggcacctgcacaacaggctcaaacaatgaggccatacctcaagcccctcctttctcctcagggcacccaaggtgaaagaaaacttgttgaggcccggaagcccacttgcatcataattagactgcctggccaaatgaaaaccaccaccgtctctaggaacaattgccaagtttggggtactcgcaaagctctgggccaaggcagcgttagcaggacctgcgctctcttcttgcctctgaatgaatttaaagagtgaagactgagaactgccaggctccgcaactctgcccctgactttggttttggtttttacaagcaaacacgcacacataggctatcctcagacctgtgagctcatcatgagtggagctccataacctacctgcaccagggctgagccagagccaccgaacactgaattccacactatggaatgtcttgtctcaggaagtgacagtgctactacaataacaaagatggctcaatttaaaaatgcttatttatgacaataaaaattattcaatttattacagtctatggggtcgctcgatggacactgagtttgggtgaactccgggagttggtgatggacagggaggcctggcgtgccgtgattcgtggggtcgcaaagagtcagacacgactgagcgactgaactgaactgatggggtcacaagagtcagacatgaccgagcgactaagcgcgcgcgcacacacacacacacacacacgtataaaatagataaccatgggaatttgctgtatgactcagggaactcaaactggggctctgtaacaaccgagaggggtgggaacatatgtatacctgtggctgattcatgctaatatatggcagaggccagcacagtattgtgaagcaagttttcttcaattaaataatttggggaaaaattatcaatttgtaaaggttttactctttcactatcttatctatctgttggttcatttgaatgtaaaagacacaacacaaaggtaatgattatggcttttgcagtcaggcatacatgggttctacgcttggcccaccacatcaaggatgcatgactctggagtaaattgcttaatctctaattcctctttttttcatctaaaaatggggata

SEQ ID NO: 62773 - DNA, 2364 bp, Bovine  19866881236307
ctctccttgattcatcagtctagtatacccacgtgccttgccattgaaagggcaaaatggattgtgatggagaaacaggaatcagtgatgcaggctccctcttgttaccatctgagtagctctctgactgattatacgcaagtttagaaagatcaggtcccatggggccatactatgtacccaccggtaagtgtatgcctctgtgtgaaactaaccaactgagattggtcttccgatgacagggtctgagctctcttgtaagagtctgcgttttgctgttcaccctacttggcaatcagcagtagtcttggtactagatgttttctactcacatacctacatgttgccttagctgtgtagccagaaaagtttgacaacacgtgtctgcctgctggttcttgttcagtcactaggtcgtgtctgacttgtggtgaccccacggcctgcagcacaccaggcttccctgtctttcatcagctcccagagtttgctcaaactcatgtccgttgagtcggtgtctcatcctctgttgctccctcttctcttgccctcagtctttcctagcatcagcctcttttccagtgaattggctcttggcatcatgtggccaaataattggcgcttcagctttaacatcagtccttccaatgaatattcaggttgatttccttagtgtctttcctgaacggctgtctttcatgggaaatcaaaactctagaggagaggggaaaagtccctagtatttgaagcgccatgagatttagggagatttggagaaaagttagactatccttctgcaagattaataaaaaaaaattttagagaacaaccaggaagttttacaaaagctccataaattaaataagaacacgaattaaaaggaaagttatgtgatttttaaaaggaagcgttttgtgtttggaagactttggacacattccttaatgtgtggagtcctcagtcgggccctgggtgcagtcactgggatgctgagctgcccaagggagctgttcagtaggaggccaggttctcttggaggctccattgcctttagctttcactgtctgggagtaactagatccatgcctctgaagtccatgagtgctcacttaacccttgtgtactttgacttcttcctacctgttcctaccagtgtcttgtgggtcctttcaggatccagcaattcagtcttgcacctgtccctgagagtgcttccttggagcctcccacttcaaattgccatcagaagctcttctacaaaagctaaacatgaaccagtgtgaccctatctggaggtgatattggagtctagttctcaaattcaaccccagttgattaaaatacctgggatccataaataacattcggtcagaagacctttccaatcgtaatatgtgacagtactcctggggccctttttctagagcctcataagccacttgtgtgagaaatttctcctccatcaaatgtaagataggatcttgttcgggagacatctacagttatgtccagtttatttccatggggcctaagcacttaaagcgatgtatagtggacccttgacacttctaagggatatttcaagggtgatcatggatttctaaatttacaggcagccctgtggactatagtttcttccccaggtgtctgtatttggacaagaagcaccacttccatacgccttttcactttcacttaacttctgtcaccatcacaagtaattggcttttctttcagtagcctttattttttaaacaaaggaacagtgttatcacttcatgagctttctatgtaacaatgaatagagagagaacaacaaaatcgctccgagatgtgactgttgaatagttggctgggttcatacaatacccaagtgattctcttcagtcttgcatgcctgtggatcagatttgtcctcagaaaaatgacaaatttgattgtagaatttctctccttaaaggaacttttattaatagttcatgtactttagaacatggtctgaggaaacactggtattttgtaggagctcctgaatgaaagcagaccctagaaagaaggtatcataaaaagaaccagggataatgtgtttgttgttagtcctcgggttcaatttcaagtttagcaagtgtgtgtgtgatgtgaatgtagacagattcatgtgtgtatattattgttttaatgtttccatgtaatgtgctttaaaatggaatgacatccttactaacctgatatatgaagccactgtgtaaaactgtctaaaaagagtatttacaaaatgagggtgttatcgaaaagtaaactgctgggtagtgggactgttgctcaaagtagtttcctggttcacatcaagatcagcaaactcat

SEQ ID NO: 62774 - DNA, 1501 bp, Bovine  19866881273976
cttttataagaaatcatactgtctttatgattttgtttttcctaagtttgaagacatagaattttgatgttgatttaagagtagtatcttttctcatgcagtaaaaactagtgcaaagaagaatttctaaaattttaatctgataagatttttaattgtacctctgactttagtaaaagaatgctctaagaataacgtaacgaaaacaaaagcaaaaaaaaaaaaaattcaaatcaatcacatataccctccacgtcccaaaaggatctcatgtatcttttcattgaaaataaaccccaggtttataaaaggtaatgataaaagttttcacaggtcgacctacttttacgtccttaatttcttgatcttcctatcataatactttgctaatctgaaattgaaataccggaaaaatcctcaaaactacaagaaaatacgtcagaacagtcttgctttaaaatgatattagaaagatatagcaagtaaatacataagtaaagatgcaaagtcaatacagtttttcttcctgaaagactgaaggcaggattcttccttgcctacattttgttctttatttttatcttaagaaaaattttttcaccaacatattaacttcttctatattgtacatgatcatattatatgacaaaagtagtatatccttcaaagataaaaaaatctctagttatagattaaactgtatactaagttgatttttctttactttcatcaaaatcacttaatatgactacaaattgccaacaaaacattcaaaaactgaaagaatttaaacgtaatttccagttaaattgatgattttattttttgtgtggatgaaaccacaaaggtgaattatttagaatatactaaattttgttagaaattttctaaagttgagaaaacttatcaactttactaaaatttcttctttttagttgactaacattttctctgtgtagcatgataaccaaaagtgaattgtatccaaacattttttaaaagcttcgttactcattttacaaagaactgggaaggagggaaaccttttctagaaaaagagttgataagtattgtaagtcagactaaacaaaggatatgttctttgcatttgaatgacagcttggtttgaaattaataaagctgttattgtttgaaatgcatttctgaacatgtacagagagaaccatgctcacttaaaaatgttctgtgcttgagctgaatgaataatctcagaatagttatgcaatgacagaatttgattttcagtatttgttgagaagcttgcttaaatttttcctttactacagtcaatgtagcagttattaatgtatctgtttccatagactgtgactaacagaaacaatcaagatgaaacatctctattttttttcctattaaattttccttagaaatcaaccttttgagaactatgtcttaagactggaatattgtaggtaaatgcatactatgattagttgaatactgtgtacatgtaaattgt

SEQ ID NO: 62775 - DNA, 599 bp, Bovine  19866881297694
atttctatcaactctttcttgaggaacaagtatgtccacaggccaacagcaattttactgtacaaattaactcaaagaatgctaccaatataactacttctgatcgaatgacttagaaaataaagcctatatcatgttttgtcttaaggaagactgagggagcaggaagtggcaatagggctagggggcaaaaaccttctacttcattcttaaggatactttactgcccctatccatgaaagcacagaatgaccagtaatatctgactcttctggggttctagaactcccaactgttttcctgtgtgctcacaagtgttttctcacgctgaagctactcatgtaaatcaatcccacttgcacagagatgtatatgatggggaggatttttttctttgtgagttatacttttagcccacatgtggctgcatatgaaatatcaatttttgccccacttttaccttgcatggcgagtcaggcctcttctctgtttacacaaggacagaagaaaagtttgaggaaggtaaaagggtcgctgggcccattatcccggccgtctacggttttctcttgccatttcctctcatccatcattgtcct

SEQ ID NO: 62776 - DNA, 2518 bp, Bovine  19866881362964
tgggtaaaagaatcctcctgcaatgcaggggactcgggtttgatccctgggttgggaagagctcttggagaagggcatggcaacccactgcagtattcttgcctgggaaattccatggacagaggagcctggcgggttataatccatagggtcacaaagagttggacacaacttcagtgactaagcacacacacgcatggtaatatgagcatgttctcggacatctagtagcgtgtagcttttcttgcaggaaactggaaacatgtcaggatgcctttctgaactctggccttgctcctaactggagccatcacactggactctgagtggcattagcaccataccacttagaggtgagaaaatcaggaacctcagtgaagcttgagggaagagtgagtacatgctgggctctgagctgatgatggtaattaatagaagaaacagaatagacgtgtggcattggaggtagactcaatagagttccttggatgtcagcagatctgttgtagattttgaagctaatgtgtcagtctgatggatgtctagggcacagggggtgggaacttgctggaaggagccatgaaagcagtgtcatggatttagaatcaggaatactgagtctaaaactctgttttgatcatttttaactgtatgactgtcagcgagttttaaaattcccgatgctccatttcttctgtgtaaagtggggataataatagtgttaaatgctctgagtagggctacatgaattaatgacttgaaaaggccttgcctagtgagtagagggtctcgtacgaaagcacactaggataagaggaaacaacaaatgagaatgactacatagtttagcagaaaagattaggattttctcagctgtggcaatgttccactctgctttttggtgtatagttgttcagctaacattttgtgagcatttactgtgttatgaggcatcttttggagagttttatccgtgtgacttgttgattccttcttaatcttgtgaggtcgatactttactgtcctttcacaaatgagaactccgtggcctagtttagtgactgagcccaaatttgaacccacgtagtttgtctctagggcttccctggtggctcagatgataaagaatccgcctgcaatgtgggatacctgggttcgatccctcagttgggaagatcccctggagaagggaagggctaccactccagcattctagcttggagaattccatggagttccttcttaatcctacttgtagatgatgaagttactccatccacagcagggcagaaggaacaaaatgttacggagtgagggataatctaagtgaaaaagataagcttattttgacttagtcacacacatttttaaaaggattgacatcatcatttgttttacctttgacttgcaagttatttctttcaattttgagtaattctgatacggaaagtaaaagttgtagtgattgccaagctaatcttttctcctaaacgatgcagtcattctcattttgttccttccccttgttctagtgcgctttcatatgagaccctgaaattggatgtgtttattgtgtagaccacaaaggatccatagggaagatagaacagccttaaagagaggattaagcaagtcaagagccatacatggtaatccagctcttcaagaataggcatcatgggctttatgattggtttatgataaaaaaccttccctgtttcactcacaccatgctaaatgaatggttttcctggcaagtctcagaacagtttttcttcttctgttcttcttatttgttagaagagctggggcatttttctcaggtttattgacatctgcttacttttcagtaaatgtactctggcatcgttctgcaatgagagcttttggaaggaaacaagcacttgaatgaaggacaggtattttggtttccataataatttctttgttcagtttttctaaacaaactatttttgaattttaagtgcctgcgttgtggattatttaggtcagagatcatgagatttataaatcatcctagagttcgtagagcgacactccttcatccccgaattctctgtttcattgacctttcggtttagtagattgacttccttttttgataagagagtgagacttagaaggataattgatgagaagatgcagacatggctgttctttcttttcagaaaagacagggatctgtcttattattgctgctttattatggtagtaataattagtattgatagcagcaataacaaaaataattgcagagtgttgagaatgtcctgtgtgtcctatgaatgacttgttgttcagtcgctaagttgtgtccgactctttgtgacccaatggactgcagcacaccatgcctccctgtccctcaccatttcctggagttcacccaagtttattgaattggtgatgtcatccaaccatctcattctctgccgccctcttctccttttgccctcagtcttttctagcatcagggtcttttccagtaagttgtctg

SEQ ID NO: 62777 - DNA, 1749 bp, Bovine  19866881509314
ctgtttgataatgagcagagattggcagagaggtcactgtcaagagactccagtataaatatgagttgtcactagatggcgctgcttgtcgttattcatcaaagacaaggaactctttttctttcttttttttcctctccatggagtcctggcccagcctgtctgcaactgggatcctaatcatgccagaactcttctgtactgaagggaggttctattttcaacatattatcatcaagatctgaggaccaaacagactccacctacaatctgggggaattacctcaacagtgttgcctttatccagaggtgattttaaaaaaatatattgtatttggatgtcaacgttcaaaggctccgaggcagaaaattccatttcaaagaaagtgtgattaatgaagccacataaatcctatagatttatgtagaggctggagcagtttcagaaatcacaccatacaaatcaaagaagcgggtttttctacatcctctctcactttctcttattcttattttggcacatcttttcctttccttccctctttccctttcgaagtctcttgaatgcacatatcccaaattccaaaacaagagggaatttgatcggatatcctaagtacagccacttttaagctctaaccatcaccatttctcctcattcttcccccaagagatgcagagacagggttgaggccgtaacagttaactcacataactcagactgcttataaaattaagtcaattctggaactccatgtagtaagactcccagcttcagtaagggatcttacttaaagaaagccaaatttaaaaaataatgaaggtccttttctagaagaggtggtgggggaattctaaagatagctttgcatagaaatttgttaaaaaatctcctttagacatatctctgtatccttcatatttcacccacttatatcaacctctaactgtaccccttactttccttccttacttttatttatattcttaaaccattcactcttttatattcttctctactccgacgacatcctgttcggactccctatctctttcataaactctaacatgctgggagtcccctcagccccctgaaagtggtgtccttaggccagtctgactgtatctgctttcacaagtgagcctgtcgcctgggtaacaatgtagactgtagtactgtgttctctagttagggttgtggagtgtcgtctctaatggtgaagcacatgagcggtagagtcagattcctgtgttgaaattccacttctactcgttactttcaagatggccctgggcaagttagtaagcttctctgtgtctctgtgtgtgctgtgtgctcagtcctgtctgattctttgcagccccatggactgtagcctgccaggcttcactgtccatgggagttttccaggcaagaatgctggagtgggttgccatttcctactccagggggtcttctcaacccagagaatgtccgggttgtcttctgcactggcaggtggattctttaccactgcaccagctgggaagcccatccttaatagtctctccctcaaagggttgctgtgaggatcaaatgaactggtataagcagtttgaagagtgtctggttcagaaagagtacagtattcactttgttattatcataactgctaaattattactattattatatgccaggcacaatgataagtaaagaaggtaaaaagatggtgataaggaaagtaaagtgctcagtcatgtccaact

SEQ ID NO: 62778 - DNA, 1451 bp, Bovine  19866881691478
ttttacagtctaacccttggtggctgaaaataaacatatattcaaaagtatgtataaattcttagagctacaaattatatatatatattatatatataacccccaaaattatataacattgagtttttcagtgtgagtgattatcacttacctgaatacttcacacagcttttaaaagcaaaccctattgctattgtaactgtaaacagatcattgaagtttataaaatcatttgagaattaatctgaataaattccaggcacatttttaaaacaccaactgtatgttatatactaaactatcttgtgatggaattttaaacctttttacatagtaacacagtgctcttattttttctgaatttcaagaaattatcttctagtcaaataatcattttatagtgaaaaccatcttcccactaaaagcttgctgataacttgtgctatcaaaaataaaggaagctctaaatgattagcattactagacaaaactaaaatttacccttgagacaacctcagataaatgcagttataaatttaagaagattattatgcagctaactttgtatacatgtgtgtataaacataaatatacatgtatatagatatatttataaagtgctacaccataccagtttaaatatttatgcagagatcccatgctagaaaaacagaattaaatacaatatcttttcacagatttttgtgacagctttgaaatgagatacaatgcagaactctcacagcatgttttcaaatattgtttctcaactgaacattttctttaaatattacaagagagccccctactgaccaaaaatgttggcagtcagcagaatcaactcccacttttttttttgcttctgctgctgctgctgataagtcgcttcagtcgtgtccgactcttgtgtgaccccacagatggcagcctaccaggctcctctgtccctgggattctccaggcaagagcactggagtgggttgccatttccttctccaatgcatgaaaatgaaaagtgaaagtgaagtcactcagtcgtgtccgactcctagcgaccccatggactgtggcccatcaggctcctccatccatgggattttccaggcaagaagtactggaatgggttgccatttttgcttctagctagcatgtaatattaatccctatatctaacacagaacactgaaaaaaaggctgaaaggaagtgaaatgaggtataaggtatatgaaatgttactctttaattaaattggaagggaaatacaaacaatgagatgtatatggtttacattacaattagaaacaataacagctactatatttaaatttaagtactatctatatgtcttatactatactaaatgctttacctatactgcctcatttaataagaccactttagttcttttgtatatttgggtgcatgttaattttcagttttctgctcaaat

SEQ ID NO: 62779 - DNA, 1893 bp, Bovine  19866881741965
ttaacaagagtgtgctaaacttcatttaactattgcttaatgtgaaggggatcttcccctgccagggtaaccagaagtcaaattcctcagatgccggtgctaagagggacagtgaaaaccttctggccaactctctcacttgatggacagagaaaccgagtcaaggaggtgccagatcccccagctacttgcaggaaggagggctacccattttcttctctttggcttcagtgtctgcttcaatcactaagtagcacagagtgaaactctacatcagtacacaaagcaccagaagaaggtaatttcattaccaggtcactaaataatttagagcctaattttttttttttaatgcaaagaccgtatgttcagaaacctacagttcaaagtacattaagtaaaaccaagtacatatgcagatatgtcttctcccatatgcatcttaagaaaataccaaagaaaaaaataatttatcatcagcccctaggaaaagaaatctgaaattaaagaatggagtaaatctaaattgtatattttcagtccttctaaaaggattaaataacagaattctaaatggtttgtttgtactttccatgcaatatgtagattaagcatgaaattctgtttgggacactttgacatctgttttcagtgcattacaatgaaatctggggacttgatacatacatttgctgtaataaaactgtcactaatcagtgttttccaaaatattgcccataactattactattcagtagtctcatttgcatgatctaatattgttgctacatcatgtttttccctgacaatgtgttagctggtcccaggcacatggtctgaaatggctacaaaccactcaataattccagcacttccacagtactctgtacacacgcctgcaatctgccccagaattgaactaatactgcatccttcatgaaatcttttcccagtaactgcaacacccaaggctgaattcacatccctgggtgtgaaagactccataacaaaaagagaacccacatcgaggaggaaattatacctcctgagacctccacaacagaagatgtaaacacaatcctaattcataagtcctttagccaatccgtaataatgctgtttgaatactaagtacagagtctgtccttgacttaaaccatttctatgaaacacagaacaagattggaccagactttaaaatcaagtctgcttcactttctccagagttaataaacagctgtatcaatgcagagaccaagcaagacacaccaactcacaaagagttaacgtatctcctggatattaggttgaacaaatgcttccatttcatgttgtacatatctggtgtgtcatgtacaaagcttggaactcagagggaaagtgattctgagagcccaaaaaaggtcttcaccaaaaaaacaaaaaattaatcatgctaacttgaaatgaattccatattttatcagtacttagaatcatattcatcttccttcacagttcaatataatttcattttgccctcctatgaactcattttaaagtcaaaatatatttctctatacacatgttttgtattatacaaatgttggatacaaaaagcagattaattgtaggccctaatactgtgttgttagtactaagaagtcattccaaatgttctaaaagggattaatgtagtctaacaagtctatttaattattgtaagaccactgatcctcatattactataagcagcttttcctttacttggacactgtaaatagaacagacactgttacatgataactatacatctaaccaaaaatactaatgctttaccatcaggaaatttaaagaaacatgttagcatctccaggaggctaaaaaaaggcaaccaatatttaagaatcatat

SEQ ID NO: 62780 - DNA, 1119 bp, Bovine  19866881788283
ttggtgatggacagggaggcctggcgtgctgtggttcatggggtcgcaaagagtcggacacaactgagggactgaactgaactgagaaaagataaaatgtgacattcctatactctcaaagaagggaaagttacatgataaatattttagcaagtagccaatatctagccttttaaagaaaagtttctgttccctaaaatttacttatatgaaactcttcattgcctaatggcatacaaataaattaataataatacttttcatattaaagataataatagttgccatttattaactgcctactattcatgaagctagacatgaaccaccaaaccttacaacagctccagaattaagtattaatatccctgatttacaagtggagcaattgaggtttggcaagactctctttcagttccacccagctgtttagcagtgaaattggtactcagacctatctcttttccattcgaagaattacaccccttccactgagccacacttgccatattttttttctcactcggggagaaataggttttgcaggcgctcacatggcttatttgcaaaacacacattaatattttctgtaaagcaagcagacatagacctgagctatatctgtgaaagttgtctgcgtgaaatacaggctctcccatctgtcaatatcagagtgatgagcagaggccccagtgtgaaagctgagaaataaaaatgttgtttctaacatcatttgctggtgtgctctttctgtaagtcctcccactctgcctctagtagtttttaatatcccgaagtttcttaagagtgaatcacatttttaaagagtgcagagttcttggccatgcctccaggagagacagcacctggtgaataacccacaaacatccttcttgaggccagctctttgcctcatcaatctataacatatttgttctggtttcagatgttccttatcaccaaaatttgatttcattctacagaccttcatcatagccccactctgtcttatttctaattcataccaaatccttccagttggttcaagtatttaatatccacccataggccatatttcaaaaattatatatatgacagaaaaattcagagcttcccaca

SEQ ID NO: 62781 - DNA, 957 bp, Bovine  19866881996039
ccatttcctgtgtcttttccttgagtaaataatgcacaagatggtcactgcctgattgcagtatcacaatgtgttttatttttatttgaattttcacttattgattttgtttcccttgcacatgaataatgcatcctttttcagaaagcacccaaattcacattatttggcacactaagtaaaaagtcctttctttttgagcagtaacaaatacaaattatgtagtcaatgtgtttttaaattggttaaatatgtatttacatgctaaactgaggcattattggagtcatttgtatagcaagtgtggtttaaattgtccaaatatctgttcatcaaaataaaataactttaaaagaggctgttgtggttcatttgggggaaatagcatatttgaatatggatgtgaacagcattccctgtagtaactaggaggtggccgtaacagttgcggtaaacaacgcaggcccttaaggctttgccaggcttgagtaatgcattgtagcactcttcccaagtgttccttgttttgtgttcttccatacagtcaaaaaacaactcaaataatgtccaaactggccattcccaattcaccttcccaagaactgtgaattgcctgtgggcgggttcctgcacatgtgaattagtgaaggaagctgacactaccccagaggcagggcacggggctgagaggcagaggggtgagcatccaccctcctgccccactgccttcagaatggggcaaaggtatgatgacttcctgcttactatgcctttggccatggcactgtattggcagggatttgtctgaaatgaagaaacaggcgctatttctaatacaggtaaagaaactcagcaaaaataagacatatgaactaagaatttattcagttcagtgaccaaaaaaagtcttacttgtgggagaaatgagtcatctcctaaagcatggtgtttccggaa

SEQ ID NO: 62782 - DNA, 1652 bp, Bovine  19866880860112
aatgatagttattgtatgtatatagcacattttaatgaaatttcttagaccaaacagtagtaaatgctagagcagaggtatgaactcttccaaacacacaaaggagaagcaattaactcccagtagtcagaaatttattaatgtggcataaattccagcttattactcaacttcgtgtgtgcctgcttcattagatcatctttgtgcatttttattaaaactcttagtcctactggcaactgagacttattcatttttatcatcttcctgttgttgttcagtcaccaagtcgtgtctgactctttgagaccccaaggactgcagcacaccaggcttccttgtccctcattatcttctggaacctgaccaagttcatgtccattgaatcagtgatatcatccaaacatctcatcctctgttgccttcttctctgacttcgatctttcctgcatcaggggcttttccaatgaatcagctgttcacatcaggtgaccaaagtatggcagcttcagcctattcagtgttgtttcctttaaaattgactggtttgatctccttgttttccaagggacgctcaagactcttcttcaacaccacagtttgtaagcatcagctcttcagtgctctgccttctttattgtccagctctcacaaccagacatgacactggaaagaccatagccttgactatatggaccttacaaatgtttgtagaaatgactggatggatgagtggatgctgctgctgctgctaagttgcttcagtcgtgtccgactctgtgcgaccccaaggacagcagcccaccaaaccccttcatccctgggagtctccaggcaaaaatactggagtgggttgccatttcccttcttcaatgcatgaaagtgaaaagtgaaagtgaagtcgctcagtcgtgtcggactcctagcgaccccatggactgcagcctgccaggctcctccatccatgggattttccaggcaagagtactggagtggggtgccattgccttctccggatgaatgatacctgagatgaatcataataaaaatggggatggtgatgataataatattacataccccaaagcatttttctgaggatttattggattaatacataaaatacttagctcagtgctgtagtccagcagatggccagtgtgtggttaataagaatggtataattctctctcttgactatcacatattgtcttcacttggatttgctctccaaatcgaaggcaaatatgaaatcatcactcattggctctatagaggtgcttctcttcagttacaagagacaaaaaccaatctcttttttttcccctgacaacttctgatttaaaacaatggaagaaaagttaaatggttgcgatattagtgcttcgggaacttgactgggaagctgtttctatatagccttttatttatgtgcacctgctcccaaactgcagcttgaaatgacacatctgccaagattttagatcctcatctcacgttgctttatcctgacacactcgccagcctaagtcttccgttctgtacagcaggacatttcttaatatcatcattgacattatcctaactgcatcctcataaacataatgataatttttctgtcaagaatattttcccttatcctaaatgttaag

SEQ ID NO: 62783 - DNA, 1262 bp, Bovine  19866881100552
ctttatttttatagttctgtaaggaaagggaaagatatgacccagattttcttggggagagaagttttagaggcaaactttctgtgatatgcaaaataaatgaactcaacaaactgcagtgcagtgggagatctcctttcatgctgtaaactcatttgtcaaaataatagatgctatgtctacatggatgacctgtatggcttctcattaacttggtttgattagacagctaaactattgagtcgaatctgaggaagactgtacataaaagtgggggctaaatgttgaatgcatatggagaggccagaactgaagggtaagaatgtaaattcatttttcaagtaatttatatatatacagaaccacagaagagatcaaaattgtctttgggcatctttgtactacattaacaaccacttatctgtgtacatggataaactgttaaaacattggccagagcaatgtatttaataacactgttaggagttgctcataacggctgatcgtatctgtttaataatcttggttatttttaggaacaaacttaataagtgttgattgtcataaagcattagggatacaatcatatatgtatgctttcaaatacttgttctaattatcgactctgacttgaattgcatcttctttttggcaaatggcagttggattcattgtagaggatactcagcatctttaacttgttaaaaatgatgacaatgggcctgttttcattttgtctctgttggttgccatagtatcctaggatacgatgacttgtagtttccatgggcacaccactggctagggctgaaatgctgtctatcatgatgcaagggcaactctgggagtatacagtctgcctaaaaccacattattgaaagtttcaaaatgtaagcattagggggaaaaaaaaaaaaacagggactctttttgccccagaaaggcgtaatattaaagaaacagctgctaattggagacaagtagaaacaacgccaaaattcatagagaaagctaagaaggagctggacaaagaaggaaggggacacagataaagagattcaggaactgagagaaaaacattacatacataattaaataatgtggatcatattaaatagaatttaaaaatttttattggctgtgctttagcagtaaatcttagcagcattaacagcactgaatatatatatctttttgctttatatgtactctagcttttgatacctttttacctcttttttcagtgtcaattaaaagaaaaa

SEQ ID NO: 62784 - DNA, 878 bp, Bovine  19866880417839
ctacgtcgagcctttccaacttggacaatcacctctggttgctgtcctctgggtggaactgacaaaatcaaggcaaactaagaggttgaaagcccggagatgggctctgttttgctttgttttcatagcttagagacctctggagcctgggggatgagccactgagcagtgagagaacaacatgtttcatctttgtgtggtgtttggggccaaattacctgacccagaagcaagagaactggaagggataaagctgcagcgtcaaattgcctcccccagcctcccagagctccggtcctcctgcatcggagacagaggggaaccctgcgccagttaagccaccgagagctgcaggctgtgctccagctgggaggtgggtcaccagcaaaagggctcagagagagattatctcccagctctctcctcacaagcctaccctgggggcacggctgctttgtttcgaggtaaaacacgactgtgtctcttcagggtggcaggaagagggaagggatttacagggattccatcaagctagtgacttatgatgtcagttacaatctgagggtggaaacaggcacaacggttgaatgatcacaagtttgaggaagtgctgaccaccgaccactgtgagcgggagatcccacgccagggttcacaatgtcacaatgcccggacaaaaattgcctgctactgcatgtgcggtgtatcagaaccttgtccaggtgtcgacatcaaaaaaataaagcgcttcctgcttgtacatattttttctgctttaacatttcactctcccatccatgctgcaagggaagctaatttctactttgtatgctctagaaattaaccaatagatgcatgcacatccattatcccatctt

SEQ ID NO: 62785 - DNA, 997 bp, Bovine  19866880492827
catttatggctcatactgtaaggcaaatgtaggtattaaaattgttccttttaaatgataaacacccgctgaaatggagcaatagagctgcatcaaaaactattttcacccaaaactaactgactcaggaaaggcagtaaatagtgaatttgactacaatccccataactgctgttgatataaggagtggggagggatggggcgctggagagaaattagcacatggagaccatatttgtgtagacgacattcaccaccttgcctgcccagccttctgcaaggtgtgacaggtagagtttcaccccaaaagggacactggctacttgttttctcccctggtttttgatagcgaggcctccattttactgtgcatatcacaatcgttacagtttttatttggagagggaagtaatggaaaaaatagttaatcgcccattcataatctcttaaacattatttttaagctgatagttgcaaaacaaaatgcaatctttctaacatcttcaaacaattacttgtcattttccccgtttccataataaaagaaaatgggaggggggcaaactctgattctgactttgggaaagatgaaggacaaagtaaattctgcccagagtttattccatcaaaaaagaaggccgtaccaagcaaggacaagtggtgggaactgggggcagagcctctcctggtctaccctactcatcctaaagataatgtaaagtgggtctaattacctgagccttgttaagcaaacttatttctgcccatcccctggaggaaatgtagggacgtgcccaccttcctcctctgccccaagagactcaataaatgaggagtcacagccaggagtcaatttaactcctcagagcatcataatgagagcctaactcataatggatggatggatggaaggatgaacttccatgccaagacaaggcttctcaaattctcagcgtgaaaggaccacttttcatttgcaatcaatgcatcctctaat

SEQ ID NO: 62786 - DNA, 1410 bp, Bovine  19866880494875
ccaggtcactaatggccaggggataccaagctggcagggagggatggcggtctttatattatcctggaacctctgggagatggtgtggttgaaactgtggggcactcctgcggcaggataggagttggtaacagagaggagcccaggtagctcagtggtaaagaggccacctgccagtgtaggagatgcaggagactctggtctgatccctgcgttgggaagatcccctggagaagggaatggcaactcactccagtattcttgcctggggaatcccatggatggaggacgcagaaggagatgcaagaccaagcagtcacttagagggctctccattcactggccaagagctcaggttgtggcagtgaggatgaagataagggcacagattcaagtggaactgaagaggaagaacagacaagactgggctaccgattggaaaagagggtgaaggaaagcctcccccctttgctgggaggaacctgggtgaacgctggtgccattgactgaggctggagtaaaggaggaggaggtggtttggggagaaggatgaggagtttaatttcactgttggctgggtgtgaagtacccaggggcgtccagagcatatgtgtcaggagctcctgagagcgaccagggctggagatgacaggacgagaggcattggctgacagatgctcactgaagttttgggagagaatgagactatcgggggaaatcttctggtaagaagagaagaagttcgagagggaccctggaggaaaaccattcatttaaagagcaggaattaatgacaacctgttagagataaaatgagaactgaaaacatttacaatagcagcaaaaaaaaggtttaaaaatcctaggaataaacgtaagaagaaatgtgcaaaatctaagtggagaaagcattaaaatgcttccaagggacagaaaagcctttgaatacaggttttagataggaaaattcacatcataaaattgtccattctccctcagataatttagaatttaataggattctccataaaaacaaagactttgttgttttttagactgattctcaagttcatatggaagaataaacaaatgttgaaaagacagttctccatgggcttctcatgttttgagtgagcagaagcagtaactaccttttccccagactccctttagggatgttcgtgtagtgaactcccttggaaaatagaggtaatgactccctctggagaactttgtttattggtcagtataataaacatgaagtcttcttctggagcaaaacccaggcaggcttactgtccattataaaaatttaggttccctaaactcaagatggaattccagctgagctatttaaaatccccaaatatgatgctgttaaagtgctgcactcaatatgttagcaaattt

SEQ ID NO: 62787 - DNA, 1737 bp, Bovine  19866880508976
atctgcacgtagggagtctttcctctgtgggccactgttcccagtcatggccatggggggaagtcctgtatgggcctttccctgctgcagccagcaagaggcatctttccctccagtgggcttttccttggtcagtcacatgactctgcccacttataaggagtccaggaaatgtgggggagcagatggcccatctggggagcattgctacctctctggctttcataactgtgggctgatctagtcgggaccttagggtgctgtcctcaggccctggtgctggcctgagtcctgcaggcaacccctcttcccgttgccagaactcagttttccaatcagcaatcaaagttattaattaaccaccctggctacagatggaggagagaaccaccctccatggttccctaacatgtgcccccaggggtctgaggcatttgaaaccacagttgggaaagaccccaaagaatacggaaacgtgtgaaacagagagatctgtccaggaagccagggccccttttccaatgtttggccctagatccctctgaagcaaaatacgagtaagaagggaggccacatttctgttcctatttcaccccagtctgggatgctgacaaaatcgccccacttttaatagtgcctggggtgggaggaaaggcctggtctgtggccacagagagaacttttgtctccaggggtgtctgacctgcctccatcctgaggattactgtaactttttaattagggcgaagtttgtagggagtgtgctcttttgatgtggcagctgtagctggaaaacaggcctacatttaagactttactgcctgccgatggctcagcagcctgccacccacatatcagagtctacaccccataaacagtccggatcgtgtttctttagagcaagctgtgtgagaggggtctgggaccaccatgacgtggaaggaccacctttgctgatagtcttatgggacctggaccacccgaggggcccccctcccaagtgggggtggtgctctgaggtagcagaggagtggataaggtgacctctaaggacacatgacaaagtgttcattcttgaccttgatgttccacaatacccagacaagaaccaagtgagagccagaactatcctcagcatcagactcatcagagcacatgcttctgggcctgctgaatggggggagggaaggggactccttcaggcatctttgtatcccagagtcccacacacagtaggctgatgaacacagctacaactgtatctttgggagagtgatggatagagtgtattttgagcatgctgttctattatgggcaacaccccttcaggagcccctactatgtactagacatttgttctaggcaccgacgattcatcagcaaacagtaaccctgcccaattagatctcctgctctgcgaatgtgaagttaatgacaagcactgggatgtatgctggatcacatggttaaccaggggcagacctaacacaaggactggggtttgctagctcccatgggagcagggcttctcaagccttcccgctgaggagctccccatggaggcagagcccaaagcagccaaatatggatgtgacatttctttgactttccaatgctttactttaaaagtttatacagatgctgaagtctgtgccatttcacatctatgtttgttttactataaagtaatggtgtaggttacctagtgtatatatatatatatatacatatatatat

SEQ ID NO: 62788 - DNA, 2766 bp, Bovine  19866880515434
caggagacaggagttcagtccctgggttggaaagatctcctggaggaagaaatagcaacccactccagtattcttgctgggatcatcccgtggccagagaagtctggcaggctacagtccatgcaattgcagagtcagacacaattgaattgagcacataaacatactctcaggctccaaacctttgtatttcctgacactgggttccagaggtggccttaaagggtggagcagaaggataatctcccttctggtccagggagggctcctccaaggacagagactcaggtgaggagctaggagaggaggaagatgttcagtgggaggcagggcaccccgcaatccagaggcaggaatgtgcttggtgtgaggtgaggaggaccacagaggagccagagcaggtggtgacggggacagggagcctggccgaaggtggcctggtggctgctcttcctgggcagctggagaaggcactggccctgagcccagagcagggagtgaagaaggaagtcagccactggctctctgcctgtgccttgatcctcaccgtggagcccagcattcccattttgaaacccgtggagcggtagttggcattaaaaaaaaaatgtaaatctgacagaagactctctcgtcagggtatttctcctttacaagagtttaagagactagaggggtcagagcgactctcgcttcccgctgagctgtgtctgtgaagctttgagcgcagaggaccaagggcacagggccggatgttcagagaggcccgaaatgaaagggaggatcagagaggacgtgccagctgccccagcctggccggccgcgcttcgtgggccccgagggatggaggaggcttcattcggggaaaccaagggctctggcacggcccacgaacaaagtcaggcctggaaaagcaagttaaaatctcactaccctcagagggggagggtctcacctctcttctcctggacacctgcccagctctgtcattcaaagatgcttcaggaggagcctcacagacccggaaagcaggacttccatgccctgcccctccccttgcccccaggaaactgccctaatcagaaagtccagaaatctgctccccttgtctaatgttagggcacttcaactaatactgagtgaggccttctcggaccaggctctctattaaggatggaagttccaagatgcaggatacaccgcacctgccctctggctcccaaacggtgggggcagagggcggggggagggatgggggaggcacagaaactgttgtaccacaaagtgattgtaccttgatggaaggatatctaaagttttgaatgcccagaggagggaccctaacctatcccgggagagtagtcagggaaggcttcctggaggaagacggcatacctgaagtgagcccttcctgagcaaaggagggagagtggcattccaggcaaaaacacatacacaataacagcagcagcaactctgaataaaagacttagttttcttttcctggttaagagaaagagagttttcagagtttcttagagagtacaaactctttaatccctaggtaaggaaattgaagctcagagaggtagagctttgcactcaatgtcacacagcaagctggggtgggatggaggttcagaggctccccagggtcccaggccgtgtcctctatgccatctcttgctgtgacttgagctgtgctttccccagacagggataccacctggaaagtagagagaaagcttctgcagggagcagaggtgtctggagcaaaggaactcaagggagccaggcagtcctgctcggtccccagggaccatatctgacgagtaagacatagggaggcggcacagaagcaagtcacaacatcaaggagcttcacagcaaagaggagactgttgtttcaacatcactggccattcgctggccctctccttcagagccacccctggaggagagaagggcattgccaactcccctggaaaaaccctagcacacctccattcttaaaatctggctgctgagccagcctccgaggtgggagggagattggtgagggcaaatgggatttcaggaccaggaaatcccacttatatattggcagtgggtcttgggagaagtgataaccacagcaacaaacataacaaccatagtaacagctcacactcagcccttaggagaagccaccttcagacagcttctacaggtcagctcacatgaccgccataacaacctgtcaggcaggcgtcattagcatccccattgcacagatgagggcactgaggctcagagacacaaggtcacttgccccaggccacagaggtcaggagtgccagagctgggaattgaaccttctttgaggctcagttctcttttcatgaagagtggggctgatcacctcctggggaagcaaggggcctagaccaccggtctaaggggaaatgaagtgggagagagacacgcaagggccacagagagcaagggcaagtcccctggagtggtgggagatagcagataggagccagcagaaggagggcctgcactttagggcacgaggccctcagggggcacccagagggaaaagcctctagtccagagagattctgagaagcaaggcaggccaggagaactgagccgtgaagcgtgagcaggtgggactcaatgcccaggggttgaaggacattcaggcaaaaggcacagtgcatgcaaaggcttggagacagagtgttccagcagcgctaaatgctttcatctttggagcac

SEQ ID NO: 62789 - DNA, 1412 bp, Bovine  19866880533346
caggccttggcctaaactccaatataatttggtgagctgtacctcttgacttgggctattaaatcattttccctccaaaggtacacatgttgtggcataaggagcaaactgttgacagatggtggagaaacttcgcaggcccataattgagacttattttcatacattcgtgccagtttgaaatctaattgccaataaaacaatactgtgatactgccacatctaatacctctgccactctccaaagttacacttgaatccactagtaaattctaatctcccagagaaaaatatttccccctcttcatcagaaaagcagtgctataaatccatgtacagtggttcattttcaaacgcgagcctactctccccggtccccaaagagccctcactcggctaatgttagtgcctgcctgagagctgtagatattctttgtttacttgacagagcacagatgtggtttggcgcagcagcaacgagatcttttgctgagaaacgctctgatgggccagtttctccccatcttagaatgacccagtaccactctttagagaccttttacccccgttaaggtaacgtggctagagacccagcaccacccactgagcagggtgagatggaggagccctgacctctcctccccaattttccattttcaaccctcctgatgaaaaggtttgcagacagatcaacccagatcaatcagggctgtaaacaaaaaagaggcttttggtgcaatgaagacatgcaggggcagggttcatttgtatctactgaaaacgcaatctgtcaccccaaaccacaagcctgctaacagtagtaccagccatccttcacatgccagagctctgcctagtttacaaagaaatcctcactgcggacggaatctatgccatgtctgagcccagggaaggtgtggtaaatacagtgattattgtccttgcctacgtggtcttcacattagccctggggatgtgggctgttatttttcccattttagagacaataaactgaggttcagagtggctaagaaatttttccttgaggttgcacagtgattagtgatgatgaaatctcaactcagattatctgggttaactccaagtccagttctttcgttatgaggattaactgaaattaactatggaagcttaaaaaagttcacttccctttctcccaccccagccccacctccacctgtggtctcagttcttccacctgatctttcccactttccacatatgggcccttaaatgtttgaaaattatcatagtctcctgaagtttccttttcccatgtgaaacatggtttcttggcttcttcatatattccccaagtcatcacctgacatctagatcactatttctcaagtgagcacatgaatcatgcagagaatttgctgaagtgcaaa

SEQ ID NO: 62790 - DNA, 3430 bp, Bovine  19866880552920
cctttatcttctgggtgacagcctgtagaaacttcaaaagaaacagtaatgctggcatctaacggcttttgttaattactatatcccaaagaaaatgaaataaaggaggaagaaaaatgatatttctctgtgacaactttgtaaaaatatcaatgatgaagcggcacagtttaagggctttaactattcatgcaggcgcggcgggcctccacccacccgtgcggggtctggaggatgtctgaggatggccggggcccaggcttcttcacaggctgcccgcgctgtccacgctgctctcatggcccctcacacagccctccctctctctctttcacatgcacacacaagcaccccatcccctccaccctcatacacactaacgcacagcacacactccacacatccccctatagcaccgtcccaaatattcatactcaatccccaatacacagccctcaaattcacccccattcacagcctcacatccacactctttcacagccgcctgtacatgcacaccctcctgtacacatgtctcacacacacacaggcaagcgttccttccttcatctgattgttcagagccctctcacaccccacactgtgccaggtgggctctgcaccaggtgctgggaagcaggtgtgcaagagctctgctctgggcagcagggaagacaggccggcagaccatagtctgtcctctctttgtgctcacgccacactgctgacgtcccaagtgaggtgagtgagtggggacagtgtggtggagggtgtaagagctcaggctctggggctggaccagctggttagaatcctggtactctcgtgttagagctgtgtgaccccaggcaagtcatgcaacctctctgtgctgcagtgtcctcgcctgtaagctgaggataagaataggacatcctgttcagggcctggtgagaactctatgcagtaacacaggtaaagtgtcccccaagtgctttaagggtcatttagggtcaggcagggcagctgactctgcctgtggggagtggcctggcatttaggggaggcttcacggaggaggtgatatttgagtgtggggccttgcggcttggaagaaaagagggagcacacagcccgggcacagaagacaacacgggaagaggtttggaggtatggtggggcacgtatgtcccttggatgctgcacgtttggtgtgactggagggtagcgtgaagcttgggtgggagaatattctggaaaggtaggtcctgatggtgacagactctgtgtttcattctcaaggggtgggtttccctgtagaagctgacgctgcagctgagtcatgttgtcagaacagatgaaggccggggacaagcaggatgcaggtgggcctgccagggtgggcttgagggtaggggcaccagagaggaggctgtgacagagctaacaattcagcctcccaccacacacacatgcacttccacacactcacacgcaaaccctcactcatatacagtcacacgtgaacacacctgctcacacgcttagttacacatacatatacacaatcttttattcgtctctcaaatcaaatcaaatcatgttaggtccaattccaaatctctgcagtggctcttgactccttaattacctggcagtgcactggcagaggtgtgactacggcagaaactgccaaatagacctccaagggccctgctctgtgatgtgtgctcctgtgtggtctggagggggcacctttggggcagagggatgggctggtcatggccctggggggtggggtcgggtgacctggcatctggtttggccttagtctctgcagctataaaatgggagagttgaacatcttctccaaggacccatctggcgatgttatcctggcatcttcttgagggtaaaccaacactttggagcactagagaggtgcacacgaggagcagcagactcatttcaagaaaaaaagagggaacatttttgaaggaaagcctagtgagtgttaagcccaatgccaggagcctcgggggatttaaacctgagtcagagagaaacaagggcttcccaggtggccctggtggtgaagaacctgctgccagtgctggagacttaatagacacgggtttgattcctgggttgggaagaccctctggagaaggtaatggtaacccactctggtattcttgcctggagaatcccatggacagaggagcctggcgggctacagtccatagggtcacacagaatcagacacggctaagccacagagcatgcacacacagagacagaccaggaagctggcatcctgcttgctcctgaccccggctcccctgggagagtagggggccctggaggacagacattgtctcagaagagatgctggcatctccaggcaccgggcagggaggaggcggccttctgtttggggaggtggcagtgaggactggccagtcttttggtggggaagggacatagcccgaacccaaagggaggcttaggatgggcagagggtgggtctcacagtcacagagaaacaaaggccttggagtggatatttggaagcctctatcttggttttcttcccactccagtactcttgcctggaaaatcccatggacggaggagcctggtaggctgcagtccatggggtcactaagagttggacacgactgaacgacttcactttcacgcattggagaaagaaatggcaacccactccagtgttcttgcctggagaatcctagggatgggggagcctggtgggctgccgtctatggggtcacacagagtcagacacacgactgaagtgacttagcagcagcagcagcagcagcagcagtatcttggttttcttgagcttctagaaacagagactcatcccaagtggcctcagtggaagtagggaggtccaggaagtctcacggttgtctccagggcccagggaggtacaggcagtgggccatcaggagcagctagaccaacactggccgctctcaagccaaggctcacctctggatggttctagaggagtcccatctgtcacctctggttttctcttcacaactctttgctctccttctttcccaatgctggaagtggtgcccacctcaacttgctacgtcctagactgagtggggctcagaggagggggtacccttgtttctctccagcagccacctctccctcactctggccttgagggctggcagaaggcagcactcccatcgggaggccacgggggccaggacaggtggaatccatggtgttttaggaaggctggtctgttctagaaccataagcaggctggccaggagtgggaatgcaaggaggatttcccagacctgtgagaaggagaacagaccctgttccctggggcctgatgtggtccctggggaagtcctgttgtgaagagctcctcacctctgaggagcagcagggg

SEQ ID NO: 62791 - DNA, 1610 bp, Bovine  19866880636223
tgtctgaaggtagtccctctcccatctctgcaccccatctctggcccggagctaagggaaatactgtctccctccaggcttctctgaccctttcctgacccagcacaaaggccccatctgctaagaagccctcctatcccacccctttcacctatgtgtaggtctccatcctgggcctctgcagctccaagtgttgcctcctgcatggccctcctttccacctggaaacacggaccatggttacttggtccttgggggttctcccttcactgttgccattaaaagtgatgtttgaggaagaccaaattcttcaggctggcattcaaggccctctctactcctgcactctgcaaatgctgacctcattttggtaacctccccgggctccattttccctgcacacacaagagcctttgtccaaaccgtgttccccccagcccccacccagagaccaggagaatggggtggattctgaaatacaggatattctggccagagctgccctggggacaggccatgaaagagagtcctgaggccaaggcagaggggtcaggttactggagagataatctgattatatctagtcaagggaggagggggatggggtttggggggaaagccttgagcctagaaaattggagaaagagacaaccaggatgctgaagtcagaagtaggagcagataaacaagaggatagaacaaaacgcagaggaataaacagtcctaggttccagccccagctccaccacttacctccacctgccaactgggtgaccgcatccagttcacctaacctcgctaaggcctagtgtcttattctaaagtcaggctaacctgtctgatgacccaggtttgctggggtgattcctggagaaaccacagggaaaggagatcaggggctctcctaagtttccttgtccccctctccatgcacagagcccttcaaagcggccccactccaccctgggggctagcaagtacccccacagcactgctggcagctggcctgtcaacctgagcgagaatctgcccccagggaggctcctaatttaatcagcttcacaaatcagctcgatgggcttaattgatctttttcactcctaatattgtcgctgtcactttctgagctgtgcctcctccagccaccccatgcatcgtgctcagccagctggagaggcagaggaaacacggagaaaacagccaggaggcccatggaagggagctggcacatgggaaggtgagaaggttggggtagtggggagggtcaggacagacaccccgagccagacctcatggaccgcacagcacccacagtggccacgatgggagtgcagagtggaggggctcctagtgagtcatcaaccaaagcctcaggaaagccactctgaacctcagtttcctcttctgtacagatcacagcaaagctctgcccttcacgatctgttcattcgctaggttcttgtggaaacctccatatcccaggcacatgctgggtgtaaggaaggaggacaagccaaaatgaacctgttccggcccttgtggggtgctccaggcaggcagacttcctgcaggtgactcccgccgtggagcacatagactaggaggggcaa

SEQ ID NO: 62792 - DNA, 454 bp, Bovine  19866880650285
tctcctaaacctctctcctgcccgcagtccttagtgggacattgagacactagcatctttccactcacatcccccaccccctgacaaagagttctgggagacttttaaaacagggtatctcaggtagtctggaaagagactgaacagcctgagatgtgcaggggagctgggcatgcacggtgctgtaacctcataccccagacaagtccatagggattagtgtcacactaatgaacactagaggaattaagcgtgatttgtcgctggttgtaaaatgcttccggtcatcatcaattcatcacagccattcaccagaagcagcaacgtagagagcctgtgagatgctgctggaaagagccaggctccctactagctagatctaggctttcatcccagggggcagcagagctgggacagaggcccaggctgatgggggccatcagactcttcagag

SEQ ID NO: 62793 - DNA, 4118 bp, Bovine  19866880657631
gagcctgaggactttggactcttggtccattgagcgaattttcacccaagccacgccggcagaagaaccccctggactcctctgtgcagcccactgctccctttccacacagtaccccacctagttcttcagacagtcagactctctttactgccccagcaacctccccaccgtgtgctcagatacccccacgtatacacagccactgccgagtgtaaattttaaaggaggacatcgcacagtcctttatctaattcatcagctcctccttcgtctatcttcacctcctcccctaaacagcccatctttcagtgcagcccgcctcctctctgttcctccaggtcgacacaacgctttcatgtccacacccttttgcgtgtgttggtctctacctgcgactgtttctccttatctgaaaacctcccccttaaagttcaacctccagctcagcagtcattcggcgggggaacggcctcaatcaagccttcttatgacaattcacccccttttccagcaggaccccaccctctccctctctgccggctacgtacacatcttgaagcccccattacgtagggtgagagcgacgttctgcccacctgcctgcccttcttgtggaccccttggaggatgaagactctggcttcctaatatttggcccaccaaggccggtcacagctcctggctcctgtcaaaggtcatatgccacagtaaaacctttctaagtccccctctcacacagggcgtgttcactcacttgtcctccctgggaagggaagataagtttatatgccattgaacagagagagagccaagctcagaaggataatcattctgtccaaacccccagagttccagcagttttgagcttggtcttcctgaacccagactctcccacagtcctgcagctcttaggagtgagtccaagttcatggactagagggtagaaatttcgagctttgtcttagacaacaggcccgggactagagggaggtgggagaggctcaaaatttaatcaggcacttattctcaggtactgcattgatccccaaagatgagagactccctaagttttctgccctcggcaggcaccttgctcacctccccctgctctctggcctgcccgggactcccgtcagctgtatcagatttcaggattggctgtgggtttgctgatttgtgcaatgaggctctctgagcgccagctctgtgccaggcactggaggcagaggggaggaaggagctgcagagaaacggacatgaagtctgctcctgatggggaggtcggtcgggaggagggagggggctcctgacacaggaactagcttcctagatgggaaggcacaacagccagactgcaagggctgttctgggagcccggttctggtgagatggctggaaacagatcagaaggtagcctggcacctgcagtgtggccaggcccacgcatcggcattgcatccagaggacacagttggtacctctgaagccatgaggctggatgtcccggatggagggctctggctaagggcagacggtgccagcaagtcacgtctcaagcaccagctattttcaaaaccgtcaccctcacctcagtcgggctccgtccttcagagtgagaagcggccttggagggcctgtgctcatctcctctagttttttaaacaagttcagtcagccatgcaccttgttctcctgctgagattccgtggaacatgccaggaggtggcagaggttcctgcccagcactactgcttgtactggagcagggcacgatcgggctttgtaaggccacggctggaaaaaccatcacgatggggtcgggggggacaggtttggctgagatttcccccttcacatacttctgctccatcctctgctgtgacccataaattcatcgagatgaagtcattccccagtcgtggctgtaaaaagtcagcctcatagctagagagtttgcagccgagttagattataaaataaaaccagggatttctggaggaggagggtcaaacccacagggccctgggggaagggagaatgctgttctgttctttttaacaaggaccagcaggttttcaactttgaaagattcctcgccccattgccccatgtgcccccaactccgttttgtacggggtcattcctgcaaccgtcacggtgcttccaaatgaaaccaaaataaagaatttaaaaaccagcctgaaagttctctctggcctgctgcatttgaaacaggcctcattgctctcaagtcgtctgaaatgtgaccagaatctgaggtctaagagatgccccagacccagccatcagctagggagagtcagagcagaatttgaacccagatctatgttaatccaaagacaggtttctcacttgcatccaagttctgaaatttctgtagcactgtggaatatagaggtagaaggaacttagagagacctcgttgcctgcagcccatgtcccaagctgtcttcatcaagttggaaagattattttgagttcccttggaattcttagaacgataagctcaaagggttgacttcagtggtgtgctggtatatgtttaacattgctttcaaaagaaaacaagaaaaaaacagcagtcaaacaaacaatccctcccgccccaccagcaatgtcttgatttgtagcatttgctgatttctgtcggagaaggcaatggtgtcatcctctaaccatagctgatttcaggttattgtgaaagcagagttagacagtctttctactgtacagaatcaacagatgttatagcgttatatagcatttctgccctatagataaaataggtgctgaacaatcatgttttcccaccatatagatacagtaaatgttgtagagttacacagtatttctgccttacagacataagggtgaagacatacccttgcctttcaggcgccctgcctttgcacacagtgggagctctgtgggcgcttccttactgatcggccacagttctcacggggtgtccacagatgtcttagaaataagctcagttttagacttgcttcagacagcctttgtgtcagagctgtaaggagcttgcacttaggtacccactgctgtgtcataaattatcccaaattgagtggcttaaaacaataaactaggctgtcccacagcttctgtggatttggaatccagacatggcttcaccgtgtcctctactcagggctcctcaccggaggctagggtctccaccatctcaaggcttgattgaggaggccccactggaaacactccagtggttgttggcaaggtccatctccttggggattgttgggtgggagggctcagtatcttcactggccctgggctcaaggctgccctcaacgtcttgctgcatgggcttcgccacagagaggcccttcagagggagtgagtgagagagcaagaaaagatgtgcgagatggaaaatgtagtctttataaccttgtcttgggtgtgacatccctttacttctgctgtcttctctccattaagaaaactttgtgaaatccagcccatactcaaggggctagcattacataagggtgtgaacaccaagaggtgagaatcactggggtccgttttagaggctccctaccacagaagctaagtgagaataaatacaactactatgggatttccctggtggcccagtgcttaggactttgtgcaggggcgctggtttaatccctggttgggggactaagatccctgcaagccacttggcatggccaaaaaagtaaatgctaaaaataataataactactaatattttttgagcttttattgtgctctggggactgtcttgcatcctttccatcaaagtcttatttgatctacagacaactcagcaggttcgttctatgcaccccatcttacagatgaaaaaactgagccctaattcccccaaaccacccagctaggagccgggagacctatggacctggcagtctgcctccctgaagctcacacttggtgatctggaccatctttcccaaaagacttttcagggatccgggcacacttccctttttgtagatgaaaagcctgagatccaaagagttttaatgacccactaaggtccctcagcaaattaggagcagggg

SEQ ID NO: 62794 - DNA, 1322 bp, Bovine  19866880669340
ttcctgggggtaggcctgcactctggtcccagaagaacctaggggcgtgatcgcccagactcaagacatgaaaatgccggctaggaactatgagctggaaaacagtgacggcaacatcagatggagccacctccctgcaggtaagtgaggagccctcctgagactcctgacaccccaactggggaatcttcttggccaggtttcccagcaagtcgggctgagaaccaggtctcggaagccctggactgctggattccaccactcctgcaggaaaaggcacagtgatcccagagcagcgaggaggtgggagcagtgggtaagaccttggtcacacctgtgctgccccctctgggaagtgtccccatctcctctaacccaacagccccactttcccaggctctgaaggctggcccaggtgtgtctctctcctagccaacaaaggtgatctctgcatgttaagactctaaagatccaaggaaacaacaaagagatccaaactttggtgtaaagaaacagaaccagaccttgcatcctggcctgccctgcttccctcctccctggtggcggcctctccaactcagcttgcttgccctgagtgtgccatgggtggcactggaaaacccgggctgttttggaaaagacccagccctccccagctgcaccccacagggcaagtgtgagccagtcacagcaggcgtcatggaaacacccctcccaccagctgtgcccctcccgctcacccccgcgtggcaggtcccttcttcccagtgccgcctgtctgcaatgggagaccagccctggaacttctcaatcagagagaattcccactgcttcagtgttgcttaattttttctttctctctctccagcattagtaataactggatcagatgcctgcatgagtcagcctagctagaggcccaattaactcgcccacatgcacccattaattctcccctggaccccgggtatcaggcagcaggcacctctccttgtgagcctggtacattcagagactcctcccactgcggccacacacatctaccccatcctgcccccactatctccaaccactgcccagattcaggctttatcacttctcttgacttgctcccaccttctaacagttgtccccacctctaagaccatctcaacaggtctggttccctccaccaccagctggttgcagggcggctgcctaaaagcagacctactcaggtcacaactaggctcacatttcagggtccaggcagcagtggcaggaagtaaggagccccccaagtcaatagagcatgcacatgggctgccttctgcaccatcagg

SEQ ID NO: 62795 - DNA, 1644 bp, Bovine  19866880796729
ttagaagttccctgtgtagtggcttcccagatggcgctagtggtaaaaaacctgactgccagtgcaggagacataagatgcaggttcaatccctgggtcaggaagagcccctggaggagggcatggcaacccactccagtattctcgcctggagaatcccatggacagaggagcctggtgggctacagtccatggagtcacaaagaggcagacaccactgaagcgacttagcactgaagtgacttgacaccctgtgtcaggcactgttcttggctgtacattaaaatcaactagagggggcttccctggtggctcagaggtaaagaacccacctgccaatgcacggttcagtccctgtgcagaagagtttgggaagattccagatgcctcagagcaactaagcccatgtgtcacaactattgagcctgtgctcctgaacccaaggggccaacaccactgaagctccagcaccctgcagcccgtgctctgaaacaggacaagccactgcaacgagaagcccacgcatggcaactggagagtaactcctgcctgtcgcaactagagaaaagcccaagcagcaacaaagacccagcacagccagatagtaaataaataatttttacaaatcaactagagggctttttaaaatcccagtgcccaagccacaccccagaccagtcagagttgagtctctacaggtgcccaggaatcattaagttttttaaactgactgcatgattcccatgcacagccacgtttgagagctagcattctaagcattccgcacaggaactcgttcaatccacaaacaaccttctgaggcaggtaagaattcttattccctttctaacaatggagcgcagagatgctaattaagccacagcagaagagaagagacaaaattttaacccaggggttgggttccagacactgccatcctaacagctcttgctgctctgtctcccggaaccactcactgtcttcacaaagctcctgcttcagagagaagccaacagatgatggagcccagtatcggaagagcagtacctggaggggcaatgcgaaagacaccgtgggttgtccagccaccagccatttccaactcaccttcacctgcctctcaccacagaggcggaaaatccaggctcctcatcccagcatcccttacagctagggtctagccaatgagataccaagggaaatcagtttggctgcttctgggaagggtttttcccaaggtatcaggacagctgtgtgaggagcattcctatcgcctatcagcccatcttcatccttctgcctggaatattgctgctgtgtgaggacatgtttggagctgctgagcccaccctgtgaccgggagaaccgcagagacagtgatccaggctgcagacgcaaccatcaacaatggaggaacctgcggaaccttctcttttcagattggttaaaggagataattaaaacgtcttcttgctttcaggtattcagttacttgcacctgcatcacttagaatgagctctgactgtgagtaacagaaagccccacaataacagtgacttacacaagacagaagcttacttctctttcatataaaagaaatctgaaggtaagcagtccagagtgacagggaagcatgtaagtca

SEQ ID NO: 62796 - DNA, 1428 bp, Bovine  19866880827116
ccggcagtgaggaaaaatattaggtacaaggagttccttgagggcctggagaaaagacagatgcatacacacgttcagttggaaaacagccggggagcaggcaatctggggctaaatgcagccgtcttctctgctgatggaggggtcattatattacagcaccacacttgctgtcaaaaacatctttaccagacacagcattaatatgaggcacaaggctgacttcttactcaccgctgaaacatgaaatcaaaaagcctctgtagcaaaaggaggtgagaggagaagggggtgatattgatgttctctaaatagacatgttggagaagggtatggcaacccactccagtattctggcctggagaatcccgtggacagatgagcctggtgggctacagtccatggggtcacaaagagtcggacacgactgaagtgacttagcacaaatagacatgtggaggtacgagaagggtgcccctccccacgaataaaggccccagtgggaaaaaaagatgggggtgtatgtagaaagtggaaggctttggacagtccactgggtgagcagtctccaactccagggtcgttcacgctgactggagtggtaggaacatggaaggaaagagttcaaagaaaaaaaaaagagagagagatcagttagggcccaataactgttgactgtaagccaacagaagggtttgcattttattccgtaagcaatagggagccagtgaatgttcgttgaaggagagattccatcagcattgagtttcagaatgagtctccacatgatatatgagagcagactggcagctaggagcatggccaggagatggaaacaacaggttaagggagcaggatgacagcctgagccagggcagtgaagatgggatggagaagaggagacagatgtcataatgatacagagaaacaatccaaacatcttggtaatggttgggcactgatgataacaaagatgcctgcaatgtgggggaggatgatggtggcactctcagaaggaggaggaagaacaggtttgaagggagaagacgacagttgcagacccatgctctgaatgattagtcaaagaccagtgagcaacctcagggcttggctgcatcagttagagggtcctagagtggtatggaactggagggtactgggcagaggaatccccaagggggtgtcatggaggagccatcttcccaccaacactgcccatgtgagctccagtttctgggggcctgcaaaaccaaaccttgagcacctatgggaactgtcaatatttgcctggttaagagccccagctagagactcagcaacagctcctccacacacagtaatcggcatcattcacgggggcttaggggaaaccgtctcaagtgataccacttcacactcagcacttacatttccaagacactccacagg

SEQ ID NO: 62797 - DNA, 1542 bp, Bovine  19866880833493
caagaatcctggagtgggttgccatccattctccaggagatctactggaccagggattgaacccgggtctcctgcgttgcaggcagattctttaccatctgagccaccagggaggccccaagtggcagatattgtcacccccatatccatgtccccttctcccatatgaatgagtgtttaagagggtggcttgcatggctgccctgaaccaggatgacacctccccagcctctgttgcacagccatgtggccaagtcctgaccaatgggacagcagcagcaatgttgtgtgataacttccaaggtctttgctaaggaggagagccagtgtgcatacttcatcccttcttctccatcattttctctgtcctggaacataaatgccaccttggactatcagggcaagggccacactgcaaggatggcaaggtggagatctagaaggttcttgggtctctgacacagtggggtgctatattggcatgacctactttcacataaaaaataaataagcttctatcttgtgtaagtcactgttatgctttactttttttttttttcagttgcagttttaatcctaaataagatagttgccatgaatgaggttgttgcttgagatgaagtatgtattaacgctcaatgacacagacgaagcgcagagacaccgctcagctttggtgctcactctacggagacagaagacaaaagacctcacgcagccatggcattgtctgcttctcatcttgctttgacgttgttttctcttctctctaccactcgctgtcctggagtccctgttgctccatattggagtggtcgtggccaggctttgattccaaatgcagaggacgtctttcattggtgatcatatacggtttacacttgaggtggaaattctccaccagcttggcatctctcactctgcctgtcctcaaccctcccgtcagcatgctggccatcagatgctggggcaagttccactgagcatccaaggcgtgacttctttctctgagcaccaatctgctttgccattctcaccattcccactctatcacagctctgagctacatcacagcagaagaaaagattttggaaacccctgatttctaatgttttaaacgaagcaacttccagagtaaataatgacatgaaaaggtctccctaaggtgttgcaataaaaaaaagaagaaaaagcacattccccatcacccaaatcaggatggactggaagcttccatgccaagttcatgtgtaagctccagaggatgcctggcctagagcagcacagggaactcagcgaagtgagctgatctgagtcatggcttggatcccaagtgttatatcttctctcatttcatctctcttgagcacatgctgtcccttaccctttataatataaagcttatattagctttaaccagtagtttgttatgtaaaatgttccacatgacagctcagctttgccctaattctcccatttcctgtaacctcttaaagatctttcttaatgtccttgctctgtaatccattaatttctatttta

SEQ ID NO: 62798 - DNA, 1131 bp, Bovine  19866880867872
caggtcagtcccaccagaggctggagaagacagcaggtgggtctccatggtgagcatacccggcagggttagaagaagttcagggcttttagggaacctaagtgagagagatgagcatatataacaattctgtgcataaggatggttactaaatagccaggttgatacctttctggcccttcttctatccatcctctttcccaaatagtgcctgtattcctagggctctgggttttccataagagaaagaaatccctctgtcttattatcattgatcctcagtgctctgtagagcatggatatttatggccaggtctgaggtggcctggaagttctcaggattatttgttgaatggatgaatggtcagagctgcctcttggttcttgtctttccgcaacccacatgcagacctggtctaaagccagagaactaaatgggccaaactgttttatttgaaagcccacttttctacgtcaatgtccatcaggtgtcttaaccaatttctattgcactctgcaccagatgcaaggcattgtggaggacagtggaaccaaaggcacttgttcctgcccttgaaacactaacaatgtggtcagtgggaaaaacccagcagattcagttgaatgagtcctcaaatgtcctttcatgcctcagccccacgatgatgaccattattgtccttatattcttggtccagaaaaatgcccagcatgctgatgccagttggtacagggactgtgtatgaaagccccttagccttctagacttcccttgttctctacttttcttggtgtgtggtccaatttccaaaatgtgcccactttattctacctgtatatctgcagatgtctgtcttagccaagtcatagttttcctgcacccacctcctgctaagactcaagggccattgtcctggctgtctcaccagcctctggtctcaatcctctaaggtaggtgggacacaaacacacacaatcacaattctcccactaatgacagatctccaggtcatgtccttaccacccaccgtggcataggcatatgagaaacctattcaggaggttttactttttttttttttttttttttttggtctcagaaggatgccattgggaaaaaggccaagaaat

SEQ ID NO: 62799 - DNA, 1414 bp, Bovine  19866880888809
tcttcatccctcatgggtattgaaacatgagcaatttcatccaattcttatacccctgtgggccatttcctgttaactcctgctcactgttctggctttgaattttgttttatttctggcatgagaggattttcccttcttgctttgagttcatggaagtggttgtaaattgacttgtgttctcttgtagccagcatgtcttcatgtgtgtagtgggtgtgacacttctgttgagggtggggagaatgctttccccaccaacttggtgttctgtagagagcaggaagtgatggtgatttgggctgtagaggctggtccttctgcctggtagttagaaagagtgctaaaagcagaagttccggaggagcctgagaagggaaacctgggaggagactccaagggacagagaagagcggcacagtgcgcgtgagaacttctgcaggtgggtccgtgtgagtggctaacacacaaagatcccctgaaggagggtatagcaatccactccagcattcttgcctggagaatccccgtggactcctcttgtcagagaagcctggcaggctacaatccatggggttgcgaagagtcggacacaactgagcgattaagcacagcacacaacacacaaacccaagtcatctgtgaaactggcctgtggttaccatgaacctctaggaacagtgctggtgggctcgactgccttctttgagtggtattttgaggaaattaaggaaaagggtccatctttcacattagggaccacttgaagtgcaaagacaaaagtagcaacatcagtatttttaaagaaaactggagcaggaaactgaatgtcttctcccaagaattttctgaaatctgggggaggacactgaacctcccacaggatgaggttaggttcaagctaactgtatttactactgcagggtgaggcaacctctagttcacatgtagctagactgaagcgacttagcagcagcagcagtaatatttcttgccttgtttagtctacctgacagactctgaacaaacaaaactagcctcattttctatgtgtgtacatgctcaattgctcagttgtgtccgattctctgcaactccatagactacagtcctctaggctcctctgtccatgggattttcctggcaagaatattggagtggattcccatttcctcttccaggggaccttcctgacccaaggattgaacttgagtctctggcgtctcctgtactgcagatagattctttttactgctgagtcactggggagtctctggagcaatggttttcagccagggggtgggtttggacccccaaggggtgttatctaatgtatgcaggcatttgtgattgtcatggcgtgggtggaggaaaaatgttactggtgtctcatgtgtaaaggccgaggatgctg

SEQ ID NO: 62800 - DNA, 764 bp, Bovine  19866880984854
cccgtgtgcagcagctactgaaacccatgccctagagcctgtgctccacaacaggaagagccactgcagtgagaagcccacgtacggcaactatactgtagcccctgctctctgcaactagaggaagcctgtgcagcaaggaagacccagcataaccataaataaatcaatagataaaatgtaaaaaacgttaacatttattaaggaaaaaaagaagtcaatgtaggtgggatcacagtttgttgcaaagcccacctaaaacaaaatataggatatgtaccttaaattctctcatagactgtctctcagcatcaaagtatttgcagttgtagctggaggtctgccagtgcatttgaatgcaagatatgcatcctcaaaacgcagcatctaaggccaacctattagctatgcaaaactatggatttctgcagtcctaaactcatttaaatcagcctattactataatagtgccaacatatagacatgatgtgagtcattgatgggtttgaccaagttgatgagacttctgctgttgaacagacttcaacactctggagaaccccagggcttattctgtcgatgcgcctataattccgtctctaggtttacatcagcgagggtgatttcagcttggtttcagtcattctacgcattaaaaaaatagtgctttcactgaaccagcaggaggcaaatgttacctagattttgatattgagtagcattcttagatttattgattcatgttccaaatttcagagattcta

SEQ ID NO: 62801 - DNA, 796 bp, Bovine  19866880985846
gaaggggtgcgcaattagtataaaattgacatttaggggaagcagaggctccctagggaagattaaaggacatttaaaaggctcttctgggaatcctggagagaggagatgaagccagagaagatggcactgggcagggaccagacaggagagacatcttaaatggagccggcgagtccccaggacaatcaaccagctggtgatggaaatacctctgagcctgcaaaatcctgacctccatcccacacaagagcttctggaaaaacggcagcattaaccccacaagaatgtctgctcaacaactgtgctgaaaatgagatgatttgatttggggaggtaaagtacatcttgaagttaaattcttggctctacttttaaaacctctcaagtgggttagaatagctggctcatccttaatggatggagctgggcactcccttcccctaccagccacttgaaaggatgtgaggacacatgaggtctccctttggatggtacatttctctcctgcatgggggtcagattgccctggggctcagagtcagggaggggacacacctgagaacctggattctagaaggcaacagggagcaggcccatcccctctacagaggaatctctcacacctcaagcccatcttctgttcaagagccactgacacagtccagcacccggactgtgtcccgaggtcacaggtgggaaagaagggtgagagggtgtgaagtcatgaccagcaaagacctgggtggggggcggggggtgttgcttggagggtaggtggtcaggttttagtgat

SEQ ID NO: 62802 - DNA, 1446 bp, Bovine  19866880995864
ccagagcttgtcctgagccataaggccctcttctgccaggaagccttttagaatccttccccacacccaactgcaaagaggtttccctcctttccttccctattagatttctacctcaattacactcttttggcatattcacttcctgacaccttctttatgtaggtctcttagcacactggatctcatgagcaggtggggctaccccacaaaggcagaggcattgcctttaaccctaggctacaaggcctaacccaagtggtatctgtcacagcttcaagcggcctaacactgagatggaccagagaagtcatctctccctgaattttacagcaaggggcaccaacttgcttcactcacccagtcaggcagtggaggaaccagactcaaacccaggactcttgacttctagcccagagtctctcacactgagggcctggaggactgtctccaggatgattcaggatattgaattaacaggcaatgtatacaagaagggacttatacacacgcatttccccaccaccaccatcctcaggatactgagttccctgctcatctccctggcctgctcacaattatagtccagtgtctgtgcatttgcgtcccattgatgagactgaaatgccagccattagtctccattcttcacactcttaaatgagagggccaagattaatgaagcatcttctctcaatcaagaagccatttcaggctgtgcttcttaagcccagtgagttgtgcagatgaattaatactgacctttttatttttcactgaaggattggtggtgctccccctacccctacactgtttgaggagcaatcctgctccagccgcttggttcagcagccaggagtgtgagcgcaaagtgatggtgtcacctcacagcactgagggcagatcattcccaggagcagttgggtggggcaagcaggctgatgtagcttctagagcctcctcctactcaatacacccacacctaacaaaacacaaaagcagacagaggacccaacaggaaagtgttgccaagccaagcccttgatgtgcagtgggggtcccggagccaagactggaactaagccagggtaacattcaaaatagctaacagcaaagtgtggcatgagcaccgaccaatcagggcagacgcccaccatgaaccaccatagggccagccaggcgcatcccaggggctatcagctgtggacagagcatttgttctcccaagaaatgaagaaggttggggtgttgatccagcgagagagaaaaagtaggcggagagggaagaggatcaagtaacatgatgggaagagttgaactcaagtcgtggaaacaatcaagggacattataaaaaagcaacatctaatcttaaaccttaagttgcttgtgtttttgcaagagaaattgctccccgttagtgaaggactctacatacaaatgtctgt

SEQ ID NO: 62803 - DNA, 1013 bp, Bovine  19866881090444
aattcacacgggaggtattacatacagaagatctcccccgtgcgctccagcaccagtctcccatccccgtgcatcagctccttccctgtgttggtttgctcctggaccaaacagttgccttaagtctctatgtcacagctcttctccctttccctttgctttgtaccccctgctggatgacaagcactttctgggtctctctgatgaaatgccaagggagaaaacgcggttgagcacttgcgtcactagctgctggcagcctggtcctgtggccggagagcaacagctaggatcggtggcagaggacctggccatgccccctctgcagagcctggaatatgccagatgcttgactgtgcagccctgggcctccccaccttgctttagagacacaggctgagcaaatgcaggtgacacagcactgcaagctgacgctgttgggctgcagggggaggcgtgggatgttcaacgaacccaatgctcttttctatgtttttgtttgctaaggatgtgagaggaatgggtgcccggggctgtcccagggcctctccttctccagggcagagctcagggaccctcctgcttgtagcaggtggttcccattttgccctaggacatggcagctctctcttggtcaggtgtgaaagctgccatttcacgctcatcttgcccaattaacaacagctggtcccctataaaaccaactggtgaggtggtttgttattggaagacaatgcaacatcattaggcattaatggctccagcctcggttcctggcccaagttcacagggttaatgtggcgagatgttgggactcacctggcagagctactcactccagtttgtaggcatcttgttcaagcttccttttcagaatcaggaactgggaggtgaagggcaggtggaggggctatattttctggaaggggcactgtgcaggaagtggtggatctgccacttacaggaaagagaccctcagtgctcctggcttgagaattgaggggactcatgga

SEQ ID NO: 62804 - DNA, 1062 bp, Bovine  19866881111824
ttacacccctgtgatcctgcgatcctgcttcctgggtatagatctcagagaaagccaccatacatgtccacaaagaaacatgtcctgcaacgtcaccatgtcacccctcccctgcttgccttcctctcactgatcgtaagatgcagctcaagcctgatccccctcaaagctttctccactaccatgatggctcctgctcccttcccccatgattccaccccactcttggctgctttctgtctacatgctcaccacactgtatatttgcaatgtgggcttccctggtggctcagatggcaaagaatttcccactgggagacctgggtttgatccctgggttgggaagatcccctggaaaaaagaatggcaacccactccatgtattcttgcctggagaattccatggacagaggaacctggcaagctatagtcctggggttgaaaagagtcagacacaggtgccatctgcatcttccattaggctgggagttccctcaacagtaccaactgtattttattcaccctgtgtctacagcacctagcactattcctggcacagagtaagcattcagctgggcggaatgaggaaattcataaaacacagggcctggatctggttcctggtatttgtaaggcagaactccatcctggtgttcagattccaccctgagtacagttatctcggctcttctgataagggtggggaggactgcttcaatccggggattcctggatatcggcaggaacttcacgtgccactccgggtgtatccttctgggggcaagtctgctaatggcctgtgtcgttttgaaggagaagacgtctgccaggatgtgatatgtactcagcacagctggtgtttgtcagccacaggcctcttggtctcactcaacttcaaccctccccttctcccctcctccccactccatgctcaagaatgtgaggcctggctccctctgggcttcaaaaatgcctcaggctgggtcctgtgaaatcttaacctttcctcccacctctattccctcagcatcaccaccttcatcgtaaaataatttatgcaag

SEQ ID NO: 62805 - DNA, 698 bp, Bovine  19866881163733
gcagactcttccctgtctgcctgactgctgagcttctcttgtttcgttttctatctatgatttctttccgatcatcttttcctctttaaaagtgtttctaacatgtttgatgtatcactctctgttcggtagtgaattttgtgactgtatgtgttttaactgcacatagaagttctcaagctagatacctcactcctctttcatttttcgtcattgtgtacatttagttcattggttctaataactgcacagcctttcctgtgagatctgttcctttccctggtggtggattcttaaacagcctccactgccccactcccacaaacatgaagcaacgagcaacgtccaggccagtgggagcactgcagagaattctagaccgtaaagtaaggtagttccctattcccggactgctctctccagtcacatttcccagaacagtggattagtggacccagtctcctgagtcttccgtcaaactcgataatggtcaacttctgacttcctggtgagctcatgtggatcaagtcacatcacgttcaaatgtgcattaggagtgatacacccttctttgtctcttagatttctccttctgtgacttgccttctcacagtctgtgcccattttttcctcttggatttcctatctttttcttcatgatacataagtattttcttgtatagccttgatatcgatta

SEQ ID NO: 62806 - DNA, 984 bp, Bovine  19866881175365
cctggagatcccggagtccctcctgacagccttcccaaagcggaatctcacctcttggcaactgcctccacctcctctggtttccctctcattggggaaggcatcacacagggagtaggatgttcagctaataaatatgtatgcaggatttttattacttaatagttgtaaggttaatcgtcgtggtgaacgcctatatttaatgtgtcaatggagctgcaaaatgccaaactgaatagctttaacacacattagttctacttgtgaatctacaaataggagccttgtcagaaaagtattcaaaccaagatcagtattgatttcggtcctcgggaaaggcactggactgtgacagtttaaaatgataaatgtctagagaattatttgcccgtattgataaaaagaagcagatataaagctgacagtctcagaggcgtcaccactgagcaagggcagcacgtgtaacattgttagggctctgggctaatctcccctttgatatggagaagatcctcttctgatctggccctgccctgagactgggcttgtaattgcagaggagggggcctctgagtgtgatcagtgggctccaggctcccgccctgaccactcccaccatagttttgaaagatagcattctgcagggacccaaggacctttcattccatccctttcctcttgctcagtaacctctgtggctcataatgcaaaactgaagcccccagcctggcctttaactatcttgtcccaaatgacaccacctccctcccagcctcagtactcaaaactcacccccacagacccacagtgtcagccagactggcagattgcagctcttgtgaacctccaccccccacctccgccccagaagcttggctcaagccatttctccagcctggaatgagccccttatccatttttagctgtccgaagcccatgctttcttccacataacacaaccccacattctcttcattctttact

SEQ ID NO: 62807 - DNA, 1974 bp, Bovine  19866881225739
tgaatgttcgcaagccgtcgtctaatcaatgattggtgattttctctctaatttccctttctttgcccagttgtgtttctactgatttcatgtttcgggaacataaatgccaactctgtgtttttaggaataaatcgagaggcactcacttaatcccattatccaagaaacaaaatgtctcagccttcacccaatcctgcaatccaatcacctgcagaggagatgagaaaggaaatccttctgttttcttttgctttttttcccccaaactagtagtattttagaaaattaattatgttgtacttgatatccagggcccaggtcctcagacagagctggggactgaaatgggacaatgttggttggttacagaggcaggtatttcatggcatccttcagcccctatgtctttgtagatgaaacaatatgttttgttgtgactctaaatacttccattcaagtaagatttagagcattatcaatagtctctttttatcacgcgtgtggaaattccacttttctcgtgggcctgtgaaagcaagacacctcagctccacctgtccagtacccttggtctgagccccagctccgtacatggtgtgacctccggcacagacccccagggcaagtggggacagctgcaggcagaagtaaacagaagaagtggacggactggatttgaaccacactctgctgtttcctgactgtgattttaggcaattgactgaaattttctgagccttagtcttctcattttttcaagtcagaataataacatccagcccactggattattgcagtgagtaaaagaaagcgctggggcacagggaaaggtctgagatggggctcagtgcttggggctgctacatatagacgcatggcttccgccttgcccagagacgcccagccaagggcctgtgaggctgatatcctgccttacgttcaatttaaacttgctggtcactcacactgggttcttaaaaaaaaattatccacccagatgactcaccctcaaaaggaaagagaaagcctctttgcaatttacacaaaagagcaatgcgcggacagaggtccctgagtacaggaggcgactctccaccccactccaatggttcctgctccagcactctcctgccaaacattgtccaaccttggctacaaagctgtgcaaaagcagactttgcatcatgcccttaggcagcccagctcatctttagatgtctctgttaaaaagtattagagttccaattttgcaagataaaaagagctctgaagatggatggtggtaatagttacacaacatttagaaatggttaagttggtaaattttaaattatgcgtattttaccacaacttaaaataatattttttcatctcaaaaatattctactaccaaaaacaaacaaacaaacaaaaaaacagagctagctccatttggtgctgagacgcaagaaactgcttggccagggagcagggacttgctctctgagggtcagaactgagtacccctggagggtaaaaagtattttcttatgtttgagctgaaatctgttttcatgtaacttttctccatggtggtctttggagcactaaaggataaacgtatcagtaaatattgtgggctcattgggctaatttagtgtattggttagattaaaagctagggcgcattacgctgcagaaaaaaagtctttggggctaagcacagcaaaaatatatttttcgctaccatgtgtaaaatagatagctagcgggaagctgctgtagagcacggggagctcagcttggtgccctgtgatgacctagaggggtgggatgggggtagtagggaggaagggaggatcaagagggaggggatatatgtatgcatatggctgactcacttcattgtatagcagagactaacacaacattgtaaagcaattacattccaataaaagataataaaacaaacatttctctcccacagtgtaa

SEQ ID NO: 62808 - DNA, 1698 bp, Bovine  19866881259554
aacgtgtccttgtcgaggtctcagcttcatttggtattccctccctcctcagcaaagcacctaagtgccttccgtgctcccagaacgtcagggaacatcagcaaggcaggcgaggaggcccccagacccgcgccccgcgctgcgggaagggctggctcactccgctgacttccattaaacatttgacgcatcgcagagctgccgaaagccatccatcacggccgcctgcctccttctgcctttctgacctgctcccagagtggggcctctgccttcatggccaacgtataagtggagtgggagagaggggacatggccatggccaggtgcctgtgaccacctcttcccttgtacagggcccaaggaggagcttcagggttgactgagccctgatattaacaagaatactgtctactgaatgctcagtgcaccgagcagaccggagcgccttctggagttcatctcccccaaaccccacccctctcaccaccgaaaggcacacttatcattgcccttcgttagatgcggagactgacattggaaggtttggttactgtgggggtgctggagccacactgggccctggcatgtgaatcccgtccctcccctcaccccttctctacttggggatggctgggaggacaggcgctcagcagggaggtaggggatgagcctgaaggtcagggtgtcctgggtgggcactccaactgggcgggcactttactcagtgcccagtggaggatcccagccttggatgagccacaggacagcctctgtgcatggtggggtcctgtccctccctccacccagttactccagccagaactgggcccctcctggcccctcgctcactcttggtccccagttcagtcagtctgaagtctctcagttcctcttcctgagtgttctttaatccttaagccagacccctttcacatatcacggctgctcgtggggactgctccagcccctgctggtccctggcctcaccttcaggttctgtttcttctccccactggagccagacaggtccagatgtgttctggagcccacatctgctcctcacccctctgcttaaaaacctgaactcaccttggggtagagcccacgtgtcttacttggctagacttgggggctgctcagctctccatgcccctctcccccttgcctctgtccacaccccaggctcatgctgaggtctccgctcctgctttgctctcggcgggggtaccatctcacgcctcacttcctggctgattcctgcctactactcaaatctcagcttagatggtatttcttccagggagccttccctggtttgccagcctgggctcaaggggccctttcatgttcttccctccatagtggcacagtctgaactgtcccaattgcttccctgcttggttgccaccctctagtgactgtcagatgcggggaggttgtgagtgccccctaccagtgttcccttggagtttagcacagggcctgctctgtagtaggcaccacgtgaatgaatgactcatgtgatgaatgaataaatgaagactgataaggccacggtggggccctgacggtgtggcacaggaggcaggggcagtgccagcaggaggaggcaatgtggagctttggagtttaaaccagaccccaagggggtgagagattgggcttgacatgtatacactactatgtatagaatag

SEQ ID NO: 62809 - DNA, 1576 bp, Bovine  19866881274155
atgagatggggcttggctccccctgtagccactcccccaccattgccttaatctaaatgcctttggatcccaccatccaccttcagagcatgtggttctaggacctacaccagcctgaacaccttcttttggacttactatcaaatgctccctcctccacctggcacccctatgtcagtgaggctctcatacttaaccccctcccactccattctactcacagggcaggggtactccaagcaagactagggacaccatctcagggggagctgggggatcccactgcaggcctagcttgctgtaaagagggagtctgcatctgctctgacagcctgcacacgctccccaatctggagccagggccccccatcttcctgagaagtcagatatctgctgcctgcctgcctgcgcttcatcagaattcagcaaaagggacataaataaataaaggaaactctgctaggctccttccgcctaacgatcaccaacatgcagacgcttaaagagacatttttccaaagcaacaatgggtgaaagccatcccgaccggggaagaatttgctgtcagatattattgttggtcgcatttaaaaaaaaataaataaaaagccaaagcagggggcctggggtggggcaaacatcatggagatttccatcagacccaagaggcttcctgcatttcaacttttgtttatttgtttatttttgtcaatacgtgagcgtttgaaattcgtaacacactcactagcagctagaaaaattccccaatcggagggcagtgtttgaaaacagtctttttaatttctttcagctgggcctctatcgctggatctttggttaatgtggattctttattcatgatctttccacctcctcatctctgtgcagctaatcagccgttggacatatggaattgttcatgctcaaagcggttagcaacgccccaggccagacgggcttcagacaaatgtgtcactcaccttttgggcagagccccccagaccctgttaggccttcttgggcagaacccctgcagcacaaagataacatgctcaggctgtgccaggccaggagcgtgttctcccaggctgcgtagggcagtgagtcaggtggctgcagggcttcccctggctccccactgcatgccgtgtggccacaatcctctttccctctccttctgcagcagttaagtgtggggttgaactagaatcaggaaaaatgctgagagaggcaaacagtcgagggcctctttgtagcaggacctctgaggatcagggactctcactatgtgggctgtctcatgtaatgacagcccgtggtttgctcagctcacctattgcatcagggtgagatgaaaacagggtttccgctagagcatgtctgactcatcagacacatagacttctgtccatagactctgaagacatccatcctgcccattaggcggcattggactcggggcagagtctgccctccttggaggtggggggggtcctcggctctcactgctccacccttttaccttcatggtgctgaagaagcaacatacgcctagagaggatctaccactcccttg

SEQ ID NO: 62810 - DNA, 1318 bp, Bovine  19866881274418
agtgtgggaaacaggctagggctggagctgacagtacattctgtgagtcaagggctacattaacagaggtccagtgggcagaggagggaggtgacaggcccgtgtgacacacgagaccagcctctagcaacttcgctgtctgagctcttctggcccttcgtatctgcacaaacgccagaccctgggctgtatggagacaaagcacatccaacaaaaacagaaaagcctcctttcagtcctggaagcacatacagaaagcagaggttgtgggttctgctggtcctttctagtctacaaggagtttcttttttaacgaggtgagcagaaaaggggttgggggtctccattatacagatgctgcaactgaggcctgagaagagggttgtggtttatctggggagctcagatgattccaggaggaatcaggctttcccattctcaggctatcccatggtaccatcctgtctttgaggcctgttctcccatatctgactgtctccatccatggtgagcagtgcctaaggcacagtagatgcttaggaaagtcctctgagcatttgctgtgcttctgcagagggactgtgatcttgggtgggttggaaagagcagccacccttccccctcgaggcccatcagttatcaaccagggagatgactgagtggagcgtgtgcacacgtgcgtgtgcacgtctgctgggcgaggaagtggcatgtgcttgggggagcctacagagcggcacttggctggatccccacctcgcctggctctgctttcatacttccttcccctgcaggcctagggaggccacgctgcacagatggccatctggctggcactttaggacacggcccagtgctcactcccaaccgtctcctcccttccttctctgcttcactggctccatggactctgaaaggagagctggacgaggatggagaggcagtgggggtgacgagcagagggcttacatacaggattgatccatggcagagctctccacactcaccatgattagactgtctttgaagagaacccgtgtctgtgctgtcccagtcctgaggcctgggaggcagcagggtcacaggatggggatatgctgtgatgctgggaaaacttactcatgtgagcatcctgcatggttccataaatactactgccaagagccagtcagggggactgcaattcagcccatctatccatccattacctcattcattccataaaccttttctgttgcttacagcatgctagaacctgttctagtctctggcaggacccctatcactaattcaagatgaataaagagccattgggttt

SEQ ID NO: 62811 - DNA, 892 bp, Bovine  19866881416487
tgtgggaaaggtagtatactcccattttatagcccagaaaactgaggctcagcaaagtgaagtgatctatccaaggtgacacagctgggaagtggcagagctaagattcgcacccagagcagtgatgggctgctcctcctgccttgagccagcacggctgctttggtgtcccagctaatcatggatagtttctccctgaggacaagaacagctgagcctgctatgaagtagaagagatagcacaacaaaataaaccaagacggattggagcagagggtttccaatggaatcatgttgcaaaactgtctttttctgcaagctgcccctcttaggagcttcaaagagaaacctgctcccaagcaggatcttttgcctgagccaaaagccatttgtctggaatattaatatgccagcagctgcctgtgacggtgtctgccgctgatcacacactcccagcaaagattccttctgggaatgctccgggaggctccaggaagctaatgggccccctgcgacacattctagttacctttgtttggctttcccagagcctcagatgggacctctgggtaggacgggacatgtctggcagcacagccacccaccacaccacggacgatgggtctgcctggctcatggcggcattatgctcaggaaagaacagagaaagacccttgagatctgaccccggtgctacatctagcaccagaaagagacaggctggaggccagcctcatcttgaaggaaggagcactgaacttagaggagacccagcctccggctatagctcagtcacgccaatgctgggcaatcttaagtcagccacagggtcccaggacggcagtctccctttctgtaaattgagggggttgggcttgatgctctctaaagg

SEQ ID NO: 62812 - DNA, 1463 bp, Bovine  19866881455423
tttcctgctctgtacagtgaagttggtgtgaatggtccttccacctctgactttctacaaccatatggaaattttggcctgttttggcttccaaattccagaagagtgagaatctggccaattcagaggaaacatgatgttagggtaaccattctctgcatctccttggaaaagagtttaggaccatggaactagaggagacagcagggggactgcagctgcaaccagcctgtgtggggcacctctgccaccctgggctttgagtcaaagcagatgtcttggtccccaatacatttagagctccagagagctctctccctccctggcttctcctactacccccaccctggtctgggccatagccctcagcactgtgagccagagggatgggtagcagtggagatgggggaattatcattattatacccattttccagataggcaaaccaaggcacacagaggtaaattgattttctgatgtcacatggccaggatgtgccagagatgaatttgaacacctttctgccttgctctactcggtttaagcctgtgttcttgaacaccagattcccaggcagatgagagacatcggtttcctgaccatttgggacagtccctgagcctgcaagagtgaatgccagagacacagccactccttcaggttgggttcaaggtgagacctcacctcccagcccagagatggagaattcagggtgggcaaagtgcgggacaaaccccactgctccagggcagggctgacccagcatagaaagtcagactcaaaagttccagcttatttctcccaggctctcaggttggaggccaaggccccctggagcagagccaggatacctttccttctctggtcatggctggcccagggaagggggcctggtgggaattctgactgggaggggctgacaacaagcaggaagctggcagttcagtatggcaggaaagcatgagacagagggtgaaggaccctgcatcctatgggagaggtttccatgaatcccctcttggcactttacagtctgagcactgcagccactccagaggcctcctgggctctgctcccagcctcttctggagtttcttttggagttccacagctgagcctgatggagaagcaagggaaggccagtgtctgtgttttggaactttcctatcaaaataaaaggagctggggaaaagcgaatactgttgaagcccaggcaaagatggagaaaactgtgccttttatggccaaagctattaaaagtctacttaggaacacggtggctggccgaggtttgccttcctgccaggattcctcccagccttccctccgctgttggcccttcctgacttcacctcggcgcttgtgaagggttttcaggggctcccgacaactttacactcgcagcttggcgaacacccatctgcgtggatctcaaagcgcatcaggattcatttccaaggac

SEQ ID NO: 62813 - DNA, 1833 bp, Bovine  19866881480513
cagccagactcctgccatcgcctcattgtgggaagagtatttgttcatgcttcttaactttgggctcagctgtgaaacttgttttggccaatgtaccagatgcctgaataaagattcagaaagatggcgacacccgggagtaaggctaaatctaataggagggagtttaattggaactggggacttccgtccaacatggcggacaaagctgacacatgatggaaagtgccagcgtgccagtctgggcctgagtctcccttgcttctgctggctggctgagtctctgccagagtcttgaaaggtacatgccctggttattctgttggtctaaggaagataagagaatggagagcagggctacccaagctgaccacagataaggtgtccaaccatcccagttttcccaggactgtgaggtgtactgggatgtgggacttggaacacccaaattgagaaagtcctgggaaaaccagaaagagtcagtcatcctacccacacacttggcgagagaagcatggccaacccagctgcagtctgaagagggccaccttgccactacagccttgatcaggcaatgcagagataggcagagagcgctgtcagctgatccacagacacatcatccacatgagtcgttcttactgtatcctctctgactttgtgattatttgttccgcagcaatattgtggcagtagctaacagagatattgccatgaactcagatattgtcactgtgaggagtgagctgcccacaccaatggaccctagagccgcaaggtgactgaaaaatccacttcttggtcagtgtgttaaatcagtggctctctatcctgatcgcatattagaaaactagggagcataacaaagccgaacatccagaacgctttccagagagtctgttcaactcttctgccacgcggtcctggcttcatcattttttaaaatccccacctgatgtgaaggcaggtttgggaattggtggattaagtagtagaccagacacagctgaaaaaacaatgctgaagttggctcagtggaagttcctgtacctgaattggcacacagcagctccttctcaccctggaaggggagaggcagcttggaagaagtttctgtgatggagactcaggggtctgagtcgacccaggatcctttgtgttctcagggtcctggagatgtaaagaagcgtggggaggagcgaggtgggagtcctgtcctacacacccgagttctgtcctctcctctaagaggcaggtgcacggtgtgagctatgtctaggccgagcttcccaaactttaagtgcccaggaagtggctgtggatcttgttaaaaacataggttccaactcacgtggaactcataggtctggggcggaactgattctctgcacttctcaggtgatgcccatgggctggagcacatattgaataggaagggggtgggaaaagaggggagaggacgccaggttccatgatcccctggactgcttataccagagagaagagggttcatgaaggtggcgggtgttcccattctagaagggctgccgtgggatctgggggttcagcacggccccatagggcagatctggggcacagagaggcgtctcattgagtacggagacaaagttcaggatgaaatgactgctgtgggaggtgggttgctgcccattccagcaatgcagtggggctgtcaccgggagcaggacgaccccgcagggggagggcccaggtgtggtcatccacccggagccttcagggcctcttcctgccccagactcttggatccttgaggtctttcgtttctgtatttggctcaagaacagagcctgg

SEQ ID NO: 62814 - DNA, 1268 bp, Bovine  19866881500121
ggccaaccaggagctgagcatccaagccagggggcctgtgtggcagcaatgccagcctggcgtggtgggagctggaccagggcagaggcagggcaggtgtggagcccagaaatgggaagacccattgggaggaggcatcatctccaaagcctgggctgcctaggtaggaggacaccctgttaggggtcttggtgatgctgtcattctgagagatggagtaagactggcctccggaggctgtgatgtttggattggagacatgttgcaaccctgcagggttgctcagaggatcgattgagtgtaacacatgtacagcacccagtgcactgcctggctgggagaagactggagacagggcccccagggaaggaaactgaggccattttccttacatccctggcatcatgtgctgagctgggcacagtaggtgttcagtgagtgctcgtcgagaagaactgtgggctggaccccagtcaccgggtttgcggccatcgcaaacgcaacacgcttcacagcacggggttcatcctgcagacctcatcaaccatgcagtcatggggagatcaattggtccggctccagctgttgaaactagcagcagagaggaaccatggacaaatagtcctcagctcagcactttctccatctgggaagaaaaccaggtgtgggggggagagcaccaggccatcaagaggttacgaggccataaataagagatttgtggtaaataagctggcgaacatatccgctcgctgctcttttttatcactcacctagagagcaaaattcccccgcatcttttctgcaggccaataaatatctttcaaggagccggtatttacatagagagtaaggggggctccacggctccccaggccctgtgtcaagaaggaacaatgtatagccctaaagagaatggctgtgcagagaatcgatgcaaatgcagtttcttttcccaggatgatgctcccgagcagggttcagcccgagttcaaggattgtgctctggcggtggtgcgggcccttctctaagccacgggggatgactctttcccctaggctgggggtcacatggcccttcctgctctagggccctgtgcatgaaactctctctcccaaatgaagcagaccctaaggagataataagggacctctagatcaaccactttccctggtggctcagtggtaaagagatctacctgcaatgcagatgacacggcctcgatcatctgtagtatagggaggatcccctggaggaggaaatgaca

SEQ ID NO: 62815 - DNA, 1037 bp, Bovine  19866880561536
aaatcccatcatctttgaccgcaaggaagtcaaactgaggctccacgtcaaagtcattaaagatgaggtgaattctgctgcctggctcagagatgatcagccagacgcagttcatgttgttaccatactcttctgggtaattcggcgagaggataattcctgatgatgccgtaaagttgaagaaacaggaaactgtgaagacacacagataataatggtttcaaacagttttgtccacatccaaagatctggctgtgtgctaaggacctgggaaggaagtctataccagcagttaactaggatggttcaactttttctttttttttaaattttgagagtatctactgaatttgttacaatccagcttctgtttttatgttttttggcctcaacatatatgggaatctcagttctctgagcagggattgttgtgggttgtgaacagattaagttcaacatacagaacaaccatagccgatacataatcaagtgtacgcttgattcaaaaatgaccctgtcaagttgactgaaacttgtggcaaatattaagatttcttgttataactttctgccttcagaagagcaaatattaatatgaaaaattatgctggtttcataaggacaatttccagaaaacaaggttgattctaatcacttccctatttttcattttaaattttgcacatgccttaaagcatattttttgaaattactttttaagtcatttacagggtaacaatgattaaagaacaacttggaaaatcagaccaaatcctggtggataatataaaagtctcttggaatatttacttaatgtgtactgagaaatcagtaagatatatgttttatatatgtctataaacatattctttgggagggagcatctattggacttatttctagggtgtggatttgcttattattttacattatttctgtatgtttccaggttattgctatacttagttataaaaaaaaaatctgtttttcaatcttctatgtagtccttcttttctacttgttaaatcacttacaag

SEQ ID NO: 62816 - DNA, 964 bp, Bovine  19866880572397
tgttggagcttcagctttagcatcagtgcttcccatgaatattcagagttgatttcctttaaggttgactggtttgatctccttgctgtaagggactctcaagagtcttatccagtaccgcagttcaaaagtatcaattctttggtgctcaggtttctttatggtccaactcaaatctgtatatgactactggaaaaaccataactttgactatacggacttttgttggcaaagtgatgtctttgctttttaataaggtgtctaggtttctcataacttttcttccaaggagtaagtgtcttttaatctgtggctgcagttgccatccacagtgattttggagtccaggagaataaatggtcgaaaaccgttttgagccaattattaaagcttaagactattggaggacactttcaactattttcaaaagacttttataattgcctcttgctagttaattgcattacttaaggaaacattcatatttaaatgtttcaaatccataattaatctacacacaagtggattcgaaaatgtcaacagagagtaaatatatagcttaataaacatcttgaaggttttcaaatgagtacaaatcatatttgtatatcctttaatatttagagcatactcctgagtaccttgtaattttaccatcttggcaattccaggtcttgataaatagcccctttaactctccctcataagttagaaacttttaattttccaaatatgtaagtgctttgctgaaacatccaacatacaggttgatgcagcctggatccaatccaggtcttcccaacaaaggtcagcactgtcaatggccttgttttaaaatactttagatgatctcacagatgagttccacattaattgactgatatttatatatgtaaaggcactggcaagggaggaaagccaggcatcctttgggacaagtaggaaaaagtatattagtacccac

SEQ ID NO: 62817 - DNA, 1362 bp, Bovine  19866880792697
aatccagcaataaaacccaaggagggtcatcatgccctcctccaggggatcttcctgacccagggattgaacccacgtctccacggttgcaggcggattcttcaccactgtgccaccttactaattatgcagcctatctaattctgccctagcaaaagtcaaaactgtatacattgtcaaatatgttttctgtgaaaggacactctacctcccagataaaatttcctgagttaagaccagcagtggacatgacgagctgacacaggatgatgggctctgtcacctgggatgtttatctcgtcttcagtaaatgatgctattagataaggatagtcaaacaaagtgagcaacagataggatttttatgggtttcccccttgaaaaatatgatgataaattcatacaatagcatttgatttctttccctccctaccaggaggatcaagcaaagcaaatgagtttgcccttcagtttttgaagctttttgatgcatgacaacctaaagtacagtgataagaattaagctccacactttaaacgaacaataagccagtttttcaagctgtctcctttagtctcccttctgcttttttttcccttctcatttttagtttcacattatttttttagaggtgcaatgcaaaaagtggctaataaaataaaaacaggcataaccaatgattttctacctataattgcccctcattctaccatatgagcatactggaaaaattctgaagccactgacagtgtttctcttgataagaaaaggaaacaccttttaaacttattccgaaaaatatttactgtcaatgtattgaaaaaaaaccttatactcagaaaccatttctaatgcaccatatgtgtagaactatacacagggcacaccttcttctttgctttgaaaaatataaagtcagtgctgctataactgtatgattatcaataataaaatgagtataagacatagaaaagtaaaaaaagaaaagaaaatgaaagaaacacatagctaaaaccactaaacagaatgaatttagctaattaattttactactattcactgagtatctggtttgtgccaggcactgtcttggctgatacagaaaccacaagtgggcaggcgtgcagggattttaccttctgatcaatcaggaggggtaagggggtgcccctccctactttggccagtgttcggctttgtgtctaggacctttctgccacgttaataataatgaatttattttacatgctaataatagtaacacacagatgcttcatcactcccaagacatctttttttttttcttccacattttagcatctctgatttgggatatgtcttacagtcactaataagaggat

SEQ ID NO: 62818 - DNA, 2692 bp, Bovine  19866880813560
gggttttcatgacattaaaaatatacatgtgagagaaaggcaaaaccaaagaaaataaaccatcgaaatgacatccacaaaacttccacaatggcacttttgatagactttattctaaaagtctatcaccttaatctcgaatgtagacacatggtagcaatggtaagagaagagaaacaggttacagtttgtatatttaaagtaaccaatacaaaaacagggaaacaaagaagggaaaagcctgtgggcagagctctgtttcttaggagtctctgggctttgcgaacatacctggattcctgatccttctgtaacgatgatcttccatatgcagtttaagttgttgccataaggttcagggaagccgggggataaaatggtacctctccgctgagtgaaattgccactgcaggggactgaaagccaaacccacacttagtgtaaataaagtacagtgaagaacactaattgtactcagtgccccttcgctgtgtgatcagctattaagagatattacatggactatgatacttgaaaaggcatttgtagccaaggtcagacttagtctgttttcttttaaatgatcaataccatagatgatcatctgctctgctgctaagtctcagacactgtacccaacaacagcatctctgaagtgaactctgtttagagtaattgctctactacaagttaagaagctctgtggagttttctcttccatatgcagacaggcagctccaacggatactaatgggatttgtgagcaaatccagagagaagagatgcttaaaaggcacagatgaattcaagtgctaatcatgattgccctggaggtccttacacaaaatgaagcaaataaactatcaccaacaatgtctttgttatttgggatgtattaacctactatttttcagatcttcatcagcaccaatttattaaaagggtattacacaagacatgaaacaaatcaacattataatgatttttcccccaaatgaaattatgttgaatacccatggcttgtgatggcatacttaataagtatcaaaaaggaaaacacatttcatacttgttaatctgatgacttatttcatgaaacacagtaatttttaggatttggctgctactcaattatttctgataaaataatttgccctttaaacagatctggagcaagagtccgcttacgtggaccagagagagtccttagtgaactgggactgcagaccccgtgcaggtgatcacaccgtggggacacacacttacccacgcagctggggatcgtgtcattccactgagccagagcgttgggcacagactggcagcggatggccgtggagccctggagcaggtagcccgggctacactcgaagcggacgatggaccctgcggagaactccgagccgattctcctcccgtacctgggctcggggacagagctgcactgcgtgtcactggtcctcgggacagctagaggcaagcacacagcacaagcatctgtgtctgcagcacaaagccacgatagctccttggaaacagatctaagatgaatccagggagagtttctgctgatgtggaaattaataatgtcttttgcagactctatgaggaatggctcagggagcactgccacatctacatgcctcctcaaatcaaccccgaggaccacctcagattcccatcacagatggggaaaacatggcccatggagaactggcgctttatgaggacagagtgatattcaggcactgaatttaactaagtacccagattattgtgccggtgataatgagatgactaagaacttgcgctcatccttaaggacctcagactctagtgagaagagctgctatataaaggattacttataatgtgaccatggtgattaaaaagcaaaattaaaaacagaactaccatatgatccagcaattctacttctgtgtgtttgtctgaaggagatgaaatccctcccctggaaaggcatctgcacccccatgtgcgtcagggtattattcgctatagccaacttatggaaacaacctccatgtccaccaatgaataagcaatgtcgtatatacatatgatagaatactattcagccgtctaaaaaggaaggaagttgagctacttgcaacaacatggacggacccataggacatggaagtggaacaagtctgtcatagaaggacaaatactgcacagttccacggataggaagcaattaagagacaaactgagagaagcagagagcagatggtggttgccaggagatggggggacgggtgcggggaaggcagagctaacatccaacggcagacgttcaagacgcccaagttctaaagatcagatcagctgacaaagctgtgccaacagttaacaatgctgtattgcctgagtgctaagttgtgtctgactctttgctaccccatggactgcagcccaccaggttcctctgtccttgggattctccaggcaagaatactggagtgggtttccatgccctcctccaggggtcttgccaacccagagatcaaacccgcatctctcacgcctcctgcattgacaggcaggttcttcaccactgtggctcctgggaagccccgaggtgccgaatcatgcactgtaaattttacaaaatgctaactgctcattttaaacaagatgaaaggacagcatagagggtaatctcatg

SEQ ID NO: 62819 - DNA, 1633 bp, Bovine  19866880827523
aaaatattagatgggtttaaagtatatatttgacattaaaaaaaactagcatttgctttcagggtgatgaacacatccttaatcatggtgatggtttcatacatgtataggtgtctcagaacatagtaaaattttcacatcaaacaggcaggtgatagtattttaattatacctcgttcaaaattttaaaggttttcagaagaaaacacccagaatatctttatgacttgagggtagtaagccttcttaaacactgtctgtaaaacaccaataacaaacgaatgcattgaacaagtagattattttcaaatgaaaacatgctattcttcaaaaagagaccaagaagaagaggaggaggacagagacagcatgagagaaaacattccacaatacatggattcaacaaaagagaggcccccaaatgcataagcaaggcttattattctataagaaaaaggtatgttacccaatataaataggaggaaagaaacaaattattcatggaggagggtgtactcttagccaaacaagcaggaaaaggagctcaaaataactcaaatgttcatacaaagtatcatggaataaacagcggtggtacatttatacagggaaacagatgacaggaatgaaggaggtgcagttaaatgccatgccctggatgtcacagtgtatgactgagtgaaagaagctggaaatagcaaagaaacatcctgcatgacttcctccacatagaatctttagggacaagggaactgtagcctttgtggaggcagtgactgggatgaggcaggactcctgggttgctggtcacattcatctactgatctgtgggcttgatcttatacaatatgcttgctgtgggaaaattcattctataaatagaagctctacctcatagagaagattctagataaacttcaagcactaaacagccatgtttttcaggtctaagaacttgcaaacagaagtcctgtttcagtcacatcctgaaccaccccataaaatgctcaccacccaaactgtttatataatttctgtgcacgtcttcctggtttgctgctccacctaccgtcacagctgggcaatgcgtggttccactggtggttccgctcacagaccaggggctcgtcgtcactcagcgtgtagcccgggtcacagctgaaggtcactgtggacccggatgccaaagtgactgccgtgccgatgcccgttcacggggatcccaggatcgaggcaggagtcagactccagagtcacacctggacacacagggaaaaccatcatatggagaccttcctaggttatagaaaaaatagtatctgtgccataatacaaacaaaatattcctagacgtgatcagacctggaaaattatggaagtgaatccagtaacccattcacatgaagacaaatatattttcaaatatttgcttttactgtagataggtgtatgctgttacattaataaccaggtagtagctagggagtaaaatcttgaataatttgctgacctccctgaatttctctttctttgaaaatcaatcaactgtactaaacaaagtctaagtctgttttctgtctctcatctctccttattcttatatttgatataccagtagatttggcaatcatac

SEQ ID NO: 62820 - DNA, 2501 bp, Bovine  19866880887281
actatatttccctgtacagtataactttgtggcttatctattttatacatactagtctgtgcctcttaatcccatacccctgtcttgcctctccctctttccctttccccactggtaaccactagcttgttctctctatctatgagtctgcttttttaaaatattcactagtctgctttatttttcagattgcagaatctaacttatatgcaataagtcaattatatttcaataaaactggacagggggaaagacatgaccccaagaacaggagaagtgtcattcaggtgtcctgtttctctctgttcctcttcctatcaatcttggtggcatttgacaaaactaaccacagctaaaagggcttccctgatggcttagttggtaaagaatctgtctgtaatgtaggagacccagttttgacccctggtttgcaaaggtcccctggagaaggaaatggcaaaccattctagtattcttgctggggaaaccccatgacaaaaagcctggcgggctgcagcccatggggcctcaaagagttggacatgacttagccactaaaccaccaccaaccacagctaaaaccccagcactctgtggaatccagaatttagaatttcagttaagccagcatcttagtctcagtaattcaatgaacaaccattctacctctgtcgtgagctaggcctggtatcaaaggtggacaaaactctggcctcatttacaatctacgtgtgcatgtggccaaagacaagaatgtgtggtcaacgttccacggaccccacgagtcctgagaaagcagagagggtgggtggccgtctggtggcacctgccgtgtactgtctgcaggtagacaggaggcgcaggagcccagggtttatgaccaactcattcctataaaacaaccctactctgctcggcaactggcagccccaagggcctctcttgctataaacaacaaatgattttttaaaatgaaaatgtacctattaaattatcttccaataaagtaaattagggagggatgtcgtgtagttacggccgctatttacaggaaatccatcttgggactccgaggaagcgagatcaccctggagcccgtcttccctggggtgggagggcctagaagtctgaccgctggaggctcagccgacgtttacttaaccccccagagtaaaggtcactcctgtgaactgaactccattttcttgcattttatgcatgattaaatggtaattaagctttaatgaaaagtgttaggctgattacaagtaacataattgcactcgtcagttcttgtcctcatgcgttacatgctgtgtggagctggcgggacaatggaccttgagcgggcttgaataccttgtgagcactggtagttctcctttctaggggagggggtgctgttctacagcacagggcaggtaaagtgcacggcagggaggtgtgctgtgcagctgctccatcagcggcccgtcgaacctgcacatggacgtgcagcactgtggttaagggtcaccaccaataaccagtcgttcctcgcccaaggttgccttaacgctgggaagaatgatcatttttataaaataaaataaggaaatttaacaaatcagaggttaaactatgttcatttaaagtggatattaatctttataaaatgaaaatggactgcttggtttctacctggtatcaaaataattaggtaaagataaatgtataaagaattataaaacttaaaaaggtcaacaaagatgcatacgaaggcaatggcaccccactccagtactcttgcctggaaaatcccatggacagaggagcctggtgggctgcagtccatggggtcgctaagagtcggacacaactgagcaactttacttacactttttcactttcatgcattggagaaggaaatagcaacccactccagtgttcttgcctggagaatcccagggatgggggagcctggtgggctgccatctatggggtcgcacagagtcggacacgactgaagcgacttagcagcagcagcagcagttaatgctacttggtgttgctagggagaactgttagctactagtgcttctgctgctcaactgaatgcataatatttagagatgcccatagaagaagcagcttgactacagggaaattcctaaaatttacatcttccaccctggttcaataattttatgcccattttactttaagtgaagcacagagaggttgaataatttgcctcagttcatatgtgttatgtggatggatcaggattcaaacccaaatctttctgtctccacaaacccaatggcacagttccacttttcactcactcctagataaagatgaatgctaaagttattacatgctgtatttaaagaagagagaggagttcccccagatggataagaatctgcttgccaatgcagaggacacaagtttgatccctggtccagaaagaaagactccacatactgctgagcaactaaaccaacgtgctgcaacta

SEQ ID NO: 62821 - DNA, 1291 bp, Bovine  19866881195910
caccgtcacatcttggaaaagggtagttccagtttctgttgatcccatgctgacaggtgagcactgggtggccaattaaaatgtacccaggatagcactcaaaagatattgattgtcccacactgtagtcagagttgaccatatacccattctggaaaggtggtgggtcagggcagttctgtaattcataggctgaaacagacagaaacaagctcataaataagaagtgcattagtctggaatttagaggaggaataggatgacatacagcttcttagcatgaactttttagatataaattttatgaaatctttactaagatacccattatcatccagtcgcatcacttcatggtaaatagaaggggaaaaagtagaagtgtgatagattttatattcttagtctccaaaatcactgctgatggtgaattaagccaagaaattaaaagattcttgctcctgggaaggaagctaaggaagctaagacaaaccccaaaacagcgtattaaaaagcaaagacatgactttgccaacaaaggtccatctagtcaaaactatggtttttccagtagtcatgtatggatgtgaaagttggaccataaagaaggctgagcaccaaataattgatattttcaagttgtggtgttggagaagacacttgagagccccttggactgcaaggaaaacaaaccagtccatcctaaaggaaatcaacccgaatattcattggaaggactgatactgaagcttctatacttcgaccacctggtgtgaagagctgattcattggaaaagaccctagcgctgggacaggttgagggcaggaggagaagaggatgataaaggatgagacagttcgagggcatcaccgacatgagtttgagccaactctgggaaatagtaaaggacaggaaaacctggtacgctgcagtccacagagtcacaaggagttagacatgacttagcacctgaacaacaacaatataaaacagtacttgtttttagtagtataatcataagaatttgcatttagtgaagacatattgtgcactttagaagttatatggtacatactaaaaataaatttgacaagacataccttgggaagaaaatatatgagaagaattaatcaaaacaagttcagacaaacaaaaagtgcttgtaaagaatgtcaggtgaacacagacctaacaattttaatttaaaagaaaattaccccagctctcctatccaagtgcttctaactagaaaacatgctattgttttgtttagttcaattaatgttcagtgca

SEQ ID NO: 62822 - DNA, 1694 bp, Bovine  19866881199246
ctgttctaacgccaggcgccacagatgacccacaggcaacaaagccatacattcaaaacattcctgtaaatacgtaagagtgtcaagcatgtctctgttggagagacctccataagctaaatcattttctttatacatctcagtaaatacgtttagttgaaagaaatttggaagcaaggaaagaagaaagacagagagagggattgaaagagacagagagagagagggagagggagaaagtaaagaaggaggaaggcaggcgagaaggagagaaggcaggaccgatgactcctagcccctcctcctcacctgtcacctctctgccacctgctgtgagagctgagccacttggccagtctgtaagtcgcaggtcagttagcatctgatctacttccttacctactgttgagctaaaaacagtttgcttttatagcctggcccaacatctgacaataaagagggttgttttttcttttttttgactaattaataaactatactaatggatttaaaaatatatatatttttggtggctgcatcaaggcctagaacctgtatggtccacagagtttcataaacacccatcacattcttcacgggaggaagaacacagaagccgacataagaacaatcaaaaacgaatgacgaattattgaaatttctatttttcatccaaaaactatgagataggatgtgaaacgagggcaagattagaacacttaaaatatttatttcctttttgggtataaaatcaaatggcagggaaacggcttaaaacgggctcatttcagatgtgcatatgcagatgtcagatgaattcattcagagatacatttgaaattcacagaacggcctggttgagaaagaaatgagagattgcaagcagatcaaggggcacaaaaaccctaaaagatggccaatatctccaaagtaaaggaaatagtgaaagtggcctttccctgatttggaattaatcttgaaatggaaatgggattatgaaaattataattttatgaaaacttagcatattaagcaggataaagtatccagccccatatcaaaccacctaatatgtatcaggaaagagaactgagcccaactctaatctggtttagaatgaaatttttagctatctaattttcagcgaattgtgtccagtttgacatcatgaagccaaaatgaagggattaaaataagcgtaacctagttatccttctattatctcacagaataccaaaagtgtgttattgcaacaagaaaacccatctgaatgcccatctagggtgaaatttacactgaccgtcattacacattggaaattaagtgtcaggaaaaggcatctgctgaaaggattttgaatctggacttgacaaaactttgaatatgtaagctgaccatagcttcagagttaaactcttgtctcttggttgacagaccctgtggatagtaagtgctctattgtacatcatctgtgcataataaatatatagcaaatgagtgaatagtttcagaatttagagggagtattctaaagagtcttttatttcatccctatgcttctagatggcccaaagccatggccaattttgaccccatgctgtgtgatgtaagtgcaagggtttcaaatataaaaagtaaagcagaaaacacaaatgatttaatcctctgttaaatatgcttttagaaactttcaa

SEQ ID NO: 62823 - DNA, 1317 bp, Bovine  19866881259157
ttttttattggaactctattaaactcattctatttagtatttcaagaatatatcatatgtcagtcagttaaaaaaaatggaaaggccttgccttcaaggagattataaggttagcaaaataataaacacgaatatttattatgcaaaatcaggcacgaggagtgctttgatgactgaaggtacaaaagacggtgattactggggaagtgattgagagtattatcttcatggttaaagcagtgtttggctttaaagtggttccatcaaattttggattagaggggtattgagtgcatatcttaccctagatacttttttattgtttaactttacaataataacactgatttggtatctcagaaaactgacttcatttttgtagttagatttgaatggcacgtactagtttgctactcagagaccatcccagagagaagaagcagtgttagcaaagacatcctagaggagcagtcttggggggaaatgaagtagtgtcctaggatggtgcttgaggatgagggtttcttagaaatgttggaatcgggtgatgggaatgacatcaaggaggatctagattcagtgaatatccttgtctgagcagaagtcacttcttcaaagcttctatttgattatctaatttttactatgactttgaaatttctacaactttaagttaaatatatcgagtactttatttttgaagaattcatctgaaatagaaaagtttgctgtaaacctaatattctaacattataaatacagtatttctgaacgaacatataatgaaattaccaactctgtggacctttgaaatgctaaatacttatatcccaggggcaaaaaaaggaaaggtatccagctgtgtttgaatttctactgtagaagttaaaaaaaaaaagcatataggtagactttttagatggtatttttcacctgtatgtttccattctttatcattatgtaaacaactataaaagaaaaacatttgctgtgtttcttaaatagtacttttaaccaactacagatttaataacttaaaacagcatttaaaaatcattttataaaactagcaacagcagtgggatatctgatattttttattaaaacactttaaaaactactcaccattttacaaattcatgtttttatgtaaaaattgctttgaattgttaggactgaaatccctttttacttgtagttgtttcctgagttctttgaattcagatgtaagtaggagactccttggcttgatataaaaaatagaattaagtatttaattgtattccatgctttttcaagctcaactttccaacagga

SEQ ID NO: 62824 - DNA, 1507 bp, Bovine  19866880417977
gggccttgcctcagacgtggcctcagagacgcacccctgactcaagaatgcccgctggaccgagcctttgcacacggagctctcagaagggctgtcccatagcaggggcaaacggcacgctttctacaaaggagggtggtgggcgtccagccatggggcctggggcatcagcagcttccatacaccagggaaccctgaaaaacggtgtaaaacgccacgaaggctctgtcagatgtaaacacggcagatttcatgtctcgctgggaacaccgcctgagaaactccgacacgcaatgaatatgtggctcccagaccccaccgatgtcaggacagtgagaaggtgagaacactccctccttggagtggatggaagaaggtgtgtggacagacctcaggagcaggtgtggggataagacaagcagattcctgatggcaggcccagcccagccccgtgactaacacggggagcttctctgggtaccaaccctcacatccatacatgacttggactgcaaggagatcaaaccggtcaaccgtcaaggaaatcaaccctgaatacttattggaaagactgatgctaaagctgaagctctgataccttggcccacccgatgtgaagagccaactcttcgcatcaggtggaaggtctctgaaacgatcctgatgctgggaaaggttgaaggcaggaggagaaaggggcgacagaggacaagatggctggatggcatcaccgactcattggacatgagtttgagcagctctgggagatggtgaagaacagggaagcctggcgtgctgcagtccatggggtcgcaaagactcagacatgactgagcaactgaacaaccgcctcgggtaccagaccagtcagcctcaatccatgtgcatatgaacacctctggcacggcccacaccaggtctgcagagggcagacgctcccaggtccctgcctgtggggtcctccttgggggctggggggctggataaagccacacctgtccagatgccagacagcctggtacccctagaagcagaggccaggagaggacatccccctcgctctctgactcccaggtagagccagtcggaggcgtcccaccctgacaccccaggctcacccctgggtcagcccccacccaagctcgggccttgaggatgagagccagaccgctggctcacgcgcagcaaacatccacccacccccatggaaactcagccaggctgccaggtccccctgcacagagcctactgcgccgctgttccctgattaaagctttacaggatcaacagcaataaagccatcccaaagaaagccatctgaggcaaagcccttttttaagaaaaaccactctctccacaggcaaaaaccactgaaaaataacacagctatgttgaggcagtttcgctgggtctctgcaaaggccctcctggtgttacctggaggcgaaccaggtgctgggggtctgtctgtccccagagagctgggatccggcgcgcccaccccacg

SEQ ID NO: 62825 - DNA, 2203 bp, Bovine  19866880421547
cataactaattattacactgggagattttttaaaatgaaagaaggcactaaagtcatcaataagcattaactgagctacaacatgtatgaaatgggaccatcctggacaaaccaaactgtagcatcatccaatttgttacatctttgtaggcattccttgggctggccgtcatcttagccagtcagatgactccagggcagtagagaaaatatttttccttttctacacagttaaggctttccaagaaaaggaaactaaaatttgggttaaaaagcaaactttggaagctaaagagtgttagacttaaaactgttagctcccatttctaggataactaaatttgtctctccaggaggcttgcagtctagggtagggactgtcccctttacttcctaagacaattggtttccattcaaaggattgtacataacaagagagtcaaggcttttctccctctctcagaagcagcgtttcgattaattgcttttttcctgtgtataggtcagactttcttgtttctctatatgtctcatacattttgttgaaacctggacatttccaataatataatgtggcagctctggaaatcagatccctactcccctccaccagggtttgttgttgctgcttgttgaatttgtcttgtgacttttctgaactaagtctataaaatatgtattctttgtcaaggattaccactgaggtctctgctgctgctgctgctaagtcacttcaatcgtgtctgactgaggtctctactcagcttcataatcaactgatgactgaatggagaatttcttaaagtcttaaatgaatctccaatctttgccgagggcttctgtgtgcaggttgaagtttgtcttccacattcaaccaggcagcgtgtgactccgccttagcctttactccttacttatacagagcctcaaggtcaaacagaggtgagggcacaggatcttccagcatccatcataagtgtgtacacggccccacatatgcacatggataattcattcttcaatgaagaacgcaaataaggtaattcatttaagcttgtgtttaatctattgtttgtcttgttatccatcacctgaggcacctgtgaagtacctgtatttgtttctaaacgttttcaacaaatgacccagagaaagggttttagccttgggtgctgctgctgctgctgctgctgataagtcgcttcagtggtgtccgactctgtgcgaacccatagatggcagcccaccatgctcccccgttcctgggattctccaggcaagaacactggagtggcttgccatttccttctccaacgcgtgaaagtgaaaaatgaaagtcaagtcgcccagtcatctccgatgcttagtgacccccatggactgcagggctacctggctcctccatccatgggattttccaggcaagagtactggagtagggtgccattgccttctcctatgcttcatagagcccggcattttgcatgacgtactctgcatgtaagtcaaacaagcagagtgacaatatacaaccttaacttactcctttcccaattttgaaccaatccattaagatagccatataatttttattcttttaatctgtgaacatagtggaatgtgtttaaataaatgtattgctagattttgcctttttttttaaagaagtttacatttatgaggacagaagagatgaatgtataattttttctaatattatccttttctgattaaaggaacaagttttacatgagaccatacaagcgatcagggagcttttgctcttatagtgttccctggatatgatatggatgatctgattcatgaatatttggtgtaactcataaaatggtcagtcaagagagttcttggtgtgttcgtgtgtgtgtgtgtgtggtgaggtgtgtgttattcaagtgtattacttattcttgagtcagttttgacaagttatgctttttccaggaaactatttttcacacttagagattcattaacagatattgatagtattttttattttctatcaagcttgcatttgtaaatatacttcaccttttttttttaacttccaacattgtttgttatttcttttctcctctttattcttgagaagtctcaccaaagatttgtttatttttattagtattcaaagaataagctattaatttggttggttttctctaaggcattcaagtaatct

SEQ ID NO: 62826 - DNA, 1885 bp, Bovine  19866880473061
tcccacgctcactttgtagttctaatggcctcctggccggaggcctcacttagccattctggcatcccccaggtcgtggggtggcagggtggggcactgggtctgcaggactctgaagtctcgcctcgtccttgcccctccccgccctctgctctgcccaccccaggagatccgcatgttgaagaaggtcgtgtctgtctacccggtgagtgcctggttcagggcaggagaccgaggtggggggagggcaggaaggatggggagggcagaggccgtggaaggccttccaaaaccagttctgagactccccggggttgcacagggggcccttggaggggccaggaccagagggcacttggggtcacaggcctcctcctgcctgatcagaggaccacagacccaagagcttcagggagagatgagggcctggggctcgccagtgggtcgctgaccatgcagcagggcactcttgggcagggtgggggctggcccaaacgcaggctgtgacacccgaccagccccacgcagccaccagctggcctgtggcccaagtaagaaagcggccagagaagtcgactggtcatcactccctggggacactccagggtggtcctcaagtgtggggaccccgggggccactgtcgagttcctccgggtggaccgaccactgtggtcactcgtgggtccagcccagggcacctggaccccaggcgggcaggtgctgagggcgtctgtcgcctcggccctccagggagacgtgctcatcacctcttgcacatacaacacggaagacaggaggctggccaccgtggtaagtcaccccaacgtcccgcccctgccgcagagctcaggcaccagtctgagctctgctggagcgcagggcgggggtgcccctcgctcactcatccagtaaagcagcagctctcacgctgtgggccctgggccagcatcagcatcccctcttcagttcagttcagtcgtgtccgactctttgcgaccccatggactgcagcatgccgggcctccctgtccattaccaactcccggagcttactcaaactcatgtccatcgagccggtgatgccatccaaccatctcatcctctgttgtccccttctcctcctcctgccctcaaacatcccctgggtacccaataaacacataaactcatcagttcctccccaggctgggtggtgactcccggcgatgtctgctttaatgagctacctgggttattttgatggctgccctagtcggagagccaaggccacagacatgtgtcagcaccggagcccacgctggggtgaggctgggggcgtgagggggctccctgcctcctgcgaccggcaaagataggataaagccgaggatgcggaggaggcgtcgctccctgagctgcacatgccggctgactgctgtgctgtctgtctctctggcaaaggctgaggaccccaggagggcagggcctctgcccactcagaacacgatctggcctcgtgtgatgagtgggtgcacgcgtgcgtgtgtggaagcactgaacacccagagaggctgaacggcagcgtctggggtgacactggcgcgccagtgctgacggggtcgtctccaccctgcaggggggcttcgggatcctggaggagatgtgcgtcaactatgtgcactactacccccagacgcagctggagctctgcaagagcgccgtggaccctggcttcctgcacaagtacttccgcctcgtgaacaggtgatggctccacggggcatgcccgctgtgccttccatcctgggcacggcagggcaaccccggccccgaacactccccccaaccccaaaccctccaggccctgggcgaaagcagggcgcccaggagcaaggtgagcaggaa

SEQ ID NO: 62827 - DNA, 1465 bp, Bovine  19866880482280
cagggcgggaatcgggaaggggctcgggcctaggtcagggaggtccacccggaagccttcctggaaggggcgttacctggggagcggctggaggccctggaggctgtgcgttcccaggccttgtacgggtacttgagtgtggtgtccagctgcttgaagctctccttgagcgagtggtactggtagtactccaccagctcctgcaggatgcacgtggcactgctgcctccgcctccaggcagtcctcccgggagccctgccctgcctctgcccctcctcctagccgcccccgacctcagctcccagacagggggcggggcgcggtcagtatggcaaagacttttgatcctgcaatttctctcccaaacatttctaaaggaagagccgcgggaagaaggccaggacggatggccacagacacgccctgcaacactcttcacaacaggaaaaaatcagaaaccccccacccacccaacagcagggaagtgcttctagaatgcacagcatatccacgtgactgagtgccgtgcagctacagcggggctggaagagagagggccgtccccctggtgagtgttcactgtgcccagaggtaaactaaggttgggtccatgtgaacagtggcattgtctggaaaaggaacccataaaccacgcctgggctccactccaggctggggggactcaccctgaaacaagaacgtcagggttgggggcacgttgtggggcactttcccttttaccgtgggctttcctgcggccacagtgggacgtctgagagcccacgtgctcgggttagacggtctccacacacgcaacacgtgtgattgagcaaagaaacactgggtctaactttaaatcattttaaggaggactgttcatgtatttatggctttctggctgggccgggacagttctgggtgaggcgggggcaggcaccggaagccccgtgtgcgtgagtccggccggccggcagccagacctggatgcagcctccctgggcctcggtttctggctcccgcagaggctcggcgtgaacgcgctgtgggaggctggtgaccctgctgtccacctcagggtttgggggacagaggtgctgacctgggagctgccttaccggtcccaaggtgccttacagaccagctttcctggatctttctcacactggaagcaccccccgaccccaccatagaagagcagcccctagcccagcggtgggggacacttgctgggccctccccactgggagcctggcctgcaggacacttgctgggctcctccccggggtggcctcagtgggagaccaaggccctcctcccaccttcggggatgggccagtgggagctccccaggaccacgcacgtaccaagaggctctcaaatttcttggcttctgtgatgtggacccagctgtccttctccaccaccttaatgtgcttcacctcgtcgttgaaccggccaagcaca

SEQ ID NO: 62828 - DNA, 1187 bp, Bovine  19866880507717
ccgcccccaggccctgcaccccacctccgtgcccctcccacctctgtgggcagcgtcagcccctatgccctggatctcacccctggggtgccacatgcctcctcctggcaggcctgtcccatctccacccctgtcccagccacagcgctcctaggcccatccccatcccaggaaggggcggctctgagaactggaggagagcccagctgggcccctcacttccgagacggcaggagtcggggaagctgcgctgcccgtactcacctgcgctgttgaagccgcagcccaggaagaacccgcggagctcgggcgcctcccccatcaggggcttgtggtccggggtgaatgactctgaaagggaggggagagcctgagggtccctcccggccacatgctcctgggtgcaatctcccaagaggacaataactgaggtgggagtgggcatccgaggccgcttcctccctgctcgctcctgccacgttccgcttgaggtcttcctcactgatgatctgaactgggctccgcctcgtggggcccggggtgtgtctcgtgacttgctgctggcgggggacctctccccgagtccctggcacagcttcccgtccctgcgccagcttcccgctgtatcacagcagggcattcctgcccgtcgaaccccgggcaatgcaagggccgggctttgctcgctgccgtatctcaagacacagggtccagcaaacagttggtgcttgatacatgctcgctcagtgaatgaaaggttgtaagttctctgggagaggggaccaagcctctggcttctgtctgccgccagcgtgctggggacggaggctaggactggtggagaggaacgctcgagcatgattaaaaagggtgtccctggtggctgagatggtaaagaatccacctgcaacgcgggaggcccaggttcaatccttgggttgggaagatcccctggagaagggaaagactgcccactgcagtatcctggctgctacccactctggtatgattataaagagccgcacttggcagccacagtcctgggtttgaaccttgctttactgattcctggctgtgtgaccttggctcataagagccttggaccctcgtctgtaacacagggatcatggtcccaatgaccgcggacttcacagggctgtgagttactcggtcacaaatatttgcag

SEQ ID NO: 62829 - DNA, 1807 bp, Bovine  19866880540031
actgctctttgatgatccgtgttggcccccaccttggggctgggaatgttcaattagcgattagtccagctcccagtccttccaggaaagctgcctcacagagttgcaggctgcgtagccttctccacctaactcagccccagcccaggccctgggccctgccaggagctcgcaggggctgagcgagatgcctttggatcccggtgggtcctggatgaggagggaacccagcctgcagcctcagaccctgacttctcaccgcccccaccccctgagcgctgtgttgttaggctccgggggaggctgcggatgccccactcacaccactgaggttagtcccgtgatgtgccggcgtgccagagagggcggcaccttcaggggcagtggttagcaccctccgtaggtggtcggctgtctgtctgggctgtctctcaccacctggtctttgttttgtgtgagtgcttcttgccagctccttgggggaggagccctgtcacccactggggtcctctaggggttctggggcacagcggtgggcagaacttgctgctgggtgtccggaaggggcgactgtgtggccaagggcagccagccggccccagccgatgcaccctccccccaacatgggcagccacacctggcagcagacaaaccacacacgcgcgcgcacacccacgcatatgcacgtacgcacacgcgcgcacgcacacacacacacgtgtacgcacgcacacggcagcacacctggaagcggacaaaccacacgcacatgcgcgcgcacacacacacacacacaggcagccacacctggaagtggacaaaccacacacacacatgcacgcgtgcacacgcacacacatgcacgcacgcacacatgcatgcagcacacacacatgcacacacgcacgcacggacacacacatacatgggaggccacacacgcacgcacacgtgcacacacatgcacacacgcacacagcaggcacacctggaaatggttgcccccccagacacacacacacgggcagccacacctagaagtggacaaaccacacacacgcacgcacgcacacacgcgcgcacacgcacgcgcgcacacgcacgcacgcgcacacacacgtgtacgcacgcacgcacacggcagcacacctggaagcggacaaaccacacacacacatgcacgtgtgcacacgcacgcacacgcacgcacgcacacacgcatgcagcacacacatgcacacacgcacgcacggacacacacatgggaggccacacacgcacgcacacgtgcacacacatgcacacatgcacacagcaggcacacctggaaatggatgcccccccagacacacacacacgggcagccacacctagaagtggacaaaccacacacatgcacacgcacacgcacgcgcatgcacgcacacagcggcacacctggaagctcacaagccacacacacgcacgtgcacacacgcacacgtgcgcacggcggcacacctggaagcggacggccgaggacctgttgcagtgcatggagatgggtgcgaagccgtacagggccttgagcacctcgcggttgaaggagttccagggcacggaggcaaactgctcagggacagacgcctgggggcaggtgcagacttcctcgctgttgaacctggtgagagaaggagccgtccagagtggggtctgggggagcggaggggagtccaacaaggcacccgtgatgcctccctgaagaggggtggggtccccagagcgggccttctagcacactgccctggccctgcctcccgccctgacg

SEQ ID NO: 62830 - DNA, 1229 bp, Bovine  19866880621910
cagcacggcgccactcacgcccagcttggccagatggtagagggtctggcagcccaggctgcccccaccgatgaccaccacgctggctgtgccaggcaggggctggcttgggccctgggccgccgccgaggcgtcctctgcctctttcaaggtccgctggtacggcacactcttctcagaggtggggccaggcccgctcaccaggggtctcagcccccagccccgggcagggctttggcgaggacgggtggccgcgatgccacgcagggctcggctcagcgaggccatggggagtcagcttcagcaccacggggagctggggagagagctggggctgtctgggtgcggaagggaccagtgggccctgggccccccaggctgcgaccctccagcttccctcctgccgcccacagcatacgtgcaccctgcattcatccagccaggtgtatgggggtctgtatgcttcaggctccggctgggcccagggaagaccacggtgggggagaagggggcagtgttcatgctgagacaggaccacggtggggtggcaggggtcacaaggccgggaccccaaccctccagcctacattcagcttgccctccaggggaactcccgtctcaaccccacacagaagttatttctgccacgttggcccccacagccctttgggacccaaggcagaaggtgaggaaggcagtgaggcccggcctccggctgccttgggccgtcttgaatctggagggtgggtggctcttctgtgacctcgcagtagcctgcagggcttaccttgcctcccttctcctccaggaagccctcccagccctccccagccagaagaccctcacagttataagaagacagtgacagggagcccaccttctaaggagaggaggtgcaggcgaagtctccttgggggagggtcccggcgggggacaggacgattctgaggggccccgggcccacctgtgggtcagcaggagagtaagaggggtgtggctgagactgcgttaataaccgtgacggcgtcaatcagccgatcattaacgaagtccacttgcgttttcaagcgtgcattacacggcaagctgggaacacacgttctctctgctctaaaatcaagatgactgttgtccccgtttcactgggtcgagggggactgaggcccaaggaagctggccaaggtgaccaaggtcacagggccaccgtgtgactgcgcctgctggctgtc

SEQ ID NO: 62831 - DNA, 1355 bp, Bovine  19866880651580
ccggacacacacacaccccacaaacacacgccagagacacacaccccaccaccaacacacgccaaacacacacacgccatcaccaacacaggccagatgccccgcccgtccagcgccacagcccccacgaattcctgaggccccccggcacacccaccctgacaaaccccgctgggcaccggtcacccctcattcggatggttaaaaattcattcacggcagcagattggttattacatctcggccttaattaaagagggccgcacagcggcattttaaacagcaatgtcactttctaattgacaaggctccattatcgagagaaagactcaaacgggcctgaaacggagccagctcccctcctccaccctcccggggtgggggatgatggttcggcttcaatttttaatccactgatgaaatattcacaggccaggaaggggatcacgtttcccggggcgtcagatcctcgccccaccgggggctcctgtgctgggagggagccaagtttggggtgacgcggtcaggtcagggcgggggctggacacctgcccacgcacagccagctccgtcccatcgcctggccacgcgcacctccctgcccggtgccctgccctgggcccacagaccccaataaggggtgagcccccggaggggagcaacagacccgaggccaccagcagcttccccgacctcctgtttccagccctgccttgtctggatctccacggccggcccgcccccagaagagtcagcaccgtccccagagccatcgcttcctaaggggaccacagagagcggcctccgccgccagcatctgttcacgagctggcaggcggacctcacggggcagacgctcctcccgaccgctgcatcggctgcccccgctttacaggcggggacgctgaggcaggaggccctgccggccctcgcagggcgtctgcccaccctgacccgggagcagagaaaggcccgctgaaaacacagatgaggacagaggggacccgggaccctcagcccccctgcaacacggccccgggtgctgtggggcggacgcggagcctggcccacctccctcccgcctgcctcccgacccaggaggaaaacatctggggtgagccgctgcccggggtgggagggacagtccacgaggccccacacagccagccaggcgcccacatgacgaccccggctgcaagtctggaagcgtccatcagctgcgtgcccgctgggcctccaaggaggaagaccctgcgtggaaactgccggcctccaaggagcaggagcccacggcaggcgcccccggaggcctaggccacccaccagccaccaggggcctctgctccgcccaggtg

SEQ ID NO: 62832 - DNA, 1028 bp, Bovine  19866880722496
ttatttgctcccggtcatcaccctttggcaaatttccaagtaggggagcccagtttgggtgagttctggcaaagtgagaatttaaacccaagaagcagtgatagattttattttcttcggctccaaaatcactgtagacggttaccgcagccatgaaattaaagacgcttgcgccttggaagaagagctatggccaactacagagtgttttaaaaagcagagacatcactttgcccacaaagatccatatagtcaagactatcattttccagtatcatgtacggatgtgagagctggaccataaagaaggctgagcgccgaagaatcgatgctttagaactgtggtgctggagaagactcttgagagccccttggactcaaggagatccaaacagtcaatcctaaaggaaatcaaccctgaatattcattggaaggactgattctgaagctgaatactttggccacctgaacagaagaactgactcattggcaaagaccctgatgctgggaaagatggagggcaaaaggagaagggggcggcagaggatgaggttggttagataacatcactgactcaatggacttgagattgagccaattccaggaggcagcggaggacagagaagcctggcgtgctgccgttcatggggccacagagtcggacacaacttagcgactgaacaacagccacagctgcacacccgtggctcctggatgaacgaagtgcacagcagggaccctcagcctgcgcccccttccatgtcccggttccctctgcttgctgactggctctcagaggcccccgccctggccgcgggggtcatccctccctcctccggcctggacgctctgggctcgggctctgcagacctggagcgctcctccggaacccaccagaagagctgagcacgtacaaccattttctcggatgaattataattttctttcatttccccttcaaaacacgctaattaaacggacattgttgagacagccaattgaaattcaaaaaaccgtcctctttcta

SEQ ID NO: 62833 - DNA, 985 bp, Bovine  19866880992224
ctcacaggctaagtttctgcttctgtttgaactgagtcctgcagatccccagcgtcccccggcaggagcttcgtcacggcgcttttctccaggggggagatttggcaaaatctttcgtgggtttctttttttcctcaaggaaatgaagaaaatgtgctgccgccctgaatgcagggtttgaaagcattctgaggccgaatagctctggcccgcgttgcccctcacctgctggtcggggcagggcctccctcgcagccgcctggcccaggggctgtctttggtgccctggcctggagcccctgggtggccgggccttagagctgggtgccaggaggcagctggggataggggagggaaggggctgaccaaagagcgccgcccttgaacatcctggggaccggcagtgggtctgtgtggtccggggcctcagtttaccttctccaggcaaagctgggactcgagtgaggtgcgcaggtgcagggcttcactctctcggggcctttgagtatgggctggtgcccacaccccactgccagcgcctctctctcccttcattctcccctctccaaggctctgtgtgctgtcaggccgctgtcccccagaccaagagggattctttgtctaggaccccacgtccccagtcctggcacctcctgggtaatacagtttctgggtcccacccagaggtctgggaacctgcttggctgaccagcgccggctggcatttgaggtcacctgtcaaggccaggcaccccagggcggggtgtgtccaggggctgtgctgtgggtgaccaccccggccccctcggcccggccgcttgggctccaagcctgaccttgtctctgcaggatgcctggagtgaccagaaggggcaggtccacctggactcccagcaggattaccagcttctgcgggcacagaggactccagaaggcctgtacctgctcttcaagaggcttttggcacctgtaccccaacgactac

SEQ ID NO: 62834 - DNA, 1785 bp, Bovine  19866881007377
caatctccctgatgtagtcacttgcccccataaagataacgggaaatgattcataatatttatttgacagacatgatatgaaccataatagcctgttgggattaaaaatatccgtacgtctctgtcacccaccaatgtggtttaaatattatatatgtggccactgcagcaaccgggagaagggagcgattattgatggcagccgtgaaggggagttgccgtgcgctgcaggatgggagcgtggcgacggaattcacctggggctcctcgtgcctgcgtccagagaagctgacccaggaaacattgccccgcacctggcttacccccagaccacccgccagccgggccacagctgccctcagccagcgccatcccaggagggcctggctgcagctcggggtccgaggaagcagccacccagcggagggcagagccctgccaccccacgcccagcaggttaaaaaccctttcctgctccccatcgccctcgggataaagtccaaactcctaagaaaactggccaggccctcccttcctgccctgagtcatctccctcctgccagcacccagccctgcccacaaagctgcccgatcctgggcagacggcagctctggaccactgtccacaccggccactccacattccaccgaaggcccggccccaccgtggcccctgtgggcagctggctgactgctcccaacacgcacgccccaaagccgggtgagcctcctctgccgcaccagtagcccacaccctcccggtgcctccgggagtcctgctccctggatgtccccaccggcctgagagcccgtcaaggctggggacctgggcgtgggatcaccaactttccattgccctacctgggacattgtgggagctcacgatactcatggagtgggggcaaggaaggaagtatggtgttgttttcacggggctggcttcctctctgagcctggggatgggctctcagggtccctatttacatctcagaagttttgtacttacgaaaacaccctttccctttcggggcctcagcttgcccatcagtacaatgggtctccagtccctgagtcgggtatgttctctgagaaagccttttagggtttgctttggggaaaacccagagacagcactgagaaagtctccaggggatttgaactccctcctccatcactcccagcctgccccgtccttgctggtcaccagccccagagcccccttcagggcgcccccatcctcaggtcgatgatgactgctggcatttgtttctcccactgacgagagtccacgccccccagaggagccacgtctgagcttaaaaaaaaacaaaaactgcccagagaaaaggggctgccctggaaacacggtcgcccgggaggagagtcagacttatctgcctacagggggccagcctcagcatcccgcctccccgggatgcgcagcgtcaccctcacaggcaggatgggaaggtgagccccagcccacaccctgttgacgagccaaaggagacggcgttcctcctcgccacgggcgtggacctccactcaccgcccctggggacacccgctcctggtgggcccctgttggccactttccccgcctcctgcttccaggcggtgctggccacatgtgggacctgctgggcacctctgccagcacattcccaggacaggggtctctgctttggtcctggaccgccccacctcgcccccagagtgcccaaaccctgcatgcatggggctgccctcatctcgcctgggcactccgccctcacctccccctgg

SEQ ID NO: 62835 - DNA, 768 bp, Bovine  19866881073409
atctggacacaaccccaaaagacagactgttccgagaagcatctgagcaaactcgaccatggagaccaccaagcccaggaggtcatctctgagactgcttccagagacagaaggtttaagtgatggcacctgcttcccagaggccatagaaagtgaaagcgaaagtgaagtcgctcagtagtgtctgactctttgcgaccccacggacagcagcctgcactaggctcctccatccatgggattttctaggcaagagtactggagtgggttgccatttccttctccagggaatcttcccgacccagggatcgaacccaggtctcctgcattgtagacagacgttttactatctgagccaacatagaaggtgcaggtaaagtcaggccccgccccctggcactggccccgccccttagtccaggccctgcccctggcccaggctcctccccgcacttacctgggggctgccggtgccaaagcccagggtgggtgtggtgggcaccgacatagagtgcgggcccatgggggaactgatgaccgagaagggcgggcccatgccgttgatgggcgagctgagggtgctgatgggtgagtgcagctgtcccggagagccgagcgaggagccgatgctgggccccagggaggggtgcagcgagggggcggccatggagctgcgcgccgtgggggagctgagggaggaggagttcacctgcgtggagaagtctgcaagacaagaagccacaggaggctggtcaggagcccacaccg

SEQ ID NO: 62836 - DNA, 1225 bp, Bovine  19866881121057
gaagtgcccgtttcacaaagccagcactgacggcggagggaagggcccccccaagagcaggcgggaactcggggacagctgcagcacagcgcagcacggagccaggtctgactcaagcctcggcccccgatccatcaacaaggtctcacgtcctgactccatcttttgaaaggagggacctgggaactgttggcttccagatggaacatgacgccctgcatggacactgtggacccaggcccaccaggaagccacagtgcactgcacgcccgcctggccttggccctgccaggactctgcacgacagtcgccagggacacttgctgagaaagcagggaggctgctcgatctctgccacggacccagggcatcagctccagggacgaggagttcacataatcatctgtccccacccgacgctgctcggatccagacagccccacttgtctcaggcatgatgcaacagctcccttctcagcacaccgcagtaagcacagtacctgcccatccaggcccggcccacgagctggtgcttgctcgtccagaaagggtgggagattcagggcaggaagcaaacgcccagggtcgctcaactggaaaagccagggcagggctggaccccgggtctggactcatccaggccagctttccctccatcctcctggggtcacgatgcctgacttcactctgaacagcttgagaaggcgggaggagccgtcccgcagccccagcccctgaagcgcctcctccggttgtaacacagcccggcctgcccctgcccacggggttctgcccaggggggacggggccagcctggaaagaggccactcaccttcccgaagtctcggacatcgaagaggtcaaaggggtcgaacagatcgctgttcctgagcccaaacttgtcatggcagactttcaggaaggtgcggatgttcttcaagcagaggaactggaggagagaagggagcgtcattcaagccacacagtctgcagggcagtaacaccaacagcagcaaaccctgcctcccggcgctgcccggctcagagcagcacgccgtgtgccccgtaaccctgtctggggagccgcaagtcccaactcaagacaaccacagttggaacaaaacagactggagttcagtcagcaggcacggagcacgcacacactgcctccccagcacagacacatccccgtcactctacacgtgacaaaggcccacgaaagcca

SEQ ID NO: 62837 - DNA, 912 bp, Bovine  19866881374365
gcacaatgtagctccctttccctgccctcccctcggccgaggagcctctcagggggtcctagcttcctgggggtcacatgccggctcccagccccaccacggggaatgctgtgtgccccacggacagaggggtggagctatagggcggtgctggaagaagtctcggggcagcattggaaacagagccatcccgatacggaccagccgtgacaggtagtgagctccctgccaggagcggtaaccaagccgagattagaaggctctgtctcaggggtgacacgtcagagtcaaggagaccacaggatgacctggagacccacagcctgggtgccgagctctggccctggggaaggcgggcaggcctgcgtgtacacccaagccgcctcccccgcctcctccactctagggaaacctgatcctctggttgcttgaaagatgagaggaacttgggtttgatgttttgaagaagtggctttttatcagaaagtcctctgggagtctgggccgcaaccagtgaaattatatctgttgtttcaaggaggggagaaaacttgggctgatggttattgagatttatggcttcccctgagcctaattgcctcagaatctttttaacagttgtactaagtggtactcagaccggacaacggagcaggcggcagctcgcccccgccaccatctcccgtccctccctctcctgcctctctgctctcgttcccccctgccctccctccccgatcctgtctacactgggagctccctggatgcaccaccaggcaggtggccaggacctcacggctcatctcaggagagagcagatgtgagaagccgctggagttcaggcctctggatgagctttgctcctcctgctgctgtgtggatggccccggaggggcaaaggggctcggggga

SEQ ID NO: 62838 - DNA, 1536 bp, Bovine  19866881419335
ggggggtggccagtgtagtgcaagggaggagccctggcgcatgcgggctcgagcctcgggctgcctcggctgggctgggccccctaatacaggaggctttgcctcggagcctcggcattctcacctttgaaatgggatcgtgtcaaggagcacagttctgctgagcctcggagacagaagaggcccagtgcatggggattgccaccatgcgcggtgctccccgggtcaggctgaaggatgaaactgcacaacccaggaggcaaggaccacttcccccagctctgctggagacgcttagggaacaccgttgttggggagacggcagagaaagccctaggccgtggaaggcccgctgttggggtggagtgtggagtgctggttcttcacccagagcagccagggctggcccccacattccagggcatggaagggacgggttgctccagcgatgcattggttattgagcaccaactgtatactggcgagcaaaaccggctgtgtgggtcgcggggatgcagtttcgcggggacgccgcgttcctctaagtgccccggcggaagtagcggcagctggcttcctcacagcagggcgggggatctctgggtggtctcgttctgcctcctcccaccacctcttccccacgcttactcactcatcagctgggacggggcccccaaaggtgacccgtcaaatctttcagctcaagttcggaacgaagtctctgccacctctcagtcaggatgctccgagaggggatctgattggctcagctcatctctagttgggctggagatggaaatggcaacccactccagtattcttgcctaggaaatcccatggacaaagtctgagcctggtgggcaacagtccaaggagtcagacacgacttagccactgagcacatctctggttgggcaggtcctgatgggcggatgcctgcggacacttgattggctgcccgttgaccaatgagatgcgtcaggggtgtggtctgtcattcagctggatcctgggacagaggaccctctggtctctggggagctggtctgaccagcactcctggttcaagccccaaatatcagacctgtggggattatttttttacacagtaagcccttatgtgcctgggccccagagactgcttctgagcactgcacgggttccttactcttctcggagctggcccaagggacaggagcttccccgggcgcagctcagggttcctgggggtgctagggtcaaaactgacccttggaggcccagacggggaggctagtggctggaaggatctgcccccaggccccaggctcactttcctctgggtccccctagttgggcagggtctatggcatcgagtcccacgtgctgagccccggggaaaccaaggctttgtatccgctgatgaacgtggaggacctctacgggaccctgtacgtgccgcacgacggtaccatggaccccgccggcacctgcaccagcctcgcccgggctgccaccaccccggggggcgcaggtacgaccgtctcctggccccgg

SEQ ID NO: 62839 - DNA, 1440 bp, Bovine  19866881452606
ggcccgactgtccctcccaggaaatgggcaaataaactgcggtatgtatagacaaacagcactcagccaggaaagcagaggatctctagtgaagtcgatgcacgaggaacatcagacttaacgtgcagaagaggctgcgtctcaggagaagccgagcagcaaggtgccaccgacccagagctggaaagcaggcaggcagcactgggctctggggacaaagaggtgggggatggaaggacatgggggctgggggccgaacaaggctggtcctggggagatgaggatacggggctgggtccagacgacggcaaagtcttccctctcaatccgggtggtgggcgtaggaggccgatttcatttttattgtctcttaaataaaatatccccatgttataacctcccctctgtctgacatctgggataacacacacagagtggcctcccggggcctccatggccttcgcacacattatgcccacttaatcctctccatcaatacggaaccaccttccctgttgcccccatgaagcatggtcccttgggtggccgctgggggaccaggctccggggtcagtgacgacatttccctacacccctgggtggagccgagtggtcaaggtcaggccagtggaacatggggcccagaaaccccacacacaccccgcagtcccttcctgtgccaactgggtggacactgaggcccagaaaccacctggggaagagccggcatcagagctcgtgagcctgggtccctgtgaggctccctggcccggaaaaccagggcccccacccccacgatctttagaagttactgaacaagaacaggaagcgaactctcattgccctgagcccctgagatctggccttcgtgtgtgacagacgggtcagcagactctggcccaggagcctcgtctgtttcctgctttcatgtgggcctgagctgagaatggcttctccgcctgaggctggggtgactcctgccatgccagagcggggctggcctcccgtctccacacaactcctggttctgggattagctgcttagttcatggttctgtgggccagacagctcacccaggggtaataaccatgggcctgtgaagtcacaggattcctggggctgggcgggaccacagagtccttgctccattgccttgttggacacagggaaagactggcccagggtgagccgcgtgggccagtctcaaagcgacttcatgacgggaggtctggaagctgagccctggtgtcctctggaggcccggccacctctctccactctgggtctggggcgctggtccctgctctggatccaggaggttggctggagggtgggaggcctccagacctggtttgcaggtcaagcaggtcaagggccccgccctgctctgctggggctctgtgtctaccgagtcagacgggtgagcgaaagtcccaggt

SEQ ID NO: 62840 - DNA, 865 bp, Bovine  19866881505334
ctccctcagtgagtcgggcctgggcccagcagatgtggtctgcaggaagccaagtccaggctgccctcagcacaccctgcccagccaagtccaaggcagacacactgctcacctgggtgtccccagcccactcctcccagcagacacgcccacgctgatcaccctttcctcctccgtcacgcccacccccaacctcaacttccagcagagaaccagggcagggcgtcaagacatgggcccgtgagcccaggggcacacccatggccaccgcccactccccacgatgggcccccggggatgggaagaggcctcctcgcaggactacctggggagaaacgagctccccgccaccaggcgtgtgcaagccgcgcagctgagccagggtctcgcacacacgcacttggcttccccgaggccccaggaccgcgccaggaagccgggtggagactggagggcgggggcctatctaacccagagttgctaaaaagagccaacggggaagtaaaaataggaaataaaaataaaattgctccagccagccctggttgtttgtgtaggaaacaaggcatctcccggcccagcagggcgtccacgctgcgcccctcccggactaggaatgtctccccccacccagcctccagccaccccaagaggccagctctgcgccctgagcagggaaggcccaagaggggtcccgagacccaggttcggatctcagcgctgccgctgaccagccaggtgaccctgggcgaagggctgaggccctgtgggcctcggacacagacccccgccccgcccatggctccggcccaccacctccctctgccgggattctccccccccgggaccctcaccatcagcagag

SEQ ID NO: 62841 - DNA, 638 bp, Bovine  19866880421723
attagatgctaactagatgcttggatgtgagtcttaactatggaactaaaagcttctaaatgtaatttatgaatgttttttcttggtgattaaaggaaagagatccaaaaccagaaagaaagagagagacagagaatagagaactaaacagctgtgaatttctccagaaagtactattcagtcctccctaattttccctgagcaacaatcagcaaacttctcattagaaggaattttaaaaggtttgctgatttgcaaaacatgacatgagtgatgtatatacactacttgtataattggttttgtgcatacatatggcacgtgctattttggaaatgtatcccctctgtggtccttatagctattgctcactctattccctgataattatttatagttacttgtcacagttttattattaggaaagtaatgaatcagcagttttatgcactctcctttaacaacctagtcttagaagtttccaaaccacagtgtatatatagtaatagaaagcaagcagattgcccaaagttatttatagatattaggcagaacatttttcaaagatcatctaagctttagtaagtcttctatttcagtgtccttaacaaattctactattactctcaaggtagttt

SEQ ID NO: 62842 - DNA, 1478 bp, Bovine  19866880436020
atagggtgagggtgtagtgggttttaattaaggaaagaatttgcttagcctaaggtctaacgtgattaatatcaaaggttaatacttatttcttctatatattcattaatgtgtataagggcagggaatgtggagacttagcagtaaacattagctcaacaaatagaaaacgcttcaccaatacaatttctaatcagcccactatacttatactaacagttttctaacttctctaaggaacatgtttgtagaaggtttaaagcatcccatgcctctcacggttgggaggctgtgagcaatcacatgtggccggacaagcctgtcagtcaggctagagaaccttaagaggagtttgtaagtttggaacactcctgtcatgcccaggaattaatgttaactggtgctctaagttaactccttctccaaaagaggtggtgggggacagccccctgtaaagtcagaggtgtaggtgagagcacaaagtagtaaagtaggcaggctctgattatgggggtagatgctcaagaatttccagggggactcctgaggctcgatcccgcttttgtgtatgtcgagcctccttcctcatgacctttgccatgggcagagcgcctcatgctggcccccgacaataatagatatttgagaggaataagtaatctattaataacttcaagtaaataacaggaaagggaagtgaaatgttagtcactcagttgtgaccggctgtttgcgaccccatggactgtggcccaccaggctcctctgtccatggaattctccaggccagaatactggagtgggttgccattcccttctccaggggactgaacctgggtctcctgcattacaggcagactctttacgatcagagccaccagaaaattcctaggaaacagaagagataaatatctataattaagcacaatttaatcactgtgctcatttagttctcttttcttcacatactatctgatgtccaggggagttaagagaactgtgtggttttgtgtagttaatgaatgactagaattcagtgtgataactccctgtctcagggttctttctaatgcagtaaccttggacatgcacagaaagccaaaacatcagggtatttatctttcagcctttaggattcatgtccaaatggaaaccttaactggttttgaggaaatataaataaattaaatctgaaggcatcacatcatagtaacttcaaaacctttataaaattaagtacattattatcatcattttgcaattagctttcaaacagaacacagagagagaagccttgggaaaaaacctatgcttcatccaaaatgtctgtgggggtagtctgcacattttttccatttcattgctaatgagtcattttcacctgatgcctgcttgccccactcccctctgaagaaccagctgtcagtgtccacagctgagtgagtttggtatcagacaggggcagcagggggggaaga

SEQ ID NO: 62843 - DNA, 2732 bp, Bovine  19866880504229
acactacaaactaaaataatggttacttggtcacaagcactgtggtatgaggaacagtagacctgatgacctgagtagaccaagtagccaagatggctacttggtgactcacaggtagggagcatacagagtgtgggtatgctgtacaaagcgatgattcacatgccaagagggataaagtaggatgaggtgaaatttcatcatatgaatcagaacagtgcataattttaaatttatatatgttatgtgaagtcactcagtcatgtctgactctttgtgaccctgtggactatagcctaccaggctcctctgtccatgggattttccaggcaagagtactggagtgggttgctatttccttctccagcagatcttcctgacccagggatcaacctgggtctcccgcattgtaggcagacactttactgtctgagctaacagggaagccaaattttaagtttaatttttgtttatatttggaattttccatttaatatttttgtactatagttgaccacaggtaactaaaaacttggaaagcaaaactagacatgaaggggaactatggtctagcaaggaatgtaagatttaaatttggtaagcttctattatatctttgctggacctttgatgagtcaacctctcacatctctctgtaacacagaaatgagacactttttcaaaaacttgagtttaaaaatgtaatgtgatgtacttgatcattatttcatagatattatagaacaatagagaattacaattatgattttcatatatctctgcttatattttttcaaaaaattgaattctccattcctttacaggactttctcttaaagctcttcccctaatttcacatgcatactattcctatgcagacatacatagttaagatgataattacaagatggagttcatgcaactctctttaggttcagaaatgagtacatttttttcaattactttacttaaaatctacacctcttaagacagaatcagagaagtataaccactttaatactaggaacaaaaaatataaaggaatcaggactttggcccatcaaaaaatcaataaaaatcaataatatcctttaaattggcctcatcaacctcattaaagtgttctcatcctgacgttctagctgctttaaacatatgtttaattatagctccttttaacatatatatttagggattgacaggttagtaaaccagaacactgatagattagtaataaaagaacattatttttaatgcagtttgcagaaatgattctttattctccactcatctaaaactggattgtactatcttgagcaattctcttaacctgtaataggtcacttagtcttaagtaaaaggattgcattatcttgctttatagctatgaaacacatttttttttagtaagtatgtgtgaaaaacagtagtgaaaataatagaggtattaaaaactaacttagtgaaagaagaatacaaataaatttgcccaattccctcagatcttgttcctacttttgcttttaaacattctgcaactactttaacatgtgtatcactcccagagaatgattcactctaccacttagcatctgagtgattttgaacagtttgattttcaagttaaagtttcttcgtaaatggcataataatattaatataatatctgcttcatagggttgtaatggaccctcaattagataacatgagcaaaatattgctcatgataacatgagcaaaatattgcctagtagacagtaagtacttggtaagtgttcaactataggttttatcagtatcttcctcatcacttttgtaatgtcattatcctttttcctgaagctatttataatatctagacccaaagctttcctaatcatacatggaataagtacatttgtcctttgaaaccactgactttttacttgctttatgtatttcttaaacattttgaaaaatacttcatgtgtgattacagcttaaaaaataataccacaaaaatacctaagagattctatcaacaaaataataataccagtttgtatacaggttgtgaaatcacttacattaatttaagctctatatttatattatttctgtaattttaattgttctgtaagtttcacaaaagctactgaaataaatcacttgcttactggaagagttggtataaatgtattttcatatatatttttaatgttatacacccactgcactttttgaaactaccatttttctagcatttcattaaaataacatattaaaatctcatgaacattatgaaataactgaagttaagtaatgcaaagattttataatccagttgccactggtgatcaaatgaaacatcaccatgtatataatttgctctcctaaacaatgctgaactcaagtatactagctattcattcctaatagtttcatagacagcttttggcagatatatcaaaaatagctgcaggacacttctatttcaaaagaacactcatttctctaagaaactacacatggaaataagagaaagtctgtatttataaaaatttaaatgcctggcatttatataaactataaagagtgtagatgtccagatatgaaacaaacaaacctacgacatagatcacttgtccctcaacatccagattgcctatttttttcattttggatgttagaaaaaaactaaggaaatgactatgttttactattgagtcattaagttctgtatgactcattat

SEQ ID NO: 62844 - DNA, 1027 bp, Bovine  19866880504647
ctactttcttgaggctttttcatttcaagttagttaaaggaaaagttttataaaattagaaacacagtatataaataggataattaaatgtgctagcataaattgtataataaaatatacttaaatggcatttgacactaaggttacaaattgtaatcattttaaaaagatttaaaaattaccaaaaaatgaaacatctcataattatagtattaatatgtacattatgaatttttatgccacataagctttaaataaaaccacttttcagaagcttagctaaaacaggcttacctatttaacatatggaaatattatattgaaaaagaacattccatagttggtattaatcctgaagacaggatgacacatttatactatttgttttttgggaactttggttaaaagtaatattaagttgtatctgccagaaacagatgcacatatagcagcaccaaaatgctaactctaacataaatgaccatctccatatgttcctggagtttatttcttttggcactttatgttgcacataattataaactgtgtttaatgcttgagaaaactaatttgataatctggtcatgaagactcacagacctgttctattcttactaaaactttttgtgatttttaaatgtatctcattagtatataaacataagtataattgtattataaaatgtttattttataaaatatctactaagggtttcctgtagtagatgtttttatcagaagaagagatgtttttatcagatttttcatcaatttgatagggactaaaatataaagccttgtatcactataaacatgtaaattgaattaaaatgtgttttttaatgcatggcgaaggtgaaaaatcagaaagaaaaagcactgggaaccaaaaacaaaacaaaacagtacatacaaagtaagaacaaacagaagtcaaatttgaatgattaaacaagcttgggaattgtgcatgcatatactctaggactcaggatctaagaatgtgtgggaatggtaatcaagagta

SEQ ID NO: 62845 - DNA, 1839 bp, Bovine  19866880737599
tttgaaaaagttttaattgtactctcttccagaagactctagttggggaattggggaacacggtttgattcaagctatttcctcccatgacacacagtttatgaattacagaaagctgaaccataatattttaagcacctcagttagttttcagctttgaaattacacttttaaagagttcagaaataccctttcagtctattgatgtgaggcaaatccctttgcttcaattaagagctatcggagggaatggtgataacagaagtccggctccgagcagcatataacaagatgattacgggcgctggcggccagccagactgccaggctgtttttcacgggtgttactttactgacagtacctccatgacatttgtaccttgacaccagaagtgctaacagctgcagcggcagtgttagaaaggcacgaaagacctttttcagcgttacttgctctcacagattctcagcgccctaggagaataaagtctataaaaactgacttcagccctgctgtctcctttgtgaagatatttgctgcagagtctgaaaaacagttttgttccatgacattggacttaggggagatacaagtttttcaaggtagaagatgtatgtggtaagtgtatgacaaaaagcagtggtaagtgtatgacaaaaagcagtaacaaggctagtctgggagttcatggttttgtgaaatagaatgtttcagcaacgaattctgcacttagttacttgctgtaggcaacccttttgaccccctcactgaggaagcaaaaatgactaaaggagaaatattctagttttcttgacattggatggtattcttaactaatagtgacagatgtaagagtatggcttctagtggttgctgctaatgcccgagcttcacgctgttgggaaatgaggaaggtctgaagacgtgtgaacatgtgtgagaaaggaattcagatgatgaaaggtgaacatgggtttagaaaagttttatttttgcagctctaccaatctctcttattgttttcatatatatatatatatatatatatatttttttttttggtacatcagtgtgccaataacatttggacacatttttcagaaccaaggtcctaaaaggcacatattacaatttactattatgaagtcactgcactgagaactcttttttgtatgttaatgttatttcttatcattttagtgttgcaaccattttggtcttagaaatgggaaaatttttttagctaaagattattaaatttccacagtttgaagtgcttttaggagacattgcacaactattaactcacactaaaatttttctataaatgtttcaatcattaatgctttgtagcatatgagacatttttataataagtctgtatttttaatttcatgaaaactgagcttgtctttgcacttttctgaaaactccattttgaagattcaggcataaaactttgtctttattactatttcatatacccaatgaaaagatctttaaatagtataaaatctacaaatataatatgctgaggtccagccccagttgatccagggagttcgaaagggagatggcattggcgaatacactggctttaattagatattaattagagatataaagagtaatagaatgaggatagctcagcaggaaaattcagtggagaaaggctgagtagcttggtttacgcgggaaaccaataaaacttcaagacaagaagtttgcaccacttacgtaggccacaggcgtccttccattctcccgaaggagaggagacactgaggcctccccggtccggatcttagaagcccaggcaaaattagtaagcttggcgg

SEQ ID NO: 62846 - DNA, 1842 bp, Bovine  19866880756889
cgctcagtcgtgtccgactcttagcgaccccatgaactgcagcccacaaggctcctccgttcatgggatttgccaggcaagagtactggagtggggtgccactgccttctccgatccgaggtggttaggtttgtttattccttttgtaatacaatatggtttgaataatgtgatagaattcaaagttaagtcaccggttcaaaaaataaaatgagagcaatgacaatgataacagataatcttagtaaatgttagagcactgtacagagtactttgatctgggctcatttgatgctgtcagcttgcaatcctggcaaatggcattattagcattttcattttgtggataaggttgagtatcaataaaccttcaccttttattataatgaacagtagctccagccaatgctgattaattccaaatccacagatctttaaaatatattattatgagtttatgcattcagttacaaaatattaatttagagtcttaagtgttagacatatagcagtaactcaaatcttgttctagtgaaattcagaataagcaaattaatatatagtttcagtaaaagtgggtcttgagaagtaagttaaggcagggtagacaataaaaaagtaggaaattgggatgtttagggaaattccctgtgagaagataaaatttgaataaatgtttggcatatatacataaatttgtttggcatatgtatatatatatatatatatatatatatatacacacacacactaagattttgctttttttacatatgcttcatacctttaattattgtgatcatgaattataatacaatatttaaatttttaaaaaattttagtaagatttactaagtataataaaattcagaaagtgtctataatcatattaaatgtacattacttctcatatttgtggctatagatttttattaagttcctaacagtcatttattattaaaaaaatattgtaggaagtaattttcctgagaattaaaatctatggaggtgcctacacatccatttaatttttatattgtgccattctgagaaattcagttcagagctttagaattctcccctgtaactgatgagactcactctacaggtttctatcaaatttagaagtaatcaactccatgtagcaaaccaaggactaaataaagtacttcttaatctttagaggagtgtgtgtgctcagtatttaaggtttaactccaaaataatggaattgcataccttttcactttcctgccaggctttatcacataagtaaagctaaaatagatttaatcctaaaatatatccatttgtgtaacatatttaatggcaatgctaaatcttttgaactgcataccttttatcttaattggaataaataattgcttcacaatacactagaatttctttagatcttgaatttaacaggtgaagaaaatcttgttaccttctggtaatgaggtccaagaaactgatgtaactttaatagcttagagtataactctttgaggattctggagaaaataaaagtatatgtgtaaaatagaagttttaaacaaaatgttctagtctgtgagtctgagatagtctgtgagaattaggttaccatggatgactatggtaaagtcacatacttattttatggctaaatcaacgcaggttaacagagttgacagtctgttcccacttctatcaccaggtaaaggccttacttaattttctagcactttgtatctatcatttcttcccataatattcatctcaaccttaaaaaaaataagtaaaaatttatttttaaaaaagaaagaacaaataaatggataatttttgtacatttaaaaa

SEQ ID NO: 62847 - DNA, 1013 bp, Bovine  19866881089731
ggagattctgttatatgcccaacatcacatatataataaccagtgggagaataatgagaaagctgcctcctacagcaatgctttcaacatgatgggtaacatgaaggtgaggcaaaaggggaaatcccgttgctcaaagctgcactgacccccttctacataagtacatctagttactttccctggattactttcagatgcttttgatataagctgtattgcttttaaaaatgacctctgtacaggaaacagaaaagttctgtaaagcaattatccttcaataaaaaatgaattaatttaaaaaagacctctcaaataaaggtttttttttttttttttttctctctctgctttgaccccattctcctccattgggttaaatccattttattgggaaggtgacagtctgttctttctgccacaaggatgatacactattgaacagagaatgtctgtcattgataaggttatacaaatactcttcttcttcttactggcagtgtggtaaatagcacagaactttgtcactgtcagcgagtgctgcctaagaactttaaaagaaatatgaaaacaaaagtgttactgaaaacaggtgcctgataatattaagtctgactggcctatggcagttgagaaagagaaatggattatagctcctctgtgatcattttgaaattgtgcaagtgcacattgaattggtcccccaggaagtcatgatgataacagagcctacctcagtgcaggaaaccaagctgactcttatcagctgtgcactggtggtattagatgtgtaattaatcagaatacagtttaatttctccttgtgagcacggtggtgggctgcaggaagggtaactgtctcttaatttagagaattttatttgttattttaatcttaaagacaaataaaatgttaaaagttatctaaaattgtcagtaattcctggggtgatataaaattaaaccatcaactaaagaaagccagattcagcatccttagaaatagaataaat

SEQ ID NO: 62848 - DNA, 884 bp, Bovine  19866881147924
atactaatctttaattgtagaaattaactgttcatttggaaaaataaaggcattggttgttagtacctgtcacaatcctactctgattactattttcagaagggataaagaacatgctcactaattttagaagctagtatatatggagagctattagagtttttcgcttaaaggtttttttcaatatgacttttgaataattcactctagttatataggcagtaggcccaaacatcaatgttataaaactgtcagagagtttgctatacaggataaatctagccattggaaaattgtgtggtcctcatagctgcctatctgtttctttataaatgcaaggtttggagcctggaagataacacaattagttcccttcctccttaaattacatatactttccagttttgcctttttttttttttaaataatgtgaaacctctgtatttctccaagtcagggagaacacaggcctcagtgtgttgtagaaggatcatcttcttttacccgcttagaattttctgaacctaatcagcaaggagcctgattattggcccataaatgaatgacacgctccaggctaagggcaagctaattgccaagttgaaattctatgtgagcttatactgtgtgttcttttaaattttccagataacaatagatcaggtacagtggcttctgcttccatgtttgaggtgcttgactaaacaagaggtaatccctcaccttaggctactgcattatgcatcccagtttgttgctctgagtatttttgacagttttaacatttgttaaatgttaaatggggtgatcttggacttttttttgatccatgaatctgaatggcctggcttgtcctcatgctcatttttccttgaccaacaaag

SEQ ID NO: 62849 - DNA, 1047 bp, Bovine  19866881158234
agaaggaattgaaagaaaaatctggctcctaatgatataatagaaaatagtcacaaacaaagcaggatatttatatgatcaatcaccccactctttttttatatatataattgtctatgccttttcattctctttaaacataaaacataatcattgccatcactactaccagcacaatgaaaaattcaattaataacttactgcctgaagggttcatgttgtcctaggttttttgctgacaagcaggtgtataagaggtgtataaccaagcatgccaagtgatcaggctatacacgtgtgttaggaatacactaccccgtgcacatgatgtagcagtaatgagacttctgggaaataacaggtagcctcaggcaacaaggaggtgggagaataccttcatgctatgtcgttaatgacctagaagatttcatgttatggtgtcttgggttttaaattaaatgtcaaatacaatttgccactggaaatgtgaagtgtggaactgtccttaagagactctgagaactctcttgtaattggtgactgcctaacactaagtaaaaatagttagaaatcattatttgatgaatcatcataccagtctgcagaaatgtgtggacttttagtttgaatcttagtaaattcttgggttagtatttaaaacatgcagcgttcagtgtagtattaaatacagtggaactggtaaactctcccctctgggatcatgccaccatttatgtcctgatctcacatttagcctataacatcagaaaatgtgtgaaagaaactgaagcagcacatattccacatgtagtaggtttcattttgcctgctgacaagggtctatgttaataataagactaataataggacttccaatccactttaatgtattagcattatttctttctgaactatctgtatattagtgctaattatgaggtatgtttaactctaaaattgtaggcttaaacacgaagatataatttttactgctggttttaattagaaacctaaagaaacacgtgcaattaaatatgcccataaaaa

SEQ ID NO: 62850 - DNA, 1049 bp, Bovine  19866881365768
tttatgccatttttggcttataaagacttcatgggaatgctttgagatgacggaaaacctatagattcctatatgcacaggtacatagatgtaaaataaagatacatccaatatctgaatataactatgtgcatgtgtgtattaaattacataaaataacagttgtcaggatgtttcatagctctcaagcaataaaacataaaatttacataatacaatattttaatatttattcattattctaattttttcagcaacaagaatcatatactttatgcatttatttatttattcatcagcagcatattgaccttatattactgtctgtatgcttagaagagaattaatcataaaaattttttaatattatactgtataagctaagctaagtcacttcattcgtgtccaactctgtgtgacgccatagacagcagcccaccgggctctgccatccctgggactctccaggcaagaacactggagtgggttgccatttccttctccaatgcgtgaaagtgaaaagtgaaagtgaagttgctcagtcgtgtctgactcccagcgaccccatggactgcagcccaccaggctcctccatccatgggattctcctggcaagagtactggagtggggtgccattgccttctccagttatgtatgttcaaataaactggtatgctcataacttttataagcactagactcatttatacacatttataaaatgtcctgagtaaacagtgttataaaatactaaacttagaattagaacacatgactttaaatagtgggcaactgtacagatatcaattagtattacaaatttgaaacacatttatcttcaaagcaatttaatacaaattggaacaaatgattatgtagcagcataattatatctaccttgtgacctacaaaagattggaaatcacacttgagattaaaactggaggaaagcatagaaaatgctgacccaaagtgccatctctttagttcagttgcatggtactaaatgccaattgtgccctccactttcttagcggaaaacttcagg

SEQ ID NO: 62851 - DNA, 705 bp, Bovine  19866881598991
taaacagtaatgctaaggtttaaaccccagggttcctaatttcaattcctgcttattttcattaatctctgagattattcatgactttttcatttatgcatctagcaatcttttctattttatttttgtttttaatatcaataacagcttatagctcaggtggaaagaattcacctgcaatgtaggagactccagttagattcttgggttgggaagatccactggaggaggaatagggtacccactccagtatttttgggctttccttgtggctcagctggtaaagaatccacctgcaatgggggagacctgggcttgatccctggattgggaagatcccctggagaaaggaaaggctacccactatagtattctggcctagagaattccagggactgactagtccatgggggtcacaaacagtcagacacagctgagtgactttcactttcattttgaaatctttctttatataactgcctctattatgcttttcttcacacacatataatcgtattaattaataggtgtgaaattcactgtagacaacatattcccataataacccctgattcactttccattacaacatttcttcaaagaaatatgactgttttaatattctaaatacacaagtgctttatttcaaatccttcttccaaagaagtattttatttttgttttggtaattcagcatgctgaata

SEQ ID NO: 62852 - DNA, 1188 bp, Bovine  19866881862662
aacagataatgggtaaagaagatactgatacacacccataccgcaagctgacaaacactcttcagccttggataaggaaccctgccaagggtaacagtatggacgaacctggagggcattaagttcagtgaaataagccagatacagacagacagatactacacagctcacttatctgtgaaactgaagcagtgaaactcatagaacgaagcagaatggtggttgccagcagctggggggatggggagatgttggtcaaagggtatgaagtgtcagttatacaggctaagtcctggatgtctaaaggacagcatgacaatacacatatattgcactgtaaaaaaaaaaaaaagaaagaaagtaaaaagaaattattaatgaatgaaattagtaatttggggagactagaactttaggaacaagaatgtagtaacagacattaaactcccagtgagctctcagacactgaagacacatggctggactttgcttagtggcaaaaattggaaaaatctagggtggtagaaatgacatcaatgtgacacaacaaaacagatctcagcacagaccagcatggtagacatatccctgcctgtgttgggagctaaataattggatcaagtttctgtaatgtgattgtgctttcttagaatgagtaattgtcagagttgctgttgtggaaaagtaattaattatgtgaagtaattatagttttccctcaagtatacttaggtttgatttttttcctagaaattaaaaaagcaatgttgtttgtatattgataggtagtgtgctatttagggacagaattacagagtagaacacggcattgacagaatgtggaagcaagtctttgcaactcaagcagtgatagagtgacatgttaacataaacagtatctttgagtttgaagagatggcttaaaatgaatatcctatttggtagagggaaatgctttataaaaaactgtatgtctaaagaaaagaattggcataaaccaggcaaatatagtcatatcaattgcaggtttgcaattgcacagaaaatcatcatgaataaggtgcagaaatgcaataattttggaagtgtgttaaatgtgcatatttaagtgtcttgattaatttcaaccctagaattcagtaagttctaccatgatcattcagtattcatgtattcagcatgctgaat

SEQ ID NO: 62853 - DNA, 2446 bp, Bovine  19866880595784
cacagcacacacacaccccttgactggccctcaggcagtgagcgttcagaggatagatgagcccctctggcccacttcagagtgcttgccatctgaggctcagtttatacgactgtacaatggggataatatagctccttccccagggggttgctggcagacatcaacaagagcaaacagcaaagcgcaggtgaagaattcagactgaaccggagggctactcaggagccctctcctcgccctgggtttgccctggccacgcctgttcagccgaagccccagaaagcttagggctccagctttctctctgcagcaacagctcagggaggcaggggccatctggggccaggacccaccctcgtgggtgggcaagaagagcaggccccgtggggcctgggctcctgggaaagcaaagccaggatccccaggtactctgccctgatggtgacaagtggagatcagatggcagggtgtggcccattaccgatgtgtgttcattcagcaaacccctcctgggcaccaactctttgccaggcctgtgccaggcactggggatgccaaaaccaacagggactccacccctgccctcagagggtctggtgagggagggtacatgtaaatggaggctttaatccagtggggtgtgtgatagggtgggtggagacccagaggagggcccagtcccagcctgcagtggcctggggacaagactccccagccccgtgggaaaccaaggcccagagaggggatgtcacctgccccaaatccctcaggaaggccacagtctgggtctctccagccctggtttggggctgtaccacctttacctaaaggactagcctctcctcactgtgtaaccaggggcatgtaccttaacctccctgagcacccgaagctggttccacaataacggaaagccatagtaagccagacaaggggcttgtttccatgctcatggatttcatttattaattttttttaactttttgatttcaaccatttttaaagtctttactgaaattgttataatattgtttctgttttgtgttttgtttttggccccgaggtatgtgggatcttggctcccctaccagggatggaacccgcagcccccacgttggaaggcgaggtctcaaccactggatcatcagggaagccccgtcctgctcactgattttaaatggtgaggatttgttgctgttcagttgctcagtcgtgtccgactctttgcaaccccacggattgcagaacacctgacttccctgtccttcaccatctcccagagtttcctcaaactcatgtccattggctcggtgatgtcatccaaccatctcatcctctgtcgtccccttctcctcctgccctcaatctttcccagcatcagggtcttttccaatgagtcggctctttgcatcaggtggccaaaggattggagcttcagcttcagcatccccttgctctatttcccctctgaaatagtcgtcagccctgtaacagtgaaggtgtgtgaaatgcagcacatttagccctggctaaagtgccatgcgaccttgggctgcggctgcccctctctgggtgttttctcatctgtgtagcaggagggagagggctctctaggttcactctctctccttcccgaactttgcagataacccccactgtatcctccctgaaacaacagcaagaactgttatcatgcctatttttttgtagatgaggaaactgggggtcagagaagggaagtcacttgcccagaccacacaacttctggtctgcatgaagtcacagccctccactccacctctcagaatgggcagtctcctgcacacaatcgagactccctgagggtcagagatctcgaggtccccgggccccagaaccccaggaggaggggcactagctcaaaaggggcttgaccccaccctgggagacactgggctgggtacagagtcagcaggaccctctttgaccgtgtcggccactcgtggtgcaaagcaattacacagcctaatagcgagaagctgccaaaaacacgtgtatttacaaaccagccgccacccagccaagctgcagcccaggatggttgcgaaatacagcctggcaggctggccacagaggtggttcccaggctggtactggagcccagactggcaccatctgagctacagaggccaagagccaagcagagccaccacgggcaggcaggtgacactcggagggccgtcccacagggcaggccaggcagagccattcccatcctctcaggatgcctggccccctagccttccggttctgaggcagtaggcagggcttgggtcacagggaaccctttggtccaccttggaggctctttctgcttccatctctccaaatatcaagtccagctgccctcatagggcgaagaggacaagcgaaaggtcaggacttaaaatgtccccaaacaaca

SEQ ID NO: 62854 - DNA, 1240 bp, Bovine  19866880603458
gcgccctgacacttggccccctccccaagtgttgaaattgagattgcgcgggtatttgttttgttaatctcctgccgaggccagggggctgcaggctgggtttcttctggttcacgtggggctccggctgccaagtgtgcctctcccttaccgagcccggggctaggcggctgcgcacctgttccctacccctctggcaaggtggtggggccagggaagcatgtgtgccctcctgagagagggtcgcctggcctcacctgagacctgctccccctcagctccttgagggccccagatatgaacactcaccacctcacaacctcttggagctatggaggtctggcctgcatccctgggtgctgctgagacctcatgggagtgccagactccagatggggtctggtccaggtagagatgttccccacagctgggtttcggtctttgtgcctcagtttccctctctgtaaaatgggcatcatgtctcttgtccaccacagagcatagtttatgaggcttcagtgagttagataagaaaatccttagcccagtgttgggcacatagtgagtgctcattaactactcgctgtagcagtgttgtgtgtccgctctgctgtcataaaatgtcattttggatccacagagaaggagacaatgctcaccagcagtttccatcgaccacgactgtcccaggcccttttccatgaggaatcttgcttcaggcccgtgatacatttccacacaaagcttactggtcccattttgcagatgaagaaactgaggcttgggtgacttggcaggctaatgacagagctgaaggtagaacccaggcttttctgatgccaggtcaggagatttcttcgaaggctgaaccctgtgaggggctggaccaggccaggaggaggggttagatgatgatgatgacgatgacgatacttttgtgtgatggatgctgtgaagcgcattacatacggtattgccgtgggctttcccaaaaccctgccagggaggtttatcgtccctaagtgttcttgcctggagaatcccagggacgggggagccttgtgggctgccgtctatggagtcgcacagagtcagacatgactgaagtgacttaacagcattagcagcaacagacagatcaggaaaccaaggcacagaaagtgggggaagcagcatccattgaccctgagcctctggggcatcgtctgcctttggctgctccatgtcgccagcagagaag

SEQ ID NO: 62855 - DNA, 1956 bp, Bovine  19866880915923
cccatagctgctgttctgttaagcatctctacccctctgcctctgggcttccctggtggctcagatggtaaagaatccgcctgcaatgcgggagatccaggtttgatccctggattgagaagatcccctggagaagggaatggtaacccagtccaggattcttgcctggagaatcccatggacgaggatcctggtgggctacagtccatggggttgcagagtcggacacgactgagtgactaacacacacacacacatacacacatccttctgcctctaatcagaatgaggcctggggctttgttcactgggcgaggcgcagccctcacagctctgggggaagagcaggaagatctgtttcctcgaggagcccatgactggctgtctttctctgtgccgtcccagctgggctttctataagcttgaaggaagttggggatcccgtgccctccagatctaggtcgcctctgtgctcagacaggagctgggagtgtttatagagttcctgggggaaccttgggggtccatagcttgcccccgagaggtactcttcctggcagtgacctgcctgggcagggaggaaaccaaagaggtgccttgggctggtcgtctgggcgggtctcacggcaactgtaattgctgggcaccagaacccgggctgggcccttttatggagacatttatagctagcccggctgggggaccattcaagtggttttctctcttttgtgtccctttaataaacgagaagaagagacataaaattaaagctgattctggagaaacttggctttgttgccaggctctggggaggtcaggggaaggttactctgctctctgacccagaggcctggatttcttaccacatgcttttaaaatgtacagactcagatgtcagggctagtcgggcctttgaggtcacccaaaccaactctcagcctgtgcagtgatccttgctggcgtgtttgcagccttccagggatggggagctcactaccttaaaagcaaacagcttgttgacaggcagctccacagagccttctgctgggggagctgaagaaacagacagacgcgggggaaagccccgtgctcgccagcatcagcatcagtccctgatcaagggctcttatctctgagagtttcctcttctgtcaaaagtcattcgttcattcattcaacaagtatttcatcttagcctgtgcttccccagaagcaaactcaagacaagggtttgaatgccagcagttgagaaatgatcccggggaaaacctcaaggagggggtcggggtgattgagacagagaaagtgctgtggattgcattgtgtccccgccaaaagcaatgttgaagtcttaagtccaggtacctgtgagcgtgaccatctttaggaatagggtctttgcagctgtaatgaagtgtagacgaagttgtactagattagtgatctaatgcaacctctgattcagtgattggtgtccttatgaggtgagagaaatgtgggcacgtggacacacaccgagggaagatagctctgtgaagacacagacacacacagggagagccaggcgctgacagaggcagggatcagttaggccgccacactccaaggatcggcagcagccaccagaagctaggagaggggcctggagccgactccccctctgagcccccaaggaggaaccagccctgctgacatcctgattttgatctctggcctcctgagctgtgagacgatataccgctgttgctttcagacacccagtttgtggtattttgctatgacggccttagaaactattaataatacaaataggaaggggaggaaataataaaaagcagcatgctgttcagcagaatgctgctgtggggaaactgaggcggggtcctctgcggagctcagggaagcagtaggtaacatgtacgtgaggaaccccagccagccaagggaagggggggg

SEQ ID NO: 62856 - DNA, 858 bp, Bovine  19866881211348
tgagaggagccatcatagaatgacctcgctgtccccagggggatcacacatgggttcaggtggactgagtcccccgagggatcgaggtttggcagctgcctctccactcgcctcttcatccccaggctccgatcacagcaacggcatctggtcctggagaacgagcctcccgggctctctccctcctgccttctctccccacaggccctttcaactcctccccttcctgacactaacactcccatcccttcatctctatttacctaccccttcactcttctctgtggattccgatcctgagcgtgtagggtaggggggaccttcaaggcttggtctggggtctcactggggaatttaaaatgggcagagacacagtacggtcttctgccctagacagagtagcttccctcatgatgcctcctctgccgggccacgcaaagaacacatcttcttccctaggtggagctacgttgaaaagtctccatctattgccttagcctgggagacaccaggcttctggaagggactaacattgacacttctgggtgaccacgtgctttctgcccactctgcactgatttctctctgcagccctgtaaagggagagctgccgtccccactcacagagcagggaggtgacccactcaaggcatcctccagctagcgacaactcagctgcctgggctgcagacagaagggcctggcctcccctccagcccgcccagccccacccaggccctgctgggtgtggggagctgagatagagggagagatgccggccagggctcagccgatagggcccgaggtgaggtcagcgctgggaggccccatggaagaagtgagtagtcaggatgcatt

SEQ ID NO: 62857 - DNA, 1175 bp, Bovine  19866881291905
cactgcatctctgaggggccggggtatttgctggttattggatgatatttcttcctgggtcctaagggagcctccattgtgtgaatgccaggaagtctgaaatcctgcattgctaaaaccattgacatcatctatgcccagcagctccctctcctgcaggtgctcgccgttctgctactgggcacgagtctttagtcagcgtctcctggcctcaccagggcgaccccaacatcattctcacaggcttgaggtttcgtctctggctgaaggcaggttacagccacaagccgtaaatggccacaacccaccagctgtccgagtcaaaatgatgggggaccatctctgactcttgcctgtccctcagcacccccttggccatcaagtcctgcagctccttccctcccaagcctctccctgcccactttctccaccacccctcatgaccactctggtcaaagccacgatgatcgcaagcctgggcactcttagccacctagtagcctgtccagcagcctatggtcctaggtgatctatttgctgttctgctgctagagtgacaattctaaaattagaattggatcttcctgcttaaaacccttccagtcactcattcattcagtcagccagttattcatctcttcaataaatattttggtctaccacatgccaaacattatttattatatggttaggaatacgtcaagacggacgaaacccctgccttcatagatttaccgtctagtgcctgtgtattgagaaatatacatggaaacgggtgaaagttgtcaagtagtggtaagcgctaggaataaaaataaaccagaaaaggagatttattgatggaggaaaacgccacgctctctagggtggtcaggaaggcccctctgaggattgtttgaatagaaacctgaacgcagtaggggcccagagcaacatgagatgtgtcctgggcaataacaggatacttcattccataaaaaacaatatcccatagcaaacagtatgatattttctgagcgcataaaacttagccaaagagaactggttggtcatctttgcaaaaacctagggagatgtttagaaaagctttcattagctatataaccttcagtaactgacttaccaggcttctctggtggctcagatggttaaaaaatcagcctgcaatgtgcaag

SEQ ID NO: 62858 - DNA, 1010 bp, Bovine  19866881332922
ccgcattgcaggcaaatctttaccttctgagccacgagggaagcccatatttaaatataagcccacgttttattgggcttcccaattggtgctagtggtaaagaacccacttgccaatgcaggagatgtaagagatgtgggtttgatccttgggtcaggaagatcccctgaaggagatctttattagtcattaacactttagtgtgaattagtatatagaccgccccccctaactcagggagttgggagaaagcccaagccaaactgtgtgggaaccggctcagaaggtgagggaaagggatcctcaaggagaaggcagggcttggggggaggtgtcagaactagaagaatcactccagttctcacaggtagaggaactgaggactagaagcagaaatgaaattgtccatagtggccatccgtttgtgccaaaggcagaattttctcccacaatcaggaagcacttgctctgttccattgtccacctaaggcgcccacccctattcaagctccccacctccattcacccaccgcctgctttataccttccttccaatgataccacagaatcagagcttatatttaatggagccttcccactttcccattccaaatagcttcttgacatcttttagcaagcatctaaaacttaacgtgtccaaaatcaaactcttcatcttctagacagacctcttctagtctccccatctcaaacagcatccgtgttcacccaggtgatcaagctgagagcatggatgcagtcttagatcggctttcctgggagcagagcctgaggcagggctccttgggcaagggtttcttggggaagagctctcaggaggaagggagcgaggggagcaggttagggcagatcagtcagggctggggtctcagctggagacagcattagccacatcccacagggagctctgtgtcctctgcattgcaggcagactctttaaccatctgagccaccagggaagcccgacgaacccacagggagctctgga

SEQ ID NO: 62859 - DNA, 1561 bp, Bovine  19866880431216
aacttgattatcttgaactttggaaacctttaaaccttacttgagaaataccttctgttactcatggttctccctatgtgtcaaagacttgtcttctaaatagcttcacttctttttgtacagcaatcagcagctccagatgtccttacacgatttgtaaagagctgaagacctctttagaaaactcaaaatagatatgtagacgttataatccataatatatgtataaacctttcctctactttttcaagatgttgattaaaaactttaccagaagtacttggatagttaagtggcttaattttttttcctgattggggtttaattttctaactgggcagtctcctttgttgtttcatgtggtgacatcattatctagtgtttttcttttctcattcctatgtaaatccgtgtctcaccacaccagaaaaacctgatcacaaatgctggttttctgaataaaacccatcaggggcctttcatatatgctggtaaagtccagtcttttcatgtggcttacagaagactccatgatttatccctcacattcatattccaggcctgtcaaacacaacagcttattcacacctctctgccttagctccagttgctctctctgcaacccttcccccaaggtcagcaggtgagcgtgtaatcctctttgaggactcagctgagctgtatctgaagttcctaaattcccctccctttctccctgaatcaatcactcccttctttgtgtctcccatgaaggaagtgtccgcactttcaaaagtaacgcatataacacttatatgtcgtccttgttaagttaggtgtgtgtctcattcttgaggcatttccctcctcctccagtataagctgaatgcaggtaggaactctgtttcctgtttgttgtatccacaacatctggcttcatagtagctgctgagtaactggaataagggaaaactctaagcccttgagaacagggactaccaccagtgcttagtgcagtttctggcacataaacacttaaatgttgagtgaattaatgaatttaaatggagtattgttatgtaagtttacacacccatttcttccgaagaattgtcacaggagaagtctctttaaaaatccaaaccaaatctaagtgctttcctgagtctttgaagcaagtaaattctttgactcttactttccttcaaatttcactcttgatttccttcataaatgttataggacaatgtgcttatttccatttcatgaaaaacattttttagaggtatgagtttttatttcaaaatctcctgtattccttagtcctcttctaagcaagtaaaataccttcaacttattgtactctttctcttaaatacatgtatatcttatacattgttaagaataacttatttagaatttatggagattgtattcaatatttgccttttccaggaggataagataatagagggtttttttggtatcatgtaggaacgtctttttgaaacatgttatttgtgacaatgggagtttttcatggttgccttttccgaaagaacaacccagacatgataggcaa

SEQ ID NO: 62860 - DNA, 707 bp, Bovine  19866880663556
tgtgttattgcctttaagactggctctattactagttttgaacaattgatttacgatgtgccttaaagaagtttgctttatttttcttataaggagaatatattgatctcagatctgtatgtttgaggttttcatcaaatttggaacatttttagtgattatatcttcaaacatttcatctctccaatttctatctctaattatacatatgtaatagagttttaataactgtcctaatttacatatatactacttcttatatctataacagttctcagttgattttgaatgattgattttcctctttattatgaattgtgtttttctacataccttataattttttagttggatgccaatcattatgaatttctctttcttgggtgctgaatatttttgtattcctataaatattcccgagctttcttatggaatgcagttatgttattaggaaacagtttgatccttgtgaattttgcttttaagatttgttatgtggaatcagagcagtgttaaatcaagggccttttaatctttaccgttgaggcaaccctctcctaggtactctacctaatgccccatgaaccttaaggttttccatattggttggtggcagcaagcatttgttgctgccctgtgtaagcaccaaacacaatatctccaatacttttggttacttctttcctggctcgggaagtttcctcaaa

SEQ ID NO: 62861 - DNA, 1391 bp, Bovine  19866880969217
tgtggactgtgtattgtttcctgtattatatgaagagtgtgtagagtttgaaggtattaaatatggggcttctaagtatgaggtgctttgggtgaggagtttgggttgtttatgaggacagtgtgctgtgtggagtgtgggtgtggtgttgtgggtgtggtgtattaaggggagagttaaaaagaatgatgaggtggtaagggtagcagggcattgtgctggttttgaaggagaataaacatttgagactttgatgcctaattagattctttgggtataggaagatgaggagtgtatatatcaaagtgaatttacaaactgaattcacaagttgaataaattaccaatccatgcttttggactcccttcctctacagatttgaattacttggttggtgttctttctccaggaataatttaaaggatgagctaagattatttcttagtgaacccaactgtagtgccactggcatatgattgttttagggagaccctttgaaagtagagctgtatgcttcacgaagcacttggagttagaataccctgtaaacaccacttttgccttttgatgtttgaagaaaatgttgtagtgagatgtttttaatcatttattttggcattaacttagaagcttcagtaacatataggcagacatttccttcctttaacgctgtcatcattgcacatggtctaacattagcttagtaggcagtattttttcttaatgatattttgtagggcttttcttctttctttgatttttaaagttacttattcttacaactttatattctgatgtccatttccagagtttgcttttaattatctaagatacctgctacattagggaaatgcatgtgtctgcatttcattatactgtaactttcaaactcagaaagaggttctgaaaagttgaccacaagcttttggtgctttgaggattaggattggcctgagattttctgcctaatttcactttcttttttcattctccaattcagtcttctacctaatgtggaatatgattgtgtgacaaaggactctatatatctagaaatggttttatccttttgtaaaattgttctgctctggtaggaacagctttagactacaacaaaaaggatagtttactcattaaaacttactctagtaacttgttgctgttttctctcatttgtgacaattattatgctcagatgtattggttttggtctggaaatttagaattcttgtattcagaggtaaagtaagattttctgacaagcttttcagattttattttgagcacatgaaaacattctagtaagtttttttcttcaaacaattggcaatgctggaacagttgtttacaaaggaaaaaagaagcttaggcatctgcatcaaacaattat

SEQ ID NO: 62862 - DNA, 5464 bp, Bovine  19866881100366
cttttgtctagttctagcaagatactggagctttccttcggtagcatttctgctctgacagtacactaagtgcaaaagaggatcttttgactgtcttttcagtcgaaaatgagaatatgctttacctaaaacccataacttcattcagtatcagtcacaggaaacttggttgtatattaattgattaaaccaccctgtccctagcatatgcttaaaagtgtttgctaaatacagcaggctggaagatgggaaaagtctgtggtccttcccttacagaaactgcatttgtgtgtttgagttagtcagacactttaaggggccagaaggataagtgttgaaaagagcttctactcagctccatctgattgttgccttgtgaaaatgaggcccaatattgccagattttttaagtaagaagccagaaaccagatttatttgtgaagtctccccatttttaaatgtttgttaacttattctgaaaattttaaaacattaggttgtctaaataaaacatgcttgggccatatagcttctgactgaaactttctgccctgcccaagaattcaagcaacaaagtattttactgaaatagatgttgcatgatctctgaagtatataagttttattactgaaatatagcttttctcttaactgaaaaatctaaaacatacataaacaggctaagaataagcattctaagaaaaatgctattagtaaataaatgtactttgaagtatagaagattttttatctttcataaatcattcccagtggtttcagtttggcgtatagcagactagtgtctgagaaacttcacctgcgaaatttcttggctttggcacagaaagggctccctttccttcaggcctcgagatcaccattccttggtagtgggaattgatgttttttcctacaaatggactcaagattatctcactaaaaacacatgtttgattgtttttttcaattgcagaattacaaaggggctgtaagaagtaaggtagtgggattgtgtgaaacctgtgtttagccctcagaaatctcgaagcctgaggtccagatcctcttttgggtccttccagccctggaagctgagacctcgctgaagtcttaacagtgatttacatacaggtggttggttggtggttttttttccccaaagccaactttgattccatcagtgtatttctaaggaaaatgtaaactgttcatacattctcttaacatcacagtgaaaaacaagtacccgtatgtgtgacagggcaggcagggagctccacctgctccggccttgacagaagcccttggccgcactggtgaacatgctggcttcacttctgcacagacacctatgtcgtgctgtcccactggagcaccggtggaccccaaaggcagggcagggggaggggttctttttgaaatgtttccaggagctctgtccagctgattctgtcttccagcctgggactgctgcacaaaactacaaggacactgatgagaccatagatctgttgcccttttctagggaagacttggcttggagtgtggctgcctggattcgaaaatgtgtccttgactccatggaataattcttatagttttgcctggaagagaccagagaatcagacatgtgaagctgctccaggttgtgatttttcccttagtctgagctgtgggaacccactagccaaggaatgtttttaaaggctgatccctatctctgtttaaagaaagagttgggcttaaatttaatagggattacctgttatcttgccttctggaaccactcttggtcctttggggcccagtatgaaggaatgatttcaagatccatgggctagaaggcaggagacctgcaccttcacaccagccctgcagcttgcagtgtgaccctggataactcagtcattgagtctgggatttcaattcctctttggtaaattagggaagaagcctccctataccaggtgagaactgggttcccccgggacacgggcccagcctctgggctgcctacactgcctttgccagcaccctctcacactgctgcctggcacctctgcctccccagagctcatggggaacaaaggccagaccaaggcaaatcaagccttacttggcagtttccaagagtttgacagcctcttcatttctgccttgctccataaacagcagggccagctccagcagggcatttgggatcaagtagtggtcatatttaatcctcttttcactgtaggacagaagaaaacacggcttacaggctcttctcttgagacatcctttgggcacgtccgtcagactcctcctgagcgtctcccaaatggaaggatccaattcatggtctcatggggttttctgacctgaattccaacttggaaggttcccactatttagccctagaaagacttaagaaccacagcaaagccttccagtcctctgcacctgggccctgagtccctgacaacctatggttcacgtcatgtcctaggcccacctccacctcagtccccaaccccacacccccccactgctgccctttatttcatctgcaaccctttccctctaggacttcacctaagcagggaaggactgaccgctgtcacctgacctcaagtctttcctgtgtccaggcattagcacatgctctacctactccacgtaaaactcctctttccttgctttctctgcctgataaacttgccaactgaagtggcgttactggaaagcctttcctggcgtctagcattatgtttaggtccttcctcctggcacctgctggcctctctgctttcctctggcacagccctcaccataccagattaagttacctatagctgtctctctaatatctgtactccccaaggatagagagtctcagttacaaactccagggggcaccattcacaggaaacactgcagataggctcctgtcgctgggcattctggtggccctggaggacaaggtctgaatgatctgggcctagaagggtcctggcacaaaacagaagctagtacatgtgaagcgagtaggagcaggccagagtcaggcactgtgcatgcgtgcgtatgggaagagaaacccagaaaatgccaccctggagccccgggcccagcagtaggccatctggagtgacagcagccacagaggcacttacttggcagagatgatcctgaaattctcctcagcctcctggacacggcccagatatttcagacacaggcctttcagcagcttcaccaagcactcgtcatccactgagtactcattctctgagaataggggagtgagggaagacagctttgttcattttctcaacactcatggagcccctactctgctgggccctggggacacagagatggctcacacatggcccctgtccgcagggagcgcacatctggggaggaaagacagatactgagacgatgacaatgcggtgaaatcaggactgactgaaggaagctcggggcttgtggaagcccagcagaggccctgatgctccctgggggacaagggacagcttcttggaggagctgttactgaaactcagcctagaaaggcagaggacaattaccagggcagagaagtgaggaaggacattttaggtagagggaaacttcagctgtaaagacctgtggtcagacccagcctggccagttcaagggcctggggtagtcacctgggcccttttccagcatctcttcagccttgatgataatctcaaggatcccatctgtgagttccggctgcttcccaatcacagcgtagccattccaaatgtacatcatttcctaggggcaggggagcaaatcagtcctaggtttcctccccagtggggcctcaagcttctccgtctataaaatgtgtagctcagatgaggatcactaaaggcccttctagctctaatcttccatggtaagtctcagcccagcttttgaagctgtaaggcttgagggagtgatggagattcttatctcttacttacgattgagatctctccttacccctgtgagaatttaagatggacccgtattctcactcttttcatatagttttcaattacgtttctgttcctgggtcccagggcactagtctgcactctccccatctctctgtccaaattccccatcctttgagaaaaaggtcatgcccctactctaaggagttgtcttccttgctccagctaacggcctcctgtattggaagagtcatagttgacgtaagctcttcaggggcttaagaccaagttaccttctctcctatttcactaaggcagtgggcctgagttttcatctatgaaacatgatttctttctttgccttaactgccaggaagctcagaatactaaattttcattctagtaactctaatctagttagccgagattagcatttcctaaactatcagaccaagcaatggacatgaaagtatttgtatacataaagttctagaaagactttttatatttttttttatgttctaggcagggactttaagttttgacaagtacttattaaatcattacatggtctaaaagagttctgtggctaaataacagggataaactgcatcttcaagcttcttctcggagacctaccatgcagatgagcatataaaggctccaagaaggtctacagtatgtaaactttgttcaggccggtctttcccaaatgtatttaatcacagaaataatcttatgcacacatagcatcttgcaggttacagttttggaaattctcccctaaatatccggttagctgctttccctgcccctccttacaacatatgccccaatttgatgacagctttattgtatattttgaattgtaaaatagttcaaaatttatttaaagatattcaggatataagctcaaaataaattctacataaatactgaacttgttaatttctgtagtgtttaataagtttttatcagcagactttcatacctgctctatgaaatgggcaaggtagatatttacattaaggggaaggggaccttgtatgcaagtcacacaattagtgagcagcatagccaggtctctgaagcagcacccttcctacctttctggctgccttattatttgaataacaaggactctttaacaaactagaacttgctctgatgcctgctcagatcatgcatggaattagcatcataattgtgattcagaaagttatgatgggctccggaaccagactgcctgggttcagattctaactcatcagctatgggacttggacaagttatttcatctttctacttatatcttatctatattttagcttcctacgtatctattaggcctttttatccccttctgtaaaatggagatgccaccagcacctaagagggttcttgtgaagatcagataaggcaataggcaatgggtgtaacgagccttgaacacagcatgtgcccagtagcaatgccagcaattactggtatttcaaagttga

SEQ ID NO: 62863 - DNA, 896 bp, Bovine  19866881464417
gagccccgggaagccctttaagacattggaagcataagatatattgtaaaggcactggaaagagaacattcccaagtgtttaaatacctaatgtgcctccttgttattttaaaacttggctgatttgtgtttttaaattgaatttttaactgcttgaggcaaataaactgagataacagtgcaacctggtttcatactcattattgatctgtttatgtcaccatcaccccctcacaacacactcagacgtaggcatactcaggtgagatcctacatggcagggacatctttcatctccctcagcgcatatctggaagaaagttattaataatatttatcttatgaatgactgaaaattctgaataactctgggacagttacaaagattaaacagatgctgaagttagtttctgcccctggttattaaataataatagttttggagtagattgagtcattcagccagtatttgttaagtacctattatgtgccctgctctatgctggaattgtcttgagtagaatttttggcctctatcaattaagcaaaactgacagttgggaaaaatacctgaaaactaggttaattttctcgttcctcttctgcctgcctgccagcaaaccctccaattccccaaccaccaagataaattatctaaattatcatagtctagcttctagacaggatagaatgctagaatagtaaaatgttagtttcagtcccagctctgcggggagataactgtgtgtcattgagttaaatctccaggcctcagttttcttagctttaatattcatccaacaaatatgtactgaccatttattatgtactaggatttattctaggtgctgaggatatacttatgaacaagatagatgacaattcttggcactcag

SEQ ID NO: 62864 - DNA, 2985 bp, Bovine  19866880431250
tgacatgaatgtcctcataattgtattgatatcagatgactatgtttttttcctttgtttttagttgtttttttttttttttttttattgaagtatatttgtttgaagggctgtgtcagtttctgctatacagcaaagtgaatcagcaatgtgcacacatacctcccctctcttttggatttacttactgctcaggtcaccacaagagcactgagtagaggtccttgtgctctacagcatgttcttactagctgtctatcctattcacagtatcaacagtgtatatgtgtcaatcccagtctcccagttcatcccactgcccttccctccttggtgtccgtacctttgttctctgtgtctgtgtctctatttctgctttgaaagattatgtttaattttaagacactttactttagaagcagaagaatgagggtaggaaaagcaaaacacaacttcactgatgaagcattgtacccacttaacgctatgtagtatcttatctttcaatccactgtataaattattgacaattttatactttaaaaatataaacatatatttttgatagagaaaacctgggttggaaaatttgacttctgttaaactgttggacccgaaatgccattttctgagaagttaaggatgataagttagtcttgaaaatcataaggaaaccaacaaaatccaatcaatcagcacctgagagaaaaccatactgcatgcagttcactttaagtaattaacaggatagaaagtatacccgtgaatttccctgtgactggaaagggcaataaaatgcgtagtggcaaattctgtccttcactctatcgaaggtcccattgctctgtttttgctttcctgccttgtaaggcattagccaaagagttcctttgggttttttttcataagatgttacagaaaagctgaacaaacattgtggccaacctaatgtatctactctcaggtgagcagatcataagcatgttcaaattaggagatgaaaaattttttaatattttatttaagcactcactgtgaaaactgatttcttctttataaaaaagaggatctcttttttcagtctgttctttgctcttataaatcttacttggccaagtcactaatgaaaaagaaaattgggtaaggtccatctgaatattctgagtccttcacaaaaactaatctaaaaggaagtcatctttgcagggaagaaggtgaaagagaacaaagatgtgaaggcaaaatagagtatttttattaatgcaaaggagagagatggtgcagagatagttattgtgttttctgcatggaatggacaaaagtgttatggacgagaaaaagaagcagagagagaaattggaagaaaagaaaagggagaacagggaagttgtgaggcagatactgctgagggcaggaagaagggaagaaaaggcactggcaagagctgagaaatgattgagattcacagcacaacacgacggatcccgtctcctaccgcccagctaggcctggaagactagaaatggcagtccacgcgtgaattcatccctggctctgtatttcctccccttcacagcctgtcttgcaaaaaccatcagggagccctaaacatccctgcttcttttatgaaatctcctctatttataaggtgcaaaggtaacaagggaccggagtcaacgttcctttctagttagcacaaacatcctttcggcttgaatgaggagtcacttataagatggataatgaccatgtacatcagttgctcagtcgtgtccaactcattgggacactgtgcactgtaccctgctaggatcctctgtctgtggggatgctccaggtaagaatactgcagtgggaagatccaggagatcttcctgattcaggaattgaacccccatctcctgcatctcctgcgtctcctgcattgggagctggattctttaccactagcgccacctgggaagcgcctgtaggagaccatggaaagcaggaaaatagcgtgtgtctggccacttgcacacgtgctaggtcacttcagctgtgtctggctctttgcaaccctatggactgtagcctgccaggctcctcaggtatctccaagaaaaacaagctgtttgcaaagtgcattttgcaaaacaaaaccgtgaatggtttctggagcttcaagtgaatcccagtgtgagaggtgcctgcagttcaatcaatgagagtaaccgacctctgctccaggcctgatacagcaaagaacactttgtctttttaggatggaaaaaacaggaggccaacacctgttgcctttgagagatgggaccccaactgaccttgaaaagttttctaattttctctgtttcaaaattttctgtaatgagtctgtctgtgatgtgctttccctccccccatcccaaattagtgtttgctgaggcagaggtgacacaagagtgacaggaggctgttttagtgattctccatcaagggattcttctctgaccctggaccaaagcagccatgatcacctggaacttgcctgtgatgccctggagggtgagttcaaactgacacacagccggtctctgtatccatagcgtctgagagagtggctctgggatgcagcctgaaaacgtatatttctacaaagttatttggtgctgctgctgctgctgctgctatcaggacagctctttgagaatcactagcctatggcacacagaaggcaatggcaccctactccagtactcttgcctggaaaatcctatggacggtggaccctggtaggctgcagtccatagggtcgctaagagttggacacgactgagcgacttcactttcacttttcactttcatgcattggagaaggaaatggcaacccactccagtgttcttgcctggagaatcccagggatgggggagcctggtgggcttccatctatggggtcgcacagagtggacacgactaagcgacttagcagcagcagcaacagcagccta

SEQ ID NO: 62865 - DNA, 2975 bp, Bovine  19866880444832
atcagtcctcccaatgaatattcaggattgatttcctttaggattgactggttggatctccttgcagttcaagggactctcaagagtcttctccaacaccacagttcaaaggcatcgattctttggcactcagccttctttatggtccaaaactcccatctatatatgactactggaaaaaccacagcattgactatactgaactttgtcggtaaagtgatatctctgcttttgaatatgctgtctaggtttgtcatagcttttcttccaaagagcaagcgtcttttaatttcagcagagaacttaaagtctgtggctcactttacttatttctgaaacaggttaattagcagcatgtgctctacagggataatatacattaaatgtgatgatttatagaaactgcttagaagagtgttgggcatttaggaaccactcaaacctctgctcctcattcacctcagtctgcttaaatgaaatcttttttacctctatgcatgtccttagttaatgatgcagaaagaggtggcgcctcttttgcaggaaagcagaagtcactgctattgctgaaaagattattcagcaggttaatgacaccagcctccttcctgggacctaagctctggtgtcaggattggtgtctttgtccagaggtcatctgtctgtgctgatcttgcctgtgtctgacaagcactttaatggagaactagacctgagcgtatctgtaccccaaatccagcagttaatgctgatgctggtcttgtttaccttagtttgcattgtcatctctaccaaacaattagacacaaaggcagctgcatgtattatttgagctttctattccactggggacttcccaggtggcatgagtggtaaagaaccctcctgacaatggaggagatgcaggagacacaagtttgatccctgcactgggaagatcccctggaggaggagcggcaaccactccagtatgcttgcctggagaatccaatgaacagaggagcctggagggctacaatccatgggctcgcaaagagtcagacacgactgagcgactgagcgcactgcacactcagctgacagctctcctcaaaggtaaggaggtaaggagttgaagaggagcctaaatcatttatttcttcagaggacacaaggcaaacagtttattgtcaggtatatagggtgaaaaagtgactccttaaaccaagaaaagctaaaggagaaacttaccagatttttctaaagtttattttcaaatcattgttttgtgaaattacttttgcaggtattaataaatgatcatctcctgtattttccatctcatcctctttttccatggctacttgggagtaactgaagttacaataaacttagatatgctcactattagacagtcttctctgaaaggcacttgcaaaattatgctttgtttttgtgcctgttaaattgcagttttcactgaacattacctaatggtaatcctctacactctataaacttgtaacaatccttcataagctaacacctcattaaaccagtgtcttgattcagaagagtgcataattcaaaacaactgctattccctagccaaataaaatttctcatattatcaaacaaaatattgggaaatccaaactggctaattaaagcttttttttttttttggttccatgaattttgattttaatgaggttttacaaaactggccttgcatattcctaccatagagatccaactacttcacacataaatctctttaatctttaagacatatattcatgatttataaaacactatacaaattgtctcatgttctcttacacacatctatgtatacacacatatatagttacatagttgatacgtttttctgagttactaaatataaaattttaaacaaacatgttaatatcatgagtggcttagttcttaagaatcgaattaatcaagagtagacatttttatggcacatttcttacaaaaattccatattttaatctataatacccataatacatagctagaattttgcatataattgacttaaaatacttattggttgaatatgttaatgaatattggaatgacaatttattataattttactatatgcaaagtgcctaattctactgagaattcttatagtagatattttgtgatatagatgaatctatatcctttatctattctatatcctatatctatatcctatatctattcatcctatagatgaatctattcatcctatagatgaatctttatcctaaaaaaaatgttaaaaaaaaaaaccaggaaaattcctggtgatccagtggttaagactcctcccattccactgcagaggccatggtttcaatccttgatggaggaactaagatcccatatgtcttgggagcatggccccaaaatacatattataaaatttaaaaaataattaaaaatttaaaaatgtcaaaaaacatatgtaagacaaataaaaagcagatcatggcaaatgccataacagagacctgacagaatgcaagaagttagagaagacaaagtaactgtggctcaggaaatcttgaaggcccattagtaaaattgagaaatgttagtgaaggcaaaaagacaagacataaaagccagaatttgcattttttcaacacagatgggggaaaaaacagataggctaaaattgaatatttacaacaggtttatatgatgagaaagtacttttcttattgatgagctacaagtagcaattttctcgagttcctaattttatataaatataaaaaggtgaacttatgtatacttttgggcttcccttgtggctcagctggtaaagaatccgcctgcaatgtgggagacctgggtttgatccctgggttgggaagatcccctggagaagggaaaggctacccactccagtattttggcctggagaattccatgcactctatagcctatggggttgcaaagagtggacagga

SEQ ID NO: 62866 - DNA, 1287 bp, Bovine  19866880518870
tcattaataatatttgcctaaaataagatagacccagtttccaaaggctagttcttgtcccgggaagaaaaaaagcatttgagttacccccttcttttttttttttaacagatattgtactgtgatggcaagtaaaagtgtgtgccttggggctatgctgtctgggggttgtctagactagagacggccctactattttatgattgtacaagataactgtctgaatcatcctttgtctcaatgtcaccctcccatttccagaaggcatcttctgtattttctgtcttctccaataaaaggataattttgcaggctcatttctgatttctcatgtgctcttctcagcattttgagtagacacccactgtcactttgaccaagaataggggtgaaattctggagtgataaagttctaaacaagttaatctcctctccctggatttcatagaattgcttagtgacacaattatattcagtttccaaaattagatataatcattttcttccttgtaaaggttaatagacacttaaaagcaacagcaagtgattggataggcttctaaatttgggattccaagatcaaataatgtggcttcatgctacacaaaaatattgaaatattttctattttgatgttacaccttccatgcatgagctgggtccgaaatttatttatttaaagaagacccctctcatgaactctagacttatacaataaactgcttttttgactacctcagaaaatcttgcatatgcaacatatgcatgcttatgttgctcagttgtgtctgactctttgtgaccctgtggactgtagcctctttccatgggactttccaggcaagaatactggagtgggttgccatttccctctctagtggaccttcccaacccaaggatcaaacttgactctcctgcattggcaggcagattctttaccactgcgccacctgggaagccccaaatatgctggctgccaagtaagtagaaatgaaacttagcaggtaccaataaaacccttaatacacttctagcctacttggcttccttcagttttcaccatctcaattaatggtttattcttcctctagtccttcagatcccaaactgaattccatctgtttgtttattcctaaatttctgtgcatcaataaggtactaagaatcttaacatttctccttctcaacctccctttcttcttgctcttctcagcttaaaatatgtgcactggatcattttgcagccctacccaccctgtgttttgttaactaatattttatctctaa

SEQ ID NO: 62867 - DNA, 885 bp, Bovine  19866880537399
cccttatttttgtaaatatcaagccttaggctaacttgatgcttttctgcttgcttgtgtgttggattctttctcagagtgccatccagaagattttcacattttcaaataaaataatttatagaaaaactaagggggaatttgtttcaaaggactcaaaattgaaacaaacaaagcaaacatcaaaggaaatgttcctgccaggttgaactcttaagcaacttctaagaacttttcaatcacatcagagaacatatatgaaaatatatttttaaatgccacaatgccagttttgatgccaactaaccggaaataacccactgaaaggaaaatgcatttcattttctccctctcccctcatctctctgtatatacatacttcaatagatagatatatttttaaatctctgtgtatacgtatttgaaacatcactatcactgaaaggttttaaaacagcatttccatgaagtgagacataaagtctatcccaccttcctcctagacggcttttaagctttcggtttgcaggaggtaacctagaagctttcacatcaggcagtcttttatgtttagagaggcatgagctgtgattatattgattgatttcaagggcatattagagatgaagccaagtctctggagagaggttgccgtcaccttgaccttgggtcagcgttagaccactgacctttgaacctaagacctatctaccagattctgataccatccaggccacccgagcaagtcagcgggggactcaacgtcgatgtgcctctggccaaatcagaattgactggccggtaggaagcccacgagcagagggaaatgcaggttaaagtatgtcaataatgtttcagaagaacgatttctctcaagaattgtag

SEQ ID NO: 62868 - DNA, 1631 bp, Bovine  19866880561603
aaaccccccagcaggaatcacaggaggtggaccttcgtgactgctgccattggggtagtggtggtggatttgccttacagattcctaacaatgcatttccaccttcttttctgtaaggatcagcactggtggagataaagggattttcctttctgtccatcccattaacaggatctcatccagccttgacaatagatgtgctaattagagttaattgctctaatggacactagtctagcaggactcaacacatagttcattcaaatagaaaagtactttactgaaggctatgaatgcatgaatttcaactgtttacttcagagtaaagggaaaatatacatccaagtctcctaaattctaaaagctgttttctgtattttgaaagaatgtttaaaataaaatcgtttttggttgatcttctaatttcaccaaggggtaaagcaatttctcccaaagaaatggattcataagaaatcagcacgagggacttccctggtggtccagtggctaagcgtctgcattcccagtgcaggaggctgggattccatccgtggtgagggaactagatcccacatgctgcaaataagacctggtagagctaaataaattaaagaaaaagaaaacactaatttaaaaaaaaagaaaagaaagcagcctgagaccgactgtgatactggatgaaatatcaagtttcctctttttctaacagttcacattcagttctttccagcagttttcacattctttaatgtttcccatagaattatgcatgtgtatacatataccctcattctgttagagatttgtcaatccctaggctccaggtgtcttctgaatcttagagatagagctaaacaattcaagacacagatgatacagataaaggtgtaaatagagatatagatatgtatctatataccatctatatctatatctatataatagatccaatctggcagcttggataagacagtgccctgtgtgggtgctaagtcacttcagacatgtccagcttgtgcgactccacgaactgcagcctgccaggctcctctgtccatggaattctccagccaaaaattctagtagtgggttgcacttccttctccaggggatctaaggtggctccaaattaaggaaaataaatcagttattcccaatcaatttttttcaaaaagtaaaaatactgtaaagttttccctaagaccaaagtcattattttataatgttaaagactggatcaaaataaaacatagaaaaaatgttagaagagatgaacatggattgctcatcattttaatgataatacatcattttcaagggtgtggatgggatccctaatttcagagcattcacaattgattacaaacagttcaatttacacgtgttggaaaatgagatattgtggagaactagaagcacaggaagacagcccgaggcaatcgctgatcaagtcagatctatgtggtctgtgggttttgctggaaaatcttttaccaagtaccttcacacatagttttgggctttgggataaaaagattgttcaccaaagggaaggaaaggttatttactgccatcaggaacagaggctctaatagtaaagtatacgaaggttattatctatcacacattaa

SEQ ID NO: 62869 - DNA, 3411 bp, Bovine  19866880597394
aaggaaacatgaatataaaaattgcatggttgattggcctgtttctggtggggtaggccacccttaatagaaatcagtttttctcctctttctctaacttgctatatctctgaaataaatggaatttctgtccagacctctcctttcaactccacttttacaatatcattaagtgttaacttatgtgacatacactcaaaatctgaagtggtccagaagaagggaaatcaagttaggtcttatgtcatcagcaaagagcagtttagacatgtctcctgctcagggaaagaagagaccacttctagccagggcagtgaccatgacgaggtcagtcagcatcctctacgtatttcggattccaggaggaaacagaactggctgcagcagaggctgtaagttgaggggtaaaagaattaaaaaattagttaagaagccagattgtagagcattgtgttgttgttcagtcacagttatgtccaactctttgggaccccttggactacagcagccaggcttcactgtccttcactatctcctggagtttgctaaaactcatgtccactgaatcaatgatactattcaaccatcttaccctctgtcaccctgttctcctcctgccctcaatatttcccagcatcaggctgtttcccagtgagtcaactctatgcatcatctggcctaagtattggaccttcagctccagcatcagtccttcccatgaatattcagggttgatttcctttaagattgactggtttgatttctttgcggtcccagggactctcaagagtcttctcaagcaccacagtttgaaagcatcaattcttcagggctcagccttatttatggttcaactctcacatctgcacatgactactagaaaagccatagctttgactatatgcacccttttcagcaaagtgttgtctctgcttctaatatgctgtctaggtttatcatagcttgtgagaaccatccaaaacagttaagtataaatgaataggtgtcattgaagttacatcttcagattttttctgatctccatacaataggaacaatgttgtacttgatgaagtttatatatataaatatatatatttatatttatattgaaaacaagtcagctttctgtggtactgtgttcttcaggaagaccagataaaaatgaaacaaaagttaatgtgttgaccagctaccatttgcctctagcttgaaagtggaggttgctcagtcatgtcctgctctttgcgaccccatggactatacagtccatggaattctccaggccagaatactggagtgggtagcctatcccttctccagtggatcttcttgacccaggaatcaaacagaggtctcctgcattgcaggcagattctttaccaactgagctatcagggaagccctaaatacagacactggttcagatatagatttagatataaatgtagccgttcccttctcatgaaacttacatgtaagttattattctatcactttcacacacacatatacacacaataataaagctaagagagattacatatatcctcaagaatacacagctcagtagtaggaggtaaattgtggactcggatctactatatttttccaaactgttcttctcaaaagtctttgtccagagctttcttgtagaggagacgagagagtgaacaggagttaatataattgtgtccagctaacatcttcatgaaaccagtgttaggaagaatctggagctcagtcagtcagttcagtcactcatttgtgtctgactctttgcaatcccatggactgcagcacgccaggctttcttgtccattaccaaatcctgaagcttgctcaaactcatgtccatcatgtcggtgatagcatccaaccatctcttcctctgaattcccttctcctcctaccttcaatctttcccagtatcagggtccttttcaaatgagtcagttctttgcataaggtggccaaagtattagagcttcagcttcagcatcagtccttccaatgaatattcaggactgatttcctttaggactgactggtttgatgtccttgcagtccaagggactctcaagagtcttctccaacgccactgttcaaaagcgccaattctttgctctggagcttagagaagcaatattatctgctcagggtcctaaagctgagagagaaagaatcaacagaaaagagttaatcagccagatacgggtaaggtatatcagaggctaatttttgtcctttaaaaacatttttttttaatttggctgtcccaggtcttagttgtggcacacaggttctttgatcttcactgagacatgtgcctttgttgttgctgttgcagcatttgaactcttacctgtggcatatgggatctattaatagatccctgaccagtgatcgaaccctggccctctgcattagaagcatggagtctaagcccccagagaagtccttaatgcttatgctgttttatgttattctacagcatccaaaacgtatgaattgaagtttgagccaagcacaaatattggctaaagccctgggtagcattagtcttgatgatctcaaagaaagaaagtgaaagtgaagtagctcagttgggtctgactctcagcaaccccatggactgtagcctaccaggctcctccatccatgggattttccaggcaagaatattggagtgggttgtcatttctttctctaggagatcttcccgacccagggattgaacccagatctcctgcattgtaggcagacgctttaccgtctgagccaccagggaagatttgatgatctcagtcattcagcatttgcctactcagagactattctcagaaaatacccaatttaagtctcaggaaatccaatgagcacatcagaggagggtgatttgtgctcaatcatgtttgactctttgcaaccccatggactatagcccagcaggctcttctgtccatgggatacctcaggcaagaatactggaatgggtttccacttcctatgccaagggatcttccaaacccaaggatcggacctgtgtctcttacgtctcttgcactgacaggcaggttccttaccattaacgccacctggaaagccatggtgttttaccaggttgaaatcaccaaagaactcatagcattggaagaaaagaaatttgcatacgctacagtaatccacctgcagtgcaggagacctgcgttcgatcctgggttgggaagatgccttggagagggcatggcaacccaatctagtattcttacctgcagaatccccatggacaaaggagcctagcgggccacagtccacagggtcacaaagagctggacacaactgagtgactaatcacacacacatgcacagtaacctgcgtgctatatagtagggattcaataaatggca

SEQ ID NO: 62870 - DNA, 821 bp, Bovine  19866880606034
cctagaaggagcttctggggacacagacagtgaaagtccaccaccataagaaggatctgactcaggttaagagccaagactaagaaaaagcatctcaagtatatttcacgatgcatctaccttcaatggagaagaaaatgagtaataataataaaatatttaaattactattttatatattttttctaaatttcttaaaataactctctagatctccaaatttcactctctccccatgatttcatgtttttttacacgttgtgggtgtgtgctaagtggcttcagtcatgtccaattctttgcaacccatggactgtagcccaccaggttcctctgtccaagggattctccaggcatgaatactggagtggtgtgccatgccctccttcaggggctcttcctgacccagggattgaacctgcatctcttatgtctcttgcaatggcaaggaggtcctttaccactagcatcacctgggaaggcctctctacacttcacctgcataattaaaggtttgacaaatgtacaaagtcttcagcttcttcaatatgacttgttttaaagttctagatgaaaaactcatgtcaatcttcattttatctacatcttgtttccacccattgtcatcacagtatgacaagcaaaactcttttattgcaacagcatttttttttttttttggtatagcaatatccttaatgttttgtttgcagtaaaaaggcttaaaatgctatttttcttctcttcacttaaaagcaatcagtctccctctcactgagctcctactcagacaactaatatccagaattataccatatcag

SEQ ID NO: 62871 - DNA, 2033 bp, Bovine  19866880699832
tcattcaccttcatcatcctgatctaaaagctttattctcaacattttgtcataaaatgctgtgtacacagcctcaaagagtagctgaatatctctccagtatttgatttgacactaaaataccaatagcaatacacttagtttatgttgtacaaagaaaataatagagcaatgaaatcataaaatacaaaaatgattgaatatttttttctaatgagttgctgtgaattaaataacttgacagaggcaggaataattttttttgaggacagactattgattgttttttaaaaataatccgaatttatttggaaagctaagcatgcattcaatatattttatcttttacaagaccattacgaatgaattctatttattaacctggtatgtgatattcaaatatttctttagagattgcttttcatctctttggaaagagtgtgctgtgtaaatattcttttatatacccttcttactctagacataccagtatttgatatcagatttcatatttaaattatccaaaatacatttgaaactaaaaacaatgtggacaatacactaccagtattatgcgtgaaaaacaaaggagaaaaacataaaaatcaatgaagtaatggaaataatcccaaatgatatttaaagaatgatagaatttggaaaatagagtcagcactgacgcttagttggctaaggatctgaagcttggaaataagaaataaaaatgatcgaagccaagtcacaaagtatctaaaactaaatgaaacagtacaagcatgtgtaagtgacatttttttgatgggtgacatttcaagaaaagtagaaatgcacaccctttaaaaaaatgtgagataggaaaaaatgcttaagatttaattactcttgagaagtacagggtgcactcagtcaccctgacttgccctaagactgtacatgattttctccccccattgctcggttaagcataaattcatagatttcatggttaagagagcttgagatgagatgctgggtccctgcactcagtcctgccacttcttatcggaccatctgctgtcacctcaaaaagccaagactgtataatctcggtaaacatacaaaccattcctgcatttcatttcggttggaaggaggatcccattatgtgtattgattttgaagtgtcagtaccttcttttgatgaattctcagctactgactgcctttccacgaacacaatattaagtcttaaaagtgtttactccaaacttcttccacaaatgcttaataaggttcatggtcttagaagttaatccagtttacacgaaagtctgcctgtgtgttttgctcacctttttgatgcaagaggcgtttgttatcaatagacccacaggtgccgaaatgggcacagggttcacgatacgcagaagcaagaatcactggttgctgagaccagaggtgggagagcaaaagctcctagaactgtctcaaagactggattatactgaccatgggggacaggcgtgtgtccttacagctgggtctcagtgtgtatacatgttcgggcatgggggataggaatgcagaaagccaaaagagacgatggaatcatagctgcagaaaaggacatttatagaggctgtacctttcctcaaatctttacttatacattttattgtgcttcattctcagttttattagtgctttagcactctgtaggatctacatgcaatactatatccagattgaagaacaaacctcacttttaaggaaagataaaaccttggaagtttccagagaaaacacattatttaaaaggtaaaaagaatcccaaagatggctaggattccaaattctgacttttatcagaaactatggaggccaaagttaatgtaaagacactttaaaaagtgctgggggggaaaaaaaaatcaagacctcagatgatgcccatagcaacaaaaaataaaacagaattcttccagaataaaggtgaaataaaagcattttaaggtaaaagaaagccaaaagaattatgaccagcccaccatcaa

SEQ ID NO: 62872 - DNA, 659 bp, Bovine  19866880876694
tgggacctttccgaatcaggggttgcctgcattggcaggcagaatcttcatcactgagccaccagaaaagccctggtagttattttgcttttccctggaggctcagtggtaaagaatcctccctgggtcaggaagattccctggaggaggaaatggcaacccactctagtattcttgcctgggaaaccccatggacaggggagcctggtgggctacagtccatagggtggcaaagagttggacatgactgagcacacacatctgggtctctgtaaatatttacaccataaataaggaaaggagagctgtccaggcagagagaagccatatgaggctgagtccgggaagaagctacaggtgtgattggatgtgcagagctgagtgctatagtggggggcagggcatgcagaagggccagatggtgaatcatatggaaattgtgaaaactgatgcgataacatctcctttgctttgaactctgttgaaaaagacaagattatgtttagacactgagacctgaatcaataaaagagcagagagatccgtccaaaggcgggagattgagctctttaaatgatgcgtatttcagaatatcttttcttcctaaggaagtcttggtgcagaaataaactgccctacttaggagcaaggagcatttt

SEQ ID NO: 62873 - DNA, 1283 bp, Bovine  19866880936504
attatgctttggtaatgctgatggctcaggtctggacattacagaaggacagttcagccaccaccccagattacacatgcaagtgttcttgtctatttagctgctttttaacttgtctggagttagtctggaacacactgccaggattggcaaaggagcacagtcagcatataattgatttaattaataattcatgtattcattcattcaacaaacacttttacctagctcctagcaattcaggcatcatgctggggacttagtgtcaggcacaaagcccaagactagccacattctggctgatgggccagaacaagaagcagaaagagtagatcacaaagcgtgtatgatgtagcaaaattagataatctcatttatgcagtttcaaccctattttttaaatgggattttttcaattgaattacatttacttataaaaatatatacccacattatgctatcaggagcttcatcaaaaagatttgaagtggctttccccttaattacctctaccaatttctagcagaatatcagatgagcagagtaaaatatccattgcataccacccactacactgacctcaataaattgtttatttcagtgtctagattgaacaattgaaatgtctgcattattgagcagtggtcaggtaaaattcaaaagaagctcctcttctttttcaaatagattcttttgtttatttatttatttattttttgctgtcatttaaatttctaatattttagagagtagatattcagtaatggttataaacacttattttgcctaattcagctaaatgggttgtctctttttagtatatgctaaagttagctctatttttcataaagacagaagtacaatgtaatattccctccctgtctgtatctttggagagtatactgtatttacattttgcagtttaaactgggggtcacaaaaggaaaatgatttgctttgaacttcggtgaataaactgactgtgatgtccacagtgtatagctaaatcactattatgaattaattcaattttatttttatcattagtatcagcctgttgactaaacccttccctggtggctcagtggtcaagaatcctttggccaaggcaggagatgcaggtttaatccgtgggtcaggaagatcccctggaggaagaaatggcaacccactcaggtattcttgcctgggaaacgccatggacagaggagcctgacaggctacagtctgggcggtcacaagagagtggacatgcctgaagcaaccgagcacacatgcatgta

SEQ ID NO: 62874 - DNA, 985 bp, Bovine  19866881065863
agtgtcctctgtattctttatctcttcttctattctattatttaatctatctatacatgagcaattccaaagtatacgttttccaaatctaacagcaaacatgctaatgagtattacaatgtatttgataactccaaccacctgttgaaaaaaatgtaaatctaagagctatttgggagattgggattgacagacacatacacacaattgatgctatgcataaaatagataacaaataagaacctactgtagagcacagggaactctactcagtgctttgtggtgacctaaatgggaaggaaatccaaaagagaggggatatatatacatatagctgggtcactttgctatacagcagaaattaatgcaacattgtaaagaaactatgtgttagaattgttactcagtcctgtctgactttttgccaccccatagtctgttcatggaattctctaggcaaggatattggagtgggttgctactccaataaaaaataagtaaaaacacaaaaaggaatttcagaaaactccttggatctggaagtttactttagttaaaaggatttaaccgtcagtttccagctattcagttgctaatgagtttctggagagagcagcattcagatcaaggagatggtggttgaagtcttctagaaaaccctgctgctcattgttgactagaatcaagatataattaatcatgcccttggtctctccctcagtgtctctgtcactcccagtgacttaaaggtaaggtcagctgagacggttttgaacttgaattgcttttgcttcggaaatatctacaggctaaaaaaatcttaatttgttttaaatgtcttaaaaagaaaatgcatttattcaaatgactccctctttatttctagtttttccttacttgtaatttttttcacgtaaagaaaaggggcgtttctttttttttattttattttttggcaccctatctagcaataaaaagttcttca

SEQ ID NO: 62875 - DNA, 1197 bp, Bovine  19866881310382
tttttctcttttatttcctcctgtttccctgagacaggagggcaaggttgcttcttgaagatgtctgatggtgagggaaaagatgcccaaagagaccgtttagagtggatgaaaagggaggatggaaaggaaattatatacaaatattctgcctctttaaagatcaatgttttcagttttctagtcttttcatccactacaagagcttgacttctttctgtattccttccatgaggatgttaccactcctcttaagtgattaagtgcctaagattctaatgacttcccagatcttgtggagaatactggctaaacaataataagtagaaatacagtatgctacagtcatccctggaggtccagtggttaagactcagctcttctaatgcagggagcatgggttcaacccctggttgtgtaaataagaccccacattccacatggcccaaaacaaatagataaataaataaaataaagcttagaaaaagaaatacaagatgcttattgtatatatgttccgctatatcgtatgtgtatattgccaacactagcaaactctgataaataacttttgttggtgagaaaatgtcattaattcaaaagtattgagtttccatgtctgttttatactggacaaaactatccacagagggatatgcaaattggcaccaactgtattaagcatcctaatgcaatttcacctgctaattaatctcatctaaattgtgattttgatctaaatattaagttccagaggatctcataccagatcactcttgcaaactatccccctggttataatttaaaacatacgtatgaacaaatattgagtctctttgaattctttaaaatcgtattgttttgaaaataagcaattacaagctatttcctgcatgtcagttattatttatttgtataaaatgtttcatgtttccttggttttgccatgaaatcttattagcatgttcacattttacaaatttaaagtataaaaaatgagtcttagaattggaaagtaggagttgtaaaaatgggagaaaagatacagaatatatttttttaaaaggatagaagaactggagtaacatttattacatttgaaagtagtgaaagtagtgtcttttctcagctaacccctttccgtgccagcaacaccaagatccagagaataaaggaacacattcttaacagcagccc

SEQ ID NO: 62876 - DNA, 1534 bp, Bovine  19866881395709
taaggagagaggaacttctcgttgagtatcgcaagggcgatgttctatttcttactctccacattccaacccctagcgtctcactggggaggaagaaataatggaatacacagatgagtatagagtggaataagtaagggtagaatgatgtagaatgtttgcaggctaatattaatgtatgagaataatcttaagaaaataaagcccatctatggggaaaagcaagacaggaatgttatcgagaaataaaatcatgtgtagtatctaaaccaattcatgactttgacactcaaggaggattcttagcaacaaagccagagatgcaaatgccttcagaagatccagactctacacacagagtgagaaactctaaaaaacgctgagtgaaggtgatcatcaatttttagcaagtcagaagatttaggggcagtttagcatttgtaaaagagaggctgacaaaatgacctgcaggtcagatccggtccactgcgggtttttatattgtgtgtgaactaaggacatttttacagtttaaaatgctggaaaaaattaaaaagtgaataatagttcatgacatctgaaaattacgtgaaattcacatttcagtgtcaataaataaagacttaatggtacacaaccacaccctcgcatttatcttcatctcatctttcactgtaacaacagagttgagtagttacaacagagacctagcgcgagcctgcaaagcctaaaatattgcttacattcctggccctttatggaaaaatttggcagtccctgaaccacaagtttctttatttttattttattcttgctttaaaatagattgactttctactatctgtttccatggagtcaaatttgattgatgtggagttgtgttaaaaactgagtttctttctttcttttttagaaaaagaaatggtaactttgggtcggttattgatttctttgtttctgaaaacacttggaaaagacccagactcttagcttgtgtctaccactgagctagtctctctcccacagttgcacagactgcaagcatatgctgtcagtggaaacattttttttttttaatccatttcatgagtatagattgagcattgtcctaggcgttgggagtgtggcaggaaaaaggacagccaaagtccctattctcacagaaggtactttcttgcagtgggagacaaatcataaaaatgtaaacagatgagccagaaaagtagagatcctgataagctatatgtaagagattaacaggaacaattgggatgggatgggatggggagcttgtgaagacaggaaaggactcttcgagcaaataatctttgagttaaactgaaaggatgaaagaaatcaaccacacacatggcccatggaagagggtgccaagcaaaagggttggaaaacgctgggtctacaggccacttggcccctgctggccaagaggatgtggtggtgtctgaggaagtgactcattgagcaggggaggatggaagaaggaaaaagaagtgggagaaagggggtaatcaag

SEQ ID NO: 62877 - DNA, 1705 bp, Bovine  19866881430221
tacagtccatgaggttgcaaagagtcagacatgactgagcagcaaacacacacacatctccccatacaaacatacacacaccacacttattaaatatggaccaacttctgtctttcttaataattctcagattagactcctcctctgatcctctctatacagagtaaggcccagaagatgtcaattatgatgtgatcactcttaactgactgagggatgtctagcaaggaggcaagctgtgaacaagaagacaatgcattggatccacaaggcgagagacaagttaaatcaggagccagaggaaagacaccagcaaacagaaatcccatccatcatagggtgcttgagaccccggggtgtgcagggagaaagtgaagcatgaacactgagttccactggcctgaaatggatgttgtccaatatgtccgttggttccagaggactctattcctaaagccaagtctgggaatgcctagggtcaggtcttcctgacatcacttggtgttacctatctacttcttcctctggcttagggacaagagagctgccctggagcaccacgtgatttatcactctaggatgtgtgtatataatgtctgtcattcaacatatattcctgtgtccatgggattctccgggcaagcatactgcagcgggttaccattcccttctccaggggatcttcccaacacatgggttgaacctgggtctcctgcattgcagacagattctttactgtctgagccaccaggaaagcccatacacacatacacacacattttattaatatgttagtcaataaaagaatagttgctcttattatgaaggatctctaatcttttctatcaggctttaaattgactcaggaaatattacactggaaaaaaatatattatgttggtcttcagatcagatcagaccagatcagtcgctcagtcgtgtccgactctttgcgaccccatgaatcgcagcacgccaggcctccctgtccatcaccaactcctggagttcactgagactcacgtccatcgaatcagtgatgccatccagccatcttatcctctgtcatccccttctcctcctgcccccaatccctcccagcatcagagtcttttccaatgagtcaactcttcacatgaggtggccaaagtactggagcttcagctttagcatcattccttccaaagaaatcccagggctgatctccttcagaatggactggttggatctccttgcagtccaagggactctcaagagtcttctccaacaccacagttcaaaagcatcaattcttcggcactcagccttcttcccagtccaactctcacatccatacatgaccacaggaaaaaccatagccttgactagacgaacctttgttggcaaattcccgtaaaataatgaaatgtagaatataagtattttgataatggatatgatttctaactaattcaagtgcatgcatctgatattgaattgtcatatctcaaggaccatctgtgactgtttgtgtttacacaaagccgattactcaggacagaacccaccatttgcagtcaatttggcctcaagcactctgataaagcagtaaagaggagtgatgaaggagcctcagaagatgcatggagatttagaagcttctgttcagcagctaagggctcatgctggggtttgttccttttacctccagaagtgatttgaagta

SEQ ID NO: 62878 - DNA, 1512 bp, Bovine  19866880055503
tagatagcatattcaaaagcagagacattactttgccacaaaggtccgtctagtcaaggctatagtttttcctgtggtcgtgtatggatgtgagagttggactgtgaagaaggctgagtgctgaagaattgatgcttttgaactgtggtgttggagaagactcttgagagtcccttggactgcaaggagatccaaccagtccattctgaaggagatcagccctgggtgttctttggaaggaatgatgctaaagctgaaactccagtactttggccacctcatgtgaagagttgactcattggaaaagactctgatgctgggagggattgggggcaggaggagaaggggatgacagaggatgagatggctggatggcatcactgactcgatggacgcgagtctcagtgaactctgggagttgatgatggacagggaggcctggcgtgctgagattcatggggtcacagagagtcggacacgactgagcgactgaactgaactgaactgataacactatggagaaagcaatggcaccccactccagtactcttgcctggaaaatcccatggatggaggagcctggtgggctgcagtccatggggtctctaggagtcagacacgactgagcaaattcactttcacttttcactttcatgcacggggagaaggaaatggcaacccactccagtgttcttgcctggagaatcccagggatggggggagcctggtgggctgctgtctatggggtcgcacagagtcggacatgactgagcgacttagcagcagcagcagaaacaggatttacagtgacccacacttaagcaacaagcaccacctactaattactgaatattaaagccagggctcataatctactgtcatccctttagaatgtgtcaaatccccaattcttctatggaggctgagaccataagcctggagtgggtccttcactcagcattttcaatgaggcaaaggtaaaatacgtaggtctttccatgggaggtttcttatgtgttgaggctggtcacagggaaatccctgttccaactaaatatcaaacaaataataattaaactagagccagaattccagtgcagaaggaacagagaaattgtacatgaatctgggctgtcatctgaggaaagcctaccttttgtcttacaagttatgggttttgttactattttttaaattatttatgtatttatctggctgcgtcgggtgtcagttacggcacttgagatcttcactgcggcatgtgcgagctttccttctggggcacaggctcttttgatgcgaggcacaggcacttccaggcggtgcgcgggcttctctagttgcagtgctcaggctcagtaattgcagcaggcagacttagtagctccacagcatggtgggatcttagttccctgaccagggatcaaacctgcatctcctccattggaaggcagattcttaaccactggaccaccaggggaagttagaccagaatccttggttcctgaggat

SEQ ID NO: 62879 - DNA, 1305 bp, Bovine  19866880396437
tctgtggaatggcaggatagatattttgtctttgataagtttccatagaggagaaaggtgcttgcctaaggaacaagcctttgaataacctctagttgctagactctcttttatgaagatgctattcataaaggacatcactgttgctttgcaaaactgccagagtgtaagtggtggatttctgcattgtatggtgttatagacttatctcttacattagtgattgagaagttcttcatctggaggcagaatatacttggcatgatgaatttgggcaaagatggcctattgtaattggtatgttcttagtgtttgttatgcttaaagcctagacatttttaagaaatacagcttaggttaaaaatataattcttgtagcaacacagttgtaatcttttttaaattgatatttttcgttaagaccttttccagttaggctataataatattgatactgttttgtttatattgtagattagcataggagtagggcactttgattctttgaaatctagaagggtgttttgatagcttctgaaaagactcacgtaatgtgtgacagtagggaaatgctgataaaaatttagtatgtcacctaacatactaacacctaacagtattcctcctgttcattttgaaactattctgaattgcactgattaaattggtctgagattttaagaggaatttttcaaaactcttaaaagatatgctgtataagggaataaaatcaggtgcaaatttacagaatcacttcattttaatgatggttgaaaaaatgtgacattgtttttcagatgattgctgaatgttttgtatttttaagttgcatctttcagttctcagtgttattctctttttccgtggtgctgtcttgtaattgcctccttgttaccaccccctccctcttcgtctgccatctgttggcttggctttttatttcactatagggaaggcaggaaagagttcttgtacacaagataaaactagtcctgtttggagcttagtgagctggagcatctatacaatatgtcttctgatgataaattccagaagtaccataagcccacgggaatagtagcaatggctctgcaatactgtctacaacttaaataaaaattaaaaaaaattataattagactattattttcatggaaaaccataaactggctggatattattaacaggcttgtaaataagaattaattacatagggagagtttagcatattgagtattcgtgaaattcttgtcaaatgatttcatactttataaacttgatttgttcatggtaaacttaaattca

SEQ ID NO: 62880 - DNA, 1165 bp, Bovine  19866880405509
tttgcagtctatgttcattttcagaaatttcaaaaagtaatttgttcagggcagcagttattagttttttgagtctgatttcttggcatgaatttgagaataggctttggtgtgaatcagatttaagaaattttgagttaatgtaacatagcataatttgtattaaaagttctttgacaactaaagcagcagcacttccccagtgtagatccttgacaaaaaggttttgaggtcaagcaaactgatatactatgtgtactttttcctttcttgatacgtaatatagtacgtgttaacacgtaaaagacctacagtaaggaacctgtttaatattaactcaacattttccaaatttatttgataactgaggcttccccttgttcccccatagcatcttgaagaactaatggaacaaattttccagaggaatcagattttgggaaatatgaattgggtttgaaaagagaataaataaaaatagctaatgatgatgagtgtgtgttacttcactacagtgatgtggggaaatttttgatagataataagatggaaggtatatatgtatatatgtgggtgattcatgttgctatatggcagaaacaatactgtaaagcaattatcctccaattaaaaataaataaataaaaatttaaaaaataatacattttttccagtgagaataaaagaaagaggcaaatgttgtttatcttagcccgtaagcattatacttttagagaagccatgttaggaaaggacttcagtcatatataacattacatgctaggcactgttttcagtcctttatatataatttgtaatttgttaatctttacaacaaacttatccagtaggtatactgttgttatcccagttttacagataaggaaattgaggcacagagagattaagcaaatagttcgaaggttacactgcagagttgttgatacagcagaaccagaatctaaacctaggcacctggctccagagtccttgtgcatagccactgctccatactgcaagatggtggcagatgggagatcatgaaatacaaattagattgagaggggatataaactctgcttgaaaggaccatacatattttctttaactttcaggcaatcagtgtctgagagaagaatgtggagagctgactgtgtcccagtga

SEQ ID NO: 62881 - DNA, 1161 bp, Bovine  19866880413144
aaagaagttggagagcctcagccgccagcccggcctgtgggatctctgaagccgccggctcaccagagacaccatgtaccggcttctgtcagccgtgatggccagagccgcgaccaccgggggctgcgcctggggctgtgggtggcgtgcggctcatcagcgcggcgggctgccgccactcggccccgggtgggtcgggggcctcggactggggctggggctggcacttggggttaagctggccggcgggctgaggggcgcatcccccgcgccacctgccgcggcccccgaccctgaggcgctgcctcaggccgagccgctgcaggcacaggaacagcccctcgccccgtggtctccgcagaccccggcgccgccgcaagccaggcacttcgccagagccatcgacagcagccgcgacctcctgcacaggatcaaggatgaggtgggcgcaccggacatcgtagttggagtctctgtagatggaaaagaagtctggtcagaaggtttaggttatgctgacgttgagaaccgtgtaccatgcaagccagagacagttatgagaattgccagtatcagcaaaagcctcaccatggttgctattgccaaactgtgggaagcagggaaactggatcttgatattccagtacaacattatgttcctgaattcccagaaaaagaatatgaaggtgaaaaggtgtctgtcacaacaagattattgatttcccatttaagaggaattcgtcattatgaaaaggacatgaaaaaggtgaaagaagagaaagcttataaagccttaaagatgatgaaagggatgatggaatctgaccaagaaaaagagttaaaagaaaaaggaggcaaaagtaacgaaaagaatgactttgctaaagctaaggtagagcaagataatgaaaccaaaggccgaaattcaaaaccttgcaagaaaaagaatgattttgaataaggtgaattatatttgaaagaaaaatttgaaaattcaattgaatctctaagattatttaaaaatgacccttgttcttcaacctggtagtcagttttttgtattcaacttttggctataccctactggcagccatagtagaaagagcttcaggatataaatatttggactatatgcagaaaatattccatgacttggatatg

SEQ ID NO: 62882 - DNA, 2031 bp, Bovine  19866880414174
tatgtatcacgtctgaagcagaatttttgattctttatgcaacagcagccccccacccccaccctcgccaccacattgccccatctcagccagtgatactggagttgcccttgattcctttcccacatcttaaacactgcagtatcagtaaatccacaaagctccacctccaaaacatctgatttcagctacttctcatcacatcccctggacaatcataatcatagtccaagttgcccttatttttggcttagactcttgcaatgtgcctaagcatgcatcccatttctactcctttccccaccataatcctcctttccccaccataatccattctccatacagtaactgaataatctcttaaaagagtgaattggatcatgtcactccctttattaaaccccttaatggtttccctttagtatttaggatgaaatctaatctccttatcatagcctgtaaggtctgggtcccttctccccttctctttccctagctcttacccctggttcattctgctgctgcagcactagccttctgtctgttcctcctgccacaagctcagctcagcctttccctttgctgttgtgtctgcctggactgctttccctcagggttttgcttgggcagatcctcctcactagtcacatctcagctcaattacaaataaaaacttaaatctgctctccattccacagtcacagagtatctgttgagctcttaaataccctgcacttttgctctttatcatatctccctattttacatacatcaaagaacttaccactacctgaaatttgtagatttcagtgtttattattccaccccacacccttactaaaattcaaagtctatatgaacagggtcattatctgagctgttctttggagcaggctcagtatttggggatcttctggcacataataatggagaaggcaatggcaccccattccagtactcttgcctggaaaatcccatggagggaggagccttgtaggctgcagtccatggggtcgctaagagtaggacacaactgagcaacttcacttaacttttcacttttgtgcattggaggaggaaatgtcaacccactccagtgttcttgcctggagaatcccggggacaggggagcctggtgggctgaagtctatggggtcgcacagagtcaaacacgactgaagcgacttagcagcagcaagaaaaacattcagcatttccctagatagaaagttaatccacagtaatttagaaaattaaattcttccattcttccaattggaaggttcagagggaaggtgtccgaccctcagcaaccccatggactgcagcccaccaggctcctctgtccatggaattttccaggtaggagtactggagtggggtgccattaccttctctgatggttatcactgttaggaaaaagttaaatttctgcaaaaggtaacttcctttatctaaaaatatggccactgcttaaaaaaacaatgacacagataaagggcatggaaactaattaactattattaaaaatcaataacacctagttctgattttgattattttatttagtttcctcctgataagtggacacaatttttaagatcagtatctggagagagagaaggaattcaaaatgtttaaaagacatttaaattaagatagtattttaatgtacaatataacttcttgcttatgaaatacatttaacctcaacattcaaattgaaagatatctagatggcatgtgtatgacagtaaaaaagccattatcagaaatattcagaagagtatttgaataaaaaataatttaataaaaattaaaaatttattttgaataaaaattattgttgaataataaatgaacaatgttcaattatttctgcttttattagtgtttttgctgttaataaaacacaggaaattttaaacaggggtacacttacctgtccctaggaagagcagtccatgctagactatgtgatgttccagcagagatctgttgaatagctatgccatctaagccacttacttt

SEQ ID NO: 62883 - DNA, 1153 bp, Bovine  19866880431405
aaaaaaagggataaaggaggcctcagtggttattatgaggatgaaacaagagctggagatccccacactcaggctacccccagcaggcgccagggccccaagatgatgatggtgaaggcccagaggtgctgaaacttctaggcagagtctgtgagcaggcagacagcatctcaccttgcctaaacccctccagggactgctgaaggcctcagttgctgcccctgggcccctggttggaccagcacttagccccgaaataaaatcccatttcatccccctgtaggaaaagccaggcttgcaaagccaccagcttcagtggaatgggagggcccactattagcctatgatacgcaggcttcctctgggtgattttctagtttacccaccattgctctgaacagtggagagaggctttttaaaggaaattaatttttcagccactactgaaaacaatgttgaaagcaagctcaggcttccagggagttaaatgtttgtttaaaatgaagccacttaaaccccatggatttgctttcatcatctctgataagccccagttcccagaggtcccatttgccctgggttggtggtttagtctggggaacaacaggatcctggtttctagcactcctctgaccaagcacaggtctgacctctccacacctcagcgttcttacctgtgtattgggatagcaagaaaatcttgctttgcagagttcttttaagaatcatgggactgtgtttgtaaagcaaacaaaggttattgtaagttcagttggaatgtcagtaacgtgcattcccttgaggctccttttcccacaaaagctcttttataatgagggttcagttccctttgatgcctagtaaacccccatgtaccaagactagtgatcacagcactgaagctgtgctgacagctgtgtccagcattgtttctagggctcgttaggccccgccccctgcaggggagctttgggtccctaagcccaggcccatctgagatgcttccagaaggcaggcactgactctccagcctgccttctaacagtcactgttcacagcaaaggcagtgggcagaacacagtgccctgcttaagtcttttctcagacttgcagataccagggggcactgtgtacttaattaactcaccaactc

SEQ ID NO: 62884 - DNA, 2464 bp, Bovine  19866880481120
tggccttgggcactgtcactcatgcccttaggaggtgggttaagagcactctggctgccaaaggagccaggtatgtgaggagctactgagtgtgggtttactgagatctcccttcactgaccttgactcccttgagcctttgaagagaagcacaagccagggactccaggcacatggagcagaatcctcattaagactaggtgtctcccacagatggaggagagagagatacgcgagtaggacccttttctgagatcaaacactgaacttcttacaggcattcttggcatcaaggcccatctttagccttgccaggtgattcgtggcactagcaccaccaaggtccagagtttctccttttagaaaatggacataacccatgtctgagcacaagcagctcatggtctaacgtcgcagggcccgttagacaagaaagcatcttcagaactgccttttgtctcatctccctgaagcttgcacaggcaccgagaatctatactgaacgagacataatagtttggtttcttcctgagctgcagaagctcagttattccctctaaatctgtaaccataactccccatatggacatttaacatcttgacttgttctgtatctacatgaagatggctgggggccccgggaagggggcaagaggcccacactcttcaaatctccaacttcactttctcactgaagactcttgagctacccccaacctgagactcttgagtggtcaggagaggggtcgctccatagaagttccactttataacattctcttttcctattctaaataaagcgggtagtagtcaagggttacacggaaatgcttcaattcttaaataaaataaaactcttcctagagataagggactctgccaacatagatcaggtagaattttgcttgtgattcaaggataacagtcagttctgttcttttgcactaagtctctacaagtcacagaggacagggtgacaggaacattctccccacccccacctcccagttaggagactcaggttcaaggtcataccttgtttcctcctggctgtatgatgtgggaaaataatgtcccttctttggccttggttccctcagctataaagtgacaggctggactaggtgagctaacatcctttccgtgctaacatgttctcagtggatactaacaactgcccatcctgactttacgtttcagggacagtgtgtgagggcagttacagaggatcagaagaaaccgtgcaggaacttgacatccagaagtaacccccacgtgtacaatgaacatggggataattagccatcttcttagaccggctcaggtctaagctggcgcctgtagagcaggaagtgcaatcaggctggtggcagagcgcttcagtagaccttcccaggcaggctgggggagcttgaggggccttgaagcagacgggctccagcttaggacattggagatcacagcccaaatgcagctttgccaccacctgtcctgcagagctcacctggagctattgctcccagaagtggggctgggctcattccttggagtgagaatccatggctgtccaaggcaaacctgttcatttggaggctgattatagaaacttggctagaattctcccctccctctcaagtcccaaagactcgggcagctaatggggctgttttcccaagaagcaaggctgagtcagccccaaagaatgaagaaccaaccctcatcctcccaggggcacctgccattcacaagagcctcctcacaccaatgtggagcaggtcaaagactgtaacgtgccctttgggttgatggggtaagcttgtctgtcagcaggaaccttgagtaatttggactcaaattgtctgcacgctctttcactgggacatgtctataattaggggctggtttaattcagggtcttctctgaaagttaacagaaactatgcagttggacaatgaaaactctggagttttctgccaggagaaaagtaatgtgaagaaaatcctttaataaacaaagtacatgaactttgagaggggggatctagggtttaaccaaactggaacgactgggactgaatcacgtaactgggccctgctttttccttaaccatgctggaaaaggaacacagaacttggtttctgtccttaagaggtacagagtctctgacagccctcaggtagggtttcttggtcttggtatgtcaatactgactttcggaactggataatcttgttgtggcggctgtcctatgcactgtatgatgttgcgcagcatccttgacctctacccattagataccagcagcatatccacctgtgacagccaaaatgtctctagacattgtcaagtgtctctggggaggaggggccaagttgcccctgattgagaaccactgccccaggcatttgtacaatgactttcccaggcccaagactttcccccactcggatcacagaattctag

SEQ ID NO: 62885 - DNA, 1008 bp, Bovine  19866880611077
cactggacagatcagaaaacatccaatatttaactaaaagataacttccaaaggaaccctataggttcaatatctaatcagctcaatgcccatgcttacgtgttttttactgcgtcatgaaaaacaacagtaatatttatgagtaccctcagaatcccataaaagtcaatatggaacaatgataaaggcattaccactttcaagtctttgaaaactgataatctggacagagtatatagttctttactaaccatactgtagcctctaaatgtactagatgttttcatggttgctataataaatttcagtgataaagtaagaagtgtattaaagatgacattaagattagcaatgttttggctaatattcaaatatatatcagaagttaacagtcatggataaactaacataaaaataaacatttccctcaaccagttttagattttaaccagataatttggtctaaaaaaggaaaagtgtcattatacaacatcacagattttttaacaatacaaaaactggaaaaataacttaaatggtatggtgtaataatggccaataagatatataactcaaatatgctactgataaactatatttcctagttgaaagaatattcaatttaagactcccctatagacaagagatctaaattactaaaaaaaatcagaattcttggcagtcaacacccaggattacatgataaaagaaaaacagccaatcaactgtataaaatgaagattcaaatgcaaggtactctcattatctatgtaatctacttaatcatatttctctgaaactatgtcaaatttctaaacctaagattgattgcaattggaaacatactacctacagagcctggaaaattttccatttatcttctgatacttagagaaccatgtgttgcttgctattaagaaccttcatctctccaatttttgagagtttgtcaggtcttgttttgacacatgaccttccagattttggctgtagagcactaggagacaa

SEQ ID NO: 62886 - DNA, 1198 bp, Bovine  19866880683550
cttttccagcattagtggttgggacatagacttggattactgtgatttgaatggtttgccttggaaacaaacctagatcattctgtcatttttgagattgcacccaagtactgcatcttggactcttgttgactattccatttattctaagggattcttgcccacagtaatagatataatagtcatctgaattaaatttgaccattcctgtccattttagtgaatgaatctgaatctgttgtagagggagctgggagagagttactgagagtggtacaaaattataggtctttactgccctattcccaaccccaagagagcccgctggcatactcacccagagccatggtgcaccaccacagcagcgaggtcgtacaggcagttctctgggccactgttctcgggctacagatcaggggagaaggtatcccaggactgagttaggagcagtggtcaatgacatcagcatctccctacctcaaatgacctccaccctctctctgtgaagatttaattttactaacaaatataattacgttacctctagtaaatagcatttcatgtactaggcctcgcaggggaaattctacatatgtatcaactttgtttcttaaatatgctgtccaatgaaatcttttcaaatgtaagcatagcacctggatgagagataaagacaaaaattgtaaacaagcagctaatttacctttcaatcaaaattaactacttgatggtactaatatctcttagataatattttaggcagtccatcagtttttcttttgattttgatattggtttcttccatgaatacctttttatgatactgtgatttataataatgtgtttagttttgtctcctttcctgacacaagatcctaaaagccttgaaatttcctcagtgaagagagcacacagagttatcttttgttatgttagtgaggtatgggggcttgttgccaagagaaccaatcaagaaattgagttaaaactttcagtcctacctccctgacccacaaaagggagagggattggaggctgaacgatcagcagtggccagtgatttaatcagttgtgtctgtgtaatgaagcccaaaggacgaggtttggagcgcttccaggttggggaaccagagctcttccacgtgccaccatgcaaggccccaaattccatgaggacagaaactccttgttcaggact

SEQ ID NO: 62887 - DNA, 794 bp, Bovine  19866880725880
tgcaactatagaaaagcccaggcagcaacaaaaactcagtgcagtcaaaaaaaaagattgtagctaaggtttatttcagccctagttactgactagtatattacattgataacaatctttttttttttttttttggttttcctcttttaagaactcattcttttctcaaaaggaaaatatacactttgtttttagttagttacaccacttaatgctgttacttagttttttttgtttttttgtttttttctttatagctttcatttacctccaaatgaatggaaaatgtgatacatgtcaaaacttggaaaaatttaaaggatcagttttgctacatttttggtgcaacatcattggaatgtagttgtaattttttccagtggtaattccagtgatttggcagtatggttttcccatagcattaatatgtagaatctgagattttttatcttcatctttcgaataaccacagtattcccttcaccgttaaatgaagcacacctgaccctgagttgtcaaagtacaaagaaattcctgggttgggactctagtggatgctgttataaaagtacaccatcagaaacagtggatagagcagaggaaatgcaactggtttcattgaggagcagtttggtttggttttgggggtgatcattagttaataatgggaaaaaagaactcttagaggcattctaaacttttctaactacaaggaattctggttcgtaggttttagaaaagagattttatgaagggaaaacatctgttcatgaaagcctttaaaatccacattt

SEQ ID NO: 62888 - DNA, 1371 bp, Bovine  19866880726343
agcaaaacatttgtgtttgccatctgctactcaagagtagttctgtagaaaaaagaatgcaaatcacttggttctttaattactttggagttaggctatactatagctgggactgtgggacagccaaagtcattgcttcaagaatactgttgtttacttagccaccaactcaaaggactctttttcaagcaaatggcatgaaaagaaattgaagcctaaaattatctttgtccttttaagtagagtcaaagaccattgtgaagtgatgtgtgaggctttttaaagttggcattaaggagacactatccagagcactggacactgaggtcagtatagaaacatcagttctcttagtcctgacaccaaaggaatatatgactcaatacttaaaaaaaaaaaaattcaaggatcttgaactcaatatcaaaaaaggtaatttactcttagtcacccaggagctaatgaccttgactttggactcagtgccacttgcttctccctctcccgttctcattagcttcttgaattgtgataattgtctgctcagtagtatctccactggcctatggatgtacaccattagttttgtttaatcaagagtaacttcaaacaacagagtttaaccaaactggaaaccctggagcttccaggttacttgtagatttccatgactgatcctttttctaatccttctcacagtaaaatttcattcactgtggtttttagcatatagaatgtgaaaaactggcaaatgaaagggaccttatttggccactgacttgctatgagatcctaaactcataggacctctgatttctaaggctattttctgctttaaattgctataaaatcagtgtgtttaagagatcatttattctaatgtttccaaagttcatacctcagaatactcagtgaatcagcagatgttagtaggtgaaactggaagagagagtttcatggtcaaactcgtttgagaaatgctatcaagtgtttggaaggtacagcctgtcggaacctttctaggctgatgcggcctctgactgcaccactgggtgtggcgggcagcttgccctgctgtgctgctccaggccactttttgaagaagtgtcttatgggacccatgggcttccctggtggctcagcagtcaagaatctgcctgtaatgcaggagatatgggtttgattcctgggtcagaaaggtcctctggagaaggaaatggctaccctttccagtattcttgcctgggcaatcccacggacagaggagcctgggaggctacagtccatagggttgcaaagagttggacacaactgagcaactaaacaacaacttacgagatctgtatgttttgcagaatataacttgggaaa

SEQ ID NO: 62889 - DNA, 1885 bp, Bovine  19866880738726
tcagctttgatgatttttgattgatttttctcctccttctgaattgtatttttctgcatttttgcatgcctggtactttttgttgggatgccaaacattgtgagttttactttgttggatgttgaatacttttgtatccatgtaaatattcttgagctttgttctggaatgcagttaagttacttggaaacagtattgtagaggagcaaaactctccacccaaaatgtctctttggcatgtgaactgttttgaagaaaaacaatcaaggcccaaaagactcaggaagaaattttgacccctccctgagctccctaaaaacttttagataaagggtctgtttctggattacagctatcaccagagatctctgcaaagatatgggctaggatggtggggaaaactctaggcagggcctaaagatcagtgttgcattgtttctgcatggcttttccaaacagttactttttcatcttcatgtcagttgcctacttcccctctgcagtctcaaaccactgctcccaacatcctcttttgtctttagctgaagatggtatttaaggagagggcttaggctatttttgtgaattactcagttttcctgggtctctcccatatatccatgttactaaactttcatttaatttttctcctcttaatctgtctcatgtgaatttaattcttagacaagccagaagaacctagaagagtggaggaaaatttcttcctctccaacagcttgttaatttcaggtcttatatttcaattttattaggccaggtcagagttgatttaatttagagttcatttttcccccaaggcaagaccgtccttggtgctctaatcagtgcctcctgaattgtgagattttctactctggctgtggggagcaggcattgttcttggcactatgagtgccgaaccctgttccctcaaatcctgttgggtgggttctttccttggtttcagcagaagtcttcccatgcctgggctggtcaatgctcagatgaatactcaggaaggaccctctgcagatcttcagaatcctccctgtgtgcagctctctcctctgctactctgccctatgaactgtaggtgccatggctgccctgcacccatttctgctcactcaacacagggagactcccaggctctgcttgggttccctgccatgtgtcacagatggaaagctttctccaggcaatgagttaagtaattgtagggctcacctcatgtgttcccattgtttccaatatttgtccatctttttcattgttttgaatgggaggataaattcaacctttgttataccatcatgaatagaaacagaagttctttaactgatgctagaagtccctctgcactgatgggaatgacagaagaccttcccacatggtggtccatggctataaatcctcaaagcaagtctatctgcttggggactcaagtacaaacccacctgacttgggcagtttttatagacaaatgttatagcatcttcaaactgacaatcaaacattgtgtctagaacaacagaaaagttgacatttaaaagacagacctactcctataagaccacactggtctttatctttccccaagaaaatagtgaggtgtaacctggaattgacattactcccaaaagccatcagtggtgaatccctaatagtataatatcccacacttgtagtatcttaatagtttagcccacaggttacttccttctgtaggccatctcttttcatcctattcttttggcagtggtcaaaaagaaccgtggatcttttactttgatattcgagaagccccaatcagacttattctctagagcctgctactcagtgtgaggtccatggagcagcagcagcacctacaagcttacaaata

SEQ ID NO: 62890 - DNA, 1843 bp, Bovine  19866880748006
ctttgaatagagagcgacttgagggtaagacacacagtgaggagggggccaggagtcagagtgacagcacagagaagcagagaggatgagctggaggtctcagaggcccagatcacaccgagaatcacagcgatcacccagctgcagcatgcacggccggccggccacatacccggactcagtcctgtgcagggagggtctggcacttcggaggggagaggaaaagattggaagttaaccgaggcaaaccatggcagatttgacccgtgtgttgactgacgcactccctttggttggttggaggtacggggctaatgcagcccgtctggggatgctccctcttggctcaggtgaagggaattgcccacccagggaactcacaccatgaaccctccccccatgctcctttatcatcgcagtctctgtactttggtaagacttcagcttttcgtccaatgtggccagcttgaaaggtgaggaaaggtaagaatcagagtctatctgggtaggctcttatctgcttccctggcacccgcctctcgtcctcagcaaagaactttctaggtgctggctggctcgggctggcagagcttggttagaacctgttaccagacttccacatctatccccatccagtgttattgtggttttgttctgttttcactttggttccactggacaaactggagaaatccatccaccataccagtctcccttccctggtatgtggaaccagaggactgtgtccacttccatgagttattgttggggatgaatggggtgagttagaggtcttcagtggggctgaaatagtgcctagcaatctaaggagaaagcttatagtcagcctgctaaggacctctcagggagggccatgggtgaatccattctcgcgggtaatacagaggagcctggtcacgaagcctccgggttaccccagctgcttgcaggctctcagaactgctcctcctcccagtcataccctccatctacagaaagtctgcttacacagacctgcttatccactggttttctgatctcagtagaaacttctagcttatatgtgtgtttggtgtggggggtgggtattccaagctggagttgtgcagatggtagccacccagccagacactccagagagcctgtgcccacggagcctactgaggtgacagagactcaaccaagtatgagatgccagcagagggccagggtccacctccccctggggcacttgataccccgaggaaccagacctaagactagagagcgaggttttactcaccccttctcctgccatctggccccttcaagtctggctgattctcctggagctatcagccccatcttctttccctactctcttctttgcctactatcttcttccacaatctcatactgagtctgtaacctcattggtccaagcctgggctctaggagcccttggtctggcttcctgggtggccccaggctgttgtaaggatgactggagcaggtatggttaggagccatccacaaagaacagggtggcctgttctcttggctcttgccagccaccactggcagcccacagcctcttgggtggcaaagaacgtggctcccctggcctgattccctgccctgaacacaaggaccagtctgtggcttggggagaccctcaggacatgagtctccccctggggagggcgtcaagtgtttgtacagaatatgctctgttctctgcatggcctgtggcctctgcacactgtaatttggtgttttgttttgtttaaggtacctaaaggtaaccaaggcctccaggatcttaaaaacaaccaccaccgaaaagaaccccaactggtcgtgg

SEQ ID NO: 62891 - DNA, 777 bp, Bovine  19866880753843
caaaatatcatgtggcatggtttctttttcatcaggatgttttggtcgtgaattgtacagcagaatggactgctgccaatcatgttttagcaacctgtaggacagcactgaaaccaacaaggtattctgggattaaacatggctccctgcatgagagcatttctggagcggctacccatgatgcttcaggagcagtatgcatatgaaaaggtaactgattacagtcactcttgcagatatacagatgactggtgctttggaatttgaactgtagctttgaatttatcccttaaaagtatgagatctgagtaaaataagtggggctatttgggcagaagcaaatgaaaaaaagtcatgcctacaattgttcagtaatcctaaacctgcttttactttattttagtgggagtaaaatttttaaataaccctcagatttgtatagtgcttctgtcattctttttcagattatttgttcattcaaaacctctttaaaccccctgtacttcagagtacatcatcttcccttttctaacccaaatatctatttctgtgtggctttgctatcccaaagttgggaggtggagtggatatgggcatcagagtaaatatcctgtccacttatcaggtgaatatttgtggaaagtttagtggaagagctaaggttgaactaaataagtagggtcattaaatactagaatgggaaatatggagtttggactttgtgcccaggtcatgatcctgtgtaacctgtcttccagccctcagtagtcacagcat

SEQ ID NO: 62892 - DNA, 1213 bp, Bovine  19866880761026
ttaagaaaaaactccgtaaaatatagccttttaagatgttatgctctgtggttatagagggcatcttcttttacttttcttaacaaaacatcctccaaagagaggaccagcatttcagttgcttgagtctatgacttatattaagcatgataataaggattttaccagctgaaactggattttatatatttaaactctcaaatccctgctaaacccaaatgctccctgcctcttttataagactggagcctgctaaagacatatgtaatgtgtacatatgtaattactatagaacatgtcacctaccacaacagcccatactttaatactttgaaaaggattgtatcctttttattcaaaactctgtttgaataagcagaattgtaaatacacctagaaattgctagacttgttctaggaactttgagctgtatacaggagggtgtttgttcctcctgctggacttttctgtgtgtgcacttgaggctccagaagacctcacatgcagttaaccagcctctctcggtccagcaagataccagtggaagacgcagctcctgagccagccagaacaggtagttgtaccctgtggcgagcagcatgtcgatctcggggttctgaaccttccccagtgaggcatgtggcactggggttcttccatatctgtgtgatcccttctgtgtgcagtactgccccacctctgcttgccctgactcacaccagagccctgcctggagagcaggcggctctgccatgtctgtaccgcgtgcaacccctcctaccagctcaggagcccttactgcattctcatcctgtggctctcgtggcccactgccatcaaccagcctgtcttgttcttcctgtccgaccttctgtgggaactccctgtctcattcgacttcagaaaccatttctttgtttaatcaatctgcaaatgaatctctgcccctccctgcagcatctttgatgcccattcttggcaccattccaggggctctgcagggatgcaggttttggcttctgtcactgggtgctagttcttcagtcccccgatcagttctcctggtgccttttgtgacttccccttgtggcgggctacagtctatagggtggcaaagaatcagacacgactgaagcgacttggcatgcatgcatgcttgcgctgcagttatcaaatgctctgacttctgcctccactgggacctaagcctta

SEQ ID NO: 62893 - DNA, 1250 bp, Bovine  19866880941519
cctagaagcctctgcctgacagcacaacatgtggtcaagatgacaagcctctggctaaccccagattacacgcataatgtgcttattatacgtataagtgtattgttgatgttttgaacaggcgacttcagcatcatttcagtgtatcactatcattaaggagggtttttaaaagtaagatcctttgtacttggggagagggggaagtaaatcaacactgtgctgcaagcagacctttttagctttcaaatgatgtcactgaagttcaactgaaattcactcaggaaagaggcagccccagtgcatgggtgctagggtttgagcagatctgaaaggcttgaagatgccttcctcgccacttgccccagacccagcattgccatcattagctgccctttttggtcatggtcccagaggaagagaagggacagcaggagttaggtttattagctcacttaacgttggagtcacaggggtagctttaaaaattagtgatgcctagacttaccacctaaaggttctgttataattggccttgggtgcatcctgggagctgggaatttttaaaagttctccacgttattctaatgtacagccatgattgagaatcactctctcctctcctcttgccccagtgctcaacccttactcccttccacctcccatgccagccctggttagtccaggaagccctgtggctcagcagacacccagaaacaaactacggggtgatattgttatcccattttacagatgaagaaactgagacccaaagaggccaagtgactttgcccaaggccacacagttaatggcagattggacctctctggcttcaaagtgattcccatttcttcaagctgccttgttaacttgggaacattaactcatgaagttattaatacaccaaaggatttcgtttatagtaataacagcccctcacatctttatggggggtgttagggtttgcaaagcacttccattttagtttatgatattaaagatgactcctgcattttaaggataagataactgaggccccaaatcattaacttgctcgtggacacacaggtagaggaaccagagtttgagtccaaatccttttcttctatttccaaagaatggactacattggaaaatggtaggagtggggtgaattttgggggtacagggaaggttggaaagtttcagagcaggacaagctctcaagttcaccaaagatgggaacccaggaggcagcaaaagagggtag

SEQ ID NO: 62894 - DNA, 1103 bp, Bovine  19866880947569
aatttttctttcaaatataattcaccttgttcaaaatcattctttttcttgcaaggttttgaatttcggcctttggtttcattatcttgctctaccttagctttcgcaaagtcattcttttcgttacttttgcctcctttttcttttaactctttttcttggtcagattccatcatctctttcatcatctttaaggctttataagctttctcttctttcacctttttcatgtccttttcataatgacgaattccacttaaatgggaaatcaataatcttgttgtgacagacacctaacagtaaaaacatgaaaattcaactacggtattaaactgcataataaaaagtcagtagccttgtaataatgttccagcaatattttccattttaaactgctgctatcatgtacgcatctttagcctcaaattttagaaaaatatccaatcagttattaccaggagaaaataaaactttaatccattaacaaaatttaaaaacaaatcaaagaatcttatgaaagcttttaaaacacttagacatcattagaaaaaggaactatgagcttcagtaccttttcaccttcatattctttttctgggaattcaggaacataatgttgtactggaatatcaagatccagtttccctgcttcccacagtttggcaatagcaaccatagtgaggcttttgctgatactggcaattctcataactgtctctggcttgcatggtacacggttctcaacgtcagcataacctaaacctttgggagaaaaaagcaaaaagtcataataggtctcatggtcaaaggagtcttcaaaaactgaaaataatactatcttaaaacattccatgtgcttatcaaaagaaaaagctattccgcttgcataactaatcaaaactgaacatataagggatgagtcttagcaatactgacaactgtaggcctaacaatttaaccttataacaagactgaaattgtaccttgtgcaaaacagtaatgttatgattcagttactaatgcttagcttatctaaacaatttgtttattccatattttaaataaattacattcttaaggaaaacatcatgttctcagattat

SEQ ID NO: 62895 - DNA, 1596 bp, Bovine  19866880952688
ggtggctcgtagtaaagaatcccctgcccgtgcaggagatacaggagacatgggttccatacctgagtcgggaacatcccctgaaggaagagatcacaacccactccagtattcttgcctggacaattctatggatagaagagcctggcgggctacacccatggggttgcaaagagttggatatgactgagcaactgagcacacatgcaatagtagcagtaatcaggcatgtgcttcattaacattaaacattaatttacatagaaatgtgcatatgtactaaaatcttttaaagggcatctccaacagagttctctgtgacttggagaaagaatatctctagaaaaagcactgcagggggcctctggcttatttcttaagttaacttttactgactctaaagtcaatagacaaaattgagtttttgaagtaaaagcatttaagtaacataagatcataatgaattcttgaatagctctaagttctcttccttcagatctaagtgtgaagagcacaacattggggatgggagggcttggttcctgttcagttctattacatcctgcctctgttgccttgtatcagctactagacctctttgtgattcagtttccctagttgtataagtggtgatgataatatctgcctcataggctctgtgtgaaaagagaaaatgaacgatccatgtaaagcacttataggagtgactagaacatagtccttagtgactggaattgctcctatcacccttctgttccttatcatcattttatgttgctgctgctgctgctgctaagtcgcttcagtcatgtccgactctgtgcgaccccatagatggcaccccaccaggctcccgccgtccctgggattctccaggcaagaagactggagtgggttgccatttccttctccagtgcatgaaagtgaaaagtgaaagtgaagtcgctcagttgtgtccgactctcagcgaccccatggactacagcctaccaggctcttccgtccatgggattttccaggcaagagtactggagtggggtgccattgccttctcctcgttttatgttactgctcccaaatttctaggttatggctacaatttagatttaaaattaaagatattcttttttatttctctagtactattgtggtattttttttattctatgaaactactttgtagcagcttcaacaaagagggaacttttaccacccagtgactcttgttgcatttctgctctgttgcaggctttgtggtgacccagctggtgacttcctgtggttctgatgggcactcaatggccctgactgaaagtggtgaggtctttagctggggagacggtgattatggcaaactcggccatgggaacagcgacaggcagcgacggcccaggcagatcgaggccttacagggagaagaagtggtgcaggtcaggcaggatatggagaagtttatctttgaatgtaaacatactgggtttagttctcaagattgggtaatgaaaaaacagtagtaaaaacatattaccccatcataaaagatccagtgtttttggtggttcacagtcatttttgagtgtctcaggggtttaaatg

SEQ ID NO: 62896 - DNA, 827 bp, Bovine  19866880958829
aatcaataatataaatgtcagccccagactaagttaaatagaagttctttaccaccaccaccaaaaaattagaatatttttcaacatttatctatccattatcccagggaaacattctgtcacaaaaaaaaaaaaaaattgctgcctagaaatttcagcatgatcttcacaaactctgaccaaaacaaagatctattatctaaaaaggaaaacctgagcatggtcagtaagaacaaagatttaaagaagtgaaatcaacaagtgtcctatcttacaattggttaaattaaacctgcaggaacatgacagttaatcaccagcctgctttgcctggtgatgagatagttcaagaacagtccatgaaattacgagtcttcaggacaggtcaaggataaattggcaagcagatttctaaaggctgccttaaacccagctagaacaaggaaaaaatatcaggagagaacatctactcaaaatggaaaacagcctgctgatagagttattcaatcctacagcagagtacaaagtcttcagataaaatccattcggttataatatcttttcaaagacgcaaactggttcatattcaaaataaactctcatttccctcctcaaaagggtcttagaaaatttaattagctagtggtgattaacggtgaagcatttagctaacacaaataccaagacaactacaaacttcacttttcaatgcacaggttttgtttcaacaaaagttttcaaaatttgaagttgccttcttaagcttacctgtatattatatatctgtaaaaaccaaacatatacctgtttttcagtatgtcttaaga

SEQ ID NO: 62897 - DNA, 873 bp, Bovine  19866881015091
tggggtcttccaaaatatgatgattgtgccttcgttaaactgtgtaacaaatgcattatattttgagtgtctgtgatttactttttttagattagtaacatttgatcagttcatataaaaagaaataactctaaagttgtgtggttataatcttagaataagtgtaagaagcaaaaggacttccctggtggtctagtgattaagactccatgcttccaatgcaggagactcaggtttaatccctgtttgaggaattaagatcccacatactgtgtgatgtggccaaaaaaattttaaaaaaatttttaaagagtaagaagcaagatactttctgcttagaataaataagtgcacagcagaagtgatcccctcttaccttcagtgttatctctgctcctgctgctaagttgcttcagtcgtgtccgactctgtgcgaccccatagacagcagcccaccaggctcccccgtccctgggattctccaggcaagaacactggagtgggttgtcatttccttctccaatgcatgaaagtgaaaagtgaaagtaaagttgctcagtcgtgtctgactctttagtgaccccatggactgcagcctaccaggcttcttcggtccatggaattttccaggcaagagtactggagtggggtgccattgccttctccgagtgttatctctattttaacgtaaatatcctgctagctttaattggtaccagttctcatcctatgaggtcaggtagaaagggtgtatcacctttaccataatcactaattcattaaaggttaacagtgaaaaaatgtaaacagtatttatttacatggtgagacaatggaagattttatttatttattttggttctctggatttta

SEQ ID NO: 62898 - DNA, 1618 bp, Bovine  19866881062009
acaggtcacttaaaccttataattcactgcttgctgctaacctaatttcttttaggttcaaaaaatctatttcaggctgatttgcaatgcatatttgatccttttaaataagctgataattttaaaatggtaatttaactaaatacaacagaaaactgaacaaagctagtatggggagataaacctacaaacctctaccatttcatccagtcaagtatcattaagtcatttgtaaagtgtgtcctctaatggaaacttaaaaggtaaaagtaacagttgatttgttaaatgtgttgttacctttctaaccaaccaaataataagagtaaaatggaaaacactataactgtaaaactcgaattagtctttagtcacaagattttctttcactgccttttttatacattactactaaaaattatgacaaaattttagcttgattatttcaataaaatgattttcaaagttttacaggggagaaaactggtatataccacttcaaattatcatcaccagtaaaggaatacaatgaattcatgtgacttctgagagacctgacgattaaatgtaacgtgcgatcctagattagatcctgcaccagaaagaaaaatgtttttccttgtgttataaaggacattattggggcaactgataaaatctgaatactgtgtgtagatttgatacaagcattatgttgatgttaatttcctgaatgcccttagttttagaaaatacatatttaagtatttatgggtaccacttaagtataaggggtagcatattaccaactgatttccaaatggctgagaaaaaaataacagagacagacagataaagcaaatgtagtaaaataactaacgtggggaatctggttgaagagtatatgaaaattctttgtaccagtttgtgtaacttttctataagtgtaagataatttctaaatttaaaaaataattaaaaataataaaaggtaaataaaagattaactaaaatataagggatgatggaagatcaaattatagatagccatgatgggtaaaattttagtttaattattcatgtgcttaaattattattgctaacttttatctaaggaacttggactacttcatgtatatatatatatatatatatatatatatatatacaaatatatatgaaaaataaaatacattttattttacttacattttaggtggaaaaagagacatgaagaaaagctcccaaaatgtggcaggttgattatggaatggagacaagcaaagcgtgactttaaattgataacatagtatgaagatgcaatatagctagacataccagaaggtaatcatttaccttgctctattgaaaatcactggctcattttcctcctgcacagttgtcagcatatccaagtcatggaatattttctgcatatagtccaaatatttatatcctgaagctctttctactatggctgccagtagggtatagccaaaagttgaatacaaaaactgactaccttgagacatcattgcaaagggggaaaaaaaaaaaagtgcttcattattattcaaaaacatgcaaaatatttttctactgaaaactggcatatttttaaaactagaatattttacta

SEQ ID NO: 62899 - DNA, 3051 bp, Bovine  19866881081854
atttgggcagaaggtctgtaaagcttgttataatcttaaactccacaggaatgttgtaaaaaccagacgtgggaaactgatctagatcagagcacaggctttcaacatctggattttaaacaactgttctgttaatagagacatagacattttcctggaaaaaatatttacacatcagtggacaaagctttagttaggaagcttaattagcaaataacgaagtttccagccagacagtccttggcaaatagtcttaagatgtacttacaaaaagaggggtcagtgaaaaacgtgatttttttacgaaaaatttcaaattcctcttggactgcatgtttgtttcaccagggaaaccgcacattaattaagaacagttgaacgttttctgtcaggaaatctctttattctcaagcagggttttatttttatttattttatttataattctttcagctgtaagcagtatatcttggctctatacgttttatttatctttaactttttactttgttttgagctgtagccagttaacaatgttgtgatagattaaggtgaagagcaaaggactcagccatatggatacacgtatccattctcccccaaaccacactgctatatttaaaatgaataaccagaacctactgtgtttggagaaggcgatggcaccccactccagtactcttgcctggaaaatcccatggatggaggagcctggtgggttgcagtccatggggtcgtgaaaagccggacacgactgagcgacttcactttcatgcattggaggaggaaatgacaacccactccaatgttcttgcctggagaatcccagggacgggggagcctggtaggctgccgtctatggggtcacacagagttggacacgactgaagcgacttagcagcagcagcagcaactgtgtatagcacatggaatcgtgctcagtgttatgtggcagcctgtacattttattattattattgccatgtgatatgtggggattttattccccaaccaagaatctaacctgctctccctgcattggaagctcagagtcctaaccactggatgaccaaggaagtcccttttttctttcctgcttttaaatcatttttgatcctgttcacttataacttttttcccctccaattttcagagctttcttctggttggtgtctctgctgttttcttccctcatttggttcacgacagcaacccttattggtaacaaagatgaaccaagagagaaatatctgctgatttttggagtgttaatctcagtccttatccaagaaatgttccgggttgcatattataaacttttaaagtaagtgtttggtttacctttttccccagtgttttttgaattattatttagtaatttgaaacattagtatgttgttgtatttgaaggtccgtgtcttcctacatagttccaagccaggggatggtacacttccagcctgaaaatattgagtattttgagttgtgggccctcattccttccttcactcattcaaaaaatatgtcttgagagtttgcttaatgccatgcactactctgggtactggggatacctcatgattaaaagacagtctcatggtggtggtaccttatagtggaaagagacaacaaatgaataaataagaaaatatatcatatattacaagataagtgccatagagaaaaataaggtagagcaagtcattgaaacaataagtacaaaaactgttccaaatcagaatttatatgtgcttctctttgacatcacctaaaatagataattcttatggcagttatgcttgccataattttgactgtattggggaaacaggtgttcattttgtgataatgtcatatgatttcatgtctgtaatagaaaaatacatttaaaaaaaaaaagtgggcgtgagttccctttctaggccaggaagcaggtcatctgtaggatccatgaggagctcacgtgaaaccactatttgaaagcagagcttgaacttggagcagtagtttccttccggcagtcatgagtttggctttgattacgtagtaatgcttagttagtaggctgataaatgtgctgttttttcatttctgcaaatgagttcattaaagcactttatgactttcaagggtgcaaccaagacagaaaggacctcaatagcatctcttgtaataggcttctgatcctttgttcctgccaaaatgccaaggcttctgtattttttacttgatgcttttaataacagatactgaaattttaataatgaagcaatttaaaccacgagtagaaaaccaggaagccattgcttagaagcaaaagtagtatcttagaaaaggtttaaaaatgaaagttccattagttcctggaaatattaaagagcaacagataaaaatcaaagataacatttcaggttccatgggaattacagtatccttaagagatggacattcagctatggttgaatatttctggcatgcagcagttaactgccattccaaaatttaatttttactgtagaatatgttaaggtaataaaaatctcccctctgtctcacctctaccatgcacaggcaaaagcagtctctcgcatggttgtcatcttatctctttcaagactgtgcattcctcattttctcacctggcccttagaagacacggatgtgacttccaaatcttttcctgtctctgttcttttatgtcagtggacacacccctttctggcagtgcccggggtttacctgtgcccaggacccagcacagtgccccgctgtggtcagagtgattcagaaagcagggcccttcccaccgttgacagggcacttttctcttaagccagcttctgattgtactggactttcttactctaacgtcatcgtcattggctcacattggttttgcgttttctgatttcagtagattttcatagataggtcctggctttagtaataaccctttaggtcttgagattctataacctcagttacctgaattggctgagtatctgctgttctttactgttgtgtttcttcagatttcctcctaaagcaaag

SEQ ID NO: 62900 - DNA, 1456 bp, Bovine  19866881088606
tttattttcatttcccaggggaaggactattaccctggtagttagcaagaagcctgagccctggagggtttctttgttaagtctgttcctcctcactgctagtttgtcaattagattgtaataattagtttttaatagtgtcattcttttccccagtgtaaacactgcatttagttctgtaattcgggcgataattacttgctatctttcaagtttccctatcaggttgcagggtttttacttactctagacgtgggtattcagagtcaatgtcctcaagggtttcctatcaggaagatcatagtctagattaccagcctcaaagacctacctggaggtatagtcagacaccaatttttccaacgtgggacattccagtggattaaataaattcttccctgctagaagaggggaggggaccagggcaagaggggtaggggagtaagggggtacaaattattaggtataagacaagttacaaagatattgtacaacaaggggactatagcctatattttataataattttaaatgaagtataacctttaaaaatggtgaatcactatattgtatacctgtaacatataatattgtacaataactatacatcaaaccagtcaatactaaaggaaatcaaccctgaatattcactggaaggactgaggctgaagctccaatactttggccacctgagttgacaaagagacaactcaatggaaaagaccctgattctgggaaagactgaaggcaggaggagaagggggtgacagaggataagatagttggatggcatcatcaattcagtggacatgagttttagcaaactctgggagatagtgaaggacagggaagcagggctacagtccacggggtcacaaagagttggacacgactgtgactaaacaataacaaatacatcaattttttaaaagtaccaaagggaagagagcccgagattttaaactgaactttaaaaaaaataagaaaaaaaaaaactaatttcctttgcttctaaaacacaaaaaattaaaaaaaaaaaaaaattccctactagaatgcaagcatgggtggccccaagacccagagtatctcctgctcatagtaggtgttcaatatacagatgctaaattgtggagagtcacgaggtcttcttgcagaatggatgtgcaccgggttgagatacgaacaatgtacagaataaagtggagtccctgccatgggactgctctggcccccctctccccacattacttcaaaagcaaaccgtctttaatccattttgagtttatttttgtgtatggtgttagaaaagtgttctagtttcattcttttacaagtggttgaccagttttcccagcaccacttgttaaagagattggcattgaaacatgtataatatcatgtatgaaacgagtttgccagtccaggttcaatgcacgatactggatgcctgggg

SEQ ID NO: 62901 - DNA, 2251 bp, Bovine  19866881098249
ctataactcttgccctgggataatcaacccttagtatcttgagctggaaacaggatgtcctgagatgtaagagggcagaaccatcacaccaaccccctaatggcctagtgaagcatcatggctgtcctggtaaagtgtatccttcagggagaatctcagcagtggtgatcatacacccctagcagagctcttccattcacaactgtcaagccaggctcagcctactgaattctgtctctgttcaacttgccccgtctctgttgcaggtgggctcctccaatccagcatatgacaagatcttcgatcaccttaaagatgtaaagtacaaaggtgaggattgtttactcaccttattgcttactcaccctctgctggagaacagcgtatttgctcttgggtgacctgaaaaagaatgcaggcaggggacaggtactgtctgtgaccaggtcctggaaccaggtagctcagaatggggctagttcattttcctaggctgttataggctcagctgtacctctgccttggggaggaaggtgacctcataccccaacatgtctctccaggccaagaagtgttcattccgggtttcagcatagaagagctgctgccagagaggcctgaagagtactaccgctatagggggtccctgactacacctccctgctaccccactgtgctctggacggtgttccggaaccctgtgcaaatttcccaggagcaggtaactgtcgtgctcttccttgtcgtagaccacgtggtacctcgaaccctgcaccgcctgtatcataatcgacgacctgactacctcactcaagagtttcattggcagctattcaaaacctctccagataccacaggggcctggaagtactttggaaatcacaagctgggcttcaaaagtggagctgtcaagtcaagaggggagaatgagtctatctccgcagttttttaaatatgagttgttaggctgtgtttcctaaccccagtggagagtttcacctcccaggcaggaaagcgcatggctccttacctggggtggaatagacaggatcaggttagatgatttaacaaacccagggggtggggagtgcagcgataaggaagtgagggtctctgccttcaagaagctcatgggagtgtgtgcctggtgagtcactctgactctttgtgacctcgtggactgtagcccaaccaggctcctctgtccacggaattcgccagacaagaatactggagtgggctgccatttcctcctccaggggatctccctgacacagggctcaaacccacgtcgcttatgtctccttcactggcaggcgggttctttaccactggcaccacctgggaaaccctcaagaagcttaggtagtgcaaaactggggaatggaatccatagcaatcatctctaactctctcatttcttaggtgatgaaagtgagggttagagagtcaaggagacattggggtcaccagcaaaggcccaaggtggagctgagttccaagtcactgctcgtgtctctgctccacagctcaaattcatcaggaagaagcatcgttgcccaggaggcggatctgcctgctggctcacccacccatgagcccagcacagctctcattgctgctcctccctttttactatggagtacctgagtaacctcgataaatgacagcaaataggcaaacaggaataaagacatgatgaatcaagagatgaaatgattggggaggcattaatgttctaacccagaaactgccttggaaacagttatgtaatctatgtgtgtgcatgaaaataccatgaaactagtggatgacctgtgaggttcttgcctgcctgtttctgttccttttgatgggaccatcagactaagccccaggcccctctaactagactgggctctgaatgaggctcaggagaggaatgcagtctctttgggaggtgggggagccccttgacatcccaggtttcgctccctgcagggcagattgcacgtgcaatcaggagctaacagtacacaccctcccgctggcccggggaagtgggaagacacatgggccagcactcagacacctgcaggggaggggcagctttctcccaccaccttctcaggggtctcccgccaggcctcagaggtgagatctggcagtccttgccttgaggtcaggcaagggggcatcactctgccttcagggggtgtttctgctctttgcctacagctgagaagttggagacagacctgtactgcacgca

SEQ ID NO: 62902 - DNA, 1284 bp, Bovine  19866881135738
ataagaatcattgtgtccttttcaactttcctttgtaaggggttctctatttttttcctcgagtcaaaggtgatgccagattatcactacagtatcttggctattctgatccccaatcagaatttcccctcccctgggtgaaagtgacattttctagcacaaaaaaatttccaagcaaaatggagttaagagtagaatgagtcacagctgaacatgaactgaaacagcaaacgtgctggtgaaatccctcccttaaaaactatctgtaaaaatgataaataaacacggtggccaatgcaacaacctgggtatcgagctgttgctgttttttgctgggaactagctcagcatgccctgcaccaaggatgactccatgccaactcagaaggcaggaccacaatgcaccatccaaggaagacaggactccacatgatgtggaacaatcaactagggtatttcatcttcagatctgatatataagagatgctatctcagttgctatgtggtgagactaaggaaaatgtgggtgcctggcaaaaaatccaccaaagctataagtggatttaaccggaagttaattttgaactctgccatactcacttttacttttaacaagctatatttaaaggaagtatttgctaaacacagtatcaagatccttcatataaataaaatttcaaactaagaatctctccaaagccttacacattctgtcctgtcaaatggccctcatcattaaagtatgacagggttaaataatcctgtccccaggagatactgggagtgaatgcaacctggagtggagcagtcataatacacagtaatctcccaagctcccagcacgtaaaggggcaagaatccactcaacttggctgaagtttcaggaacatctgtgaagcatttccccctaatcctagtgatttctctacttgtgatctagcaacaatattctatcatttgttcccctgtcagaaaagttaggccagaaaagccaaaagagattttaatgtaaaacacttaagccaatgagggtggagctgatcattcacttttatcctggccttttcggataagacacacgtctcaaacaaagtacagaaccctccccaaactattcctgctttaatcttctgatgttgcaagaactccaaagggtcactgtgcagtggttatctttcagcaaaaaatgaagaagttccttgggacgagttaagtactggctcttcaaagctaatcagaaccacatcaagcagcactgtttagcacactgcttatgatgttaag

SEQ ID NO: 62903 - DNA, 913 bp, Bovine  19866881154468
ttgagaacccctgctggatatcgctacaatttgcaaatggcccctgtgagtactccagccagtcctgctcagccagagaccagaacttgaaaacagaggcggggaagttacacctttctgtggatgaccctgcagctgtcacctgacggcacacatggggatgagatgaagggaagggaggcttgtaacgtgtgtgcattacccctccccaggcatcgtcctttccgtggccctggcctgtggtctcggcatctgtattgtcctggcggtatccatttggcttttaagaaggagaaagaggtgagctggtttgggtttgaaatgggagtgggtggctctgtgtccatgagaattgatctgtctgggaaggcagggtgcataatgaggagctgtgccacccgaaccagcttatccttggagtgccatctccaaaacaccactgatcgaggccttggcgtgagaggctgatgctggcggatcgcggtgctcagggctggaggtgtgtctgccagcgtggaccttggacaagcttcttgattttggtgcctgaacacaagcaccaaggctgcttctttctaagatcttttcatctggtttttcttctctaaacccaaaaagaaaattgaggaaaattttgatttctcattcacactaatgccctttgctcatgttcttattgcctaaaataacctaacttatttttcctggtatgaaaaaacataaaaggttgccagaaaccctatgggaatcagagatctgagcagcatggtaatgagaccttcatcaaaatgcaggtctagtatcatcaggtgttgaaagagaacagttgaaaaatgcacagtttccattttggttagcggttattggggggcatttgctcccaagaccaatggcacttagagaggtttccaag

SEQ ID NO: 62904 - DNA, 1298 bp, Bovine  19866881163284
aataggtgaggaaagagttaagtgtttgaatgttggaatggcaaatgactgtcacaatgctacctgtcaggcctgttgataccttattaaccttggcttccaggtcagaatcacctggggaacatttaaaattaccagtgtggggacttccctagtggtccagtggataagactgctctcccaatgcagggggtccaggttcgattcctggtcagggaactagatcccatgttgcataccacaactaagatccagcacagccaaaataaataaatattaaaataaaaataaacatgggtgtacctgtggctgattcttgttgatgtatgacagaaaaccacaaaattctgtaaagcaattgtccttcagttaaaaaatttaaaataaaataaaaaataaaactactagtgtgcagatcccacccttgaacagttaagtcagaatctcaaaatttggggaaaagagcaggtctaaccattatttttattaagttcttcaggtaattctaaagtgcggccaggtctaaaagcccctttcgctatttacatttattaacgtgtatgtaaaatacttgctaactgtataaaataaatctacagactttcctttttctgccttcagatagatggtttttgttttgttcattcttctttagccagttgcagattctaaagaaataaatggaaggaggtggaagaaaacagaaagaggtctcatggccttctttgagaaggggcatgaggggtgggtaggaagctttgtttattgcatttcaggaagtagaaaatatggcatggtctcaatctatcttaaattacgtaactttgaggggatgtgatccatttgtgtcaaaataaagaggcatataatactttgcatttaacatgtgtgggaattctttgcagagtaattagcattcctttctttagcctgtattcaggggacacataccgttcacaccctctctgtgttcacattttccagtgcgttggagagctttttttcaatagaaatctttgtccttttcccaataagacttgaattatatttgaagacattgagcatgtctttctttctttttctggcaggcattgattttaaaatcagaacgatagaactagatggaaagaaaattaagcttcagatatggtaagtaaaaaaaaaaaatatatatatatatatatatatagcatttctactttagtcaggtactaaagcaggaatgagaaggtgaattgtggtaaattagaggtatccttgggagctaaaacatcttttctttatcagaaccaaggggg

SEQ ID NO: 62905 - DNA, 1023 bp, Bovine  19866881281667
atgactcggcagtgggatgggtcagccagacaagctggtgggatcttaatctgtgtgcacagaagggtgatgtctagaaaaggggcatgtgtgtccgcctgtggcaccctgggagccctgcccctggagtagcatcacccagtaaaagacttggagacaaagtcagcaagttcaggaaaggaagggaagcgggccaccacagatgagctgcagcgtggctggagtggctctgcctccctgtgctgtcggcagagctgcggtgggtgtgcagagcatgaaggccaccccccaccccacccgccatgctctggtcttgtctgcacaccagccaagtggaagagtgccagaccacccaccaccaggagtcatctgccaggtgggccgccccactcacctcggcggcgaagtgctccccgccgacagtgtgctccgagccgtgggggtcgttcttgtccccccagtgcaggtgcagctgcgaggcattgtagcgggccccgaggccccggacctgcatgtccttgggcagtttcaccttcactgcagggagaggaggggcagtcttcagagccctggccagctgggtgctgcctgagagcaggttggcaacaactgctaagggcccagacaggggcagggggatgcagcgatgggggaaccagagaggtgcggctcggaaacctgggctctttctctgagaacgtcccctcttccactaaagcaattccagtggcggcagcaccttcgtggttccccttggaaaatgatggcaggaactaatctagccaacagatggatgtttgtttacatatccatgtattacacacttggccatgaagatggaacctacagtaaaatatctgccaagctgagaattatataacaacaacagcaataataattgctatttatgaagcttctttctattctggatcttaacatacagaatctctagtctttacagtagctatcagtatgcccattttccagatgaaacctcaagagtttaaaattcttatccagagt

SEQ ID NO: 62906 - DNA, 954 bp, Bovine  19866881349377
tttcagattgtctcctggcttcccccacccagtcccataggaagcaatcaaatacatacacagcagaaccagggcaggaggagacagagtttaattatgaatccaagtcttttgtggaaaggaaactaattatatcgaaatctcagcattgcttctccacatggggccaatggtttgttatacttgtacatttgttgttggtctcagctagactgtagagtgctaggaactgctgctttaattgtgagcttccttcctttgacaaattaaatttaaactttacgttagcctctcctttcctttttttccagagtgaaattggctctgctctgggttttgtttgtaaagctgtgtttggcagttttcctcagattcacagtgacattgtagaccagtctaacacctgatttgtttgctgactctgggtctctagaacgctgttgttgagccaaaaagcggaaaggtccaagcagcaaagctagttatacaaagtccatttgctaaaatgctgcacttgcctcattggggagggagcccctggatccaaacttagcatttgcattcttgctttaaagcagggctgggggcctcctagaggtgggccatcagcatctgagaggaagaagtggcaacgtggcagtggcattctttatgtgacttggggcaagtcagcagccagcctcccaggcttccttttttctccataagcaaacagggaatgttgtgctagattcactctatagtcccttccaaaactctgatcctaagtggtgacgacgagctcactcaccacttttattcacaaaatggtaaaaacagatgtgaaaactgaagatgacattgtataggtaaaaaagaacttgggacttttgagacagagactcaaattcaaatccagactctgctaattcctggtgagagctttgagtgaattatttaaccattttccttatt

SEQ ID NO: 62907 - DNA, 1640 bp, Bovine  19866881359422
tgttttgtctaagcggtttaactgcccaattgtatgcccatcctccctgtgacccttctgctgcaggccctctggagctggctaacgccctggcagcctgctgcctctcctcgaggctgtcctcgcagcacaggcagtgggctgctcagcagctcgtgcgcactcttgccgcacatgaccgcgacaaccagactgctccacagacgcttgctgatatgggaggagatctcagaaaatgctcctttatcaagttggaggcgcatcagaacagagtgtgtattttaagccccaagtgtgttgatcaccttatgtaagataaaatagtttctgctgttctccaggagcttaaagtttagatcatggggtgtgtatatgtgtgtctctctttctctgtttctctctctctcttacgcacgtacatgtgtgtgctaaattatcagtatttgctagttaccgactctcctttctctacatgtgtatgttgcatgctgtataatcggatacaaatgggaacatcagatggggaatgagaagaaaaccaaaggaataacctcacgaaagataagagcttatatatgcaagaggagaagaagttgaccctactgttttaatctaacccacttaggcccctgagcagtgacaagggaactttaggaaatgaagactgacctctactttcccaatttaaaaatcattttttagtcttataatttgttttatagaacatattgaatacttctattttgttggattaaaaaacattttttaattaaacaaacatgtttaattaagattgtaacaagtctaagataattcaaatgagtttgggcatagtattttaaaggtatatctcatataggtgtatatttacaagccaattagaaagaattagaccatgcatactgttttataacatggatacttttacaatttcatggtagatttaattttcatttgatagaactctttcaaattacagaatcatttgagttaaaacttgctcacatattgctggactttttatctttactaggtaatgacttgtgtttggtgtaataaaaaaggactgttggctacaagtggcaatgatggcaccatccgggtttggaatgtcaccaagaagcagtattcactgcaacagacctgtgtgttcaacagattgtgagtaatggcgttagttcccttgggtaacatttaaaaataggagaatcctaaacatgcttcatcttggttgtgttagtataatcaaattgtcactaaagttttttacaattttttatttcagaacagtttccaatgtgttgttttggttttttgcaagatagtatttaattaattaattaatttttggctgcactgggtcttcattgctgggcatgggctttctctagttgtggtgagtagcgggtacactctagttgcagtgcacgagcttctcattgggtgacttctctcgttgcggagcacaggctctaggcacaggggcttcagtagttgcgttgcacaaacttagttgcctctcagcatgtagaatcttcccagaccagggatcgaatccctgtcccctgcattggcagatggtctctcaaccactggaccaccaagtcctgctagaaagtaacttagaagataaaaatatt

SEQ ID NO: 62908 - DNA, 1449 bp, Bovine  19866881367329
tagctgggcctaagactgagggcctggcgggtggcagcttcttcctcggaaacccctgtgctgtttgccttcacctgctcccagcagctcttcctgccaacccttccagagtcctgacaccttttccctgctcacttagcacttgacaatggccttgctccccagctcctcgcaccactgcctggcagctccccagcactgaccattgtatgactgacctagggtttgtgttagaaggtcagcctttgggcctcgtgtgtgggccgagctcaagaaattcatctctgagttagagagaacatcagtgatgtgaactgatgggtcagcggtggtggaaagagcagggacagacctggagtcacgttgtggctcagctcctagctgtctgatcataacttcctagaatttctgttttctccactgttcatggagattataaaacacacccacacaggctcgaattcacagggttactgtgaagagtaaacactgacacatactactaagcccctggctgtgtgctgacacatggcagattctcaaaaagtgctcacttccttcctttcctccttccagctatgtctcttccaagtccaaaaggctacgagcctttgaaacacacattcccatgttaaactataacttgggaaggttaccaaactgctagaaagtggatcttcccagaggaacaaggatctcaggtgacagagacaacctctgtgtccccacagatcaggagagggtgctgaaggtgacagagctcacacatcacacctgagcacagagatgaaggcagggtcactccacagagaattaacaagtaagcgaaagctggggagacctgggaatgaccgtgaggaaagagagaaagagagggcagtgacccgagagtggaggagactgcacaccactgagagcaaagggctcagccagggactctctgtgcccctacagcctcacacagactcccaagaagacagggaagaaggggggaggcacttgcttaagtttccttttcagacccaggaaatggggagatttgagagattcctaactgaactgaatggcagggtcagggttgggtgagccagagtcaactcactgttctcccacagggcagtggttctgagagccgtccctggacaagggtggcctcagcatcacctgggtttgccagaaatgctgatcagcagcgcccgcctcacacacttcaatatatttgctgctatttagttgctaggtcacctccaactctgcaacctcatggactgtagcccaccagactcctctgtccatgggatttcccaggcaagaacactggagtggataaccatttccttctccaggggatctttccaactcagggatcaaacccacatctgcttcagcaggtgaggtctttaccactgatgggaagcccacatcaatatacagacccagccgtctgta

SEQ ID NO: 62909 - DNA, 1597 bp, Bovine  19866881471853
cacaaatggcagtggtgctgccctggaaaacggaacgggaggcgccctcagtgatgccgagagaaggccaactgtttcagacatcaaagggcaaaggcctgtatttgaaactctagcatcaagccaggttggaatcaatccttttcagtccaatgaatatttcaaattctctttctactctctgtataagtgtctggatatttttagaaggctgtttctgatcctaggactgttctaaatggaaacttaataggaaatcagctttaataagtactatggagtacatgatgtaaaaaccaggaaggtccttaaaagaaataagtttaagacttcatgcctttattattgttgttatttagtgactaagtcgtgtctgactcttttgtgaacccatggactgtagactaccaggatcctctatccatgggattctccaggcaagaatattggagtgggttgccatttccttcttcagggattgttcctgacccaggaatcaaacccgaacgtcctgtattagcaggtgtattctttaccactgagccacttgggaagccctcacaccttcagaagactactaaagctactacaaagaggaaaaaatataactaaggaacaaaacttaccagaacttcagacccacagaatctgcagtggggacctttaccagaaggaagcaaggatctctgagaccctatgcaaaagggtaacaaggtacgcgaggaggccttgagaacaaatgctcactaaggcactggagcatggtggtaatcctgatggaaggcaggcactgacagactcgccgaggcattagtcacatcgagagtcgtcagtaccagtggcaaacactttgtgaaatattccaaatacaagacatacgtttagaaaagttcataagggggtaacactaatgttaagagttgtaatcagtgactagacctcaaccaattcttgtatttgaataaattttaattacttacatttacttttagtaacttgctgttcagtgatgagttttccaaaagttttcttttcctatgcctgtcagctgtgaaagctgagctattaaaacacaaacagacagacaatcaaaaagacattcctacatacacaccacccgcaggacagacagcaaaggtggccatgctaagctttgagggtacagccctggttgactgagtagccaggccagggagggacccatgaggctgctgtggcccaccagtacttcaagtaccaaggagttccacttcccctggaaatgcccactgctcctccagcagggtgggactagaatctgccacctctgggcacttcccagagaagctggccaggtagatgtggtctctgagacggtccctctcctccaccactctgtctaccgatggtgaatctccaaacaagagaatacacacaccacagaaaaaagggaaaccctggtccgacatgattattctgacatttaacatcaactctcaaatactctatttctttcttaattttggtaaaggtatcctcttttgttcgtatgttgtaacagatgatcacataatctgagactgtagaatgataaatacattagaggtacacaggcata

SEQ ID NO: 62910 - DNA, 1499 bp, Bovine  19866881489931
ctggtgatccaactaaactgcactctggaggaacagtgggactaagggaaagggagtgagagcaaatccatttaaaccaatagcccatgctacagttggtaatggaggtttcaactaataaaaaatattgttatggggccaacaaagagtaactgaccctgtccacaatcattaggaaatgagttattccaaatcaatgaatgctccagataaactgatgctcacttctttagtttttactttccacaattaggatgaaaattcaaaatgtattaatacttcatacttaacctactttgaaaaaatatacatgccacacagaaattaacatcctgtgggaaaatattagaacccaggtctttttcccttgacttttaaaactagggctattgctatcatactatcttgaacttttggtgggaaatttaagttaacatgtacgtaaatacagagaaacatacgaaggttaagttttagtaacagatgttaagtagaaggtatatacaaaaatacatgtgaaataaagaggttctcaaaacaactaccttcatacacactgtcctgcttgccaataagatctggagcttgtcctttgtacctgcaccaaacacaaagaacattgtgttttcatataaaacaattattactccaaagcgcaaattatgtcattaggacattttaaaggtcattaataaagcaacacaaaataaaaaagtaagtttcatgttatggaaagtgaaagtgttagttgctcagtcatgtccgactctttacaacctcatagactgtagcccaccaggctcctctgtccatgggattctccaggcaagaatactggagtgggttgccatttcctcctccaggagatcttcccaactgagggatcgaaactgggtctcctgtgtctcctgcattggcaggtgggttctttaccactaggcgccacctgggaagtcccttcatgttacgggctaatgtaataaaaaccactggtatgtaggtgtttacaaaatcagtgactattttatcaaataactgtggaggtttctgagtgaccaacataaatctttttttccccccaatttatttattaatgagcaaaaaccttattcattagctattaattgctatttaggaatataaagaagtaatattttcatggaagctcatttaatctaaatagtctatttttttaatcaagaaaaaagatcttaatcaagatgtcaaaaatatggtgaaaaaaaaacaaaggaaaaagaggaacataagcctcctgaaggttaaagcaaaggtcccactcacaatttgttaacaaatttaagattaatatagtcaaactccagtgaaggacctgagaccataccactgttcccagactatagactgccacctctggcaggaacttgaattcttccacttccctcatccctgtatctaaattcagcaatcacaggactttataaaggaaaaaagtaaaggaaatgaagtcgctcagtcgt

SEQ ID NO: 62911 - DNA, 839 bp, Bovine  19866881491531
aacctgagcagcagccgtcactctccttaaagcaaccacccggtcatgaggatttgctaaggcagctgcctgttcacccaatgttattctcccagaggaactcttttctacagagccatggcaacctgaaaaacataagattttgctcagttttcaagaaggtaagggaaaaaatagccaaactactgaaaaattttccctaggtagctaggttctaggcttctaggaaataaagcaaatcaatgtattttgctcatccataaaactgttatatagaagatggtttgagagaaacagatatttctaagtcaataatttattataggaaaaatatgattcttaaattttttggttttatttttgctcatgtatcacttccactgatattaacatatagaaaaaatatagttttaaaaatatgctttgagtacatattcacccaaattaaaaaatactacaaaatagtttttgtttccaggtttctcttaacacaaagttaaaaaaaaaaaactttgcattttataaattctttttatcatttgaatattttataaaaacaaaagaatcagaagttagtattacattataccttcaaaacattaaacacctggctaaagatagttgatgggatagaaaatattgaactcattattattaacctctgccttattatttacttttctaataagcaaattaatacagactctataaaatccatgccaatcagcattccaagtttacctatttgcatcagagtctcttccatactggttgggttgctgttaccattgctactgatgctcctaatggatcactgtcagggaactgaactggttctg

SEQ ID NO: 62912 - DNA, 1212 bp, Bovine  19866881554366
gggtaaatgaccctatacacagattccaagggcaagagtccacaccctttgtaatactatcattgtacacacaaaatgcccagattctatctttctagtgacttgtagctagtgattgtgcaataacttaaaaactacagcatctccaactttttttttttttgaaagtacacttttatcagaatattttatttcaagagttaacacttttttcaaaaagtaaaaatatagttacttccctgagtataaagaactcatcctccaataaaagacaattacaaaagtaagcaattagaggtacataattctctgcattcagttatactctattacaaatttattctttaaaattgcatgtattttgggacttcaatgtttcaaaacaaaacaaaaaccaacaaacaaaaacaaaaccataacagcttgttttgcacctgtgatgttaaggtacgtctgatctgtctttatcaaattccagagcaatctttaaaacagtgctgttgaggccaacagactgcatgttacatatgatagaaacaactattcctcttggggggaccttgatatttagcgcttctgcgtccagttcttcaggaaggaccagcaggacactactggcacccactgcgcctccagtgtgtgaggcataatgccgctgcttcctgcaagaaccgtatgtctgcttcttttccaccacgccccaggccattgcatatttaccctctttatcccaagacatctctgtgttagggactggtgtccaaatcatcagcattgtttccggtttaagatatccaggtaaaagattttcatttgcgttcttaaacagcccgacttggtaaccatatagcatcgcattcccaaatttcagaaggtcacccactgtagacagaaatccaccaccagcccatttataggagttatccacgtaaggtgtgttgacaaggcgtttctttttattgtaaacataaaatctaaaatgaaataagaatagtcattaaaaatgtgatagtctagtattgactccatacatgaagatgaatagaaaaatgtatacatgagacagactgtatttcattgtagtgaatatattttctcagaaagtaaccactacttttcagtatgattcaaataaaatgaaacacaagctactgagtaaagtatagaaagctgattgttttttctattgcaagccttgcccatgctgagtgt

SEQ ID NO: 62913 - DNA, 773 bp, Bovine  19866881578818
agtgtctgcttccttttacatagtagctttgaaaaatactttttattctgagggagtacaatctttcttgtgtgaattttttttttttaaatgattgaaattctgttttgtggagggttgcaggaaagtgagcatcctgaaaaagtttagacctggagggaagcagtaaagggggggtgaatctcatgtatgatgttgggctttgcatttactatggagtagatgtggtaaaaagaggctctgagctgtgtcttcagttgacatggaggaggggaaatcccatgcctcttttttagccccaagagctctgacaggaagtggtagccaagaggcttcaaacagcacaaaaaatacgttacctgcaacctaatgctttggagttgaagttaagttaggaaaataaggtgaatgttaacatcattctagtgaaatgttccacacacattgaccacaaacataggcttgaagtgtctgcatctctagcagaaatatccatgcccccaaccttcacccccgtttccaggtggtctgaagttgctgaaggaagcattggtggtccacctcctcccagtcacaattatttcttgaggcatctcagcatggaagtttccagggcttctctgactgggtttggaaagatttgccacatgattgctgacaaaatttgataaggtctacgtcacagtaaaaatctatttcttaatacctggggtttgtgtgtgtgtgttgtgtgtttcaggagttatatatatataaatatctctttcttccca

SEQ ID NO: 62914 - DNA, 1793 bp, Bovine  19866881647694
cgattgcaggggatggggcttgatccttggtcagggaactaagatcccacgtgtttgtggcagtgtccccctgcccctgcaaaaggtaaaagttagaatttttcctatttctgagggataattgaaacaaatgtagtctgtttgaagagtagggaactagattacaagtacaacaacagaaaaaagatgcaatagcatcagtgaaggagaaccaggtttgtatcttattattttccgtcaggctgacccttatgagaaagttgtccttccctcttcccaactttatactgaaatataaaatttccaagaatgaattataaattgttttaatttcaatgtttgttaaaaataaaattaattgcaggatggatataggaaatcagttggagccaagtgtgtttatcagttgcgaggacacatcacccctgtacggaccgttgcctttagttctgatgggttggccctggtgtctggtggattaggtggccttatgaacatttggtctttaagggtaagagtatagatgttattttcatcttcagaaatgtttatatattaatttacatacattaaaagttaacccaaccaatcttaggagtattttgtgtaataatatcttgaatattgaagaaacccttttcagaattctctgccctttaatttttcttagtgatgtatttttaaagttcttctaaaaaggtcctagagaattggatagtaatatgcagtttgacattgccgaatttagctaaatgtaggttttagaataagtttttgtgaatgtgaagtatacatttaaaatgtaagtaatggctaaccagttaaggagtgtgtattgatcaatacatttcattttaagatggctctgtcttgcaaactgttgtgattggctctggagctattcagaccacagtatggattccagatgttggggtggctgcttgctcaaatagatcaaaggtaattttataattaaatcaaatcataagttgttaacctctaaggtatctttgaaatcgtagtccaaggatcccactttaagaggagaaaactgatatccagagggatttttacttgcccaagataatgcaactatctagtggcagaaggaaaactagaacctagtactcttctatacactgtactttggggaaaatgcttaattattgaatgactttccactggaagttataaagagaactttttactttctgccatgatttttgaaataggactaaattatcttaaaataattttccctaaaaagaaggaccacctcataaacctttcactcaagtattcagaatagatcttggctttcaaatttaatgttctagtaaaaaatactagccctcttctgtgaaataattttgtgatgacattatctcttacagtccatggggttgcaaagagtcggacatgactaagtgacttcactttcacttcatatcttacaatattgcttttcatacccctaatgagtagtgccaatatcctgctttggtttacattttatgtggttaagtaatattaaaatagagctataaacctgcatgaacagtcctactagatgtaaaatatagaatcggaccataggtagtagtggcctgcatagaataaaccatagagccatagggcagtgctgcttctcctgtagatgtgtgtcagtcagcagagtactgcttcctctagtatccctttgatcatgtcagactgttgaaatatcctggatgattttcctataagtcctagaaatagcaaataattaatgtctctttaagaagaatcagcta

SEQ ID NO: 62915 - DNA, 1106 bp, Bovine  19866881696949
ctgtttctttatgaccccctggcctgtggcacaagacctaaaagggggtttctgcggtctgggccaaggctgagagacacggagggaagacagagccgccagagccctgttggacctgggcaccctgtgcatgaatgaaggccagatgtatgggacaggcaagtgtgtggatctggcatctggcagataatttcccttttcttttttaggaaatcaaaagctactccagaaaagattgagtttaggggaatgcaacagggtgaggtaattttaaatcttcacaatcagctcatctaagagcaggaagtagggccagctctgggaagatttaactctgcaaatggccccagtcccacctggcctcccactgccctgctggcgctcaaccctcacccagaggccagtgagacatttcctgtggacaaaggagcatggcaggtgatgggccacagggtcgcaaagagtcggagatgactgaagcaacttggcacacacacacgcacacacgcaaggtatcatctctcagcccagagactacagccccagacacagggttcgctcctgggatttctctatctgttgatccgagattctcagctgggagaaaaaacaggcctaaaactcaccaacaaattctggtgtcccaaaaatgttcttaaattcaactccgtcttctatttcatgagccaggccaaagtcaatcagcttgatgtgtggaatgggaatattcttgtccaacaacataatgttttctggctgggaaacaaaaaaaaaaagaagaagaaaagaggataaaagaaaagatggtaattaaagccctattttatgtttttgctttgggtttaagggggggtttagtgttcttttttaggaccaaaacagcacaaaccctttcttactcttgtgtccctcagtcctctcccgtgaacccaagaacagccacaacgctgagggcaaggcctgggttttaccaaagctgctgctgacagcagaaccaggactgtggctttaatccttctgtttctgatggggagatccctgccatgtagtgcccttttgtctccccatctgtcaaatggggccagggaggatacttgcagcatttc

SEQ ID NO: 62916 - DNA, 839 bp, Bovine  19866881712394
tttttttttttagattaagaactgggaacacaaactttattcaaaaagtaaagacattactaaaacatatacttcagctatatatttatgacttgctaatggatggaggggaagagaaagaggaaactagtaggaaaaaggttgaaaacagaaactattgatgagaggtcaccaactgtgtttccgatttttgaaatgtgaattaaccattgtttatagttcttcaactgttccaataccaaagcctattaaggtctccttaaaatgggaccctcttagcagaccaccaagggacaatttttctttggggtgcagcaacagtgaaccaaacaatgtcgggatgacgtcaactggagcacgagatgaaaagttctataagcccgtgccagatgaaattccctacactatcccagtcctcagtttaggtctttttgtatgtacctacctactttccttccacagagattctgtggctcatttcttctgatatggccttcatctccttccaaaataaggttatcagcaaatgaaaaggctagtggaaaaggcaaatgaaatctaagatccggagtcaggaaaaccagtgagattgacattaaaatgcagagcactgaaatatttataggtgcatttgtgaaatattaatgcagcatctggcaaacacagggacagggaaccttcagactctttgaagactgccttttaactgagcacagctctcagaaatgtcactagaaatgttccatctgcctcagggcacgctgtggtctcttgaagtatcaattggtcagtgaagccttcttcagaatgcacccagcacactcaattccctgggccag

SEQ ID NO: 62917 - DNA, 2346 bp, Bovine  19866880705310
atattgattatgtatctttataaggtaaccacttctcaggttactttattgagtaatggtaagcctgttctccactttagtaccatcaacaagaaatcaagccttgggcttttcccctctatttctacattaataatttttttttaattgtaccatagaaagcttggcctattattttgcatttgacagatggatttccctattcactattaaattcacttctaaaggtttaagtcttttttttctttattattttgactttttaataattcctatgtttctatcctctcttatgttattaccactttgggtaacatatatacattttagcatagaagtactacgtgaaaaagtttcaaaaatctttataattacaagcaaatgatattaagaaaatcaagaaatggagctgttcgcttcctttcattttaatattaaaactgtccttagaagatgtttttaatgtcaaggctaataaattaaaatttgagatatttttttacatgtagactcatatctgcttctgtgtgcctttggaaggatacacttaaaaaatgttcttgtatatttcatgcattcctatgttatcaggatcattgtcctcagttaaatggtggaattatttacccagaaatgctgttatttaagataacattatactttaatcaaactctacctattttatactttcctacaatacatagatgttgttcatattgtatttctataggaaaagaaaactcgcaatgactaatgtaaatattttatattactttagaaataataaaaatccttggtacatacatagtattaaagaatatagacaaattaatatgtgttcaatactccttagtacttgccttttaaaactaattcttaaaaagtcaccttagaacattagttcttaaatcaatctgaattttgatgcatgagaatgtgcttttttatcttattgtatttttagttgcagaataattagataatattaaagctgagaagaatcactaacattacatagcccagtcttctaaattgcaaataagacaattgaagttcaaaaatcagaacagccttctcaaagtcataagaaattgatgatatcatccaagtcaaatattgttttatatatatttcaatgatttttcctttctttttttttttaactgtttaaagctttttttgtgtatacaaatgaattttataatagtgtaaacaccttgaaagcagaatacatatatgattcattttctggtaatgaaagcacataactggttaaatcaaattttgtgtctgatctaaatgttgtatctgtgttaatatagatttaatgtgaaatttttttctccacaaagggtatttgggtccctgaaggagaaacagtgaagattcctgtggctattaagattcttaatgaaacaactggtcccaaagccaatgtggaatttatggatgtaagtacagacaccaggcgatcacatttttatccattattgactacttttaaaattaaaaaaaaaaagactccaacttcaaactgtcttctcttgtaatggcataatgttataactaaagacttgaacaaggatcaaaaaacttttgcttaaaagaccagagaataaatattacagcttattcctgcaatgtgatctttgtggcaactactcagctctctccttttggtaaattatcagccataaacaattaaaaaaaatagtgcaggaatgagtatgactgtgttccagtaaaactttatttacacgagcaagctgaaggccaggtttggcctgcagaccaaatcctgctctcaagggccgtgtgtttaagcactgtgccaaactgcatttgagagtagtgatgatgatttgaaaaattaaccagactgttttgttttattgttgttatcatctgtttagttgaaaacatcaatcaagattagtttcgatagttgccattaaatttaaattaggaacctagtaactcagataattgctcattgaaacttagttttttcaattcaactctgaagacaagacctcataggtaaaatgctccaactatagaatagctcactggtagctcagctggtaaagaatctgtctgcaatatgggagatcctggttccattcctgggtcagaaagatctgctggagaagagatagtctacccactctagtactcttgggcttccctggtggctcagacagtaaagaatccgcctgtaatgaaagaggcttaggttcgattcctcagttgggaagatcccctggagaaggaaacagctacccactccagtattctttccatgagaatccccatggacagaggagcctggcaggcccagtctga

SEQ ID NO: 62918 - DNA, 1871 bp, Bovine  19866880787621
ttcatggaatagaaagaactttatagggatatcaaaaagtaattaaaaagtggccccgacaagctgtaaatgttaattctgaggatgtaaaagtgtcctcttctaaaataaaaatcacacagattagcatataaattgctttaagcatgcatttataaatcttataaattttgaataatattagcttgtaaacaatataaactataagacagtttaattcataaatttatctgccttaatcttgaatttatatttgagagataaaatacgagtgcccccactcagaagactcaactcagtgaggcaacaacatacacagtaaattttggaaggatactgttatcttttttaaagatattcaatatgttctcctttacgttgtccaactaagtctcacttgtaaaataaactatatcagaaaggcataatacatttattctaggacagaacaatcctagttaatcaatagccacccagtaagagaatgactttcaggaaatcacagcacctttcttaaccctaaaatagtaacatctgatcttatcttgtgtgcatgccaagtcgcttcagtcatgtctgactctttgtgactgcagccttccaggttcctctgtccatggggattctccaggcaagaatactggagagagttgccatgccctcctccaggagatcttccccacctggggactgaacccgcatctcacatctcctgcattggcaagtgggttctttaccacaagcgatggtaaagacttgatgtatgtgagtcagactaggaggaaagggaggatcagaaagtgaaagggagagctgccagactcacaaagcagtcggtgtccttcgggtcccgaacagcccccagcacattctcggtgacagcaatcactcacgtagggtccatagcatctgccatcacactgttccgcacacacggtccttgtcactgcagaagacagagatagtgcctcatcaaagtcagcttccaaggtgatttggagtagctgagaaaagctgagccctggagtaagtaacaatttgctcaaccatcactgactcagctcagcaaacatttactgcttgaagttggcaattgatcaaaattactatacaaaatccttcaaaattaatacatgaatttgtttttagattcattctttttcaagcaaagacagtgctttacaaaaatcacacaattaggaagaaagaatcaaatttagaaaaactgaatgagaggcattctggcaggttgctaaaaatggagtcagcagcaaagtctatttacaatgtgcaccgtgagggcctacagcagaaagtgtctccagaaaggggtgcttgatttttgctagccaatgcaaagaatgaaaacataaactcttacatgattcacattataccttatatcattcctatcagatagacagatgatgggtgataaatggataggtaacagacaaataggtaggtaggtagatagataaacagacagacaaagataggtagataacgcctctgtagtagcacaaacatttctattcctgagatttaagtgaaatttctaccaaaatttctcaaaaagagggacttaacaaggagtagagcaacatccttgaagaaacaggaaggagggcagaagacacattcatagtaaacacaacaaaaacttccgttagtttttcttataacattcttcagtcttagttgacagcatcatgctgtcaaggtttactttagtaaatcaagctatatacactggacaacaaaatcatagcattaagggacacatttctgcttatcatacttattccaaagagatattttaaaagtatatagagaaatgaattatacaacatatgtgtaacacatcattt

SEQ ID NO: 62919 - DNA, 925 bp, Bovine  19866880803050
gctttggaaggcaagctaatgtgaactcaagctatattttacatatcatcataaattagatgtatggttattaataagcactaatttattctgtttcctcaaaacattttcttaatcaattgttgttttagcaagtactttatcacaaacatgacaattccctgatgatagtctacgagatgcataatcagaacgagactcactgatgatatattattcactaagatgacactttccaggaagaatctattaaaaaccaatctagaaaattcagtaagctttaatttatggctataaaacttcatgtgtcctcataattgctttactaatatattttatacagtgtttcgcacagattacttggcaacaaagggacataagccagagagatcaaacaagtttaccttccagacagtatacaaaacaataacttacaccaagtccttggtctggcattcttgaacattctctactaaatgccaaagtggaatcagtggaccattccataaaaataatgaaatgagaattctgaagctcactcagcactttgcttatcgtgataagggaaccatgaaaaaaaattcagtgaaaaacttctaagtgaaagttaagagctattgttcatttttattgttagtactagtttggaattgctaacacaacccctgttcagtatctttcagatcaagcttatatctcatgtctggtgagaggtaagggaaagagtctcagttcaaggtctgctgagcatcttctgtacatttccctctccttcctttttctccctactcatttctataatacatactttgtttcactataaaattaggacagacaaattaagtttttgtgacattaagagaagtaataaattactgtgtttctatatcatgagaggtataatctatggtttgcttgagcagaa

SEQ ID NO: 62920 - DNA, 726 bp, Bovine  19866880861710
ttagcactcaatgatcttccctctatgctgcctagattatttctgtttattgatcaaatttcgacaaactgtgtccatgaaacacactgtgtccattaaataaatgttgaataattttagtgctaggctgtttttggttacaaacttggaggtttgaataagaaaaatgctcaggttaatgcagaggtgatttaggttgaacgtgaagaagaatttattgactattagagtgataaaaacactgtaaggagactctgaatgggcttcctgagtctttgtcagtatttaagggaaatctcttttgaatgcttcagacctccacttaattaaagacagcagacttgatgaaatgctctctagaggtaccttctagttggattgtaatccaatatttattgtattggaattcaatatttattcctatgaatggtgaaattgtgcccccgccaccaagctgaacactctgggttgtgtaacatgcttctcagttcagttcagttgtgaccctatgacagcagcacgcaaggcctccctgtccatcaacaactccgaatttagtcaaactcatgtcatttgagtccgtgatgccatccaatcatctcatcctctgtcatccccttatcctcctgccttcaatctttctcagcataatggtcttttcaaatgagtcagttctttacatcaggtggccaaagtaaaaagcttcaattatcagactagactttt

SEQ ID NO: 62921 - DNA, 734 bp, Bovine  19866881078745
ctgagaagagaatctggttaatgtagatatggatttttttctttaataatattggtttcttttgcatgtaaatgaaatggtttcaggcaaagtataaagtcgtcttgctattatttcaatattgcttgaattgacttaggttcaattttttttctttgtttatgttttatctggtggctctaaatctctattcagaatatctgtggactcataacatcttgtaagcaattgcttcaggaaaaaaaactgggtttccccataattagaaatgtgttttatttaggaattgggcatttatatacgttaaaaaagtaggtatattgttaaacattgttattagattctccaaagtgtgtaattgtgattttggtcacaataaacctccccttagaacattaaaaaaaaaaaaaaaaatcctttctatgctaaaaacattgattaaagtgtggtgcaatgaccaaaaaatctttataaggagggtttgtttgtcttttctctgacttttctgtagagtattctaaaggagaaacagcttcaccctatcattttttaatctttgggttacttccaagatactatgggcccaggatttagaaaaaactgaatatctgtagttttttcaagttaaatgttaatgaagaaatctgctttcttcatgttctacttattgatcttctagtacagatttggaagttcataaattatgaaaacattttagtacttttgaaatttgt

SEQ ID NO: 62922 - DNA, 1649 bp, Bovine  19866881453537
caggggagcagcttattttttctagtttcccttgaagcaaagtgtctttgtgactatttcagtatcctcaaactatgtgcttatgtgtaaaccagtgaggtggcattagctcttccaagctgaatttgaatttgaatggcagaatattactttaccttttgagaatacgccacttcacagagtgacttaagctgatttcttgacctgcagggaattgcagcagcatctgcaaattgatgtcctcttggcagaaaatgatgtggtttgctttacttcttcggtattccctattagccagcctttaatctggcagaaaatctctttacggaatctcatactttcctgccaaatctaaagcacccaagatgattctccacaagtgtgcgtgtgcttgtacgtgtgtgtgtgcatgtgtgtgggcattcacaatggtgaagaggatttttggacagaaggaggatagagcatgtgaacctgctctcaattctaaatttattcaccttctagaggaaaaaaagaaaaggaaaagtccttattaaaataggtttgctgtcttttaaagaaatagttgctgagattcgttagatgcagtgacactatttcttttatagttcagtgcttttctcctttctgtaatgtctttgttattcaactgttatcaatatcaaaggtattctaattattattcattttaacaatgcatcctttgaaaagttaaaaaaaatgtgtacccatctttgaattgtcctacatcggttacattaggtaatatgctaacctatgatagaattactttcacaaaatgtacttgcatttttattaatatgcgtatcactaaattccttttttttcatcatcactgcttttgcttatattttgttgaaggagtaatacaaggtagcatttatcaaagagagatccttactttaagttgattgtcacaacaaagaaacataaagtctctgtgaaagacttttatcaagtggaatctcaaaggtataattgcttgttttttcttatatctttagtttccagcaaaatttggaagaatttctgcactgtacacaatgtatatgtgataccagcttcatgaaggtgtcgatagaagttattaaaaaatgttaaacagaaacattttagtgggtataaattcaattccataaagcattcttgcagaaatgatttctcttaaaatcaacatatataaagatcaacagaattttacatgagagtatcacatattgactagattgcctcagggataaacatgtatgtgtgtaccttttgattagcaacatgcacttgattgagtttttggccagtaaagttgcttacccttgggtgcagtttggatggcacgggtggcactctcgatcttgatcagcatacttgaaaatgaaactgtttgccccctgtaagccatctggacatttttccacacagttcgggccatccttgaaatgggagcactttgtacagttgtcaggtccctaaaaagtgtgaggggaaaaaaaacaaaatgaagaaagaaaaatgggtgccttttcttctggaatgtattcatctagtttagctactgagacctcagtggatggcgaaatgtcctctaggaagagcattttcagaagtacaaaaggggatgctgctag

SEQ ID NO: 62923 - DNA, 827 bp, Bovine  19866881522927
aaaaatattaatgcatatagaaaattatatatgaaacctgattctaatattactaaaaaccttaaatggaatttttaaaagatgccctataaaaataaatatcctagttcatgtctcaaaacaaaattaaattgacatttttcatgaatataagtgatagtaaagaaactaatctttgccctataaatttaggttacaaatcctcttttaaaatttctatcttggtaattttacatatgcataccatttctatgttttaaattcctgttaatcgcttgaaaatatagagagggatcactaatggaggagagatacaaattgcaagaataaaaattcactggactgtgacttcctagtggtcaggagctgtgtcttatttatttctgaacttagctataactggatctgatacacagtaggtgttcagtatagcaaagttgaagaatgaatgaaatgggaaatgttgcttaaataaaagtcctctagtcaaggcaagaagagacaatgttataacctttttctctaggaatattagtgagactcccctgataatagctaaatggatcacaaatttttaaaatatctaaagaacttattagagttaatacatttaatgtattatacctttagagtagtaaaagtgcttttaaggtattacatagataattttattttcaggcaatcattaaacaatattcagaattagaattttccttctgaaaaatgtgatttgaaagactattttcattaacttggtttctgcattatctagctgacataatattggcatatattaacaaaagaagctgttttccaaagtagagacg

SEQ ID NO: 62924 - DNA, 1717 bp, Bovine  19866880390054
gtgtgctttcataaattattcatacattatattttatttaccttgaattttagaagtttctactatttggggaaatgtgtcagaatttgtggaacggcagctatccttacacaaggtaagatttatactttaattttaacataggacatcaaagaatgtttcctccttagtctccaattgttttgctgggagaaagatagcagattttagagccatccagtgtaacctgcagtcttgtgattttatgatgctcacacgtaggacttgtggttggtagatttaacagacacggatttcacccttaggtaacgatgtgaaagttgtgctgttccagtgataggaagtgtattgctgatcagtccaggtgtgtacagaggaagtagatgaattctgttcatctgtgatctggtagttcctggcgtggctatagaaggatatgatgcttcttgtcttgcctccttgcagggaatggattctaactgaaatgtatgaaggcagtcagggactgaactctacttgccaaaaatgagaacctttgtccagggctggcctatttctcccccatcaagtcttgagtttggatgccacagaactgaacagagatgttgggagtttggagggtgctgggatattgtgaaacgtttatatcctactcagagggcccaatatgagaacctttgatctgaattcatccatgaaatctatttgtttgatctgataatttgaattagtcatcagaatttaaaattgggagtttgtacaaatttttttttccttgaaaaatcagctgattaacaaaatcagtttttgttcagtacatgtgacgcttggctgaagctgacaagggtctctcccctttagatggggcatgcactcctgggccatcaaattctctggctctgtaccttcacttccttgcatcctttcttggctcctatagcattagactttgtaacctttgatgtatgatgtttccaggaagacagagctctagagtgagagccaaaatcttttgcttctgcgcattaaccaagatcaccacactagggcacgtatctttgatgttttgggtcgtctgattttaagtgagggacaataaacctaccataaagaatgagagggacttccttggtgttccagtggttaatcctccatgctcccaatgccaggagcttgggtttgatccctatttagggttctagatcccacatgccataactaaaagatcccatacaccgcagcgaagatcaagacactgtgtgccacaactgagatctggtgcagacaagtaaataaataaacgtttttttttttttttaaaagagagaatgaggaagcagaaaatctctcccctgatggcaagggattaaaatttaaaatgccacacaatttcagtcagttcagttcagtcgctcagtcgtgtctgactctctgccccaccacggaccacagcacgccaggcttccctgtccatcaccaactctcggagcttgctcaaactcatgcccattgagttggtgacgtggccaaagtattagagtttcagcctcagcatcagtccttccaatgaacagtcaggactgatttcctttaggatggactggttggatctccttgcagtccaagggactcttaagggtcttttccaacatcacagttcaaaagcatcaattctttggcactcagctttctttatagtccaactctcacatccata

SEQ ID NO: 62925 - DNA, 1003 bp, Bovine  19866880442268
aattctatgaagatgtcaggagcccagaaagccacatcacgtataaaatgatgaagtcttttctctaaaactgaaaagtgaaaaacaacttcctgtacttttctttggggaactgagatgtatcagttgcccattttatttacactttggtccatttttaaagcagtgaatatttctaaaggtcataattacagttaaaatcaaaattctgagtattcagctattcatttacttgcatggcccgagagacaaaaatgaaagtacacttcatatttcaagtgtcaggagcataacagtggtcccctagggtgcttaccatttagacatttaccaattgatctaggatacccatatgaaatagttcatttacagattttctgaggaaaattcagaggtttgcatagcgctgactatatatctttccctttgagggtgctggatgatagccagtccacaattcaagtccactcttctttaccctgacacgatttataatgcatatcaaacattttagaaacccatttgagggtggtagtttgttttgtagaaatagtccatcagtagggaggtccagggcttccctggtagtccagtggttaggaatctgcctcacaatgcaggggacacaagttcgatccttggctggggaggatcccacaggctgcggagctattgggcccgtgtgccacaaccactgagcttgcgctctcgagccctggaccagaactactgaagcccgtgtgcctgagccggtgctctgcaacgagaagacactgcagcgagaagcccaacacaccgccacgagagagcagcccccagccaagaaaagccagcaaccaagaccaatgcagccaaaaataaacagaaagagaaaaaaggatttaaaaaaatagagaggtccatctcccatcagcgatatcaaatctaaacttctgagtccccttccaaggccatcattacttccctgttactggtaccacaaggcaaggacactctgactgta

SEQ ID NO: 62926 - DNA, 827 bp, Bovine  19866880452912
ccccccaaaacttcatgagctatgcaggtgctggattgagtggtgctaatgggtagaagtcagggtaatagcagaattaagagtataaaatataaagtgatcagctggtaagaatgatagaaagatagctgggaaaggtactgtgtctcttgagggaacatgatgaaataagaaaggcacaggggagggatatgcattatctcttattaggagttgccaagagtgtaactgagatgaatacttagaaagagatgactaacacattcttgatttgcagttgaagttactgtattttggaagcattcagtatattaccacatgcatatctctttcacataagtcatttattaaatgcctgaattcttactaagggtaaattcttgcttgaggtagacggatacaaaattcaataaagcatggtttcttccctcaaaataggaaagaaatctacaaatccagtgaacaaatacataaacaattataaaacaataccagtgtcatagaaaaggcttaaagtgaaaagaacagcatcctgaccaatttcacgagacaatttaagtccataactctacattaccaagttagcggttggtgttttaggatctcatattttataagattatcagcttgaatacaagcctgaatgccttaaggaaaaattaataattttcaaatgtcaaaggatgagaaagaaattagaggttgtaaaagaaggaatgaatagaataggaaaaaattgacctcagggcttggcatagctgggaggcagcatgcagttcttggtcttctggcaagcagggaatgagggccctttgggggagttaagt

SEQ ID NO: 62927 - DNA, 1374 bp, Bovine  19866880487978
acccaggaatcgaacctgggtctcctgcgtagcagattctttatggactgagctatgagggagcactcagcaaatatttctgaaacgcatgagacatttctcactgcaggaagaccaggttgctgctgctgctgctaagttgcttcagtcgtgtccgactctgtgcgaccccagagacggcagcccaccaggctcccccgtccctgggattctccaggcaagaacactggagtgggttgccatttccttctccaatgcatgaaagtgaaaagtgaaagtgaagtcactcagttgtgtctgactctttagcgaccccatagactgcagcctaccaggctcctccgtccatgagattttccaggcaagagtactggagtggggtgccattgccttctccgggaaaactaggtagatcctcttattttccctctttccctcccccactctcccccacaattaccacactgctttgcacataaatgacattcagtaaattccttctgattgactttaaaatgttcaaagaagccatatgatgttcttttcagagaaaagtggatctgcaagcatctgatttcacacggcctgagcgatgatgaacagctgctatttatgaagcagaagagacaaaaaatgttgaatgaatgagaaatagacttcaattgaaatggtaaggatttaatttagcttttgaaattcatttcctgatatgaagcttacaaaatactaaaaggcaacacaaaggagactgtgaaaaaatttcattctttataaatagattatctttgaacgtttcccaaaatagatcaagtacttatttgaaggttaacgggtatttctgacctgagttctcaacagtctgatatgagacagatttttttttttaaataaagtttttcataggggataattttacaggaaagttggaaagtttttctcattaacatcttacattaccatggtacacttaccaaaattaagaaattggaacatgtaattgttaaaaaaaacttcaaactttatttgaatttcctgcttctccagttatctcctctttctgacccaagtgagacagccttctgatattcttcagtggtgtgtaaaagactgtgtgttctagacatcaagctctgtaagtagaaatacacatgtctagagttgcctcgggtccttcatcttgaggcagaagtattttccgatcaaccagacttgattaggatccttagctctatcacttggaagagctgtgtgcttgtgggcaacttgtttaattacactgaaccatgctttccacagggtttctctggtggttcagagggaaagaatctgcctgcaatttaggagacccaggtttgatccctaagtgggaagatc

SEQ ID NO: 62928 - DNA, 1399 bp, Bovine  19866880488139
tactttttccatgccacacaaacaacagaaccacttggatgtaaatgttttcctgggccttccaccgtgttgaacttctctgcccagacccagatatttttctcccatcttgcacatatacaccctacatttgagtggtttaattcctctatctttctaagcatgtttttgttcaaattatgaatgccactttgctttaattccatattgtatgtgtgctcagtcactcagttatgtccgactccttgaggccccacaggctgtagactgccaggctcctctgcccatggaatttttcaggcaagaatactggagtgcgttgccatttcctcctccaggggatcttcccaattcagggactgaacccacatctcttgcgtctcctgcattggcaggtggagtcttgaccacaaacaccacctgggaagtccaattccatattccagggctctgattttccatcaagattggtatattaagacttactttgtcagataagaaaaagcggtaatctaaaatgcaaagccatatatatacacatttgatttcacttacgcaggaataaatgtgacttggaatgccaggctattttctacacccagaaagtagtttggctctttcactaactgtcagaggaaaccgttctatagtctacaaggtaacctgaagtcccagacacctccagaaagcgcccacaagcttgatcactccctcctcctgtgctccggctttgcacccgtacttcttctgctgcattattatgcatttatttttatgcccaattcccctgctggcccagaagtttctgaaggacagcagttgtgatattcatattaagtgtttgctattatgaacacagtgcaatgttagaaaaagcaagtcaaagtttgccttgtagcaacggtcaattgtgataaacttatagtttccccatggccattttgtgagtgtctctttcaactattaaagaactgtcatcttaaaaaaaaataactttttacagatccagatgtttaaaaaaatatttctagctacataatgactctcacctgggtatcttgagatccacaagtctgcagttgaatagctgatcaataagcaccaaattttcttcttccagctcatgaatagcattttccagttcttccacttccttcctgtgatttgcaatctattctcaggaaaaggagaatggatgttagttttccacaagaaatttaactttaaaaaatgttgatggagaggaagatctatcttgtattatttattactgtgtttgctctaagaaggaagggatgggacggacttcattccaagtcattttaggcagaacttggtttcctggttaggcagttattagtgaatggcaagaatttcctttcctactcttcaggaacat

SEQ ID NO: 62929 - DNA, 2418 bp, Bovine  19866880514205
tttggtaggtgccagtggtcgggggcaagggtggtgagaagggagaatggggagttagtgtttaatggggacagagtttcagctcaggaagctgaaaaatttgggagatggattatggtgagaattctacaataatgtacaattgtggtacattaagtggtgcttagtgccactgaacggtacagctaaacatggttaaaataatatgttttatattatgtgacttttatcacaataaaaaaaaaaactgaatgcaacacaaagaaggaagagctatgaaattagggtttggagagagagattaaatagcaagaatgagcattacgatagttattttggtacctggcttcagttatatctgaagtcagtccacctctatactcttcagttttgtgattcaataaaatactttttttccccttaaaaaaaaaaagtcagagccaggcagacacccatggaggccacactcaactcccatggcagcgaagaaagttctggttcatctggttcatctactctgctttgagtagagcctcaacctgaagttacagttgtagaatgacttagtgccagcgggaacttggcagcaacctagcagagagaacacagcgggcttggagctggggacactggtccctcctgggaagaccgcatgctctaatcatcgccaccctgttgcttccaccagattcgttttgtgaacataggcagttcacttaacctttccgggcctcaaaaactcctttggaggaagccaaaccaagtgatttctaagacctgcgtagtttttaattcagcatctccttagcccagtcataattgcaactcacatggtaaatgcttttaaacggcctgccgcgcacagcactgtaaacatcactggggagatgcacgtcaataggaccctttcctcaaagaacttatgttgtgcagtagacatcattgtaagtcaactatatttcaataaaatatagagagagatcattattatcaccactggacagagaggtaaaacgaagcaggggcaagtacccagagtctcaagctcgttgggtgacagagcgtgaatgcgaacccaggggcgtccgatcccagagcccactttatgtcactcgagtgggacacagggtggaattgttccatgtgacacagtgtggaagctccaccctctgctgttcatgagaagctgtcttcgttcctgccgaaggaccaccagctgactggagatgtggacacggcgtttccccagaccccaccccggctgtcgctgctccccagccgggtcggcagcaccagctggagcttccagccactcctggactctcaggaagaccagggtgggggtcaggagccacacccacgtcccctggtccccaaacggtggggtggaaagggcaccgtcaggagatccagtcaaagcaaggctcagtttaagctttgctactctctggctgtgtgaggttgggtaatttatttaaacccttgaactctaccttcctcatctgtaaaatgggcgtgagagcatgcgagacagaaagcttgaactacattttagaaaaatgtttgcatcatattccacacatggtttctttttaatacgtatttatttattggctgtgacaggtcttacttgctgccgttgtgcagcacgaggaatcttgagctgtggcatgcgggatctagttccctgaccaggaactgaccccgggccccctacactgggagctcggaatcttaaccacgggaccaccgaggaagtcctgaatcaagctacttttgattcagaacaagcgaattactcaaaagttctgtacaagtatgagaagctatattttcatgtcatctccacatagaaactttcccccaattttttggtgcacttagttttgaaatatttcagatataaaatgttttattataaataaaataagtactataaaatatcaagacttttttcaaagctttctagtcacttttataactcagtactacttcattagggttaacccttcatcttaaatgcagatatactgagaagcttttggaaaattctaaaattcttcaataccactggagaattggacttgcccccagaaaccacatatgcagcaccaggaaagccattcttggctgccagatgtaccactgaatcaatctgtctcttggaaacatgacaaattataacttaccttggaccctttcatctctgtaagaactgaaaaagtgagtgttttctgcaaatgccaagagttacaccatttttatcattctgtgtgcaccttttctgtgttgatgtgtctctgacagatgaaaccgggatatctgtgcaattttgtttcccgctttttccattttaaatcatctcatacacgtctgttcaggtgtctgcataggcttcatacaatttctgcggctgcc

SEQ ID NO: 62930 - DNA, 1311 bp, Bovine  19866880622593
aataaataactcatgaaatatttatttcaggaagctagaattttaaattttggtcaatagtaaacacagtaaatcaagctacacctcttataatttggacttttaatttttttagtggatacacttagttttcaagtgaataatgatgcatgtttatccaaaacaaaacattttgactgcaaatagtatttttttcataattttatttatttaatttttggctgtgctgggtcttcgttgctgtgcaggctttctctagttgcagtgggcaggagatgctcttcgttgcaatgttcgggcttctcattgcagtggcttctcttgttcctgtgtatgggctctagagtgcacgggcttagttgctcactctactgtggagagtactgagtgaatagttgaacactactgcttcagtggttgcagcactcacgctcagtagctgtggtacacaggcttaactgctccgccgcgcatgtgccatcttcccagatcagggatcgaactggtgtctcctgcattggcagacatattctttaccactgagtcaccaagaaagccctataaatggtattttaaatagtattttaagcttaagaaaaaagtaacaaataacatgttttgttattttcaatattccatatttttaaaagattttttaaatgtggaccatttttaaagtctttattgacttttctacaacattgcttctgttttttgatttcttggctgagaggcttgtgagatagtcgtgtcttgaacagggatcgaacccacaccccctgtattggaagctcaaatcttaaccactggacctccagagaagtcccatatttttaattttgttaatttcttctaattaagcttcacagtcacaaagatgtttttaaactgaagtttcattagccttttcatttcttgcttttaaatggtgatgtttatgttcacaacatgaaaagcttcagaatcctttaaaaattactttattcaatagagagattttgtattacttgtctttcataccattcagaaccacactagcctgaataaacatttcagatggccttggtatcatctgggcccaagcaacagcaaataatgaagcaaaactgtagaaactgtccaacctcttttgtgtgaatcaagtcaacgaattagctgaggctccgacagctttgcctttgtctgctgagacggattgtccaataactccactgaaattgcagtcccagcaataagacacatagatcagtgaaagagaatagaaagcccagaaatagacataggcaaatatggtcagctgatattgacaaa

SEQ ID NO: 62931 - DNA, 1820 bp, Bovine  19866880631983
tcatgcttcctcctagacactacactcactgagaacacgaggatttgtgcctgttcattttagggggagctccttttgtgtctagaacttagcatgcagaactaggtatctgacaggtgttagaaaacttcaggctcaagtccttactcccttttcatccctaatattaacaagatgacttgaaccatgaaataagcgattccatgaattaaggaagcttattgtaattaaatgtcaaattgggccttagactaaacagtttagtgtcagcgggcatgctagtgcatgcggctaggacaaggctttttaaggaacgttgcatgtggtgtacagctatttgacccagggctcccagctcacagtcctgcccctgttccactgttccctgcgccagattctcttaccttttcttcccgtggctgtgggtcagcctgaccccagctggccatgcacaacagtgaccaaggccatcatgggtcaccctgcagggcgcggtctcacctctatctatggacaaattaacgaacaaatatgtacttcagggaaacgatgttttgttcctgcaggacaaagttcagtcatactcaagactttaggtcaaatcgagatctatttctgagatattttccacagatacttctcccatctttacagagacatgttttggtctgtgttcatggattcttgccaaccagcagtttacccaacgctgtgattcatttctttgttttctatatactgtttgacttctctcatatttggctttggctggggactctcagcatatgctttacatggctagtcagtccgaccttttaatatttttggatcttaatacaaaaaaaaaaaaaaaaaattcagaccagaggccaagatttttctaataataaaccagggactactcattttctttttaagtgagtattaacttcaatttagttctcttctgtgaaacttcacagcattaatgttcaaacgtaattcaggtcaagtataatatcagctcctggggtgtcattaatagttcctcgttcatgaataagagccctacaaagtagcacaggcccacagaaatgggcctgaggaaattaggccaagcaaggctcaaagaaatgaagggataagaggctgcattttccctgctctcaggagcagcacttcttttctcataagtaaccttagacacaggcaatgtaggcactggcctgtagcatagaggggcgctgaaggtctcaaaaggtggtcctccaacccacctctaatgcttgacattcctacctccagaatggtattcccttggcagaagtttgattcagacgcttccatccatccctttcctcattcattcactcatcaaatgttaattagtgccactgtgtgcaggaaccccggagagaaaagtgagaaggactcaaagcttttcgttttgtgggaagatcaaaataaggagatggttaaaactctgagcctttgtcagatggttaaaacttcacctttgggactgccaggaggggagggaggtggccccagagaatgggaagtcacagaaaaccacaagtggaagaacgatgaagtcatggacttcacagaggacaagttagggaaggaaagaaaatgctgagtgcagacctctctgacggagtcagtgctttaagctggctagtgtataccaacaaagtggaatggacagtagacccctaggttcccagtgtaaagtcatctgaaaactggcagaacttgactcataagctaagacttgatgggcttcccaggtggcgctagtggtaaagagcccgcctgccaatacaggtagatgtgag

SEQ ID NO: 62932 - DNA, 1622 bp, Bovine  19866880670130
atcggcccagaggcctgggcaggcacgaggcaggcgcatcctggtcacagagggctctggggtccagctacgggccctgtggcttagggagctcctggaggcttttcagtggggccaagctatgatctcagctcatctctgaagacccacctggcggtgggtctttgctcccctcatcaccccctccatgctttggctcacatggtccacggagagcccagcccccatcctctgactaaatcctactcatccctgagacctaactcaagtcttaaccctggaataaagcccttcgtgactactccagcccagaccttccttcttttccatagatgttttcattcttatggccaaaatcctaccccaaaggaaaggcaatgggaaaggtctttgtgtcagtgagcatcggcctcaccagctagaggagataaaattataacgatgagtgggtaacctgtctgtctcttctacaaagaaggcagaacaagacttgttcccagagcattggaaaaaaggactccttctcttttctattttcctatcaaaagaaaagaaaagaaaaatgccttaaggttcaactacagacaagggatcagtttgaaagctccgtagtgggtggagggccccttcctctactaactaatgggctcaattcatttctggggaaagaaagcctgagtttccctaaggttttactcatgagtgaccaggtcattcaaagatctcagggcacaatggctttccgaactccccagtagcctgggacaaaagaaccagggtgcacgcgctggccctgcccattgtgcagcagcagcagctgtgggatttcccggccctgcaaacccctccccgttcccccttcaccgcccagcgcctgctcggggctctcagcactgctgggggtgatggctgagcttggaggcctgggggtgggggtggaggctcttaacagaaaagcttcctcttttattcctttagcggcagcagggtagggaacaatctcagcggctagggaattcaggcaacttattttgggcactgactggaaagccaactgccctctcctttcttggtaaccttgctgtcccctgtaccgccccggagctctaaagataactgccaagttgctgcaagcgtttgtttacaagtctgtctccccatttagacatctaggcgtccttccggcaggtcctacttctctttatgttagttcttgacttgcagttggagctaaaaaaatgtttgaagagagagagagagagggaaggagagagaacagaaggaaacgaatggatggatggatggataagtgaataaataacagactctgtctctgaggctggacgcctagcttaggagatgccaatctggactctgaagaccctagtgggtcctcacaggttgcacaggctgtcaagtggggagtgtcatgagaatagatgtccgtcttgctactcctgtgcagtttaactctgcttttatgatattcattgaacttccttatgtgagattttgtgtgaataaaaggttctgtggctaagaaagtcccttgaaaggaatattgggctagatttttcccccctcgatttcctcccactttgctattttccatgataggcaag

SEQ ID NO: 62933 - DNA, 734 bp, Bovine  19866880789928
tgtccttttcccgtctgtgatcctttgtttctggagactttgggaatactcgtcttgcttaaaagcattaatctcaggactgagtggccgtttatcaaacaggaaggatttctagaatgaaagcgaagcaactcatttattctagaatcatagaaagcatcaaagaaagtgaaagtgaagtcacatggactgtagcttacccggctcctccatctatgggaatttccaggcaagagcactggagtgggctgccatttccttctccaaaaagcatcaaagaacaaaggtaatcattcagaaaatgtcaaccagaaaacattaagttatcatatttgcccagtcttcaacgtggcaaatagctagtgacccacagattaatatgagcacacttaaggatgaatctgaatagtactgaccacagccccataacagagagggagatgaaaaaggacttcacggagtaggtcctccactagtacgtacacattcgtactgaaagaaggaattgagtgagtgcaaaagcatcagcaggaatgcaagggggtggaagaaggagaatatagcacctacttgggcctggccactctcaatacagggaacccagccgtgaccaagaacagagaccaacagagagcctcactctcactgatcccacatgctggtgccggagacatccagtcaacaaggaacaatgcacagatcatttaagaaattaatgtgtgctatgagggctt

SEQ ID NO: 62934 - DNA, 1066 bp, Bovine  19866880810068
cctctggtaataataggtagatggaagagaaagggaaaacaaaaactctttaagtgctgcccttgtggaagcaagatgatgcctataagcattaccacaactaccttctgtgactctcagaaactcatttttcaaaaagatttacaaaattaattattctataacctacattcatagctttcataaacaatgacaaacaataaatgcattaagttcacttctgaagggaagaaaacattctgaaccatatggctctggttgcaagtcttactgaaggaaggagagctgcactaacatagaatattctttaccacatttaatagaataaatcttctacgatatacagccaattccaaacataaaaatcaccaccatctacctgattttacagagaaagcatttaaaaattaggttactttttcgtattcaatactagattaaacacacagggtaatactcaatgttacatcgtattcatacgataacatgaatatgtatacgtataacgtatatgtatttatgtatgaatacatataatgtattcataacagcacagaatgcgatatagtgtagtgttataactgaatatgtaccttactatatttaagacacttctttcacttgggtaaagactgatttctttgaaatgtacacttaaagacaaagaaaccaagttaagagatacagtcatttaaacacagtttacctctgcaactttgagaaactctgagattctagtcatcctagtcaggaacttcttatagatgtcaagaccttctttgcactggttctttttcatatcaaaatatttttctgccaaaaacagattataaacatacttttattcatatcaaaatataatactcaaaagagaaaaaagatttaaaacagccgatggtatacctgatgtctcagaaaacacattcaccctacagaaaaaagtgttaaattagccttaggtattcaaagcaagttaaaatagagatgctgctatattaaaaattaagaaattatgattttactattaccagtttttcctacaatacttcttccctacaattctcta

SEQ ID NO: 62935 - DNA, 1922 bp, Bovine  19866880828015
caagtctgtcctccactgctccccagtcacacagccggggcctccaccaagttgtactgaacgtgtttgtgtttccaagcctctcccaaagccctcctccactgcccaggtcgcccttctatctcttcagttattcagccattcaattattcgttcagcaataagcccttctcggtgccagaaactgtgctgaccttggagctgcagagacagacaagacacatccctggtctccaggtgtccctgtggctcccccttttggggtcactgtggtcctgacccttgttccaccccccagagaggagaggctcagtcactacactgtctacaagaatgccttggtgtccatgaaacggaattgccacttggtaaattaaactaatcgagtgttctgctcatgttttaataaatcgttgagttagactgtcctgcctggttagtgcctttcttttctgagatttttaaaaataattttatttacttatttatgaccgtgttgggtctctgttgctgcaccagcttttctctagttttggagagtggggccagtctctcgctgcggtgcgctggcttctcatcgccgtgggttcctgcgttgcagagcacaggctctaggacatgtgggctcagtacttgtggcccccaggctctcgagcagaggctcaggaggtgtggcccacgggcttagttgggattcccaggtggctcagtggtaaaaatccacctgccagtgcaggagccgcaggagatgtgggtttgatccctaggttggcaagatcccctggaggaggaaacggcaacccactccagcattcttgcctgggaaagcccatggacagagaagcctggcgggctatggttcatgtggttgcaaagactcagacatgactgagcgaccaagtacacatgcacgggcttagtcgctccgtggcatttgggatcctcccagatcagggatctaacccctgtctcctgcactggcgggtagattctttaccactgagccaccaggggagcccttgggatttttttctaactactgctctacatccagttccctgatggaaaatgccatgtttggtaaactagtataactcaagcatgactaatatccttcgtgggtgagccttgcttagacataaggacgttgtccttgaagtgacatatttaacaactccaggatgtttgctagaccagatttggaagatcccctagaaatgccatcatttttttctgtcctcatagggaaaaatgtgtcaggaatcatccgttcaatgctccctgctttattttccatctgctcctttatgcctcattaagttcttcaaggtgtttaatgtcccatgttctcttcatttgcattcatctgaggagtcaaaattgtaaaatgttatggaggttcactcatagaaaataatttgacttgaaaatgcaattatttatgctttcacccactgtgtgaaaggataaaacattataatgattacactcgagtccatacatccaggcattaacattgtgatcagatttcttttccgcctgtaatttttcagatggctcatttttgttgaaaagacagttctttagagtaagagggggtcttctgatttgattttttaatcaaatttttgacttgagcttctgtttccctggatatttatttagtctatagtgtgttgaattcagtttttcttgactctggagctccatagccccttgacatagtgtttgttttctacgccgttttaaaaccttttcttttgaaatgttataaatctggctagagagtcaagttggtgatttggcaaatgttaagctctgtgctgctgctgccaagtcactttagtcgtgtctgactccgtgcgaccccagagacggcagcccaccaggctcccccgtccctgggattctccaggcaagaa

SEQ ID NO: 62936 - DNA, 2763 bp, Bovine  19866880911405
atgttagtatgctcagtattaaagatgtcaagatactgtcatgaatttctttccctgtctacctactgcttagacttccaaaagaatcttcattctattttgtgaaattagatggtgattcaaagattttagaagtaacccacgaaaagaggactaaagaagcatgaagttttacagattactgttaaataacatcttttatcccatgttaataacttaacccatgacatttgtcaaaaatttcaagatctatgttagaaatacccagtattatctcaaaccaaatctggctatttcaaatgtattagaacttggcgctgggattttaaaatgtcctgggtccctcctcccttctttccttgcctccttctttcctccctctcttccttccatttattcttcctttttccatttttatagccttatggtgctccttacttatatctagggcaacatttcagcagaagaaagtactttaggaagcaaagtgctaccatgtcacgtggcctcattgagataaagagatgtgtttgccagtcatgatgctgtaagtcatttggactcatacagcctccatcaagatgtttgtgcctcagctgttgatgcagatataaagattatccctttaatttttaacatagtcaaagttaatatgtactgtttccttttcaatgctgttaatgttaatacaaaccttttaatttttaacattttaagagttaatataaactccattaatgcttcttagctgatcacaggaaggatcatcaagcactagttgtatcgataatttttttctgtagttaattttttggtgatgatattgtcaacggctataatgacatctacttatacttagattctttaatatatatatacacaaagtactatccttctcagtccctcatttgagaccatcctcagcaccctgctcattgctccaggcttcttccccagttgcctctgtgacctcctaaccttttctccaggcagctgctccttacccctggggctacattctttggatgtgcataaactccttccttcattcttccaagtacaggtaacacggcctattgtgtgtggtagacttgactaagtgtattcctttcctgggctgtggtacaaagtgccacaaaccgaatggcttagacaataaaaatttactgtcttaaagttctgaaagccagaaatttgaaatcaaggtggttgacagagttattccttctgagagctatgaggaaagaatctgttcagaggcctccaactctttgcgaccccatggactgcagcaccccaggcttccctgtccatcaccaactcctggaactcgctcaaactcacaccgatcaagtcggtgatgccatccaaccatctcatcctctgtcgtcctcttctcttcccaccttcaatctttcccagcatcagggtcttttccagtgagtcagttcctcccatcaggtggccaaagtattagagtttcagcttcagatcagtccttccaatgaatattcaggactggtttcaagacagtttaacttgattacctctataaagatcctatctccaaataaggtgacattctgaagtaccagatgttacaactgcaacacattctttttctttaaagtgtttatgtgtctactaagtctcttcagtcacgtccgactctttgagaccctatggtctgtagcccactgggttcctgtgtccattggattctccaggcaagaatactggagtgggttgccatgccctcctccaggggatcttcctaacctaggaatcaaacacatgtctctaagtctcctgcactggcaggccagttctataccattaccaccacctgggaagcctttatagtttttaagaaagaaaaaaagtgaagtcgttcagtcgtgtccaactctttacgaccccacggactatagcctaccaggcttctccatccataaattttccaggcaagggtactggagtgggttgccatttccttctccttatagtttttaggagggtacatttcaatccataacacaaagtcctaaagtaacacatggggaagacagcatagaaaagaaaaacttacactgaatttcaagtgtcattgtcaagaaatccattgactctgttacaagctctgattccttccttctgtccaatccctaccatgtttctggggccggctcatcatcctgggtggtaacactattatgcacatctcttacatcctgtgatgggtaattttatgtgtcaaattgactggaccacaggttacccagataattggtcaaacattattctgagtgtttctgtaatgtttggggatgaggttactatttaaatcagtagactgagtaaagcaggtttctttccataatgtgagtgggtcccacccaatcagttgagaacctgaaaagaacacaaggctagccctcccctgccttctcctgcctggcggccttaaaacaggaatgtcagctcttcctttttatatagcagcttcctgctttaagatgcaaactaggacactggctctgagagtaggtacacacacactcacacacacacacacacacactcacacacacacacactcacacacacacacacacacacaaactagagattctgtttctctggggaagtctaatacattccctaagaccgacctataaagaaaaatcacaaatgacataattatcccttcacattgcaccctatctgccacaaagccagccctttatcttactaaacgcaata

SEQ ID NO: 62937 - DNA, 1067 bp, Bovine  19866880940548
ctatccttttgattattttcttgttaagctaaaggtatttctcatatatcttggtagacaactgctttttttgttttattaaaacatgagtcactaataatattgatcattggatacatgtatatatatgggtgagtcccttctcttttcatttgaaacaagcacaacattgttaatcagatatacccaatacaaaataaaaagtttaagaaaaaataaatattgaacatttatgtgtaaaatactgcatcagactctacatgagtatgtcagttaattctcctgtaaccatatgaggtagaatattataaccattttgaagttcagtttgtttgtaatattgggaaaattatttcttttaaaaaaatattttctacctagcttaattcagttctttggtgattatagtagccatttaataaatattttttttatttagaaacattcagtaaattcttcatgactgaagtgaacttagaaatgggctttattttgtaattagaagtatttaatgttgaaatgaactaaaaatacttctgagatgtagcctaagaatttcaagagttgaagggtaccttttgttctcactgacttatttctgaactaaattcagtgttatagggtttgtgttgtggcttttaaataaatctgaattcttcgattaatatttttgcactgtatggctgtgactctgattgctagagataaatgtctttttctgtcctacgcctaagtgtttgaattcattgtattttactttgaaggaagtcattgtcattttagaacagaacattagctaatgtgttttttttttccaggttaatagcaacgaacttacaaatggggtaataaatgctgccttcatgctcctgttcaaagatgccattagactgtttgcagcatacaatgaaggaattattaacctgttgggtaaatatttctatcatttaataacgctttatttcttatcttgtgtcattgataaataatattggcttagttattacttaaagctgccttaaaattcattgagatatagttattcattgaacagtttggagaaaaga

SEQ ID NO: 62938 - DNA, 843 bp, Bovine  19866880955968
tggagagaaattagggaggctgctggggtgagagagagacctccaaaacaagtaagcagctagattctgtggccaaaaagctgttttctagaaaatgcatatgttttgttatattcattttacagatcatgtggaggtggcataaaatagatgcgtgttacaataggaagatcactcttataaaggaatcttgtgatgaatcattttattgtgttacagacattttctgctttcctatctagattttttaagcctggggggagaaggggtgcctgacttactggcagtgcatttggaaaatatggttggtcagttgcttattctctacctgtctgtctttctctgcgagctttcccagtggctcagcgatagggatctgcctgcaatgcaggagacctgggtcagaaagatcccctggaggaggaaatggcaactcactccagtgttcttgcctggagaatcccatggtcagagaaaccctgtgggctacagtctatggggtcgcaaagagttggacacaactgaagtaacttagcaacagcatcagctgtccttgtctactagcttatggatttggatttctttttctttcttaaagtaaaagttcctggaaggaaaaaagtatcgctttttgttgatcaggttcttattcctattaatatttattaaacacgtgctgttgatgttaatctgtgttacgaaagactctaagaaactgtgccctcaccttctcttatttgtaactgccagacttgctgcgcaaagagccaaatatataaaagataagaggaagaaacacagtgttacaagagggctcggatgcccaggtaaggggacatatta

SEQ ID NO: 62939 - DNA, 950 bp, Bovine  19866881107853
tctttgaagtgaatgtgaggctgaaatttgaaattgtaccttactaaacttccactgggcttcccacgtggcgttagcggtaaagaacccacctgccaatgcaggtagacgtaaaagacaagggtttgattcctgggttgggaagatgccctgaaggagggcttggcaacccactccagtattcttgcctggagaatccatggacagaggagcctggcgggctgcattccatagggtcacaaagggttggacacgactgaagtgacttagcatgcatgcaaacttccattactgcaaagtaggtttgaagttttgagacccacctgagatttctcaagggttttgaaaaggggacctgaccaaatataaccaaaggccccaatgagaagggagaaaatgggtatttcctgttgtattccactgaaatcagcatattccataaagtggttacaataatattagttaatagtttatgcttttctattataaggtctctgagtttgttttttttttttaataagaaaagtacaatttagaggtgaagtgtgctaatatatgttctcagtaagtatcatattaagaacgaaccagttgtttgggacatatatccatggaaacccaaactataaaattacactcaatgtcaatccatgaggcaggaagtgtgaggacaagcagttctcctattaacaaatttctcacccacctacctgaccaccaactccaggtgtggactgatcaggaaagtacagtgagactattatctaccccatccatcagatttctaataatgcagcctggagcctatgtgataagtcacttcagccatgtctgcctctttgcaaccctatggactgtgtagccttccaggatcctatgtccagggattctccaggcaagaatgctggactgggtccctccaggggaatcttcccaacccagggatcaaa

SEQ ID NO: 62940 - DNA, 1123 bp, Bovine  19866881134259
ctagccatggaggctcttgtctgttcttttcacatgccagactttgacctgtggggtctgtggacccactgttcccctctgcctgctgggttccccactttcagtccttccttataatatcacctgttgagatcttcacagtcctcagcagtatttgaaatcttgtttgcttgttcacttttgttcataaacgtcagctagaaaatgaattctatgaaggcaggcaggtgtctcactctttcaccagagttttttcagcacctagtatctggcacataataggtgctcaacaaatattcattgactgcatgatgatttgagaaattatgcagtggagaaaactgagcttagtttggcctgacatgccccaaaagttttgggttgaccaaaaagttcattcaggttacatcgtatagaaagactcaaacgaactttttggccaacccagtatttgaccacagacccctacttgccattgtagagaatactcagtatcccatggctcatttcctagcacacactttgctttctgctggtttaatatcaatattcggaagaggtaatgtttgaaactcagtggatcttcaaatccaaagttgaaaaatctcttgtaagccagcattttggtaggtctttgggagtccaggatatttttattgggagaatgttagtttaaaaagtaagttagagggcattctttctttgagatattgggttcaaaaattcaaaatagaatctcaagattgtagagttcagaggttggtgaaagggttggaggtgagagaggagtccagacaggacatagccaaatgaagggatgtggttgactagggtgaaatgagatggaggccctctaaagctttcctacttctaatggaatttttagaaacagacacctgcagttggaaacttggctattttcagcctatgtatgttttctgtgattatttcttttctgttttccctcatgttaagtaaagctgttcttgaaaataccagcctgtctcagttgtgccaaaggaaacaactttgtccacattgaacattttaaagggggaaccacacaggcttgggtgaggcatgaatttgtgatacgatgacactaagtcaggaaaacagaaat

SEQ ID NO: 62941 - DNA, 1160 bp, Bovine  19866881140684
tatgtctacatatatcccctccttcttgagcttccttcctactccaccccattccaccccctctacgtcggtaggagcgctgagcactgagctgagctccctgtgctaacagcagcttcccattagctatctatttgatgtatgggtgggatgaattgagagagcaccattgatatatatgcctgtcccttttaaaaaggaatgttttattgtttttatttttaattacaaacatggtttatattcatgaaaatttaagaaatgcagaaaaataaaacaaagactcagctgtaatcccactaaccactcttgccatttgatgaatatttacatgaatgcgtgactagctgagtcacagttgaaggcccacaacaaccctgggacttaggtagggttattagtctcttttgatcagtgtaggagctgagatcagagaggttgaaatttgcctttagatacacagctggcaagtgatggagcctgatttgaacctggttctatatcccaatcttctcacaatactctactcgttttgatccatgggaatacccgaggtgatgccatgtcatcaaatctcagtttccagatgggaaatactccaaagcaaaaagtatgacttgaagatgttttcacagtgtgtcttgtctgtcaagttgggtcacacttcctgtaactttgtaaactcatccattgcaacagtggtgttttgattctttgcccctctgacaaccagaacagaaagcatcttccctcccatcactgggctggaggcttccttctgcttctgcccaaggcagaatgtggttagcacttactgcttaacctcttcctctgcaagttactctctgaaggagaacattttgtttagcccattttgacatcatgaacattctgtgcccctaaatatcaaccaatctctttaaaaaaaaaaaaaaaaatcagtgaatttttttttaattggagggtaattgccttacagtgttgtggtggtctcgtccatacatcagagagaatcagtcgtaattatatatgtatatcccctccctcccctacttcccacccctctaggttgttgcagtacccccagctgggctccctgtgttatatagcagctttccactagttactgtttgcttttttcgaatggcttaacaacctta

SEQ ID NO: 62942 - DNA, 709 bp, Bovine  19866881239204
ccccctccaaccccactttcccagtcatctccaaagtgcagacagctctcctgctaattcgggtcaatgaataatggagtgctggataccggagactgaattcttttgctgattcaaagaaccagcattcctttatttgggctcaacccagattccactcaaaatgtcgctttattcggcaaaaatctggcacgccattttctttccgagccaaagaatttgggggcagttttctaaagagatcacctgtttgtctttttcatggtgagttcagcatatatatttttaaaaaatgaaaaaggaaaaatggaaggattttcacaaagtgctcagtgcaaggtaattgtcaacacgtagttctagcactgatgattaaagagctcctgagtttattatgtgtcgtgggacattgtttcagcctgtgttagaatactgtgcacagatgtgtaatttacatttacatagaatttataaatctgtgttataaatcatgcactgtgtcaggaacatgtcatcatggatctagaacatttttcattaatttggataagcagtattccagttctgaagccagcatttggaatgagcactgcaggccccaggcagtacccggtgttacccttggtagagggcagcgtgtcccacttcctgtgggtgggcatgtccacatgctgcagcatatttgacctcatcacgcagagcagctgtg

SEQ ID NO: 62943 - DNA, 1687 bp, Bovine  19866881266786
ccatgtgcggtggagcaactatgcctgagcctgtgctccacagcccggcgctgctgctactgaagtcggcacgttctggagcctgtctccacgaccagagaagccacgacagtgagaagcttacaggccacaaccagaggagagccccagcagcgacgaagacccggcacagccaaaatgaatacataaaattaattcaaacattttaacagtgaagcaggtcacttcatgattgatttcatcacggcagtcagatttagtcacactagcggccaaattgattggacaaccaccgtccgtccagttctttcaatcatctatgttactactactactaagttgcttcagtagtgtccgactctgtgcaaccccatagacggaagcccaccaggctcccctgtccctgggattctccaggcaagaacactggagtgggttgccatttccttcagtgcctggaagtggaaagtgaaagtgaagtcgctcagtcgtgttaggcaatctaaatcaggaaaaatagcacaataggataataaagaacaatgggacccaatgtttttaggcatatttccaaagttactgtaaaccatgattttaaatgttcagataagttgattgcatataatcattgctaaaaaaaaatgtgaaatgctttgtggcagcacttctttaatacagggaaaaaaatcttttttttttttagaatgctctaaggttcattgacaagggcagctatcgagagatctgggagaatgactggctcaaaaaagaggtaagtggaattttaaaaaaggaaaacaatttcttctttctcatttttctgaaccggaaatgacttttatttatgagctgaagtcatggggaaatcatggatatgtgagtcaccgaggtaaagtgaaattcaagtggagccctaatattattacaagctgtcactcaatgaacaccgtatatgttttcaataataaccagaagtcaattttggtgtcacaattttcatacaatacactcaagtgtctaaaacttcttgatattctaaaactgacccggccttcctctgaaccctatttgctcccaactgatggaagcaaggctgaaggatcattctaacctcattctctccggttttaaattgtctcttcaggtattcaaactggtatggaagaggtaaaactgtcattatatgcagatgacatgacactgtatatagaaaaccctaaagactacacacagaaactgctagaattgatagactaattcaacaaggtagcgggatacaagaattaacacacagggatttctttacactaacaatgttgtatttctttacaacaatgttgtatttctttataacaaagttgtatttctttacactagcaatgaaatatcagaaagggaacgcaaacagtcaatgtcttttagaatcacatttttaaaatagctcataggaataaacttcataaaggaggtggaagacatgctgagaactacaaaacattgataaaggaaactgaagatgattcagagaaatggaaagatgtcctatatgctcttggattagaagaattaatattgttaaaatggccatagtacccaaagcaatctacaaacttaatgccatccctatcaacttacccatgacatttttcacaaaactggaacaaataatcctaaaattatataagag

SEQ ID NO: 62944 - DNA, 951 bp, Bovine  19866881317686
caaaccagaaacctcctacagttttgaaatgttgataactaactcaaccatttttaaatgttatgcagatcaaacaagcaacttacacagtctgagttcagttgctgcccaccacttaataacctttgatctttgtgtatttggtgtgtttaatcttagcttccaatttttcacaaaaaactacaaattacgttcagtaaaaacaaatgcagctagaatatcaggaagtgttagagggaagagacatacaattagtatggaaacaaaaatagatatggtaaaaaattgaaaatgacaaatgtatgtatttataggataaattgttcatcaataatgacatttctgaagaacaaagatctggtcattcaatcatgcctatactgatgccatcagcaataatgagcaaaaggaatggaaagttattgttaggatgaaagactttaataagcgtgcaaccagaaaacagacattaatgccaaatgcctaaataaagttaattctggataaagaccggcatttctttgggaacttaaagactgaacatgataaaaacgctgctgtgagaacttctgacacagccagataattccgtagttcaagggcattccagctcccaagtttcccacttgcagttgtcaacagggaggtggattacttctcctggcacatattcaacatagaggaaactggtatataagaaaagatcacttatagacagactgttagaaggtaggagaaaaaagcatgtttgctttgtggttttaaagactgatttttttttttaaagcaaacactgtaaatatttaaaaatccaaatagttttaaaagatatacagtagaaaaaaagtcttcattttgccctaaatccccagttctcctacctagttcagttcagttcagtcgctcagttgtgtcctacttctttgcgactccagaatcacagcacgccag

SEQ ID NO: 62945 - DNA, 621 bp, Bovine  19866881353995
ctaattacccctgatgagtggctctctcattcatttggttccaggcacttagctgtctcttgcatttgcttccactgatcagggtccctgaggtttgcacatatgttttcccagtgaacttttgtcctctctgaaaagtgcattctgctctctttttatcagattccagctttcatgactaatatgcggtgataactccagaactgtttacacgacaaattaaagtgggcagaatcttccgcttacaaattgcttcaagacagggctcagatgtctgcccatagaatcatcttctacacgctagcataaaatggatctgagcttgtacagcttcagctggcccttgacttagaggcctgttgtttctcgacagggatctgcgctcccagtctgttcctcaaactgaggctacagagattttatgacgcacttggaaaaaaatatgcgggctacttctccaacctgctttggaaaaacaggatgtttctctctcacaatcttgcacatacctgtaaacaagcgactcattggcaaggcctctgagtcagaggtatagcagtttcagactctcgggtttgatgatatttgctggataaatcagaagttcggtcagaacagagc

SEQ ID NO: 62946 - DNA, 700 bp, Bovine  19866881372169
tgacagagagacaatagaaaagtctgtaacatacacactgcgggggtggcatgctctccccactcttctgctttacaaagattgccagggttcctaattcctagcccctctgcagtccccatgattcctgcccgtttgcagtgtgatcctcccagttcccattactctgtgagcttcctagtagccttccagtaactcccttaagttagctcgttagtatctgtggtcttgtctgcttgttgtggtttagtcgctaagtcgtgtcccactcttcagcgaccccatggactgtagcccaccaggctcctctatccatgggatttctcaggcaagaatcctggagtgggttaccatgccctcctccaggggctcttcctaaccgagggattgaactcgtctcctacactggcaggcagattctttaccattgggtcacctgggaagcctgtctgcttacaagtttgtaaaacagttaatattagactagagagtgtagtaaaacaggccatccatcctctcatcccattttcagagaataaacttgaggattaaagagaaacacttaaatcctagctttaactagacagaggggcttaaacagagccatgtgcaggcaatgtgacggtcctttgaaatgaaaaccagaaaaagaaaggggcaaatgtcaataggaagattagaggcttctaatgcagattag

SEQ ID NO: 62947 - DNA, 1665 bp, Bovine  19866881411183
cgcttgcactccagctgccagccattcaggagagcaactgtctggcctcctttccagcttccataaggggaagacatgctctgcctcccatgagacccatgtttcctgcagtgccaattcccccagacatagaaagtgggctcagatgctaggcagccaataaaaaatggaacccctgacaaatgctctatactagaattcttaaaagtcccatccaactcaggatgtgggggaagtgaggatgtgcacatactgagtcacgtctgactcttcaagaccccatggactgtagcctgccaggctcctctgtccgtgggattttccaggcaagaataccggagtgggttgccatgccccctcctccaggagatcttcccgatcccggatcaaagtcaagtcacctgcgtctcctgcattggcaggccagttctttgccagttctttactgagccacttgggaagccctggttcaaaattggaaagctaaagctaagaggtcatgatttactgagtagcaacagtgacttgagactttatttaccaggaactgttcgaggcactgggtacaaagatgactaagacacagatgctggcctcaaggtgctcctgtcgggtagggaagaaagataaacaaaatactaaaataaaatgtgataaggagaggccataactgatagactacaaagcagaaagggaacccaagagtaaaggattaaagctggggcctgtggggggtggtcagaaacgctttcacagagaagacgggccaaaggaaggaaggggagaggaggaaagagcattcgaggcaaagccacgtctggtatgatttaatcttctttgtcggccaaaatctggtcctggcatttcctggctcagttcttcccactgccaccaaccacagcacacatgctacgatgattaaggtctaaaattagtatcagtaccggccgagtgttattagagcactgttagaaccacattttgcttctgctggtctccccccaagctccagtgcataacgctgttggcacacgcttactgctgctgccgttgtccttagatgcaaccaactgcatgctcagtcaggcctgggctttaaataatcagccagccgttgactaattgtaaggcctctccacgcctcgatttcctggaaagtaaaatgggaatcaggcttacttgcctccctaagtctggatgggaggggagtttgggatacgtgtatacgtatggctgagtcccttccctgttcacttgaaactacacaatatttgtttattaattggctatacctcaaaagaaaagttaaaaagaaaaaaaaaaacttgccttccaaataaacaaactcatagaaaaagagatcagatggtgggttaccagaggagagaggaggagagaaggaaattggaggacagtgggccaaaggtacaggctttcagttataaataagtactggggtgatataacatatggcaagagcttttaaaaatatttattgatttatttggcttcccgggtctcagttgcagcatgaagaatctttagttggggcacgtggtttctagttccctgtcaaggatcaaaactgggccccttcattgggactgtggagtcagcctctggaccaccagggaagtcccacaacatattaatatatctaaaaca

SEQ ID NO: 62948 - DNA, 1123 bp, Bovine  19866881493252
actgaagcgacttagcagcagcagcagcagccccatcagaggatttgtgaggagctggtcacatttagctatctctgtttcactattttgggcttcccaggtggtgctagtggtaaagaacccacctgccaatgcaggagacctaaagagacgtgagtttgatccctgggttaggaaaatcccctggaggagggcatggccatccattccagtatatttagggcttgatctgtgaatcaaagtctttgaagaaagctcatccttgaagaaacaactagtatgggccctggaatggggaagctttccttctatgtccacagtgactgctaaaagccaagggataattttttcttgctggaaatgtgattaatcagttaaggcctggaacactggcctctttcatcactcaaatgcccaggatgttaatcacccagagtcatccaatttccatggccaacctggcatatagtcaagatttaaaaggaaaaattctaaacatggcctgttagtactggagaactttcccttttttataagatctattagtgaagttctcctgccttgggatatgtgctaattagtcataaaccaaagagataatccttgttaaggtagcactagctgctacaacacatagactccagaatattagtagcttagcaaagtgtaaatgtgcttcttgctcacttacattcgaagaggttttccatcttagtggttggttctgttccaagtagcaattaaagatcccaggattcctccagcttggaactcctccatattcaatatgtgggctccaagatcatggacttgggagaaaaagcacagaggatggcagttaggtgtttttatagacggggcccacaagtagttcatatcacttctattagcattccattggctagagctgggtcttatggccacactaacttcaaggtgcctgggagatgtaataaaactctgtgcccaggaggaagaggaaaaaggttttccgtagtccctgaaatcactacatgtcagtgatctaaaaataggtgatttgcaaaatatttggaaaccttccaaggcatgtggtcctatatagcctagtttgtgaacatagtgatataatatatagagtaag

SEQ ID NO: 62949 - DNA, 2113 bp, Bovine  19866881503065
tttcagtgctcacgaataagttatctacaattgtcatcataaagatttctcccaaagggatttaagagctttctcttctgtcttctattagcaaccagtacatggaaagctgtagtctttcccattgctgcctgttgatttgtaagtcttttctgctgtactgaccattctgtgagatcaaggatcagtcatttatttccatatcccttgtgtctagcacaggatttgtacctgtagattagtatttattgaggcaaaatattaggaggacactgtgctaattcacttcagttgtgtctaactctgtgtgaccctaccgactgcagcctgccaggctcttctctccattggatctcctaggcaagaatactggatgggttgccatttcctcctccaggagatcttcttgacccagggatcaaacccaagtctctttcatctcgctggattggcaggtgggttctttaccactagcgccacctgggaagccctatttaggaggacccatatggggtcgcacagagtagaacacaactgaaacgacttagcagcagcagcatgctaattctactgccagaatatttctgtaaagtgttcattccgtgtttatcttcctgaagtagcagtctaaaaagatttcatttgtctaccgtcaatttatttttatttgtgtgtttattatttgcagctgtgttgggtctgatcgctgcactcagactttctctagctgcggtgcgcaggcttctcttggcagtggctccttttgttacaaagcccggctctagagcatgggctcagtagtggtggcacatggatttggttgccctgtggcatgtggaccaagcatgaaccggggtcccctgcattggctcacatggttaaataatctgcctgtgatgcaggagacctgtgtgatatccctgggttgggaagatcccctggagaagaaaattgcaactcactccagtattcctacctggagaagcccatggacagaagaagcctggcaggctacagtccatggggtcgcaaaaagtcagacatgactgagtgactaatgctttcactgcattggtgggtggattcttaaccactggaccacaagggaagaatagtctaccttcagtttaaataaaagtgcagccttaacaaaactgaacctgttataccaaatttccttttgtcttcctttgctctagccacttcctcctggtcaaaatcatctctttttgtgtcataatcccatctttttttttttttttaattggtgatagtctttttctgaaaatttgcattattgcaagttccccagaaagctgtgagtgttatcgataacaaaggagacccatccttccctctgccttcttcctacagccgtttgagtcagcagggtttcttggaatcttagcacaaggtcagtacatggcctctctccctgaaggttacagccatgctagagttagacaagggattagaatatcccaggcacacatccaggcattattgtaaagaatgaagtgctctgtgagctcagatttgaggaggggatttggcttggagaagactcttgagagtcccttggactgcaggaaatcaaaccagtcaatcctaaaggaaatcagtcccgaatattcattggaaggactgatgctgaagctgaagctccagtactttggccacctgatgccaagaactgactcatcagaaaagaccctgatgctgggaaagattgaaggcaggaggagaaggggacgacagaggataagatggttggatggcatcaccgacttgatggacatgagtttgagtaaactccaggagtttgtgatggacagggaggactggcatgctgcaatccatggggtcgtcaagagtgagacacgactgagtgactgaactgtgtgtggctatctaacatattcatgaaatcatgctcttgacaggcttcacagagctctgaggcctatcctttcatgtagcagagagaagctgcccagttcagtggaaagagtgttgactttagagtcaggacttgactttgagcctggttttaccactacctggctggctattcttatggcaaatcaccaatatgcgatcactttgcaataca

SEQ ID NO: 62950 - DNA, 1204 bp, Bovine  19866881595289
tacttgcatttgtttctctgtcagactgtcgtgcctacatccttgcccccagtccagccccccattctccatcccatacacttcagctcggatttcaggaataatgaacttcgcttatatcttcaatcccctccagcccattctctccagctccatcatagtaacagacctaccgccagcatgagctgactgcttctcccaaatccttctcatgctcctttcggactcctcaagcttccaagtcaggccaaaggtagggagacttttatttcccagggtcactgttagaactctcccatcatcttatttaaacaaatagtttccacagcaacaaaacccatttcttggtgccttttctaagagttgtgctatttagagagactgacctttcctcctttttgtcattgtcatttaccatctttcattcattgaggactttggcaccagcttatagactttctccacccttggatgacttcagaatcaaagggctgattcccccagcacccagacctcctccaactggaatactctccttttgcaatccagctcagctactactgcagtcacaccccagaccttggcatagtgtggaatttgtctgtgtgaatcattgaaatcacagaagtcagtgagcctaacaacattctctgaccagagatgctgcttgctcagccttgccctctgaactcaccagtctccagcctcctctgccctctacctctcctgcccggtgacctagtccagtccagcttccagcccagggtcatcattcctgctcatcccgacagtaccctcatcttttgcctctatgtcttttcactgctgggcttccccggtggctcagtggtaaagaatccacctgccaatgccaggtgatgcaggagatgccactttgatccctgggtcaggaagatcccctggagaaaagaatggcaacccattccagtgttcttgcctcggaagtcccatggacagaggaacctggcaggcttcaggccctggggttgcaaagagtcagatgcaactgaagcgacctagcacacgtgcacagatgctgcgggggcccctctgcctacaggcggtcccccacccgcgccgatcggctctggcacccattctctccgtctttgaggaatccaccccaatagcatctaaatatgttcacggtctctccactctaaaatccccttgcagccagagg

SEQ ID NO: 62951 - DNA, 887 bp, Bovine  19866881606096
tggaaggaatccagtgtggtctgtcaaggcacagtatagaactatgaccttggaccacataaaaacacaaacagttattaggcagcattctgggaggtctctggaggatgtgatgaagcctgagggtcaaacttagttcacttaatatctaccctagtgatcttggaacgtgggatcttcatccctttttaatgaaattcaatgaagataacaaaatggctggagttacagtcaccagaaaggacggaagaaatgttgacaggaaacgtttcccattaaacgtggggggaggaggaagcaaggaatgcaaaacagatagtcactaagatacagaggtctggatggagccgccatgatttaagaggcctgcaatagacagaagggcagaggggaaattatattgaaggcgaaatgtggtcgctggcctgagcgctgtttcccagatgtgcagaatcccagatgtcacagacttccatgctttgggggcacagctggagggaggaccctggtcaacactgagctggtctcccgggtccgggagctcttggagtagtttgggagacgccgaggcagagcggcaggggggaaggtggggagggcagtagagaagggatgaatgtgtgtcctgaagagcagctgcacttcctcttaacttgcccatccaccctctctactgttaagttgttctgggctggcccaaagtgtcagtggcccctgagtttctccctgaagactctctcaaggacctcccatatggtcctgaagtcattgcacatggcaggttggttggtaatgactgggttacttgactctccttctccaacctgtgaactccagttgacgaagggcacttgaggcaaacacacgttaggagaccatctgcagaa

SEQ ID NO: 62952 - DNA, 1169 bp, Bovine  19866881689193
tagagactaacattaaaccagcatccaggggtccccccccttcaggatctaatgtccgatgacctgaggtagagctggcgtactaataatagaaataaagggcacaataaatgtaagacacttgaatcatccccaaaccatccccttccccaggctgtgtgttccatgaaactggttcctggtgacacaaaggtcggggactgctgtgcctatatcgcagggattgggacttaggaaggagaggttttgtatgaaaagaaaaaggaataggaaagaacagatcaggaaggttgtgtctaaggtgctggagatgaagcaagactcaggcagggagccccagtgtagcatcagcattgtccagaaggttacaggaggggaacaactgaaaaagctaaagagacaagggtaaagtgagtggtaaaagatggacttctccagctggacacaacttctcatatgagctcctgtcctgtactgaaaactttaggagggaaatgaactatggttttttctgccctgtgtctcccatggcgccaagcatggtatcttcaggccttgagcagagagagcacttagagactatcttctgattagactccattcagcaagcgttgattaagctccatctttatggttggccaccataaatacatggaagatccaaatggaataagatagtttactcatggtccccgaccttaaggagtttacaacccacctgaagagaggaacagctctaaggtgatataaaccaattagtaaagcatggtatggattgactggtttactttgaacacatagaggtaattcattatgtaggaagtatctccactgaattgttggttcttgatctaaatcttgagaataggattttgattcaagtgggaaggtgacccagcacagtccctggcataaagatttattgtgtgagttctaaacaggaggacctgcataagcaagagacgtgattgggacaaacgagaatcacacagactcttagggctgggaatatacgagacacttcttccctcttgacaaaaaccccacatttctttccagttctttcttcccccaaatggccgtgtgctttgcgaagtcttggtcctccgcaaccccaaggagtgggagctaattaatccctagccagtcacagagaagttccctcccca

SEQ ID NO: 62953 - DNA, 850 bp, Bovine  19866881725229
aacctgcgcttcattaagtcctgagaacaggtgtgtgatctcaatcaaaagactgtgggttcaagtcctcatccggattttgactgggttcaagccccagcacatgggttgaagtctcaaatctgagttgcacggtttcaccagggcacaggcttctgtcctctgctaccctccaatcaccttgatgtgctcaacaccctagaagttccatcatttagggttttttatggtggtttcattatgtaggcatgatggattaaatcattggccactggtaattaaattctatctccagcccctttacccttccaggagttgggaataaaaattctatcctgccgatcaaggtttggtctttctggacaccacccccatcctgaagctatcgagaggcttgccaagaatggcctcattaaaagacattcctattacccttatcactcaggaaattctaaaggtcttaggcactatgccaagaactgcggataaaaaaaaatatccttccatgataccacagtgtgggaattaatttaagggcgtaaatttaagggtatatacagtgaataagtagtttgtaattatgatgccaacaatggtttcaaagtttcaaaggtaataacaagtcattaggttacacttgtgtttcatcgcaatttattttccactaactttttcgctagggaaattaatgacatcactcattaattatagcactcccctccccacttcatctagccccaatgccatcttactctgagtcatttatttgataattagatgttacagacactcatgagaatgtgtggctgaattaaacattctagcactgtgatagcctttctaggaaaag

SEQ ID NO: 62954 - DNA, 1325 bp, Bovine  19866880351862
tagaagtgcagtatgtgtgaaccactttgaaaaatgcagactgctcccgcagcacgattgtcgctatttgtgtacgtagagaacacaaagaaggtgaggcggtgagaagaggggaagccttcaagcagcagagcccagatgtgcttgtccaccttgcttggcgggctgctgctccagggcgggaagctagagtgaagatgctttatcgaagttcaacattttctcgttagttcttcacttctgtttttacaaaatgacaacagcaagtagttttgctagagtagttggtgctcctcaacctcttaataagtatttacgtggcatcccctgtgagccaggctctgaacagtgccattttctctcggcctgctttcagtcactgtgtcattctgcagagggtctgagcagttttcagctcccctgggtcttctggttctacatctgaggctcttcccacaacaaaagagctatgagaagtgggacttggtgtcatgtttatatttgcataggaacgtgcattgcgagctgtatttgctggattattggcttcattttattttttttttcataaggaaggttttattttataaatagacttcagttagacacatttaaattttaaaagggaaatgacatgaacataatcatagaagctgaaatgcatagttctttttctgggtatagttagaaaatcagtttatgtaaatggtatgagagacagtacttccatgtgaaaatctgccacatgaaatggtcacatcctgagggaagagcacagtggcccaatttatggcccatgttcacagagagaactctgtgatatgcatttttattttaacttcggttctggtgctattttatgttcctacccttgttttccatcttctcctttatccgttttagatttgtgctgtgtttttttttttttttttgtattgctgtaagcctctttaaaccctttctgctacaaatcagggatatataaacagatagatttttttcttttttaaacaggaatcgacttaaagcctccagagaagtggaatctgtagaccttcctaattgccacctgattaaaggaatcggtgagtctgagaaaatgcttgttacacagctcacattgtttggccactaacactaaaaaattcactaagagtattttggcacataattactgtttatcagaggaaaaatcacattagatcagcaaaaccttttcatctcttttgatctcatgtaccctgtatttcttctctcttactctcactgtgatttattaatgatttgttcaaccctatgtgtgttgttagatttcttgcttgttt

SEQ ID NO: 62955 - DNA, 1952 bp, Bovine  19866880381074
aatacacgctttggggggataatcatttcgtctccttcttcatggaacatgccctgacctgactggctttggttctagaagtcactgggctcttcggggctctggagctcagctgcagccatgaacctgcatgtggttgttaagctcactttggagggtgcgaggtcatccctgaggggtctgatggggtcagggtgtaggggaaggcagtgggacctcagagctggagttccagcaagctgcctgcagtgtcacaggcagtccccgcaaccttatttacacacaggcttgcaacctcctctagaagcttccagaaaaaaatgggagatgctgaagaactcaagaaatcttaaatcacagatgcgataagaattatagaaatatagtttatactgtaaacaagacctcatgtaaccagtctggtgtggcctaggaaaacctggattggatagataggtaggtaggtgaattaaaacacaaaaatagggaaaacgaatttggtaacatcaagcaatgtaacatactgacactttataatatatttaatagcataaaatattgttattgcactttaaaatattctaaatcaagtatataagtttcatgttcctctgagctgaaaacagacctgagaaaaaagtagaatggctttttaaagggttaataattcccaggtgaggaatgtgttttaattcagaattcctcaagaaaaaccagccttctctgtagattttacaaataacagccaatgctggctaatatttctaacctgtagtcagttttctgttgatgaaaaatcagaatcagggattattactttcacaaagaatgtttagacatcccagtgacatgatcactatataaaataaaattcaaattatctgagtttaaacactgactttgacagttagtaaaatcatttaattttctgctatggaaactattttaataattttaaccacttcttagattatatcaattctttgagatgaagtacgacggagaatgaaaataatctttgtaaattgagctccattgcaaaaaaaaaatgatttccattcttcagtagaaatattaacggataacctttcgagtgcctttccttgtatttctcttctgcctctgcatcccctgctttctacagctcaaagaaagcctagctcatgaaaacagattctacttaatgatccccttccctctgccttctcccattctctttcattcacattcccaactttgcatctctgttctcattttccctttttctttccggggaatgaccacctcaaaggattaattcagaacatgcagcagaaaatggtaacaagagtgggcaaatcaggatgtggatttaaaatcaagaggtattttaaaggaggagagttactcaaattaaacatatgttaagaatatgggtttgttgttcatggcatacctgctgcctgtcatcccaccctcatcggatcagccttcaagggcaaagcattccctagtggaataataaatagagcggctggagtggatatgaatctgagcagcccagcaagctgcctgtcctcttggtctgacttcactgttggaacacaggtggtcactgaaccagatcagctagtgaaatggatcgtggcccctcaggctcactgccagagagagagagggaacacaattcaggctccaagtaatcaggctttgggaataaaaaattctaatacaggtcttactgagcttttataccaaactgttttaactgacactgcctgttttccaaggcatcatctttcctactttgatgcaagtgaactaggcaaaaatccactggtcttttttaaaaaatatgctggtaagatgcttaacagctgacctgccatcaatcaaggggtgtggcaaatttattctatagataaaaacacaaagagttgccctatttctgcactttcattcttcccaatgta

SEQ ID NO: 62956 - DNA, 713 bp, Bovine  19866880414231
tgtcccccctcccccccccacccctgccaaggaaacactaaaagtagacacaccatccccttgtgttaaagggaaataggaatatgacatatctcagtacttaggcagaagttcatgtttgatggttttcagatgcaaaagtgacttttcttcttcttgaaatttaaacaactcaaccgtggacttaacgtctggatggctcaccaccagcaggtacacagtattatctgagaagagattaaaaacaaaaatcgaaacattaaccgagctctcagctgtcagctctgtctctaaaaagcaatttctacccacctccaaccagtacttaggatgtcaggcagatggaatattttcatctctttgtagagagaagcatttgtgattgctccagagaaaaatggctaaaggaagacctagtgacagtctaaaaaccaccagactccacagggggaaaaaaagtcctcaacttaggagtgagcagcccttgacactaaaactccaaagagcttattaagctttctgctgcaaatggtctcagcaagatgcagcactgagataaaagagataaaagatgagaagaatatcaataagagaaggtgtgctcaggtgtaatttacacagtgtgagatgataaattccataaaaagagcacctgagagataatatcaaagggatttagcttccagggagtcggtgcaactctgcggcatgaa

SEQ ID NO: 62957 - DNA, 1580 bp, Bovine  19866880432492
ggagtagataggatagtagatactgctgtatgatacgttacatccagcagagattttactgacctccattcaggcccctctttatgccaacaacacaatagaagcccagaggtgaagtgcagcttttctgcctgtcagacctggaatacagactcttttttttttttattaaatttttagaccatttaataagcatactataatagaaaagccatcctttctttttcttaatttctttcactattatttctaaagaaattgtgatgtatgttcttttcctcttgtaaaatatttttttaaaactcctttattgaagcatagttgatttataatgtttgccaatctctgctgtacagctcaggtatacacaaacacacattcttttttatattcttttccattatgatttatcacaggatctgcaatatagttccctgtgctaatcattaggaccttgttgtttatccattctaaatgtaatcatttgcatctaccaatcccaaactcccagtccatccctctccctcccgctctccccccttggcagctagaagtcggatctctgtgtctgtggatttgtttctgttttgtagacaggttcctttgtgccatactttaggttccacatgaagtggtatcatacggcatttgtcgttctctttctgaccgacttcactgggtgtgatcatctcggcgatgatgagtgtgatcaacacgtgaggccacacgtgttgctgcagatggcggtgtttcactcttttcagtgatggagcaggagtcattgtgtgtgtggatcacatcttctctctccattcctctggtgatggatgtttagttgttcccatgtcttggctatttgaataacgctgctctgaacataggggtgcatgcatctttttgaattatagttttgcccaaatattttcccaggagtgggattgctggatcatgtggtgaattctatttgtagttttctgaggaacctccttattgttttccatggcggctgcacctacttacatttccaccaacagggtaggaatggaatctgggactcttagttcccaactaaatgcctttctgctatatcgtgtgtctttcctattatctcaatccaacaaatagcttatttttaattctctggtttgttgtggtggtgtagaaatagcccacatcttgtacaaaaaccagatgccacatatatttttggtagctttctaagaaggaaactttgtatagtgtggtagtgctatgtgtatagagatcagacctgcttccctacttttattttaagggaaaaaagaatatattttgaagacttagaagctaagtgctgtttcacactataaggctgggagaccgaggcaaaaaaaaatctctaacaattattttccagcaaagtaaaacataattgtgtccccctctgacctcctggcatcttgcttctcttggtgccattatgctttgattgatgccatcgtttatttgtccttgacagtgagcataatgttttgccttcagagatctctgctgttatatatgcagtcttgaggaagcagaggtagaatgacaaggaacgg

SEQ ID NO: 62958 - DNA, 1436 bp, Bovine  19866880478611
attttataaaaattagtgctgcctttgcatacaggataatctggagaggagacaggcaattttacagctctgtaaaagtgcctttgaaagtcaaaacatttttaagtctttgtagagctaaactgaagaactcccaacaaaacattttctttctttcctctcaaaggaatgctgacatggcaagaaaaatagtttcaccatgtgtttgtactttcttttataaggagtataaaagaattgctatactcttttaatctgagcagctcagtctacagaaactttaacttctatctagaaattttactgtgggaagctttcctctcgacatgcatactagatattttttcttgatgccttaataattcatctccagtttggtgatttttatcttaacatggagaaattgatgagggctccctgcctacgaattcaaataactaaaagttgaaagctaaaatctttaagattagaggaactatggttatttagtgaagactagagaataacttaaaagtttcccctcagtggacatagttgtatcttattacatagcttttaatctcttactaaggataagcaagaataaacacatttgttttgaaatatggtttcaaggggagcccagaaagaattttttatacagtggagcagatattaaggaacgtgatagactttcctagaagagttttgctaaggttatggaggtccactttgagtttaggcaagacccaaacatgttaaaggcagagttggcagaggtctagggaaattaggatcaaagaaatattaaaataaaataccttttgacttttacatttaaaagagaaacaaatttcagggaatgaatggcagtctaacaaggtggacattataaaaacatgttctgcagggttaatccgggtgtaataaaccagttaaggagcatggaacctcaataaagaaagatgtgattatgaaattttgagtataggatgttttctttcactcagatttgttttctagctcagttcccacccatattaaaaattgtattagaaatacatttttattcctaaataaattagaaatatatttttaaaagataattgtttaaaaaaatactacaagtgcattgactttaacttttgttaagcactgggttccatgttgccctggctggaactcttctatcagaatggtgaaggtcttcctccattctatgagtttccagggtcagctataagaaaagacaacaatctgggtggcttaagcaataaaaattgattgtctcgtagatctgaaggctggaagttcaaaatcaaggtgtcagaaaagttggttctttctgaggaaggtgagggtaagtctgttccatgctagtctggtcctagcttctcgtagccttgggggtttcttggcttatagatgcatgatcgctgtatcttcagattatcttc

SEQ ID NO: 62959 - DNA, 1785 bp, Bovine  19866880553420
cgacttcactttcatgcattggagaaggaaatggcaacccactcccagtgttcttgcctggagaatcccagggacgggggagcctggtgggctgccgtctacggggtcacacagagtcggacatgactgaagcgacttagcagcagcagcagtgggtgtgaagtggcatctcactgtggtttgcacacacacttttgtgtactcagcacacagcttaggtctaggcacacacagtgctgagaggcacgaaaattccaagggatttgaagaaaagtcattggaatattgttgttgttcagtcactcagtcgtgtccaactccttgcaaccccatggactgcagcacgtcagggcttccttatccttcactgtctcccagggtttacccaaactcatgtccatcaagtcggtgatgccatccaaccatctcatcctctgttgtccccttctcctcctgccctcaatcttttccagcatcagggtcttttccaatgaatcggctcttcacatcaggtgaccaaagtattggagcttaagcaccagtccttccaatgaatattcaggtttgatttccgttaggattgattggaatgagtggtttctaatctcccagaaatcagattttagaatcagctgcttttctttcttaaaaaaatgcaaactgagtcaggaagtagcaagcaagctaattcaacttttgctcccggacaccccattactaatggggtgatgactttcagtaggtggttccttttagagttgagaagaatgacgtgtgtgctgtagaagagcgacttaggcataggaaaagagagctctgaaggaagaaagaccctttcccttcatctcaaagttaaatgcccaactcatgagtcactttcacaccttctccattgtcagatgcccggtgctgcatgattgcctagaagaggtgtttttgacagcaatgatctccgattacatttgtttccattaacaagagaaatatctttgagggtttcttaggtactttcagaaatatatactagctcatgagtagccagaaacatctgatctgtctgcctcacaagcctctgacagctaagcatttgattttaggcgagtgaaatgtcagccgccattaaacagcatatggcaacaatatggccattccctctccaggaccagtttctccccagaagagatggtacttgaaataagagatgcttttcaatacaaggcccctgtccctcctgcccaggcacgatagctggggagtgggcagaatgctacgcacgaaaggacccaggcagccagatcacatgtgaagccacggggcctgccgcccgaccagtggtgaccaaaggctgtttgccctgggcatctgggtctgtggttaagggaaagtaccatccttaagccggcctggattaactctatgaaataggaaacagcccccacagccacttaggggttggggccgactggaattgaatgcacttggtgtgcagtgtgggaagggagatgtggtgaatggagccccaccccactcctctctggggagttcccttggtgaatggggtgaaataggctgctttgtctctaaacagaagacgaggtgtggaaccctgcggtagtgggtcagttcacatgccagtggccgtgtggcaatacaaagagggctgcctttgcaccaggtggcctgtgggagattagaaaatcaacgagctcctcaggagcctctgggtgaccacatctgtggaggacaccagaaactgtccatagtgatggcctgaccctcagaaca

SEQ ID NO: 62960 - DNA, 707 bp, Bovine  19866880586133
acgggtgctatttaaagataaggttggttaagtaaatggtctttgatcgctggggcaataaatatgggtatatttttccatctaaacctgtgtttcttgtacaaaagatgagatcactttttttttttttttaaatttgcttgttctgtgcaggaattggtgatcataaaatgatcttttcctgaaaagtcattgagtttagaagttgggaaaacacccgagaatattaaacctttgtctggagagggcttattgtcctaatattgaatggggttccctgagtgtagtgggagcgacagagtcctagcctctggtgattcttaagaggcggacggaatttggctccagcctgactctttctgtttgatcactgacctgtcagagatggccaggtaagagccccttgtcctgtaactttaggagcattgaggatggaaaaagggagcctttaatgtcctaagtgaaaaggacacacaataataatcaaaaagaatatgaggagttgcagacatggcttttgccagtaagtattcctttaaaacaactctagctttcagttgaatgactaggttttctaattttcaatggcataaccatgggctatatttagtgtatcctcaaggctgctaccaggggcctgagagaacgggccgtttcagtaggtcaggtaggtttgttattttttttaaagtcaggttttaaacttg

SEQ ID NO: 62961 - DNA, 2061 bp, Bovine  19866880600582
cacagtttgctcataaaagtgagcaggtttggtagatacatttaaaagatgtgaaggccaggacaaatcccagttatgtaatttgtgtccctgtaccctccaagcatacactctggttgcaaggtggggagactagtaaataaaatcatgaagctttagaaaagtagaggttttttttgtatcattttttctgttctctgccagtcttcttacagttttgtctttaagtttttttatttataagtattagttgctcagttttgtttaattctttgctacccccatggattgtagcccaccaggctcttctgtccatggaattctccaggcaaaaatattggagtaggttgccatttccttctccggacccagggatggaacctgggtctcctgcattgcaggcagattctttatggtctgagctgctggggaaatcccatagtagaggctaaaaagagggtcagtatgtgtcaagtcagagtgttcaggataaagttaaaggattggactgttggctctttttcccattgccttcaagtgtggcctgctgaacagtggaaggttttaaaactctttcaagtcttagtgctgttgaatatatgcttaaaggtttatatctgacttccaagtcctcaaaaacattttaacggcttgataaggagggctatatttaagagttgtatcgtgttctcagtgtttctttatgaatatgtgtgcttcttgccactgaagactgatttatattttctgtgcctagaaaataatatttgttgaaacaaaacagatgatgatacaagatttagctgattgatgctggcctgctgctgcctgtaggcctttttgtgtgtgtgtgacttcttgattttttttgttttattggatgggattatttacttctagtctgttagactcctgcatctatttctgccatgactttaaaatctgtgtttttaaagtggagttcctttttatatgaaaaacatagcaatatgcatttaataacaggttttagaaggaggtacctgatttgctttgttttaatctggtttgttgtaatcaacctttctttttctttcttcagaggatgttaagcaagtttttggacagaccacaattcatcaacatattccatttaactgggattcagaatttgtgcaactacactttggaaaagaaagaaaaagacacctgacatatgcagaattcactcagtttttactggtgagtccagctcttgtaaaaggttaaaaagaatggatgaataaataaaactaggatcccaatccaaatttgctaaccctggccaaaccatcctatttggaagtatttcttcattagtatgtagaaactatagggttaaacaggctctgatacagcctggaaccatttcatgcttaaatggaatacactctgaggaccctggaaattaagtgatctgctgaaaggttatataaatcaggaggggcgagttggaacctgaactctgggcttatgactggttccactactgtgtccgtgctaagtcactctgttgtgtctctttgtgaccctatggacagtagcctgccaggctcctctgtccgtggaattctccaggtaagaatactggagtgggttgctatttcctactccaggggatcttccccacccagggattgaacacgcatctgttacctctgcattggcaggcgagtttgacttcttggcttatgactggttccactactacttacttaataattttgttatccctttagaaatggacagatgttgtcaccagcatctaactgtagaattatttgcgttttatagacaagacattggatctaaaacttgactgcatattggaatcacctggggagttttaaaaactattattgttttggtcccccacctctagagattagattctgtgagtcaggtgtgtgtttgtatctggggtgaagggcagagagggcttgcttggcacttggagtcttttgaggcatttctgttgtgcggctaagtgtgagaaacactgttcagggcacatgctatccatagcggcgttcagctctgcgg

SEQ ID NO: 62962 - DNA, 1468 bp, Bovine  19866880630426
ggtttttttcttagtgtattctagtgtcaattactttccccagtttctggattgtttctttaacttgtttgactatttaggatgtattgatatgctctttttttcgaagtagggtatcactttgatgatctttatcctgcttctcatatatgttagttgccaggattacagtatgaatagaatttgaccattaggacaaattactactacatcaactcaggacaataaaaattgagagattgttcttattcttccagtactttgtaaagaataaataaaagcttcgtagaggaaaaataaatatgatctttgaaaacgctcctttttccttccaaagtagagtaacaggccctcccataaattctggggaagcgacctcagtgtttactactggaagctcaccagtgctggggacgtttctggagaggaatgttgtggaattggccgtaaaagtgaaatagttttctctcctgccccctgctcgctggcttgaactacacccaagtcaaaagtaagaagaagtctcttaaaagttgtctgtttccctctcacttaggaccttccttagtgattaaaaacgtaacttttaaaccaaatttcccctttaccactctgccagacccagctgcgttaagagccataaagggcgcccccatccaggagggttatgtttgagcctcttggcttctgcccacctatgaaacctaacttatgcctgattggtttgctttttctctccctcagtcatcctcctttaacaaaatttagttaatgaaccgagttttgctagtcctttgctattaagaccatttttttttttcaatatagcaatccatgggccatcaaaatgaaatgtctttatgtctgtgagtgtgtgtgtgatactgtttattcttattacagtattttgtgtatatctagatctgtaatgaattagagcaggcacacacctcactaagaatgccttttccagtctggagtctgtctgaaaaaacagtttcttaagagtagagaatgatcatgtcttctttagcaagtttgtgacgaaattactaccaatttctctgagattggtccctcttcatacttacgccccctacataatcctcttagataatcttcctaaaataaaatatatcacaatatataacagtgtttgtattctgtggaatcttaatgggtgtttttttaaagccaggagaagaggttccatgatttaaaagcaatacagaaaaagttaaagtgaacaagtatttttacccgagaggccttttaaacttattcttcaggaatgggctgatttatgccatgcagaggtccccaaactcatctggatatggaactcatttttacccagacacgcaggagaacagtattccttggaatatactcttggaaactctgacagacaccgctccacttgctctcctaatcacttcagacacctcaaccctgcatttcatggttt

SEQ ID NO: 62963 - DNA, 1200 bp, Bovine  19866880644146
tgctttctaaaaaagcgccagactagaggggacaggtctttaaatggagtttctgttctcccacaaggaatcttccaaatgtgaagaagatcttaagtcctgttcacaaaggcagttttctgagagataacagcaagggaagtaggaagaggggcttagtaaccgtgggtataagttctcattgtggccatgtgattttcccttgatctttcagaaccaagagaaaacaaagattaaaaatatcagctttccaggaatgtctgaacagtgagtaaggcatgtaaatcgttgaggctagtagatgcacaacaaaatttcttcctttccttttcctcccaaaatatactcttggtccattgtaggaggcttccctggcagccttactttagcagcttcactcacctgtagactaaaatacaattacatgttccagggaacactgcctgtggttgccatcttattcagttctgttttgctcctctgagttcctctaatttggccatatgctaaagagatttaaggattcagttggctactggtagatggttggtattttaaacatttttgttgctacccaatagactgaataagagaactggcccctttccaaaggaaaactaaagaaaaactattcaatttactatgcagatgcttcaaagtgatttagagcaactactccacagcctgactttccaaagagaaagtcatctttacaacaagtatgactgactcatttatccagaagataaagtgatttgttctcttgtggatggggaattcggtttccttatttacaaggaacaaggtcatagctgaagatgctgtcttccaaatacaaaacaaatttgtagagggtgtatttcactgaaagccacccgtatgtaatttatgtataaattacataaggggggggtggggagaattatagggcctgtaattgctttccagggtacagaaggacatttgatttttttttttttcccttcagcataattcagaaggaagtgataccccagggagccaagactgggttttctttttgggcaagaaagacattttctggggaaggaaaaggtgtgtcaaagtttggggaaggtaaagaagatttctgccattgaaccattctgcatatgaagcccagggtataagcagtctctgatcatcaggtacctttctgcacacaaagatatcagtataaaa

SEQ ID NO: 62964 - DNA, 1234 bp, Bovine  19866880662787
ttaggcccagtgcaacacttcaggcagtgtctgtgaaccatggctacatgctagagtcatcgggaagcttgtaaagaatagtgattccaggatgttacaccagaccaattaactcagaatctcctgtctgggcaccgacattctttcaaagcttcccaggtgactgcaatatacagctatgattgagaactcttccatgctggaatgtgcccagtaactatatgctaaatgaataaacaaataggtgaacaaatatgagattgcacagagactccaaaaacagaaaaagtaatggggatactgatagcaagcagtgtaacagaaaataaagatgtgagaaaacagagtacagtcagtggtaaagaatccgcctgcaatgcaggacaccaaggagatgtaggttcaatccctgggtcgggaaggtcccctggagaaggaaaaggcaacccgctccagtactcttgcctgaaaaatcccatggacagaggagcctggtgggctacagtccacggggtctcgaagagtcaaatatgactgagtgtgcacatatacatacaaaggggaaaaaaacacatttagcaggaagagaatcattagagtctggaagacaatgtaggtaatttaatcacaaatagttttcagaaacatgggaaaaggaatttgctggcaacatgaaatcagactcttaagtacctgaccaacctgagaaaaataggtagagagaaaaccagtgcattgaaacccaacaaagcttcagtgtaccagtccttttcaatcacttggaggaaaaatgatgtgttcagtacgtcctccttctccatgtttgaacctttaagcagggtatttggattcacagactgaacccgactcagattgtttccccttccagcacactgctgtacttcttaaatgacaccaggcttccaagcaagattgattgtaaactcgaaaaggttacatgtgatgtaatgaataacacatgctattccctcaagcgcatctctggaatgacacacaccaaggatcctgcaagctttcgtagtttagaaaagattgggaagagatctcacagacaagtgccaaaagagaatttcctattatgctcacttaataaactgctctatcttgaattcattcactcaatgaatacttaatgaagacttaaaaactgtttttggagttctataaatgtttgtcgacaaatggggagatgaatggatataatgtgccaatc

SEQ ID NO: 62965 - DNA, 1640 bp, Bovine  19866880698927
tcttgttccccagaacattcacaagagagccagtcttccatgggctacaacactttaaacttttaagtctctcctatagtcggcctccttgtatatggtcccagctttcatcatagttcgctatcttttcttcatctccactccatctgggttccagaccctggcatgggctagaccctccagtgagaaccaggcagaactagccttggcactctgtgctgggggatagactggaatgcttcagaatctgcaaggtccctcatttttgaaatgaagttttccatgcaggtttgaagcatcaaggcaaaacagggctaagcactttggaaagacagagcccgaacaaagccaggaagtgtgaaaatgggaaaatgcagatatattttcctttctcaccttcaacagacttactaccaaaacactaactattaattaaatgttccacccttcgagtttcctcccagtgggggcaaagggagcaaagaatacttgctaccaagatatggctgtggactactttaattttgtgccctacaaggggggctgagcccctggggtacctcatgtttgttaacaacttcatgacgctcatgacatgaatgaaggtccctgagtcagcccggagaaagtcagtgctttttaataagcaaaaacattgaaccaactagaaagacagttttcatactgttctccatagaggaacggaggagtaaaatttccatatgtgaactcaacaagattgaaatgagatggtccgttgtttgaataaactgagggcatgcagctgagtttttccttggcagtcctttctaacagcctgaataaagagcatgttaaattacctactttggggagaaagcccgtggaatatttcctcaggaggaggagacaagtggatttaaaacatatcatgtttttaaaggactaagtttttcctgcatggaggcatggtataaatattactttaaaaatgccatgtttcctaaaacacagtggtttccccaatatataatatgaatgtaaacaagatgcctgtcaagcatggctataacatactgcttaccacaccaaacttgtaatatgcacttattagtcttggttctcttaatgaaaggaactaaggacactgcataaattcttcaacacaggtttcatttctccagctgccttgtgctgtagaacatcaggctaacaagaagtgatgctaacaagaagctaaaaccagtgtagcaaatggggcatttaaaatatatataaacataccggccttcacaaagaaaggagctgtttggggggaactaaatggatccctagacagacatattttagtttaatattccatgtattttcctacatgcttactatgtcagttcttctcaatggcagaaaaatgctctgtgagagaacaagaagctggcctgccattattccccggcctcataatctccacacaaccatttttggggggaagggtagaaggtagccacctgaattcgccaactttcttcggtcactttagggccattctcaaataccaatatttgtagacagcagctaaagaaaccaaagattggactgcttattctaaacaaaccatctggcagcttgtggggatttggggaagctggacattttataca

SEQ ID NO: 62966 - DNA, 1179 bp, Bovine  19866880705202
acatatgattttacttactattagtacacactgaggttgagcataaaatgttttttcatggtgtttagtttagtgtgtatgtactgaatgatacccagaaacacttaataatttatatgattattatattttgcccttttacttacttatactgatacacacacttgccattttattgttcatgggataatttttattgttaagtaattacggaaataaatgaaaatttatgttaatataaaagccaatgatggaattaaaagatgaacgatttataaaaggggatctgatactatctttatttatatgtattatttttaaagcttttattttactatattggatatcatgtagttttacagacaccctgggattactctgaaatgtatggaaagcaaatggataaagaaaaataaaataacttatcacatgagtgacgtataatgacagaataaacatattatgtaccaagttaccttcaacaaaaataaaagaaatagttcaacatccaaatcctgaataaaatgagatcgtggacaagtaaccaggtatgaatgagttggaggaagggtgttgcagtaaagacgccgatcagcaatgaaaccaagatacacaacagagtcaaagaaatttaaacatgttaattagctgctaatctgccaccgtttcaagttttcctttaagtttcccaccgagcattctattttcatcatagaataactctgtgcctggggtggttatgaaattcataaccagattcacagtatttaggttggcagagagaggctgggattcagcaatggaaatgaagcttttcttcttcatcttgtgatttctggtatttaccagtggtaactcatttaacaagtgtaagacactctaacagtaatgcagtgggttaggttgactgcagcatcagccagtaagcagccaattgctaaccactctacaatctgtcctcctatctccttccagccccctcaattccaaaaataaatacacctgagccataagccaaagcatttcttaaaacataaaaacaaaaggagatgtaaaagaatagtaaacgctggacatggtatatcctacacaagtcaaatctgaggctatattaaaacacaaagcactctaaagtacctagagggggctctggcgagatcccgatgctttgcagcaggg

SEQ ID NO: 62967 - DNA, 1549 bp, Bovine  19866880764129
tactagggctatgctatacaacatgatgatgaaagctgacacttatatgacatacaggaaaggtgctaagaaagtaaagcccaagagttctcactgcagggagaaaatgttttttcttttgtttttattgcatccatatgagacaatggtgctagtggtaaagaatctgcctgctaatgcaggagacataaaagctgtgggttcaatccctgggtcaggaagattccctggaggagggcatggcaacccgctccagcattgcatgggaaatcccatggagagaggagcctggcgggctacagtccacagggtcacaaacagtaggacatgactgaagtgatttagcacacatgagatagtgcatgttagctgaacctattgtgaagatcatttcacaatatacgtaaatcaaaccatcacgctgtgtacattgaagagtgattgctgtgcgcattaaggagtgatacacgtcaactatttttccattaaactaggaaagaggactaccattctgctagcttgtgctgagaaataaaaaagaagtccagtaaccttctctgcaaatgagcttagcaacttttattgatccctgaagcaaccacatcagagcccattatctttcttctttctattcagggtggagagacccccctgagggtagggtactgagctcctcccagttctacagttttcctgaattcttgttgcttttgtcttctctttcgaacaaatcactagtcactaattggacaaaatagtttgggccaatgacagcatcatgccaaacagatcatctccagagtatcatcccaaaactttctctaagtgccatttccaaaagcaatacactgaataataaggacatttagaaatccatcatatcactcaatctttcagaatcattgatgttgctccccaatctcaaggatttccttactttggatgggcagtgatgatgataaagattttctgatgtcaggaataaaattggaacaatgaagtatttactttaaccaggctctttttaaaaagcctctttcttaatttactgtgtgaaaaacttccctccattggccaacagcaaaaccctaacctggagctcagacatgggccacactaagccacacagaagtccatctgagctgaatttaaaaaaaaataaataagacttcctctcagagagcaagcgtgtatgtccccagatcttgaccacagaggacctgtggtcaagcaagcagtctctctagaagttcagcaaccccttgctaaaagcagatgctccaactgttactgtaacccttatgggtatccacagtgctctctgcctgagacacagtgacaggacagcaacagtttttaattcatcagtccatgtgctacataaagagaaaacccagtaatacacactttattttaatttccaaagagactggcttctaatcagcctgcaatccactgatttcagtctccctgaagtccaattagctgggagcgtctgtcaactgctctttacataaagatcattcaagcaattccatatatacaaaat

SEQ ID NO: 62968 - DNA, 1412 bp, Bovine  19866880777338
tcatcctcatagaaattttagaaatcctgaaaattacgaacaaaccattcaaatcccaacaatttcaagaaaatcttaggtaacatatggtgtatttctgttcagtctttttgctgagtatctttgtaacatagttacaataaatatgcatcatgaaagactgattatagtttttaaagtttatcttttatgatttaaaatgggaaatatgtctgaaattataaaatattttggaaaaatagataaaatatggcactacccacatatgactactaacattttggcatatgttcttacaataattttctagggtattttcttaagttgttatatggaatatattgatttgggcttccctcatggctcagcaggtgaagaacctgcctgcaatgcaggagatgagggcttgatctctggttctggaagatcctgtggaggaggaaatggcaacccactccagagttcttggctggagaatcccatggacagaggagtctgacgggctgcgggccatagggttgcaaagagtcagagatgactgaagcgactgagctcacacacacatacatatattggtttacagcagaggtaatacagatattcacagatcctagactgttgcagaataatttctaaggaccaataatgtgctgcctatttcattttaccttagtctattcctaaggctcaatagaataaagcattatactgcaccatccattaaatttgaaaactccttttattgattttttaattgattttattgatatgagtgggctaatacttaagatcaggttgtcaaatcagactcatttgaaggatgcttctgcaataacaaactttactgatagttggaggatatgggcaaccaagaggcatgggcagagcagacagaagtctggggcaccaaaggtggcttcgtgggtcctgtcaccccacatcagatatgttctctctgatctagaataatagatgacatttcagataatgttttgcagtttacttcacatagcatgaagcgtgcttaagttatgaaataccttcattttatacttcagaagagttatataacttatgtgagattcttcagggaaccctgcatcatagatctatagattctgggtttatttattaagtaacccttagcaaggacgtcgtgctaaggcattctgtgataagagcccttccctttagcaaatattattagtctatttatctggagtttcagttgacaaagagattagactggattaacctgcctttttctcttccccagtgtagtttctcttaacacccgcaaagaaagtgaatgaatctctgaccagctgttgaaattctttcattctcaataagcaataggaaaagagaaaaaaatccctacaatctagcttctcattttccacccctaaatc

SEQ ID NO: 62969 - DNA, 1487 bp, Bovine  19866880858740
atggaccatagaactcagaagcaatcttttcagaaatataattttttttttaatattggatttaaagtttacctttaagtagatgatagcatcagttccgtatcctggcaaagagtagagatttagatctccttgaaagtacttggcgtagagacgagaaattggtaagccgtaaccaaaaccagcctggaagggaaagatcagttactgacaaagaagtgaacacaatcatagaaatacaaaatgtattccctgatactgatgtcctagaacttagacacatatcttctgcttccaatcggaaaccccttggataactgtttcttagttggctttatcattccttctcatatcccccatgcccagtttaactaaactgattaacttgcctaaatacatcccttgtaatccttcctctacatttagaactaggtggctggggtgaacttagcccatttagttggtcttaccagcggagcattccgggaattatccatcacaggcgttggtgcagtggagtacgtgtaactgaagagacggtcaatgactctcaggggaacaccaccctcctctgtctgaaatcttaaacaaacaagtcatcagagctatatgctaaaaacaatgtatatttgtctatacaaaaaatgtcttgtcttcacctggtatacatgactttgatctgtagctcaaagcagagagctttattattattgactcctttttaaaaattctcttaagaaggactcaaaagacaaaacagaatagttaccttaattgtaagatcttctttccccaagacaacaatcacctcaattggtgtcagagaaggccagttttgctggtgttcaactgtggccctcattgcattctaaagaaaacaaaaccacaaggtattcaatggcagaaggatgagggacaataaataattgtttttatgtttaaaatgaaagcacagagggtaattcaaagttcttattttacttttttaagttaggagtaaaatagctctgtgaatagccatttatgaatgtgtcatgcaggatgtataatgaaaaatattcatttatcatgtaatatagctcttgggagtaatgtctaatggaaaaacaattctgctagctgtcaagttcttatttgtaagcttaatttaaatgtagaaattggtttttatagtccatttcctggctctttcttttctgactttccattacattttacatcttagcaccaaagactattacataacaaataaacagtgaatcattgaaccaatttattggcttttataaaatttgatgggaaaatgctgttactatgttaaaggatagtaaataattctaaattaaatttcaatttgcatttgattatcatcttaacttttacctatgatggcaaaataactattatgagttgaaccattcaatttaaaagtaaatcaaatcaacaaaaaagagtctttgtcctttaaacagaaagaaacccaaata

SEQ ID NO: 62970 - DNA, 1641 bp, Bovine  19866880926394
ggaagactatctggcccacctaaaactaggatagaggtcctctgtttcaagacttaacagagggacactgaaccagatttaacagtattagtcaccccaggtcactgacaattttctacttggcaccaagactagaaacagagaaaacttgagtactgaaaagaggtatgctgaagcaacgacttggcacagcacacagcaatgctgaagctgtgaacgtcgctcaggcatggccgattctccgtggcccctcggactgtagcccgccaggctcctcagtctgcagaattctccaggccagaatactggagtgggtagccgttcccttctccagggcatcttccagacccaggaatagaactggggtctcctgcattgcaggtggatttttttttttttaccaggtgagctgccagggaagccctaaaagaaaattttttttttttttttggctgcaccgggtcttagttgaggcatgcaggatctttgatctttattgctgcatgtggatctagttccctgaccagggatcaaacctgggcccccagcactagaagtatggcgctttagccactgggtcatcagggaagtccctttactcagtcgtgtccagctctttgcgaccccacagactgtagccccaaagactcctctgtccatggggattctccaggcaatgcgcctcaaagacaggacctggaatcaatagagatttctgaccacagaggattggggcaaagtagataagcccagagaaaaggaaactcatgggagagaaaacctaaggctggaaagtgggacaaaacaaatgagaatgagccagggtggcgacacagcccaatcagactgagtgagtggagaggtgatctgctgaggacacccgtggccagcagaatggaagggcctgcctgccaggtcattctctcacaaggcaatcaagtttccagaagctcaaagctcaaattgttagtgacttcacttggtaattaccaatacaccgaaagcagtgttttgaaaggcagcagccaggcctgtggaatgcctctgaactagattaagacaccaggctagtaattaaactaactttatatgggagaggtctcttgctcaaacttgagcaatcttgctcatgtcaagaaagccattttcgcacaaaagtggaaacaagaaacttttgagcctcaatttcggctcagataccaccgttggcacctctgttctcctaactacaaaactaggagaccgactccttccaaggggtgttaaaggggattaagattatgaaatactatgaagatgaaaaggactgagtctcagtcttgtatcatttgcaggtagtttaacagtctctgcttctgtgtcagcaaacaagttttaacgttttatccatctagacacttcgatagcagccattgctatagcacctaagtgctttttaccagaccagccactgaaagactgcttggcatcttgtcagaatgacatgctgctatatcatgtcaaagtctgcacaagcctaaagattcagaacagaagatgacttttcttccaattgataatgaatactatgcctcatgacaatactgttcatgtcttacagctggatcacaatttggtaaatcgtgttccattgcacgatca

SEQ ID NO: 62971 - DNA, 959 bp, Bovine  19866880960612
tgtcagaaattactttgcattatgtttaaatctctgaattaatttttaaggtttcccacatgacagtacctggaattttcttgagaatgatatgggttgtattcttgatccagctgacagtctctgccttttcaggaatacctaatcatactttctagagaaactggaatatggaacagcagcttgggaggggtgtgcatgtgtatcaaaaggtaatagtaaaaggcatttcagaatctttaaatatacagcgaattctgacccatgaaaaactttgataaattgatttttaacagatccagtcaaaattttggcacaagagagggaaaaagtactttgtttacaaagtcctcaaacatttcttgagaagttgttacctgctggtctttgttctctgccctcaagaaccccgagtaagcaattataggatattttctgttctgtgctcacaactggattttcataaaataacattcctcttttattccgtttcagtaaaattaatatggtcagttgggaaggatgtatccttaccctttggtactcagtgacttgaagatttctataattttaatagcttttacattacaacttctacagaaggttgttcataaatattaagtcaattaaaggacagtctgtaaaatttttatatcattgttgtcatttatatgcaatattggagagaatacattttcataccttctgatcttataaatctaaactttcaatttcctttatgaagtggctacttgatagatagcacagctcccaccagtattgccaagctctgtataaccatgactattttgacttttttcccatcctgggaatttgcaaggtttacttgtgtggtgaagttgaaggcagaccatttaactgtgcctgttgactgaaccagacttgacatttgcttctgttgaggagaaataattggctgccaagccaatatctctgca

SEQ ID NO: 62972 - DNA, 1521 bp, Bovine  19866881002809
taaacagtggcaccaaatgcagtgtcagtgatgaactccacaggctttcctgagaggcctgccagtcagcccccactaaatctccttgaacaaggagcaaggcacggggacatgagttatgtagcttcctggggataatgcaggtcattgcaaaaggaattttgatgctctcagtttaagaaaataagagtcagagctactcgctgctaattaatattgacgtacttcacatataaaaagctgatctctcatttacaactggtcaagcagataaatcaaacccacgtccaggtataggcctcttccctgtctgattgtcaacttactctcctacccaccaatcaatgacagttcaactctaccctggtttaggaacacatacagtggtcctgccagagctccatccatgccgggttaggagatacagtgttcatgaagcctgcccagctcgtccgctacagagcccatgttctgaatttgttttccattagtgacattcccttacaacctatctacactgcctgatccatcttcctctctcctctgcattgtagcacttgctcgcctgcagttctccagcttcactatcactgaaaacaatcccttcacatcttttttttctcatcctccaattacccctacctgacaacagaaatctcaaagttcaaatcagccactccaggtactctgaactctatacccattcccaactcctcggacttttgtcaaacttccactctctccttatttccctcttttccctggtttgccctttatcccccttgtttcactatgactcatcatccatcctcccagacgtctcagctcttgcagcttgtgtttcagcccattttggagctcagtaaaccaccatcctaccatccaagtaaatgaatcaatcagttcagttcagttgcttagtcgtgtccgactctttgcgaccccatgaatcgcagcatgccaggcctccctgtccatcaccaactcccggagttcactcagactcacgtccatcgagtcagtgatgccatccagccatctcatcctctgttgtccccttctcctcctgcccccaatccctcccagcatcacagtcttctcgaatgagtcaactcttcaaatgaggtggccaaagtactggagtttcagctccagtactttcttcctccaaagaaatcccagggctgatctccttcagaatggactggttggatctccttgtagtccaagggactctcaagagtcttctccgacaccacagttcaaaagcatcaattcttcggcgctcagccttcttcacagtccaactctcacatccatacatgaccacaggaaaaaccatagccttgactagacgaacctttgttggcaaagtaatgtctctgcttttgaatatgctgtctaggttggtcataactttccttccaaggagtaagtgtcttttaatttcatggctgcagtcaccacctgcagtgattttggagctcaaaaaaataaagtctgacactgtttctactacaa

SEQ ID NO: 62973 - DNA, 2761 bp, Bovine  19866881037839
tgaatgtttgggcataaaagaggtatttgtataatgtagttcatgattcaccgtatctatagtgtccaaaaaaagcataatgaaaaagaagcatttttccagtggtttaacaactatttgagtcaactgttaggctttcattatgactagtgaccaactgctcacttttaaaagcaaaggagagaagagtaactggaatagagattggagaggaagaacaagcactctttctaagtttatgttctacataccttttccccatgcaaatacagttattttttcctggccatcaatctatagacaagttggaggctgccgtctgagcacttcacacaagtacgctttttcttaacctccaactttcacctgtgaaacattcatttacctgtttattactattgagtgcctgtatgtgccaggcactgttctaggccaggttatcctgttcaaatagatgacaataggtgagtatctatggacctgtagatgtggctctctaaaggtcagaaaaactctagtgaggaatgtgataaaccagaggagggctgccagaccgatgaaaggttctatctaaatgttgcaaaagtactggccgaccgtgaggacaaagatcagagagaattccgggccactgatcagttttatctgccagcctaaaaagtaagagtgcaaaactgctcctacagtgttaagctctgatattccctaaatgataaataattcatgttttaaaatggaaaagatgttctgatagctgacagtctcagaaattcatgcaaacctttcatgaaagtggaatacaatgattcattcacttcctcactttgcaagtccagcctacatggcatataaatatttatacacaaacttgtataggcagatattttatttcatattctatttcagatataccaatagtaacacacatacttacagaagaaacaaataactcttcatttctgtacaggccagtgttaatctagactcataagactggagcagtttcatgccgtgatttgaggctactgttctaggcagtaatgtttcaagataaaatttagcagttttgaaattctataactaaacacaattttgttagacataaaaaaaaaattaacactataattaatgactgcctcagaatccaaacggctattgaagatgacagtttgaaaccacagaagaatcataaagatgattaattatacaaactaatacttgtttcagaaggtttatattcagagaccatttatcaccaaaatgagaatatattaatctcattgaatattgcaaattactatgcacacattaatttggtttttataaaattagatattagggttttcttttcatttagtcaagtactccgtaaaatataaaagtcataagtattttcttatcaattcagaaaaaaaagtggcttgaaaatttataaactaatgctacctgaataagcacactatttatataagaattagtttaatcatggtctttaacatatgtaattatcaaaatagacccactgctactacatttactataagatgaatacttataacattaattgaaatagcactttctttttaacatacttttcctagaaaaaaatcatgttaacactaaaattataatcatatattttaaccagatgattttatttcaaatacatataatttattatgacaaggaaatgaactaatatattatttcaaagtagcttattttatgtaattatatttattagcaccccaaatctgtccatacaaatatgcctttgtgctttttacttaactgcacaggtttgtggctaataaacattcaggttaaaaacactaagtatctggattttcagtttttatctggatttgggcatcacataagtcttttccatggagggaaaaaccaaaagaagtgtttagcattagcgaaggaaaaaacactgtttaacccatggaagaataagctagcacttaaaagaccttctagagtccagaaacctatggccacactcgtttaatgagaaacacaagtgttcggggcaattataactggactccggtgagctgagcctagctcagcccttccctcccctcccagatgctgccagaactgagccacgctatcgggctcctcgtcggcagaggataatggctttcataaagcacaataattaaatcgactgatttcaagtgcagttctttttcattaaggaactcgtatttgcatcaacccccaaatttcagtttaacttcgtattttgtcttctgcatgccagccttccccacagagggggattatttatattcagggcataaattcctgtggaaaagggatgtgggccctgtcctactggaaaacgtgaagtcattccacgaagcgaacaattattgcctcagtgtaatccacttaaaaaccatacgtgtattatttagtttgcgtctctcaaacactcttttaactcccaacacgtccagtttatcaggtgctactatgctgaacagcgatttaaagtacaagggaaatggctcacggaatccctctttcttcttgctctagctgtctgtgagaacggctgcaggcactttttatagcccctgtacattacaccttgaccaccattctaaagtatcttgcataggtcatttttcctactgggattccaagtagaattttcattccagtttttaattgtagctttaaaatagattcagatgaacgtttaaaaccacgctttagcgactgcgtttgatctcatagtctc

SEQ ID NO: 62974 - DNA, 2532 bp, Bovine  19866881095129
aattttaaatgacccatcaggtacagtctgtaaaaataagatttatctactttttcttaggtttgcaaccatatttatcattcagttcagttcagttcagttcagttgctcagtcgtgtccgactctttgtgaccccatgaatcgcagcatgccaggcctccctgtccatcaccaactcccacagttcactcaaactcacatccattgagtcggtgatgccatccagccatctcatcctctgttgtccccttctcctcctgcccccaatccctctcagcatcagagtcttttccagtgagtcaactcttcgcatgaggtagccaaagtactggagtttcagctttagcaccattccttccaaagaacacccaggaccaattcaaagggacttaaatttaaagccttatgattattaagaagaaaaaattataaactaagaaaacttcaattaatagaaacactaggtggtttgaactatagggataacctaataagcttgtgaattttaatggtcttgtctttgaaactgggagctggatagatcatacaaaatcatccaactcaataaccttctgcagaacaggacagtcatttatataacatgaaaattaagctcagtgtgtccatttcttaccagtgaacgttcctcctccgactctgacccttcctgtcgcacagacactgttctcctggtgtttctctagagcagatgaagctacagccaagccagttgagctggaaactatagcatcacctttgacctacccctcatccctgaggcttccagagtttgggccagacactgcaatactttaactagtttctccaggtctttttactctccattctggtacttgtcaactctaacttcatatgagaattatcaggagaatttttaaaaataaaaagtactcatgcctgggccccactcagagcaacaggattggaactgctgggggtgcagtccagacagcaggcctcctgaagatcctaaggcacagccaggattgagaatcactgctctactccaatccagcctccaggtcggctctacacagtccagctgattatgcttagaaagtttaaacaggttcctgtttaaaaaataaagcacacacagcaaacaccgacagttcccttttgcccatcaaagcaggccccaatttctcagcatacctttaataagcatctccagacctatccttcacctgtccctactgttatcatcccttaactttaagctcccctcagatccaaacttccccacatcagctcctttgttcatgctccagcctccatctgggactgcctccttcctccccacttgggtttcacccatccttccaggacaatgtcaaatgtctcttcctcctgagcttcaacttcaggagttgtcatttttcctccttaagcctataggggttggtttgtacctgtcctgaacatcctgatcgtccctgtagctcagatggtaaagaatctgctgcaatgcaggacacctggcttcgatccctgggtcaggaagatcttctggagaagagaacggcaatccactccagtattcttgcctggagaatcccatggataggggagcctagcgggctacagttcgtggggttgcaaagagtcgcacacgagcctaacactgctacactgaacatcctagtttatccgtctgtcttatttctctccttccctttaatagggtaagaacggtgccttgctctattacaggagcctaagagagcacagcatacagaacagatgctcagcatttctggaattctttcgcgtgaggcttatataatttgaattgataatttggagactgtgacatctgcctaccgcgtttttttttaataataagtaaaatgtgagaaggactaggcgtgtcctgtttggcattctggcttcacggttcctggacgaggagataaataaggaagtgatgtaagaacagtagctgaatatttcaagtatttttgatctaccgcgccaagattagagagcggaagaagcttctccaacgcggcaggggagggatggagaacaactttgttagagacagaggctggtttgggcaccaaagagaagcaggatccgtgacctgaaataaatctttataattaaagtttcagtgcatgagtaatagtgttgttttcaagttaaagcacgaggtttgcccttgagtaaattgcacggcactcgcacagctcgtcaacctaggtagcaaagaactttgtgagcagcaaaagcttgtaaactctccaggaagtctcgcgatccagcccaaactgtgtggggttttgcgagcggctgggggtggggtggtggcgctcggcgggccagggagcagagccggcagagagcgtccccggccccgggccccagcacgagggtccccgcgcccccgcagccccggcatcccgaccctgcggaccagggagggcccccagcccctacctgagcgccaggagcctctcgcccagcagcgccagcgcgatccccagcaagctcagcgccagcagccg

SEQ ID NO: 62975 - DNA, 1088 bp, Bovine  19866881172303
caagggcataggatatctttccatttctttgaatcatcttcagtttcctttatcaatattttataggtttcagtatatagatctttcacctcctttgttaagtttatgcctaggtattttatatataaatatgttttatttacatataatttttttttttttggccgcactgcacagcttgcaggatcttaattcaacagcctgggcttgtgaaagtacagtcataaccactggactgccaggaaattcttcataggtacttttgatgtgattttaaatgtgattttttttttttttactttcttcttcagtatatagaaatgtaacagatttctgtattaatttaaaatgagtttcagcaaatttaaaagtttttgataaaaatataccctaccatagaacttacatgtgacttttttcccatagtggtggaaataacagtccttaaaaatgcagattcaccctcataaaatgtttcaccatattctaacatagctcgctgtcttttttatctgtgaaactttcacttaggttgggaaaatattagaagttttctttcgattattttgccaaacattttcctcactagaaatgttagtttgctttgcttgattagcacaggatgaaaacaaaattgcttctagaaacttaaatttatctacctcactctattacactttttcacccagctgacaataaaaacaagatcatcgtaatgttagatttagaaggtgagctgtatattgccccgtttttagaattaaatgtcactatcaggaagcactttaagtataatcttagcttgaatgtgtgaatgtgtattcacaggttgtatccacacccaaagttaataatttctgccattttaataattgtaggtaagaccaaacaggtgtcctaacaaacaagaccaccactcttttcattttaaacagcatctgtctggacagaatcgtgtccttcttacccttggcagctcctaactcttctcctgagcgcaaacgcatttgaaactctgtctaggagacttttaatccagtaatgccttaatcattaagcaagtgaaaaatctctgtcatgtttcatag

SEQ ID NO: 62976 - DNA, 1534 bp, Bovine  19866881209044
gatgaggagacgcccttgcacacggctgcccactttggcctccccgagctggtggccttctacgtggagcacggggccatcgtggacagtgtgaacgcccacatggagacccctctggccatcgcaacctactgggccctccgcttcaaagagcaggagtacagccgggatcatcacctcatctgccgcatgctgctggactacaaggcggaggtcaacgcccgggatgatgactttaaatctccgctccacaaggcagcctggaactgcgaccacgtgctcatggacatgatgctggaggccggcgcggaagccaatctcatggacatcaacggctgcgctgccatccagtatgtgctgaaggtcacctccgtgcgacccgccgcccggcctgagatctgctaccagctgctgctgaaccatggggctgctcggatatacccgccacagttccataaggtgaggctgccacgtgcagaactgggcggatgggcagcagggtaatggggactcagagggtggctcagtctgaaatctccaagtcactcaagcctgttggaggcctggctaactgcctctgaccttcgatctgacctttcattttgtgtatctacccctagctatctcagcctagtccacgtttgtttgaaatctgggctgagagcagagaaagagcaagaatagcaggtaattgtccatggcctgtgtgaacaccagtgaactggtagtggcttcctgggggactgaatgggcaagatcagaaggatactgtgcctctgcagaagcggcgaaaggcgccacactgcacacgcggctcttccacagaatgtctgcctatagatgacagagcctgctttggaaccggtttgaatacaggaaagggcggctcagttttctactttaatgaaaactaacatttattaagaactaatagttaatatttattatagataataaattatatttattaagcacacttataagtcatcttacatttcttaatttaatccatttaattctgtaataatctgataaggtagattatattattattctataaaggaggaaactcaggcacagaggagttaagcaatttgatctcacacagtggcactgtaggtattcaaccttagttcacttggtgctagtctttaattttataatatactacacaacctttattttaaatagtatttattgataatttctaatgggctgctgctgctgctaagtcacttcagtcgtgtcagactctgtgcgaccccacagatggcagcccaccaggctcctctgtccatgggattttccaggcaagagtgctggagtggggtaccattgccttctccgtctcatgggctagtagggaccaaatattaacaatattggcaagattaatacatggtcactactctcagttagcttaggatctagctggagagacaaacacgtaaagaggtaactttaatatttcatggtaaatgacgaagtagaggagtgaagggttctatagcgcagggagagtttagcattaagt

SEQ ID NO: 62977 - DNA, 1067 bp, Bovine  19866881216359
tacacacattgctttagaaagcaaaataaggacaacctggggtttgctggagaagctgcccttgaggttagacatgtacagttaaatttggagtcaagctgaggtcactgctaaagagatttggagttggaggtctgtgtggaaaatggttgcctcgtggaagctattcactcaccaataaaactcattttgaatgatatcagagcaggaaaaatttaagggttttaatccaaaaacaggcttggacttttcttgaagtcttggttttatttggaaaggaggttctatggtatttaatctttgccatccaacctctatttctaaaagaaatcctagtaaaaattgaatgagaagttttattgggaagatatacaccatatatcttccataggaatttcgttgtaaacatgtaggtaccgagctatacattgttaaaagaatgtccgtttttacttcactctgggtccctctggacttccctggtggatcagatggtaaagaatctgcctgaaatgtgggagacctgggttcgatccctgggtcaggaagatcccctggagaagggaatggctacccactccagtactcttgcctggagaatcccatggacagaggagcctggtgggctacagtctatggggttgtaaagagtcagacaaaactgagtgactaacacacttacctgggttcctccagacaaacagagtatattgtattccctgttttaaattggtatttaaattttaatattaagtctttactttcctctttggctgtttcttggaggtagaggaggggggaaaaatgggacagaaaacctggcaccctgtctttttaagcgaccacatcagcttggatgccagtgactggtgacagaaaagccaggctaagtgtgttggagccttcaggaaaggcagtctgctgacatggcagcagctccatttctagctgatttgaggcccagataactatccctttcagcttaagtgatgcttggcagtaattgaccaatacccagttgggtggagcagagttctttggaacctgttcagaccagctctgcctgc

SEQ ID NO: 62978 - DNA, 2033 bp, Bovine  19866881245964
ctcctagaaacttacgagggacagttttaaagagtgtgtgtgtgtggtgacggggggtggggggtgggtcgggggaaggagggtggtatttttattattactacaggaaaagatactgggtcatgtcttgtaaatatatattggaatcactatttttaataacagtatatagatgggaggagggaaacatcaattttctaagtaatgcttcatccagactatgctgtgctcagtccggtcactcagtcgtattcgactctttgcgaacacatggactgtatgtagcccgccaggctcctctgtccatggaattctccaggcaagaatactggagtgggttgccatgcccccctccaggggaatcttccaaaccaggaatcaaagccaggtctccagaattgtaggctgattctttaccatccaatccaccagggaacaagtgagtatggctgaaataagcttctgatggttgctggttaattgtcaccctacattatgtaggcagaaatggtcacaattgcaaattttcaacagacataggtcttattaacaacgagtaaataaaagcagatgccagtttctcacctgtaatacaccccaggggggaaaaaaaaaaaaaaaagatcccgcatttcctgtagggcttccctagtagctcagctggtaaagaatccgcctgcaatgcaggagagcctggttcgattcctgggtctggaagatccgctgcagaagggacaggttacccactccggtattcttgggcttccctggtggctcagcaggtaaagaatccacctgcaatgagggagacctgggtttgatccctggagaaggggacagctacccactgcagtattctggcctggttgcaaagagcaactttcactttcacttttcagtttctgtatgtgagtgtttctgattccgtctgagagatattaagttgtgttgcatggtagatagagagttacatagttgtcctttgaaagcccaggagggttaccttttgtgtgtgtgtcatggacttctctggctgtagtgaaactatagctactttcctagaaaaatgtttataagtgcatacaatgaaagtactagttgcaaaggaggtcaattacattcaaaagaaatcatcaaagtgttctttcagaagtttgtgctacagtagtatagcagtgtaatgtgtgctgcattgttaacacattaaatagcaaggtgtagcactgttctttcaagtagtaatgagcataaatgttgtttcaagaaatctgtagcaccataatgaaatactgatcataactcttatttccattagtaacaaagtcacaagtattgctaatgcttctggaacttgtttcctactttcgtaattgaaagcaatccttaattccattagaaaccaagatactttcccctcattcaagatcacaaaccctccataattctatatatggaccatctggatgaagaatgtgccatagttaccctatgactgggtgggatctcttctttagggagttttttttttttttttttaattgtctgtttgaacacaaataccctgataccgtgcttttttgtttttttggttttttaatttttggctgtgctgagtcttcgctgctgcacaggcttttgtctggttgtgcaagagggggctcctctccagttgccatatgcaggcttctcattgtgatggtttctcttgttgtggagtatgggctctggggcatgtggcttcagtagttatggcacatgggcttaatagttgtggctcatgggcttagttgctctgcagcacgtgggatcttcccggatcagagatccaacctgtgtctccctcattggcaggtggattctttaccactgagccaccagtgaagccctaaggaggtttttaatgacagtctttggagaagagaagaatctcatatgtgacatcagaatttagaatgaagacctaaaggagaaggcctgggcctatggccagggcttctgtgttagtttggagagcattatgccaatgattctgg

SEQ ID NO: 62979 - DNA, 1436 bp, Bovine  19866881320086
ggaacctctgggaggaacatgtttgaaaagcacagcacttttcaaaataatatcatggcaggcttcccagctcacagccacaacatcctgtggaatcaacaaagcaatttaaaaagccccaaactcatcatctccaggggagacaccccttcctctcagagtatgaatcctaccatttgttctttcaattagaacaattctgtggaggtggagggcaacaaagcttctcttcctagactctagaatactggtcttcttagatcatgacctagacagatctaaaacaaacatttcaccccctaccatctcactaatcacaagcaggcttctttctgtattttatttcattttaatgatgattatgacccgcaatggcaccccactccagtactcttgcctggaaaatcccatggatggaggagcctggtaggctgcagtccatggggtcgctaagagtcggacacgactgagcgacttcactttcacttttcacttttatgcattggagaaggaaatgacaacccactccagtgttcttgcctggagaatcccagggatgggggagcctggtgggctgccgtctatggggtcacacagagtcggatacgactgaagcgacttagcagcagcagcagcaaggacctaacagaagcagaagagattaagaaatggtgataagaatacacagaagaactatacaaaaaagctcttaatgacccagataaccatgatggtgtgatcattcacctagagccagatatcctggaatgtgaagtcaaatggggcttaagaagcatcactacaaacaaaactagtggaggtgatggaatttcagcagagctatttcaaatcctaaaagatgatgctgtgaaagtgccagaaaatttggaaaactcagccaaggccacaggactggaaaaggtcagctttccccaggcaagaacactggagtgggttgccatttccctctccaatgcatgaaagtgaaaagtgaaagtgaagtcgctcagtcatgtccgactcttagcgaccccatggaccgcagcctaccaggctcctctgtctgtgggaattctccaggcaagagtactggagtggggtgccattgccttctccgaatccctaagaaaggcaatgccaaagaatgctcaaactactgcacaattgtactcatctcacacactagtaaagtaatgctcaaaattctccaagccaggcttcaacaatatgtgaaccgtgaacttcctgatgttcaagctagatttaggaaaggcagaggaaccagagatcaaattgccaacatccgctagatcatggaaaaagcaagagagttccagaaaaacatctatttctgctttattgactatgccaaagccattgactgtgtggatcaccacaaactgggaaaattcgaaagagatgggaataccagacca

SEQ ID NO: 62980 - DNA, 2527 bp, Bovine  19866881353648
tgggatgaattgcacttctgtggaggagcagaaagtgtgcagctctgcatcagcaagggtctcacacctaccgatcccatctcaggcaaggcccatgttgtcatgaggtagcatcaggggcaggtggtgtaggagatgaaggcataaagatctcaattctgctcagtcactatatggttcctagtgctggactgtaatcatttaacttttctggcccttaatttcctcactattaattggagaactaaatgaaaaaaaattatagaataatgtgtctagtaggatcccattacctttttttgttttgataatattaaaaacccctttacaggaattccctggtgtccagtggttagaatttggtgcctgggttcaatccctgattggggaacaaagatcctgtaagttgcagcccaaaacaaaagcccactcccctgcaaaattcctttattaccaagaggaggaaggggataggatgaattgggagattgatattgatatatatacattgctgctgctgctactaagttgcttcagtcgtgtccaactctatgcgaccccacggacggcagcccaccaagctcccccgtccctgggattctccaggcaagaataatggagtgggttgccatttccttcttgagggcatcgtccccacacagggattgaacccgtgtctcctgcattggcaggcggatatttttctcactgtgccacccgagaagcccagtattgttattacctattccttaggactattttaaaatgttggatgagaagagcaatatttccacattctcagtatcatgatatttgggtatttggtggatattctagttcccctccccacaaccctcttttgatcacataattttaactgagagtgtaataagggagcgagctctatgatacctaccttcaggtggagttgagagggacagcctttctctgtcccctgaaaggagacttctgtgactcccagtggagacagctccattcaagtccaggtcgatgtgccttcctgtgggacctgactctcaaccagagggcactgcagaaagggactcggtgtcaccagcattaacaaccgtctgcctcatctcctgtcccagccgaggtgcagctgctgcagggagtcccagcgcagtgcccgcatgatcgtgcccacctctattatgtacagttgtcctccatgacttttaagatgatggcagagagcagtggctcggatccagatttactgatgcgatttattatgaacttctgaaggggtaaacaggggattgtgtgtgcgctcactgaaatcaccagattgagtctgtccatccttttttttttttttcttgttacatttaaatggcaaaggcatgagtaacatctcaaagcctatgagtaaggaggtaaaatataaaatgcagtgttttcaggtaggccacatgatgcttcgtttatacagcatacgtttttggttgtttcattttggcattgtatctggaaaatatagtgtacacatttattttcacagataggggtctattttctttgcagagcaggtgcttacctcccattagcataaatggaagttatatgaattccttgaaagagaagacccattttattatttggctataatttttattctattcatgcatctcaaaagttacttaaatagacagtggttgcatgtaccacttaaaattcgaagatctagattttaaaatgagcccagcacttgagtaagtttgcaagattttgctccccaaactatgggacaccatctgttttggagctgtgtgatcccattcaattaattgaaagatgagtaagataacaagtcataaattaactacaaatataacctgaacatgtcgagtgtattcttcttcagacctgttaatcattgttgggtttttcaaaaatgatgtgtgaacacacatattcttaagaattaaaaataagaattactcacggccaaggctctttaccaaatagcaaggttttctatatatagagagagaaagctgattttaacggcacatgggccagtgagtgtagaattattcacgtgtcctgatgattgataaccagcctcgctacctgtctctctcgccgatgtgttttacagaaagcctgctgccattgttaatgcttcagtgcagtcacacagatgcagctgtcataaatatcccctaacaactatgcttgctgcttatctgaattagttagaatgctgtttgcagccccagttgtgaaagaagcagtttatcttctacctcctatttatttctttttccattaacctcttctagggaagattttgttttcagttgggataaatatgcataagtttcagatccctgattttattcctacagtagtcaaaatgataaaattccaaaatcatctcggctgaaagtagagttggaaaaataaaacagcaactggaaaactgtaatttgggagatgaaggaggtcttattgccctggctttctctgtttagtaccccatttactcattatctaaggg

SEQ ID NO: 62981 - DNA, 1495 bp, Bovine  19866881387970
tagttgcatacaagtagtatgcaaatggatacttgtgacgtttatgattcgtttttaaaaaaatttaggagtttgggtcgcagaaaggttcttcatttctccgtgcttccattttcttagtttccaattgggcgcagaaaagagacatatgaatgatggataattggtgacagtcttctccaaattcattttacttgacatttctggcaccatcgcccctaggatcatcctcaccgttaacatgaaaactcttgttcagatcaattttcccaagaacttgtcatagtgttatctcctaattcatgtgctcgcaagcattttttgctgtgaaaaggaaaagtgccagaataagcagaattgcattcagtatgcaaatgaaagttttatagaaatagggttgtattggagatgagattaattgtgacagttcaggaggagttttacgggaaaagatgaacatgttaggtcttcagtggctgtcttccctaatgcatataatattaggcaaaatgaaatctccatgtgcccaagcttggtggaggaatgtttattgagtgcatagaaatttgagcaaggcatgtctctaagagtttatgacagcccattttcttttctcggtgtgaggatgaattggtccattatcatctaaattggaagtcatgatgatggttcttctttgagtctcttgttgtttacttgttaagaaacttgtacaggaaaatgtgttattctgaattaagctgctattatagaatagtcttccccatgaaaagggaagattttatatagggggagatcagatctaacttaatttatttgatttttcaacagagggtaaggtatacaatcggttactacccagaagtcctgttttcaagtttgattgccttttgaacgatttctgcagtgatcatacagaaaagttatttgtgtatattcactttttttcttcttttgctccaaggaaaccaacatgtctgacaaaagtgacttaaaagctgagctagagcgcaaaaaacagcgcttagcacagataagagaagagaagaaacggaaggaagaggagaggaagaagaaagaggtaagtcctgggtgcttgtgcctgtgatcagggaaaaggaaaaccactcagttcctaggggctggtcagatggatgaagaggaccctgtgaaagaatgcgtttacaatacctgcataaaatgagtggtatttacatacttagaacagtaaggtcactgccatctattgtgtactggtcaggcaccacataaatggtcaatagcatttggtccagagacctccaaaccccaggtttaccccagacttgaacagaaccctgaaagtgatctacgatagttctactgttagaaattccttcacctttccgggtctcagttccctgtgcttaacagagaaatagccggtgtgtttattttgttcagtcatgaggatgaaaaaagttgatcttataagcacttagcaatatctgggata

SEQ ID NO: 62982 - DNA, 1614 bp, Bovine  19866881422967
acacgatgttttgccgagctcaggaacaagatgcaggtcgtccgtccacataaagaaatactcattccaagcgtttctgacaatgcagagcgcactctgcccatcaccccccacctccttctcccggaagcacggggagccttgaagacctgctggcgtgtgtgaagaaaagcaaagcagagggctatggctgctggcttcaaactacaaatcccagtgcctgacccagcagagggtgccgtgaggaaagactgcacgataaataaaactccaggaaaggtcagcaaagatgtgctcaaaggccaaacacttctgccacagacgacttctactgcagaaccagctgcaagcaatggcggatttaacaggcatgactcaacaggcaggaagaccagagacgtttaccgcttccacctcaggaacggttgcctgtctagggaacgccagggtgccctagtagacagtgcccttgagcaggatctgtggggaacagaagccttagtccacacttgggtagcatggtagggctatgtacatgaaacaagtcttttcagtgttgagatccgcaaaaggtacttacacagcctccggcaagaatttctgctgccagtgggactgagccatctctgcgcataaatttatccctcacaaaatcattcaccttgaagaaaaatatttagaaaagctgataaaaaatatagagatagtcatcaaacacacatatacaactgtacataaatgttatttttcttccagtgttttggagtaatcataaactgaataaaagaacgagcttaagactttgctcttgatctcatatatgtcgtttttgaaagccagaatatatagatatgcattcctgatgtttgggggagaatataaattaagagaggtggtttaacaagcctaattcatatatgtctgcaattaccatagcatagagagagagacatattaacaacagaggacacaattaaaacatacattttataacttaaaaacttttagaagatttgattaaaaatcactttcaagtcttctaacaggatttaatctcaaacagcttcatcactgaaacacatttagccgagcagatctttcagcgtggtagaaactcagcatctaagaaatttctcaaggattctcaaagaacatcaagagcattaattaattaagtacaatattctcaaaatggtgtacactacaagcaattttaaggatcaatcagaagattagctgtcccaccagtcacatcggaagatgatgaaaggaaaatttcagcgccaacactacgcagcccaatccagagggaaggtctaactctccggggctttatgaccttagtgatgacaatgtgatcactgacccgttccagaaatccgaactaactacttaccacctgtcagataggagtcgggcactggagaaccaatctgatggagcaccaacttcaaccagaactcagattcctcaacctgttgctctggcaaatgttacacctcgaacacaaattacttgtgtacttgagtgatatgttctggagtcagaaaaaaactgctttggattctagctttcccacagatgaactgtgcaaacgcaggcaaacacttcccc

SEQ ID NO: 62983 - DNA, 1100 bp, Bovine  19866881518419
ctcctgctttttctgtttctttttaccgaccagcccacaggcagcttttcaatagaataacaataagacccagagacaagtcttcccaaataaaagtgatacatcctgctactcattcagaacacaactccagtgtgtttacttttttttttttttaaggcaattttatttgcttcccttgtagctcagtcggtaaagaatctccctgcaattcaggagacccgggttcgatccctgggttgggaagatcccctggagaaggaaatggcaacccactccagtatccttgcctggaaaatctgatggacagaggagcctggtgggctgtagtccatggggtcgcaaagagtccggcacgactgagtgactaacgcgaacacgaacgaacaaacgaattttattttcttcgtatataaacattaagtccaattctttaaaataggcttggacctggtttaagtttgaaatccaaggactattccagagaaatgtcagaattttggatggccatagagactgaggctggtggaaataagtttttaatggaagttttaaacttatgtccaagctagaacaaaggaaggacataaggattttccccacaaagtgctagagagaaacaaacaccagaatttgcaattatgatgattttacttacaaatattatggcatatttggtaaaataaatagatattttagaatgaattgaatatttagccaggtaaaagaaaaggtgaataggagaaccacggaacagaactgttaaaagtcttgaattgtacactaagacattaaaccttttacattgggattagaaaatccagttatttctccaagagtttgctccccattccaacttgaaatggaataaacccccttgtgtgggaggtagaatttgaggggatttatttcttctcaagttgaagggcatttggaaaaagcagacctttgttattaatgctcaaaagcatccaggtgcttttttttttctgttggcaatgctaatgatgaagtaaagtgattacaaatgacagaggaaagaactaccatccttccaagcataaaatcaaagcactgcagttcaaatcacaatgaatgtg

SEQ ID NO: 62984 - DNA, 1023 bp, Bovine  19866881726003
aacatacgagggattacattttaaagtatagcttagcagtcttttgagataagtggaatttgtaggctacgccaagctaatccctggcttatgttttttcatgggaaaatttgttttctgactcccaaataaccacgttacccaatacaaagcaggcttgtttggaacttgtttgtatgctggcaattcctcacacttggttggaagtatttctcaaataatgacatataactagtttgtaattagaaattaatggttgttaagcaaaattacagaaataataatagtttttttcaatgcttctcaaactatgtgtgctgaaggacaggttttctttgcctttgtaaagtacagtgaaagtgaattactagaaaatgaaatgaaaattcagacgtacaaaataggagcccaaatcttttataatttgattcagcagatgtaaaattactttgtcaaatttgtgtaacagttctaaatgcttattctcaagttttcatacttatcttaccatggaccagaaataaagcattcacagaccaaaaatggtccttggaacacaagtggacagcctttcgtgatcgtattttaacactttaaagttctttgcagtatattatcacgtgtaaaatccccagtaatttatgaaataggcttcttgtaattattgtcattttgtatatgatgggacattcgtccctccatatcctttttattttcttcctctcttttccttttttttttttttttaaggagtcatatttttagttttttaaacatagaaatacatggaagaggtgttataaaagatagttattatcagtaaaagaaagatttgctttgtagatgcttcatactagtgctccttggagggtagagttccctaccaacttacggcagtgtgcaaattcaaagaaaaactgaatgagtttttccattgtgtcagtgtatctctagaacatatgaataaacaattttgagataatgtggaagttaatcagagggtccactgacccaagtcatttt

SEQ ID NO: 62985 - DNA, 913 bp, Bovine  19866881820151
caagcagcctgttgggaagcaaactctgttatttctctaccggcacaaaacctttttgtgtaaacggaggtataaaatttgtgcatgcttagtcgctcagttgtgtctgactctttgcgaccccatggactgcagcccgccagggattctccaggcaagaatgctggagtggattgccatgccctcctccaggggatcttcccaacccagggatccagccctcctctcctgtgtcttctgcattggcaggcggattctttaccactcacaccatctgggaagccctctaaaatttgtaggtgctacataataaactttaaagaaaaaaaacaaacattctggtatatttccactttgcaagcctgtttcctctttccttgccttcctcctgggtccttctttcattcatcacgctgcccttcctgtcttcctttcttcttttttgggccttgctgagtggcttgtgtgtggctgagttcagagcacaagcttagggaatgattgatcacatcagaccttccgggtctgcttgtccagcagagctcagcttaaagccaggccacaaaactgctgtggtcaccatgggacagaattgtattgatgatcacagccactggcatttattaaatactgttatgaattatggtggttggtccatgtctttacatatgcatgcattcattctgcaatatatatgcattcattctgcagatatttgcatttaccttgtacccagcttttctagctttgaggacagtacagagaacaaaacagatctcacagatctcaaaatgttagaatacattttcataatctcttgcgcaatagtagtttttacaaagtgatttcccagggtggtgcaagtggttaagaatcctgccaagcaagagacacaggagatgcagggttcgat

SEQ ID NO: 62986 - DNA, 1370 bp, Bovine  19866881634725
cgtttccgactctgtgtgaccccatagacggcagccaccagactcccccgtccctgggattctccaggcaataacactggagtgggttgccatttccttctccagtgcatgaaagtgaaaagtgaaagtgaagtcgctcagtcgtatctaactcttagcgaccccatggactgcagcccaccaggctcccctgtccatgggattttccaggcaagagtactggagttagtcagttataataatgatagcctgcttttgtggggtctgtcacagactatgtagttagagttcagattgtcattaaaagaaattggagcaacgtgtctcaggtaaggaacaataaatatgcttattttctgccttagaaatctgataagatattgtctggccaataaaatcttttgtatctactattgttaatgcatgagaagaaatttaattttctgtcatcaatatatatagcaatctaaattaattttaatatttatttgtaactgttaccaaaataatgagtactacttgaagtcatatgaaaaatgaggtacttggtattctaatgttctaaattagagcttttgtaatacatagaatctaatggttttacctaatagccaagtagaaacatactgtacctgcaaccttatgatctaactattttgtttttccctctccctttctcctagtagccttttttttcatataagcataaggtataccaaatgccatatgttaaaaattatatatatctttttttttcccttctcagtctaaagaactccaaataaaaaagcagtttcaggacacctgtaaaatccaaaccagacagtacaaagcattaagaaatcacttattggagactacaccaaagagcgagcacaaagctgttctgaaacggctcaaggaggagcagacccggaagttagccatcttggctgaacaatacgaccacagcattaatgaaatgctctccacccaagcagtgagtgtgtgttatttaggcaaaacaaattcagggccactttccttccaccccctgaaagaagtctcagtaattaaaacactaataggaagtggtagctctcctacagcctgggaaatagtagtggttatctgtatttttcctgtctctgcattctttggaagtaggcatgatttatataaaattctcattgatacacttagacatgagattctaaataggctccttgccagtgcctctcaggtgtttagcacatatcaataccaagagtatacctagattagagcaacagcattgttaggcattgggcaaaaagtagtactgtattagaaatctaaatggtcacattttaatggaggcaaatacaaagtattttctatgtaagttttgt

SEQ ID NO: 62987 - DNA, 1546 bp, Bovine  19866880234003
ccttgtggctcagctggtaaagaatccacctgcaatgtgggagacctgggttccatccctgggttgggaaaatcccctggagaagggaaaggctacccactccagtattctggccaggagaattccctggactatatagtccatggggtcacagtctttgatcctcactttattcatcattaaaataggtatagtgaaaatataatacaactataataactaccaacagagtttctctaagaataaagtcagaaaatacttcaaaaataaaacccctttataccatgtcaggtacttggtaaagtctcacgaaacatcacctgctatgagaattgctgtaacaacacctgtggaatcttatttggcgccagaaatagaaaatagaaatacaaaataggaaatagaaacatattgttaaatgacttaatttctaatttttaatatgagatattctgttggcatttatgctaactgtccacaactaccttgagcattccaagatgctggaggaactctccaagtaagagtgaatttggaattttcaacacatcaaaatgtgcgagaggaattaactagagatggttttattaagtggctctagacaggggccaccaagggtactggcagatcctgttggtcggttgttgcaggtcagaagcccagcagcttgtgttgaaagatcagtgatgataagcaagtccgttttgttccaacctacccaagagaacagtcattactagatataatcatgcttgtcaaaagcggttactgaaaaccctctgctgcttcagcataatcagaacgacagaagctgcaggatggttttccttgtgagaggcgtccaagcagaatgctaattaggtgaagtaaaaggaaaatggatcagcagctgagagatgcatttctctctagtgagtgaacacaagaaaggaaataggaggaggaagaatgtgacttacctgtgttatggttcatgatgtgattctcaacgttgatttcaggcttttaattctcactgctgattttttaaagaggtgctgggaaaaaccacagcaaagagaaagctgggtttttctctctgaaacattggaggtcctttcattggaaataactttgtgcagagaaaaaaatgaccttaaaacccagtgccagttgttatcatccaaccccctggaaagaaagctatcaaaaaataaagtttggagtttatatatatatttttttgcccacttctgctgtcttttgggtgacctcagatggaacttgaatccagtgacaaatggacccaacgactaagatctagtccccttggaataactctggtatttctgcttttatttccttccaaacattcaatttgaaagagaaatctaaacatttaatcagaaaatctcacgtggttgttgtctaggggaacatgacagagggcttcctgcctgtctaaagcactaatataaactcttcacaagcagaacttcatataattctcatagcatactgagaggtcggtctcattactctcgtgagtacctacgtaagaagtgag

SEQ ID NO: 62988 - DNA, 2556 bp, Bovine  19866880345231
tatccaaggagaaagtggttcattttcactaaaaagaacagatttgtattggcctgaaggcttcaggtctgtattgctacaagttttttaaccaagacttcagaacactgcctatgtatttggtgaaaatatttattgatcaagtgtataaccagttagtatactatcactcctactttgtattaagggttaaaatttatagaatctagaaattatctcagaggtgtttaagaatcaaaggaaaaataaaaccttttttttttttttttttggtgcaaaccattgttctagaaaacagccaaaagggctagaatatttggaaaactctcaaattattagaatcacaaaaatgataatttatagacaacaatcattaattactgctacacataagagggatatccaaatgggacatttttagttgtagatcagccaagagattaaaataagcatgtttacagagacataactatttaaaatatttatagagaaaacagttgcagatgattcaaagagagattccaacaaaaacacagcacaaatgtagacaccatatggttcaacgtatgcactcatgacctcatgtgaaaagccggccaaagacacagcagctggagatacctcccttttacccacagaacaacaaactcttgggtttggaagggactaattataatcatgtacatggatgagtgaaatctatgggtaatgtcaaagtcttcgggaagaaatctctcaaaacaattgtttctgaaagcctttgctttgttggggtttcaaattcagtctccctttctttctgactccatctaggcaattcaggcaggtgatacacagttttaatgaaacaagagaagcatcacattctttctgggctcttttgtcatatcttgataattcattagcaagataattatttgaggggaactgatgcttgtaagaactttctatcaaaagcctttggtaacactggggaggggaagggaaggaacgtgagggccagggatgctcatacatcatctactgagaccagtggtcctgaggggaatgctttcagtctgcaatgtgcctctcctcaaaccacctcagcttccagcctagatccccaaggtttacagtcaaactcctccaagagctgaactgcccagaaactatccaaagagttctgaaatcatttcacacaagacccctctaattttttgtttaaaataaacacctttctctatcttaattgaaagaagacaatttgtagccacagtgaggaagggaaggcagggttattttttgtcatccagggctgcagaacaagtctgttgggcagtataacatctttgggacagaggaaaagccactggagcatcttcctcacttttgaactttctatgaccataaataataatgtgcttcactttgcagggcatgtaatgtgagtcaagatatgacgatagaagaaaagagtgatgagctaagtgctattgagaactcatatggcccagcaacatttgttattaccatattctgtgctggtttgttttgaactttgttttaaaattccatggctgatgacacttcaaattcatgaggaatcttctataacagaatgcttttgtctatggattagtggaaatttgatgaacacgtaccagtaagttgaggccagtccatttttagatactcagtttaagtctttgcaaagaaattcctaatgtgggcaattaagcaagcataacctatcaaagatgccaagccttccagataatgtggaattctgaccatatatttaccctggaagctcttgctctactcaaatactttaacttttaatgaagtgttcagtccttttgtgatggcactgaagtgtaatcaaacatcaccacaagccaagtcacacactagcatgtcttgccttgtttaaatatctcaaacgtatttgagtaactggtaatgatgtctaggcctctggttgtccatatggtctgaacagactgtcttttgtagagcagttgtgctatcttagtgagacaaaaccaaatcatctctgctccaaagtggagagcttaggagggtcagattaagttggtgccttacctcaactcttgaaaccaactcacattatagccccagaaattgctctgttgtctgaaaatcttgcttgcatttgtgaaatacacaggaaccacacaccaagcatcatgtgatatgtactctgccacaactgtccttaggatgcagtgacaagccatggatgatacaacaaagccagcactgaaaccacacgtaatcgttctggacagcaaacactctacatggtggcaccacttcatctcagacagataataaggatcagtgaaagggtctgactgttggcaagaactctgctctaatgctctctgggtggtatgggtattgagacaagcaaggtagctgctgatttttcaattaatgaaacttaaggggagttttagggatttggcttaagagctcagaaactaaaataattactgggccttaataattattcgcattatctcccgaggaaagtatcccagggacgat

SEQ ID NO: 62989 - DNA, 1426 bp, Bovine  19866880407691
tctctaagactgtgtatggtctccctccagcccctgtgaaactcgcctccttgtagtgtctctggggcctgatgctgagggaacagtgcttggaggtgcatatttgaaaaacactgttttatgctatttttttttttttttcaatttctttgccttcgtcagtcttcgtttatgtccacaggtcatctgtagcatgatttatacactattaaatttttcctccatatatatgtatgtaattttaaaaataggatagttgaacctctatagaacttaaggttttatttaagtcacataagctcctatactggcattagtgaattgtcactcacctatgcatattaaggaggcataatcaaattgctgctgaacccagaggaagagcagatcacctcaaatgatcatgaaaaaatccaatttgagtcttttaattgttttcttgtggcagtcccacttgcttagatattttctttccatcttcatcaagcatcttccgttaaggacaaaagagtaaatttcaagtcatgcagtttttatgatgtcaatttttatatgtgacagttcctggtagggaagtagatacaactgagcaaatatatcttgcttttcataagaaggaaaaacactaacgatcatttctgatttaagtctaaataatgtaaaaagggttttacaagagctgttgagacgaagaccctaaaacacttggcagttgcctttctgctgtggtctgagctgccctgtagggtcagctgggacatggcacaaatcaactctttcttcctgtggttcaaggatactaattttcttaggccttctaaatgcttaccagaatgtaaatcacagcactaataaacccatttgaagtctttagattgttatgagtattttatttattagcaacatataaaccaacatatgtgtttattgttgttaagtgtaaacatattgaggatgtgaggcttatacatccattatcagtcattctttcgaatgtttgttaaaatgttattatttgttatgcaaaaaggagtgggcatctggccctctggctaaagtaaaggactcaaggaagtattggacaataattattaagtcagtgaagtaaataaagtgtaaaatcaccatacactttggctctgggggaaggacttgattggagtgggatcaagacctttgaaaggctcttgaagaacaggaaaatgtagggattttttttgagtgggaatttatgtagggaatttttgagatgctttggtttcaaccctgtaagccagaaggcagttattgtactagttaaatgtggaaataaatcagtaggtatttatagggtaagcactacgccaagggaagggtgcagagcagtaaacccaacccttttagtctttagtgattttgcaattcctttagagagataagacataaa

SEQ ID NO: 62990 - DNA, 1755 bp, Bovine  19866880457569
atgttcccattccctttcctttggcacatattctttcaaatttttctatctatatgaacacatattttccccacaaaaatcgaatccttttttacagaatattcagcaacttgcttctatactcatattatatcaagtgtatctgcagaacagagtcccatcctctatagtttgccttaattttttaaccagtccgcctttgtaatctcttttctacattagagtgctacaatccatggactcgtgaatatatttttgtaagactggctatgcttctgttgaataaactctgtaagttaaattgctacactgaaggacagtctgcacagaattaggaattatcagaatatccactaagtagggtataatatttacatacttagaaattgtattgtcagctccatctgatataactaaataccaaatattgagtggcttaaacaacattaatttattttctcctagttacagaggctggaaagtttaaaatcaaggtctggcaagacttagtttctgatgaaaattctcttccttgcttgcacatagccactttctggtctgcacattatggccttttctccctatgcttatgcagaaagagaaagagggcaagctctctcatgtcttctgttatcagggcatagtaccaccacaagagtcctaccttcctgacctcatctaactgtaattatatattatatatggccataataatatctcccaccagtcccatcttcaaataccatcacactgtggattaagggcttcaaaatatgaattaagtggaggacacaaacattcagtccataacaacagtattttgagggtcctaatcactagatttgtaattggcaagtcttcatttgcatgtccttaaatcacctcttccaaccctaaatgtgtttcaccagttttaccttgacaaattgtgtggtggtttattcctctatctccttttccagtttttacagtggcagaattgctctaggaatatgtggtatgtttttcctttgtctgtctaaagtggtctttggctgtctagaggaagacgcattgcaggctcttatgagtatagggggctgtgatatttgaaaatccaccaggatgccctgcaaatctgtttgactgcattgttcttgttgactggattccatttacgggaggggacattatcatttcacccttcattacactgtcagttttctcttgcttgctgggtagatgtttgagaagacatttcagtgttttcagttcagttcagttcagttcaattgatcagtcatgtcccactctttgagaccccatggactgcagcatgccaggcctccctgtctatcgccaactcccggaatttactcaaactcatgttcattgagttggtgatgccatccaaccgtctcatcctctgtcgtgcccttctcctcctgccctcaatctttcccaacatcagggtcttttccagtaagtcagctctttgcatcaagtggccaaagtattgaagtttcagcttcagcatcagtccttccaatgaacacccaggactgatctcctttaggatggactggttggatctccttgcagtccaagagactctcaagagtcttctccaacaccacagttcaaaagcatcagttctttggtgctcagctttccttacagtccatctttcacatccatacatgactattggaaaaaccatagccttgactagacggacctttgttcgcaaggtaatggtctctgttttttaatatg

SEQ ID NO: 62991 - DNA, 1934 bp, Bovine  19866880506444
tttcccatcatgctcactacagagctttaggagaaatgattcagaaaaagttagttaactggccaccacacataatactgtctcatgtgaagcatgaaagtactttggaatagggctcttggaaaggacatatccttcttgtgatggagttatctcagtctgcactctgatgccaacaggagacaagcctacattacatgagagaattcaggggaacccccgggcctctcctgcaccaacaagaatagactcagttgctacacacagtgataatgacaaaaagcacatcaagaaccatgatcaccttttggaaagaacaaaacattgtcaatctttctcaaaacactagtataaagataaatgaattataagaaatgttatttaagaaagaaatcatgtgccataaatttacctaaaacagagcagtcctggagacagtgttcccattgttaataaaataaaaataaactgaatcatcattaacaaaatcaaaaccactcaacttccaactcttgcttaccagcagaaaataatagcccagagtgtccttttctgagcaaatatccttatcatctaagtcaaattaagtatgtttttaaaataattttgattattacttgcaggcaaggaaaatcaatttaaatgtgctaatatttcagttattatataaggaactgccactgagcctgaggagaactgttactctatcatatctattagaaaggcagtgttcttttaataataagttaattttctcttgtatgaattcctcttttggctttgcagatgggactacagaattgtgtttttttaattaaaactacacactggaaataaaaatggttttgaagactggtattcaaaattgagatctgagaaagcagcagttttgtccatagggtacaccttcccccttaataaccaagcatttccttactaaataaaaatgataacaatatagcagaatatacatcctggccttgaaacaaagcacctacaagctaaaaacttgcaattcatcaactgatacatactacactgacttttaagatttctaaataattcttcctttttagtggaataaacacagaagttaactttatatatataaaatgctagaagccatggaccatagatagtatttatagctctggtgaaggcaaaactgccaaggggaacagcaggggtattaaggcatttcatttaaaaccacatcttatttcttgttacaatgactccacatatatcatgcaacaatacagaatgcacagtctcccctctcctcccctgaaaacactgaaatcaaggctagcgttaaagacattggagatgtcacactctctgtcatggtccagaagggggaaaataggacaccaagtcaaagtaaaaattggatcagaagaagaaaatgattttttgttctacttgtatttcattttttggttccagatctttttggcttaaaaggagaaaagatggaaagaaatacgcagtgaagagtggggaaagtaatggaaaatacaattccacaaccaaagtaacttattactgggaaccctactgattctatcaggtgaacaaattgtgcacaagtgaaaaaagtttttaataaatatccctaaaattggagcagggacaattatggccaaaaagcctttaaacagaaacataaaaaccatatgtaggacttccctggtggtacagtgaataagaatctgcctgccaatacagaggacacagacttgattcctggtccaggaaggttccacatcccgaggagcaactaagcccatgaaccacagctattgagcctgtcctctagcgcccctgagctgcagctactgagcccatgtgccacactactgacaaccatgcacctagagcctgtgctccgcaacaagagaagccgccgcaacaggaagcccacataccaa

SEQ ID NO: 62992 - DNA, 2843 bp, Bovine  19866880539941
ttttaaaagaataagttagagctaaatatagccacctaggaggatgttcataataaattgttaggttaaataaagcaatttgaataagagtgcacattgtatagtcccatttatgttgaaatgacaacaacaacaaatgtgagaggtgggaagattaaaaatgtgcattgatttgtctgaagattgagtaagtaggggatggatagacactatattgataatactgattatctaggggacagggtgattcaagaagaaagagaagaaaaatttttttctctttttacctctgcatattcaacttgctacaacagccacgtagtacagctgtaattttcaaaatgcaaaggagaagagctgactttggcttccctggtagctcagtggcacagaatctgcctgccaatgcaggatacatgagttcgatcccgggtctgggaatatcccacatgctgcagagcagctaagcccatgtgccacaactactgagcctgtgctctagagcccgcgagccgcaacaactaagcccaagcactgcagctactgaagcccgcgtgccctagagcccatgctccacaaagccctagagccatgctttcaccacagtgaaaggcccacacacctctactagacggtaggccccactcccagcaagtaaagaccttccagcaatgcagaaccgcagtcaaaaaaaaaaaaaaaaaaagctgacttttgttaaatagcaaggagaggttcgctttgtttactggcatgtttgagatggcttatcccccagtaactagctgtattatgtgtgtaaacagagcatccttagagtttacttcctctcactccaggaagattagctccaaagtgacacctgtctttctctgccaaatgatcaccacatgtgaccagaccttataactcataggagcatttctcccagttttaatgtctctttggtaaaatcttggcaaagtgcccccccattccctgtcagtgagccccatccaaagcaggtgctgtggggctccaatgcgggcgaggcagccaagccaagggacagctgcagctcaggatagcctggacgaggcccttggcaccacagatccacgcagaaatttcatttaataattaagagaggtttggtacttggaaaatacttccctagggttgtggatgaccaaattacacctaggtataaaatttttgcagagcttttaaaaagacctcgggtattattttgtgctccctccctccctcccttcctaacccttccttctttgtttctctttttctttttggtcttatgaaacatacaacaagagaattaggaatatacattttaaatgatgatcatatcatttatttagtgcttacagtgggccatgtattggtaaggatttataataggtaatttatgaattgttaatgtaataattgctgtaacaagtaaacctccagatctcagtggctcaacacaactactcatttgttgttcttatcacagtctaggtcaggttgacaggggccagatacccattcagccactcagggactcaggttccttctatcttgccactataccttcctcttagttctcagagttctgtccatcagctgactgatgaaagaagaagacgaggaccagacattggccaggcctggaaatggtacttatcagtgcatttatactccactgggcagaataaggggcttccctgatagctcagttggtaaagaattcacctgcaatgcaggagaccctggttcaattcctgggtgaggaagatctgctggagaagggataagctacccactccagtattcttgggcttcccttgtggctcagctggtaaagaacccgcctgcaatgtgggagacctgggttcaatccctggcttgggaagatcccctggagaagggaaaggctacccactccgatattctggcctagagaattccatgggcagaataaaatcacatgatcatatctaatagcaaaggacgttgaggaatataatgtagctgtgtgttttgtaagaagaggactcacagatgttgaagagcataagtagtctccacattttatttgtattctgtcacctacaggtgacaataactcattagtctataagcttaagatggcttttgtttcttcccttagtttctctagtactgtgtagtatgcatattaaattaatactgaataaatgaatgaatgacaaaactaaggcacagaaaaagttaaacaacttgctcaaagtctccagagtatttattgtgaacacatggattgtgagcatctatattgagtaaaatattcagggaacctatcgttttatgtattttatgtcttaagatctttttttaaaatgtaatccattcttttttatggtaagctacaaattttatcatctggaagctctaactaactcagaagataaaaatacggttttcatttgagccattcagtggagaatcaaggctaccatatggtttctctagtacaaaagtgggaaagatgtgtgtacctcctcattctttcttgccttttggataagttaaaaattcaggttcaaggactacctaggggcattcagtttactttatatgactatgtatagagtttaaattcctttcttctggccttgagatgattgataaaatcagaggagtagtgaatatgaaatgtgtacctccaacttccctaaagctcaggaagacagagagaggccaaaatgcacgagactacctctccacatccacttctctagtgagcctgggtctgagctagggccatgggaactggaaaagacatagcagtctgactcttggtcttcaaaagacttagcagt

SEQ ID NO: 62993 - DNA, 766 bp, Bovine  19866880554147
aaaacatatgtaatgaattcagacctaattggccatggtccagcccagttctaaggagggcattcttggcattttggaggtcagaggagagattttatttgaaccttgtcatgtgtgtttcccatatgttctatttaagttcgtttattacattcactggatgtacccattgccttttaatttctggacagaggtcagatcaactggacaactcaggttcattatactatcaatccagtgccctggtgcaaaagacatctacacagttgtcccagtatatggaaacagttcacagagcaatctagagtttgaatgggaaagagacctgcttaagattgatgctcattatttggccagaaaagaatcctgattcagttgggaaatttactttgcagttatagtattagggtgtggctcatgtctccaaagtttacatggaagctgtattataaaaaaagtcttctgagtaaaagcatccctctgtagtattcttgctgacctattgaatttccatggtctgctcatctcagaatttcactgtgtgggatagcggagggaatggggaattctggggcatgctgctggttgaattttaatttgtttgtctaacttcagcagagaagtgaaaaacagtgagtagcatgttctatttgtctatcagaggaaccattcatttgatggaaaggctcttccaaatcctgttttcatttcctcttttctgttggagtccgatcccagttataattatcaagccttgggtgtgtga

SEQ ID NO: 62994 - DNA, 1270 bp, Bovine  19866880554614
ttgatagctggtgatttatatgtgctttttctattgagttgaaaagcaaaaacattcgtatcaataaggattactgaatattattagactcagatgtgactctaacttcagcttcagtgtttcagagtaggagggaaagacgtcttggatttcttgtctagttggtgtccatctctccaggttattccttttgccctgattcactacctgatggtaatccagccattaatgtggtctctgcataggtctctgatatccagctgtttctagaacaaagtcccaaaattattcttgcctccaaaactttgtttgccatgtttctttgggctgaacgctcttttagcaacgtcccactttcctttagagctcaacttaaatgtaattttttgggggaagctttgtggcttattgttactatgatttttcatttagctctttatagggaaatagctgttttctttatgcatgtcttccaccctctgtaggccacctcatgatgttccatggctcactggtgatacaagtccttcaattactctagctacaaaagcatcaaagattaatctacactgttgcctgtgcgcttagtcgtgtccaactctgtgaccttacggactatagcctgccaggctcctctgtccctgtgattctccaggcaagaatactggattgggttgctgtttccttctcccatgtatcttctcaacccagggattgaacccacatctcctgagtcttctgcattggcaggtgaagtctttaaccactaagtctcttggggagccctaatctatactgttacagagtgacaaaaactatatccagattggagaagagaagagattaacaacagatggagtgaaaatgtaaatttaaatatcttactcttccccccaacatgacagttcttaaattgttggtttctgactcttcatataaggatggagtgtttagaattaatcctgggacaaatcagtctcattttgtccagatttctggacagatcttttgatgaactgatggcatttaatgagaatagagatttttcatttttatttctaggaccagttgagtttgaaatctgtgactgtagagagaacctgggtttcctctgtccttatctcttcaggtggtcagtatgttaagtttaagacatgatcgtaacatgggtactaggataatgatcaccttctgtacatactgattggcacagcatgtaacttttactccatcacactcattggcagtccctaaaacaaaagctgatgat

SEQ ID NO: 62995 - DNA, 4621 bp, Bovine  19866880622577
ttgacctggccctcctgatgttcttattgtgggtcacttcaaaaagcttcatctggtttgggtcctgaaaagtgagatgtgcagcatttgcttgggccaccgcatttatgggaatctgaccctagctgccatttccagtgaaatcattcattgcagtgtttcaacagagagaacagaaatgacttggatctgtgggtatttgcactgtcaggagatgatcagtgttgactggttggcctattcttctaagagcctttcagctgccctctcagcggctacagttctgaagtccatgagatggattatttgcaaacaggccatttgctgcatgaccaggagatgtgaaagaccagaaagtctctgaaatgactgcacagatgggagctgctcacttccacattatagagaaagggaaggtaccctggtgacccttctgacatctggttccattttattccttctttaaaagctgataaataggaaagttaattcattcactggcagaagatccaggtttgattgcttcatttactctgattcactccaacttggaataaataagcactaggagcctactgtcagccacatcaaacatatatctcctaccaccctcaacaaacaaccccaactgcaagacttagaaatgggtactgtgctaagctttttaaattcaaatacacttttagacttaaatatccttaaaaagttaggtaggtttttcagtcagacttttcagcaattctgaattaagtttggaatcagctacccagttaattcaatccttttttgataaaaagcttgttgaagtcaagtattaccttaagttgcatcctcaagcatgcatatgggatccatatgatgtggccatgactccattaataccagggcgattagagcaaagttggatggtgatggagctaaaacacgaacttcttctaaacaatgattcaagggagaagcaaactggtccgcaagatgtttcacaaataaacgtttgcatagcaggcactgctgatattttctaattttgatgaaaggaaaaaagacatgtggagtggatgggtatgtgtgagtgtgtgtgtgtgtgtgtgtgcatgtgtgcacagctataggaaatgaactatactttcttaacattcaaaagcagagtttactttattactctttatacttttatatcttctttaaaattggctaaccacagaccaaaagggatgtctttttgtcaacacattgcaactagatcaggggtgcaaacatgtggtgccctctctgccatgcccctccagaatccacagtgcaccaaatctggctgcccttcagaatcctcctaaacacagtgctccaggcagcctctccccagggatcagaatggaccatgctattctgggctgtcttggactaggcctaactccactcacttcaaagagagctaaaacgatgctgaaagaaaatggttacatgtcagctcactaaacagtgctactggatacagcataggcaggacaagggggaaaatctcaacggtttcaatgaaacacaaaagatgttgttgagtatcttcaaaccagcaggcaccgggcttgggtaatgttccaactccatcatgatgaatttccagggatcttgactcttatttgttgtatcaaatgtaattttcaagaagttggtctcaggacttccctggtggtccaatggttaagaatccgcctgcccatgcggggcacacaggtttgacccctggtctgggaagacgccacatgtcacggggcaactaagcccgtgggcagccaccactgaagcctatgcactctacagccggtgctccacagccagagcagccactgcaacgagaagcctgcgcactgcagccagagaaagcctgtccgcggcagtgaaggcctagcaagttccaaaatgaataaataagtagatcgttttttctttaagttggtttcaggctggagggtgagagatcatttgtttcataaagctacctattatgatgtatatttcaaactgaacagagtttaaaaattttacatatattggcaaacatgaaataaataagttgcaagacatatatggatttatatgtaaaaacatgatagcaaatatatttaccctatattatttgcatatgatatgtcaaaatgctagttataaactattaaaacagcttttcacagacagtattatgaattgagcatttcaagtgaaacctgcaaagtgtcaccactgtagaactgaagaaaaccttttaaaatcataaaaggagaaacacagaaataagtatttctcttaccagtggtctgagttctggatgcgtcaggatatatccattatttgtgattgcaaaggcatagccatgaatccctaactgtaagaagaagtgagaaagaaaccttcattagcttgctccctggtgaattcacaaagcagaaagcagcccgacatttagtaatttacagcttaaacttggcattcataacccttatcagcacaatatttcattaaaatgaatgcaaggcactgatccttgacatttggtggaaatgaagacctgtcacaggataagctcagcaaatagcacaatttaaaatgtcacagacccatgttggcatccaaagaccccactttgatttatttaaaatgaaaacaattataatttttaaaaagcaagtggctaatgtttctggagactctatgtccaagtgaacagaattttgtcaacctgggtgtcttttctctacctgagataagtaaggcaagaggggcctccctctgatgcaccctaggctcccgacaattccatacccccaaggccatctcaagcatgcattctcctaggcagtcattttccgtaattcttcaaggagaaaagtgtccccacaagcctatataggagcctgccaaccccttttacatcctttcgtctttaaactgtgaggccgccaagcttttccatgcatgcttccatcgacacaaagcctgggtaattttctatgcagagcctcacttaatttatgttttctgactaaataggactatgggaaatagtttgagagcaatgaaatgttttattagctttaaaaagtatgtaatcaaatttaacactgcacttatttaaataataatcccagctttttgacaatatttctattacacagttgaatgcatccattggctacaataaatttacctacaaatcattcatgtattaaaatggcctctggcataaaacccatactgatctctctctctgaagaaagaaaatgtaacccacttttgccggagcagtgaaaggggagaagaaaaaaaaatcctttttcccaatgagttatttcatagtcctgagccctcactgttattttctttaaaattctctgctgctcgcattcttgaatatgatactattaaatgatccagacaacagagtttacaaaccaagaatgaccctgtctgcttgttagcttaacgtcaaggtgatgtgaaattaacttcagagaatttaacaccgggcaattaaaagtattccttgcattacaaaaagcaaatacgcacgtggtagtcaagggcaacagacattttcttctggagttaccttacacagcaagtcttaataagattctacttgattctaatgataaaagtatatttcattatgctgtgaaagataaaccagagatttcctatcctttgagatgtatatcgtctcttttcatcttgtctcttggaaaaatgtcagacacagtcagcactgcattaattacctttattatgtccctgtttaatacagactgaggagtcaaaacggactcagagagtttgactttttccattaaaggcaaaagtggtctttggttggaaattcaaactcacgatgagaccaaacaaatgatattttatagtcaactaatatattcagtggcttctaacgtacattccttcacttcttggtttgcctgtaggaagcaatactccaaagaaagtaaaactccatgcatatgccccctccaagctctctacttttcttgtgtagcacttatctaagtgataatcaattatttgtgaggttgactataaatagtcaagatatcagtcaaggcctttgattatttaaagcctatctccctgccagaatataagttctgtgacagccaaggtcataccatgcagttatagagggatggctaggatgaagggaagaggggtcaagaaaggaggaagcaggaaaggaggaagaagggaagtaacagaagctgaattgagtgcagatcctacaaaagtatcctgaactctctgcttctttcctgggatgcagagactgaggtgaccttcccacccaatgtcctccactcattgtttagctgccatcttgcttccttgttgctcactcacatttcattctcccagaacctgcctctgtcatgccccctcgcccaccaaaatgccaccagaactcctttctctacagttgccagtggcctcctaattgccaaaccatatagaatgtaccctcttttcctggttgtcttagcctactgacccctcttccttgacactctaatccctcagtttccaggccccacactcccggattccctccctttcgtaggat

SEQ ID NO: 62996 - DNA, 2745 bp, Bovine  19866880628772
aagatctgggttcgatcttattcccccagggtccctcccatcttctaaatcagaatatttttaccatgtcctctaggttaacaactcagaaaccttcatgtcctcagaattgaaacagaggtgatagtgataatatctccctgtgaggattttatcaaatcctcatagtgttctgggtagttaagattacatcaggtccagcttctttaacttttatcaaaaaagatgaaacagtctatagtggtttgaagcccagggtccttgcgggtaacttggattctataaggagtccagacaaggaaatgaaattaatctggggcctctgatagagggatggcagctccttagcagacagattggtgaggggtgaacaatgtatcagtcttggagattcagctgcaggccagcaccctgcatgaccccctcatggccgcccggggcggccctggagtcagtctgcggcactctgggccttactgacgagccatcagggagccttgggctgggctttctgtctgtggcccctggtggcagtagcaggggtgggtggtgactgagttccagtgtcccggggtactagtgggaaaggctgacccctgtgaggacatcccccgcacagccctttcccctgggcccccagcactctggcttcccttggagtctcttcactttccagtcagatcgtctttcccatgcagtcagtttaggggctggaggcaggtggtgaggaggaactggcccaggcagttgccatattgtcctttcaattctgagattcctctaggcctcagctttggggactcaaaaatccagaattgactcctttgttctctgggttcctctgtacctcccttccccgaggccctaagcatggaatgctttagctgagggaatggagaagagccagggggtgccaggaaactctgggaggaatgttggtaacgactgtgtttcaaagtgttatccctcaaagaaagcacgagaggcaactgattaactgcctagtgcctggaatacagtgcatttgcttgttcagtcatccagtcagtcagtcagcctttactgagagctactgggtgccaaggaacctttggagaagggataaatccctgagtagaggggcactgaggtcaggcagcttggctcacccttaagacctctgcagtggtatctaccctgctgagacagatttgaacttcctgccaagtcagagaaggaagcacccgccctgccccatggtccaccctgcccccacaccagaacatgatcagtgcagtctgttctgaaaagccagttcaggaacccaaagaagagactcgagtattgccaagtatgtgtttgagagcaatcatttaatgacagaagatgatttttccatcctcaacatctgcctgattaaattatgggacaaaactggtatccttaaccccatgtctaattcccaaatattccaagctcttgagattccaagaggttgaagtggggaaaaaatgcttaattactccaaaatgctgtccaacctgctcattaatacttcccattcgcttctccctccctgctcatagtcaccttgtgtgcagctattgtgggaggaccttgtctaggtcggccatggctgagcacatcgccacccacgtatttgacttcggaatgggtgtctggatagagagagggaaccaggcccaggggtgtgctggtcttgcctttccaggctgccttcctgcatgagcacactcataagcacatggtctttcccttgactgtttctgttgctgtcttttccatgtcaaatgaaatggagccactgaacagtgattgggataatggtcttattgacccacccaccatcaagagggcaattctgcttctgaggagctgtccccagaatgatcactgaattttgtttgaccctcccttgtttggtcctggttgctatctgataaagatagaggaaatgtgctgttttcacttgcactggacatgcagatctcagacacttcaagcttattctcagcttggaactttgcatgtggcctaaaatgcttttcccaccctcaccaggtcactagattttcaccctataggttctccctcttaattgaatacttacctaatactgtcttccgtaattccaagacataattagtgagcagagaaacgtgtttcatgaaatgattcatttacaggcaaaatcaaaacatgctgaaatttaccatactgaaatgatagacccttgagattgaaaagctggatggtatctggcaagacacagatgaagtttatgtgacagtgcaaaaactcaaggttccaggcttcactcagtcgggagagattagaaacaagaatacaccacaccatctgatcccaggtgctgctttctgggtggaagtccatcatctctcacctggttggatgaatgctaccagctcctaaccagtcccttacacaaactatagagcccacctccctcacctgcagatatgtcctacacacagatctgttcacatctcatgtccatgcttttatgagaagctgttcatgggtcttcatttccctcggaacagagccaaagatacctggatggcagaggtaggtctcctaggagagaaaagtgtctgaaaatagttgatgtcaccatcagcacagcatcaacccaactgcctgttcatacctttgacttgtatcataagtgcctacctgggctgggtacttctcagttacaaagaataaagagtaacaaacagt

SEQ ID NO: 62997 - DNA, 1511 bp, Bovine  19866880652988
cagcctttctgagctcttttctcttgtaatcttgtctaactaaaaagtataatattatgggttgtcagtgtaaatgggataatacaagtaaagagccttgtgtgacaaatcaagccccaggatattgtggggaccgtggcagttctgtgggcattctgtttgtgttttattgactgctataaagattgtgaggactcggtgatggtggatgcttgcgggggtgggggctggatttaaagaacattttaaattattcaccttgttcaggttatcatgataaacatcagtgagggattgtatccacacacacatgagtaaacagacagagtccttgggatcatgcagtctgcatgcagttctactttcaacctgacatcaacttagtctgtgcaacctcagctacgcctgtctgtgcctgtctgtctctccccctcgctctgtctgtctctctgtctgtctgtctctcacacattcacacccttatttttcttggtcagctctgagctagaagaaaagcaaaccgtagctgtactgggaggttctgtgtgagcccagggaacctaagtgttttgttactgttgtctgtctgtttttaaagaagcactgaggatatgctagcagctgcggtagctaaagtatgccagttgagaatcagtccgcatgggggaacagcccagctcggcgcgtacaggtagtttatttgtctctgtcttgttcacctgaacaacaaaagcagaaaactgactccctccttctccctcaccacaagtcactcagcacagaggagggacttcgaaggagaaggaatgaaagaatcctccaaagtcgttgtttcatttccagttactttggatccttcaggataatgttatgtaattagggcacttcccccagaaacctggtgtctgcaccagacgtctgtggacccagtcagagcctcacccacagctggggacaaccagcagcagcagtgtgcttggccagctctagcagggaatcctcactccaacctgacaggccttctccaagcccagtcatacagttaaatccttgttacaaatggatgttgccctcggttctggccgaggctgccagattagcacagtgggtgtgagtgggagattgtggccagcatgggggacggagccgactcacttaaaataactcctattccctctccatctgccactgaggttgtttctgcccctgcagccagaggaaagaagtgggtttcctgaagcacaataccaatatttttctaatttgtccaataaaattttccccccaaacttaatatttggcttgatttatccagtattttctttcatcttgtatgatttgggtgtgaatcatgaagtgtctccaaaaacatctcagatgtaggagccttactcagcagactggctttggtttaattggcaaagctgctcaagcaggacttttctgttgatagctgggctgtctgtagtctttctccaagtgtttctcagtcactctgtccttgccacccg

SEQ ID NO: 62998 - DNA, 1312 bp, Bovine  19866880653432
tgaaagtgaaagttgctcagtcgtgtctgactctttacaataccattgactacacagtccattgaattcttcatggcagaatactggagtgggttgccatttccttctccaggggatcttcccaacccagggatcaaacccaggtctcccacattgtagacagattctttaccagctgagctaccaggtaaaaccaaatggaaggaaatagatcaaaatctagtcatttccttctcaggctcatggctgctatcactcgcagctcacaatgaaaatcccactattacctgtatcttctgtctcttatatacacaaagaacttactctccacgtgaagttatacttaatataggttacattaaagcaataaataagacattgtccgttcgtgaaataacaagaaatctgccttaaacacacagaactagaaatttaatgggaaaataagaatgagagtctggtgcagcttgaatgagctggtttccatgctggtccatggaattccttccttctgtgtgacacagggtttctgtaatgtgtccaatatctcatctggaagtcaagcctttcatctttgtgccatttcaagtttgacctaagtcacagatgcatccagcaggactgtaatttgacaaggtaaacaattaaatcacacctgagaaagcccctgacccatgactgcacaggcccccacgcctgcacatgccaagacatccaaagcagcacggtggacagccctggcaatttgttcttctgaccacagcccacccaggctgcattaaaaacagccagacgtcgatgttaaatttaacagtaaccacaataaataaatttggtttgtgtactgcaagctgttagtctgctaaacagtgacataagggcataagcagtggccacgattcacctattaaaagatgatcttttggactctacattcaatatttcgagatgttcagtgagtttatcacagagtgtgaggaatcatctaatggttattggaagcatgaagcacaatctctcaattcactttagaacacagaaaagtaatgcttttttaaaaacgcagcaaattgtacttacaagacaagttctgtcattatccatttcactgcagcaaggaaggcattataaggctgcagagaagaattcggttcattaaaaacaatgtatcacacacaaaatttgtagtttaacctaaggctttacataaagacaatgttattcttctagagagattcatatcatgtcaaaaaacagtgaagctctcccttaaagacgaaaatggttggatactatatcccaaaactaacat

SEQ ID NO: 62999 - DNA, 904 bp, Bovine  19866880661516
ttaagcgattcattatgttgactgtagttaaggcatatttccaatacgctccttttccttattctgcatttcagatgtcaaaacttggcacttagttcccttaacacctgctctctaacagtggaaagaatatcatctctccctctctgagattcctcccctgggtttcctactgttgctcccccttaccagcttcatcagtcatgactggactgacacacaaaaggatatacctgatttcaatgggtgccatggtgatgggggccacagactcacagaggcagctgctgtccaccaccaccatgaacaaattgctgctcgggatctgctggatgacaaaggacctgttggaacaagaggcagagagagagtgagtggtcatttaccatcccccaagttaatagccatgaggaaaacttcctccagagtgggacaactgctatagtattttggaaaacaaatttcagagactggtttactactcaagttgcctctttccatgaagctcttcatttcaaatccaaagcttcactaagaagacaatagctatgtccatacgtagctcacacaactcatcttggaaagactagactttatgtgcatgaaacaggagagtcagagttggctaaattacctcagtttctaagctctaagaggttatgcttttccaagactcattttcttctcttagggcttaaaaaccattgcaaggttgcatctgatgttcttctgagtgtatgtttctctcctcctcacctcaaggatagactgaagccatgccatagtaattataaaagaacatgaacttcctagacctttccctcaatcactttgcacaatgtctgcccataatagaggtatattgcttaggatgaaatcaaggctagtggtaaggagctccctt

SEQ ID NO: 63000 - DNA, 2236 bp, Bovine  19866880686336
tttgtgaacacttcatttaaaatgtactttaaaaaaatggttcattaaaaaaaaaaactaaagacactaaatatatccaggttgaaactgatgactacttatgcttgaaacctaagacagctttaaaaaaaaatctttaaaaagagaaggagggtaatgtggagagaatgtgttggtacatgaaacacccaagagtataaagattgcaggtgaagcttgatccaggcacgtacaccatgctttcaggactctcttcatgtcttttctctgccttccctgcactggcttcattctcaggaaagctgtctccaagcagtggcagagttggctacgaggaactcaagttcccctcctgccttagtgatcctagtagacagagagctactttttccagataaatccaagaaagcatccagattgagtctcatttgggttggtatgagttgtgtccccaatcctgagctactcaccatgtcctggagagttgtgggtctccttcacatactcgggtccttcactggcttccttccgaaccaggatggtcttgccatcactggaactgcatttactgagtgtgaggtccatggagattccctataggaaaaccaaagagatttccctgaaatatgtgggggatgagtggcggtggtccacagcccaggtatcttcctaatggaggtctattctctagctgagtaataagttttttcttttttttaacttttaaaagtatttatgtatttatgtttttggctacactgggcctttgttattgtgaggactttctctagtagtagctgctgctgctgctaagtcgcttcagtcatatccgactctgtgcgaccccatggactgcagcctaccaggctcctccgtccatgggattttccaggcaagagtactggggtggggtgccaacgccttctccgctagttgtggcagttaggggctgttctctagctgcagcgcctgggcttctcgttgcggtggcttctcttgttgctgagcatgagcgccaggtgcgtgggcttcagcaggtgttgggctcagtagttgtgactcttgggctgtagcgcatgagctcagtagttgtgctgcacgggcttggttgcctcgcagcatgtgggatcttcctggaccagggatcaaactcgtgtttccagcattgcaaggtggattcttaaccactggaacaccagggaatccagcattcttttaccaagagaaaagataaagtggatttagggtcatcattctgaagtttactcattgtccttgacctgttttatctatgcaacagcccgttgactttttcgtttgttactcaaagtagtcactctgctacactactgtatggatttctgtttgtattttaagagactcggccattaatgaagactcaagtagaaagtattgactgtttcatacctacttcactggtttagcagacattgtagaggagcattccaaagggtatatccctggtcccgtctgtttctttcaatgcagttaaattagagacttgctggaatatgatgactttcaggccagcacactgggaaacctttcctcccctcactctctagtctctgctagtttcttgaatactaacagtgcagtgtactgaatttcttgagtggtttgattaaaacaatgaaagaagatatctaggaatggtcaaaagtcatgggatccatctctgtggattccacttttgccaggtatcatctaaaaggacttgggttctttagcacaggtatgaacttttctgccaggagagtctccagtcccagcctgctatttagtatgtaagtatcttacacatgaagaggaggcatatgagggtgactatatgacaccatcatcttcaacaaacatcttcttcctgcctaatgtctgcacaacagtgacccaacaaattattcagtgggtctccttcatgtcaaggaaatgacgtattagacatgtgtttgccatgagctagtgtcttcccaaggttattacttttccaggacttctgctagccacatgcatattaaaggtttattccatactgaacttgggggtgtgcttgccaccttacatacagtacctagttaattgtttcagcgtaccttggctacggaggtattactgtttttcataattttgcagttgagcaaggaaggaaggaggcttggagcagctgagtgccttacttcatgtcacatgctcagtgagcagcagaaccactgtg

SEQ ID NO: 63001 - DNA, 1519 bp, Bovine  19866880698104
tctctgtcctgggcccgataagcagattctgccatcccaaaggaagcccacagtgcggaagtgattgcgtagggccctttctcagtgattatccactgcgtgactaaagcactcagccacagcacagtgaaacccaaccaaaatcaaccgtccaagttatctaatcgtagccactctaaatcaaataaggcaggaacagtcatttcagtttctggattttcaaaggcagcatcaaatttctccaaagttaccatcagtaccctctgcctctctgtccagtaagaagggacgtatttatttatgccaaatgacaagccgacttcgagcatctgatttcatttattacaccatctcattgcagaaagctgtttgttacctctcctttacacttttaataaagggtgacaatatttatcagaaaactcattattatgtgagacaaaaagctaaaattggattttcaaaataaaaatagcagtccagcaaaaatctcatttaaacaaaacagacttttccacccggacagggctgctgaatgctgatgagttctcctccgtgagtgctggaaaaggtagcactgctaagtggcttacccaaaacaccctcatttgtcatcagtcctggcatagaaaacacaagaaatttcattaaaattactttataatttcagctttggggcaagataaaacttaaccttgataaatattattgcctgtaaacacatttccagagggtgtatttgtcgatctttaagcccaccagattatttaaggcattaaaaccagcttccaaagttaagatattggcttcaaaccactgaagatatcattttaaaaacagcccatgtattagcacagtatgtgccggactctgcagccaggacatgcacagtttcacttcccccacaaccgtgccaggagggacacctgccacaggaacactggggcagaagagaatccactccacagcctgcgtccagacaacccctttcctcttcaataaagtcacgtgggacttggtccagcccacaagaactgtctaaaaagcaagtgacactgttcatgacaaagcacttgaaaggcattttgaagtataggtgacaggttcaaattttaatcctgctgaagcagctgtgaccctggagcgagtgacatgaaagaagcattctttatttaggagaggtctagattatgacctattttaataagagcatacattttaaacccaataatttatttagaattaattgaaagtaattagcagtgtctccttctgttggtatgcctaaccgtaactattgtttaaatgcagggttatgactaagttttaaaaagtctaattgtaaacagccagtgttcttactcaggagttaatcttcaaatggtataattcatccctgggtaagtttatagacttttacaacccctcatggtagctgtcactgctgcaaatgaatatcttgattaatagcagcaacgtaactagtgtccaatatgtattcatcaccacagctcaattt

SEQ ID NO: 63002 - DNA, 1219 bp, Bovine  19866880704918
ttgtgtctttataagaggaaaggatccagagataagcagagaagaggcccgtgtgaagacagaggtggagactggagtgggcaaggaaggagtctcccctacaattgacttcttaattttagacttctggcccttagaattgttaaaatacacgtctattgtaagccatcccatctgtaacacttcactgtcatagccctggggatctaattcaaggttgggacctataaatgagagtgagatcatcccatcacaatcaaggattctttctggagatttccttcctctggtcatttaaacacttcagttttggaaaagtggtgcatactgtaaaaagatgcctgcttaaattcctctcatctattcttgatttcatgattctaacagcaggattaaaagtgaggaaaaattatacatcctccatccttaaattaaataagtaaataaaggtcaccagaacttgagtcagagagggtctgagttaacgacccccttagcatcaagaaggaaatccagtcactgtactcacagtctcattctgcttactaaacacaggcatggcgaccgtggtcatcaggacggggccctgatcatcagcaagctggatggagaaagaaaagccagttacctgagaatagtctggaagaaacagtaccaggggccataccttttcactgtctcatcccttcctgaccaggggctgttggaaatggaccagtgtccactcaagtctttatagcttaggtgggaggacaatattcctctacctggatgtgctaatgaggatcctagcctctcctcacgggtgggggaaacaatgatagctaccatcagtcactccagctgatctgtttactgcattcagccatttgagttcaaataaagccctgtttggatcctagtgattcattttattttattactacagattgattttatcgttttactttacagactttatgttcaatatgtgcaatattaatgcttctccttaatgtggaaattgaggatcagaaagcatgagcataaggggttttacgagttgcccctgctgcaaacaatggaatctggaagcatttattctccccaaggtagctgagtcatggcccttttgaatctctacatatatctacatgccagtcccagatggaaaacaaacaaaatgaaaaaataacttatccatttcatccctgaatcactggtaactgaagctgaacat

SEQ ID NO: 63003 - DNA, 1625 bp, Bovine  19866880740512
atataaagcctgatgtatagtatatgctatgtaaatatctgctgaatgaaaatgaatggacatttctgtttatcttttactgaaaaatattttctttttaacaaaagtattatatatttactgtagaaaatttgtaaaaaaaaaaaaaagcagttaataggaaagaagtatcactggtattagatactttttgcatgcatctttccattatttttttctatgtatgtatacttttaattttttatagattggataagactgtccatggcattttgataagaacagatactacactggatcttaaccataaagccgagaagctatgtccatggtattttggaacctattttgtctgtttagtgatgtcttttcaagtcattaagtggtcaacttcaccattatttgtaatggcttcactaaagtcactgagtgaacatactacaacccccttctgtgggcacgtctagattgtaatttttctctagtatgaacagtgttttccaataatgtgttctctaatgaacatatgtcctttatggaaaatctttgcttcactctctgatggtgtccttgggcaacatggagagataaacaaagatgatatccaacatattaaagcttctgaaaagacaaattaatttggtgggtagaaaggaaggcaactcatgctttcacagaatataaggcatctacattttttctaagattgaaaggacaacattatcttcctgaaatcatcagtggctaaatgtttagatgccatggaatttggattgttacattggttctatctgaacattttagcaaaataaaaaaaaaaaattcaacttggtggtaaaaaaataattcctagaagtgatttccgagaaatggaattgccatgtcaaaggtcatgtgcatttcacatatttgaaacatatggccaagttattttcaggaagctataacaatttatattcccaccagtggaaagactatttcctaatatttttattgtcattaacaaatcatttccaatttaatagcaaaaccccccaaaataacacctcaaaactcttatttttattttaatttatatttgtatttatgcataaaagtagggttggacattgtgatctgttttttgttgtgttgccatgagtatttcctcttctgtgatctggcagttcatgtcttttgctagtgttctcatatcatagtgttgcaattaagaaaatgagctttggagtcccacataccttaaaagggtccaatagctttcacttaactgctatgtgacctggaacatgttcctaccctctctaggcctcagtttgcttatctgttgaatgagaataatgctggtgccctcccgttgcagtcctgctatgtgtggtatctggcaaagggccagtgctcagcatcctcaagttttagttcatcagtactcatttaatccctctatttctcttggcatattcctactccatatgccatgatgaattatccccatttaacctatgtttatatcttttaattgcttgcagtaaccacattaattcatttatctgacaaatatttagggggatctgctatgggtcaggtgctagattagaaagttcagcaatagtgaacaaaacacgttg

SEQ ID NO: 63004 - DNA, 1369 bp, Bovine  19866880742278
ctgctctctaattattagcaagtgctgttctcaggcaggggagacggtttccgtttcctaacaacttggttaagccttcagcgcaaaaaaaaaaaaaaagcacttgcagaaagaggtgcgcaagtagccagcctagctccatgtgcatcagccagaaagtatagccctttggtacttgcaaccccccagagcacattagcaacccttctgaaaaaccttttcatctcagggttgcattattattaaattttcttgtgatgggctattttgatactaattgccgcccaaatcatggataagactaataatatatggtaataatatgcattttagcacagagaacagtgcaattttccccaaaggacaaagaggggagcaccctaagatgcttacaggatgttaagtgcacagagttcccagatcaagtaagttagtaaaatcctggttgcacaaattaaacagctttctctgctgaaacttcccagagcctttatttttctaatgtgtttcttgcctctcccaggataaatgggtgggctttctttccagtcctaaacttctttagctctttcttctttttttcccccacagagccataactaccactccccatccccctacctctgtgccttaccataatctagtcctagtttgctcaggacttccagtgttaaagtgaaagtgaaagtgtcactcagtcgtgtccgacttgtcgggatcccatggactgttgcccaaccaggctcctctgtccatggaattctccaggcaagaatcatggaatgggaatcttcccaacccagggatcaaacctgggtctcccacattgtagggcagactctttaccaagtgagccaccaaggaaccttcttccagtgttaaaactggggcaaaccaaaacaactggtcactccaccatgccctcagcacacgggctttccttagttcaccagacatttgtgttagagttggttgagtttatcttcctggatagaggacagagaacagactcaatgtcgctttggaaccccagcacctaccaaaatcctccataggtatgtcttgaataaatgaattaaatagaaagtagagagtccttccaaacagacccactccttttcttcactcaaaactactatgaaattgccatttttataggtcaaaaatggtcagatatgggaaatttcatgttttaacctaacatgtcccatcatgtcatgggaaatagatggggaaacaatggaaacagtgtcagactttatttttctgggcttcaaaatcactacagatgatgactgcagacaggaaatgaaaagacgcttactccttggaaggaaagttatgaccaacctagatagcatattcaaaa

SEQ ID NO: 63005 - DNA, 1517 bp, Bovine  19866880786201
tcaaggcatgactccttctatctggttcccatttaatccctagaagaaaaatggagttatgagaaacccagaaacttcaaatatttattcatagcatttcaaggctgttctgctctgctgattgaatgaacagggtgaaaaatcacatgcaaagaccaaccctggggctcatcacatgctccatcaccagctctgggaaggtgctttagggttggaacacggcctcagcccaactgctccaggatctgctagagagtggtgacatctttagtaacccgctgcccatcaagaaaggacatggctgcagttccttcctaaggctagttaaagtttgccaaggccacatctcactgtcctacaagttgctggacctggctgcatcatttgtagatctctgggcagagtcatgccctgttcctggacccagacaggtaatgcctagagcatggtgggggcggaggcattagaaagtactcggtatgtttccatctcagactatacacagtctgttctcttgtgagccctgttttggcttggcttcctacattgaaatgaaataaaatggccctaattatgctgcataatagaagttgaatttcagtctttgaagcctggagggttttccccttacataaaatggaatccaacatccttagccctgtggcttgcagactggtcgagatacatccaaacttcacattctctatttaaaacttagtttttaagaataaactttcatttaaaaagaaaagtgtttgctgcctaaaagtaagatagaaaatccttgttttcaaccatcggtgttactcagggatggaggattttgcagttgagaaaataaacacataaaaataattttcacaggagaaaggcctgagactgtagtattgagattctcctttccaattaataagtgccagttctctggactacattgggctgataataggtaggtgcgtaagataacactgctaaatcatttcagaaataactatgagatagaagtttgtaaactgaagagtcattttattctattctccttgtatctacatctccctcccacaaatggacctaatttaaagattctctgtaacaaatcagaaaatagaagagaagccactgccaaaggaaggttattaggtaatgaagataaaataaaagtgacatgatattgtacactaaaggagaagaatatagtttattttaaaaacatctgacatactgcatttgtataaagccaagtatagctaggttgacagtcttgacacttaaaatgaaattatatccatagtgaggctaagtattactccaatgtataactccaccaagaactggcttgagtccaaataaaaagaattatttttaatgtgttgacccatagtcgacattcagtggacattcctggacttgaactgtggccagtgttctgaggccataaccctacctgctcatcctccacctcaccctcctctgccacccttccttcatcacagcctcatcactatgtgctccgctgg

SEQ ID NO: 63006 - DNA, 814 bp, Bovine  19866880942629
atttttttgctctttctccccccaccccaccccgccccagtgtttcaaagatctaagtcattaagcagggactacattttatgggtaaacatctagacaggaaggatgcagtctttgaccagggacatatatataagcaaactcatgcacaagagaatattacagagtaacatatctgaaagctgtcttagggaactgctttacagtatacaagaggcttatttcaggaatcctcaaaataaggaaacaggaattattaggggcattggattttggctaatattcatgatcagctatgccacataactgaacaccaccgccctctcccaccccccaactgtggccaaagatttgtatttttacaaacatggcttagacgtctccctaatgcctgaaaacacagccaacagtcagggcttcaaggccctgggacaaactctttcccctgtttaaagaccccctgaaatgctgcttcctccataaaaccttccctaacaaagtggaaatgggaaacatatgttctcaaacttcacttgttgttcagtcgcttagtcgtgtccaactctttgcgaccccatggactgcagcacacaagacctccctgtccttcactatctcccagagtttgctcaagcttattgccattgagttggttatgccatacaaccatcttgttctctgtcacctccttcttctcctgctctcaatctttcccaccatcagggtcttttccagtgagtcagctctttgtatcaagtgaccaaactatgggagaattcagtttcagcatcactccttccaatgaatatttctg

SEQ ID NO: 63007 - DNA, 1258 bp, Bovine  19866880947061
tccagaagccttgcagcaattacagaagcaattccaatctcctccctgtcatattccacatgacagaatggaagatgcctgggtcgctgagtcacccactgaaagagaaatgcccaggaaaactcctggttccaaaaaggcatttacacaagcaagaaataaagtatgtgctaattccctgaggtttcaggtttgttccttatactgactaaagcaattgggcactgggctaggcatgtgaaaaggagagaaataatacaaagccctgctttaatttattgaaatcaaagaaaagtgaagataaacatataaattatgggtaatagtcttttataaaaatgttttcttagattagtttaaactacctcaattcacattcagatctccctgctcactagtaatgaaggcattctatttggttgaaagccttccattagtttaaaagctccaattgttgaaccatcaacgtctataagaatgtaataaaggacagaataactaagtgttatgtaagcggaaactatagccatattaacattcatgagtttacccaccacagtaccattcagtcaatttagaaatacaaatacaataataaaaatttcaacttacaaagaaaccaaatgcttcccctccttcccctccccactggcccccaaacaacaactaagtctggaatatcagtttcttttatgacatctcaatttggctctaattattacaggaagaaatactattagagggttaccaaacacagcaaatgcaatttgttgggaactggaattgtaacttacatgctattgatataaatttctcccaagggttacccttaaaagagaaaatatatttatctgccaacacaacccaaagaaacataagtatcttactgttcaaaaggaaaaattccttttagaaatccccatgtgtttattttagcatcacttaatgaaaattttgtaaactaatagaggcaatatggtaacgtgctgcgagtatgttttcacccataaagatccatttatataagctaacactgcttaacccctcaaagcataacttctctctccttagaaagctacacattaattcaaatttattcacttcagaaggtctaggcaaatagaattcagataaactcatctagtgatagagctgcctgtagtttggagtggaataaaatgagaatgtctattagcttttcaactgctccagagaatgaatgccatgtacaattttcggaaaaagatgtaaggctggg

SEQ ID NO: 63008 - DNA, 1781 bp, Bovine  19866881010220
tagctgcctcagtacctctggggtggttttggaaagctcaggaatccctctctcctctttggggtgtgggggtggggggcagatgccagtctggagagcagaattcctgagctgagtgaagagtgagggcttatccctttaagaatgccagccctgaaataatcttaagtgatttggaaggaaggttttgttctttctttttcctaaactgctttgttccctttgactttcaaatgattttacaaagcccctcccatctgtttttgccttcctttgagcctttaagaggagcaggggttttcctgaaaccacaggcaactgggaaaggagttaaatcccactgctcttagaggaggggtctcgacagtctcttcccaccccaccggcactctggctctgtcattctttatcccatagaaccacttaaggtgggggcttagggtggcaaggggctgttcgaaggggaagtgacagggagtagccatactggggagggcgggggagtggtgcagcagttcatttttattgaagaccttctgtgttccaggccagtggaccagagcccagaagtatggagctgacatgatagctccaaggagatctcagagagcaaataacagattacagataaaaagtgagaagaccagtaattagacatattctgaagagacaaacaaaggccagagacaagagtaatggggtggccaagggagccctctttaagcagagtgcatatagggaaaggagctgggtaggaagggtagaggaacagtagtttcaaaggccctgatgaggagaagttgtgtgtgtgtgtgtgtgtgtgtgtgtgagaagctgggtaaagagcagctggctagagcctggtgggctggggctgtgtcagagctggtggggtactggtaggacaagtcagggccagctcctctggcctgtggttggcacagtaggagttgggattgtgctgcaaggccagtggggagtcattgcaggctcctgagcagaggagagacatgctctggttgtcctcagaagcttcctctggctactgtatgggagtcagtctatgaggcgtggacatgggctgggcatgcagcttgggtaccagctctcttcaccataaataatgtgagtggatgtccatgaaggtagtcgactttttaaaattcctatggaagtccccagctgctcctgtttcttactgcttgttcacttcagggcttagtcgggtggttacatttctctgttccctccctccctgactaaagtcacatttggtctgaacgttttgggtgagtttgtgtcgttgctgtattttctcaagggtgatcaatcctacagctgtcttgggaaaatagcaggaccattcatttactcgtggtcagtcagtggtatgacagggaaagacattcctagtcaccatggtgagagctcatgcaggccctcctcactgctgaagggagagtcaaaacggttcactgtctcccagtttatttttaattacttctgctggtactagacatcctgtgattcctgcaagaacacgatgagacaagttaggaaccaagtctagtgatgcgtgcctgctgccagccatcgcaaaagcgttttttgtcggggactcagaacagctgtgtgggcccctcccctgctgctaccagtgctgtttttctgtgtgggctccggtggggaccttggcctccgcccagacactactgtcttcagaaggcaggtgggcagtcagtgcacattcccgagtgacccccacaccctcctgaaaatgg

SEQ ID NO: 63009 - DNA, 1017 bp, Bovine  19866881079934
aaggaaggggatttgtggagccgggcctgttgctgtaccctgagggagagagagtggagtctggaatagggccagagcagtggagatggggaattagacttgaggcatattttagagatagggccagaagaacatgctggtggattagcgatggggtgggttgaggaaatgatggctgtcaaggataattcttaagtttttggcccagttggacagtggcgtcatcggctgaaatggaaaggaccccatgggggaggaatgggtttggccaaggaaatcaggagttggctttggatgagttcagtctgagaatcctgctagtcatccctgtggaggtgtcaggtatacagttggctatgagtctgtagctctggggagaagccagctttttgtaacttttcagaactttgattatgataagcaaggccaagtgaggatgatccctcagctccatctccttccaaatgtgtgactgtttttccttctcactccccctctatactgagaatctgtctctcccatccccctctttctatttattccctctcttctcttggccctattttggaaagcccaaatcagggatttttactgttggctttgaggatcagaatgaaaacacagacaaccgagaaaaactcctcccaagagaggctgtctttactgcacatttagtacaggaacccaaaataggaatagtactatactgtgaattgctcatgcgggtatccccttgatctagaaccatggagttctctcctcttcctttcaacatggcgacacatctcttggtttgtcctctgtggagtttgtctctgtaagtcccttcatgcagagccaaaggtttatctactagagaagagatgaaatgttttctttcctattcagacactgtttacagtcatggtttatggagggatggtaactgtggatgcttgctgtcatccagcaatcttctttaaagcatgtttttcccactgtgcctccaagaggagccacctggaagccttgcataaa

SEQ ID NO: 63010 - DNA, 665 bp, Bovine  19866881083368
tctctatgaaaagacttgaaaaatgatgtaattcttacatttggtatttaatatatggataatgttaattccattccagattagaaaattgcttttcaaaacactgcacgctgtaatggcaattacaaacaccatgacactaaaccacagcttaaaagtctcactgtagaaaaatagataaatatgtctcctaagtattcaatctttttccgcatgcctataatctcagtcccttccctgtgctgttggcatagctattatgtcttattttatttattgactgactgccttttcattgttcttagagtatcagccttactttatatgcgtggattcttgtgcatgcttccttaaccagcaataaagggaacagttactgtgctgcaaagcaagaaaaactggctttaaattaagtgacgttcttcaaatggtcttgcctctgtgtacagcagagcgtctcagctttggcacggtgggcgtatgggccgtgtaattctaccactacatatggtagtgggggctgttctgtgcattctaggaagtttagcagaatgcctggtttctacccaccagaggccagtagctcttattccctccctggccccaggttttgacagccccacatgtctctggacagtcctcagcaatggggaactgttggcata

SEQ ID NO: 63011 - DNA, 675 bp, Bovine  19866881084286
gtcaccattaatcctttttggagccccataaggagagtgatcttccattctaagggttattatcacagcaaagctaacgattcttgagttctcactatgcaccagatgctgtgcttgatccaactttatcatcccagcttttgcaatgaagccgagggaggttaaacactgaattctaaccctgagtccaccattattctgtattgcctcttgattttttcagtcgactgaaggaacaggaaaggggtggactaatcttccaagcagtgctaagacaaacctaagagacagaagacaaggagccccgaaggctgtagctgggacttgctggatggagataaaggaaaggagttgcaaagtcagcctgggctgcccgtgcagggtaggactgggacatttttgccaaagatatgcaggagaatattgtgtctatgggatagtagcatggatcctagcgtcctgagtgctcagtatcccccaaatggtctggtgccctggggaaggaccctactcacggtgtggaggtggcggagacccagcagtgtgcaaggtctgactgtacgtaccctgtgaaaatacaaagtcttccatctatcagttaggacttggtcctaggatcagaagcttctctaggtagtccaagggacttgaatacagggaatcagaagcttttat

SEQ ID NO: 63012 - DNA, 1605 bp, Bovine  19866881107851
tatgactttgttaagtctgagcctcttttgttcttttcttttttttccttctttttctcaaagtttcttttctgccagaaatatttctgctttgctttttcccttattaggagctgctgcagcctgcattgctcagatttacaactgctagtcaaagttaagggaggtgaaaacgtaggcatggttttctcatcggaggtaaacttcaggtttttaatccaatgtagttattacatttgatcaatttctctggtgctctcaggctagttttatcttgtcttatttattctaacaccaatgtgcttttaggcaaacacacgagtaccaagccacctcataaagtctgtctggcaggggcaagcacagataacgtttccagttttgaagaagacatagccatgtatccggagaaggaaatggcaacctactccagtaatcttgcctggagaattccatgaacagaggcgcctggcaggctgcagtccatggggttgcaaagagtcaggcatgactgagcaactatcacccactcacactagccatgtatcaggatgaacagaagtaaaagaaatgtgaaacagtaccttgggcacctgtgaccttgccggctatctcatcatcctgcactttggagcacacatttgtggaagtcaagtgtggggattcaggtttttctgtcatcgatccgccctcgccaggtgtttagtgctcctgcacacctggagcagtgaatgacttgctgtgtcgggcttccagaaagaggtgtacattctctcaaggatcctttgtttctggactgtcattattccggatctctcattacagataccaactcatggctttttctttatccaagtatacagcctctgtcagaagtgagtggtgcttatttcaggggtccccatcttttgcagtcacagtgcttgtcaaaacagcctcccaaactgagatccacagtgtcctccagacagagacttttcacagcttgcatgttccctgggacactctgattggacttagagatttgctatggccgagactgagaaaaaatgaaatagatatcgaaaatgccagcctatgaattagcgtatgagagtccccctcccccactactcttttagtgtgatttttatacaagagacataatggcctttgcttcatctccagtggctgcagtgaggcttttgtgtatcatggagcgagagggaaagttcctcatgtcaggatcctggcaatatcgatagaatcttcatcagccctctctggtccattaagcaaaagtgaacttctccttcaagagaagaacatggagaagaaggggaggatgcttgatttccctgagtatttagtagccagcacatttagctggtggtccctgaaatgcgaagccagcctcagagactttttcctgacagtccgacctggacctcagctcaccctctgcaggtgaggcatctgctcagctgatgtattttaagggatttctctgtgtagccagcgtgtctacttttcagggagaaagtcattttacaggcataactttgcaaagggtgcaggggtgtatttaacaaatggtataacacttggttgggtgctcattccaag

SEQ ID NO: 63013 - DNA, 939 bp, Bovine  19866881124451
tactcatttttaaataatttggcaactctaatctaaatacttcctgtagtgagtaaaatgacctattgggcaattgccaaatttgaaaattattagtttttccaatgccctggggaaataattgcttgtcagtctgacccaattaaattctggcctctttacatagggatagtcttaatataaattttgaaacttttaaactgcagaatcaaatcttttattgcctctcttaccctgaatcagtgtgatagatatgagtgaaaaattttattgatgttaatttaaattctaaaacctatactttatgaacactgataccagtgtaaagagatattttagtccatctttcatgtgggaacaaaagatacttttattatgcaaattgcttttgtaagagtaggttgtaaggcctgaatgggggaggctggaattttaaaatatcctcctctaaaattcatttagagactacaaaattgtttaccagaaaaaaaaaaaaactcagttatatcactggatcaaatgtatagatatctttcacaaagatacgccttcacataattgtggaaaaggagaagctgataatcttacataggtcaacaacgattcttttcattttaaggttttgttctgttggctgcacagatgtttttaatttttggggtgtgtttatatgtttgcaagtttctgaggctgtgctgatgaatggagtttttattgaatttatatgtagctttcagatagtaaaaatgtgcttaagcttcttcatcttgccccctacccccaatctgggtcttatctgaggaaatttattctactgtcttagtatccttcacatttccctaatctgtgcctctatatgctactataattaaaatatttgaaaagggaaaaatgacatttaggaatttagtggcaggaccacaagacactggatttatt

SEQ ID NO: 63014 - DNA, 550 bp, Bovine  19866881124738
caaaggacatttaagattagtccctgcacagaaaatgtgaaatgccccgaagtctcacagctccagtatgaaagcagtctgatgggagttttcccagatttgacacacctaaaaatatacatgacaataccagtcacaaggagtgaaagttttctacactagcaataataaaagtcaagtttccattctattccagggcggtggttctcccccagtgcttttataaaaggcaaatggctgggtcccactgatactgatttaattagcctgggagcatcctcagctttaggactgtaatagttcccagattattctactgggcaccccatgggcaggaccactgccaaaaaagaatgagtcatctttctattttttccatagaaaatgatattacaaaaccatcatcatgtgaaaagcagatcaatgagctttcagccaaaaactgtagggaaaaaaaaaaagagagatttgggaacatggaacatgttaggcaatgaattaaaataataataacagtaataataactttatgttattttctggattttgt

SEQ ID NO: 63015 - DNA, 642 bp, Bovine  19866881136503
atgctctctaaagcttcctgggcaaaggttagatgcaagacaggcttaacaatgaatttcaaaattcaaagacttgcactgaattcttgagcatgaaaatgtgccatatcccaaacctgattttacataaagacttcagagaccactgagtaattaggagataacatcttgggtaaaaagaggacctctataatttgagaatatgtctgtggcttttgacaagcaacttttttttgggggtggggcatttacagaactttatttggcattattcctttgagaagttaattatatatcaaaagactcttgggtttgtggaacctgtcagaccattttgaacatggggtacaattaggcaccgcgaattgattccagtttcaaaacagcaaagacaatgaatttccttattcactcaagtaatatcacaaattagtatcaagcagcactgccatgcagtaatgggtcagtcttcaaatgacgctacagctaactgttcaccacgggggtgggttctccatggtgctggcttttctgctgtcctctgtaacattcctagtatctgtaactagctcagtcactgtgaaaaaaagccccagtctcatcccttggtggggcgatgtattcagaacagatatctctcat

SEQ ID NO: 63016 - DNA, 1697 bp, Bovine  19866881160525
ctggatgttgacaggaggggaacctaagtttgaattttttttgctgtaaattagtgcggtgaaaaaaaaaatactgatatgattgatatggttccttggagaaggaaaaaactattttgctctatttgaattgaaatgctcccagagtaaagctatccagaactgtgtgttttatgtagtttaaaatagaggacaagggcctttgtaagcatacttgatgccataaaatttagggtaactggcccagcaatatgtggttctcccttgctcccaattgttaaacgggaaagagggcttgtatgtcaaattgggtttggtttggagacagtttctttgttgagatcagcttagtccctgttgtgaactctgcctctctattaacaagtcatggaccatgtgacatttgaaatgagatgaggtggccactgacaggcctcttagatgttggtttatgttaaggccagggaagcactgggtatgactgttttttacactacactgacacctctcttctcgaaaaggaaaggttgttatttcccacgagacttgtgatcatttgaagtgcaaagacttcagattctaatttgccagtgcatttgctgtggaatcgtcttttgccacattgcagtagaatgcaccactgcgcaccagggatctgcctttccagtccatgccacccaatgagcaaatgtcccttctcaaatgtcccagggaaacactggatcttagaatttgctccatccctgtgatgcgccatgcctagcagcctcccatttgagccctgatccccatcaagccaagtcaggtcagggattctagagcctcctctagtgccttcccgcccaaaactgaccaccaagtgctcatcgatggtggatggctaggaggactcaagaacacagaggaataaaactggctcccaagcagtgttgattattaaaatttccattgatgtgtataaaatatttatgagactggcagtagcaatttagaagactgcaataatacctttagtctgatggagagaggttcaattagtgctgggaggaaaaaaaagtactacagtaacccagtcctttaacatgtctgtcacctcttagctgttaaacagtgttgatctttttctctttctctccagacttgatttcatcatttccccccatcacttttcccaatgattagttgaatcagagtgattttatcatactcatcccctatttgaattactctccactatgcaattatcctatcacagaaaacccatttttctccccgtcagatgtctgaagtaaatgtgaaacccaaagtggcctgcccattacataacctctgtcatctggtgggtaatggattatatgtgattttttttttccaggctagcaaattacaaataaccttagctttaataattgccattaacataatggggccatcattatggtagcattttgtaactaatattttctagcactgtttaatgccattggtagtttaaataattttttcgtttccactcagagacttgatgtaggttgttttaatataaagccacataggtttgatgcagcgatgctgctctttgcttttgtgtataaagattacacccaaagaatcatttcccagcttctttgttcaaacatatttgtgctaccaagccctcggttaatgttgctgagcactttatcaagttttaagtc

SEQ ID NO: 63017 - DNA, 929 bp, Bovine  19866881244263
cgtgctgcggttctggggtcgcaaagagtcggacacgactgagcgactgaatggaactgaactgaatatcagtgttcactgtgtcagttatcatacttacattgcctttctaaacacagccatagacagctgcttgagataaagtactgaaactattttacagtgagttgagaactttagctgtgatttgttggttaaaactttactgagatataaaattttgatttcaagccaagtttttctgagcaaaactattctaaatagggacagagctggaatgaaatccttaccccatactcttattaatgtggtaacaatatggtattagtataaagagatttttaattactagtgatggttctaatacttatgcattaaaagacactgaacacaaattcctaatgcccatagttaataattgttactccagtggctgccttataaaaggttcagtgaatgtgagttgaatgcaatccaattgaatttagaagcagggagaaggcagatctgaatttaaatatacttatgaccaaaacaattaagaattttctggcctgagtttaagccgtaataaaaaccagcttctttcccagtgtgtataggtattcaatacacaggagaaaaactgagagagctccaccataacacttgtgtgcggtgatttttaacattttctccaaatctaaaggggccacaaaatctcctaagatattatgtcatccataactttatcatgaataaggtaaattcctttttattatgtgatttcattcaaagttcagtgaaaaccccacttgccaaaaaccaattagacaacagccttaattaatcagaattcttttccagacataattctttataggaaaaatggggaataacaacaaagcatactgaacagagaagccattacacacacacacacacacaca

SEQ ID NO: 63018 - DNA, 2394 bp, Bovine  19866881252195
ttccatgtctcatctcaatgtcacctccacagagaagcttccctgctctctgaccaaaggagccacacaccttccctcacttcccatcacaccccgtatttcagtttcctctgatcacttatcactcttgagaaaggtctgtgtgttcagcctctcccacacgatcccttgtgaattcctgtgactttgctgctgcaccgagggagtggttgatagatacttctcggtagattttgatggcgtttgaaggatgctgatgactaaatatctgggtaccaattttctacaataagtgagaagtgcaggtgccacatgtttacccatcaaacacttactgagtctttgcttcatcacatgcaaaatttgaatctcatgtaattggttaagttctcctttctttccgcccctgcctctgctggactgcaaacattcatgagatgttcctcacgtcaggcactgtgctagctgatggagacagagaagcaggtacaacagcatctctgcccacaaggagctcattgctacaggccaagaggagttatgtgctcgcgggggaggcatctgcttttcttgaggaaggcaccctgagatgctggagggcttcccagaagaggtggcatgcacaccaatttcatccacagcctactgtgagggacatttctttccagactcagcaggggtcccacacacttcctgagatctctgtcctcatgctggaccaagcactgcttttgatttctgtctctggtctcagaaccatgcattctgctggccccaacctgctggggtgtagcgggtgggaacctgtcatcgtttatataactctgtggcttctaagactggaatcccatctccagtcttcagctctgttatctgctcagactgctgggaactgaacgagactggccagtaggtggcgcacgggcaccgccgtgtgcccgctccctgagcacattgtcaaaacacaatccttttatgtcgggtctgaatccatcccgttttattttaaaagaaagaatcatcggatgcttagtatatgtatctgctcagaggagtgtgttcttggagaaaaaataaacaagactgtgtgacccccatggagcgagcctggtaattttgaaatacatcctttggtgaaagagaaaacagagcctcgcgtgcttttctcttgatgaaatgctgagagcaacggttggagcctccccagtctggacacttgagtggaagactggcagccctgagcaaggaatgcttacacctcgtgagcttcaggatgaagcaggttagaggggtgcctgcctttctgtcctgcaaacctcaggaactctatagctgcttggtccccaagttctgtggccgggtgtgtacaggggcacctagggcatagataggatttagcagagagtgggttagcagtgacagtgcagctgttacgtagagttttaagaaccatgctgtgtgcttatcatctttgtgtgttttgcctcattaagtcttcgtagcatcctgtgtgttagttcttgttttagagagattaactgatgcctaggccaaggactgtgtcaatcagaaagcaaatttgactcagtcttttttatttatttattttttgactcagtcttcagagggaaaaaaaaagacaactatggacagtgtggttttccatcaagttaaacctcttcaattgaacagacttccttaattctgaagcagtgttataaggctcttttataaaatgagagttgggcggtgggcctctcttggcttctgcagacaattttcctctttgcttctgctgtctgctcctgcacaccacctgcatgggcactcagggtggcatctttgatcttggccttggatggagtttagctggtggggaactcacacccagaagaaacgagaggagagtgcagtggattgtatattcagccctgtgtcccctggcactggctgcacccagtctaaagccacattagccttttgttctctgtgggctgctgtgattgttccttcctctgtcccttcatgcagagtggaagagaagggccccactgcttgtgacttcagggcactacaccatttcttatagttccctacacctgccccactcttacaataggccctttattaaaacttccttaattagccagcttgacgatgccatatgcttcctgctggggtcctgactgatacaaaggtaagagttagatggaaggtttgtttctcttaagtgcttactagaaaaaaaaagggggggggggataaataaaggaaaaagaagaaagggaagaaggaagaatggaagaaaagaggaagaattaaaaggaaaaagatggaggaaggaaggaagaaaaacaaaaagcaagaggaaaaggccctccatcctgtccttca

SEQ ID NO: 63019 - DNA, 751 bp, Bovine  19866881294082
cctgggcactgtgtatccagtctggagaagaccgtgacttttccaatggtgtgcttgtctactgtttatttatatgctggccagagaccacaggcaagtcatgagacatggttggcccaccctgagtgggtggaagagacatcctcctggtcactacaattcaatgtgtgtcagccggtgcccattttcaggaggctgttacagagcaagacgaaaaacaaggttatccggagaatggtatttagtcattaccttttaaatctggtgattatgaaccttcttttttaaagtatattgagtagacataagataaaacagaattgctcatatttgatctgaaggctgacatggatgcagcatcatgaaggcagtgacctcaaaagaacctgtatgtctccaaaagcagagaggcctcctcagcacttccccacatttcactggctctgactcacccgtcatgtcactggatgattaggttcggccactttcttctgtgtgttctcgacaaattaagtagacattgtttactgctttaaaattaaaaagcccattttaattggggaagaaaccttgttttggcagatgaagaggaatatgtgagcaggcttgtcccccaaccagtgtgcctccaacggcacatgggatacagccaactggcagtaatttgggatttcagtgaaatccttgtgctgaattgaaatttatctgaaaagaaaggtgtgcaccttttgcagtttattatcaaggacta

SEQ ID NO: 63020 - DNA, 1805 bp, Bovine  19866881301981
acaggggaaagatccagacagccaattttctttgcatttttgcaaatgagtgagtctgacccaaagctccaagcaacatgaggtcaaaagggcatgctggctgaacaaatgaaatcattgccccaagaggaagtactctgtttccaacacttcaacacagaaacagtacagtgggtgaaaccatgtgggatcttaatcaaatcctcaaaaggaaagacagaggaaaaaccaccatgccttgaaaactgagtatgaccatccaatttcaagaagccagttcttcattgacactctttttattcaagatttgatgtaagatgaatggataaaaatgatgtgattgatatctatctatctatatacacacacacagaatggaatccttgttgtttagtccttaagttatgtctgactcctctgcaaccccatggactgtagcctgccaggctcctctgtccattggatttcccaggtgagactactggagtggattgccactgccttctccaggggatatttccaacccaggaatccaaccctcgtctcctgcattggcaggcagattctttactgctgagctaccgtcgaagcccagtggaatactactcagtcataaaaaagaatgaaattttgccatttgtagcaacatgggtatacttggaaagcattatgctaaaagtgaaatgagtcaaacagagaaagacaaaaactatatgacatcacttatatgtggaatctacaaaatacaacaaattagtaaatataacaaaaaagaagaagattcacagatatagataatgaactagtggtttccagtagggagagggaaggagtggggcaagacaggtgtggggaagtgggaggtacaaactattgggtgtaaagtgacagtcaaagtgttacccactcagtcatctatgactctttgtgaccccatgggctgtagcccaccaggctcctctgtccagggattctccaggcaagaatactggagtgggctgccatttccttctccaggggatcttcctgacccagggatcaaaccttggagtctcccacactgcaggcagattctttaccatttgagccaccagggaagccccagttgggtataaaataggctcaaagatgtgttgtgcagcactaggaatatagcccatatgttgtaataactgtaaatggaaagtgaccatttaaaattaagtatttttttttaaagatttgatgtccaaagggaaagcctgtttgttctggagagaagataccacacaggattctgcctgggaggggttagatgcaagaagcccaccccacagggctctggaggctcaagctgggctccttctttcctggcaagcagtgaactccaggatattgctcaaagacagaatcgatactgaaaacatttccaagttggtctggaacaaaatttccacagaaggtatctgaaatagaatagctcaccaaaggatctatattaacgggtaggtggatttctgtaactgaacccaggataacctcaaagctgcaactggaagagacaccctctagagagccaaatagaagcccacagaaatagcaagccagggggctcctaataacatcccccagcccctgcaaagaatcacagagctgtaagcaggcagactgcaggaagcagagattacagacaacacaaagacaggacagtctcggcgcggcacggtggagctttgatgcctccagccctggctggcaatttctttctgaaatagcgcagagccttttaaaattatatgttgcttctccccagcctcaaagaactt

SEQ ID NO: 63021 - DNA, 1456 bp, Bovine  19866881328702
gaaaagactctgatgttgggagggattgggggcaggaggagaaggggacggcagaggatgagatggctggatggcatcactgactcgatggatgtgagtctgagtgaactccgggagttggtgatggacagggaggcctggtgtgctgcaattcatggggtcgcgaagagtcagacacgactgagcaactgaactgaactgaactgaactgagctgatagagggggactaagtatacaagccaattctttttttcacatgaatttagctggtagactccttacctctaaacatgccaggtgcaaagcaaagtttcccctctccttggacattctatgtgtggaatggagcctttctcgtctaatctaaagcttttatagcacataccttcatgatacaggatagggaatcttacatagtctgtattctgatctccatatttggcctcagcatcctggtaacatttctcaaacacatggaaccttccacttgctatcacactggccatagcagtgctgagataagcagggctacttaacccgaagagcatggagactgggaatcactgccagatttaatggccattagcacatctctctggaaaagctgatgagtgcattaatatcacaggaagttttttgagttttttttcccctcctaaagcactggtgttacagtcacctggcaagcctactattttatcagacaatcctgtgtctggatatttctgtgtctcgggactttaatgctgtatttataatgtaggaaagtctgccctctgctgcaggctcaggataagcaacccctttgccagttcaaaagacatggctgatggcatactggaaaaaatacatatgtatgtatagcttttatttttcttctttccttttgtttctaaattagccagctttggatttaatgggcaggattctaatacagcatcactctaggtgttttaagactaccattttggatgctgctcagttactatggagacaggtgctgaaggcacttggtgtggaggagaaaatcaccgctggtgtatgggaccaaagaggtccacactggccccgcagtggaatctaggagagagaggccaggcagggcagatctcccatcactgcggggccagatgggcttcagcagttttcctgctaagttgttttccctctgcgctgcatttcagggacgctggggtgtcctggggtgtccgcccgtaccacccaggaaggctgccccaactctaagggggagtgggctctgaccatattgggccaccggccttctactcccttctctcaggttttcaattaacagacagtcacggtcagttttatgacatcagctccactccagatgaagaggaagggaagtggttccctcagaagccgctgtaaacgatagcagattcacagttggatcctgttatggaaagttcactatgtttggccctcgag

SEQ ID NO: 63022 - DNA, 796 bp, Bovine  19866881344398
cggtggatcgagcctggtatggcagcctgggcttgcaaggaagcactccacgctctcaggggtgggtgttctgggaaggcttcctagggcaagcaggggtgagtccatctaaacggacatgccctgagaagataagagagaagcagataaggggaaggcagaagatgcatggagagtgtggagggggagcatgtgtggagtcttaaaaactgattgagtggaaaaataggggaagggagaggcaggtggagctcatagcactccctggaagagtggagagtcacaggagatgaaactggagagggaggcagacattttcaacaaattataaacttttcaccaaaatcttaacttcctttctcctaacatgcaatcaaagctaaaaaaaatacatatggaaagtaaattttatattaagttcttatgttttgcatttggaaggcaaaaactgaattatggccattggggcctgagaataatgggttttgccttggcatgtgcttgttcgttcagggttggtatttcatataacaggacagatgctaatgtatttttttgctttgttgtttcagcacttcagggagcatctggacaaactttttgccaaaggaatcggaatgctggatatagctttgaatgaagccttcaacattctcagtgatgtaagctcctctttgatttgcctttctcgcctctaagagaatagatgggatttttcgtgggccagcattattgttagtcaggcaggggataagagggtaaggctggggaaccaggtctagtttgggaggccaac

SEQ ID NO: 63023 - DNA, 847 bp, Bovine  19866881661760
taaaacagcgtattcctttggcgtatccttgtccatgcaagtcatccttgttcaagccaaaataactgttttatcatgctttttggggaggagggttctgttccccttttccatcccgctaatcacctttgttctcttgttctttaagttccaagtgtgacatgactgtgtctgtagccctggactttgctgtgtcccgtgcttgtcactcttgttgtgtagtcactaagtcgtgtccaactcttttgtgaccccgtagactgtagcccaccaggctcctctttccgtgggattctccaggcaagaatactggagtgggttgtcatttccttctccaaggggatcttcccaacccagggatcaaacccacgtctcctgtatcggcagatggattctttaccactgagccgtctgggaaacaacacccttgttaggcctgccttgatttgcgtttctcactgttgccctggctggtggttagtgactcttcacctgctggttggtccgcagcaccatgtggttctcacgtcttcccatttagtgaagctcctttcccttctcttctatagaattaccctttatgactatcaagccatgtgcagggccaacaaggagagcagtgacggcgcccacggtcttctggatgtaagtacagtacagtcactcagaagacagctgtgtgttttttcctgtctctgtgtgtgcatatagttttccttggacccatcaagtttatgtttcaaaataatgaatatttaaatgtgcttcctgatttcatcggttaagaaaagttatttctgttaaatccaaatctggtgatttccggaatgacaaacagacctgaagc

SEQ ID NO: 63024 - DNA, 1247 bp, Bovine  19866881737899
gcatggaaggaagcgcttttagcaggagcggtctcaccttcacaaagggttcagtcaatcagaagtaaactcggactggagatgtaactcggaccctgaacagagtccccgatatccggctcagagacggcactgacaggtccagggccgcgccccaccaccgggtgcctcagactcaagatccgtgcctctggcgactctgcgacccctacgagcccgggacaggaaggtcgctcctcaagtgactctgaggagcctgggacacgacgccggccctcaggcaacttccagaccctgaggagctcaggcacgacgggtgccctcaggtgactccgcaacctcgaaaagccaggaacaggatagccgaccctcaggtgacttcctgaccccaaggagcccggggcagggcggccaccctctgtcgactccaaggaaccctctacaggacagtagccagaggagggattggagacaaaatggtggagaaggaccttacgctcatcgcaagattatctcgcgagaacaccagaaaacaaaacaaaatgtattttaccaaagtaaaaatggcacattaatcttttcgatattatataaagcttaaatcaagtacatcatttttaaagatgatcaccaatctactagtgcctctcttaatgactgttaaattacccctttaatggataattaatgcatttaatatctctcactattatgatttcttttatgcaaatttagaatgataatagctaacaaacacaatactccctttatcataatttagccatctaaatgcccttgctaggaaagacaggtcaccttaaatgctttagtaataattcaattcaatctttctttttaaacaaataaatatgcattaattatacattgatttttcaaagacttgtcccatctcccagggagtttcactgaaaatcaacaagaggtcatcctgatttcctaaagcaaaatttacttaggatgattttcataactgaaaattgtaagtcttcatgttccttatttggaggctgataaagacaaatcacttatcctaaggagtatcataaaacacaaattagtaattaaaatcccctacatgtcagcttccaaattatttttccaccatatttttggaagtaacccacaagaaagttaagggggtaaaaaagatttacttagaaaccaacagattttccatactcaaagagcattagaagcagtaaagggaatgattcctcccctcttcg

SEQ ID NO: 63025 - DNA, 1664 bp, Bovine  19866880257556
tatattccccatgaacaagaatcagctttgagagccagagcagaaggatggcccgtttctatttgcttctctgctttaacagtctgcttctggttggaaaaggaattaaccacattcagtaaagtggaaagataaaaatcacattaataactgcaatattgagactataaggaattttgaagtttgtagaaatgtagaagaaatatctgatgaatgaaaggcacttcccctaaatatttggtcttcctctacagttccagatttccagctccccagattcttggaatttgctaaatgttgagagtgatcgtttagtcaaggctatggtttttcagtagtcatgcatggatgtgagagttggactatagaggaaactgagcaccaaagaattgatgcttttgaactgtggtgttgggagaagacccttgagagtcccttggactgcaaggagatccaaccagtccattctgaaggagatcagtcctgggtgttcattggaaggactgatgctgaagctgaaactccagtactttggccacctcatgtgaagagttgactcggaaaagaccctgatgctgggagggattgggggcaggaggagaaggggacgatagaggatgagatggttggatggcatcactgactcaatgagcatgagtttgagtaagctctaggagttggtgatggacagggaggcctgagtccatggggttgcaaagagttggacatgtctgagctgagcgattgaactgaactgagagtaataatggtgttttgatatgttaatgaggtgacttttgaaaagcatccagggataagagccactagtatctgaagttgggtggtgagggggatgaagagtgaggaggattcttgtgtgactgaacttgtggaatctgatattatgtctagatagtaagtgtcagaactgagttgaattctcagacactctgctggtgtctgagaattactttttggtgtgagggaaactgcgcccccccgccccaacattggaaattgagtctcagaacactgaaaaaataacatattatgccccctttgctaaatacttatgattttcctcatatgatgcagtcttcatccttctctgccctatattatgcccagaacaataactttatattctgccttgacctgccctgccttttgtcttcaggttgggagccagtcagtggttgacacaagtgagaaatcagaggttggagttgaagtaaggcaaggttttcattttcccatctccccagctacctctgccagaggtcacagctcctgtctagcagccctcctgtgcaatcaaagctgctgcttactattctagtaacttctccctccttgtgtgtcttcacatctagggatggtgacattctcatatcctgccacctctccagtggcacaccatcccttgtttcccttaacttaaaaaaaaaaataatcccttaattaaagtttcttcagttgtcctggtaagtatggcatttacttttcttcagaccattactgataaactcattatatctgtatgattttgtatctgcatgaagtattttttgattagattagaactccttaaaatcagggattctaattcttaaaattctcttatccttttcctccactacaaagcacaatacactatatacaga

SEQ ID NO: 63026 - DNA, 673 bp, Bovine  19866880366595
ctttacgtgaatgaaaatggggcttttcttttggcctggctacttttactctttcatactctctgtgtcctccccgctgcccctcagaaaaccctcgggggcacagaaaccccaggctccccaggctccccaggctatttctccttctgtgtgccaaaacccagcccgctcgctgttgtggacacatggtccagtcccaacatcagagatgtgctctcagcccacgaactccacacctcagaagaaatcctgccccctccccaccccccagccctgcctgtgtcctctagggcagtgcctgtgtctggccttggagccaagaggcagcttctcagagaaagctggacgtggcgagtaggtgacgctgccctcggcaggactgccaaggctttcctaaaggccacagcaaccgagtctgcccgcgagaacattttggtgagctcagtttgtttgctaccgagaacctccttgtcctcacagtctatttttaccacgcagtgacgctgaacactctgctgtcattaaagtgaatgatatatagaaccaactctccatgagctatcactgtacggggaaaggaaccctggattcagaatcagaaatcaggagcttgacccctggttttgaccttggtgtgaccttgaggaagccatttaaccctgctgagtctcag

SEQ ID NO: 63027 - DNA, 1129 bp, Bovine  19866880391919
aattgccgtttgtcccgtttagcctgcaacctcggtcctttcccttcccccaccaacttttctgggactcaagttgttgtgtttctcctactcccttcgacgagggagcacaattatatttctacttcgtccgcatttgtggaaagaggaatgggtgttagcccccttacgctgcgtccgggaccactcttcagagcccatgtctttgcgtatttgtggggaacggtgcagtatcgtgttgaatttgtacgcattctatgcacagttatatgcacataaaatgtaaaacaccgggcggatgtcgatgtcaatattttaacagaatcttagaaggggcggggaacaacttaaagttttgtattaagtgccaagatttcaactgtgcaaaacagtccgggggaacagctgttgtcggaagaattttgcgcgcgcgcgcgcacacacacacacaaacacacacactcaggctacgctcactgcttggtttagcgcttcagaaactttccagccaggatttgtaaaacttttcgggaggtgctcctgctgaccagctagggctggggagtagatttgggtcagagcgccggcaaatcggaagggggcggcggatcgtaaagagatgaggggcggcggcaggcccatgagcttggggacccaacttgaggcccaggaaggagcttgggggctggaaaactggccgatccaaggagagacagctgtcgcttacattttctctttcggcagtgacagttcaatttccatgctcccgaggctaataataacgcgattagcgggtgacctgcagagacaaagttttatgaattctccgtgttcttgcggccggttacggtatttgggtttagtgctggggaattatttttattagtcgatgaaaagaaaattaaaaggagatttatttcatccgctcaagcctttccctgtatttggatgcgggtgcctgtccacgcggacccctgtgtgggcaatccagaaaggaacgcgtggctaatgtgtgtttcccatctctggacagaccctatttcctcaccgcacttatttgttgtcaaaatctcctttgggccttcacacagtttagtggaagttcttgcaggtcttaggacagctcata

SEQ ID NO: 63028 - DNA, 3821 bp, Bovine  19866880410738
tggtgttggagaagactcttgacagtcccttggactgcaaggagatccaaccagtccattctgaaggagatcagccctgggatttctttggaaggaatgatgctaaagctgaaactccagtactttggccacctcatgcagagttgactcattggaaaagactgatgctgggagggattaggggcaagaggagaaggggacaacagaggatgagatggctggatggcatcacggactcgatggacgtgagtttgagtgaactctgggagttggtgatggacagggaggcctggtgtgctgcaattcatggggtcgcaaagagtcagacatgactgagcaactgaattgaactgaactgaactgataccaaatattgccacagaaagaaagaaagaaagaaagtaaagttgttcagtcgtgtccaactctttgtgaccccatggactgtagcctaccaggcttctctgtccatgggattttccaagcaagaatactggaatgggttgccatttccttttccagatcttcccaacccagggattgaacccgggtctcccacactgtaggcagacgctttaccatctgagccaccagggaagtccaaatattgccatagaccaaagggaactcttcttttggtggaacataagttggaatgccagtttggagagcaatctggcaatactcccttggaatattttttccagtagtcacatacagatatgagagttgggcaacaaagaaagctgagtgccaaagaattgatgcttttgaactgtggtattgaagaagactcttgagagttccttggattgcaaggagatcaaaccagtcaatcctaaagggaaacggtcctgaatattcattggaaggactgatgctgaagctgaaactccaatactttggccacctgatgctaagaactgactcattggaaaagaccctgatgctggaaaagattgaagacagaaggagaaggggacgacagaggatgagatgattggatggcatcaccaacttgatggacatgagtttgagaatctgatggataaggaagcatggcgtgctgcagtccatgggcctgcaaagagtcggtcactactgagtgactgaactgaactgagctggcaataattcactaacgttgatgtcatatatcctcatgattccactcttgggtatgtacacctagaaaagcctttcagaggtgaacaaaaagcatatgtaagtatgtccactgtagtattattcacagtaacaaaaagttagaagaaatcttaatatcttttgccaggaaaataacaatagattaaacaaattgtgatacagccagacaatggaatatcatccagccatcaaaatgattaaatctcaaacacataattaatgctgcatacaaaaatatagattcaggaagatatgtgcagcataaggctatttatgtaaagttctaaaacatacaaaataaataatatggattgttatggccaaatcatatgcaataaaaatgtaaacaggtacatgggaatgatgaatattaaattcagcatagtggttccctctggagaggctttcagaggtgcacaaaaagcatatgtaagtgtgcccattgtaataatattcacagtaacaaaaagttggaaaaaatctaaatatctttagccaggcaagcaacaatagataaataaattgtgatagagccagacaatggaatatcatacagcagtcaaaatgattaaatttcctgcctgcaacgagggagacccaggttcaattcctgggtcgggaagatcccctggagaagaaaatggcaacccactccagtattcttgcttggagaattccatggacagaagagcctggtgggctacagtccatggtgtcacaaagagtcggacatgatcgagtgactaacactttcacacacattttctggggaggcagaaagcagaatgagactagagagagcttaaaaagttttgactatacctgtaatgttttacttcttaacccccaaaaactgcatgcaagtatgccaaaaggttagcattcaaagagcagccatccatactcatactcttctcaatgtttgaaatatttctcgataacaaactcttgtgaaaatattttgtcattgggaatgaagagaggcacagtcactatatttgatcttcatcttacaaatgcactccatccttaaatcaagaagcctggattggggacagtgtgtgtgtggtgcggtaaggtgagagagaaagttaacatctgtcaggaatcatatgtatacgtcatgttatttaaatatccttattgtagacattataaagggggttcaaagagcttcagtaacttgcctagtatgtcacaacgagaagagatcacagtgagattcaaactgtatctggcttcagagcccatactcattgccctgatagtaaaaaagctcttcttggaggtgtaattaagatatgacctaactctgtgctccaggatggaagcaacacaaatacaatagcttctcatcgaatcacatatgagtatagatctaggcaaggaagtggtactagcagaaacttttagagaaggaaataacatgaggagtttgggtattttaataattttcctaacttctctttattatttattccatgggacatttagaacctctgcctctccctggaaactctggaagtgatgccaattttacaaatagattcctcaagaccattaagttatatagaggtttgtttgcttcctttatgagttgaacgtatacctgttgtcagtagcctaacaacttgagagtttaacaaatataaatacatacttaaacacaattccaaaattatgaggataaatgaaaacacaagagattctcggtcctagtttaggatttggctttgtatctttaagacaagcaccatgggtcaggtacttttgtttgtatttactgagccaagattcatgtagtcagttccgttggccctcattcggaaatgggttccttcatagtcccccttcctgtattactattattgatttttgtttcctgggaaaccaaacctcgctctaattagagaatgaggtcacattctgaagttgcagatttcattctttgccctggactcttccctggactgtttcggaccctctgtaacaggaggtctgatggtcaaagttgtccttttctcttagccttggcagaaagccaatgcctaaagctatgaactccagcttttatcttccatctgcagggtgactcaatcccaagcaaagtaacaactaaagacgtggagacatgcacctcagagacagctgtgggaatcagattggatctgcactcaagcctgctagaaataaaagaccactgacttgggcatttggatggaaagctctgccaagcacacacacaggcaggcgtcttctctctccctctctcactcacacacacacacaaatgcatgcacataggcacaccttttagaggagaggctccgaaaaattccccacatatggcaaacatattttaggggaagcaccatgactagaggccagtgggaaagaaagaaaaagaaaataatgagaaaaatcttcaataagtctcaattgttccagtcagactgctgagaaagaatgcaaaggactggagataaaaataattgataaaatcagcatcccaacatagctaaattctttcgctatttcaaacaattactagaacttactctggtagacaacaatagcccggggaactggcctctatatttatccgtgaagtactttgcttaacacagtggatgaacatgaaaagaacacttaca

SEQ ID NO: 63029 - DNA, 3080 bp, Bovine  19866880458416
acctaaggagatcctaaaggaaataatgctggagctgagctctgaaggctgtgtacagaataggcagagagcagtaggagctagaaaggaaggtctccaggccagggacatagcaagtgcaaaggccctggggctagagaagaggaaggcagctagagagcagaaaacaccttgttgctaattggtaagaagttggtctactggatgtatgtgtgtgtatgcgtgcatgagtgtgtgctcagtcatgtccaactctctgtggccccatagactcctgtgtgccaggctcctctgcccctggaattttccaagcacaaatactcaagtggggtgccatttcctactccaggggctcttcccaagctagggatggaacttgcttctcttgagtctcccgcattagcagatggattctttagcactagctctagtaccacctgggaaagccctgtctacttgatacacgcaattgttttgtcacttgcaggagatttgttgaaatatcttcttggctgccttcattcttcttgcttcctctttttattctatcataattaagaatatttcttagttgttttgtataacatggaatggaatctagatattcagacttaaaatatgaagctgagacaacgtttctatgaaccctgacaaaattcaaaggaaaaatttcttattaaggattaaggcatgtcaaaccacttgtccatcttttgtgtggctatgattggatttaaacagatacactgttttaaagacaaatattcctgtatcaaataaagtcctgtaagataactcttagccataaatttgatgtgtgttttccagtatgatcaatgttagagacaagctggaagaaaggaatggtagcataaattaggaggagatgaagccttctgaatgctcactgaggagatgatatcttcttcccacttttcctaataagttatcaaacttgaagtcatagacatgatagctatttgcagcctcgtaataacccttccaaaggaaacctgggtggtgtcaggtaattgtcatttgaatctaatactttttcaccatcttgccaagtcattttgacgtgtcctgcttggtgaaaggagaatcgtaaatgccttttgcgatccgtcactgttggaaatcaccgaagtggtattcctctgactgtgtttatctagcaaccagagttgtgttgttggtgtgaaagtcgccccacatgaacccatcagtcatcaggcaggatcttttagcctcaccgtcagggctgagattcagtaaacatcttaaattctcccctggaattatgagagtttctgtaaaagaaccacacacacacacacacctatatgaaagatacacacaacaatatgaaaaccaagcccatactttgctctgcttatctagcaagggcaataggtctgcaaaatattgtaaaaaattaagaatatgacatttccaacattatttcatgatcatctatataataataaataccagatatcttctggatagactacaccatgcaagtggttgtgttgataacattaaataattcttacctgtatcctatatcttctctcaaaaatcacttgtgctcatcatctaactacattacaggcctgctcaaaagtcatttaaatcatgtttctctcttccttaaagctcttcaggggtgcttataacatataggttacaagataaagtctgaatgtcttagcatggtgccagggctccttgtcttacttctttataaatattgcttatattttctcctttttaagatgttcatttcactttttgccttttccaccctggtagcccatttattgcttgtttgcagtagtgtgcatcaaatatcggtcacttcccatgaacaacatatgtgggcatatcatgcccagagagaaggcactatatcattgattccccccccccctgtattttcatagtactttgcacactgtaggtgtgtgttgggtaaccataggtgacaacaaagaccacgataatggttagcaatttagtatactgtgtagaaatacttaatagtagtaagtcaacatcagccaaaatttcttttccgttttttctctatttgagtgtcatgcatcagtaatattgtgtgtgttcagtcatgtccaactctttgcaaccccatggactgtagcccactaggcttgctttgtccatggaatttcccaggcaagaatactggagtgagttgccatttcctcctccaggggatcttccaacccagggtttgaactcgtgtctcttgtgtctcctgcattgataggtggattctttaccactgcgccatctggggatattcatatgaatgtaattatttggaaaagttattttccactgaaatactcataaaactttaatgcgtatattgaaaataacgaatatccttagtgcagttcatatattggtgactttggtcactagatggcataccacaagctcctgctgggcagctacacaagctgacgcatcatttgaaaaaggcctgcgaagacacagggcagtttgctttggacaaattacatctgaagggattttcagtgtttgtttcaaagtgaaaattagacttagaatacatagttaaatatataacaaatgtgagctgtaaggaatcatttattcaacagataattattttaaagagaaactaggtactaaacgctgtgtcaggcccggaggaagacagcaagatgctaagacttgagcctggttgaagctgagcagagaagctaagtgtataagcctcactctactttccaattggcactgaaaaaataaacctaacaaaacagagagtagattgtttaactcctgaagaagaaagtagaagaataataggtggatggaacctataactacactggaaaccttcagtgtagttaaatgtcagtgaaggagttttttacatttggagaaggcaatggcaccccactccagtactcttgcctggaaaatctcatggacggaggagcctggaaggctgcagtccacggggttgctgagggtcggacacgactgagggacttcactttcacttttcattttcatgt

SEQ ID NO: 63030 - DNA, 795 bp, Bovine  19866880508614
taaaatgaggataacaatccttatgcttgatacaggtttgtgaagatgaactatggttatagtttaccaaacacttcttcatatgttaaattaggaaaatattagaaatccacaagaattaagagacttctgggctcacataaactctcttgtggatgaagaaggagttaacctgcctggcagtgcacaggggtctgatgggtctggtcagccaatataagcagatggctgtgatgtcattcttgtaacatgattccttgctggggtgcaccggtggggcatattggagcctcacagaggagcccctctctagcctgcccacatagttcaatttactctcaataaaaatgcaataaaaggctcacttgccttcagactgttgaatgcttgtgactccagattatttggaatagaaatcctgactgacaggatttgggagaagaagatggatgaaatatccttaaagcaaaaaagcaggaaatgaaggaaataaagtggttgtattttaccaaactggatggtagttcaaagaccctgcaagattttggaagtgtataagccagggctaaaataatctctagtagcaaatgatgttgtgttcctaatacaaggtggtggaatcaaaccctttcttctaaagattcacatgactttggggaagctgggcaacactaactgccacctcttcattatcgtaaaaagtctaaacttcctgagtctcaagattggccagttcgagggcatgctaatgcttctcccatattatggcattatccagagtgtttagctctggca

SEQ ID NO: 63031 - DNA, 1192 bp, Bovine  19866880651412
gataaaagcattataggaaaacacagattggaggtgagacatacaggaaactggaaatcagtgtacttgcccatggctggaaggactaagtgactggagcatcacatcacacagaacccgtagcagaggatctcaatcataggtggtgagtgcaatgtgtcttcttcatttggataaatattgagcgaattggttctgataccagtagactccactccactaaaaggtctcagaacccctgctgtgtgatggctgttccttcctgcttcacattttcaggatgggctcctctgtctttaaattttacaagccattatttgaactttgttattgattttatggacattctctcatgttatgggagagctaaggggatttggggtgttctctcttcctcagaaagttaccatttccctaaagataggagccatgattttcgtttcttcagtcttcatgcatagcatccagtgcggattctggcattcagtgaaaattcagtgcgttaaccgccaaaattaaatcaggggcaccaattacacctggccagcggacgggggagcctggtgggctgccatctatggggtcgcacagagtcggacacgactgaagtgatttagcagcagcagcagcagccttaagacctagacttctcttataaattcataaatttcttgaccaatcagccagaaatgcccctacaagagtttctctgagtttattgccctcagaggataatatgaattatatggtacgaataataagaattattctactaaacgatatgatttatttcagcattttgaaatgcgtcctgtgtttctgtctgaattctcctgacttgacagtgagttcctggagcacaagaactctgtctgataaacacagtctgatacataacagacagttgctaaatgttagatgtgtaataaatgtaatttcacaagaggaaaaaaaaaaactttcatgcttgcttaattacttaaaatgactcaaaatagcatagagattcttttttacccatttgaaacctcctgggactagtcagttctagaggaaaaaaagggaaagaggaaggtagaggagatggggttatttgactcacatgtccttgatcatccaattcattgttggtcagcttgagtttgtcaaaactgaccacctgtctcatccaagtatctccagaagctagaga

SEQ ID NO: 63032 - DNA, 1590 bp, Bovine  19866880767607
tatgtatatactactgcataaaatagataactaataaggacctactctataataaggactatagggaattctactcaatactctgtaatggcctacgtgggaaaagaatctaaaagaatggttacatgtataacagatccactttgctgtatacctgaaactaacacagcattgtaaaccaattatactccgataaaaggttttggggaaaaaattaccttttctttataaaaatctttggaaaatggcagtggttatttgtgagcatgtcatttaatttacactaccgctgctgtgctatagataccagctatcttccttttttttgcttaacaatatagttttaagatataatcttatttttatgcatatattcaccttgtggcttctggtttctgctaagtactacatcatctgcatccaccttagattaatactccctcagggtcaggacccagactgctatcatctccctgctaccacaaacaacactataataaagagtgctttgagctcctatttcttctctatccaataatagaaagcctttaaggaaatattcaacgcattgatagattccctaactaagaaaacatgcagaatcctactgaaaattaagtcatatggctatttttcttactatgcaaataattatccttaatatgtttgtggtataagtttcatgttcggacttatatacatttgacttccataaagataaaacatccatatgaaacaatttggacattcttcaagctcagtgggattagtactttgctctctttcatttaaactgtctcaagtaatcagctttcttctttgagatactgtatcccaggccagtagatatgacttcttggaagtcctaacatttggcttacatttacctttccttaaattgatctcaaaagagtgatctcttcaggccaaattcctccctaaagaaattagcagtgtgtaaggttagctaaaatcacagattcataataagaactctgtaactatttgggttcaggaatagacaatagtagatgaaggtaagacagctttgcagatgtccctacatctataaccaggggctgaaattttatgataggtccttaggaaaaagtaatgttgagtctattcatttttttgtgataaagataatttaaagcctggtaagtagactgattcaattacaatgtgttgggggaatacaacatcttaattaaccaatgtttactgaatatttattatatttgaggcattatgataagcaatgggatagaagaatgtggaatgtaaacattaataaaatatttatacttgtaagattattagtagagggagaggttcttgatatgggaataactaacagaggaaggtaagactacagaaacccgattcaacaaatattgagttccaaccaaatagggctatcgttttaagtcctcatcaacacaaatgactttggtgtccgccctcacaatctgcaagaggtggaaaacaagaaaataaatgtgattaagtcttatggaaactatgatggaaagaatgcagaaagagacaaaaaaagtcaggagagggagatccataaaaagaaagtat

SEQ ID NO: 63033 - DNA, 1268 bp, Bovine  19866880787377
tgctttgcaagggctgtctctagttgcggagagcggggctactgttccttgcggtgcacgggcttctcactgaggtggtttttcttgctgtggagcacaggctgtagtcatgagagcttcaggagttgtgctcaccagccttagagcacgtgggctttagtagctgtggcacatgggctgagttcctccgtggcatgtggaatcattctgggctaggggtggaacccatgacttctgcattggcaggcagattcttatccattgccaccaccagggaagtcctcccattcttatttgaatgaaaggagaggtctatgacaagtattcgtggcttgtagccccatcactttctccttcccctcagtgggaaccagggtgatggatgtgattgctgagtctggaactcttcaggacggcttgcctgcagagagtatgcaatctgggctcttcccattgcatggtaagcccagcagaggaggcctgcaggaagtcaactcatttcagggggttccaacacactctttcagccttcgtacctgtgctgtcatcttcaaatacttttatcaatagtaaaactggcgttttggtctccatgacatcaggctcctaggtctttctcagaaatttattctgagttcaaatgaggacaaggggtgataaccgttgggcgttccagaaccccagtgggaatcccagtgagttcactgtgttagccctgtgacatcatcagagcccataatggttcctcctgcttctttaggaagcatcattcacatgctacagtgtgagaaggtcactgcccttcgacctttacttatggagctcctacttttcattcccatgtaattatgtccctgaatagaagtgtctaccaaagtgtgtgtgtgtgttcatgttatggagaagagtagtagacatctagtccttttgcagtgaaaacactgacagattttgcttccaggcattgtctctgcaatgggagggagattgtttatttctgttgttcttccttctagatttctcagaaattctgtagcccaaatacagctttgggtggaagcatcaatatgtatttacctttagcaggcccagcccagggtgcaatatccagcatcccctctgggagattcctcataaggaggaggcagtaacaccttcttgttgctgagggaaaacagatgcccttagcttgagttaagttttgtcttgtgatctgtgctcctgggctctgtttgttccctgctagaataagctcctgcagaggggct

SEQ ID NO: 63034 - DNA, 2515 bp, Bovine  19866880871389
ttgcctgattgactattttgactaaacccatcagcattcagaaaacttagatcatggcatctggtcctatcacttcatgggaaatagatggggaaataggggaaacagtgtcagactttatttttctgggctccaaaatcactgcagatggtgactgcaaccatgagattaaaagatgcttactccttggaaggaaagttatgcccaacctagatagcatattcaaaagcagagacattactttgccaacaaaggtccgtctagtcaaggctatggtttttctagtggtcatgtatggatgtgagagttggactgtgaagaaagctgagcactggagaattgatgcttttgaactgtggtgttggagaagactcttgagagtcccttggactgcaaggagatccaaccggtccatcctaaagaaatcagtactgaatattcattgaaaggactgatgctaaagctgaaactccaatactttggccacctcatgagaagaattgactcattggaaaagaccctgatgctgggagggattgagggcaggaggagaaagggacgacagaggttgagatggctggatggcatcaccgacttgatggacaggagtttgggtgaactctgggagttggtgatggacagggaggcctggcgtgctgcaattcatggggtcacaaagagtcggacacgacagagtgactgaactgaactgaactgaaaatgactttataattcagtcaagttgctggcttttcaccaaaaaagatcaccagtgtcatattgctaatattttatatttgtgtgacagtttgttttctcagagcattgtctgtcgtaggatggaaaatcacaataatctcatttgattctctcaaaaccatacaaaatggagccagtagtcaccgtattttggagatggggagacgaatggcccatgatcacagccaggtgtgagcagagccctgggagaaagccattgattttccatgagcatcctccccccagactcagtaccctctcttcccttaccctgggttggaagacgagctggaggcaggtaggatgcggctttacactctgagggcctttgaatgtacactgaggctcctctggttctacagggctgagctggcctgtaagtacatggtagtgatgtggagagtttccttcattctttttgaggagtcactgtttctgggcccagaatatctgcctgtctgtttccttagctgctgcccagtaggctcaggagcacctgctctgtactatttgttaaattcctgctgaatgacagtgatcagtaggtacctccttctggggatgggcttctgttacctgtacacctgttaaatcactgacttcttggcaaatgtgtttgtaggttttcccagacaggctgagtcaaagcctaagaatcacaaggtaggttctgtatttttcctcttaaaagtaccaggctcacctctgcatcttagaggtcatagttgtcctgcaagattccattccttaatagaatgtaacagttgttacttatttttctttttttcttacaaattaaaaatactcaaataacttgtacacatattaaaaaattcaaatagcataagaagtagtcactgaaatgcactaagtgaaaattaatctcccatcgctagtgtcctggtttatcactgtagggtcagtcactgttaccactttgttttgtatcattccaggtagaggtataatgtatatgagttgttatatgaatgattatatgattataatcatatgattattcattatatgaatcattatatacacttacatacatatgtttatatacaaacctttaaaatcaaaacacagattttggcataatacacccagtactttggactttatgaagttagtttcaaactgttatactggagattgttaaatagacatacttataggttttccccttcctgctgttttaaaagtcccatagtattccagtgtgtggatttatcatcatttttacccaaactactttaatggacctttacattgttttcagtcattttcttctgtaaataaagctcctagactatgtgaggggggcattttgatagcatttatggaataaattctagaagtagagttgtgtggttgaagttacatcatttaaaattctgatggatgttccaaaattgccctccataaaaggttgtgcaatttacacttccacccacaggacatgacagcctagtttcccacccacttgccaacagtatattagaaaatgtttccatctttgctaactaatatccttgtctttgaaaactgtttgcaaattgatcttgtcataaattcttttcagctctccccacaacttccctattttttcaaggtacagaacttaagtttatagggctttagggcaattccttcttcccttaaaataggcagagggtttcatttaatctctcaggcttccctgttcctgcatttattaccaatcattactttaacttattcttttaggatcctg

SEQ ID NO: 63035 - DNA, 834 bp, Bovine  19866880890980
cctgcaatgcaggtgacctgggtttgatccctgggttgggaagaccccatggaaaaggacatggctacccactctagtactcttgcctgggaaatcctatgatagaggagaccagcaggctacagtccatggggttacaagtgtcagacacgacttagcaactaaattcaccaccacgaccctacaagtagaacttttgattatcttttctcagaaatatgtgattatctccatttcacagaaccaaagactcaaatccaggcctttaaaaatatgtctagggtatgttccttgtatgctgtctgcccttgtatagcagaaaaagcactggatatggcccaaagactgtagcttctctaaaagcaaaacacactaataaaattctgcttctgtgggggagagtcaattgaaatcaaataagagtacatttcattctgtcatctcctgacctataaaagtgagttagaagactggactcctggacagttgttgcctctgggccctacaaaagtctctgttcacttctcattgttgcagatttctgaatcttgtcttcaggccagcttccttctctcttgatatcacaacagcattccattctgtacttggacagtctgtgaaatctgtcttctcttagaacagatgatagagctcaggtttcaaaattcaataaatcttgtcctgtgagattcttgaagtgggcattcaggaaagcagaagccaaaaatagatgttcttcaattaagcctacagtgaaggtgttagttactcagttgtgtccgactccttgagatcccatggactgttgcccgccaaggctccactgtccttgga

SEQ ID NO: 63036 - DNA, 1578 bp, Bovine  19866880898623
cagagcccacactcagaccctttgattccactgcttctctgctgtgctaagattcatcacttggtgttagccttccagacttagaatctgaggttgactttgtactgatctagccctgcctgatcactgtggatccagtaataccgcatccttatgcttctctcttccttttttcaataaatacacagctaaagtcaggcaccattctagggaacagcaggaaaaaaaagatcacaaatgagtatggtccctgctatcactgggaaaagagacaaacgaggagttaggatacaatgtggtaagcgatctgatcaggaaagcagaggaactcagagcaataaatttggtcagcaaaggcttccttgaccaaaatacctctgaaactgagacctgccagacagggaggcatgctatgcccatcttagctctgtctttgtccaccacttgtacaagagtggcagacaatctattgggtttgtttttaactttttaagttgagtagcattagagttcaaggaatataagaattcccctggtctctaagaatttcacaaaaacactgagataaagggaaattccacagaggaatcatagacctcagcttggaattgctacctggggaaaggaatgcaatacacattttctagaaagatcttgggcccattgagggaaaggctgtgtggtgcggttttattctataccgcattgggctatactttttctgcaataaaaccatagcacttggtgtgtcagactgagtctaattcagagatgtaactatgacctcagccatagaagaggactagaaaaataaccacaggttgaccttgaaaagagcagtactgattcaggcatggaataaggtttagcttacaacagcttgttagaaccacttaacattataaagaaattctagttcaggatacacagtcttcaaagatagcacctgaggatttagacacactaaatatttgagccttggtctaattccagggtcagtgttaggatgagatggaccggctttaggttcatggggatttcaaacgcacggcctgttactaagagtctaattatataagaaactccatattaacataaagctctagattaattggcagggcttcaaaaccgatgttattattgaactctttcctaattatacaagtttatcatttcacaaagttcttttactttccttcttctttctctccctcttttctccttttaagtaatagtacataaaaatatatcccataagttgaatgcttagtatggggtgggccagaaagtatgtgtgggtttttcctggaatgaacttttcggccaacctaatatttgccacccattgtaacaggagctaaggctccctttattacataaatcacttaattattctatggagtagatattatttcactgattttaaagatgaggaaactgagatttaaaggaggataattaacatgttcattataaatggacacacagatcaccacacaaatggaaattgtctgaactaggatttaaacccattttgtctgaactctcaagtctgtgctattactgtctgtggttgag

SEQ ID NO: 63037 - DNA, 1102 bp, Bovine  19866880941959
tgttcttgatatgtatttccttgcatttgtccctcaatttaatgtcatcaacccatcatgaaatctataggagaggaattgccattttatatctgaggaacatgaggctcagagagtactgttagcttgtacagtatctctccataagtaagaagcaaatccaatatcaaaacctttactccttattcctaaatagtgcttttttcatgaacacatagagagcatgtttgaaaccccagcatgtttgagaccccaagcattcttattttgaagatgagtacagattgaactgaactgaactgaactagaaatataggacttcccaggtggctcagtggtaaagaaccctcttgtctaggaaatcccatggaaaaaggaacatagtgggctacagtccttggggtcaaagaagagctggacacaacttagtgaataaacaacaactggaaatacagacctgaactactgatactgtttatatcagcaaatcaactaatagctgctagatttaaatctggattcagccaaacttgatcacatttgctgctcagaatccccaaagcgggtcccaagttttgtctccttatgcttacctcagaaatacctcaaagtatattctgcctgactacaagagcagttggcctgagaattccctggcagtccagtggttgactccaagcttttactgcaggggtcacagtttcgatccctggttggggaactaagatcccacgtgctatgtggcacaaccgaaaaaaaagtagttggcctgatgagttggattttcccattaagtggaagcttctcatctcacatctgcttcagtctaagtagtagcaagtctctctaaaacctagcttgtctgcacttccttttcccacatctgaaaatggaaatgataattgtgattcaccacaccagggcctgattgattttgtaacagaaattgattgtaagttttttgtcagtgagtaccatgatcaccatttacacatgagaaatgagcatgctgggcaaagaatctttactcgcgtttcttaaagagaaggaaatagaagtggtctttttatcagagtagatattaatacacctaacactgcct

SEQ ID NO: 63038 - DNA, 2310 bp, Bovine  19866880965742
ttagaatctatactctcctgacctctaacaagttcccccattgtaggttgcagtttttaatgaacaaagtgtgttgtagttgttgactctccccggtcacatccttttcaggcatatctatcctacctgcataccaggtggcaaggataaggcagaatcatgtttaagctgaaatttgaggacccaaagctataaattagcaatgcaagtataaggagagatctggaaatagaaataaataggcatagaaagaaatataggtgtcatgatgatttgagagaccattttgtcttggcactgattagatttcctataaagactttacagcagtttctcttcttaacatctcaggagttcattgttgaaactttagaagcaaaaccttctttgcttggaacagtttgaacagctcctagttcctgaaatgtggctgaagatatgactcccatgggaagggggtaaagggaaataaaagcgctctgtaggttttgtgtttggtattgctgctgctggtggcatccctgaggcatctgggggagcaggctgaaccagtgagcaaactgctgtgctttcctgttttcagagaagactgcattgcttctcaagctgggctttcaggccaccttgcttcatgaatcatggccccacagcttgtttctctttctctgaccctcaatactccacaccccctctcatcagtaattttgtttttctagatgatgagaaactgccagatggatcccttgctttgctcgatccctggatcattggtctacctgctgcttctgccggtacttgccgctgggactccactgtctaaaaggactgccaaggtgcatttgtcagagcatggctcattatcttacaaactaaaggcaggtttatgtcctaaaacctaagcgttgaaactgcctttatgagtcctgttgagctaaaaaacactcatggaatctgtctgcaacatctcattattcaagaagaatttataatgatctactggttacccttttcctgtgattcttcagtctcattgctgagaaatcatttttgcagtctcagtctgagtccattttctgggaccagccttgtcaacgtagggagagagtaaccgagctcaagaaacccatcccttgcattttctgctctgaccttacagttgagttctagcatctagactcatgctttgttctgagaaccagtccccaccatatgctcctgattcaatggcatcgtaagcataggattcacttttgacctcaatgccatgtgcctttgggcatgttcttctttagaattcccttacatataccctttttctcacttgattcacagaatagtctcattgaaatcaattattttacacttaaaatccattttcaatgtagctgggacttgaacaaagcccttataactccataatcaatgctttttaagcaacatgtcttttctgttttagcataaacctgttctgaaacatgtggaaatagagattaatatgaagaagatctaaataagctttactggtattttagaatttttagtctacacatatagttttttttcattgttgataccattctataaaaaaatttcataacctgaaaatttgcattcagtgaatttgaatggtcttttggttctgttttctttttttaaatactgccactgttgattttgatcatcatattaaatcggtcctaagactataccaaaaaaaaaaaaaaaaggaggaaagaaagggaaggagggaggaaggaagggaaggagaaagagaggaagagagggaggaaggcaatagactctcccagatataatagaaaggaactatcagagcaggatattcctgagccaggtttcttgagccggacactgcagactagaggaaactttgtagaaaatttgtagataggcagactagaggaaaatctgtagataggcacacaaacaaaacattacaatggttccctgggcttggtttagaaactatctgattccctccttaagctatgtaaaattcgaatacctctttcacagtagccagtgcaaggaaacatctctagtacaatcccagtgcctactctgagacagtgtatagtatggtacatgaaacaaccaaatgaagcaaggcattacttcctgagcaggtatgctcatgttagggaaacctgtgcccaagaatagcagcagagttcttcttcatcaatctcatttacctaaaatgccaacctaaaaggtgagaagaacagccaatttttgtggtttaattggaaaggtcttcaaactgccccccaatcccaagcctacaagtct

SEQ ID NO: 63039 - DNA, 882 bp, Bovine  19866880989149
agaaatgaggggcaactgattctggggggtggagccggtgggagggtggtccaccaactcagtttaccagtgcttaagttgctttcctcagtcttcatttttttcaaatccatagaatttttccagctatttctgagaatggcagaaaaaatgttagaagcaaaaataacttgtatttcttttaaattcagtaatgccatagaactcttttggcaggagagccctgggcgttcacacaagcaacaataggttatatcaaacacaaagactagaaatcactgatccgggacatctgaacatgtgatattaatctaaaaacttttcaagagctttatggaagctcttaattctagctataaaaaaaaattttttttttggtcttatgttgctattactgttactttctacaactgcaataaaacttccctcattccaacaaagtaaaggatgtcagttcagttcagttcagtcgctcagtcgtgtccgactctgcgaccccatgaattgcagctcgccaggcctccctgtccatcaccaactcccggatgagtcaaatgatagctaagttgtattaggaggaaaaaataaaaattattttttaagttaacaggattacagaatcttatagctaaaggggcctcaggttatttaagcctctctcgtatttcatgaaccaggaaccaaggcctcctcagtggctacgaaccaactttaaaactttttttttcaccatttatatgtctgcctttaaaaccaatatcctcggttccaacattaataacaaagcttgcactagaatctagtctaatttaagttagtgtagcccacttcctatcttaatacatggatataatctagaatacaagggcttgtgtccaatgt

SEQ ID NO: 63040 - DNA, 1353 bp, Bovine  19866881014142
aaaagtgatagtaccatagataatattctatagatagctgtttaaaattaattttatttatcctatagttggctttgtactactttatagtatgatgcactataatttttatccagttctctacagataaacattaagattgcttttattttatacatttgttttgaaaatccagacaaagtttaaataaaaatttaaaaatatgtattttggctacttgtatgcattaaatcttagaaaactcaggttctagcctttatgggttgaatctgctggaaaatctattgtatattccaaagatagactcttagtgatttatcaagccttctccagatctctcataatcctcaaatgagcaaggctcactcaacagctgccaccagccctggtttccccaaaagggtcgtcttgtgggcttcagttaacctgactgtgaacaaattaggttctggctccaaaaacctccccctctcttccacagatgcacagaacaggacaggttctccctgcctctaaccatacatagacaattttagcaacagcctgcctggcatctgtttcaccaggttcttaatctcagcaccattagtaattgacaccataaataagatcaccggtgagtgcctggaatcttgggatgggccaggaatttgacctggagatgctgggggatctgacaagagcagtcttgtggtaaattaatatctgtggcaaaaaaagggtgactctagcacatagctgagtagacacgcaggtttcccagtctggaggtgctccataaataagataaagtttcctgacctatctctgggattatttgtagccatggttacagcatgtgatagctacaagtgctttctgtaactaggggagtggggcttctaacttcaggcttttggccagaggttgcaaacttctggtatgttgtcagtaaacatgtagaatgctaaatagtaaaaataaataatttgccaacatttaaaaattgggaggtttggcataaaattctgaacttctggtatctttggggggaaaagcaaagatttggcaccaccaagaccacagtttcatgtgggggccagacagggctgccatcttcagtagggttgtgagcgctccaatttgacagatcttcctctggtcttcttccctagcctgtaactgcaggcctctggctaggatgtgatgccattgacaaccccaggtgttctgtggctactcatggctaagcagatgagctaaccactcacacagtgttaattagtggcaaactttgggcctcccaactctcaaatatttattctttcatttacctagagggcaaaaatgctaacattaagattcactcaatga

SEQ ID NO: 63041 - DNA, 2006 bp, Bovine  19866881020143
tgacatcctattggtagtttgaaattctatatttacctcctggaaatttgcagattctactgactaatgcttttgtcctctttggagactttattttaccctgctcctctgaagaagatgactatagcattaagccatgggagtggtgaagtgaaactgtttccagaaattttagccccaaatgtatcatactagtttttgtgactgaatgagctgtaagacattccacagttagagagctcccattgacaagcacttagtatctatcttgtatccctcacaaagcacattttatggaaactgtgtcaatgtttgcacactcaaaacaagacagtgtctcaactcccggtacttgctcatcttctctgaatttctcacaggctcttgggtggaaagaggattctgcaaatctagttgtcaaatcttcagggactgattatacgggtcatggataaaacaggctctctttcctcatcttcctcatcaccttctggcctttttactgctcattagcacctccaccagagacccgggattgggaaggaatgagtgggtgtggaacgctcatcagaccttctggctccttgccagctgctcatgtaggttttgttgggaggagtaacttagagacaaagtaatggatccctagcatgggtgattttattcaactaactacccactttggcctcacccactcccaacacagatcattaagtgttggttgcattagcttattctgctccatgatgttttattcacttcagtacattccactggtggctggtttagttaactgtggatctggccaagcattgtgcaggatcagagtggagagaagattcgaattaaataatgttcacaaattagaccttgaaaaaagtgaaagtgttagtcgcttgtcgtgtctgactctttgcaaccctatggacttttgtccactaggcttctcttccatgggattttctgggcaagaatactggagtgggtagacattcccttctctaggggatcttccaacccagcgattgaacctgggtcttctgcattgcaggcagattctttatggtctgagccaccagggaagtccaaggagagaagattcaaatttaatagtgttcacaaatgtgatcttaggatgagtaaaaggcaactgtgctgaaatttcagggacgtctcagctgcttccccttaatgcttcttgcaattgtactctaaggatgtatagtaaaccctccacataattatattattaaaagtaaaaacattagtcaaatctttggttatggatgtttacttggctatgaatttacctctttcattaagggatttgtttatcttgctttggaatttcaagcaagagaaatatggtgagctatagtccatgggattgcaaagagttggacatgactgagcacatgtgtgcgtgcgtgttagcatttgtagagctaataagtagagtgcatctatgtacagtaatggagggccacattttagacatagtgaagacagtcttctctatgaagagatgcttaaacagagacccaagaaatgaggagagaccaccccatgggaaaagctgggggaagagcatgaagaatgagggacaagcaagctcaggaactctggagtgagttgtacgtgctgaggagctgaaagaaggctagtgtgtatgatggaggaggagtagcaggaacctctgttggagaagtacttggggatgagggtaaaagacagacatgttatacagggcttcacagaccatggcagggaatttagacttagtgttctaagtgcaataggaaaggattgcagagttttaagttggggagtgtgatgaaatatacattttaaagtccactctggctgctgcatggagaatgcctggtagggacaggagtggaaataaggaggcaaattaggtggctatgttgagagcttctagatgagagaggatggtgagctgcaccatgatggtagcagtgatgttaaagacaggggatagattc

SEQ ID NO: 63042 - DNA, 3198 bp, Bovine  19866881021387
tcctaaaaagaggttataatgggctactcttctctttcctcttggagttgtcttttcttctgatcagtgcttctgatttccccaggattagagcaggtggggagaaggaagaggtgagggaaataggaagtctggggtggtccagagtcagcagcctgtggacctgtagatatttaaatgactcttcctttactggatgcttcttgaaagtcgtcattaggcttttctcaccttaagttctcctgtgcattaatacttggcttctcgtgtggcctctgggcatccaggagtctacctttggcttccctgctccttaggtcctcttgtccctccaggaagttctctctaatcatctggtttgtaggaaatgcacagtctttgccctgactctgggagcatacgcaattcctgtaccttagccgcctactccgtttcagccagcctctgcttgtttatatttttaagatgtggttcaaacatcgaaccattatgtcccccagagttcacaggaattatattaagatcttgaatgggtctcttcaaaatccctctttctggatttgggtttaggaaggtggtattctcacccctctctccctcgacggggcagggtggaagacacattgtaccagtctctccaaagaaatctcttcaaatacgtacctcttgaccttttatatccttaatgtgggtaagtaattgaccctgtaagagtttctgaacatctcctttgccaactgtacaaactggaatgaatcgtttccttggtgtcttagcatcaagttccattttaccatcttgttgtatttgtcaaatagccaccacagtgtctggcatagaaaagcactcaatagatgttcattcccttgtttccagggaaactagcaaagcataattacagataaataattaaattagtcaaacgttttgagatattccagatggaaacaccaaagaaggtgtaaagcaccattcttagagcaattttcatcctctctcttcattctgggcagctggcagtcttcttatatggagtgctgacacattcatgatgtgtctttctctgggaccaattttgatgacaggcaaatacaatttgacattattcagagctgtaaaattcctcctttctccaagaagcatgtacatcaaactgatcatctcagcttttttgttgcttttaatattttagaagtatggcaggtaaactgaatttttagtgtgtatcatttatgcaacttacctggaaaattagcctatcactatacatgtgatatgggagaagtcaatggcacctcactccagtgttcttgactggagaatcccagggatgggggagcctggtgggctcccatctatggggttgcacagagttggacacgactgaaatgacttagcagcagcagcgtatatgtgatatatcatgatttaattgaccccagatgagtaaattacattgttttacaatgactctatgataggtaatctctgggcaatgaatggttgaattgatctaagtttactggtgagatggctaagataaagtttaaggtctgtaagtcgcctgatacatgaattgggtgggtcagtcagggcttgatttgatcttttaagagggtcaatctgttagttttctgggcatttaagagaaactggaccctattgacctctgcttctatcaaagctgtcagcacaaactcaacgctcttcatgcctccacaggaaataggaaacataaaaatctgaatggtcaaccaatcaggctttctcatatgaggattatttctctacacagattgatggagttccatctatagaactgcaacagtggcttaccaagatgttaacaaaactttagcctcagtcataatttatatgtgcatataattctggaagcttattaatgaggaggctttattttcctctctatcttatcttcgatcatcagtatccatgctaaagattctttgttttcatggatcaaatggttggattagaacaacaggatcagagtctatataaatcttttctttaaagcttttgaaatatactgcccaattgttctctacaatggttgataaataagatatgcttcctctaagggggataaaagtgcctggtttttcaggattttaggaatactggtaaattctgttggcccttgactttgggagctcccatgcaatcttacacttgacattgctccttctgttgtgataactcaggaactgatatcagcaactgctttctatactcatgacctcgcttttgattcatgtattaaggtttggtatgatgttaagattttattttttggaccaccaatctatccttcatctcatttagtcaatcttatctcaatcttgtacacttattgtgattgatatgtacatcatggccaagatagactagaattgagattctagaaagattatcataggatgaagactttatgaataagacagagactcacttctcaggcctggtttatatattggatggctgattccctggtggctcagtgataaagaacctgcctaccaatgcaggagatgcgggtttgatccctgagttgcgaacaaactctggagaaggaaatggcaacacaaatccagtattcttgcctgagaaatcccatggacagaagagcccggtgggttacagtccatggggtcgcaaaaagagttggacacaacttagcaattaagcaatagcaaaatatcttggattagttacagaggttaatgaaagcttaaaaaagttcaaagctccttaaatttccctgtggtcaaaatcagtcccagagcttagagaaggactgaaccttttgaaaatgggagggagatgcaattggctctctggtggagataaagggcaagaattttaaaggcacaatttccccaagtttgttttgtggccgtcctcctctctgtaaaatctcaccttatccacactcatcatttcaaatatcagtttgtgccaacgactcttaaatgtatatctctagccctgaccttctccaaactccagctgatttaacaacttctgatgaatatatacataaattttcatgttttgaaacttccagtgtcaatatcagatctaatcccttgaatctattgctgggagaaatatcaataacctcagatattcagatgacaccaccctcatggcagaaagtgcagaagaactaaagag

SEQ ID NO: 63043 - DNA, 1488 bp, Bovine  19866881114926
ttttgagactgagagccccacagtgggacattctgccaacctcatgggattccccacctggccaaagcatctttccattctgggcacgagactgcaggattccccctcccccaatttcatgactctgaatgcagaatggatccaatattttctgtgctagccgtggaggtcattgtacctatgagatcgatcagttttctttgcaccttcaacttgcttaaagcattggggatagtgagctcagcatgcaattttcaaatgttttttccaaatcagatttctgcaaacaaggtaactcataggcacatgtggatacccactcagagggtggctgcctctccaatttccctctgaccatgatgtcaggaacttttatctttcaatctccaggatttactgtagggctcagcataagataagtgttcaggaaatgtgtgctgatgaactgattgctagctaaggggtcacttggtaaaaacagaaatcacagaagttcttgtcaaccgagctaaaacttaaaaaaaaaaatccccaagggacccttgtctattgaatgttaaagcatatatcaattctgtggtcaaattttacctctactatacaaagaaaataattagtgcttcaatgaaaagaatatcatgtttaccggaatcccaagtagtttaatttcgatgagggaagatggatggactcagaaaatataacttttttttctcctttggaaagtgaaaaacttgttagactgtattggtcatggtcactggtcttaaggtttttgtcataatggttttgatcagcctactccgaatttccagaggaatttgagagtttgaaatataaatgcttctgatttgagggaataaagacactgaaaagtgcaatcagattggagttatggacagagacagcagagaggggtgttgacaacagaagactgagtttgatgataatgataaagcctgattaagttctttccatctgccaaacaccattctaaatgtctgatttgaaatatgtgatttaatgctcacaacaatgtatgaggaaggaaccatcatcttctctattttccaatgaggaaaccaaggcacagagatgttataacttgcctaaggccacacagcagggacaggatttgatcccaagcagtaaaactccagaatctatgtttatatcccctgcccaagttgcttgcactgctcctcagctctgtgttattgagaaggcattctgaacctttctgagccttagtactcaggataggaataataatgatctaatactgcttgcaaatgtaggagatgtaagggatgcgggtttgtttcctgggtcgggaagatcccttggagtaggaaatggcaacccactccagtattcttgaatggagaatcccatggacagaggagcctggcaggcttcagtctatggggcctcaaggagttggacatgactgagcacacacacacacaataataataataataattg

SEQ ID NO: 63044 - DNA, 1138 bp, Bovine  19866881165848
ttgttgtgtggcagaaactgacagcattgtaaagcagttatcctccaattaaaaaaacatttttcttaaagccatgttctaatggagaatagtgttcaaaatttcttccccagtttggcctagtatttattttaagcaagattcctgggattcttctccatccttcattagccttcaaaaatattataagtggatcctccatacgcttctttgtgcctagcgttgtagtttattgttttccttaaatctttgtgcattcaggatttccaagtatctgcaaatatgagttaaaattcatcttatttgaactatttttttttacttcctaatttatcagtcatttgcctgaattgtgcaagaggtctaagagtttagttcattattttctgttgccgggtcattactcactgacttatttagaaaaaaaatttttttttccagtgtcttctcacttcatgacaatcataaatgaaaaatcttcattctttttacactgttatgcttgcattaagtcattctggtttttttcctgccaagtattttttctccaagtcttgactggggctgggtctacatgacaccaaaacatccaaatgagaaagaaaaattcagttgaaccactcagatgtttatccaccaaatccagatgtttggcaagtggggatgatatttttggataatgagtgattcctctacagtcaacattttcatcttaatgctttaataaagacacagcttgactatgtgcacgcactctgtaaagaatggtagtttctgataggctcaattcctgtatgaaaagaacctctgcccactggtctaggttgagatgaagtatcttcctatatggatacaatgggcttattaccatgaagaattgtggattacgaagtgggcatctgtcccagaataaataaatccagatggcaaggaaaaaaaaaaaaaaaatcaagggagaaagaatcaggaacttgaatcttcttcagctgtagaatcatggtaaatacttctagatatcctccacactattcaattctttaagtctgcatactttgcctaacttattccttaatataattaaatgaaaaacacacactttgcatttagacactgacattctgcaagatttgaaatgctg

SEQ ID NO: 63045 - DNA, 1094 bp, Bovine  19866881265113
agacattacaaacctggtacctcagaaaagagagtccagtggatcaaactcttgccctccagtagactgcggatgctcacccttctgtggagtcggaggttcctcttctgtgctccagacaaccggctaccacctagaggatgctgataccctctttttctcaccatcttctgcccccagaccccttcagaggcatagcaggctggaaggagcagcctaccagtgccctagtcaccataggggaggtaaggagcaaatttctgccccctctgaacagaaacagtctgccccagtctgaaagacccaggaaaacaaggacaaagattcttcctcgttccgtttctccttcctcatctcccacctctcccctcatactcttcctagcatttgaaagtccaggaggtccttgaagggagctgcttctaaaggctttgctttgctttttcaggaaggagagggggacaggggcaggaaaggagtatttttaaagctcctctaaagccaaactgccaaagaaattgtgacagctgtttgggacaacctgtaatgttccagaccccacccccagcccctcaggagggacagtaactgctctttaaacgagatgacagcagtcaggactgaggaggtggggggcagtctaacttgtttctaacctgagcggctagaaaaatgtcaaactgaggctgcatctggagtagcctctgttgctgctctgtggtgaataggttagaggaacaggcctgacccacagcaaagtgaggccttggatttaggagcaggacacttctgatcttccgtttcctcacctgtctgccccacctacatcagagactaaggccccagggagtctgcgacttgctagctagcgctttacagtttataaagaatgagagtggtgacaacccaaaggctagtcagggacctccgcagcctgccgcctgccgccttcttgaagttctccaggggccgctttttgaaccgcctttaaaaatcgaaaccaaaccccaactcaacagtgttgaatcagctgctcactctacctgacccgccccccctccatgtatctacagccgcgatgctaacgatcacct

SEQ ID NO: 63046 - DNA, 1761 bp, Bovine  19866881268956
cctagaccttggaagcagttaccagtgaactgcacacaatagtccctgctaataagcaactctaccccagaaagccaaatttcctgtagcaagggggttagtaccactagggctgatgttcggggtgtgcataccagtagtttattatagtcagcacccaggactcaccagttgttaaatatttctaatatcacctccgggtgtttccattagcttccctgttaaggaaatattttggtttttacaacctgtactgttcattggaatcactttactctcactgcgttcccacctaaagatcatgacagatcattagaattggtaagatgaaaatttctcttagtttcattgttttttaacaccatgattttcagggttttgttttaatgtgatgttaagggggcattacagttttgtcaatagcacagtatgagacttctggaaagtttccacaaacagtttgatgttaactaatataatgtcatgatattttctgaccttccccatgaaatctggaatttatctgatttggagtctagaaaatcttagacttttatattaataaaatggaaaagaaacagtggcagtgcaggattgtttcaagggacagtggggaagtggattcaccttattcctgcctaagccgggactgtggaggcaagccagccagaagacggccagatttgctaaaagggactgagtcaggatgttgttacaggtggcttcagatcaccctttgcttgcttttaagatttcttaatttagcattataattaggttcatgtcagatttgtttctctcctctcttttcaccctacaggcaaagactgccaaggagaaacataatggaaccgtggggctgctcacatacccagtgctccaggcagctgacattctgctgtacaagtaaggagcagagttcaccccagccctaaatgtagtcatgctgacaagagagtgtcacctgactctagaaaatttggcccacggggaaggatggttacagcaaggggcaggcacatgaatccatttgcatctattccccagtaataatgctaaatcaaaccagtcagtcctaaatgaaatcaaccctgaatagtctttggaaggactgatgctgaaactgaagctccaatactttggccacctcattggaaaagatcctgatgctgggaaagattgagggcaggaggagaaggggacgacagaggatgagacagtcggttggcatcaccaactcatcaactcaatggacataagtttgagcagattctgggaaatagtgaaggacagagaagcctggcattttgcagtccatgggtcataaagagtcagagacgactgagcaactgaacaacaacaaatagaagtatgtttaaatgtgaaactaataattttaagaagtagcatttaaatagcacttactatggattgcaagcagtcataagtaatttacatacattaacccatttaatcctcacaacagccttaagaatctgtactgtcagcatcctcattttacagatgtgcaaaccagagcacagagtggttagtaacttgcctggggtcaggtgacagcaaggcctggacctaggatttgcgcctataaagtttacgtacagagtctgtgttcttaacagtatgggatatagtgttcacttcaagagttttgaatattgatttctcagataatctagcctcccaagaaatgctattccatagcacttgctgcagctatgcagatgctctctatctgctcta

SEQ ID NO: 63047 - DNA, 930 bp, Bovine  19866881307094
acagaaacattagtgctactttttaaataagtaaagaaagattcagtaacttggctagacttgtacatttgccattagtctgtagtttcttctagttgggaacccagtggaacctcttaactctaaatgtgcccaaggaagtggcatgccccttcttgactactctggattctgtttgtctcctgcatgtcccattatcttagtcttcacatctccttccctgcttcctttcttccttaagtgctcttataataattcccttaaaggtcttagtttgtgcatgcagggtgttccttaggctgatttctccccaccttcatttcctgcagcccactctgtccagcaccgtgtgcctatgttactaggtaaagggattgtactgtggggcagcacttggtctctttaacatgatgactctgtgtctgttctcatcgactatgtgttctccctgtgtgacgaatgttctcttttcactctgtcaactgggggggactttggaaatttttttggctgggaagagtcaacttttccctgtaattgagctgaaaacagattgcctattgctagcatgtaacaaacacccccatagacagtcaacctggaggctttactgttaatcatttaagccctcatatgttaactttcaacagttctgctatattggccaggctgggattatcttatttctccaggaaggaaactggctcagagcattagtgacttatcctcggatatgagattcaacattatgacaaaagtttatgtaaggcctgctttgtgaaaggcacagggggaaatgcaatgtgcctataatgtagaggaagacacacacatatcgggctcagtctcagtcgtgtctgactctttgccaccctatgactgtagcccaccaaacttcctctgtccatggggattttccaggcaagaata

SEQ ID NO: 63048 - DNA, 784 bp, Bovine  19866881405368
ctgctttttggtgacacagaactctactcaaggattcatactcaaagaaaaagtgttggccttgcatcaaaagaagtggcacataaatagtcattcacatgttttaaattataataaaatgcataagctatgtgtatatcattttttatgatttctcactttaactggcttttttgaccaacacattaactactggtcccgaccacattggataaagatgactttcagtgaactactttatatagcagttaataaagttgggggtgctcttcctttcttaaggtggtacaaaccagactttgaaagtatatatatattttttaaaaaaggccactcagaagcaatcagtatttatgctttaagttaagtatggtacatgaaatttcctacaactttttctggcacataaaacactgaaatagatggataaggcaatgcacatcaacgtctaccagtatctcaactgccttctacttaagataaagatctttaccaccattcttctgcctttacttgttctcctctctctccatcttctgtcttgcatgcctgccttcattttaaaaaaaaaaattccttcacccattttctcaccctccactccatatgccttttttttaacaatgaaaaattgttaaaatttacatttctgatctataaatactaaatatttgatatatcacctatagagcaattctaaaagttgagaaccaacaaataatagtattacaaaatgatgtgactgatgctccctatagcaaataaaattagaggatgcccaatt

SEQ ID NO: 63049 - DNA, 1144 bp, Bovine  19866881413736
tgttatggagagctgggtgtaacggttcccccagcctgcgtgggcgaattggttccggatgttaacattttttccttggggcttgactacattcttctttttctttgcctgtctgttttcctgcccaaattgttaggcctgtacagctgtgtggctcattgctggtgagtgttgagaatgacagatctggctttaaggcaggggcaatttgggggcatgtgtgtaggtagacttttgagatgttttcatccagcatctttcctaaactttgaggatttttttttcaatccatcatcttgccagctgagtaccaaccctatactgtattggatggcctctgttggggaatgagtatgaaattctgtagaaagcagacggtccttcatatcctagaagcagaagaaaccagccagtgtgggaaactaagataacagatggaagccaaagaggcagccttgtacagtggagaagagcatggggtgccggttagggaggctggaccagtggacgtggttctgactgtgtagcctgaagttagtgacttacttctgtgcctccagtgcatccgtgtacaatgagggcagtgacacatgctgcagagctgctgtgagagttaagtgagataacaaatgcaaagtgcttggcacagtgccaggcctatggaaagtgctcagtgtttccatgctcatggttatactgttggtaagctgagaactcagaaactctccagtgttcttatgagaaaccttttggtgagtgtcggacagcattgtcccgaactacccttcttagcttatctccactgcttgccctattccctttacacaggctgactttttaaaaaatgacatacacattgtataagtttaagttatacagtgtgttgatctgatacatctatatactgaaacatgatgaccgccttttgtggtgagagcatttaagatctggtctcagcagctttaaggtacatagtggagtgttgttgaatataatcgcaatgctgtgtgttaggtctccaggactcatttaccttctctctacaagtttgcaccctttgactaacatctaaattccccaccccacccctgctactcaccattctactctgtttctatgaattcagctttttaaaaatgcaacg

SEQ ID NO: 63050 - DNA, 1417 bp, Bovine  19866881445859
aaatatgacaaaatgtcaacaatattcacccttggtgttgggaacatgagttctgttatactatttcctttgttttgctgaatttaaattttttcaaaaacatttacttaacaagtacagcatagcatgatacaaaaaaaaaaaaaaatacagtttctaggtattgatcaaatccattcaagcaattagctaattcaataaatcttagatcaaacgtctaaagtgtcccttgggattttactatttcccatataaatgttatcttcccaggaatcaggtacttttaagttttggtttaggcacttgtaagactgttcagacacaaattcccatttatcattttctctcaaaaactagcaatttcatgctgagttatctttattagactcttatcatccccatcacaaatccccttaacaggggccttgtttggggatctgattttaattaaaagaaattttatcaataaactttcattcactctcttcaactggtctgcctcctgttggtacttatgtttgccaacgaatatctatctgtaggcatttggatttttctatactttttcttagtccaatacttccaaagctaaataagtagctatttaagtctactccagactgaaaagtcacctccctctaagttctattgcttaatttatacatgtgtatgtgtaaacatatgttttgttttgttttgttttttatctatagtagtgaattagtctgctttttctagcttatgttgggtaacagccctaaataagcggctcacagcaatggtttctttttcattgacttcacatattagtagctgtaggctggcgtgtgtgtgtgtgtgcgtgcgtgctcagtcatgtctgactctttgtgaccctacagactgtagcccaccaggctctgcctatacgattttccaggcaagaatactggagtgggttgccatcttctccttcaagggatcttcccaacccagggaacaaactcgcatctcttgtgtctccagctttggcaggtggattctttaccactggtgccacctgggaacccacctgggaagtttactctgctttatttaccttctcaatttaggacctaaattgagttaggaggaaggaaaaagagcaagagagttagaacaaacatggagtggcttgtaaaggttctgcctgggcatggtgtgtatcatgctcactcattttccattggctaaaacaagtcatgtggacaagcccaacatcactggagtatgaccagatgtttctcctactgatgcaccgcctgctggtcacatggcagtgaacgaggacatataatcctcagacagtaggggttagcaaactgctgctcataggccaaatctgtggttttagatatgttcacattgagattttctgacagatctcaaagagagatgt

SEQ ID NO: 63051 - DNA, 1445 bp, Bovine  19866881924870
ccttaaaatagtcatctcagagtccagatcaacagtcgaggtaaaaataaaatttattcctttgtaaagtacatttccaaatcatagttacataaaatatttaggctagccagataaattatttcatctgttaatcagaatgtacactcaagttacctaagtgcatagtgagtacgttatttcaattaagtcaggtcctccattcagaaatataatgtcttttgaagatcagaaaatacttctgtgttttcaaagttctttcattcttggcaatttgtgacttcctgccttcaaaaaataaccattaggaactcatttgaatgacctggatagatgttttggctatcagatgtctcttgtgaacaatattgtaatgagggaagttttaggaagtcaggaacataaatgaaaagttacgcataactaaggaagttaaaagagaaaactttgggaacctgcactaagccagttacaagtcactggagaaccgcatgtgactccgagtcgaaccaacatatctattgctttccaaaagagagtctaaccatcagttcacagggtcactcattttctctctctgacctgtttcatatagacaagctggatactgtaacactaagttctcagagaaagctcagtttagcttagagagattccagttctcaattcatgcaaaacaatagcaataataaaatagtttctttctaatagtttctaatagatagtattaatatactacataatatatggcatattatgtttatgtcaattttgtggatgaggaaattaagactaagaaaaactaaaaacaacatggcctatgaagttggtcttctgcttcctgaatcaatgatcaggtctccccaagatcatactacattcatccttggccaaagcagtcagcaattctgtaacacccttcaactgttttggctggccatccttacaactgaaatggcttaaatgtttgatctcagccaaatcacataactgggcttccctgttggctcagtggtaaagaatctgcctgctgatgcaggagacacaagttcgatccctgagtcaggaagatcccttggagaaggaaatggcaacccatgcagtattcttgcctggaaaatcccatggatagaggagcctggagggctacagtccatgggaaggcaaaagagttagacataacttagcaactgaacaacaacaagtcacatgactattctggtccctattttccttaatctttatagcacagcacatgagcatataattagggatactataaagtcccctttaagtttaatgtttaataaaggatttgtagtacagcttaaagaacaccaagtctaacagcagcaacccaaccatgataaactggattcagttaacatgtataggaaaagcctgtattatgtgttctttgacttaatttcaaaattagatattat

SEQ ID NO: 63052 - DNA, 862 bp, Bovine  19866881980201
cttgttatttatttgagaatcatcattttctgccttgtgttagagctaattctaaatgatttgggctccatctctggggagcaatttctcaatggcagggatcctaacaggtgattagtgcttagtattccctagaatgcttcagttgtgcctttcactaaattcttagtgactgtatgtaaaaaccaaatgaatatagttgtagttttactgagaatttttgctatgaaatagactaattttccatagaacgtattattacatatctaatttagtacactgactcagacattctagataagtttgcccttaaaatatacaaagcaggaaggcaaagtctgacatgagagtcagcttgcaaagggttgtttgccttatccctcaacattataaaaggtcccagtggattagcacttaaaatgttttgcatttaaagcactctaatactttttaaaaagaggccttggctatgataccacatggttaaaagataggaaaataactatgtaaaccacatgtgaatattaactgctatgaacactggaatgaaatttgacagaatacattatgttctcgctcccaaattaaggacccatatctcatcttctgcagctcaaatatgccttgaagatgcaagatgctagaatcccagggcatttcagggtcgtttcattctcagaacagccccttatcctgtattctaccaagtgcagtgctttcagatgctttaacattttgtgtcatatgtttctgaatcataaacattgcttttgtaacaaaatgactaagagggtctgttttttaaaaataggttcgatgcacgatactggatgcttggggctagtgcactgggacgacccag

SEQ ID NO: 63053 - DNA, 1729 bp, Bovine  19866880458608
aactggtgggggactgaatggtaggtgatgtatagtgatggtgtgaggtcaaccagtgcactctttcaaccagattatatttttgcagcaagaatggtttgagaatctggttccctgagcccctctctcctttcaaagaaggactgtttatccctgaaagacctgtctccttttccatgtgtcccctccctcagtcctctttggcagcttctctctctccttccagccctccctgatggagctctggacacggccctccgtggagatgaggcgggcagtgaggaggacctgtatgaggatgtgcacagctccagccaccactacagccacactggagggggcggcgagcagttggccatcaacgaggtacagtcggggctgcgtgggtggacagggctgggacgcatggcctttctaggggagcaacttcagcacattcatgcaggcccggacagccacagactgcgttccaagcagatgacagtggcacagtgtgcacttggcacggtttcagcctgtggctctcactttggaatgtggtgtccacgagcagagcttgtcaaatccgaggtccctcctctctgcctttatggggccttcacggaatccagaatataggtgttgtccccagcacctatgatataacccctgtaacatcatcctcagtgggagatctgcttgggaggaaggaggacaggggttagccccttacatgatttaaaatagccatgaagtaatgatttcttcaaaatccattattcataaggattaagcatccaaataaattgatttttccaatatttgaagcctttctttaagtgcttctaataagctgttttgagtagaaggggctccaaaatgatgtcatcttaagcataattcacagaaaatatcttgcttttccttgatgactcagctgcccttcccagtgttggggcccaaccctggtgggaggccgtgtatggcgggggagaacctcccaccccttggatcagaactcctccctgcagtggctagacacacagatctgagcaggtagccctgtgagcactgatttactgaactgaaaaataggatgaccatgtggttgcaggaggacagactgaaataacaaacgtgagtaacgtggcatgtggtaggttcttggtctccaatgatgaggatgataatgaggaagaaacagtaacgtaaagctttccagggctctgaaaaggtgtggggttatctgattggccatcagtgcagccttgttacagctttcctgtctgctttttatagccttctcctacctgatggtggaatctggccggtcacgttgtgctgctagttggggatgtgccttttcgacccttgacaaattgtccactctcagatgctttggatgaggaaagctaagagccagaagtgctccagaagaacaaataatctctgatgtggggcaggaggggccacgttttgatagaaatgaaggcaattaggactatgaattgtataggacctattttgactgcttagagaatttgtttcctgtttgggtcaaaggtcctgcctggtgtttgaggttactgagaggacagggtggtgatgttgagtttatgtttagaaccctcagtgcttccaaggttctggtcttccccggaccctgtgagagcccccgggatggagggggatggcaaagcgcaccgcagaggagggccagggccagctgcagagcccctccggtgacgca

SEQ ID NO: 63054 - DNA, 2614 bp, Bovine  19866881131028
ccctcccccttggttgagggcaattctagtcttgtttctgcggatgtggaataggttacgaaagcacttcttgggtcgtttcagggaaatcctcttccttgggatactcttggccacagctggtacgaagggcatctggggcacaaagtggcggtagtcaatcatgcgctggctgctgggggtccctgggaaacttgcactgcccaccagctgccctgtagctgtggctgccctgtcagccctgggcacactgtcgtgattcttgctcttccgaaccagtttgaaggtggtgccacagagagctgcaggccctccattggtgtctggctgggcttcccgatcagagcatctgttgtatccttgggtgctgggactgacctgggggcccctctcactgtggggcagctgctgccctcccagtgagattgcatcctctgtggtcagggcagtcgctgctgggtcttggaggtttctcatggtcagtctgcaggctagatttgatgaaggtcttgcctctcttcagctccatgctgcagtgtcaccgctgctatgggggaaagcaggagacactcaatatctaggatggaggcttgtggttctagaaaacctgaccccataccccgccccctgccccactcacacaggcatgggagctgagctctgacatctgagctcggatcctctgtggaggcaaggggagggggagataggaacagtcccacccccacacttactgctccagcctttgtagataactgatactcagagaaattaagtcacatgcttaaaggcacagagttggagccaaaatgagagcagacagggtctgatgttcgtgtactgtgagatcttgtgactcactaaagaatcctttcaaagcttgtctgggcaagttagcctaccatatccaggccttattggatataccaatagcaccatatccttagggtatcacggcccttctgagtggatgaagcagagaagtcaataagtaagttgcttccttcatgtaagcaacaaagctgaaaggaaatctgcttccagggctgggtgccatgggtcatcagtggaaggggaagacccatggcccttcaggattgctttacccatcaggcaagcaaggcacaactaagcatttcatgatgcacacagagcttgagcagaagaagagagacagcaatgtggcagaaagcaaaagagaggagacaagcatgagaccaggaatagacagactggccatacacagctcatcatgtgctggaggatcaggcaagtgttgtcttttgtgcatatcctaactgacaggcattgctacctggagtgccatccagagaaagtttctgatgcccagtctgagctcaatgggaaagaatgctggaatcgcttattgatgtcttccctggacttgagagggggggaagtggtaagagtgttaacaagttgatcattgttggcacagttggggagtctggccttaccctgagtcaataaagagctatagaagtcttctgagggagcaggtggaagcaatggcataatgaatttggtggtctgagaccatttatctgatgtctgagtggaggatggactaaagcatgagagaggttctgaacagaggggactcacaagaggcagtaaaatggaccagatgtaaggagataaggtctagatggaggctgtaactataagcaaaataaagagagtaaagccttacgagctttcaaaggaagaaacatcaggattcagcaactgaagaaagaaagacaaacagtctagaaacctgaggcctgaatacatgccattagggggataaacactgaggcctggatgcaagccgttagggggatcaaaaaagagggaaagctgaagtggagaggatgagaagtgaatgaaggcaaggaagtgacctgtgaaaagagctggtttgggggagagaagcagtggtctagtttaaatgtattacctttggggtgagtttggaaacccatgagaacacatgaaaagaaggcagtactgtgtccgtaatcaaaggatgtcaccatcatcagtgattgcagcactccaggaggagccactgagccctgaggaaagtcaggatgtgaaaacacagggtacttgccccagatagcatatcaaaggaatgatttcagtgagcccagactcttgcatcttcccatacctagaaaagcaccaaattccttaacttgggatatctggttttctttcattaacaataatcatttgacactaatactacctgccccttgttgcaaatcctctatatagcctggttcccactctcgattccttggagcagttctctaatggttacttgagatgctgcctcctgggcttgaagtcctaaaaatttccacggaataaaaggtaactctttaaaaaaaaaactaaaagaaggcaggggtgaagagcacccccttaagccaatccctccatcctggtttactggacctcacaggtatccagctctcaggctccatctgtctcactgtctccacatgtccttggcagtgagggactgccagttggtcttctggcagttgaccagggagagagtatagagcttgggcgatttcttggttctccatagggagca

SEQ ID NO: 63055 - DNA, 786 bp, Bovine  19866881499658
agtcattggagactgagtgtgctgggacctgccgggtcagccgtagtagcgtttagctaattgtctagagcattaacccctggagaagcgaatggcaacccactccagtattcttacttggagaatcccatggacagaggagcctggtcggctacagtccatggggctgcaaagagtcggacacgactgagtgactaagcatacatactagcgcacaaagaagaaagtcccggttggagacacgaggcctgcagcaccggctgtggaacctccatgatgtgactacacagctgcatctgcaaatgtctgtgggtgaccagggagggggcgcatagctgtaggcaggcattcttgggactgcatacactggcacactggtggggtgggtggggggtgacaggagctggggagtgggcagttagcagggtacctgtttggaaggtaggatgtgctccaggatatatgttgagggaaaaggctggagctgctgctgtatagcccatggggaaaccagctagataaccattcctttggaatttgcatggggaaccccagaagaacccaggctataaacaggattggtgacttcaggcccctgggctggcggttgcgcttggcaagggcctgccacggaggcctgctcccatgagaggctgagtcacaaggtctgtgccctgccttgcctgggctccccgcgcactctctctttctttttcttgcagtctcatctctaaacctttgcttttatccctcctctccctccctccccacttatacttttaaatc

SEQ ID NO: 63056 - DNA, 745 bp, Bovine  19866880458626
cttatttaagatgactgaggtgaagggcagggtgctggacacagtgggcacagatgcaaaccttgttgaacattgtaagccatggcattcctagtcatgctggaaggaagccagcctgccaggctagcacgctgtggttttgtccctttgtgtttaacatcctccccatcccagatgatatcatcttcccaatgcagctgtgtcaccatcaggaagttttcatcagccagaagatcggtgccactgctttcctcaggtatcctgtattcctacagaagtaggggaagaacaacaaatccctgaatggtcactggtcagagttcccatttcaaatcccacagcagataaatcagatacatcaaatgtggtcctgacttgagagacacacacctgataatgaaggaatacctgcctcctcccactcttagtctggcacaacactcatttcacaaacaagaatccttgcaatagggccaagttgccagggcgatataccacaccaaacaaaaggtttagacacctcaatctcccaccaaagaaaccctactcagtgtctccccaattgaaaagtaaagtaatactgatagggctctgggcacagtgattcctttcttacataccgtgttgcttacatccgccattctacatttcatcacaggttcctgttccatctttcttagtttgaagccatagtcaaacccactgccatcttcagggacacccagcatatcataccacagtcgag

SEQ ID NO: 63057 - DNA, 3618 bp, Bovine  19866880529042
ttaagtaggtacaccccccatattacactgttagattattctggatctgaatgtatgcgtccctctaccactgtgttgtatgtttttgtaatattaattgagtggaaggagtaagtcccacgcatgttcttttctgaccctgagttctgtgcctgtcccaaccctcgtgctctgtccacctgacgtcatgctatgagccccggaaggaagtcaatgtgagaatatgggggaagggcggacccaagtgctccccattgctcaggtccagtcacccctaactccccacaagtaacccaggtttcgccggagggggggggtctcctgtttctaagatgggcagccatgtccccagagccaccttcccattttcactcatccacaccctcagcagttggcagacatcacagaatcacaaggtaggatccagtgcctcctccagcgactccaacattttgagatgtcctgtcctgaggtttggtgaactgcatccctccccttctatgttttgggaacgtgacaacaccccttgaataaaggagatccaacccttgctttggctcactcaatgccttacagaatctggaccagtctctacttccattactccctgattcacatctttctgcctcaaggggcattatccctgatgacttttattcacacacagagatgcccaggcaccaacttggaatgtgcatcataccctcttttgtgaaataaaaccatggtctttcaggaagggagtcaggcagaacctaccctcacttcactcaaatacaaatgtgtccctctgagtcgcaggctggcacagccctggggtcttggctgagagaaggaagtcctccccaaacttcagggcgggggcgggggggggaattgaacatggatttcagacttagtcttgtgtgccctaacaagtagtctgggagactgagctgggacactctgggaaacatcatttgcaggaaaatctatgtcatggggctggtggaacagtatttgatggagaccctgtaagaacacagacttaccaaccatacttgtcatagagcctgacgggcctgtttccactcaagggcagagagacatccaggctgcaggagtgtaggctggtcagctggctagggcagggaggccatgaaagctccaaggactggaccatccatctctagctgtcagggtgcactctgccccagattggcaccagacgcctctcctgacttccagctcggcaactaacctcagcttttctcctgtgctccctgtacctttgctcctgctccccagttcactgggtccaagattcatcctcatgccctttactgaccccgaggaaggggaagcaaaagttttggtgcctgagtctcggggatgagtgctaaagaggagagggggagagtatgcaggttcctgcttgcaaggtggcaccggggggtggggtagagactccactgagagggtagggactgggaatggggaagatgagcacacctgtgcctgctaccacctacttaagtaaacatgcaggcaaggtcatcgatggcaagccaggggagggatcgagggtgctctgacaggaaagcagagtggtcagggtaagcaggacagtgagtgcagtgagggaagggtgaaagactggagctctgtaagggggtcacgagttccttctgacagggaggcagaatggcagcaatgaatggaaactgctaaaccccagaggagggtgtttagagaactagaagagggccttcagggaaaagggaggacgtgccaatgtggccagacagagcccacacagaacacagactgggggcgctccgctggcctgacggcctggatggtagcagaggctgacccagagtccccaccacagattccagaggtactgttctggaaaatgctctgaggtggaacagcttcccaccaggcctcgtcccactcccttaacccctaccccgcagagagagggcagaacacagaatatgagaagtcctttaatcaaaaactgctgtggcaaaaccaatacaatattgtaaagtaaaataaattaattaattttttaaaaaaacaactgctgtgagactggggcagagagggggcaaaacaaggggcagaggatgccctggtggaggcagaacaagaggcaacaagcttggccacagctcgccggtcccggaggtaacagctgctcctcttgcaggaagatactgggctcaacctgtgaaacagcagtcagggaagagcctcaagccagggccagcccacagccctgctcaacagccgacgttgtgggaaggggtatggaatgtgtaacactcacttcaaaggatccggaacttctcagccaggtactgcatggaggctgcaacagggagaggcataaacaggtgctccagacagacggacacagaagcctgtccccctgtccccgtggggaaccacctagccctgcaacctgaaacccacgtacccccagccctgatgcaaagaaagagctctgggcctgatcgggccccactaccggaattaaatgtggagccatttcctaaaaggaaacaaaatgtgccagcagctctcaagcttggggccacgcccaaaccattcaaaaattgtctcgcaaaatatccaccaagaaccttagaggccacaccagatcaacaaggcatctctacaagtcctatcagaaggaactctctaggactcgaatggctggcggagtgtgcacgcagtccacacagtacgttgttacttgtccgcacgccccaggggcaggcttgctaggttctcctccccacaggaatgctgatccctgcgaggtcccctgcacttgcagcccaccccaccccaagggcccaccccgcttctgcactgagaacccgctgctctctgtccctggttcctcataccaagttgctccttaaggtcgtctatttctttctgtagcaccagacactaggccagcagacacaggaggaagagaaatggttagtatacacccgcctcccctctcctcctcctctcctctcccctgggccctccatcccaaagccaggtgtccagactggcaagggaaagactttcctcagtggaaaggaggtgggctccctccctggggtgtgggatggggacgggggggagggggcccacaacatatcagttgaacttggacccagatcccaccatggggtttgggtgtgcatttccaggagtcagaagaagcattacccgaggacagccctgccttctgggtggctgctgccgccttttcagtcttgggtgatggtcagctggtttctggtcacctgacagggaaaagacacacaatccagcttcccaggctcccagtgaggtggaaagggccaagcagggtctaacgtgaggtgaggcagtaccaccctctgctagcatcaagcctcccctgctctgcctggcaggcagcccaaaccttctctctgggcctgcccctcctattccgcaggggcagccacttcaccacgatggtctccaaagactgtggttctgggttcgagcttcccagagcggcagccacagccagcacctgggagagcaatgtgggcgaacagcacttcacagaaaaggctattagcctgcaggtct

SEQ ID NO: 63058 - DNA, 2358 bp, Bovine  19866880665174
cctcagacagaaactgagaccattgatgtgctcgactgggtgtgctccccccttccactggcacagaagcagtaagtgggtatgcacagcccttcaagcccttcccttgttctttgtagggagcaaagctgaaagaattttcctgaaatgttagcctccaccccgcagtgagtgcccctgcttttgtttctagtcttgtggcccaagtgaaggctccacactggttcgtggcattgatagggtcaataggaagaatgtcctgttttttaaatgctcattgattgatgaaatgaaacaagagtcattttctggggccacccctctgcctaaagataacataacttttcccattataaatactgttccatcttctaaccttgttgttcagaattccagctattaaaatttgcctccctttttaaggatggacctgaaacagaaattgaggaaacatttctgttgagactttaccttaaatgactgagcgtgtaaagggtcttctcgtgcttatttgggatttttcatctctttaaactacatgtgctttattgctaattcttggacaccatcagaagacattttgaaaaaaaaattgttttgcccatgattctaggaccattctaaaggagatcggtcctgggtgttctttggaaggactgatgctaaagctgaaactccaatactttggccacctcatgcgaagagttgactcgttggaaaagactctgatgctcggagggattgggggcaggaggagaaggggacgacagaggatgagatggctggatggcatcaccaactcgatggacatgagtttgggtgagctccgggagttggggatggacagggaggcctggcgcggtgcagttcatggggtcgcaaagagtcggacacgactgagcgactgaactgaactgaactaggacccaaatgcctcagctgatttttcccgcatggttcctgccccagaatcacagatgtacagaatactagagctagataatctcatgtagaaatctaacaggtctactcctgaggggtgtacaaatgaggaatctgagagtagagggacagtgccatgtccaggccagcaggcagttcaactctacctgttcagtccccactttgctgttcgttaggacagaagcacctgcatcgcctcacactcagaactctcgtggatgtatgttgaagctggtgcagcttcttcccaacctcctgactaatttgaaacaatgaaatcggtcccatttactgtcagttatagctagagccttgttcactcacttgagcatcccaggtgaagcactccccttcactgcatccacagaatctctagtgttttggggtcaccttggattgctgacctaacagccctaacataaggcagagtaaggtagggcaagcacttgatgaggaatcaggagacctacctctctcctaacctgacgaaaagcactttccctttctgaacctcttgtttctccatcgggaaaagaggaaggtgacctagaacagtggctctcaacctggattccaagaacttcctgaaattgtgtgcagagttgtgggaggtaatgtatacagtcttcttgggagggtgtatagagctttcaatagattctcaaaggagtcctattatgggctgaattgtgtggccctcaaatgcctatcttaaagccctaaccctcaatgtgactgaatttggagatggagcctttagagaggtaattagggttaactgagggagctggtaaagaatctgcctgcaatataggttttgattcccgtgtcgggaagtacccctgcagaagggatacgctacccaatctagtattcttgggcttccctggtggctagatggtaacgaacccacctgcaatgtggcacacctgagttccatccctgtgttgggaagttcccctggaggagggcatggcaacccactccaggattcttgcctggagaattcccatggagagaggagcctggtgtgccacagttcatggggtcaccaagagtcggacacaactgagtgaccaagcacaacacatacagaggtgtaagagtggggccctaatcccaaaggatctgacatccttataagaggaggagttaccagacctcttgcgcgcggtctctctctgtctccatacacacacacaggaaatgtcatgtgaggaaacagagggaaggtggccaactgcaatacaagaggagtgcctacaccaggagttgaactcgctggcaccttgatcttggacttctagtttcccgaactatgagaaactaaatgtcttttgtttaagccatccagcctgtggtattttgggttttggcaactcgaacagactaaca

SEQ ID NO: 63059 - DNA, 1133 bp, Bovine  19866881166541
cctggcatcctaatttctctcctgagctactcagaagcattaaatactgaatgtcgacaacaggaataaagaccctctctatatcacagattcctggcctctttgatttcaatgataatgcactcatatagcaaaaaggtttctttttaaaattatataccagtttgaaaaaaagaaaaaaattacataccagtttgaattgacaaacaccacactccagactccccagtgatacacacacatgcagacactcttttgtccttttctttcctttgtactatcttcacaatattcaacatacagaccacttacatctggaactgccatcattttctgggtgacaatgttgtccagaataaaagaaaatgccacttggtcatcatcatccagcaaggggttgattgctttctctaaacgagccaatttatcttctttctgacatgaaacaaagcaaaggaaacataaaggctttcctgaggtataatcatcatagagtattaaggacaattaatatttctcttgtcctaaaaagtctaactttgaattgtaaactcatctgttccagacaaaaattcagataagaaataatactccagtaaaaggatcaaaagagatgtgtcaaccattcttataggtattctatcttctagtcttgtagatcatcaaaaatatacacccttgggcaacaacagcttagttcccacaacaaaaacatcttcaccaaattaagttttaatatcacactgtttttgctgtaaaactatcactgaaaacactgaacacattattgttgattagtaacttttatacaagggaatctaacccaataaattcattttagactacactacgaaaaagtctgtatatcaattgctccatgtcttaacccactaaaaatcttcttaaaaattatttttggctgcactgggtctctgttgctgtgcatgggcttctcattgcaatggcttctcctgttgtggagcatgggctctagagcttgggctcagcagctgaggtacacgggcttagttgccctgtggcatgtggaatcttccccctctagggatcgaaccctgtgtcccctgcattgacagttggtttcttaaccactggaccaccagggaagaccatgc

SEQ ID NO: 63060 - DNA, 809 bp, Bovine  19866880459113
cccttggaaggagagaaagaatttaggccagggctgggaccccctgggtgaaccaggtgcttttcctctgaacatctgactttcccattcacagccctggtctgtccctttaaacttaaattcggtaacattccaaacccaggaaatattaaaaaggtctaaaaattaatttccaagttttcttctttaaaaccaacaggggggcagggggagtagagtttgctcaaaactgagaaaatttcgtgtttttaaaggttagttggtctaacagtgtagtatcttaatgcctctgcccaacaacttcatcagaactgcacacgttaaaaaatagaaatgttcagggcatccaggtacctcccagggtgaggggaacaccgctcacttcacacactcccatactatttgaatggttttataatttgaaaagtatataaaccttttacaagtctggcaacactgagcatgtactgttttaacccaaataaaacgtatacggatctttaactgggaatataaataaaacctgacatttaaactcaactgctgagagggagggttccatctacgcccctgccaggagggaaacgggggcggattcgaggcgccctctcccgcctcctccccgttgacactaaacttcccagtgagttggttccctctttccattcccgagattgggattcagatctcttttacctcaatccattttttgaaagaatctgctagaaacattcagccctgaatgtgggaaaactttcagaagagtccattcaaagcctttaaaaaaggaaggcaaagaatacggcccg

SEQ ID NO: 63061 - DNA, 2889 bp, Bovine  19866880904423
ttccagatagcacgggcctgtagctaagaaagcccaggtgtcttttaccttaggtggtggccaggcagagaggaacaggggaggggtgagaaggcatgggtcctcccccttggtggtcacagacagaagtcagtttcctcatctgttaaaagcagttcataaagtggcctctgtctgccccacagggtagatatgaggttcagtggagtaatctatagaaaaatctttgattctcaaaacactgcattcatgcagagtgatcttattttttattatgtttacaatctctaattgccctgaaagttacaaaccagaaagcctacctcaaatacccgttctccatgacacattttttcctttactctcactgctagtagtattaataatttctatctcccctaagaccttaaagtggtttctttttttaatttgcttgtttccccatcctagggaggattacctgcttggctattggagaaaaaatctattgttctccgttcttcggatccaggtgagttgttagagatgttggaagagaatttaagaaagttcagatactttatatccaaagggtcagatacaatatttcaaaggctggggtactcctgggtgaatgcttctgaaagtttagtaaaagtgtgggtgtccatcattctccaccagacgctgaatgtgtaggaaagaaggattgttcggacaactcaactagatcttgtcgatgccttggtaactctttgagttagcactgggccctgtttgcggttgactgattgacttgagtgctttctctgcctccattctcagtctgtgacttgatggggatgactcccagctaaccagacgggcagacgtagcttctctggtggcgtcactggatctctcttcatctacttttacagagtgatctgtgagtgataggtttttccccttatctagctataaaccctgaccggtctgcaggccccgattcgctgtatttatttttgctggcgtatggttgacttacagtgtggtggtattttctgctgtacagcgcaatgaatcacatatgcatatttttgagattctttttctatgtaggtcactgcaggggactcagtagagttcctagctgcttttctgtcttctgaagacttcatttcgcttggggatgaagctggtcataagagcagctaacaacgattaaatctgctgtataaaaggctagtacgaaaaaaaataaataaataaaaggctagtacgttatgctctgtgtggcttttcttcttagcgtattacccacacgttttaactcttagtatattattagtattttcccatgtactagctcatttaatacttacagcagctttgtgaactgcatacttatccccatttgacagtgtaaatgtatagttgattagaacttaattttttaaaaactcagctgtgacagagaaggacccatcactcagtcattcaacaaacacgggcagatgcctcctgtgctgcaggcttgtggccctagcggcaggggctgatatcaggctgatcctctgaaggctccgctgagcggacaactccaggcaggacagcttttatcagacttgcggtgcacgtgacacccccgtttcagaaagtagtggttgaatcagtctgttcgatctctgctgccagccccaggataacagggtgcatggtgcctctttgtagtaaaaaggtgtgtgatggtgttaaacctggctgttttccagattaccttgcggctgtggacaagtggctgggggtccttctgcccaagatgagacccctcctctataagaatggaggcccgattataacagtgcaggtaatcatggagcccgggctggtagggggagatttccatttatccacacagtatacgggagtgaagcagatgggagccacatgtgactctttctttctttctttttttctttttaatttttagaactgaagtgtagttgatttgctatgttatgtaagtttcaggagtccagcaacatcattcggttttatatacagatatagattcttttccaatataggttattacaagatgttgaatatagttccctgggctctacagtaaggtccttgctgtttatcttcctatgtctatctctaagaggcaatgccacagacggtactttgatttaaattgcattttgagggggctttaccatttttgaatgctctctgtgtgagactctgtgctggccgccctacagatgccattcagttatcccagccaccatcgccaaagaggttaagtggcttggccaaggtcacgcagctggcaggtggcagtaaggattgcagcctggcccctctctgctcccacagcgccttctggctgcagggacgcagcccggaccgaccccgctttggtgtctgtattgcgtcggtcgtcggttcccgtgggtgtagaaagaggatgcggtgagctggggccactgtgttttctcctcccacttcctgccctcaccttccttcttccatgtgtttttccctttgcagtgactggtagaaggaggagtctgtcatgtggcaagggtgttccaagagaaagatcagttcacttgacctgcagtgatttttgatatttgtaaaatgacttaggtcaaacaaaaccatgtctgttggtcatttgcaagggttctcttactgcagagagtatgttatgtaaaactggctgtgtcccggaccagcatgggatgtgtgcagcgctccctaggggaatgtgggccagcacttggggccagcactgttcactgttcatagggatggtcactgtggggaaggagcctggccccttctgtgcacttaagacccaggctgtaaggggctccgtggcggtccagtgtttaggactctgcactgtccctg

SEQ ID NO: 63062 - DNA, 1403 bp, Bovine  19866880922189
ggcctgggctcccctccgaggcagagacacgcgcacctggagtgggggaccagctgcatctctctgtgcagaggttttgttgctcagaacgggaatagcatggtctggtatcccacttgagtattcttgcctgggaaatcccatggacagaggagcctggcaggccacagtccacagtgtcgcagagagtcggacacaactgaaatgccttagcatgcacagtgccgtgggagaggtttgtcatgggcttgggtgtcgcttctttagacagttaactacttcttccaaccttgaactttgtcagcagaaatcataaaatgaatatcagcttaaaaaggcaaagggaagtaacagtgattgaggatttgctgtgtgcaggacaaacgacatggatgatgccatttctccaagtcagccgaatacagctgataaaactgaaatttgccgaggcatgtgcttttggacagaaatccagctgagatttaaagataagggtgtttgtaggtggccgtagctcctctcagctcctaggggaacatgccttgttgggtagatccctgaaacctagtttgtctttgtggttctgctggggtgattctatggcccagggttacagaatccccccccccaataactatctctcctcatctcttctgtttgtttcaaaatgactaattgagaaggaagttggggtggctggccactctggtttctgcattgctgatgtggattgctgataacttttcaaagataaagtatgagaaaatccagcagcagattcctgggacagatggttagggagaatccccttcatttttctgattgtaggaccactggggcctgtctgtagttttagccctaaaattaaagttttaaaactaaactaagttctaggagaccaaaatggctccagggaaccaggaaaccctgaaaccataagtctggggtcaccagagagacctttgtgatggcaatgggtagctttgtatttaaatttgtgtcccttgctgcaggcagccagggaaactggtcagagttttggttactttacctccttcagggtattcctgataaaatttttggttaggaggacacagggcttggaggctcttccatttttattgaaaaacatttttcaaaaagtaagtatatcgcttatgaccttaacacacatactttcatttttcctaagccttacacaggcatatataatttttacacagtagaagtttgtgtccatgtaattatgtatttttttgttttttggccacgccgtgcggcttgcaggatctcagttccccaaccaggtattgaaccccagccctgtcagtggaagcccggaatcctaaccactaggccacaagggaactcgatatatatatatatatatatatatatatata

SEQ ID NO: 63063 - DNA, 1131 bp, Bovine  19866881104484
ctacatggacctttgttgacaagtaatgtctatgctttttaatacattttctagatttgtcaactttcttccaaggagtgagtgtcttttaatttcatggctgtatcaccatattcaccatctgcactgattttggagcccaagaatataaagtctgacactgtttccattgtttccccatatatttgccatgaagtgatgggaccggatgccatgatcttagttttgtgaatgttgagctttaagccaggtttttgactctcctctttcacctttaagaggctctttagttcctcttcacttcctaccataagggtgatgtcatcttcatatctgagtttattgatatttctcccagcaatcttgattccttcttgtgcttcatccagcctagcattttgcatgatgtactttgcatataagtaagcagggtaacaatatacagccttgacatactcctttcccaattttgaaccagtccgttgttctatgtctggttctaaatgttgcttcttgacctgaatacagatttctcaggacgcaggtaaggtggtctgttactcccatctctttaaggacctttgtttggaattacatatggtggtcaatgcagacccccatggagaagcccacatataaacactaatttgaaggaaaagaagaggttagtcattcagatatctggaacaaatattgcttttagaagaaagaacatcaggagtaatcatcctaaggcagaggcattcatgagatcctagacctagtgggaatggcctgggagaaaattaatgagattaagggagagggaggaggggaactgtgcagacaaactgtgcagagaaagtacaaaccttctctgtggaccatagcaatacatttggaagactgttagctaacacaggagcttttgaacacttttctgttggtccttcatatctcattgcctgtcatgcctaaggcctgaagtatatcacttaagatttaaaataaaaaaatatagacaggggagaaagcctaccccaaacaaaaactcacctgaaaagtttcaaatctgtcttagcttaaataaatatgtaggatcctttcaaagacaaatatatgttgattacctctcaacaagtattaagagta

SEQ ID NO: 63064 - DNA, 853 bp, Bovine  19866881830080
tccctcccctaacaaatatcagggaacctggctctttcatttcctcatctgctcccgaggctcacagaatgttttgccaacctggccctaatccacatgtctgaatttctgacacagtgccctggatatttacttaagtgtcctttgcctaattaaacgatggaagtttctcttctcttttgactgttattatcattgcctgttggttcatgagcgtaggacaactctgcagaagctccatggttatcgcatgttatagttaagctgatgggagaacaagtgtcaccaaaacaggaaattgcccatcatctcaaaaacctttgggtgagataattgccttgatgcccatagttggcatggaggtggggggcgggggggcaattgtcccaaagactgatgagattctcagcacatttagcttgaagatggagagattttatgagacatgctagagatagagggattgtgtgggacatgctttctttaagtgggaatggaaaagaagaattctcccctcccattttccataataacagcaatcaaagaaagaaagaaagaaaataaattttgtaagtgtcaagagttgaggacgaaacaaagttcttgaatttcagactctgcaacagagggattcataggaccctgatagaaggatgttaactaaaattttagaaaccaatgcctgattgaaattaaaaggtgtttatttggggtttgttaaggctgtagcctgggagacacagactcgagaagcaccggagtttgttctgctggactacaaaatgagagaggctgataaaggaaaaacccatgggttacactgagtttcaggagtggtttatcaagcattaga

SEQ ID NO: 63065 - DNA, 966 bp, Bovine  19866880539706
taaacttctttttattaggactcatgcagagtctgccatgttctcatgctgtctctcagtagctggcctctcagagcttcagattattgatcattctgcacatcagaaattaagttaaaattcctctgcttcactgtgctattattcatgttaggtttcaattcagcatttccaactgtgtttcactatatggaaagtattatctatattaatttgtggactatttattagtaactaatatacttaaaatgagcccatagagtttaagtgttcaactagttttgaatatatcactgtataatttaaagattaggatatattcagaaatgttaagtgatttgaagtaagtttgagtagtgaaagtttgtgaaaagatagaaaatacatcaggttttgtaactcctgatttaaaaagtttttcagtttactataatatatcagtacatgtatttattgagtgtggccatgaaattaaaagacgcttactccttgggagggaaagttatgaccaacctagatagcatattcaaaagcagagacattacttcgccaacaaaggtccgtctagtcaaggctatggtttttccagtggtcatgtatggatgtgagagttggactgtgaagaaggctgagcaccaaagaattgatgcttttgaactgtggtgttgcagaagactcttgagagtcccttggactgcacggagatccaaccagtccatttgaaaggagatccgtcctgggtgttctttggaaggaatgatgctaaagctgaaactccagtactttggccacctcatgtaaagagttaacacattggaaaagactctgatgctgggagggattaggggcaggaggaaaaggggacaacagaggatgagatggctggatggcatcactgactcgatggacgtaagtttgagtaactccgggagttggtgaggacagggaggccggcacgcgcaattc

SEQ ID NO: 63066 - DNA, 5439 bp, Bovine  19866880852231
tgtggtgaggaaatggttggaaagaaaatgtccatggaatatattctttgtaaggttttttgtcaggaagcaaaagagagaagtagggtctatgctttaatggagatgtgaaagccctttaggatgagagtttcatggatggaggagtccgtttactgactccatggtctccctgccctgccatttcccactcagccccactgtgagatcgctccagagtctaagactcattcccagttcttccccacccagtccctattccagtgggtcaagtcggagcgttctcacccagaacccaaggctccagccctccatccactcgagcgtcccccctgttcccgctccgtctgcgccagcacatctggggtcccagcacagtctccatcattgctctctctgcacctttacacacgcacttccttgcatttctccagcagccctaacaccacttcacattccatctggcccctccccacccaggacctgtcttgacttcctggcgtgctgtgggtgcttcctgctgtgccccactgccgccccctcccaccgctgctcaccaggggagggagtttccaagaaatcgtttgatgatccctctgggcttggaaatgaaaagagatcattctgtcgtttttgagattgcatccaagtactgcattcaggactcttttgttgaccatgatggctactccatttcttctaagggattcctgtccacagtagtagatataattgtcatctgagttaaattcacccattccagagacattactttgccaacaaaggtccgtctagtcaaggctatgatttttccagtggtcatgtatggatgtgagagttggactgtgaagaaagctgagcgccgaagaactgatgcttttgaactgtggtgttggagaagactcttgagagtcccttggactgcaaggagatccaaccagtacatcccgaaggagatcagtcctgggtgttctttggaaggattgaaagctgaaactccagtactttggccacctcatgcgaagagctgactctttggaaaaaagtctgatgctgggagggattgagggcaggagaagaaggggactacagaggatgagatggctggatggcatcaccaacttgatggacatgagtttgagtaaactccaggagttggtgatggacagggtggcctggtatgctgtgattcatggggtcgcaaagagttggacacgactgagcaactgaactcaactgaactgggcaactgaacaaaacaacattttatctgatattctttaagtagttacttcagattgttattagaatgcttacatttatacataaaccagcatttcatatagttactcattaaggctgaaattttatctgagaaaattgaaaaaaaatatgaattttgccttagatacagatgacacttttttctactaattgcataaagtgataacactgagtcaaatagtttataaaaaatatgaagcaatcaacagaaccatcaatcacaaaatagcaaatatactgtaatactcgtaatttctataaaatcaaaagtattttacataaaatgtttactttcaaacagtagttcagttcagtctctcagttatgtcctactcttcacaactccatggactgcagcacgccaggcttcattgtccatcatagactcctggagtttgctcaaactcatgcccactgagttggtgataccacccaactgtttcatcctctgttgtccccttctcctcctgccctcaatctttcccagaatcatggtcttctctaatgagtcaatcctttgcatcgagaggccataatattggagtttcagctgcatcatcagtccttccaatgaatattcaggattgatttcctttaagatggactggttggatctccttgcagtccaagggactctcaagcatcttctccaacaccacagttcaaaagcatcaattctttggggctcagcttactttatagcccaactctcatatctgtacatgactactggaaaaaccatagctttgactagatggacatttgttggcaaagtaatgtctctgctttttaatatgatgtcaaattttgttacagatttacttccaaaggagcaagcatcttttaatgtcatggctgcagtcaccatctgcagtgattttggagcctaagaaaatgaagtctctcactttttccattgtttcctcatctacttgtcatgaagtgatgggagcagatgctatgatcttagttttttgaacattgagtttttagccagcttttttcactctcctcttttactttcaacacgaggctcttcagttcttctttgctttctgtgagggtggtttcatttgcatgtctgaggttattgatttttcttccttcaatcttaattccagcttgtgcttcatccagtctggcattttgcatgaggtactctgcatataagttaaataaagaggttgacaaccttgatgtaaacctttcccaatttggaaccagtccgttgttccatatctggttctaactgttgcttcttgacctgcacacagatttctcaggaggcagataaggtggtcaggtattcccaacttttgaagaattttccacagctttttgtgttgcatgcagtcagaactttagcacagtcaatgaagaagaagtagatgttaaagagtagaatgctgtcctagttaatgctatttccttccagtttttttataagaatagattttattagatttcttgtgtttgtgcttagttgcttcagtcaagtaccactctttgcgacactgtagactgttgcctaaaggctcctctgtccatgggattctccaggcaagaatattggaatgtgttgccatgccctcctccaggggacctttctgacccagggattaaacctgtgtctcttacatctcttgcattggccggtaggttcttaacattagtaccacctggggagaactgttagatttcttgtgagtaatgtaataatctgaaaattaattgtggttgaaagcaaaaggcaaaggaacttaaggcaaagaaaaaataacttaggagatgcaaggactagtttcttttcctttcttctagggtttcagtggttgaaacattctgattttgtagacttgttatgagaacagtgatgtttataatgcctaccctaggacatggttggccctcaactaatattaactgtatttgaattctaaagctgtctttacatagactttcaagaaagttattaattcaggtacttcctgagtggttcagtggttaacactctgcctcccaatgcaagaggtctgaaattcatccttgggcagggattaaaacctgtgtggtgtggctgaaaaaagaaaataactgatccatacacattgagtgatcattaattttgaaagattaggggaaaaaaaaaagttgaatctgaaactttaagtcctctaatgacatactttgttttgtctatttcattttaacctaacaaataaaggaaatccttaaagattgtgatcagagaaattaaaatatgaccgttttaatctgccataatttaacatatttaaccttacatcattggcaattgattatctgtatatgtgaatgcattcgtatgagtgtaatgatgaagagcatttgatataagttccttaaaattcaactagtctggatagaaggcaaacatttcccttcctttcagctgttttttggggggttatatgatcctgactgcttttctgtattgaattttgtgatttgtatgtgataataagtctctcagtatgctcaactggataattctcttttttcctgacagttcacacaaatagcaataaacttatctgatgcctgctgctttctttatgtcatttggaaatgagttactgttatattttcagcataaattgaattctgtccttttaaacatggatttgagtagtcttgtacttcagtttgtttgttttttttctcttatgttacagaatattacttagtccaatgtgacacactgtaggaagagtaccatttaaatcctgttgctattgtggaatctgggatttgtttccatggacacagagccaagctaacagtaaggattttacagcctaacattgactgaggactgggaacctaaacagtctctattaaaatgaagtgactataaattaagcaagcattgtgtatattacacaaaaactaatttatcaaatttcctctacagaaacattgaaaacgattattagagcttcaagaatttttttaaagcagaaaataccactactttccccaatcctaataactatagattaatcattttgatgcgtgatactagcacaaacatatgataatgaattagatataatgaaagacggcatatttattaatctagaataaaactggtccattggcttgagtgtgtgtgtgtccatcactctgtcttatctgactctatgtgatgccatggactgtagcccaccaggctcctctgtccacagaatttcccaggcaggaaaactaatgatttcctcctccaggagatcttcctgattcagggatccaactggtgtctcttgcattggcagataggttctttaccattagcgccacctagagtaaaactaggcggtgatgtaacaagcatctctagaaacaacattctctgactgtatgtctatttaaaaaaataaagaaaagaacaaaatgttgatataaagtgaaaatatttaatgaaccagttaaattgtataaaagtgctacattaagaagattgattttttcttcattttatttcagtggaaatattgctttccaatgtgggtttttgtgagggtccttgggcttcccttttggttcagtcggtaaagaatcaactgcagtgcaggagacctgggttcgatccctgggttgggaacatcctctggagaagggaaaggctaccaattccggtattctgacctgcagaattccatggactgcatagtccatgaggttgcaaagaatcagacacgactgagcgactttcacttcaccaggttaaaattcttgtgttcttagaagattagtaaagattcacatctttactaatgtgaatctgccttgcttaatgtttcactcagccatcaacctattcattcattctggagagttgcaggtaggctgagatttatggcataaagtttacttcaccaatgatgattaagtaaagaaagtgaagttcctcagtcatgtccgactctttgcgaccctatggactgtagcctatcaggctcttccgtccatgggattttccaggcaagagtactgggggtgcgttgccatttccttctccagggatctttccgacgcagggatcgaacccgggtctccctcaactgtaggcagatgctttaccgtttgagccaccagggaagtaccctatcaata

SEQ ID NO: 63067 - DNA, 1496 bp, Bovine  19866881066481
tgacttggctatccccaggtacttttcaaattttgcattacctatacagtcctagtagtgtatggaaaatgccacacctgcagacagttaccttaaggagttttcaagtctgttctccacaaattgctagctgaaatcaattgacagagatctctcatttctttgggtttgaaatgtgtcactgcaagcaattgttctatttgctgttaagtactttctttgtggaactcagcactgcttattgacatcctttccttgggtaaattctgcacttcaagcagatctcttgtcagtaagtaggttcatgatttagcttcattgcacttttttttttttaaagtatgtgaagcattttaaaagttaatgctcaaggttaatacaaatatttaggtcatttaagatataaagctgagaaagatgtcatcataatgactgtgggaaataatgtatctgatattcaaacttcatgcagtatttcatcgtgaatctaatcatagcaacattttacccaaaataataagcaaatataaatttctgccttaactaaataaatgaaatagcagactgtatttttatatgaatgtataaccaggagatctcaacaatgtagagatgaataacccattgtgtagatgttataagcctctcttttgttaatttctgtatagttcactaagaagtgaaaaggtcctgtggtcagtaagatgcaaccttacgatagtcacagaacttaagtgtggcatctgagactgttttgtgtttgcatgcttgggcttccaggtggtactaatggtaaagaacacagctgccagtgcaggagacataagagacatgggttcaatacctgggtcaggaagatccgcttaaggagggtatggcaaccacactccagtattcttgcctagagaatcccatgaacagaggagtctgctgggctatggtccatagggtcacaaagagttggacacaactgaagcagcttcatgcaggcaggagcttgaagcaattaaaataagtatcaagaaatgaataaatatttaaaaaataaaattttgtactatacacctgcaatttttaatgctactgtgttacatttatttgaataactattattttgttggacagaggaataaagtttcaataaagactgcaggagaatatgtttagcctcatatggttggagtatgcaaagaaaaagtaacaaacctcatcagctctggtttcattataatattaagctgggtttccagttcaacactaaatagaatattgtatctgggagtataagattgggaattaagaaacagtgaaaaaaagctatttaaatggaagaagaggtctgtattataagaaatggaaagccatgcatgacttttattttttaaagatgtaataaaaattttgcttcactaatttcactgaaaagctcaaattaaatatatgtacaattacacaataatgtctaaaatttctaatatagtaaaaattacattttt

SEQ ID NO: 63068 - DNA, 777 bp, Bovine  19866881149751
ctaattgatatctataggacacttatcccaaaacaatgaatttcacttttttctcaagcacacatggaaccttctccaggatagatcacatcctgggccataaagctagccttggtaagttttggtgtctttactgttaatttgaagaattttttgtatattctaagtaaagttttttttctgttagacatattcaattctgttcaattctgttgcctatgttttaaatttatgtaaattttatggagttctaatatcaataatttttgtttttgagaaacttgaaaatcgttaataaatatatagagaagtttaagaatacacaaagagcccagtagatatttttaaaagaagctaatataagacatgcctatagtatactatagcatgccatatgttttaagatttagcatgtttgacaacacactaataaaccaactgaaagaatagaaagctgaaaaccgaccatttatagatagccttctcatatacattgaagtgttgccataaatcatttaagaaagagaatttcagtagattgcatcaggaaacctagctctttatgtagagaaaaagaaacttaatcaaatgtgtcacacaaggatggaacctagattgactgaatatttaattttgaaggctaaaccacaaagttaataaagaaaattaagaaaaactttagtgtcttagaggcagaaaagaaacttcttgcataaaacttttacagaacaaattacaaggcaaaacaataaatttagttacatcgaaattaaaaat

SEQ ID NO: 63069 - DNA, 1039 bp, Bovine  19866881196009
tatttttagataaatttaaattagacgacggaatacagaatggactcaagaagagaggtgctaccaaggaatgaaagtgactaagtctctaatggtggagttcatcatcatttaaccttagggaatctgtgattattagtcaagagttcccgggaaaagtctgttttaagccaacaaaggaaggacaacaagtaatttgttttcttgatgggaaataggagattgctgcaggactttaaggaattagaatagaatatttggaacaagaataatatatatacaaatacaggaaggagtcgacataggctaatattaacttaaaagagagtcaagaaagttaaatgagtttgtgatgatgaaataatacatggaagcaatattgtaataaacattttcaagattagctaatagaaagattaatagggaaagggaaatgaaaataaaaagtgtcatcttaacactacaagaataattatacagtcattattgcagccaaattcccactggtttcagtgggggctttggagagaactagaagacatatgcttcagtagcgtacctagaattgcaaagtttatttaagggataaatgtagaaaaatctaggaggtaataattgatagattttaaaaaaaatacgccatgcctgtattttttagaaagcaaccttttaaaagaactgatacagagatcttatttcacaattggcatgtttaagctgagtacatttgtatgtatccctaacttttatcaattcatcaggagtctgggtctctcagcacaattcctccatccatctttgctgtgaaactggaaatggatttgtttaaattattgggcttttaatttgccacattttgtctcctgtctgagaagcctgtttattttcaggcagctgcatatgttggcgtgattgatgagagccgccacagtcaagcaagcagccctgggcggccagtttacccttccctgctagggtttcagctgccagttgcccccattctgtgacagcttctccttctcctcaccttgtcatcaag

SEQ ID NO: 63070 - DNA, 2495 bp, Bovine  19866881278223
ctttttgataaagtctttatttctaaattattcattttgcagcaaaaatcacagtgttctgtatggcttaaaggcatgcatatttatttatcctgtgtagctgccacattttaattgagacatatgggaagtttctgattgggcacttaatagtcctaacagcttgctattcttgagaagttcaattacagtaaatatagcagtgttagtagcctagtgctggtactacctcaatggctggcacagagatactgcattttaaaaaatgaatacttaatgattttaactttatgaaggtgaaaagatgtatttcaacagtggcaatttgcattataataaatgctgttcttagaggtgggtgagttggagtagaaactggatagttttatattaatttcaatgtaaaacacatgactctaatggcttttaaagtaaaatgttgcctacatttttttctgatttccaaaatgtactttgaaaggtttggcctaataacaaggacgtagagcaaaaatatccatattcaagcattcaggaaacaaccaatttattttaaatctaaaactgtaggcagaaattgctggcttagtatgtatagaacaagaattttaacttgctctatgtaagaagtttagcccttgctggggaattataattagatgtaggtctcaaaataaaagcaaatcaataaataagaaggatgtcaataaataaagtatacatataatgacaatgtggggttttttcatactaatcttgctgaggaaatttgatatgaaataaatcatgatctcatacctcaaagacaatgctgtgtggcataaactttacacaatttggaatatatctgcacatatctcacctatttccctaggttgagagttccctgaatataggaactgtgctttacttatggttatatccccagcattttaggatgttttgtatctaggcattggggctccccttgtggctcagcactaaagaatccacctacatttcaggagatgccagttcaatcccagggttgggaagattctgtagaggaggaatagcaacccactccaatatttttgcttggggaatcccatggacaaaggagagtggcaagctacaatccatagactggtaaaagtgttggacgtgacttagtgtctagataacaataataacaacatctaggcattaggacagagaaggcaatggcaccccactccaatactcttgcctggaaaatccatggacgaaggagcctagtaggctgcagtccatggggtcgctaagagtcagatacgactgagcgacttcactttcactttttactttcatgcattggagaaggaaatggcaacctactccagtgttcttgcctggggaatcccagggatggggaagcctggtgggctgccgtctatggggtcgcacagagttggacacgactgaagcgacttagcagcagcagcagtagcagcaggcattagaaggtattgaaaacatccttaccttaaatggcttatgcagttttggtactatgattttgaataagctctctagtattaaatattcactatctatgtaagtatctagagtatttggctggggcagagggtattgatgagcactgttgaacatccatcatatattgttgttgcattattgcttcgattcactcatgtagccaacattcattcattggatggacattaaacgagattttggggaagcagaaatttacaaaaccatgactaaaatttaggtgttttgttttggtgaaacaatcagacaataaactatgtgtctgcgataatcagtgctgtgattataagtaaagtgggatgaatgataatagactggggatgcttgtttaagaaaaagtgttgtagaaagcctttctgctgaaatgtcatttgagcagagacttgaatgaagtgaagaagcaaacacctacatggatattttgttcaaagtcattccaagtagagaaaacattagatacaagtgttcttgagtgagaatgtgtttgatttgttatggggaaactcaagaagacaaaaccggatggtgccgagtgaacaatgggaagaaattttggaaataaaatcacagagttggggtggccatgtcaatctatagtaaaaatataattttagccttattttagtgtcagtcttgtatttttctctgaaattggacttatcatagagtgaaatacttgaattcttgagtcaaaatagtctatctgctctcctatttcaaaacaccgtagcaaaaaaactactaaacaagagatgagtcgttaaatatgaattttgtaagacagacaaggtttttgtacaagattctattgaaaagcacaattatacttgatccagttagataaagaaagttattcatgtaaaacaaacaaataaaaaaggcaagaaaagaaaattctaatgataaaatgtaatcataaagagcagaagacacaaaggtaaaggacaagttggaaaaag

SEQ ID NO: 63071 - DNA, 834 bp, Bovine  19866881869184
actgaggaaatcccatgagagaaacctgtagtctaaattagcttataaaatgaaagtacttatacctaatatacatcactagagggatgaatatctttcttaaatttggaaattaaaaaaaaaaaagaaaaaagttatgtatgtaggttaatgtcaagagagtatatggtgaagcataacattttctctacattgcatgtttttttctaagtaaatttaaaattgtttttgagtgactggattatacctacacaaggcagagtattttacaatagctggtagtggagatgattttttccaaatgaggaacttctatatttcatctttaaatcagtccatcacggtatgaatgggaatcaaatccacttaaatatgtcagcatgaacatatgcttcctattttaggtgtataaagagactattgttattcttttgagaaaaatcctgctgtgaagttttctgtatatgttttagaagcatacagggcatgctgccagcaccattgtatttcaaagcctgattccctttgtaaatgctataactggccatgttaatggacttggggtggatatggatgttgagggtgttgcacagataataacggggctctgatgaattaagtctgtgtgttcctgtggggtgatggaaatagaatagaatcataatgaaatttcaaacctgcagctgtatttcacctaaaacattctgctcatagaatccgtctcttcctcaggcttctaactagcagagaggaatgtagaagataagcttctctgagacagaaaatctaattttcactgaataaagttatccatatgtatagatagatacaaaa

SEQ ID NO: 63072 - DNA, 2716 bp, Bovine  19866880298166
tctgttgttccatgtccagttctaactgttgcttcctgacctgcatataggtttctcaagaggcaggtcaggtggcctggtattcccatctgcttcagaattttccacagtttattgggatccacatagtcaaaggctttggcataattaacaaagcaaaaatagatgtttttctggaactctcttactttttccatgatccagaggatgtttgatctctggttcctttgcgttttctaaaaccagcttgaacatctggaagttcgcggttcatgtattgctgaagtctggcttggagaattttgagcattactttactagtgtgtgagatgagtgcaattgtgtgtagtttgagcattctttggcattgcctttctttgggactggaatgaaaactgaccttttccagtcctgtggccactcctgagttttccaaatttgctggcatattgagtgcagcactttcacagcatcatctttcaggatgtgaaatagctcaactgaaattctatcacttccactagctttgttcgtagtgatgctttctaaggcccacttgacttcacattccaggatgtctggctctaggtgagtgatcacaccatcctgattatcttggtcatgaagatcttttttgtacagttcttctgtgtattcttgctacctcttcttaatatcttctgcttctgttaggtccataccatttctatcctttatcgagcccatctttgcatgaaatattcccttggtatctctaattttcttgaagagatctgtagtctttcccaatctgttgttttcctctatttctttgcattgatcgctgaggaagctcttagatgagtaataaaaaggttcaactgcacataattgtcaaaactccacatgtgacttagcactaaggcttttcttttcacagtggttggacctcctgaatgcaggaaagcctggagtcgcagaacctttaagaaaagcttgggtttccattctgcaccatccattcatgttttagtctgactgatcgcctacattaggatcacaggaaagggtgagggttaaaacaaaaatgtcctgccttgcctggtgtgagcctcacaggtgttgaaagtatatcattccccagagaccacatccacagccccccccacatccactgaggacctcttacctgccttgctctggatgcacaccatgcattcttagacctttgcttactgaacccctaagcatcaactaatcatttttgtttctctctccagggtcttagtggttctcctggagagaattttaaatgacctactttctcttacatttttgcatgttccatgtcagacctacagaaaatgctctttcatactttcccttccacactgtgggaatgcaggacagccagcatggtcatctctctttgcctcaaacaccagcaacctgccggcctagcaattgtacttctgactcctcagatggaatacaaaaccagcccactgtgtccccaactgcacggacccactgatgtacatcttaccaggcttgaaatgatggtcagggacagttaatagacactgtctgaagcttggaaatcatttaaaggaataactacatgtcatttcagatacactccaaaagcccactcaaaggttatcttatcctctaggaaaatgttcctttgtgtgattatcgtttactagtcataaagctctgattctgtgaagtaatatattaactggtaggttttttttccatctacaatttttacatcatttgcattaggtttttgaaccaatttaaccatcctggtggttccttcctttatgaattaaataaacatgtaaattctattaatatatttatagaccatcatgttcttaatttctgaaattatattttgatagtggataccaagctttcctcttctgaagcgagatgggacacatgacagagcagaaacttatcaaaagtactctttcaatatccactccactcttggttccccgaagtttattacaggcagaagtggataatcaaatcaggattataaaacagattttctatcatctcctttttacaagtcctgaaatttagctttactttgaaatggaacatctactttcctcatgcctaggcagacagtggatataacatcctattacatatgtatgggatttttcaaattgtcaaggatagccaagctttagaggcaacataaaattacaaaaagattttttaaaaacataaattagtatgatataaatgtatttagatatatcttatggactaaacttaaaaaggaaagagaagaaacttatagttaaggtgtgacattgtcctttttgtaatttttctcagcattgtaatttctggtggtcacccatgacatagaattcttcagcaaataaatttccataacacaggcaatgattactgatgtttcacaagtgtagggcatatgataaattcctgcttccttcaatgtgtagtcctttcccagttgaaaagtaaatatataagctttttcaatgggcatgtcgttttcaaccagcgtttattcaacacctgctctattgtggacactgcctaaaagtggatacaaaaaggaacaaaggctgtatctctgcctttgaggaacccattgtctattgaggaaagtaagagatcacaaataattaatatgtaatgtagcaagtactagattcacaaagtagggagagagacatgt

SEQ ID NO: 63073 - DNA, 2921 bp, Bovine  19866880423183
ggttgggaagatcccctgaagaagggcatggcaacccactccgtattcttgcctggacaatccccatggacagaggatcctggctggctacagtccacgggattgaaaagagtcgaacacaactaagcacagcacagcatgacataagtactaatattatgttcaaatagggggtgggaaaaatatagcttagaaagtatagtgacttagaactattagttcattaaactcgtccttggacccaagtccaaaccttcaatctctagagatactgatactaagtgcagggcactttgccaaattctgggcgggatacagaaatgaataagtattttctcttttccagtggtatacagtcatcgggttatgactcttgaggagtcctaaacatatacttaaagaaagcttcctcaccatccatatttatggcctctttcatttcataagatgcaaaaacatctatccagaccatctgcatttatgtgtccaccgtgtctgtaatgccagtccaattgactactacccccaccttttgtacctaactgcattatcttctagaattgcccaaattagagaattggaataatgtttgacccctccctcccactcagagcctatagctagtcacttattcttggaatctacctaggaaacctttcacaactgtgcaacttccaagttctactcctattgaaagaaagttgacttcggagacaaacaggtcttattttcactctgccacttttcagttgtatgaccttaggcaaactacacaacttctctttgagtttctatgtctttgtgcatcaaatatctgacttattggaatggtgttaactgtagagattggtatttaacatcaccagcacctatacagagtatcttagcagctattactagtactgatctattttaggtcactgctgctgctaagtcgcttcagtcgtgtccgactctgtgcgaccccatagacggcggcccaccgggctcccccgtccctgggattctccaggcaaggacactggagtggggttgccatttccttctccaatgcatcaaagtgaaaagtgaaagtgaagtcactcagtcgtgtccgactcttagcgaccccatggactgcagcccaccaggctcctccatccatgggattttccaggcaagagtactgaagtggggtgccattgccttctcccattttaggtcactggcatctcttaaaacacaatgcctagtacaaaacaagcactcaacaaataatcactaaaaaaactttggaaaaaaataaaataaattcaataaattgaaagaacaaatgacttcagactgtcatttgcagctggaacagattgtgattaatagcaagattccaacatattcaatagactaggtctattgaacttaaacagttcccccagggaattctcaaaaaggtacctgttgggttattcttcataataaacagaaatggatgatttgctataaattgattccttgacagactcatgatcacaggtgtatttatgcctatgaaatagagacaagagttatttagatgttcacatttaaagatcagtaaagaaaatatatccataatattcacaatattttttgtagacaggaaaggccatttttgtttgaggagttaacatgtggaaaaataaccattttctaaatacagaaatttggaataaatctaaaaattgaagagcagaggaaaagatattggaattcatggaataattctaacttcacactttatgcttaatgaagaagaaagccagatactagattcaatttagtgacagcagctgaaaatttcatcttttaagcagtaactttctgctcactttttatttacattagataatttactttatagtgtttgaactcctaattcctatccaggtattttgtaaatccactgagaagatgcctgaaagtcaaaatactcacactaccaaaggtgatacatcagggtcactgctgaccccttaatgattgttatctcctcttagagaactttatactaaaaacaagaggccttggccaaggcagaagagttctgaacctgaaatcaggaaatctggtttcattccaaaccctactgtttcttactaatatgaccttaggcaaactgctccacacgtgagtctgttttatcaccaacataatgagaggatcagactatgatctacaagcactcttccaattctatgtaaaagcaagtgaaaattttttctacatgaactagcaacttcatccccaacaccagctttgatttctctaaggattgtaatagcccatacaggagcccttcaggagatgacaaaacattagggagcccagtgtgcccacccagatgtcaaaatccactggcattaataatgtgggtataaatttaacaatatgactatttaaaagatatgtatcttttacatactggctaaaatccaaatagtctgaaaaattaaaatatgtttatgaggaattcattaaagttgccttcccatttctaattgaatttaaggctttttctccaattatttgttgaatattacttttatgcagcatagatactattcaaaatgccacttgttcaaggagatatagaagagcagctcctaaactgtaatgttcatacaagtcaccaggagaccttggaaaatgcagatgctggatcagtcagtctggagttgggcccgaggttctgcatttctaataagttccacagaatgatgctgatgctgctggtctatgcattatactcatagtaccaaggataagctgcaagtcactggagagcagcagttctcaacctttaatgtgcattgtcatcacttaggaaaatgtaagaaaatgctgaaggctaaatctcatcaccagagatactattcaatattttagggtgttcaatattcaat

SEQ ID NO: 63074 - DNA, 1495 bp, Bovine  19866880460529
ttgtttcaaatgaatggccactcatttataggaggctgtaaattgttgccatatataatgtagaatgggctcttatcttaagacaatactcattcagtgatttatttatttttcctttcacaaatgaactgaagaaatcattgggattaacgaagctggtgatttaccatggcacagtgacctaccaaatggcataatgatttatataaaatatattcatttgacaattcctgaagtatgagaatgaatgtttttagttttagtaaaaccaatttttacctagatttaaaattttcctttgataaaacaaccttcttaggcaaaatccatacattatttgtattttcgtatcagtatttaacttcctatcatatatacatttcagtatgctcatccaaatctcttactgagccaaacttccagggaaatggagaacaattcttcttctttaaggttgagggtataggacagcattagagacttttagaagaaggttgtgaaaaatgctacatgaaatgtgccatttcccagaaagtagtgaatcatagttttgaaactgacagtgctccatacataacaaaaaaatattgtgtttagaatgttttcaggtcctgggttgaggggagaagcagactgcagggtattaaaaatctttttttctaggctgttagctttcgttatgctattgtattttttagattatgaactaaaaaagtgcttctgacagagatgttttatagctatatatttaaatatgagggatacctctttaagaagtgggcatgaaaagtggaaacaacaatgaatctgcttcagcttgcctctatatccattgagacaatgtcaaggaaggtttcactaatccgtccagttttgtagtgagtagattggcgattgcttgtagacttaattcaaaatatggttctccttggtcagaaaaacagattgaaaagactaggacaaatggcttttatgtaatgtcctatacttctgatagtttaaaattttaaactattgtcttcaatttatgaggttagttactttaaaaattcttcaaacaagcatttctggtaaccatttcaatgccacagaattacaaagatgtaagagttattgttgattcttcttgtgtctaaaagcagtatacagcctggggaagttatttatgtatccatgtctgtctgaaaaaaaaaaaaagtatttgttttcttgtattgttggaattattttgagatttttgtggcaaagtattattaatttataatcataaaaagaagaaaaaatctgctagagattatgtctatttctgtgttaattggctttattaagactgtgtcttggactgaacaataaagagttcatgaagaagggctcttcctttttacttcatttctgccactgttatttcaatacttgtaagtgtaatgttcattctctttaaaattatgtaaaattttattttgtaacttttgaaatgaacctttattacatatga

SEQ ID NO: 63075 - DNA, 1085 bp, Bovine  19866880513841
tggggagaaattttcaaatttcacttcttcttgaaatgtggatgttttcaaaccaagcgtctcctgggaaatttttctcttaaacttcttctattccttttaattcaatttaaatttagaagttaaattttaacagacttcatctattaatgtatttatatcatgatagagatctaccatttaacaggaaaagactaaagaagcttgcattttccatttttgttttttcatctacttaacaatgatcaaggactcgtacaaagcaaagaacaaattattctgtattgaaataaaacaattaaaatcgtcaaaacacagtgtgaatgcatgactaaacaagtacatctgccattacatcattataggatagtttgatctgcagggatctgtggcttcagaagacagccaaattagccccatgaatggttatatgtgttagtgacaagcaggaggaaattgtgccttgcactccaaaaaaattttttttggccttttgctaaattttgtcacttttaacaaatgcttgttgaatactacattacgtactatgctcaggtataaatggggcacaaatatgactaagtcacaggcttccttccaactggtagaaagtgggagctgtagccaaataaccaaaatatcatctataataggatctgttctaagagaatatgagcaatgtaaatggtggttaaacacataatgagattgtaacaatacacagagatcagagaaaagattttaagaattggatgctatttgaaatagaccctgaagcccagagagaattatcactgatagcgaggactatggagatgaggaaacatttgcaagggagaaaaggaaagccaactactggggtcaaagtaaatacaagtatggagaaagagagctactcttccggccactctgagtaattcagaaagatctaacagaagtgtaagatatataaaacagaatgatatttgagctggactgagggccactttaaatactaagccaaaaaatacaaaacaaagaaactacatagacattaaaaaacctcacagtatagaagcatctttatacatttggataaaaaaaaa

SEQ ID NO: 63076 - DNA, 1227 bp, Bovine  19866880523106
ttattttcttatgtttctctcaatattctttccggatgtggtgaaaatgcctggaaagcaatatagtcaaaagatcattcctcaaaaaaccagcagccggtgaaatcaaagcaatctcctcaaaaggattttacagtaaaaatgcttttgattaataagaaaacaaattcatactaaacaataatgtgatcaaataatctttaaaactctaaacctctagtatgtgaatgacagtctccatgatcatgtatgacagaaaatgtctactgtatttttctccatttacctgagagctgctcccctgcagaataggagacttggttttctgctggcttttactaatctcttttgtagaacaattcttccatttgggttcatctggattaacttcctttataaaccgatgggcagcatccaatacattggatagtaattgcgattttgcctataaaaaaaaagaagataggaataaaaagcccattgtcagcctaagtaatttatatatattaaatcatgttttcattattctatgactagcaaaattcaatgcattttgttcaatatttaaaaatataaattgctatttatatcagccatataatagtgacagttgccatctactgaatgcctagtttgggctcacattatcttaagtatcttaaaaacatatcttttaatcctcaagtcaactctaaagtgttaactatttttatcattgttttagtgataaagttttgagggtttaaataacttgatcgtggttacaaggtgagtgggtggcagagctgggaagtgaccccaggtgtgtataattctaataactcatactactactactactactaagtcgcttcagtcgtgtccaattctgtgcgaccccagagacggcagcccaccaggctcccccgtccctgggattctccacgcaagaacactggagtgggttgccatttccttctccactaataattcatagcctttccattatattgaccccaaatagatagatgagctattttgtgcacatcatggctaaagaactaaatgtagttgatgtagagggagtctgaataagcagtagtgagtattttcttggtgataaaatatctttagaaagtattaactactcaaagtgcacatcaggaagtgccctatcaaattccaagttctttttgtcatgcctttgctcataagataccaggaaggccctccctcctttattacctc

SEQ ID NO: 63077 - DNA, 2870 bp, Bovine  19866880634377
tggaaaaccagagagaaggcaaagatctggggtgggtgaagtaagagaggcaaagatacatctcccacagggatctttcattctaactcttggcattttctcttgtttttcaggtgaggttggccttagttgcagaaagtactatcaatgagcaattcagatttttaaaacacacacacacaatatctctgttaccattaattttagccttaagattgagtagggcttgataaatttgacacaaatcagcagatagttctgaatttcaattaaaaaatcacatttatttactataagacatttaaatcagtatgataaagatggcttgtttttatgttaacagtcaactcaattttcaaaagagaaccaaaaaattgccaattgacaaagcactgttacttttccaaataggtttaaattttatctcatttcttaccttatcttttattttattagatatattttctattagatagtttgtattcttatatttttttttctgccaagcattatttaattaaacccattcaacaacccataaagtataattatctctattttacagataagaaaattaaagcacaagagagatttgtaggttcttttccatatacttctcctgatgtggtatagctcagacctttggactcattttggatttgaatgaatacaagtgttattacagtattcctaccaatgacctaacctgtcagactcacttggccgttacaaggattaaatgacaggtaaagaacagtttaagaaacagtcattttccagtccttctctgatgactccagtgttggagctgcatgtgagttaaagatgcagctgcggtgtaagaacagtaaaggctgtgaaccatgtgagggcctgtgttgtgttctttacctgtgtattcttatattataatcccatctccctgaaaccaaatttgttatttaaaaatagccctatgacctcaagaagttatgtaagttttttgagcctcagctttcctacttaaaaaaataaagttacactatcttaatgaaccattccatgcatcattccatgattctgaattgctaggttttaccttccttctatgaaatatgacaatctcagctgcccctttgagtaccagattgcaccatttatactttatgacaaagtaatgatcacagacaaaattcgcaagtgcacattttggtctgaatacatttctcagtcctcaccttctggcttgggaggatgcaccagcaggctcttgccagccattgagcttagaaacatgttctgcctgtgaggatcctagattttcacttcacgatggctttatcagcttccgcagctgctggataatgcaagctcctaagagtctccaagagatgcttagacacctgtcaagccaggtgcactgggacagcaattgcccaagaaatatctaggctggcataaagccaattccttctctacccgcccacccccgcccccaaaaaagctgttgtgatcacagttaattgagagcaccctttcccatctagccatttttacaggcactgaaaagacagaaaagtgtgctttttaaaaatccaaagcaaggctaagtcacaatccagaaatgaagcttactcagcctattctgaaatgttacctagttgttaatcattaatgagatgctaaatttatgaaaccttgaagtgaaagggaagactgagattttggcatcaagtttcatttgaatcaactttctggaggaaaaacagctcagtaagttggagtgcaagctgtgggggctaccccggggcatctgtgttgttctggaaaaccatactatatcatcagcatacatgtgcgcaagggagaaaacacattagactgtaagataatcgtcaagcagagaaaataaaatatgccctcaggcgtcccatttgtaattcccttgaatctgtgctcttggggctttctttcctgtacaattcttcaagttaatgcaaagcactttatgcagtctctacaaggccccacatttttgaagttttgcaggggtaatttatggcctgctaaagcaaatgccttagagaggtcaataaaaatggctcctatcaggcagtcttagtctattgcattggaggtaccttgggtgtcacattctgggtgattggtttgctgtgaagcctgaccagaaagaagtcagcaaatcctttggctatagcagtttgaaatgtgtaggtacattttttttttccagaaacagaccaaaataggcttttgctgaagcaagtctcttaatttcccttctgcggacatgaactaccctggcacatctcccacactgaataagaaaagacctgagatcagaggtgtttacttcagctgttaaaggaactgccaaatatagagatttgggctcttccttgaaattgtgtctcaactcattgttcacaaggaaataattccaaaccttccaaagcataaattaatctacctacaccaaatatctgcattcttgtctcttgtgaacatttgtgagcatgaggtcaggtcccaccactatcaccaactggcattgatgaaagaaagaacagcagtaataatctatttttgtcatcagatttctactgttataagtttacagttaactagatagataaatagaggtaaagatatagagtatatcttaggcattaatcttaattctctaagaaaaactttccagatgtttccagaaatgattcactagttgtgtatgtattagaagagttggcaggttttagttttctgacaagaaacactctgtatactagtcagggttcttcagagaaacagaaccaataagagagagagaggagagagagagggagatttataatggaaattgactcatg

SEQ ID NO: 63078 - DNA, 1303 bp, Bovine  19866880666695
tttcaaagccactcaagctacatgatcttaaaatattttattcactaagcatccagccagttccaaacagtttcactcatcaaggtcaccagcaagttaaagactcagaattaggattaaatcagctgaagcagaaaacaggatttctgggttctttttccttttgtggtggtggtggtggtttagtctctaagtcatgtctgactcttgcaaccccatgggttgtagctcaccaggcttttctgtccatgggatttcccaggcaagaataccggagtgggtagccattccctttttcaggggattataaaactctctccttttaccttcctacagttttgcatgaagtctatcatacctgtcccagcctgtaactaggattgtcttcttaagaaccaggatgtgtgaaatatccacagctccctcttgcccaacattgagtgtgtggtgacaacagccattgaggtcccagacctttaaaagagaagttaaaatcagctttgagataagaaaagaaaatgtcttctcaatgagtacagcaacaggatgtaataggatttttacagttttttgtttatgttctgcactagggttgattcacttgagacacataataattaaagccttctcaccacttaaatttagctcgtatgtttattactctatttgtaaccttatcagtctactctgataatagttgattcaaaggcaatacatcagtgtttatttttaagggggaggcagtataaaaacatgaagagcttcattttggagtctgtcaaaatcctgtttctttctccaagtatctttctaaattttgattttcttatttatgacataggacctctatttcagggatgcttggaattgtaaacatataatacagagcttgaaacacagtcatcacgtccgaggtttcctatcttctgccaataaaacctcctgttgacagtgggtaccagacccacatccacagaagcacaagcaattctagtttacctcctcaggccgtgggatgaggatgtagaccaatcggttcactttaagagagaaagtaattagctgttaaaactaagccctgctatgaaacattattggtacatcatcaaagggcagatggcactttctatcgagataaaaatgcatatcccttttgcctcaaaaattcaacttttagaaaatcattactcagagatactcatatgtgaaattatgtattttaaaggattttctggaagcattgttcataacagctaaaaattgaatcaacttaattgctcattaacaaggaatgaacatccaa

SEQ ID NO: 63079 - DNA, 1070 bp, Bovine  19866880723600
gccttgacgtactccttttcctatttggaaccgtctgttgttcctgtccagttctaactgttgcttgcagattaacaatgttcaaataacagataaaatagaatatcaataataagatattgactgattaagagtcttggcaaggaatataaagagctaaaatatgatgcataaggaaaaactgttcactattccgtttgtaacacctacataggtaattcattaaagtagaggacttccatgaaaattttacaccctcaagaataaagatcccagctctcaacttttaccctttaccctcttccacatttcttcctccactgtgttgatccaagagtgcagctatacacataaaattacaccatacacctactcatcctaatttccaaaccaagtgcaaccagcacattctatgaaacaattttaaactctgattagattggacattccaagaaaagcatctattcagaaatatattttactctttattaggagtccaacaaggctacattcccatagaacttatcactttgggtctgtggattcatatgactactttgtagggtcattgtaagaatgactgctggttattattttcatttttatatatccctctgtcaagtattttcatcagaactcacagtgtatacaacacaatgtaggatatatttgttcatggttttttgaatggagcaatctgtaaatatattcaaagcagtggctcaattgttaggggaactaattaagctttgctgtattccatttgtacagattcaacccccaaatccccatttaaccatgtggtatcttactggaaacaaacaacattatccaagagtataagctaaccaatataatcccaaggaagttaaacacacactcacacacatacacataagacatataaagtttcagcaaatggcaagattactaaaaaacattttggatacatttcaaaggaagttacaagaacatctcacccatcagaatcaaaactcttagctgtcactgaaatttcacaagacaaattgaagctgccaaatttttctcaaatcccattcacttcaggg

SEQ ID NO: 63080 - DNA, 2111 bp, Bovine  19866880765007
tgtatatatgtgtgtgtgagtttttttttttttctttcagtttgtgacctatacttgattcaagtaaaagtaatgaacagttttctctggtcacagaatgacttaacttcaatttgatgctcaagcaactaaccaatagggggcaggagagcatcactactaactctggtgcttgtccagtttaacaattcttatctaacattcctaagacttaaaatatcattgcggctggccttagtatttgcatttgctgtactagaagtagttgctcaaatttagtgtgttaataaagtgctgtaactcttagtaatgttaatgaatcaagcattttgattagcaagacatgttcaggggaaaaagttaagattgtgtattcaaatgaaagtcattaaaatgaacacagcgctgaaaatgaaaatgtgacgtacataaatgtccctattatcgcaagataacagaatgctattcaggcaattttcctgtaaccgagcagaccactcgttaattgtctgtcccttccttctcacacttcccactcaaaagacttttgtctctgctactgtaatagaaaaagtttaaagggcagagtctgaaaaagtttgagaatgactcagaataaattaccattcagagatatctaatgctatatcacttgtttttattaatatagtttcaaatagaaaattatctgtctgataattttccatccaatgttgttgaccaatgcatgtatcctgaaacagagagaggaaggagagaggactttgcttgctccctgcctcccacaacaaccttcaggagtcctcagaaccttcaagcaaactatacagctttgtgaatataacttacatcttggggttttcccaaaaacctgcccaaaaggccttgtttttcttaagaatggaaagactataattcacatttcccttgtgaataaagcagggtaggatgaggtaaggagccagatttgtggatttaaagggaaagtggggaatttaaaacaatgctgtgtacttgattttgattcttaaagaatccactccttcccacagaagtgatttttttcactagtcctgttccatatttctttatcaactggagtgggtgttacaatgagaatttaccaaggaagccaatttaattgcaccccttttctctcaatatcataaacagttccagacatgcatgcctgggataatggaatgcctataacatgttaagtatagctctcagttgtacagtatatatgtggtcttaagatccaggataaggagaattgcaattatgtggatgcttttggaaccctctgtaactcgtatggggcttcccagatggtgtagtagtaaagaatctgcttaccaatgcaggcgactcaagaggtgcagatttgataccagggtcaggaagatcccctgaggaaggaaatgggaacccactccagtattcctgcctgggggatcccatggacagagcagcctggcaagctatagtccatggggttgcaaagaatcagacacagctgtgactgagtgcactcacatgcacacacacgcacacgctcacacacacagacacacacacacacacataactggtttgagccaggatttgtctgtgacttcatctttaagggagttaaaaatggatcacacctagaaagaaagactagagcccaatcttaagattgagtgggtgtgtctagatataaggtctgcttcagattgagtacatgatgcaccaattgcctgtcctttctctgttgtggttccagcctttctttttcttatttctgcttcccttttaagctcagccctaacaacagtttctctctctcttgctcttctctctcatctatatatgatctacctcagctgaaatccaagttcccagccatattagaatttagatgtctgagaactcagttaaagaacaactataaaaggattatcaagtaacctttgttggatttggtaaagaacactaattgtaaagttcagaaagtctagctttctgtgtcaattttcaattctcagaattttgtaaatattttcttagtattaaataattaatttacaattaaaagaaaatactacaatcctgccctggcagta

SEQ ID NO: 63081 - DNA, 2006 bp, Bovine  19866880769425
taagtgagtgatcacaccatcatggttatctgggtcatgaagatcttttttgtatagttcttctgtgtatcattgccacctcttcttaatatcttctgcttctgttaggtgcataccacttctgtccttcctttattgtgcccatttttgcatgaaatgttcccttggtatctctaattttcatgatgagatctctagtctttactattctattgttttcctctatttctttgcactgatcactgatgagggctttcttatctctccttgctattctttggaactctgcattcagatgggtatatctttccttttctcctttgcctttagcttctctttttttcctcagctaattgtaaggtctcctcagacaaccattttgcttttttgcatttctttttcttggggacggtcttgatcactgcctcttgtacagtgtcatgagcctccctccgtagttcttcagacagtctgtctattaggtctaatcacttgaatctatatgtatacatatatcccttctctcttgagcctcccttccatttccccaccctccaatcccacccgtctatgtcatcacagaatgctgagctgaacaccctgtgttatacagcaacttctcactagctatctatttcacacatagtaaggtatatatgtcaatcctactctcccaatttgtttcaccctcccctttccccactgtgtccacatatctattctctgcatctgcatctctattcatgtcttgcaaataagttcttgtgtaccagttttccagattgtatatatatgtgtgttaatgtatgatatttgtttatctctttctgactttcttcactctgtatgacactctctgttcacatctaaggagatgctttccctcaaatccttctcacagtgaggcccctgagttaggatgctgaaggcctgaaccatgaaatttggataaagaactggtaggttttaagttagcttaggaggtagaatggacaaagtcatggctactttcacttgatgaatgaaaggccaggctggctaagtaatttgtggggcccagtgctaaatagaatgacaggcttctttgtttacaaatgatgaagttctaaaggtgagactgaagcatttgatcagatgtgaggcccttcaatgaacaaggaccagtgtacctgcacagatcacatactcctgaagctagccctgaggaaggaagggagaacgtggagaggagggttattttttgcacacggggtgagttgtgatagttgtttatgacactttgatcagatgatgtccactgggcatatctgcctataaaataatctgtttttattttcttcattacctatctgctccctcttaggtccaacaatccacattccctagaaacttttatattttaggatggaacaaaattttaaaccaaaagaataattgaatctgcttaaaagtaaaaaaagagaaagctttgtctccacctggattataaggtatattgtgctaaacaccgggaaggaaagaatccagttgactatttaagtgcactgaaaatagtgactgatttccaagctgaatcctggagacttgaaagcaataataatcttccaaaggtaccttatttattgaccttcccacctcagagatttttatttattttttactttatattccttgtggttgacgtccttttagtaagccatttatttccctaacagtcttaatggtgtttgtttctggaattacatgaaagtcaattatgagggctacaatttaaaaccattccacgccacccagcttcctagtttttgacatgggtctttgtggaaaaaaaggtgactgatttttagctattgtgttcagtctgttgaaagatgacacggatgatggtgctgctgactgctctcccatgactcatagatggagttgcctagtaactaacccaaaataacatagctgatgcacatcaaacctgagaagcatgggctgctgtgacacctttacaaagg

SEQ ID NO: 63082 - DNA, 1225 bp, Bovine  19866880781892
ttttttattactttttccctttctgaaggcattcactggaggcctgtgagaaggtaaacaagtaaagcttaatctactactgtattccatagtacagcgtgcatccagcaatctcagtcagtccatcacttgctgaccaaaagcagcaggtcagagcatttctcactccagctcccttagaagaatcaaaaaacctcattttttatggcagcagaaaattggtgaaccctgcaggtgcccatcctcatcattaaggtaatagcatgaagacaaatttgatagccctgcagttggcacaaacgggaacgacagaggatgctttggtggttttgtctgagttgttagaattcatggggaggttaacaaaggatgccatcattggaacacaagcaagtgaagttctctgtcaacacacatgaaaaatcggccttcctgaacactgctgcccttgtgctgaattttgtgacaagttctaacagcttcatgccttttctaatttctctgtttgctttcagaaatgtcatttataaaaattaatctagatcagaaagggtgatgaagagtacttttgagggacaaacattttaaccttaagctttggccaggattggagtagagaaggcaagcaagaaacttgttataaaggagaaagaaagcaagcaaatatgcctactgctattcatttgtagtatatcaatttaacaagacctttacaccatgggcctgtgtgcttcctcagtcacttcagttgtgtccaactctttgtgaccccatgggtcatagcctgccagggccccacctgtccatgagatttcccaggcaagaatactggagtggggtgccatgccctcctccaaaggatctttccaacccagggatcgagcctcatctctatgtctcctctatagcaggcagattgtttattgctgagccaccagagaaaccaagatgaagggcacagcctaccttttcaaatttcctaaaaattaagaaagaaaaatgaggaaaacagacaattggagagatataatttgcgctgttttgattttgcatttgtgctatgttagcaagtatagttacacccaatgattagacaggagccctctgaattgcccttcatgatttctgatctttccctgaagctttggtcagacacaagtccctcgggtcattttttcctctcatcaggtgttaccaacatattaggaaaagagtcttgttagat

SEQ ID NO: 63083 - DNA, 2454 bp, Bovine  19866880846733
tacaataaaacaagtggacaattattgattgttatttattggtgagtttattctgatatgcctaagtgtgttagttgctaggtcatgtctgactccttgcgaccccatggactgtagtatgcctaaaaatctgtttttcaaagtattgcatattaaatcactttttcttcatgtatctcaaatatgcataattgctgaaagcagctaagtcatctggatgcattgtacacgtaatattagttgaaaacaatagtacttgctaagataattaatatagtgcataattatatggcattgaaactgcaaatagaaagcagattgcaggtgtgactttcctacgttgttttcttgttgctattctggctcttttaagattgctctctaaatagaatttttaatgttgcaataaaatttgaaaggctgagatcacattttgttattttttttaagtgtcaagtgatttaaaatttttgaaaatatattatctttcgtgctattacgtttatatgctatattgtcttatttttaaatagtttaactgcatttagtattttatttcattattctcacactttattatagtactaaatattgagtccagattacttttatttgacatttactgtctactgaatagtaaattgcatttataatcagaggcatgtatccaggtgcttgcttattttttattatgtctttatgtgtcaaggaggaataataatacataaatctttgattaataaaacccatagtttccattagacctttagaggaaaggaaaatctaagggttctttaagttctgcttaaagttataccgaaagagtgctagaataagcaataaacttcagtcacatgaatgtcacactttcaggatttgattcctatctagcttgcactaagtagttctttataccactgacatttttgtactactcatgcaaattccatatctgtttttagaaatatgatgagcagtggatttgaaacatgattctgttgtgagtccctctgctgcagttttctttcatcctacaaataatttacttttctcctacatatatttctacatatatttatatggggacttttattcaaactctgttcttctttctggtgtctgctaaatggaaattcctttccttgtttctttaccttttagctggcctgaagttgacccttttctctctttcttttgatcctaacagtagatgaaaactttgctcaagccatttatttaggtatcttttatttcaagtttcatagaaaattcagaattgaccctatggcaaagcctatttttaggagaagactcttgagagtcccttggactgcaaggagagccaaccagtccattctgaaggagatcagccctgggatttctttggaaggaatgatgctaaagctgaaactccagtactttgaacacctcatgcgaagagttgactcattggaaaagactctgatgctgggagggattgggggcaggaggagaaggggacgacagaggatgagatgactggatggcatcactgactcgatggacatgagtccgagtgaactccgggagttggtgatggacagggaggcctggtgtgctgtgattcatggggtcgcaaagagtcagacacgactgagcgactgaactgcactaaactgaagactacctgtaaagatggattcattaaaataacagttttccctaagaaaagagtatatattttaattgaaaagactgggagataaatttcatcttgatcttggaaaaacagcaacagggtctttgttccctgcccaggaattgaatctgggtaacctgaatgaaaactcggaatcttggccactagaccacgacgggctagaggctggaagccctggctcttcttgccctgtttgaaaaacgaatttctcaaggaggcaaaaactgtaaaaacaggcacaaagtttattactagagacacagcacaacatggggggagctcacagagaaagactgtttatttaggacagaagcaaggcagaaataacaccacaggagagaaagggtgtgggcatctttcctaatgaggagaagtgtagtaaagaagcagttagatcattgatacagggcagttcttctgggtctttgcttacctttggccagttatctgcattctcttctcacatctgacctgctctaggacatgccccaacatgaaaaagtgaaagtgaaaatgttagtcactcagttgtgtctgactctttgtgatcccatggactgtaacctaccaggctcctctgtcccacaggattctccaggcaagaatactggagtgggttgccattcctttctccagggatcttcccaactcagggatcttcccaactcagggatcaaacccgggtctcccacattgcaggaagattcttaggacactccccaacatgagtgcgtgtctttttgccaacatggatt

SEQ ID NO: 63084 - DNA, 1698 bp, Bovine  19866880870092
caaaataatgaatgaaggagtggtaactagattttatagaacatcttatgtatcctacctcacttaatactcagcacaaaccagtgaagctttcattgggcttttcccagtgtatatttgagagaatcagagtgctgggaattgatctcagggctactcccctgtccaacatccatatgctttcaacaaggaaactgaggagaaagttgtttcttgtgtttgtagtttcctaattaggtgttctcatatattagggggagccaacctggtatcatgtggaggatctgggtatgtcagattctgggatacatttaagaagcaacttttggctgaatttttggctcatagtggagttggttctattattatgtctactgataaatcaaatcgatacctcgccacaggagatctggagggctggttaaaaatctggaatatagaggtatgttgaaaaaattttcacattatcattataatttttgattgtcttttgtttcagataattatgaatcaggtcttgtctgtttctagataaaggaagaaacattcagtagtctaaagaaaacttatgtattgatcagagacttctttaatttatggagaaaaacagatttttctcaatattgaaaatcctctattaatatagtcaggtcagtctcccaatttaggaatgcagtattgttagtacggttctacagcattgtttgagaataaatagttaagatacgcctcattttaaatgagatagtaaacatgatctaagtagtgtactgccttttatctaacattgttgtcatctgaatttgggattttttgtgtcactgattacctgctcaattttctaataatgctgtaaaattgtataatatgtgactacctatacatgataaagttcatccactttatctaatagctgactttactgcttatatttttccatccttccattccccgtccttcctttctgtctacttctcaagttagtcaaatcagttagaaacattttcttgaatgtgaataccatttttctaacctctgttatcatgagctcttcttttgcatttgtatcacagattgctattcccaaatgcacctttgttcaatttctgtatcagactttttttttttaaagtggtatatcactgtagtcatttcatatttggacattttagaattctggcatgtcttttcattcaggagtactgtcttaattccagcaagaacaaactcacacaggccccagctctgataagatccgtccggcctcacgaagactggataagctccttagagatgtgtgaggcgggcggccgctcgctggttctctctgcctctgcagactgcagcatttgtgcgactgatgtctgtggtgttcctgtccagatctttggtcaggtagaaatattgcttctttactattctaatatttacttgacatttagtatgaacttggcttggtttccatttgaatcccatcatctagtaaagttcattagtcatgaaagaactgacttccatttctgcaactatagctccaggcatcccttattaaccatggcagttccatcaagtagaggacactggagacatggaaagatgggggacctaagcagcttaaaatatgtaaagatttctgagcaaaatttctcctccaaaataagtggatctcttcagtttcaaaattcagtagaaatacag

SEQ ID NO: 63085 - DNA, 1105 bp, Bovine  19866881041625
tcttccacttacgaagttcaaactgcattctagtttatgtacattccattctctgcttttaaatgaaacattctaaaatattttactatactcagaagccagagacagtttagaaattaataaaaaatatggtaattttcaaatttttaatttcaaattaatatttcaacttaaaattaatgtcataccacagtaaaacatctaaaatgagtggtccttttgaagtacttaaaaaagaagaaccaaacaagaagctgcttacttgattgtctgcagaaacctcactctgtcgttgatctcatctgggatcttgctgagaatttgtttaagtgctcgtgccttttcatttaggtcctggaattctggctctggtcgttcaatcatatactctgatgaaataaatacgtagtaaaaaacattatgcaacttgctgccaaattcaagtctaagaatttccaatgtgttggtcaaggaggtgagaggggagataaaaggctagaaaactaggaagaacaaggttgcaaagcagaattaattacagtttaactcagttcagtagttgtattagggtccctccaagtaaaatatcagaagataaaaaaatgaacatcttcaatatgggataaatggaaattccatgaaatcttagaaataaataaaattttaaaggaaggcttaatcaaatttttcaggcctctcaagttacatttcacaaggaacatttggtaagtaatgacatttgtaacaaatacaatggcaatatatatctgccaatggtgaatatgagtttaattaaagaaacctctacattcaacatacaacggctcattacatcaaaactccaaacctactaaagtcttcagcacattcttgaaatctcacttaaaacaaaaataccaccatagaaagtccaacataaggcttggtatcaaaaaacagcaactttggtaaggaagtttagtcagatgcagcaaaggcaaaaacttcacaaccagattcaccgtaggcttggaaacattacaactctaccaactcatcaatacaacctggcctgacaggctgcaggtgctcaatccaaaataataatgaggactttctcataatt

SEQ ID NO: 63086 - DNA, 899 bp, Bovine  19866881062601
tgtttgagaacccacagggaacaacttggaagctaaagagagattgtgaaagatgtttcaacttgaaagggaaagaaagaaaatacaaaagaacactgaaaaacccagtaggtaagattaaaaagtcacctgggggttacaaactgtttgaaaactgtcccaagttccaaaataatagtttagagtgttgaaagtaagtctggcaaaatgcctctcatcctacaatccccaaataaccttccaaacactgtaattatggagatttcaagaatgtatgtaaaatgcagggcaaagacttaaggtagactctgtaatgataatgtggaggggggactgtattggtgattgagtttttttaagattttttgagattttttttaagagttttttttaagtgccatttataatagtaatttttaaattcaatacctcctatgaaaaaggagatgaacaattttaaatgaaaatgataaaaacaggcaatattaagtgaaatagctggatttataaatcatcataagaataggttgcccagggattgtgatttcatcatttgaaatttgaacaagaggggccgcatctagaaatattaataacatggacacctgcctgaataacatggattcttctcaactataatccaccttttactggttatgcaaagctagataaattatttaaactcttcttctatgccatggagcctatgccagagaccctttatatagtaaataggggcaataataatccctatgtcatagaggtatttagtggaataataatatcatcaataaagaaaatgtattaaactttgattaggtgacaggctctgtgctaagggcttcacatgggttatttcacctaatgttcacgacaacattatggggagggtaacaaat

SEQ ID NO: 63087 - DNA, 846 bp, Bovine  19866881108066
cacacacacacacaggcgcacacacacacacacacacgcaaaaccgtatctgatgaccagtcctttcctaatctaattcagtctctgtgagtttatccagttgatacaacagaacgtcactgggacatgaggtgtgacatattcattacccaaataaattagtctaaggaaaaacctttagtatctaaggaaactaaaataaaatgtgagaggcaattgtcaagacattttgcttaagcataaaatattcatctgctctgctaaacttccataaaatacaatataattccatctaatgcttcacacaggtttctaaagcaagaaataatttaagatttccaggtggcataatatttaatacaagctctagactaagcctgagcagcctatcaagtgaacacgagttcccattttcctaccaaggagtacccaaggttcactcaaaggcaatttggcgaggtttattggcaaaaaataaactagataaaaatgagagtcctgttccccaccatcagtaattcagaagcgctgatgtagcataaggaaaaggaacagccagccatggagaatttgctaagccaagtaaatctcaaggttctttttagtcactttgacaagacaacggtatcactaatcccttgcgcttacagccaatcatctataattcagaagcaagctgcagcaggcccatgcacaaacaaccaggccacattattttagtttcaaacttgcactcacccgattttgattttagcagcctctgataatcagggtgaaggacatagtgagcattttctgtgctgttgttccacagaacaatttctccatcataactccctacaggag

SEQ ID NO: 63088 - DNA, 754 bp, Bovine  19866881139644
ttgaacagtttacgctgatatatgtcagacagagaccagaaaaatactgtatgatatcccctatgtgtagaatcacaaaagtcaaactcataaaaaacagtgagtaaggtggtgtttacgaggggtatagtggagtgggaggatgagtagtgttgtttaaggtacaagctcataacaagcggtgaataagccatggagatctaatgcacagtatagtcaatatagacaacaattgtgtattataaatatgaatttattttaaaaaatgaggactgcttaagtctataaaggctttttgataatccttgggaaaatttagagctggtgtcataggtctgtatatggccagtaatatgtgtgcataggtcatattagtcatttttcatagataaatttattcagtgtgaaataacactggttaatttgatgttcactgatttattccaaagccagattgcaatgaatcttaataaatttacaaaaggtcataactggaaagtgtcaatgtagtcttagctatttaaataggtaactagatgaaaattttagaatagggatatttccatgggagagtataaaataaccatttctgatccctgctgaagtttgcttctgtcttgagaacatttgtttaagaagcaagacctattccttgtgtacctaataccaggttttcagcaagtctctgaagggtttgcagtcttccctcgagagtttatcggttcaagctcagatgcgatccagactcctgcag

SEQ ID NO: 63089 - DNA, 1052 bp, Bovine  19866881160390
ctgtgacttattctggataatcttgttggaggctggatgggggcgagtatgtgtgaaattcacaaataaccctcaagactaactttgtgatggtttcagtatccaaaattgggctccacaaattttaggaaaaagcatgaaaaataacatttattttgaactcattccctacctttgagataacctttttatcctaaaaacaatggatatgttcttttggactaacaagacatgaacaattaacctctgagggagcagatgtgtaaaatgcatgtctgactctgtgaccccatgcactgtagcctgccaggctcctctggcaggcttttctgggatttcctaggcaagaatactgaagtaggttgccattttcttctccaggggatcttcccaacccagggatcgaacccatgtctcttgcatcttctgcattgctaggtggattcttcacccaactgtgccactgagaagccccaagagaacaaataattgactttgttcttttgttctcaatgttacaatttctacatgataagttttggtaaaatttattatcctctcattcatcctaaaagagattatttttaacacattgaaaatgttttttttttttgctcttgtcaggcaaactaattttactttctcagaattggtcatcatatctaaattctgaattagagataaggccgtcatcagaagaacacagtgactcagtagctgtcctcccaggacttcagatgtgaggtgtggaatggaactagtaacctgcttcaatgtcagaaagaacaaatctctcagactcttaaaatggcctaaaaattggctcgttctgcacttcaattttactcttggcaaaagtacaaacttagaaaaaaagttatattgaaaatgtacaaagtaagaaatacagtgtggattctgaaggtattttaaggataactgtcatttcaaatgaaagtttcaggttaggtttcaagggaaagtaggcagctaattagcttctcaccactgtgacacacaaggtcaaatatcagaatggctactttttatac

SEQ ID NO: 63090 - DNA, 1686 bp, Bovine  19866881341613
tgcctggagagtcccatggacagaggagcatggtgggctacaatccctagggtcgcatagagtggacaggacttagtacgcatgcacgcacactgtattctctctttgtaagaaaggacttagtatgcacacacgaacactgtattctctctttgtaaaggtcaatgtaggtcatcgacatatgaggaaataatgataactaacatctgtgatttgtgaagcacctgtgcttcctcagtcgcatttggtcgctaacagttgtgatgggaggggagagaccgagcctactgtaagcactacctttaccatccaggtaatcagtatgtggtttaaggatgtccctagagatatcaaggccacacagcttcttagtgagagaagcagggttgaacttaatgcacaactgtgactaacagtctagtggccttcctatcatgctatgacgtttcaaacttttcaggaaaagcttgtccgcatgaaatactgcaacagggcagagaatgggcaattgttctcttcgattctgatttgtgagaagtattatcaggatgtggggtaaatagctgagaagcagctattggagatatgcaacctttattaggatgtaatatctctgtggtttggttttaaagcaacttagtaagctgaactaatcaatatgatcaagtaacagtctatgaaattctatttgaaagcaaagctgttagattaaaaaatccaaagataaaatctgaaaatgtaagctgttggtaatcctctttatcattttgaagaaattcaaatcacaataaaagctgagaaatgaagggtttaaaaagaaaatatgaaaactgattctgcaaaatttcatttcatatcaagtcttaatagtcattaacaccctgagtatggaggttcacatgacagaccttgaactgtttcagcaatgagatggctctataatcaaacaacattgtttgtagtagaaagtggaatgcctattttaccattcttagtttaaataaacggacagaaaatcaccccaaataatgtcccatttggatcaccttaagggacccatagtttcattaattctgaactttgagagttccttagcaaacaggaacaaaagctgactatccaacaatagggaacagttaactatattatgatgtttccctttagtggcatattagctcatcatgaatttttattgacatggcaaaacacccatgatttaatattagttgtggaaaagacatgataccaattgaattcatctgtgagggctgccatgaaaaacaacagaaattaattttcttactgctttagagactagaagtccaagataaagatattggcactcggtttctcctgaggccattctcctgggctggcaaatggctacctcccaacatgggctttttcctacctatgcttgctcctgtgtcttcttctgcttttaaggacatggtcataggaccacatcctaagagcctcattttaccttaatcacctctttaaagactttgtctccaaataaggtcacatactgagatactggggtttgtgacttcagcatgtgaattttgaagggacataatttagtctattacaccaattatatgcagaaagattctcctctggctatatgtataggtatatgttagacaaaactaaaggaaatagacaaaaataacagaaatt

SEQ ID NO: 63091 - DNA, 1246 bp, Bovine  19866881351175
aatatataatgaatcagcaacatgaatgtctgttctttttcaactttatgtaattttatcattttaccattttaggagacagagaatggatcccagaccatagtgtaagtgcatatgctgataacacagttgccttaggtgttctgaagtttgcccagaaaccatcagcaaggagaacacagcaaaagactggtaagattgactgtaaggctgctgtgccatattgtagctcagtatgtttattagtttatctcttagtactttactaggcgcctgaagattaattttgtcagttatttaatttaaacttattcatttaaactgtcctggacttttcttccaaagccaaaaaaccaagaatagtcattactcctctcaaaaacataaattttacagtcttagctattttctgtcacaatgtactagagaatgacatttttaaaatgtagctcaggataaggcatatatattttgaacaacccttataaaatacacactgagtttcattacactttcaagaaacagtatatttatactagattttgtttcctcctctacttgattcaaattatgatcacacaaagccatgagattgctgtttgctgctgtggttaagacactgctggtttaaatctaatgcttaatatgttggccctgaaatcttgatttcagtctattaattctattttctagccaaaataattttgagattttctatacgataatttttgacatattgaatggtcattgcagtatttttctagtaagtgcatgcagagaactttaacatcattaaaatcagtagtgttactggttattgttatctgaaagtacctgataaagtaggtttgctttgtgctcaatttcatatgaagttgcagttgatgactaatgaattaagacaattcaacatgcacggtgagtatgacgacactgtgctgggtcctggggaaaagagttgcctgagtcatgttccttgatcttgggagctcatgattcaggagaaacatttgacagaggggactgtttgacttcatctgaaggccaacttcaagccagaaatttaattacgtatgatttgtccatatatgtaagatttatatttctctcttgccttaaatcctatgattaaaacaacttggccagcttagattctttccatatgcatttatgttgagaaactgtcagattttaataggttttttttttttttagggaaaatccattcatgtagataaattttttt

SEQ ID NO: 63092 - DNA, 901 bp, Bovine  19866881428431
agcacaggtacacacaaaagactaggtatagactttttaaagtggtagaagtttaacctgaaaactaaccacaccattacaaagaaggtgaaagccatggaaggctttgtaattgagaatgatttctaatgccatgattttacaggaaggaagctgtgtgaattgattaacttctacggtaatttgttggcgtgctcattatagtctcctgttttgactaatgaatacgtttagagcttcatctctgtgcaagctaaggcatccaggcagtttgactgtcttagaataattagagaattttgcattgtcagccagtgggatacttacctctcccggtgagcttcacagagtattttttcctatttcctcttccttccctcattagtgtctgttatggaattaagcccaactctccaacagatcactataaaacattttatagacatttataggactgatctgactgaactaaactattattaatttgctaattaggatggtaagaagacagatgttattcttatgtgagataatttaggggaatttatcatattagggcttaaagatgttttatctaatttactgaagggctaaaccaggaaagttaaatgtgtgataaacatacccccctcaacccttttgtgcctgtgatacacatttataatttataatgccgctcttttcctctgagcctgcaaatgacttcacaattctgcatacagcactggaaacagcaagagcttgggacctgacatgaaagatgaaccagacagctaattgttcctacaagactgtaagtccctcaggggtaggcaccgggtccaagtcaggactcgacacacaagagactcttaataaatggttttcggaagaatgatagagagatggataattaatgggt

SEQ ID NO: 63093 - DNA, 822 bp, Bovine  19866880452442
ctccggattcttgacgatagcaatactttgcccacagctcactctttctcaatgacagtgagaccagtgaaaaagaagacaaaatcttagttcactatgaacacggaataccagtaataaaagtgactgtggtaactgtgatgatagtggcagaaactgggaactgattctcggaaaggtctactgggcttgatttattttaagcagccaggagagatctagaatttggatgcagtgtttggatctatccttttatttttctccattgcccactgactttaaaaacctaagatcataccaaacttctattagcatgtccaccatgaatgcacaattaaataactcaaataaataatgggtagctaaagaatactttaaaggtagtaaaaagatagcacctcagtgatttcttagcataatgctaatctttcaaatgtgggtaaaatcccatttagtgggaaggtttggaatcttacataaaaatataacatgcattatatatttcttgaatataaaaaattcaagcgactgtatccttactgatattaatgtaacacaaataaaattataatgaacattttaacacaaaatgcagttcatttctagttaacatattgaaataactgatattcaaattctaactattatagcacacacatatgaatggagtttacgtatatacatatgcttcaaagtagaacttgctttggggctagtactttttattctaatgcacagtatttatgactaattttcagttggttttactaagaaatcaggagataaacttaaatttctgactcttggatcagtcagaaaata

SEQ ID NO: 63094 - DNA, 766 bp, Bovine  19866880617200
tagaagctggttctcttgattgagaataccttgcttggtaagagagaatgccttgcttggttaggatagctaacatcctatagaaatggggacacagaagatgtgttttctcttgtgactctcatcattggttccttcactttagttttgctacaaggctgaatctatggtaaattgtgtgttacactaggtgagaaaatgtacttgacttgtttgctaagccctgcttcctataaccgaaccattggcaggaattagagacctcagcatcactgcttttcaggttttaaggctggtcctagaaaattggactaaatgaattttttcccattgttttgtgttgtgttttagcattagaaatgaacccttaacactcctccatgtgaatgaaaaagtatgttctcacattatgttttaaaaggtcttattttctctctttgtagcttcagacatgaagtaactcgaaagtgtaattaccatgttgttgtttagtcactaagtggtctctgactcttttgcctccccgtgggctgtagccttccagactcctctgtccatgggacttcccagacaagaatcctggggagtgggttgccatttccttctccaggggatcttcttgacccagggatagaacccaagtctcctgcattagcaagctaattctttaccactgagccaccagaaaagctcataattatgataaagcttatctgtttcttaacatgtctttctgagaagtaccttaccacaaatcacttgtcat

SEQ ID NO: 63095 - DNA, 787 bp, Bovine  19866880787677
gctgaggcttaaattgcctggttctgagcagggactccgctgagtatttgtaagctagaagagttcattttgtgcttccttagggaaacttttttttttaaacttagcaggcctggtttgggtaatgaagaccagacaactgatgctaccaggtcaccagggtggtggaaaatcagactcaggagagaacactccagaatgaccagggaaaatgggttctgggaaagttctgttattgagaggagctagactctataagcctatcaatgtttagtttttaagttttcccagaattcatctttttatatggcttggcaagcaattattttatttttttcttatgaaattataatctgggacatcattttgaaaggcttgccagtagctattctttggtctgttctgcctccgcttgttttatttttaaccctctcttgattatttctaaaccccttaatcataaaagctcattttcttttattaggagggatttattcacaaggctaactcagacatacacagcatcttttaatatacattactgaatgctgacatggttctgcaagattcagaaatgctttctgataacaatgctcaaaatatatggaaaaataaagaagctcatacctaagctcataatttgaatcaatttagttttatatatactgaagaaattcccttgacaataacaacgaactcagcatccacgggactgacaacagtgacctcttactaggtaccaggtgacagattaagtgttaaagataaaacaagaaacatggtggct

SEQ ID NO: 63096 - DNA, 1905 bp, Bovine  19866880810063
ggtcttgaatatggcgtggacacagtgagagctgtgttcacatcaccaccaattaccacaggtgttatatgtgctttaatggattttactgattcctctccaagaatagatctcttacactcgacatttctgagcctctagtttttaaggttgctgttaacaggatgacaatggactttgtgtatctggttccacatgtaaagtcgtcactactgttctcaagagaaaagagctgaacaaatgaacatgtcttctcagatccatcagagaatgaggtcacaaattgcttcccccaaaaatggagagagcaacaggggacagagaatcacagcccccagggagaagctgcaggggccaggtgggcaggcgcattggaagggggctgacaaaaggcttggacgtgggcatggacgagcttaagacaaaactctggggccagtcatacagggtcccaggtttacttaagctctacctccaggaggcccccctagccaggattctcagaagttgtctgcagcttctggtggggtggggggaagaaaccacttccaactatgaccagtaatttgctctcttcaacaagggtcttttttcaaggaaaactatttgaccagggcctgacccacctggggaaaggtaaacaccaactccagccccccagcagctctgtccctcctaaataagacatgtgtgtgacggtcacagcccaggggcacaagctcacaggacgacagagacctactcatcagagggctagtgcgctcccctccccagcagccccactgcatccacgggcgcctgtacaacaggagatgacatgtatcggacccttttaatagcacacagctgcagccaacagtaaacacagcctaattcctggccacataaatacacagcctcacctctttacctcagctcctctcacctgaatcaccacacccagctttcaacaaaaaattacaaggcatgctaaggcaaaaaaacactgaacagacaaggcaagcatcagaatcagactcagatatagcagaggttttggagtgatcagaccaggaatttaaaacatctatgattagtaactccagtattcttgcctggagaattctacggacaaagaagcatggcaggttacagtccatggggtcgcaaagagtcagacacaaccgagtgactaacaattacttagcctggtggctcagatggtaacaaatctgcaatgtgggagactcaggttcgatccctggatcaggaagattccctggagaagggaatggcaacccactccaatattctttcctggagaattccatggacagagcagcttggcaggctacagacctgtagcctgtagtctgactctttgcaacctcatggtggcaactaatactttcacgattaatatgctaagggctataattaagtgaacatcatccaagagctgatgggcaatgtaagcaaagagacagaaattctaaaaaaatcgaggggaaatgttaaaaaccaaaaacagtacaacagaaatgaaaaatgtttttgatgggttcatcagcaaatggacacagacaagagaaaaaccaatgcgctcagagatatgtcagtaaaaagtctcaaaactgaaaaggaaattgggggtggggggaggaaaaaacaaacaaaaacggaacagaatattcaaaagcagaaaattacaaaaggtataaataataaatgtgcaatgggactaccagaaaaaggagagggaaaaaacacaggaagggacttccctggtggtccagtggttaggactctgcacttctactgtcggagggcccaggtttgatccctgatcgaggacctaagatcccaccagttgcatggcacagctaaaaaagaaagaaacacgagaaatacctgaagtgataatgg

SEQ ID NO: 63097 - DNA, 1296 bp, Bovine  19866880814938
cttttgatgtcattagctactctgaaggctgtgggcaactggtaagaggactatgcgtcaagtgcaaaggaagagtagctgctctaattgtgttaccaaagaattagatctggatctgttgcaaaacctggggcttgtctgttcccatctcacgtaattatttattggagggacagatgaatgcttgcttcacaggtgactatggtaataggatccttggccagcccaacagattcagattttatacacaaatctgtaaaatcttatttaatgtgtcctgatgtggcattttggccaatcacattttctttatactctgaatgatttcacacaggagagctacttcaaatcatatgtcaggcaaaacaacatcacttatgaatctcttctcccaagtcttgggcaagaacccattttcctcaagttcaggcctttggagtatttatttcaaattaagacttgaataaagaagtgaaatagtatcaatattgttttgttacttgccgtatctgtcttctgcagggatggccaggggtggtaaaagtgagtggtggagattggcaaagcaggaattgatcagtttcgttgggggttgggggagttgtgggctgaagtctgtgttgatgtggggtcaactcactggcctgagaagacagtgtgaagcagtccaggtgtctctcagtagggaagggaagaacgtctagacataaattataacacaccttttttttctcagaaaaaaatcattttacaattattccatgtgttcccacagctcagatgcctagacctcacccaataagctccaacagctgcctggaggaggcagtgaatcttcataattaccattgaatgtggggagtttttacccatttttaaagaagaaaatactagagaagagactttacaagtggtttgcatgagtgatgatgctatttaatcctccaaacacacctgcgatgtaaattgcattcttagcttcattttacatatgaggaaactgaggcttagagatgttacatcaattacctgaggtttcacaggtactcccttcagttttccctgaaagcctgtcctgctggatccttggttgatccagatggggaaatgaggctcagagaggttcagtgaattattcaagatcacacagtatgtagcagaactaggatcaagtttaggttaaatatttctaagttcaattctaatgcagtggtcttctgtttttctcattcttccaaacttgaagaacatcactttgcagagtggcctcaatggtggcacccacatcatttgaaa

SEQ ID NO: 63098 - DNA, 2043 bp, Bovine  19866881128770
tttcccttatggcctgaaatgcataccctatgctgtgaagtgtgagagctaccccttacctccataagcatcaaatccacatactcaaaactgtaagacaaaataattgaaggagtctaatccctggatgacagccctggatgctcattaattaattttaattcatgagaaaacaaacctattacttgcttatattacagtttattgtggtctctgttgcttaaaactgaataccatcctatctaatacatctcaaaggaaaagagctttgaaaaactgtgtttgttgtaacccatgtaataggaacaaatgatctgtaatcagatcttgaaatgaaaatgtaaatggtcaaataacagaccgaatggacattgctgtagagcaaattaatgagttctgagaggtgattgaggaattctgtatcacagtgaaacagcaaaagaaatggagactatcaacacagttgtattatttttctcaggtgaagtaataatgtaccacagtctggacggcttaaacaacaaaaatttatcctcagtgccggaaattagacttccaagatcaaattattgacaatgttactccttctaagggttatgaggaagaatctgttctgtgtctctctcctagcttctcttggtttcctggcaacctctggtaggggcaggcgtgtgtgttcagttgcgtccgactctttgtgacgccatagactgtagcccgtcaggctcctctgtctatggaattttccaggcaagaatactggagttgaggggaaaaaggatactggagtgcgtggccatttcctactccaggggatcttcctgacccagatattgaacccacacctgctgcatcccctgcatgagcaggcagattctttacaactgtgccatctaggaagccctttggtattccttggcttatagatgaatcacccaaatctctgccttcaaattcacatgatattcttcctatgtatgtatctgtgtccaaaattcccctttcttataagaacactagtcagatatgatctcaactttaattgtatctgcaataacactatttccaaacaaggtcgtattctgaagtactggggtttgagactttaacgtatgaatatggggagaggggccaaattcaatccatacagcaattaagacaaggagaaaagagaagagaagccctcatatccatgccatggaaattgtaaaaggtgagaagggacagaattaagaaatagaaatatctttttaaaataaaaaaggaagaaaatttccctgagccaaatgatatgtctatatgtagaaaaaatccattgagtaccaagcaggaggaaaaataaaaagaccaactccttgtcaaattgtaataaaatctgacaataagaacaatgatgtttttaagcatccaaaataaaaaataaagattacacttcaaaacgacaaaaattagattaacattacacttcatatcaacactgctggaagcaagaaaacaatggagcaatatgctcaacatctgaggaaaaaaaggtatttctgaggtacagaaaactataatacaagcgagagagcaaactagaaatggtaccaggtggccattaagtaacttgatccaactgcagtttcatggacagggcctgcttagttccagccaatcagagtagtcccatcatcttgctagggctgggcttcaaatgagtaggtgacatatttgagctgagacaccaagagaaatctgctgggcttctggaataaaatccctcctcactttcctgggattggatcccttccttccattggaagcaaacatggaaaatatcagccattgctctaccagtcacccacagccacaaaaagagccagatacaagacaaaaccagcaaccatggggctccttctcctggggttctgcaagagaattaagtcttactgaaaattttctcagttctcccaaggagtggtacttacctagggaacagtgctagagtgcatagaagataagctaatttattatattcaataaatgccttatgtcattaag

SEQ ID NO: 63099 - DNA, 1321 bp, Bovine  19866881151385
ggactctgtcttgtctcaacaaatgagaattgctgacctgggtgagtgtatttatatagttgctcctaaaattaggagaactgaaaatctcagattaatttttttcttgactttggtatgcaccataatttttccccttgaatgttagtttttctaattatgttccctttagcctaataaagggaacattccttccattgctccttggaagaaaagcaatgacaaacctagacagcatattaaaaagcagagacattactttgcctacaaaggtccatatagtcaaagctatggtttttctagtagtcacatatggatgtgagagctggacaataaaaagtactgagcactgaagaattgatgccttcaaactgtggtgttagagaagactcttgagagttccttggactgcagggagatcaaaccagtcaatcctaaaggaaatcagtcctgaatatttattgaagaactgttgctgaagctgaagctccaatactttggccacctgatgtgaagagctgactcattggaaaagaccctggtgctgggaaagattgaaggcagaaggagaaagggaagacagaggatgagatgattggactcaatggacataagtttgagcaagatggtgatggacagggaaggctggcatgctgcggtccatggggtggcaaagagtcagacacagccgagcaactgaagaacaaatagcctaatattgaaatgggcttgtttgtctaaacacaactttttaggctgagaaaaaggcaacccaagagctccctggatgatgagggaaagtcaaattgactgaagtttaaatttttttgtagagattccacatgtggaaaaatttataggcagatgatctaaacttgactgggcaatgggtgggaccatccaggagagaccacagaatatattggagaggtgacaaagatctcaagaaccaggtactgagctgatagctagggtgcaagggtgtgcccagactatggtccaacccagtcaattattttgaatgtcttgctagcaatgggttacccaggtggcgctagtggtgaagaatccgccctccaatgcaggggacacagaaaaagcggatttgattcctgggtcaaatcccctggaggaggaaatgacaacccattccagtacttgcctggaaaattctatggacagaggaggctggtgggctacaatccatgtggttgcaaacagttggacacaacttaatgactgagcacacatgctctagcagtgaagatggttggtgattagtttagtctctaaattcctacataagttctatgggctcatt

SEQ ID NO: 63100 - DNA, 519 bp, Bovine  19866881990742
tactggtatattactcacaaaaatgatgataaccacatttccctttttactttattttaaaagccaaaggaaaaaagaactaccaaaaaacatacagaattaacagccaggaacattataaaggaggtgtctggattaagcaaagagtactaaaaaagacatttgctaatttgaatatgctcttctgaaagtgtctacacaaagccagtttttctttaaaaatgtgctcaatacttccaagactaactggatccttgattttgcataagtttccaaaaccatcatcagtaccagatagacttaggccttgaacatcctcaccaggaccacagtttagccctgagaaaactttttctgacctatttttggttccctatcctaacttacttccagaccctctgtcttgtttctttggtcccatccttttcaatgctatctcatctcagtcctgatctacagcactttctcctaactatgatcctaattgtatattgtccatgactcattttttcattacct

SEQ ID NO: 63101 - DNA, 928 bp, Bovine  19866880462852
aaagagctaacactttcttagcaaaggtcacagaattatggatatctgtatttgcgtatcattgattgggtgacctctttatctagcatagcttttcttcacattctccagatcaacaaattcaccctcaatatttagaagtccacaagatttatggcaagaaaattagatgtgtcacattatcacctgctctaaggtcagtattgtgcaggatccttatttattaggcagaacagcctgctggttaaaaaaaaaaaaagaaaataaaactgcttaccatctctgcaaagtctgacatgaggcacgactgcttctttttttaaaaaagtactacagtaacaagaaggttttgtatgaagtgacctcttcatgttgtttgatgcagtagagccagaatgatgtttctagaaatctgttctctgggtcaaataatagcagaacacaattagtctagaaaaaattaatccaccttatgtgaaagtctcaaagctcgcaatagtgacacacatagtaactattgggaaaagggcaaaggaggtttacataaatccctgaaaaagtacatgtttaatttgaaaatcctggcataattttctctttgctctaggacttgatttacacatttttcttttcttaccatccctaggcaatgactgccatggaataattccctctgataataaatgcgcacgtgaacaaaactgcaggaaaccaagcaaagtctcctagttccattgttttctttcctttccctcagcccattaagacaaaatgaatattggctatatttaggagttaaaaacattgaaaataatgtttacactgagtcttaacccctaactgaaaattaaaataaaatgtgcaatttctttaattcttactatactataaaacaatacgaagcacaatttcaatccccaggaaaata

SEQ ID NO: 63102 - DNA, 1135 bp, Bovine  19866880547825
tttagagtgactctaaagtatatttccttgccgcaaggtatcatgattgaaatcacgtcaattcaaggggggataatgtaagctatgtctctgaattccagtgatcaaaggatatcatgaaacacattagttcctaaaaaacagactgagtgtgtattccatggcatgttatcatggaatttatgttgggcaattatgtattaaaactaatatgcgtttggggactgagtataggctaggaggaaagggagaatctagtcaggtgaacgatgaccttcagaagcacatgtaaaaattgtgatctctcttgtttttataggagtcacagctgaaagcaatgaaagagactgtgcaactctgcctctcaactgttttccgcgatcagcatcctctccatttgaatcccttcaggccgtatcgaactcagttatcagtcccaaccatgataactgacaccaggactgcatatgtaagcacaacggccaaggtactttcttgacttcaattcatattatcatcaaagtgaatccaagtaagatagcaaattcattgaaaaatcaggatgtaaacgggagatagtaacccagtttgtaaagtcttcatagtcacttggagaatgttggaaaacaaattttctgtataagagaacaaggtgtttcttaggcagaattattatcatcataattattttacaatattataagaaaatatcttgtattatattccagttttcaccaggggtttattatggaaaatactttcttctagggtataaccaccatccttacaaaagtggatacatttttcagaaatgaagcctgtagttctcaacactgtgactatacattagaatcacttgggatagtttttttttttattttttttttttaaagtcttaatacttgggactcacctcagacaaattcttcctggtttggctccagtcatcattaggttttaagagctccctaggggactaggagggcttccctgtggctcagcagcaaagaatccacctgtcaatgcaggagacgtgggttccatccctgggttaggacgatcccctggagaaggaaatagaagatagaaacccactccagtatgcttgcctggaaaatcccatggacagaggagc

SEQ ID NO: 63103 - DNA, 1532 bp, Bovine  19866880604774
gattaaagcactatacatacctgtaaagtagaaaaattgaactccaaatagatataaatgcaaatttcccaatctcagactaattatggttacataaattataaaatacaaaaatgtgtgcatcgtattgtttttagatctaaaaaatagctcatcattgccctcagctgaaaacatgccattgaatctgctaagtataattaaatttaaaatgagagcaaaaacacctgcagaagtattcaatcaaaaactagagtttgccatgtcttattgtggaaagtaccttctgtttaaaacttgactctacagaagcgactttatatgactgcttgggctctatgcatgtttaaatatttcttaaaatccttgaaaagatgatgtgtgcccttcaaagatgagagcttgcaagtgatgagatatatgtgctcgtaataaggaaattcatcttatacagtgattaatataaaatggaaatattctgtttcatcaactcttacataatgcaacttttcactttcaaaccttttgatcccaggatgcagcttgcaaaagatgaaaactttttaaggtgttgtttcttctaattctagaaagttattggcaggtcagcatcttagttaaaattctgattgtaggacaggtgatgcacagagtcatagaacctcttgttttgaaagaataaatgagctagctgtcaataaccaaatttgatgtatgtattgaattaaactttaatatgcttttattatcagaagactgcaattttcaaagccagtgcaatcctttatcaggcaatataagacattatgattcaaggaataatttatagctagagcagtaactaggcaagataaatttgctgtgagaccattaggaaaatttagttaattcactcataattacttctgaggatatttgtgccctgacctactcaattaaggcttgaacacctgccactttttccttgctattctgctgagaatccctggccaataaaatcatttcattgtaggaacatggctaggtgactagagtgattaaaagcgtatttcttacctcaactttgtgagaaattcttcttaaagttttttcaaaattgtttttccttattgttcaggccaaagctgtaagaatatgaattatttatttctaaattagtagatttcctaggtgcattgacatataaataatatttgctttaaaattttatgtttatacactaacaataatcaggatatataaaagggatcaaagataatgtatcagatggagtacgtgagcaccctgtgtattatgtatgcatgaactgaagcttgctgaatatttactatggtggacaattcttaatactagctaggctctcaagtggacaataagatgctattgcatgtttagtaagcagggtgttttatataatacatttgatttatttccttttattggcatcatttgaggattttcagtgctgagcagaatgggctggggcacgtggagtgcaatatcatcacccttattgtctccaaccagagtag

SEQ ID NO: 63104 - DNA, 1121 bp, Bovine  19866880807602
aggttgagcatctgctgggaattagcctagaccttttttctacacacctgttctgtagaagaatattgataatgaaagtgcctactagcttgtcctatgtaactaacaaaatccaagcctgtaatattccctgcccatatcattacaaaaggcagattctggtctgtgagatggcactaaagaaaacaaataaggtaaagtttgatgaaattctgtgggtagagttgtatggaatcgtaagccctctgggccagtccctctcactgggctttagtttccccatctgtaatgaggggaatggaactgatctctaaataaatttcaattcttatgtgtcagttatgttgactggggtatagtgttctttgtattttattttttgttttaaaatcatattcaatgcctagagggaaaaagacaaaagaaagaaaaatattagcaactgttttagaaacatggtatcaaagcctttgtattgctatgtttaaaaatactatctcagatagagctgagatgaatgttattaaaaatattcttttgactagaatagaggagacacaatttatttttaaatacgatttgtgtgtgtatgtgtgcatgttcatatcacaccaactccaggcatagactggacagtttaaaacacaactggagttaaaaatgtgtcaacctgtaggctgatcgccctaaagtttgtaacagtagcctcaaacgggtccttagtgctgaccagcagtcaaaatatattttcactcttctagaagactatttcgtattttattccttcactttaaattctgtcttccaacaccttctccccagtgctcactctcagctgatggttttgcttcctgttccctgagaagactgaagaaaacttccacagctcccatccaccccctggcatctgtacccatgtattctgacgtgctgcctgatactcaagacaaactaactgcattcccaccaaagcctatctcctttacttatgcaatagtttccattactgtcacctacttcagaccaataactttcccatgctctccttactgagtcaaagccagcctctctccacaccccacctcacccctagtgataactcccatcgccgtacaagcata

SEQ ID NO: 63105 - DNA, 1312 bp, Bovine  19866881113402
ctagactaaggcaagaatatcttaccagttctattcaacattgtactagatgctacaggaaaagcaacaaagtacgaaaaataaaagttatacatattaaaaaggaaggaataaaagtccttctgttctcagatggcatggtgttttatataaaaaatcatatggaataaaaaataaatagcttttagaactagcgagtttaccatgtttagtatatttataaaacagtaaaacaaataaaatagacataacataccaggaatttaaagattcaatattatcaagatgaaaagttttctcaagttaattctagattccactcaacctcattcaaaattctcatagtttttttttaaaatagaaactgataatcaaatcataaaatttatttggaaattcaaatggtctagaatagattaaagtgttttgaaaaagaaaatagatgggcatcttatactacataatttctgtgcctagtacatagaaggtgcaccatacatatttttaactaaataacatgttcccctacatgtaacgaagtcttaccataatcaaatgtcacattaacctttggcaggaaaaaatgaattatgaagatagcaaatgataacatcaggtgaagtaaaaaataaaataactaacagatcttaagttctattgagtttgatgtggacatatcatcaggtgtcagatgtctttgccatttgcagattaaaagcaaattttcccatagttgaaaatttcaactcatcactataccttttcacagctgctatcatgttatttctcttgtgaagtgtttaaaatggcagaatatataagcacttgagccatacagtcattaaagatattaagacaaaaataaatcattccatactgaaacctctaagcctgaaaaatctgtgacagataaaacagtgagtaaccttaggagaaatttattgctttacatactgaaaactaaacctaactgcctcataaataagtaagaaaaatatgtaagtgataatctgaggcctaaattaaagttgttaaactgatgatgctgaaatatacaggtgtccatatgagcttagttttgagaaacacaatttctccacttttattttatttagcaagattttcactgtgcctatctgctacaagtgtgataatttcagccagcagattattgcatataattttactaatgatttagaaattctccatgtagctaaaaagatatacttattgctgatctcagcctaccaaggttcccaatgaggcaaagtgctaggacttctagaaggggtcaacaataggctaaaaagta

SEQ ID NO: 63106 - DNA, 1181 bp, Bovine  19866881343024
aaataaagtctttaatgaagaaatagaaatctatgcctctaataacatttggttgggaatttagcacagaaggaagtcaatgaacaaaaccatcacatggcaattaattttgtacaaaatggtaatggtccaattagttaaatgaagaaaccattttgaaattctgtcatgatttaaaaatcaaggagttacttattaaacccttgctgggtgacaggctgctgcttgcagaaaccaagtagtttcagacataacattacatcgtgaatcatcaatcatcattaaaaaacacacatatacaaatattttcatggttaaaagaactgaacagagatattgaagcctagacactttcattttttagggctgcatggtggagaaagaaaggaatattaatattttaaatatctaccttgaactaaatgatatactaaattctttaaatatcctatttttttatatgttgaatatttgaaagctttaatggaaggagaatctatatcaaacacacttctaattaaacatataattttttaatttataaatattatataatttgtaaggattatatgataatttatagcctgaaacattaaaagtttatattttcttctaaaatgttggttaactgctttgggtatcagctaaaacattatctttctagagagacttcatttctggcagttgatttggaagaagaagaaaaggaatgaacatctaaatgtcagaaggtcctaaaattctgatgtatgatattaacccaaataatcattcacaaaaattaaactataataggctatatgctgctgctatgctcagttgtgtccaactcgttgccacaccatgaactatagacttgcaggctcctttgtctgtggaattttccaggcaagaacactgaagtgggttgccatttcttactccgataggctatacagaataaacttattttttctaatttatctttttcactgcattgagttgaaaattcagttaaaaaaaaaaaaaaatagtggatatttaagctccatttccaaatattacatttatatagttctaatgtgcatggattcatttgggggttttttttttctatattgaaataaaaatggctatctctgagttctctggcaataaaatatctccaaagaaaaacacaatataaaattcaaatatcattt

SEQ ID NO: 63107 - DNA, 2810 bp, Bovine  19866880153279
ttcacccagactcacgtccatctagtcagtgatgccatccagccatctcatcctctgtcatccccttctcctcctgcccccaatccctcccaacatcagagttttttccaatgagtcaactcttcccatgaggtagtcaaagtactggagtttcagctttagcatcattccttccaaagaacacccagggctgatctcctttagaatggactggttggatctccttgcagtccaagggactctcaagtcttctccaacaccacagttcaaaagcatcaattcttcagcgctcagccttcttcacagtccaactctcacatccatacatgaccacaggaaaaaccataggccttgactagacgaacctttgttggcaaagtaatgtctctgcttttgaatatgctatctaggttggtcataactttccttccaaggagtaagcgtctttttatttcatggctgcagtcaccatttgtagtgattttggagcccagaaaaataaagtctgacactgtttccactgtttccccatctatttcccatgaagtggtgggaccggatgccatgatctttgttgtttttttttttatctttgttttctgaatgttgagctctaagccaactttttcactctccactttcactttcatcaagaggctttttagtttcttcttcactttctgccataagggtggtacaggcactcaatttaaaacactttaaatccacacatttcattccacctccgctactgccaccctagtcctaaataacaacagctctttcccagagccactgcaatggcttctttttttcaatagactgatctctaggtgctcattctagctcttccctaatctactctccacacagcagcaagcggcactttctaaacataaatcagttcatgtcaactctgccatttatgatcttccattagcttttcatttcagtcagaataaaatccaaactccttaatatgacctacagatctttgcattcacgtcagtctccccacagagaaggcgatgggaccccacttcaggactcttgcctggaaaatctcatggacagaggagcctggtaggctcctaagagtcagacacgcctgaacgacttcactttgacttttcactttcatgcattggagaaggaaatggcaacctatttccgtgttcttgcatggagaatcccagggatgggggagcctggtgggctgccgtctatggggtcgaacagagtaggacatgactgaagcaacttgcagcagcagcagcatgtccattgcattggtggtgccatccagccatctcatcctctgatgccctcttctccttctgccctcaatctttcccagcttcaaggacttttccaatgagtcagctgtttgcaatggaatattactcagccataaaataatgaaataatgccatttgtagcaacatgaatggacctagagattatcagactaagtgaaatgaagaaagtcagaaagataaatactttatctttgttatatcacttacacgtggaataaaaatgtggcacaaatgaacttatctatgaaacagaaacagaatcatggacatggagtacagactggtggttgccaaaggggaggggattgaaggaaggatggagtgggaggttgagattagcagacgtaagctcttgtatacagaatggataaacaaggttctactgtatagcacaggaaactatttcaatatcctatgataagctaaagtggaaaaagaacataaaaatttatctatatgtataactgaatcattttgctgtacagcagtaattaacacagcattgtaaatcacctatacttcaataaaaaaaaaagactatatgatgcttggatataataactgctcccagtaaacagcaagcgttcttgtcattattccctctccttccttgagactaagaccaatgacaaaaccatttctaagcctgctaatgcctcagatttacagttcaattttctgactctcttttttatctatcacttgagtcattcaaggtgaataagtgtaggagcctctacattcagagatttggtccaaacccagcttgcttgcgtgctgttttccgcatgctggccgtgggtatgtgacagtctccccaggactgatgttcctttgctgtacagtgaggacgtgagcctcttgcttacaggtgactgtgcaggacacgtgtggaggggcctgctctgctctccacgaagttgggtccaagcacaggacggcataccctcggcaagtagggccttggattccttcatgccttccagtatcaccccagcacctgctcagtgaacactggccgaatggatggaaccagtgatgaaagcaggaaggagaaataatacccaggacagttgggacaatggtaaagcctacaggaagtaactttgagtgcagccacaggaagtccaagaatggggacactgtgtccatcttctttatctttccacagttctgggagaggctgacatcagggacctgtcagccacctgactcaggccctcctggaggtgggtggagaggcccagagggaagttgagtcactggacaaagggtgtggagaccttgaaagactgtccttattttcttctactttacatggcatcactgacatgagtttgagtaagctccaggagttggtgatggacagggaagcctggcatgctgcagtccatgtggttgcaaagagctggacatgactgagcagctaagctgaactgactaactctacatgagaatcttaactttacatttccacttaatggagggaaa

SEQ ID NO: 63108 - DNA, 1284 bp, Bovine  19866880182842
cttctatgatgtactctgcatataagttaaataagcagggtgacaatatacagccttgatttggaaccagtctgttgttccatgtccagttcaaactgtcacttcctgacctgcatataggtttctcaagaggcaggtcaggtggtctggtattcccatctccttcagaattttccacagtttattgtgatccacacaatcaaaggctttgggatagtcaataaagcagaaatagatgtttttctggaactctcttgctttttccatgatccagcggatgttggcaatttgatctctggttcctctgcctattctaaaaccagcttgaacatctggaagttcatggttcacatatttctgaagcctggcttggagaattttgagcattactttactagcgtgtgagatgagtgtaattgtgcagtagtttaagcattctttggcattgcctttctttgggattggaatgaaaactgaccttttccagtcctgtggccactgctgagttttccaaatttgctgaaataccaagtgcagcactttcacaatatcatctttcagtatttgaaatagctcaactggaattccttaagactctacaaatcatttttagcttgtgagctgtataaaaatgggcaagatttggccttaatgcaatagtctatcaacaatataagctttcttatattgtgttgggttcataaaaataactaacgaaatattaaatttaccctttctttgaaagatatatttactggaaatataatttaatattgtgaaaaagtttttacaaaatttaacaaaggaattaggacttctagcacatcaacttttagttttattgaaatgcatgtcaccagttgtatcatatgaaataagtgtcagtgatcataaaatatatatatatatatttatacatatataaatacatatatatatacatatatatacggtgtaaaaaaaaaaaagtgctcaagtagctgcattaagcccttcaagaatatttctcatcaagtctgctgaaaaaaacctggtgcagctgtgaagagtggtatcactgtgtgtccccatgagaaagcagaagtctttaaaacaaagccacagagtggtacctacctccatgcctcccagtcggtctgcagacccttctcggtaggtgtttaggtatccatccaccagggtagttaggtcagacatcatttcatccaagagtaccaagcgaagagggagcaggtaggtagcttccaaagccaaaattttcagcaaagaaggtgaaagaggtcg

SEQ ID NO: 63109 - DNA, 4103 bp, Bovine  19866880354508
tatggataaggtgggtagatgcttatgagatttagaatgcagtaatttgcatcaagcttattatatctttttgctctgattggcaggaatatatggtttacaggaagcatacctacatgaggcttgatggctcatctaagatctcagagagacgggacatggttgctgattttcaaaccaggtaatgttaatagaaattacagaaattgtcatttgatttttcctctagttgagatggtgactttcaaagaaataccagtatgtctcagattgttaagcaatcatgatacagttcctgccattctaagaggtagctccatctgcttatgatggttcagatctgggtggctgtgagagagagaggaaatgaatagttggtgattttggtattctaaatattctttcttactgaatcagtgcctgtttctttgcgcaataaaagaaataatttctgagtatgaaccaggatccttcttatgtgaataatatgcatgtaaaaaaaaaaagtccacaaggctatattcataaatgttaacagtggctatctctgggtattgacttatagttgattttcattttgttttgcttacctgttttattttgtataagtttaaagaaaaataccttctttttttcctgctttgcccctaatattgtagtggtacagtgaactctgacaaattgcaatagtgtgcagtcttcatctggcagctctcagttacagtacctatcctacccgataataagcctgtgaaatttcaaataccgcctgctggatgctgatggcctacagagccataattatcctaagtgcaggttctcattgtaataagcagggtctagttactgctctctccaaggagaaagccaggctgtactagtgacaggtctcctgaactcaacccttaattttccttgagaactaaggaatagactaggtcttaatgttctgtaagtcagaacaattctgaatttttggcctttaattgtatagtctgttactatttagcttttgaattcttggtaagaaaattaagcatatagccacttgtatttaggttataatttttaaatttcttttatttcagttttaaaacatgttttacttcaacataaaacaaatctgtaattcaacatagcatgcatgccctctgagaatttttgctattgcacagtccttcgttatacagcgtgggtaagaggtgcatcctgatgtgttagtttacagtgcatactcagaccaataactcctggttgaaactgcttctgaattcaggtgcctgtttgaccaacaatggaggggaagaacttctttggacctgttttagtttgttacctagcagaagcttttggccggtttgtgaattgattatttaagtgagacgtgtaataagcaaagtagtgcttcctagcactgcatattgttttgtgcctcccctcaccccagaaaaagtttaccagctgatctttatcttttcttgattttgaaatcgaatgaaacacatttcactatgtccttacctagtccaacgttcagagctccaactgacgagactcttacatatgaaatctacagactgtttccctggggtgcctatattctctccaggcgtatgtgttagaagaaaagtaatcagtctttcacctactattgtttgtggttttttcccccactaatatgtttgatattgtacatttgagaatctcctttatagaaaagctttttttttttttcaagtaacagttgtggccattttgtattatagaaaatgcctattgaggaagatttgagattatttgataaagtaaaaatcacccacagtctcatcactgttaacattttggtttatccctctaggctctgatacatgtgtgtgattatatttacatgttgataccatattgtacagatgattatgtgtccttatttcttccacttagcagtatttcataaagatcttcatatatcatccaaaaagtcattatagtcattatttttaatgacctatattcccttacattggatatactatctttctgttgttaaaatgttgaatatctttgtttataaagctttgtcgtcatttaaattattgtcttagtatggattcaaacaagagagattactgagtgaaggaatatgagtgtttaagactgtacatattttcatattactttatagaaaattctgctgatgttgataaccaaccagagctgtaatgtgttgatctgtaaacaatttgggcttctgagttatagagctacagcttttcttctagctgatccagttccctaaactggggatttcatggggtggggggggcggggcggggggggcgggaaaaatcagtagatgtatctatttactacttttaaaatctcttacttgtgattacttgggcaatcccagtagtttagctttaaaagaagggtattttcaccattaaattatactagatatacttagtaaatactttgttttttaaactttcctggaaaaccttacttgagtgtccaaattctgcaactaagaattacttagggagcaatgaattttatttagactcaaagtgagtaacaatcatattaacacttggcatttaataaacaactttggcatcccaaagtcagctgcatgcccagcactatttcagtattttggtgcaaagtggccttaactaaagaagaatgagagtgagatttaggcaaaataaaaaaacagacttaagtctttttcccttcctacatgatgagctagactagacgattagaattaggattatggctaggaaataatctctctctcatgtatagaatctgaactgtatttatgctgatcagaagcctgtgagatagatccctccaaatgggatctcaacttataaaagttctcaacttataaatttgaaaggctaacccaatatagagaaaaagacaggtgtttttgaaaacaagaaagcatccttgccaaatattttctttgttattaatgaaaagacatcaaaagaaaaaattgtagttttcaactggaaagccctgtggctcaaaggtcagccagagtaaacaagaactcctataaaaagccatttacattcccttcatacaagattgatttatgaggggtccttccaggaaagagtctgactgagactaaagactgtttggccaggatgtcctgactgggcaacattcagaacatgtgaccagtacgtgatcctagactaagccattcacaagggcttttctctggggtgccttggccttttgcttctcttcctcctatcccatgacatttcccaaatggactcccgccccccaccaccattacctgattattcgggtgactggaaaatataagcaaaagtaagagcatagtgtggattttttccttcttggtgagactataaataaagctccagggtctttaattctagctcttttccactcatcatcaagtctttgccagtcagctacatgcccagcactatttcagtattttggtgcaaagtggccttaactaaagaagaatgagagtgagatttaaccatgtctttgctacatgatttcataggctgcttcacagaccaccctgaagcctggtctctaagacccattccaatagagaccctgagttgagattcctttttagcctcatagagggcacccaaactatcatgttgccttctgggattctattttcttccttttagtcagcttccaaaacattaatttacattatcaatgctagatttattaagtagaaaggaacttctcagcagtgcaatttagatgttttggtctacatatgatccaacagtgtgatccgggatggacactaatttctttgacttttaataatctaagactcccataatccttatttttccattagagtatgatgaaattacactgggcacagccaaacattgctgcttaccatctcatcactaaaaggtatcttcttgctacataggtaacatccccagaagagcatttttcaccagtcatgtctctaaattttgttactaatttatttttaactagattcctttctctagtgtttttttctgtatatagtccctgtttgtgaagaattgctacat

SEQ ID NO: 63110 - DNA, 2591 bp, Bovine  19866880430359
ctccctcctagagagacctcccctcactacccatctaaagtaggaccacctccactgtgggcctctgcgattgtttccttcatgtcttcatgtcacctccatttgttccgcattttatctgccacccatcgatgccaacccccctctaccctctctatgcttcaggaagcagcagcaggttctatcttggtgctgataagactaagtcacctgacacatggtacgtggggacacagtggaccaagaggacctagcagagcatggtgcagggtggacgttccacataaggaagcctcttccccttcccactggcccttggatgagaacgcagggcagtgtgtactatgtttcctaaaggccacgatcaaaaccactaaaggaaaaaaacccaggagatttgctgtgtgcaggggaaagtgccaattatatggaaacgtacccaatgtggtaccctcccccagtgctgtcttgtgtgtgtgtgagacagacagacagacagactggcagggggttgtttcccggtttatgtcaaagccctctattgttaacagcccatctgagagttgactaggcttggctgggtgggtctcgactgggatttgtcatgaggtgaaagtcagaaggcagctggggctgaagatcagaaggctcagctgggctggtcgttcacgacggctttgctcccatctcagctgggccagtcggaggcagtctgagactcttggccaccccatgtgacaagcttgggcttcccacacaatgtggaggtctcaaggcagttggatttcttagacagtggttggcttctccagaacacacatgccaagagctctaggtggaaacttcaaggcttcttataacttgggaggtcataaagcatcaattccgctgaattctactgatcacaaggtgagccagaggccattccagattcaagggcatgaataccggaaggcatgggtgggaaggcattggttggcagcagtgggagcaaaaggcatcttttgagaccagttaccacatttgctgtaaaactgtggtcttaatgtctgtgtgcctcagtcttctctcctatggaaggggataacagttcctatctcacagaacttttgcaaggagcaaatgagtttaaaaaatatggaaaacacttaacaatgcaccatgtgccagctattatcactactcacaagagtaaggagcaaatcttttctctgattaatctctgtgtcccaaggtctatggaatattttatgatcatgggttgctctctgtgtgaagagaagtacccaaatctccactaaaaaaaaaaaagttgtttttcatttaaacatctaggtaggtttaaagtttggatagaagtagccctttctcatgatcaagtatgcatttaaaatatctacagaaagtaaaaatatcttgccgggcttagtgaatgccattctgagtcacggtgatgacgtgctcactttaggggcagaggcagccacacgcgtagtgtggaatttcccgtggcaccggcggaaacggaaccccgaatgtgtttgtcagcaaacttccccaaaacaaaaagaaaccaggatttcctgctggaggcccaagaagcaagtgatgtccaggacctcacaacccaacctcagactggcctcagctctggccagaaaacaggatctgccaacaaattagcggtcggccccaggccctggggatgcacacttttctattgttgccaaattccaacaaagctcagagacaagtcattgagctcaagctctaaatatgaaaatggcttcatgatctgagcctgtgggcatacgttctactctacagaattctcttccatgtcatcctctaccgcatatccctcagtgttcccattcagcctccaggataaacccagccagcagacacacacactccaccatatgcacaactcacattactttaaaggccctgagctcagacatcttcccgttcttacaacctcttcctgctgtctggacgggaagaacaatagtaagggcagacagattatctgtctgctgactgtgcaccagacaggtactgtggtaagagtgccacatcacctcactttatcctcaccccatcctgaaaggccctgattttgctggttggtgaactcacctggagcccatatgatcaagaagagctacttcataaggtcagacatacggatcaatgaaatagaattgagagtccagaaataaacctccacatttatacccaacagattttcaataaggatgccaagacaattcagtgggggagagtattgtcttttcaacaaatggtgccaggacaactagatatgtacatgcaagaaaatcaagcttgaccccaacctcacaccatatacaaaagttaacttaaaatggaacagtcacttattgtaagcgctaaaattataaacctcttagaacaataacaggagtaagttttcatgagtttgggttagggcaaaagcacaagcagtaaaaacttaaataggtaaattagacttcattaaaattacaaacttgaatttctcagactataccataaagaaagtaaaacccaatccagaaaatagacaa

SEQ ID NO: 63111 - DNA, 1807 bp, Bovine  19866880463205
ccgctcctcccagggtcctgcaggcgttcctcagtgagtgtgggcaggaggcttgcttctggtcctggctccgtcaacaactaacctgatctctcacaagccaggtcacctttttggatttagtttgtgcctcagtaacttgatattgactgaatgctggctacgtgccacagttgtaggcatcaggatagaggtgagaacaaaatacacaagtccctacctgcttggagcctgaaaattctaaaggccccatatgggaaggaatagaagtagcttgccaggtcactacagatagtgggtcacagacacacctctgccttggccttatttggcctcggtggtctctctgttctcttctcccattcccatcatttctcctggactgttgaaaagagccagttgggttaggcagtagtcatgacatgctaagagtgactgtccctgtgaggcaggcactgactcacgtggctggcacagggatcagtagaaaggcagtgttctttctctctagggatagaacctccttgtcattcggatacctccataacatttcatattcttgatgccagttgactgtgactgattttattgtaaatggacttctgaagcactggctaagtctacttgcttccagtgctcacactgatgcttaatcatggctgctctttagaacagcctggaaggttttttgttgttgtttgtgttatttcagtggctggttcctactcccagagattctaattcagttgatctagagtgctgccttgccattggaagttttgtaaatctttgtagatgattctaaagggtggccaagatggaggcccttggagataggcagtgtggagtctggagggattgatctgctggcgctgcagtcaacatggcccttcctgaagctgctctttttcatgcaggcacggcagtgaccagcgagtgttccgcctagagtttgtctcaaaccaagagttcactgagagcgaattcatgaagtggaaagaagcggtgagtgagtagacagcacctccctagcagttgttcatgaagatattgacagagcctctttcccaaattctttattataaacaacccttttattgcgttttggtccagatgttctctgctggcatgcagttgcccactctagatgaaatcaataagaaggaattatctattaaagaagctcttaattataaattcaatgaccaggacattgaagaggtaagaaacctcgtatcccagagtctggagactcatcaagagccaagtgttagagaagatcatgcctgtcttttctttcctgtattttgacatttttggctctaccactattgcatgaggaagagggaattctgttattactaccttagaatttatagttcatcaggattttcttgtacactgtcacttgaaatcacagcctaacaaagtagattcagggctcagggatctctgttcttctgctaggcttggtccttcaagagtttcctttctccaagacattttggtaaaatggtttgatctctgttctcttggacagaggatagccttacagtacaaggcccttgggctgctgctgtttattggtgcatgttcctttgcgctagccaggaagactctctgggaccctggaagcagcatagtaccccttggaatgaactcgttctgggtgtggggcatggcactgccataggaagagcagccctcttttaactatctgcttacctccacaatgggctcacctgtcctgcctacaaaagtagtttaggaatacctcactggctggtgtctcctctctggtacagat

SEQ ID NO: 63112 - DNA, 1159 bp, Bovine  19866880500432
acggtttccctctcctgagtgggagtggagccaagctccaggctccgctcgcgaactgccgccgtctgctcccggcgcccgcaccaggcttggacgcgggcaagggaggggcgcgggacagcgagcttaggcaggggtaggaacgctgccctcctccgctttgctgctcctaattctggccggggagggtggagggaggtaaactgaggctgagagggtgggaccagtctgccgatctccgcccccggtagcctggatgttctggggccaggtttgaccctttgataacccaggctagggtatggtgcagtcattccccgtgcctgcccctccgggtcgtgtttctcccagtatagccgtcctgtcccccttgttttaatcaaggccaaatactttaaataactatccgcggtcaacgagaaggagttgctctagatccacgttatgcaagtgtccctgaagtggaggaagaggcgaagggcgccctcagcctctggtggctcggggcttgcccagaagggcggtgagagcagcggccgtgcgccggggcggccgggcctgcgggacctaggctccccccgcgctcggattggacgaggcgcgagagtcactgtaatggcttgcagtggctccgtgattcacttacccctgagacttacgttatcctcagggagacgtggtttgtgaaacaagaaggaaaaggaaaaagtgtcatagagcaggaacccaccccgacaccaggcagagggtgtggggagtccctctctcctccgtaggggtacccctgacccctgacatttctggtgtaaccctgttccctgaaaggaggcggtgccgcccgagggtttctgaggcggggaatgaggggcggtgagaggactcctccctccctacccccgaaaatccggagcagtaactgtgggcccaacgctccccccgttcaaatctctgagagctgagaggcgggcgctggaggcaggggagccacgagggcagcccccggcttcactcttcttgctaaaggcggaggaggacctgcggcccaggactgcttacacgtaggcagcccagctggggtcaagactccggggcccagtcgcagctgtgccctgggcgtcttcggccggcctctcccactctgggcctccccgtcaccccg

SEQ ID NO: 63113 - DNA, 663 bp, Bovine  19866880558100
tatgcaggcgttaggtggggcttagtgtcagatttgggtttacattcaatgattttaggactggttcaagggattgaagttttgctttggttggatgctgtgaagaagtggggggcaattccacaattggacatttaataacttttatctgaaaggtagaaggaaaggtgtggagctaaagctgtaattgatagataaaggaatagcggcagtcagtcctgaaagatgagaaagggtgatgatctgtcttctctatggctgggacagtgatcttgtttttatctgtctcagaaccactgcacagcggtcttgtttttgtttcgctccatcgtggccgcagtcaccttgtctgccgttggtgttctgagccctggtccgtgcttgtcaggagagcacactggtccgggagctggtgctggggcggctcccagctgagagctgtcagagcagcgctttcctcccaagcagctgcttccaaacctgtgggtctggagagggctcccgtgctccttcctttgtggcttggcttctgttttcattccctcatttccacagctcctcactcaccgctttgcaccgtcttcttccccacagtcgcctcttctctggcgcggctaatgccagatatccagacaccatcgccttgaccttcgatcctactaa

SEQ ID NO: 63114 - DNA, 1129 bp, Bovine  19866880570150
cgaggaagggatgcttgaccaagagaagaggagaagctctccaggaaaacagtgaaaactggaatctttggcatcaccattaaacgtccccgcttcacataggaattcagtgcttcaaactgctttaaatggctttgtttgtcctagagctgtgaatgaaggaaatacttagctgaagttgaatgacccttgaatagtctgactgagctcgagtgccggtgcatatctttagcacccaaaactagtagctgcctttgcgtgcctcagaccttgcctcttgcagatgcccgactcccggcactctttattgaagactacccgagatgattctaaaagcctgccttatggtaaccaacgtaagacctggtgtataaggcttcatgtgctgctctaatatatggtagctgtggtaacagtcatagagcttgtgattcatggataactaactctgaagcaaaatttgaagaccaaaagacatacgtattttgtggtggttgggggcaaagaaggaagtgacagagggcctttatgcagctcttacctcatatggcctgttgctttgaatcataactgttccttctatctaaagtagccttttcaccaaattctccacttatttttagatccaactctatatttactggagccacggggccttctcagactagccctaccaccttggaatcagtctctaattgttctttatgtatgtcttcatttcttaaggtcagggccatgttctttatttcctttacatcaccaggcttcatacagtgtaaggaatggtctaaatactaaatgaataaatggatgagaaaaattaaaagatctcaaatatagtgaaggtaaattccagaagaagagcaaatgttcaggaggaatttgtgacttctttagaaatcaaaattagaaataataaaatgttgaaaagaaatttaaaaaagaaatagagacacatcctatttaagtgtgaagggcattagagagaaagagaagtatatatatccagaaagtagtgctcattaaaagctttttaattcagaagagacctagttaaaaatatggttaaaatatggttaaaagccaaagtgagagccagtagagatggggatttaagttattagagaga

SEQ ID NO: 63115 - DNA, 725 bp, Bovine  19866880589084
agggctgcggtgggggcccacctcccagcctagctctgggccagactaccatctcagtagggggaggggcatgcccccaccctcatttcagaccccttaaggtgagacaggggcctctgtgggctgagatcacattcctagcctctctgctctggttcctgcttccagagtcggagggtagagttcagcttgtggttcccgggtcctgtgagggtccacaggaggccttcgtgggcgctggctccttccgcttccattggccggcctgctgggagcaggagctgagtattcacctgcaggtaatgcccgcttcagactgggtgccatctctgtcttcaccctcagcttctcctggcacccccggtggtcaggcagcctgggaggtgtggggtgacctcggcctcctgtccccttcctgctgcttcttggtcactcctagggcaatctgtgaggctctgctgggacgcaagggtagagggtcttaggtcctcgtcatcctccctgcaggatgccccccaagagcagctgaaggtgcccctgagggctctgccctctggccaagtggtgcaactcgtcttccctacatcccaggtaatggtgaccggaggaagaaagccagatgcacattgtgggcacagtccttgaggacctgtcctgctgtagcggctcctgtccttggcccccgccctggacaagggccaggccaggggagaggggtcttcagg

SEQ ID NO: 63116 - DNA, 1316 bp, Bovine  19866880625514
cccggataccaccaccagtggccataacagcaaccactgggatctagaagagaagacaacggggctcgaagaggccctagcgagaggccggtcaagccacaggaagaggtggtagcaatccaagggaccactcagctcacccacagctcaacctggtcaagatctaattggggctcctgggaccagttctagtcagacccaaagagggtctagtcggaagtgggcttgcaagggtcaggcctgtctggttttaagaactcagaaaaaatggacaggttccaggcttcatctccacacctaacccctaaggagtctgatgattacttttttgaagccccagggtcacctcaaaagtctcccacatagccactccgctccctctttcaggaagaggtcatttccctaggagcggccccagtctgacctgaacctccaaggactgccccaggccagcagggggccctgaggctgtacatctcactggtcagttacccagagcccagcctcaacacctggagcaggccgaggaccaagaacaatgagaaggcaggttagcccagtggggaagctcacaggctcctggtgactcaggccatgctctgcatttgatgcaatcaagctcctgacaacatcaaatgcaggaaggcagagcaggcttggcaccagtgctggtctggtgagggcacaaccggtgccagcatctgggacagccccctagtcccacgcagtccccagacctcatcttcccgcaggtctctgtccagatgcagggcctgctgcagggccttggccaccacctgcttcctcctgctcaggaaggcctgctcctcagcacagggcccacagcccagccgcacagccaggtccctgggtctggtgagaaggaagggaccatgaagcagctcctgggatcatcagagaacgaaactgggcctgccctgaaaagctcaccaccatccttctcacctctcttctccccaaccctcagcccacctctggtgtcctgactgaagggtgatgtgtagatgtgaggggagaaggcgaccccagaccctggtggggacatccttggggaagcagcgctgcagagccacagaccaggaaagcggtgggacccaacaccatcaatctgcttccacctcagcccctctccctcacccacccagaaacggctccagaggggggcagaaatgacgttccctcctcttcctggtgggagctggcctctcatcctgcggctggccagtgcaggtgactccgcccgtctcctgcagctcagctgaggcccgcccacaacggctgcccctcaaggggcg

SEQ ID NO: 63117 - DNA, 862 bp, Bovine  19866880628338
aggcaggtactgggccccagtctcccagtatgaaaatggacggagtcaagtgagcagtcccaggatgcccgggagatggaagctctatggggctttggctaagggcacgccccttaggaatggccccccgaaagccctcagtcaccagaccctcaaacactgaccactagggataggtagacaaaatgcccagacaggtggatacttcagtggtaacagcaagcaggattgctctgggattcagggctcacatgtggttctgagagtcagattccaggaaggatgagggtgttccaggcctctcttactttaataggggatgctgatgaggtaggtttcagggatggttaactcaaaggatgatattcaaagtgtgggaaggagaagcctgtggaagatgtggggatggctggaacaggtgacccccaagagagcaggaaagtgccagggggaggaaaagaaacgagaagcgaaggcagagaaatcctgaggccacaagagtgtggaccactatggagatgcaagaagagggagggctcttcaaaggggtggtgtctgaagaggcgggcaactgggggtgggcagggggcactgcagggttgggtttggggggaggggctggacagtcttcaggaagaaagagcagggctctgcctttgggtgtgtgaaagaccccgtcctcatggcctgtcatcaccccagtccagaccacagcggggaagctcagcacacactacctggtgcttcttaatgagcctgatggtggctgtctcatccccaccatagtcctggctgctcaccagcggccacttctcctccacccagtcctccagactctgatgcgtccaggaaacacggcaag

SEQ ID NO: 63118 - DNA, 862 bp, Bovine  19866880647072
gcgtttgagaaatgctgattttgcagtctctgactgccttgctgtgccttcatctatgtgttcagggacttggtgggccattaggcttctccaaggcctccaagaacattgcacttacagaaaagggcacaaataaccattggtaatggttttctccagctccttagagactgttttctatgtgtgtacaaacatactgttttaacagaaatgtgattaccatgcacatttcctacagcttgactttaaaaatatatatatatatatttatttatttgcctgcatcataccttatttgcatcatgtgggacttttcattgcagggtgtgggctctctagttggcacgtgggcttctctctagttgtagtgcataggctcctcagcatgtgggctctggtgctcgggcttagttgccccacagcctgtgggatcttagtttccctgcaagggatcaaacctgagtccctgcattggaaagcggattcttaaccactggaccaccagggacatcccatacatcttgatttttggtttgttggtcctaaattttaggacctctggattttagcttcagccttatccattccttgttactggtaggcctctgaccaatgttaattgtctatattcttcagggtttctccctggcttagtgattctaagtgtctttcaacctgtagctccttcagaaaagttagcatgtgatacactcaggatgccttgaagacagttcttttcagcacttgataataactgataataactgactcatatcctagtctgacttactgtgacaagtccttactcacatcctatgcccagaaatagcacatatggttccagccagtcggccagtccctg

SEQ ID NO: 63119 - DNA, 3065 bp, Bovine  19866880660014
aacagccttttccgttgcaaagtaaactcgtcctggaaacaaaacaaggactccctgcacatgtttaattgaagtagctgttattgttaactgaagtgactatttttgaaaatatatatttaatacttgagtgaccccttagacaactgatgtttattttgagatgatttgtactccctataattagtaacagcccttttttaagacactcacagcactatttaagcaactaaacccttggacttgctaaaaattgttatgcttcttatttaaagcaattcacttcattaaaccaaatttatttcattttattgtggtaagaacacttaccatgtgatctaccctcttaaatttttaggtgtacagtattgttaactacagacagggttgtatagcagttctctagaatgtactcatctttccttgtggttcagctggtaaagaatccgcctgcaatgcaggagacctgggttcgatccctaggttgggaagatcctctggagaagggaaaggctacagtattctggcctggagaattccatggactgtatatagtccatggggttgcatagagtcagacatgactgagtaactttcactttcgctaggtaataactgaagctttatgccctttgcttagcagtttcccctcaccccagcccctggcagtcaccagtccacgctatgattccaagtctgttttagacacctcatgtaagtgaaataatgcagtatttgtccttctgtgactggcttatttcacttagtatagtgttctcagggctcacccttgtcacacattattccagtgtatatatacaccgcatttgttctattcattcatctgccaatgggcttttaggctgtctccaaatctcagctacgtggattatgcagcagtaaacatgagagtgctaacatcttctttaagatctcagttttaaattcttttggatagatacccaggagtaggattgcaggatcatacggtagttttgtttttaattttggaggggaataaatggatcccctggagaaaggcatggcgacccactccagtattcttgtctggagaaccccatgggcagaggggttctctgagtccatggggtcccaaagagtgagacccaactaaagcgatttagcacaaactagatatagatttactgagtacctactctgctcagtggtggatcctgggtgaacagtggtgaacagatgaggggtgaagtttccctttggcgtttctgtcacataatcaccaaataaatatatcattatagagagtaagtgctccacaagaaaaaccactggtgctggagaacagatcacaggggaacggatttagggagtgtcaggtgtgctgcagtgggcttttggactccagacatgatgatgacagtctcatctagagcacgggctgtggcagagaacagacccgttcgcgaggcagggacatgctgctctgcttgggtgggggaggcctcctgagggcatgggtggttggagatgggagagagggaaggcactccaggcagaagggaagttctgggcaaagtcctgggcttggctggctggtcagggggccttgtccaccccaagaatggcactagcagcaagggcagagagaaccattatcttgcattctttcattgacacacgtcttgattaaaactcacgtaataggaaacttggctttgggaagtaactgaagcatttttttctgttgtgctattaaaaatagtcagtcaaatttgcttccttggggtgcctgccctgtgtttacctgagcctggggccactgtcctgacctcatatgccatttcctggtaaggcttgtcagcaaggacggagaccgtggtctccacagggctgtgacggaagccccctgattgggtggaaagggccccttccttcctgcctcctcctcgttcccagaatgtggaaccaggaatgccaagctgggatcttccacaggacaaagtctctttcccagctccaaaagccatatagctgtggggtccttttgcaaaaagagaagctgtacttttaaacaattgaactgattacacctctgttttgttccagactattacaagttccactggaacatcttacagaattgaaatgtctgtcatcggcacctctcctctaggggcctggttttagttcaggttccactacctgctggctgtgtaaccttgggcaggtgtctaaaatcattaagcctcagtttctacatctgtggacgtgctcagtcatgtccaactcttggaactcaatagtccccatagcctatcgccctccaggctcctctgtgcatggaattttccaggcaagaatactggagtgggttgccgtttcgtcctccaggagatctttctgacccagggatcaaacctgagtctcttgtatctccttcattggcaggcgattctttactaactgcaccacctgggaagctcctatatataatagactgataacatatttaaaatatattgagtaccgtggggacagttctattattatattgaattttatggtctccacacacactcatacatgtgcatgtatataccctacacccacaggcatgctcacctgggggtgtgtactcacatgcccagatctgtatgccctgggtcttatttcattctgtgcagctggaactgattctcataaactcagagtactctcgtccctggtctgtcacgatgaaagactttaagcacctcagccatgaggcaagacactgtgaaattcacgactctcaaagtttcagtggacaagccaaattttacattaacttttgtggttaagactgttggaactgttgctaaatccaactgcatacatggccagattcatgacatagttcccttgaacagctttcaacttcctggtccactcagcagtgtgtggagatgtatatcttcaaacaagttcagcaaccttggattttttttccttttttcccttctccctttctttcttctttgcagccttctgtccatcctttctttttctttcatatttatttttactttttaagtcagttttat

SEQ ID NO: 63120 - DNA, 1997 bp, Bovine  19866880669100
ctggcaattgtgtgtcctgctgccagcccccataatatgcacacaagtgaaggtaggcttcgttagagtcttctggcaccatgcaagtctcaagtgaaaatcataaagcagtatgataggccccacagagacatacttcgtgccacagtgtagcagagaacacactgttatctgtattttcccctcagataaagatgtgcccatttaacaaggggccatattttgttttccatgtcctattcagaattaaaaagagtacttacgctaaagttaggtcattacttagaaattaattttccgcttttgctcttaaagaacacatcaaactcagatatagagaaactgtctcacttaaaatgaaagggcacagtgcttatagaccaattgctaagattacaaggattctattttcacagatggaaatacagaaaaaaactgaaaacaatggttttccagagctttccacaagggtgctggcagctctcatgatttcaggaaatgatgatatagatactgcagttgcaaattaacatctagcggaggagtttttggaaacttcctgtttgggagattcttcatcaatagccattcaaagctctctaagcatttaatagagtacagtgtttaaaacttaaaaaaaaacacacatcactttttccaaaacaactctttatgtttagattcttctgtatattttaaactgcaaaatctgaaatgccctcaatttctatgaattagctggctcactagagttgtagtgagccagttaactcatataatacctaagcagaccattaccatgacaacagtttctcagagactgggacaggaaatgaaatggatgctgtaccctttctgccaattaccatttttaacatattatttaactggatatagtataaaatctgttccgcctccccgaaagatggctcaatggtatatttcctacagattctggtttttgtctttagtcttcaaagcaaaataagattaaaaagaaaaaaaaaaagattcatgtgtatgagacttgccctctaacccctgcaaaactgtacaagaaaggaggtccagtgagagcccacactggggagggaggtatgtgagaatgaattcacaaaagttttgagctaaatactattccttcttgaactcatcaccagtaaagcagggtaaagaacaatgagggttagtggcttctgtatcacaagcatcgtaagaaaaggatgatcagaaaagcacttacgtcaagcaagagattttaaaaggccctaactttgttcaaaatactcctaaagtgtcatctcatctgtgttcttagcctagtttttagtttcttgatgtttttgtatacccccccaaagccagtattatgagaatggtacttctttgaactctgtaacacaggattcaaatttaacattcactgctgggtaagaagagttttacaggtatactcagtgggaaaaaaaagagcttcccactgttaaaattcattcacatccacgagtggcaagaaagacgggaggattggattagactgctgaatataacttaggtaatatgtgatttaaagatagactatcaagaaaaagatgacaacgtgtagtaagtcaacattcattaacttcctcctcagaggaataagaagaaagcattcaccttgatctgatgataggaagctgtatttaggagacaggctgctggaacaatacctgccactatttataacataaaatatacgaaggcacagaagagaacaaaataaagggttttctgcaacaagaggataaaagtgaatatggaaaaaattaactaaaagttaatctgatagctccaaaggaattttattcagagttattatctgagggcttccttggtggctcagtggtgggagagtctgcctgctaatacaggagacagggtttgacccctgatctgggaggatcccacatgccatggtgctactaagcctgtgcaccacaatttctgagcctgtg

SEQ ID NO: 63121 - DNA, 786 bp, Bovine  19866880710664
ggcgaggacctggaggacaagcggaacatcctggagttcctgcagagagtggacactgcagaggcctggatccaggagatggtgagaccctgctgggtagggacagagctggcagtggggctgtggggctggcagatggaggagggagccccggcaggaagttccccaagtcaccgcctgccccaccactgcccctagcagctggatgcctgggaactaggtgcccccagggctgggtgctcagagtacagccttcccaacccatggcccccacaggaggtgatggtgaatgtcagcgacctgggccaggaccgtgagcactgccagcagctccacaggcagctccgcaagctccgaggagtctgggccggggtaaggtgccctgcatcaggaaatagtgacccagtgtgggctctggagccagaggcgggtcctcatgtcagctcagtgcttactacctgcgcttgcttagacaggctctctcaccttgccaagtcttagtttcttcatctttaaagtggggatactgcttccttcataggtaagagagcatatatgaatggtggtggttacaggaatctatacatatgataaaactgcctagagtgatactttcccacacatacacagatgtgtgcgagtaaaaactgctgaactctgaataaaatctgtagtgtagttaatagttataccagtcaatgccctggttttcatattgcactatagttatataagctgttaccatcaggggaagctgggggagggtacatgggccttcattataca

SEQ ID NO: 63122 - DNA, 698 bp, Bovine  19866880816162
caagttagagaaacaccctcttcctcgcccagtcctccagaaagactccgtcatcaacaattcattaagacactcgtctccattggctggcgcctccactcgcgccggcagcggtccaatgagaaaggacttgagagacccttctgaataatgaacacgctcccgtgacgtagcgaccggagactggctgagatggcgcgaggcggggccagctcgggcggcggcgagggctgttggggctgctcagttccagctggggagggtcgagcccggagtggggtcggagctcgggaccggcactgagagggcgagcgcggggcacagacgagcgggcaggcggcaggatgttcagctggttagggcggcaggcgggcgggcgcggaggtacgggcgcggacccggtgcagaccgtgacgggtggcctgcgctcactctaccagcgcaaggtgctgccgctggaggaggcgtatcgtttccacgagttccactcgccggcgctggaggacgccgactttgagaacaagcccatgatcctgctggtgggccagtacagcaccggcaagaccaccttatcaggtaacccttccccgccccctccgccctcctccctgcacacctgtccccgtcacctaggtggaggccgtcgtcctccccacgtgcgcgcctgttgtcaccagcctcccgccagcttcctgcag

SEQ ID NO: 63123 - DNA, 1897 bp, Bovine  19866880825513
ctgtgtgtatacatttgagtgtcagtatgtaatgggggaaaaatgtgggggagggagggagggtataaggtggacagggggagagagagggcttgagagagagatcagggcttctcacgcaaaactggaagcagcaggactgattatatgaccaaaactgcagccaatatgatcatgacttaagtttacatgcaaggctgttagaagctgaagaaaatctatctaactttgggagaagtaattggcatgatttttgttccagtgtcttaagccaaattcccaataaaatcccctcttatccaacttgaaaatttattttaaagtactttaaccaacaaatctggatgctggtcttttcccacttgagaccacaaactgctcccatttgaaacaactaagattttggcaatgtccatatgaagactctgatgctgggaggggttgggggcaggaggagaaggggacgacagaggatgagatggctggatggcatcactgactcgatggacgtgagtctgagtgaactctgggagttggtgagggacagggaggcctggtgtgctgcggttcatggggtcgcaaagagtcagacatgactgagcgactgatctgatctgatctgatatgcttttcatagaagctgtcatttttctatataaaatgctaataatcccactcacaaagcacttgaaaatattaatgtcatatgagacatactttaatactcactcgaatccatttttgtctcacttccagaaaggagagatgtttaggggctattttaaggtgtctgattaaactttcctgtaaagtactaatgcagtttggaagaaagcctcccgtttccacggaaaattgaaggacatctgctacctgtggcattcaaaaagaacaaacagaccaattcatagaatatattacagagagctatctcatgacagaaatatatttggagaaatgtcattaaataccatttttcccaaggacccatgtgatagacaatgccatcagaaaattttaagttgttaggttaacttattcttagaaattagaaacaaaaaaaggaccatgcaactttaatgtgtccctattttctctttcacttcttttaattgcctgcgttatggttatttattactctttggtgccttcaatgaatggggaaaggagaataaaattaaaggatcacttatacttattagcaactctggtaaagttttggtaaggaaagctaataaaattaagaattataatcattatttatctgtgtgtggtatgctaaataatggcccctgaagatatctacatcctaatttctagacctgtgaatattaccataaatggcaaaatggattttgcatctgttattagttaaggatactgagatagggagatgaatttgaattatctgggtgggccctaaacataatcacaaatgttcttcttataagatgagacagagggagattttattacaggcagaggagaaggtgacgtgatgacgaaagaggagatttgagtgatatacttggaagatggaaggagtcacaaaccaaagtacaggcgaaagctgaaaaggcaaggaaacagattgttctctcagagcctccagaagaaaccagccctgaggacaccttggctttcacctggtgaaaatgatttcagatgtctgacctccagaactgtaggagagtaaatttatgttttaagccacaaagtttatggtgattagttacaatagcaacagaaaactaatacactgttaaaggaagacaaattgaaataattctgaattcctgcttcttgaactatgaaaatctgaaaagaaaaatatggaaagacatgctagggattttctggtggtccagtgggttaagacttcgtcttccaatgcagg

SEQ ID NO: 63124 - DNA, 766 bp, Bovine  19866880830743
tccctgatggtggctgccttcatcagggccgccacccaggtcagagaccaccccagcccagtgccatgcactcgggccacgtctcccagttccagatgatgtccaccttcgcagcttgttcaggcctcgccacagccctgtgatgaggacactgaagtttggagagttaaatggctttctgagaggccatgctggagcctagacgtttgattcgaagaccctgtgtgtggagacccctctgcttcctaagctcttgcagacccagggcaaagagaggcactgggagggagcagatcagtccagtgtcccggggccagcgagcctcacctccaaaatgaggtcccacccaaggtccctgcccagcccttcctgtggctggggggccagctgagctggggctgtcttcctgggcccaggctgctggatcttatttaccaggcactgcccagccctcccctcgggccagcagtccactgcctgggcacagctgagggcaagcgtgtgggacatctctgtggaccatcagcattgtgagactcacgtccccacccccaccaggccaaggactggatccaggagcaactccagcaactgaaggagccagtcccttctggggacctgaaagctaagttgagacacctgcagaaacaccaggccttttgagggcttgaggtccaggcccatgaggaaatcataacctctgttgtcaaggtaacagccaggccctcagcccccacgctgacccacagtggggattccaagatgg

SEQ ID NO: 63125 - DNA, 2535 bp, Bovine  19866880917728
catgcttttactttgactcttctaaactgttctcatgttcttcaagtccccagtttctctttttccttcctttaccaccacatcttcttttaatcttggcaaatcacctcactcccttactacctcccaggtagaaatataagctctgtacatttattacccatgggatcttactgaagttatttcccttctcagtgatttttgcttccttcactgtaaaatggggataaccacagtacctatcttatgaggtggttgtgaggattaaataaattaatatataagaactgtttaggcctataccatggtgaatgcttagtaaatattagctcttaatgtttctgagaacacagaggccaatgacgtgaattccatcatccaaactcctcttcacctgaaaaaaaactctgtcactctctaccactgcctccctcagagcaaaaacatgtcttattttctaagtctgtgctctccacctgtgtcttgattccatcccctcccatttactcaagggaactttgttgaatgaattcttttctccttcatagtttaaattgattcctttttcctggctcctgtttctcattctcaaacacactcaggtctctcctattttgaaaaaggcctctgtatgacccccatgtctttgagttactgtcccattttcctcctcctttcactgccaaatactctgtgcctccatgtcttcgtgactcactttctcgttattcctctgccatctggctccctctgccaccccccactctcacatggctgtgtctgtggtcacccatctccaaattcaaaggacttttcttgatttctgtcctctttagccactttgcaatggtcagtattgctggctgtcatctactctgtgaaatcctctcctctctcacactctcctctgagtgcaagtctgttgtgctgctgcttctccttccctgtgtctcctttgttcaataaatacccttacaggttccatttttttctttctactctttggttgtggacatggagagggttcaccatgcaacctactgatctctactcttactctttgatctcttgcaggtcttgtgccttcccatcactcctttaagtatggcacctgcctcactttttgtactcacctctttagcctcatgcctcatgctcggagaaggcaatggcaccccactccagtactcttgcctggaaaatcccatggatggaggagcctggtaggctgcagtccatggggtcgctcagagtcggacacgactgagtgacttcgctttcacttttcactttcatgctttggagaaggaaatggcaacccactccagtgttcttgcctggagaatctcagggacggaggagcctggtggctgccatctatggggtcacacacagtcggacacgactgaaaatgacttagcatagcatagcatgcctcatgcttgctctcattctctgtttcggccactctggctttcttttgagttcttgaaggtgctggggcctttctgacatgggatttttgttattgctgttgtttaatttgcattcatcttcatctttttttttttttaaccctcattgttactgtaatttttttctattttgaagattgagatataattcacataccacaaaattttatcctcttaaagtatatgattcagtaggctttagtatatttacgaagttgtgcaacagttaccactatttcattccagaacattttcatcacctcaaaaagaaatcctatacccattaacaggccctctctttctcccttgtctccatcagtccctggcaaccactaatctactttctgtctctgtgttgtgggtttttgtgcatgctggtccttttgcctagaacctctcctctactttattccctagtcagcttctgtttttcctcagtgatcagtgccagtgtccttgagctggtcaattcctcctacatgctttcacaggaatatgtacctcttttgcagaatttgttataaattgcagttttattctctgtgtgtggagtcatttataaatgcaccaaattgtacatttccattaacaccagattcacttgaatgtaatagtatgatacccaactaacacaaaaatgcatatttttctccccacatcaattcctccttcatacttccccatttgatgatacttcctcattgtctcaagcacacaggttcagtttcttgaagaactttgattcccttctctttcgtcttcaacatccagttctcttcaaatcctcaagttgagtggattcttttgcaagtccttgcatgccagcctttagtagtgtccttaatgctcagtaaacactgcctgataacgaataccttatggagctatctgcaataaaggaaatggttgtggccatgatgttgagtgagtcttagagactgccaaaggggcgaaagagagaggtgaacgcagagagtggagggtggcattggatggagactatcctatactacagagaccggagaaaagcagtaaagtactaagagaagcaaaaggagaa

SEQ ID NO: 63126 - DNA, 1362 bp, Bovine  19866880933908
acatacttggcatctccttcttcaggaagctgatgatgtaggcatgtacctgaaggggtatatgtcagtgaggacgtgccatttagaacagagatgcaaacaagatggcatctttatgcatcgtaacacataacaggcaccccaagggccatggtccttgggacaggaggagggtgagaacctggtggaaagggatgggggtgctgggtgggaaacagcctggttctggtgactaacctaagagaaaggttcaccagggctggtatataggagcaccaggaaatgaagctgaggctgatggaaatggctgatgggcatggaaatctgtgcccagtgaacagtgagatgaggactcccataacttcccttcagacagtttagatctcaagatcactgaggtcatttcggcacaagaccagctgcctaggaccaggctggaaaacagaagtgccctgtgggagagggagacctagcacatgatgggggagccccagaaaccttggtcacttagggttagctggcctggcactgttacccaaagggtggtgaattccgatgggagggctctgcttggcttgtgtcacctccttccctaaaatttccacccttctactgatttccaactttaggatgttaaaaaacgctcataaggttctctttgtatatctagaattctacagagtaatttagaagccaagaaaataaataagaaaagatgagaaacaaggcagtgattacaaaaagaaaatgactatgtagctatggaaaattctattaaagaaaacagatgcctgctataatcttgtggaagaatgaaaattgaatagagggggtaagcagatacattccatggctcagttgagggcctctgtgtatggatatacaccaggcacagccaaaaacattttgctaagatttgaacactaaagtgcgtgcatagtgcaaatgctgacatgtttggaccagacaacgctaacttctcctcctgtataaaggtcattttaacataagcacaccctgtgctgcctggctatttctgcaagtatgactgggacagatggctggatagcatcaccgactcaatggacatgaatttgaacaaacgctgggagacagtggaagacagggaagcctgatgtgctgtagtccatggggtcataaagagttggacacaacctaggaactgaacaacaacagcagcaacaatagattgggagagatgcttttacaccttcctgtcactggtaaacttacttacttttcaaattaaaacaacttaaaatattcgcacagttcttcaagataactagagaaatccaaggtttgggaatccttttatttagaatcatgggctttaactgc

SEQ ID NO: 63127 - DNA, 2782 bp, Bovine  19866880947363
ccagacaagtccaggcctgctgccatcaccaagagcccagcattcccacaggatccgcctcctacgactctccatcctccagaaggcagaaacaaatgaatcctgggatgagcaaggaatgcagaagaggcacacgcagggagagcacagaaggtctgagctgtgaccctgcacctaaaatttcctctttcagaccaagtaaaatcagaaggtgactcacagaggcacaccaaaggtcctcaagtcttgctcacacatcaccctgtgtgccttttgaacactataattccacaacccaacattccctattccctctcactgcctattgcttatactttttccaaagcacacatcaacttgtaatattccatacaattttctcttggggaggcaatagggtctgtcttcatcactagactgccagctctctgacagtaacacttgtttacttcgtttactgttaaatcccaaaggcctagaaaattgacactccgtaaatatttgtgaataaatctttaagtcattagctaccagatctcaaagaacctaactcctgaagagcctcctgagtagcagaccccggggcaggtccacagttctccccgaccttaggcttctaggactcactgatgctggagggcagtgtgatgatggaaagaataggaaaactggggtcaggcagacctgtctgctaacaaactgtgtgatcttgggcatatttcttcacttctctgaacctcagtttcctcatctataagacaagaataataatattctatgtctcaagaattgttgtgagaattgaagaaaaaaatatgcaaaataaccagcagggcactcctagctatcttcttgacaggttccctggggcaccaataacaaggaaatggctatccaggggtcagcagtggcaacaggaaccccaactacagtctcccatccaggacctgcagattagtgactcatcagggtcctcctccagatgtggaattacaaactgtccctccagattcactcccaaaggggaaatgttatggctttaattgttctaagagatgagtctaggatgttgcctaggacatccttgattgtagtcctctttagatacctggcatccttccaaataagtaacattcctaggccaaatcatgagacccattggtctctgtttccgagatgctctctgagacccacccatccactcaaaggaatgggaaaagaaaattggccataataacccagtaaataacatggtacatgtctctctgcccaggggaatctgaacatattcccttccaggacaagaagcagatctcacaggactcatgactcaagtccaaaaggcagggtctgagccccttcctctcactcaccaggctctagccaccatggctgctgtttagctactcaaacaagtgaatcaatgcatcctttcttgggacctttgtagttgaggtctccacctgaaagcacagatcttcacacagggattcctctttgtcgcccagacaacagctcaaaggtcagctcccactgagccctgaccagctgatcttcaagtagccctactcccacccagctccaggatgttcacgtactctcctttccatcactccttcagaacactgaccagtctcatgatattatcttgctcatttgtttgtttacatgcttactatctgcttacccactcccctcccccaattgccttaaacccggaagaagcggtgacactgtccgtcttagtcactgctgtataccctgcggctagaagagtatacagattaggttttcagcaagtatctgccacacacgattgactgtatggatgaacaaggtcttctgggaagacctacagggccctgtttctggagtgagatctgttgggaagccaggagaaagggcacggaggggatgggtgtctacgggtggcgtcacgcatgactcacagccatcagggcaccgagtccaggcgtcctctttccttagctccacccagtctgtccaccactccacacgctccctggcgaccgccccgcacccagtgtttaccacagggaggaagaaggcagcagcgtgctccttcagctcatctgccactagaacacgggccaggaggagattctgtggcttcacatgcagtccaaagccctggagctgggtctctcagcatcgattccaacaggcactgagtaaatggagggcctcctcaggagagcgggctttcccctcctccccccgacgtaaaccaccaagaggtcctttcctggctgccagatagggcccctcactgttccaggacacctcccactccagtagcaggtctgcacagaggctctgcactcaggccaggtcctgcactctggcattaagggtcgagagaaatccattctccaaactgactgactccacagcagcaacaggggctgtgctgggctctaaaggtcctgaaactctaccagggcagctagggaaggagtccaagtcaattatgggttttcaactaaattgaggggcttaaaatgtgacaggtgaggggttgggtttcctgtggggaaaagagcaaagggagagctctggagaagagacgcaagagccactaaaactcaagggtccttgcccagaggctttaaaccctgcccctgcctcgaacacatctctctccaccccgccctcccttgagctgtttcatttcctttcagaaaagctttgttttggtttgatatttgcctctaggcctctgggagaatttttggagctttggttctcttcttggttctag

SEQ ID NO: 63128 - DNA, 948 bp, Bovine  19866880985854
ccggcacatcctggggtgcctgtggtcctgggtgtgctgacagccctggtgacggctgctgccctggccctcatcctgcttcgaaagaggaggaaggagacacggtttgggtaagggctggggacatggagagaaaagtaggcactgactgaagaccgtggagctgactccaagtcctgggtctccttttaggcaagcctttgacagcgtcatggcccggggtgagccagctgttcacttccgggcagcacggtccttcaatcgggaaaggcctgagcgcatcgaggccacacgtgagtgagtggtggggagtccaacgaggaagggatgggctgtcttgaacctgcacctgcctttctcttactgatttgaccaataggtttgaaccttgctgagtcctaggcacaccatggaaaaaacatgtagacctatcctgaggtctctggcccagctgtgggggagctaaataaagctcatctctgctttgagggtggcttctggggtggaggaggcagactgagttttggatcaggaccagagaggtcgctccctttcttatggcctcctccccgcagtggacagcttgggcatcagcgacgagctgaaggacaagctggaagacgtgctgatcccggagcagcagttcaccctgggcccggatgttaggcaaaggtgtgtggggctgagcagggactggcctgagctgccagggctgggtgtgtctgctagcttccatgtcactctggggctgtggatgtaggtcagctcctatgaacaggatatgctcataaactcctggctgctggacatttaggggaatggaggctggggtcgagaaaggctgaggtgtcatcactcctagcttactttgttttgctatgaatgagggagcctccttcagtggccccagaaagtgatactgtgtccctatgaagggtcactggggag

SEQ ID NO: 63129 - DNA, 3329 bp, Bovine  19866881088332
cttctcttgctgcggagccaggctctagggcacacaggcttcagtagttgtggcatctgggctcaggagttgtggttcccaggctttaaagcacaggctcagtaattgtggcacacaggcttagttgctgtgtggcatgtgtgatcttcccagatcaggggttaacccatgtctcctgcgttggcaggtggattctttaccgctgagccactagggaagcccactgctgctgctttttgttcctccagtctaggtgtagtagagtcttcctgctgttaataatctccgggaccgcctcaccatccactcttggcttatctccattagctatgtaataaattttctatattaaattccctctgtttcatatacttagagtgctttctgcttttctggttagatcctgactgctataggggtataccacatagtttttgaaatatattctaagagggtacatgtagtgcttactgcaatcatctatgatttctcccagagacagtaaattatatttcatggatttgtgtgatcatatctgtgtcctgccacccatgtaatgcctggaggtataagagaaacttgttttcagagatgcagttggaattatatgaggataatttgcaaggatgttgcaataccaagaaaatggtattgaatatattaatgaattataactttaggaagggaagtggtctttggagtgatatctaataaaattagacaaaactttataaccaaggagggattagaaaattaaagtcaagcagatgactaaaaagctgaatgtccattgaaaatttcccttcagtaaggagggaaaaaggcccagtcatgttgaactgtaaacagcagtactatcatatgactcactgaaaatgtttaaaaaacaacatggaaatcaaagcattgcccattaataaatagtgcttctcattatattacatgggttaaatattctgtttattgtaatttttctaaaatctcaacagtgtatcattttattttctttcatttccatctgtagtgcaggtgctaaataagtaataggaattagggaagaatgaggaataaatacatgaatttcaaaaaatgttcctggaaatcatcatgcaacaatgatctcaaccttaaataaaatagtggaataaatatttaaaaagaaaaaatgtgcaagcctttaaaggatgaaggaattctgactaatcaacagcagtgattaattataaatagtggacattgccagattggcgtgagtggttttctggggggtttttggattttaaattccaggaacaaaaagaaaagaagtactagatattctagattgggcagtcagtaaagcattttaagctagcatcttatgaaatctcaattacgaaattaatttatagtgatttccaggtgagagtgataactggaaactttaaaagaaggtttagaggaattaatgagcaatggcagggaattttttacaattttttttattgtgaaataagcacttatataatagaaatgcattgtttaaagaaaaatctgaaatgatcacccaggtcaagaattagcccattgccagtagcatagaaccttaccttgtttccatttcccattacaactccccatccccagagataactactattctgaattttatgtcaatcatgtccttgcttttcttgacagtgtcaccctctacctatgaattctctagcaggcaagtagctttgcctgtttttgaactttatatatatgaaatcacattggatatattcttttgtatatttttttttggggggggagggggctgtgggatctcagtttactaaccagggactaaaccccaggtcactgcagtgaaagcactgaatccgaactactagatcaccaggaaactcccatgtatctggcttctttttattcaatattattttgttgttatattgtgtgagtgtatgtctcattttcattgctatatgatatcccattttggtatataccagaatttagctatcccattgttgtgtattaattttgttgtagtaaacaaccctttaatttcactggcttacaataacaaactcttgtgtcatgctcttgatattgtaaactgtatcagctttggttcttttctatgtgttttttcattccaagacacagaataaagcagcaaactctgtttaggacatgcctttttgtggaagagataaaagcaatagctctgaaagaaactcacgagtctaatacatgtctactctgcctatagtttattggccaaagcatatctcatgtccaaaccaaaagctaattaggtggtatgcataacccttctacaggaggcatgaaggtcacatggtggggaaagatgtatagttttctaaataggaaatatggtataattcatcaccactatcaatgttcttatatctggttatcacaaaccgccttactgtgagtttccttgtatatgtagccttgtacaattgagcatgaatttcttcagcaatggaattgctagttaagtgtatttttttaactttttattttatactgtagtatagtcaattaagaatgttctaatagtttcaagtggtcaacaaaaggactcagtcaatcatacatatacatatatccactctcctccaaactcccctcctatccaggctgtcacatatcattgagcagagttccctgtgctagacactagacctttggttggttatccattttaagtacagcacgttgatcccaaactccctaactatcctttgccccaatcctgctctggaaaccataatcttgttctctaagtccctgagtctgtttctgttttgtaaattaagttcatttgtattatttcttttttagattctgcatgtaaatatcacatgatatttctcctctgacttacttctctcactatgacaatctctaggtccatccacattgcagcaaatggcattatttcattttttgtaaatgactgagttatattccatgatataaatgtgctgctgctgctgctgctgctgctaagtcacttcagttgtgtcccactctgtgcgatcccatagacggaagcccacagacagaagcccaccaggctaccgtccccaggattctccaagcaagaacactggagtgggttgccatttccctctccaatgcatgaaagagaaaagtgaaagtgaagtcgctcagtcgtgtctgactcttagcgaccccatggactgcggcctaccaggctcctccgttcatgggatcttccaggcaagagtactggagtggggtgccattgccttctccgataaatgtactacatcttcttatccatt

SEQ ID NO: 63130 - DNA, 1468 bp, Bovine  19866881113539
gcacatgcctggcatgtttgggaaaaaacgtggaagccagtgaacaagttgtagttgagatcagggaggtatggaggccaggggtggtggcagagatcctgccggaccctgcaggacacggtaaagacttggtttttactcagcagaagataggaaatcatggcaggacttgagcagaggagtgacatgatctaacttttattttacagtgatcattctggatgccatgacaggagtagactgaagggacaagggcagaagcagagagaacagtcaggaagctactgcagtaatcacttagaacaatagagaagtgggggtgatgagaaatgggaggggttctgcctttattttgagtccaagggaatttgcaaacggatgagatgtgggatgtgagaaagcaagtcatccagttcctggccagggcactgggaaggatggagttgcagtcacctgagatgaggactggaaggaaggcttgggggtcagaggaggcctgaacctcccagactctccttccagtttttctgcctgtttctaaaaggcagggacactgcccctagcactccaggttaggatgctcacagccccagccacagtactcaggctcctccagaacagacaagtccccccaccaccaactgcggaccccaagcttccctgccatggcccaatgtacaccacccttattcccacatcccccaggcagctggagatcacccagcgctgggagcggatcctccagcggctccaagggcagaggaagcagatagcgggcatgcaggctgtgctgagcctgctgcaggaggtggagactgcctccgaccagctcaatgagctgcaggtgggccctggaccagtggacccctgggggaacatagcagcatgcaccagtcctggcattcatggggacccagcactctgggacgttaatgaccactcatctgtccctggccaggtgctagtcagctccatggcctgtgggcagaagctgacagaggtagagaggctgctgcagaggcatgagctgctggaggcccagatctcagcccttggagcccacgtgagccatctggcccaccagacgatgaagctggactcttccatgggcactgctgtggaggtgctgcaggccaaggccagggcgctggcccagctctaccagagcctcatgtctcttgctaggtccaggtaagagcccacccaaactcctctaccctctccacaacttttctgtaatccagattacctcctgcccaggtttaaacagtgctgcctggtgacttcctgtaccctgacctagtctcctctgttgcatgatccagggacaggagagctcctatctaaggggaggtgtctgggcctggtggggaacccctccccaagtcccatcactgcccaatcccctccgtggcccttgccatccctcaggagggcctcactggagcagacgctgcagcaggcagag

SEQ ID NO: 63131 - DNA, 1484 bp, Bovine  19866881167129
cttccttgaaccgggggcggcacctgggcgatccgatgcccagatgcctcgccaggtgtagagagccctgcttccaccatcctgcaccccttgtaaccttggaagaacattttaacgatggtgactcacccgactcatctcccagtgggacaggcttcggggcagggctgggctgggcactgaggctggacagagacaaacagtcagagagcacggctcccgcccactcactctgaagcgccagcccccacccttcaaagcctcaaccccctgctctcaccccccagtcccgctgagggtgcatccaggccctgcccggcctgtgcctgtctggcccactgcaggctcgcacagacctggctctttcttggcacccctggaaaggacaggcagcgctgggagctcctcctcttctgtgccctcgtcttctccctccttgtcgctgtctgaggagagagctggtccgggagatagcatcgagggggcctcgtgcctgcatccaagacaagcaaggtgacggggagaggagacttggtgggtggagaggtcagcggcgtggctcttcgagtaagcaacaggtacggggagacacagagctgctgagtggcaggtccatggcgaggaggaggagcagcctggaggcccacccaccagcatccacgcccacactctgatctcaccggttgggtccagcggccctctgaggagaggatgatccttgctgcttgcctccgcgctggcgctggcgcagctcagccagacgctgcctcatgctgatggtcatctccgagctcaggcgccacacaaatatgcagctggggtggagccacagagctgggtgaggggtgcggggactgcaaggggcagcacctccctgggctggcaaggagcaccagagccaccctccagtgccgggccattcagccctacttcccaagacatcactgatgtggagaggggactgacacaggaagaatcccagggaagctggcttctgctcacctgtcccctgatacagagatgaggtgtttgcagtcattactaaacttcatgccagtgacaatctctgtgaaaacaaatatggccaatgagccccccacccaaagtctcagccagatgtcttctcaacagtggaggttggggattggctggaggggagggacagacagctctgctgggacccagaaaaggctacggagaaacgggaaggttccagggggagagaagcagggctacactcacctgagtggccaaacatggtagccacgcactcgcctgaggaaaagtcaaaaatggagaggttcttgtcagagcagctggtagcgatgtagatccctgaggggtccgtctgcacctgaggagtggacacactgctggatgaggccaggaagcactgggccctctccacccagcaccatctgtgccccccattctctggcccggcacccatcccactgagccctcaccttaatcagagtgccgtc

SEQ ID NO: 63132 - DNA, 1746 bp, Bovine  19866881190335
tctaatattttttaaaagcaccaagtctttgttccttctataatatgatcattatagaacctatctaacaatagccaagatcagaagtaaatttactttggagttttttaggaggtgtgggtggcgggatagttctgatgaggtttccatcttagaaatgctccagatgagctatttttaagaaccacagtctgttaatttaccttgataaaatactgtgaaagggtgctactttaatcttctaatttttcattttaatttactcagttattttaagtgctactttatttttgtactcaggagctaggaagaagggacaaatgaaagaaaacagctacatgttctagatgataccttaagtgaataaatgacatattaagtaaaacatcatttatatattaagtgatatataattatggcaactctgtaagtgaatttacttctcaaacttttaatatttcaacacttagttaccatttagaaacaaattccaatgcttttaatggctatgtttcaaccatttcaaatttttaatcattcaaggataatagtttctaggtcattttgaaagaatccaagaggccaaagtgatcagtttcttagttaactgagctaaaatatattaacttcctatgctgataacagagattttacacttgtttcaagaaatatcccaactatgcacacgatagtcaataaatattgatcatgaaaatgagcataacccatctcttctaaacagggtgtcttttcagactttgtacagaaatcccttctttgtataaagaggtccctttatacttctacctgaaggtaatatggaaaggctcagaacataaaggcagagcttactggggtcacatgtatcaagatgggctagggtctacttctgctcacagattagtgttactcatctgcaacagagtcaaattctgaaattctgggtgagggcaaggggggagtgtgtaagagcaaaaagggcttaaatgcaaggccacacaggtgaacgcaatttaggaggtgccagaaagctatgtgtggagaaggcaatggcaacccacttcagtactcttgcctggaaaatcccaggaggagcctgggtaggctgcagtctatggggtctcgaagagttggacacaactgagcgacttcactttcacttttcactttcatgcattggagaaggaaatggcaacccgctccagtgttcttgcctggagaatcccagggacagcggaacctggtgggctgccatctatggggtcgcacagagtcggacatgactgaagcgacttagcagcagcagcaagccatgtgtcttccttttctactgtctatctgcttcaatctgccactgcctaagcttagcaactgtcatctacagcttatgatgcttaacccctgggggagagggaagaaaggtaagcatgaaaatagaaaaaaataaaatgtttcaatttaacaggggttttcctggctgagctggtaaacatctgcctgcaatacgcgagacctgggtttgatccctgggttgggaagatcccctggagaagggaaaggctacccactccagtattctgccctggatatttccatagactgtacagtccatggggtcacaaagagctggacacaactaagtgacgttcactttcacttttcctggccgaacctaggtgtgcgaagggaaccttgtttccttccaacaattttcaaaagaaatgagatcacaaagctgcctcacct

SEQ ID NO: 63133 - DNA, 2581 bp, Bovine  19866881224910
attttaattcacggttgttaacattttgctatatttgtctatttgtatatgtgtgtgtgtgtgtgtatatatatatatattctttttgatgaaccattttaaagttgcagatagtcaaacttttcaccccttaagctttaagcatatattcctgaggacagggatttgtttcctgcataaccacaatactattatcacacctaacaaagtttgactctggctaagaagactgaggaattcgggtgctggggagacttttcattatgtacactttttgtactatttttaccatgtggatagattgttttctcaaactaaaaaaaacaacctagtataaaaagaaatacaacttgaatgtgatcattgtttaagaaaagtaacctgaagtataatactgtaagtattaaaaactgaccccatgggctaaatattatgaagtttttaaaaagcactccaaagcaatatagaaaaattatgaattaataaatgaaaaataagctattataactatgtaaagtgcacaagtgacatattaggtaatatatgaagacatgaaaacagtggcattgatattgtaaacaaattttgtcttttcaaaaagtcttttgagaaagttagtcattcttgaaccaacttattttgtgaaaactaaaaaaaaactttagttctagagcaacatttgaggcctgaggccatagcctgttcaggttcctgaagaagacagttgtggctggcagaatcaagagaaaggtggagactaattagtacagcagtaaaattgtacctgcaggctcacagtataaggataatgatgataatagctaacctggcatgcttaccaggtgccagaccttggccaagcacttttctctcctggactgagttagttcactgcacaaccccattcactcagccctcattcgtgagctgtggtgccatgtttggaatcagactgtcagcctgactctcagaggagtgtttactgagctgcgcacacctgcctatcgggcagaaaggtccccaccggcttcctcagtgtctgggctcctgctggctctgccctggcaggggtggttctgcctcttcttctgctccctgctctccttgagagctagcacagaacagagcccaggctggcttgaaacctgaggctgaagaatttactgcttggcccggggtgtcctctcatactagctttgggccactcacttcctgtttctcctgcgtgtgcctgtgttaattttgtcccattgttcccaaaactgcgagtgggtttttgttgcatgagctgggggaggaggacaactatcagaactccctgagccacccctttacccctgaaggtacagcctaggacaaagtccacacttgtcacaccctttttggctgttgtcttttctcctttgataactatttttttccctcctatctccagtctaccccgagattaaactatttcccaggaattccttttttgcattttcaaagtttcattgtctacctgtggttagtccctcattttaattgtcagcttgtacctgagttagtgcaaaatgaggaacaaagtaacttccttgtagatgtcatctgaagatagcacaaccgttttacagattgcctaatcttctttcttggaacccattcctttactgggaactcagtggagctcatgcagttgcagagaaagaggctgacccaaggctgtagtgattttttacccaaagatcagccctgagggaaaagataaaagtcactgatgcttgaggaaaagtaaactagattttaaaaatactgtctgtttcacatgccctagtccttaattcagcacatgttacctacccaactgcacaagtctgaaacaccaaactgattaatagggatgtgtttttgatcaaagctggaattttcatagcttctaagtcagggtactgaaaggtgaaagtttcacactttccttttaaactaaatttagctttgttttgttaaatcttaaccaactgacatttaacacagagtcttaattaaccctagacttcactcttgagagtcaattttgtttactcttgatttattttctaactcctttcattctttctgttttgacacactagaggtgagttagttgagacatcgcaccactttactgactttgaagcatttaatggtgagctgggaccagaaaggcagctggtttccaaagggccactcacattcaggttgaatttgaccagaggacaacttctgtaactgcaactaattctgtgttcttcagtttctcacagtcagatcacccgcctctacagccggttcaccagcctggacaaaggagagaatgggactctcaggtaggcatttcctttctttatttcctgctagtggctgaatagctgcttttatccagagagcttacatctggcaggcagagagcagggaccatttcttcacgcatctttaagtgttattgatccacaagggacttaaacagaacaatggatttacatttatcactaggtgctcgctgctttaccccctgctccccttagtttgattggccattactcggacacgactgagcgactga

SEQ ID NO: 63134 - DNA, 1922 bp, Bovine  19866881281363
tatcccagaaagtatttgggttttgtatgtacccacttcttccaaagcattcttggtatttgaagcttaaattgatgtagggaaaagcactttttctaggcaacatttaaagccaagtgcttacatagaaagcagccttcaggcttcatagttgtgtagttgtttccttttttccttctaatctgtaatgtatacaaagagacctataagaggaagtctggatttttgagagagggttgtcaggacatttttacttctcatattccccatgttttatggagccaataaagagtgaactgccctggactgtaattgcatttatggacataaattttttcatttataccacttggagctctgtagccaaccactctgaagaataaccccactttcctgacatatttacacataaaaattcccactattctacttaagtattatttctgaggaggctgaagtctgaactatcatgtctggtactgatatttccctaaaaagcccctaaaaagcagtagtaacttgaagaagactataatcgtgtaaaggtatgggggcaagcaggaagcaagagaaagcttttctcatctggctgaagggttcctctccagcacccttgccttttctgcccttctccccatacttgtttgtagagtttcttcagtagcttgtgctaaatctgaaatgggagtaatcacaccataattacaaggacgggaagaaaagtttttaacatgtctgaatgttttatacatgtcttcagatcaggcctggggtgtgagtaaggcaatatttcctgagagattttaattatattgatttctaacctatctgtgatggagagaaactgatttcctttgaagcctcaaccctggccttgagttaagacaaattaatttccatggcacatgctatgaaaactttagggtcagttcaggatgaactgtgtcactaaggaaggaattatcattagctgaggaaatcgttctgcaaggttaataaactaagaccctgggaattcatcataccaaaaaactaaagtgcttggagcggtcacgcttcttagagccagagcaggaatctacatgtcctcaggaaggacgcgctgaatgcttgaggaggcagcccctaaagatactagagtttagaaagttaatgaagcaacaccaggggtcagctcatgtgagacgaaagggagtgtgcatttccatttgtggggaggcaggaatggtatgtcatacttcatctcccctgcttctgagcagttgggaaggctgcttggggtgggcagaatgggtggaggtgggctgtttaggatacagctgacttggaaggcataatttaagtagaaatggacatgtttgcctccttttggacctcgtgggtttactgcttatgtacttaaagcatgatattctgtgattctgtatatatcttgattcagggctcctgccaagtaagcttaacgaaacattaaaaaatatttcactacgagctgtgccctcggaatctcctagtttttaatcctgaatttggaaggctatcagcaaaatgaaattggaaaacaggagaacgtttgtaactttaaaaagttgttttgtttttaaactgtaaaagagtgactagaaatgagtccagacaggaaaaacattctttcctgtgtcaactgttttcaccttgttcctttatgattttctagcttttgacttttcacctcaagaacatgggcccaaagtttttatataattccaatgtaagttctgcttttcttaaaaaaaaaaaaatagcaaggggagaagggggaggaaggaaaggattgggagtttggaattagcagatgtaaattattttatacataggatggataaacagcaagggccaactgtatagcacaggagctgtattcaatatcctgtgataaacca

SEQ ID NO: 63135 - DNA, 840 bp, Bovine  19866881304616
tcatacctcctggagggcagcagcctgctgcaggtgccgggcgtgtgcctcacacgcctgctccagatccgcccagcggccttccagctcctggcaccgctccatgatgtgctgggcctgggggtgcccggaggctgcgaggtgtcgtccggagcccagcacccgtcgcacctgtccctggtgggctctcacctgcacccggagttcctgccacagaacagcataaagggcgctattttagggcactcgttagccacagggggcccggaacagagcccgtggatgtgccttgcaggcagagaagggctgggggcagagacttggaaatcaggactctgagtcatggaggagggcatcgaggctctgggaaaggcacgtcagggatcctgggaggaaacggggactgttaccttgtgcttgtggagaaggcggtgggcaccatctgggcacttagcagagctggcgctgggcgtgggcatgtgctctgccacccacacgagctccgcgttgctcaggtggtggaagtggtacagctcaaccgaggcctgcagctgccgtcgccggctggccagatgtccctgcagggcctcgaacctgggtggacagaggagacagaaagggctgggaacaggcgaggtccagtgcccagtgctttcctcatcccagtcaggggccacaaaggaagaggcaggggtcggggaacatctgaagatggggaggcagctggaaaggcccagggcccaagctcccaccctgatgacctccctggctttagactgtggggtgcttaggaagactggctggtgtctctgactctcctaccatagaagtgactccact

SEQ ID NO: 63136 - DNA, 782 bp, Bovine  19866881336566
ttaccgtgtctaaccaagaggtggaatacctgtccctttttggcagcagcaacagtaatctgtcacacctcacgtttgtatgcatctctgtgacacataaagtgctctatttcaccctgtacagctactcaaggtagcaaggaagcaaaaggacacaacaggtcatgggctctgtgtgcctacacaaagagggcccacactgcccagaacctctgaatctctggccacatcctggagaccaggccacagcccctatttaaaatcctccacctaccccagggtgcccacagcaggggtgccgatggattcaatgtctggatagtgccaggcagtgcaccctggggagcccctgggagggctggagaccacaactgggccgtccaaaccgctagaggttccggaagctggtgatcaccccaactcagtgagcctcaaacagagtcgggggccgtggggctggtcgcggccccgtcccgcccatcactcgggccggcgctgcgtgcgctgcctccgcctctgcatggcctcacgcagggcctccagcagccgctcctggttgttgcaaatgttgtactgcgtcaggtggagcagcttgtccgtgtcctccaggctgtaggtcaccttcgagtagtggtagggggagtcggatgcagacaggttcacctccccagcagcctgctcctcggctgtccgtcggacccctgtggggagagtgcagcccggccatgggggatgcccgctgggggtggaggatgggtttgggggacacatggggggagaca

SEQ ID NO: 63137 - DNA, 1298 bp, Bovine  19866881341977
agcctggagccccacctgggggtgaccttccaggcctgcctacactctgggtgccctcatgcccaccctctcgtgccctgcagcatcccttacctccgtcaggaagtactgggcttcctgagcctgctgtagccgccgacgcctctgtgcagcctctgcccgcaggcggcccatggcgtcctccagctgctgcactcgggcagccacatcgcgggcagcaaagtgcccagcctgtaccagcttgcgccctgtgcccaccaccgcccgggttagagcctcgtggctgctcatctcactctccaggctctgtggagtcagaggaagatggcatgggacatgctcctgggtgctccttgggggaccttgggagttatgtccaaagcccagtgggaccccacagattcccccagacagaaccctgcctcctgaccaacaaagaatcctaggacccccagaacctcccggaggcagaagctcccagaaccagaggtgactgtgggcacagtccctgtccctctaggcccacacctggtgcttctcctgcaggcgccgcagggcacttgggctctggccacagtcccgggcggccaccaggagcagcttctcctgcacccaggccatctcctcgtctgcgtccctgaagaactgcagcagcaggctccgggcctccagggctgtcctgcgctcctgcaggggcgcccgcaggctctcgaacctgcagtggtggagggcgggccagcggcaggtgggaccccggttgtcaggatctggggccagactgtgacctgcacatcactcactcactctgtccctcgccatgggctgggcaggccctgaggagctgggctgggggacagggaggaggggtgggtgttacctctgaagcagccgctgggcctgctcttccacgtctcgggccaggcagtgaccttcctggacacaggcctgggcctgggcttggcccagcagggcctgtgcccgcccgacctgcctgtccactgctgcctccagctccccctgatcccccaggagctcatccagcccaggctggtcctggcccccgatggggactctcagcttgagctccacaggctccagccagctctccagttcctccatgctccgtcgcagacgcagggcctggggcagaatgcgagtgtgaagaggagaggccaagagctgtacccagcccactccaccacacagcctcacctcacgggcctcctgtagcttggctgccctcctctggctctgggcctgcagctcctcccagagctttctcagctcctgcagccgct

SEQ ID NO: 63138 - DNA, 1023 bp, Bovine  19866881343248
ggtggaaatctgggggtctcttggaatcctgtgcgccacaactgtcagctgttctctaagagttggactaatttgcagtcctcctaacagtgtacagatgtgcctgtttctcccatctccatttttctgttgggttgtttgatctttttcttagttatctgtaaaagttttgtgtttaggatacttttttttttttgccatcagaaagttgtaattgtactcttttattttttcttttgggacttctggcttgcaaaggtttacagttgttttcttgcaatacttagattatttcattaaatttttttccatctgtgatccaagcaactaagccacttgttataacttcacattagataattttagaattaaatttaaagcattattattttatcattgcagttctatacaaatgcctcagttgcttacatttcagcgttgaagccaatggtttttttctttcagattcctttctccaaatttttcttctctaatcaaggaagaatccgggatgcccagtaccagcttctgctcgacaaggtaacgtttttctgtattttcactcaggactgtattgcatgtgtgttcagttgtgtctgattctttggggccccacggtctgtagcccaccaggctcctctgtccatgggatttcccaggcaagaatgctggagtgggttgccattaccttctccagggagtcttcccaacgcagtgttgaaacctgagtctcttgtgtcgactgcgttggcaggtgagttccttaccactagcgccacctgggaagaccatatatattcagttcagttcagttgctcggtcgtgtctgactctttgagaccctgtgaactgcagcacgccaggcttccctgtccatcaccaattcctggagcttgctcagactcatatccattgagttggtgatgccatccaaccatctctgtcgtccatccttggccgtccccttctcctaccttcaatctttctcagcatcagggaaagactgtttattacctttagtga

SEQ ID NO: 63139 - DNA, 1368 bp, Bovine  19866880373531
aaccccatagacggcagcccaccaggcttccctgcccctggtattctccaggcaagaacactggagtgggttgccatttccttctccaatgcatgaaagtgaaaagtgaaagtgaagtcgctcagtcgtgtccgactcctagcaaccccatggacttcagcctaccaggcccctctgtccatgggattttccaggcaagagtactggagtgggttgccattgccttctctgccttaccatacttaattaatacaaatcccaagtgcccgtaagacaatgtttgcctcaatttacctagctgaaagatcagtgtacaattcttcagcaggacacaatgaaatgctttggaaagagaaaaatgcaagcaggagaggactcaataaaatgatgtacattcattcattcatattcataacatttgctttaccaaaatgatgattcagtccagctgagaatttgtgttttagatttgatgtataatagttattaataaaggaatgttattgaatccttagagtaagtacatagtcttccaggtgcttactggttttttctctgaacgtttgttctattaattcatatttatgtagcacttattaactgcatggtatacttttacacaggtaaactatatgcttaataagaaagtaggcccttgggagcctgtagttaagaaaactgttatttggaattcatgtaatataagtatttataactaagattgcctttcatttaaaaggaaagaaattctcttcttgaggaccacaatggagcatgttagaatcctgagtgagtcatccccacacatggtgctggaggcctgagccatcgccttccttcttaatcccaattgcactgccaaagcaatcatgcatcgagaaccacagtttgttagctgcagctgaagaataaatcactcctggggaccctgcagttcaagtatatatatatttcaagcaaacccaggatatgaaaatctgtatttacacaacagatagattaaggataataattcactttccaaaggatttactactgcaggccctatgaactaactctctctatataaagtgtgatttgattttcaaaagatcccttctataggcaattttggaggaagagtctgttgtgtaaattaagatggtcaggggagataggaattataggctgctatgtaatggggcagtttgttttttagttcctttgtgagttcatctctatgctttgtcaacttcaaagttgtgacattctttagaacgtgttatggtgtacagagatggaggcctgattgcaagcaattaaaagattaatcaaatatataaagttctagcattctttaaggtgattgaatggtaactgtctttgcaa

SEQ ID NO: 63140 - DNA, 2586 bp, Bovine  19866880420545
tatgctgctttatttctttacaaagacaggcatagaaattcccatgagatggggaataatcagtattcagaagaaaacagaataccaactcttggacctgaatagaaggatggtatatgcaatgtttgtttcatttcttacctcttctttgagtgatgcaatgtaactcaccacaactcaatataatcaaggaggtggcatttcacaggaatgctaccatcatgacagagaggaggttcaaaagttggctttgctactgataacagtagcaattcagtgacattaaaaaaaattaagtaccatttccaaaggatagttacctttgaagaaataatattgcctttgcattgactttcatgctctagttcatccccaacagatagatgcagtgaagagcctgtatccgtactgtgaacaatatacttcctttaatgtcaatcccgggtgaaatgaacccagccaggaagagcactacaatctttccagttttgatcatcaacagttctccaaaaaagcagacttggattgttgttatccaagcaagttgatcatttacaaatggatcgtgtccaaaaatttcacttgtatatttggattatagagtgtcaagtataagtgcttatctaggcaatataaaaatgacaggttcccagaacagctcatagacatctatttccttcatgttttgctgatggtgttgggagagacaaacaaggatggaggatttgaagagtagtagttggccttggaaagacaatctgtggcacaagattaaaaaaaaaaaaaatctcctaatgatttctactacttccaaaaggaaaggaaggaaggggggcaaagaaagaggaaggaatagctatatcagctatggtccaaccaagaaacagcattctgagtatttcagtttcttgagagacaaaaacacagggtagctactaggaggtgttgaggcaattcagaaattagcagcagcaggaagttactaccatccctggaatggagggtcacaaagaaaaggtggtattgccagaatccagaagccggatcaccctgtggaagctggaactacaacgggcctgtccactggggactggagccatgaaggagctgccataggtaacatcagagaagaacctatggatacagggaaagacaggacaaacaccatggcttctccctttctcccaccatccagttcccattggtgccttccattgaccaaacccagacagaagccagctgacgaaggatcctgggaaattcagcctcctgtgatgcagagcaggaaagagcaatgagtggatctgtgggctcacaggtcagggctggcacattagacaattaattaaaaagaaaaagaaaaactctaatcccagtcttagcagattccacaagagggagtggtgaatattattaggtctgagaataagaaccatgcatggtctacataaaaagccaaattatgatacaacaaaaataacactaccaaacaccaatatgaatgatgttacaagaaaaaccatgacagccaaatgaatgatcatgagagggaagagaccatactggtctggctggaaatggttgggttcttatttagaaagaaggaaaagcaggatgaaaccaagacttccagggcagaccaggcaccatctatggagacaaacaggtgttttgtcaaacaggtttggtcaaacaccacatacctgcaatggaaaggtaagcgaaacccggggaaaggagctggcttcctgggtggggagaggagcaggtgagtggctcatggtcataccagcatggccctagtctaggctagaagccacactgtgtttactgactcggtgccatcacatagtaaagcctgacaatgagtggagagacaaaaagaagctctcaggcggcaggggtccacaaagggtctggttttaaaatggaggaacgaggtagtagagaccaacaccaatggctaagaatctgcacaataaatcatctgccagtcttactcttcccaccctcaccccacccccaaacctccttccttgccctaccctcgcaggctgcaagttactcctggaggaactgcacctcactggtcttcgtagtttcagggccttgaacagtgtctggcacaaagtaggtgctcactgcacagtggttaaatgaatgaatggaccgaggtgcactctgggtacactgggagagcagaactgcaggggatgagggcagacactgcagtgatgtggcagcgtgctggcctgctggaaaactccagcagcagccagaccagtgtgggcagctggagtcagaaaatgagatggttctttgaagcaaatatgttagttataaacagcacaggcctatgcaagtagccacagctgcccagcaaaggactggagcgcaaccggcacacgatacattcctgccacctaaattctgcctggctaattccgcagctcggagaaggatgggagctgcctcccacaggggagacccacagagttgagccaggatggtcaccattgcagtaaagctgcatactgctgctactgctgctaagtcggcttcagtcgtgtccgactctgtgcgacc

SEQ ID NO: 63141 - DNA, 2056 bp, Bovine  19866880502168
ttcccttttaaaactagtgactagtgtgggtttcactgagtcaataagcactgtattgtaataagtcaatgtattgactctttaatgtgtacaaggcatggtgctttcacagaaacagttttatttaggcatatagaaagtaagctaaggtctgccttactctcatgaagccatctgtggagcatgatgactttgtaataccaggtttcactctgtactatgaaggcaatcactctgtcttttcagagcccttggaagaatgtgtgcacagagcgtcaaagcctgccgggacataccgtcactcaacaaattgcagcttttactgttattattattcaaactgacttcatgcatgtagaccaggaccatcaactggcttgaggagtctgccccttcagctcacaatacacacaacacccacacatctttctgaattgtttttaccagaacaatctcagcatccatgagcaaacaaacaagcaaacaaatgcattaaagaaaatcatgtgaagcaactgagtatctggccaatagttaaagttcgtgttccaaagcccctctgtgcatcggaagaaccatggtctctgcaacagcgtatgacccacatgctatttatgtcttgggtggcacatcgatgctactgctggaggaatgaacggctgtttggagacttcttttgcctggttcattatctgttttaaactatcagggctccatctgagtgggccaacaggaagcctgcttttgatttaacagtgctctgaacaagctccttctatggctttccaagaattaattacagagcttagtaaaggcgccggctgcaaagtcccacagatgcctttatgagcaattacagcagccacactgatgccagtagaataagaatttccttggaggactgcttggaaagagaggactggcttgtggaaatataggcacacagagttcccatctgtagtttacaggggaattaaaaagtcacaaagcgagaagagattggttgacggtgcacaacatctgtgttattgggcacttgtagacctaggcttgtgtaatttgaccagaaaaaaaaaaaagagagatcatttgatatgttgagattggagcactgtagaggcaaagaaacaccttagagctcaccggggaagggtgcaaagccaaagaagtctgggatctaattgcatgtccgtgcagcacagagtcattcagactggtgggcttgcaactctgggcatgaagcaaatccatacagtggctcttaaccaactgtagcaatcgagtgagtcctgggagcatgtttgttttaggagggcaaattgaatactgctggactccttgctcagatgtttccattttttgtactggcagcatgactgtattgacaagatgcagaggtgaatccagtgggaaacccattgagagaagggggttcctttgctgagcaaaagattgtacaaaccttcctgggcaggtgcccgctgtctcctgcagggcaggcttactgctcccatgcaggtggatggagctaaaatggctttccatagctacttagtgaatgaatgaagagatgaatgactcagaactggtcacttcacaagccacccacttacaccattagaaagaaattaaagtagtgggagaaaccactcagcctcttattcttgttggtaacaagggtaggttttagaagggcagacattttaatataaatatccagctgtgcaatagtctcatggactttaattaggggtcctactcaccagggacctgtatgtcccctctctccttgtgtcctgggctgttggatgctaagagtgaaactttgtctcccagtaattgaaggatgtggcctctgggtctctctgcacttgtgggttttgcctggtgccagtgttttcatgtacacaaggaagttccacacttactccttgcccacacatttgtgagctttttgtagaggcatggggctcctggccaaaatctgttaccgtaattgagaaaaataaatttaaaaattaagtttgctcctataattttgttttcctgtggggaa

SEQ ID NO: 63142 - DNA, 897 bp, Bovine  19866880530802
atcccctcacgttgtagagcaggaaatggaagtcaagaaaggttaagtaatctaaacaagggttacccagccgctgcctggtggcagaaccaggactaaaaccctggtagcaaaattatctaacctagctaattattaataataaacacttttcttccaaaacaatgagcaagtgctatgctagtactgtgaagggtctgtgctattacaaaatatgtatgttttcttttctaacactggaaaattcaagtcactcaatctcacacacagaacattttcagttgcaaactccagctatctagaggactctttctacatatttaaacacacacacacacatatatatacatatacagtggatttgtttgttttacaaatgttttaaattacatctgctgcttggctccaattttctggctcatgtacacttcctgtcagtgacatctataatccaacagaaaaaaacctaagcaacaagtccttccaaagatctttagtgaagcttgcttgatcaaaaaagtatcagtgggcatctttgtgatctcagttacactaggggactctatgcagataagaataagagtgagcactgcagctaggatctagggccatctactaatagcacaagtctagaacagctttagcaaagctcagcaacctcatagcccattattcttggatggttcaccctcaagggcagcatgcataggatctgcagttgacttcattacctctctaagagtagtatctccattaagatgttagtctttaaaaatgaagccctaaatttcagcaactagcatactttccttcataaggcatgtgtgccttcctgttccacctatttttatcgtgttttttctttaaaaaaaaaaaaaaaaagcctgctccagctga

SEQ ID NO: 63143 - DNA, 1213 bp, Bovine  19866880815012
gaaaacactgttccttttcctctctcttcttatggaatgcccgagtatagaagaccagctctaaaacagtgagaggtcacggaatagctgacaacctgcagagcacacagttgaaaatcatgtcttatctctaaaaaaatctttctcacgcaaaatgttgaccaggttctgtttattctggaagagattcagtctttacaggaaaactctcactattgttaacaagatacatcttgcagttgaactaagcaatgaaacatactgttgttgacaaattactctcctatttcgtgatagaagtgtagatccaggaggagggaagatgagtgtcctctctggcctaatttgtccctggaactttataaaaatacatagttggcattatcctatctttctatgacttctccagagacggggtgcctttttctaattcatacgagggtgtcttatgggctagcagtgatcctggatgtgaattattgatctcaaagcactctgataggtgttctagggagaggtgtgaaagtgttactgaaacataaaggagaaagcaactgagtggtgcctggtaattcagaagaaagttggaattccaggcaggagtagcagaatactggaacagctgttctgcatcgtgtgaaaggcttcctccactggttggagtgttgatgtcattgaatctctcaatcaaaatcccatcagtggttagaaataagcctgaggatcagtatcagctccaatagcaacttatatttaataagcaaaattgaaaccagagcagagttatccctggtgtgtgtgtgtgtgtgtgtgcatgtgtgcgctcagtcacatccaattctttgcaatcccatggactgtagcctgccaggctcctctgtccgtggaattttccaggcaagaatactggagtgggttgccatgctctcctccaggagatctcctcaaccacatttcttatgtctcctgcattggcagggcgggttctttaccactgcgccacctgggaagccttggttatataagttggtaaatttgaatggagttgcatttgtaatgcacttagcaacatttgatttaacaagagattccttgatcctgagtaaatcaaacactttcctgtgacattgacaatataaggagaaataaaatgataagagatgaatcattctggaagcttaaatgaggatgtaacatattcttctccctttcc

SEQ ID NO: 63144 - DNA, 1425 bp, Bovine  19866881088376
cgtgggcagtcttaccgtttagtttttattcttcctgctgagggttttcacagagttgcagagctaactaatggaagagcctaccttcaagcccaggcctccggactcccagattacagccctccccatccctgggccacaccacctgtttcgacaccagaagtatctcttgtattgaccagggtaggaaaacagcagttttccacgtggatgaaaacacagctaactagggcatctcattcactgctggtgaaagcataaatggacaagcattggaaaaaagagtttggtgaaatgtattaacactgctcctctatacttttacccagtaattttatttctaggaatctatcctaaggaattaatactaaggatatgtgactaaagatttacataggaatgtgtttactggaatgctacttataatatccaccaataagaggttagttaagagtattatgatacattccaataaaaacctcattttgaagattattggtagtaaataaatattgagaagatatttatgatataagatgtaatgaaaaaagtcagcatccagatagtgtagctaccagaggaaaaaaagaatttatggaaatgttaacaatgcttaactgtgggtgatgaaattataaataatatttttaaatttttagtcatttctcatgttccaaatagttccaattttatagtgagggaaaattctatttaactttttaaatatagtaaaaacagagtaaacactaaaagcaaatagtggttagtatttaaaatcatcattttacctacactagtctataaactagctcatgtaaaaagaaaaacaaacaaatggagggctaatttgttatgttgccaaggagaagatgatacaagatttatgatataagatttgtaatagagtgtgtggtaaatacttaaagctagaaaattttggctccaaacaattgactctgttgcatgagctgagccagttccactaaatgtgcaggagctgggctctaggaagccttgctacgagaacttcttgaaagttcctctaccgggtagtcacgtggtttctgccttcactgtctttggccctggcttgtcctgtgggatcaggagaagcaggctcagccctgaacaacatccccagcaagcaaaagcccagagataatttgggactttctaggggggaagaaagagaagtacagacccagagggaaagcagccgaaggactcggggttaacattccactctgggaggagactttagtccttggagggcttccagtctgaacttggagaattcatcaacaggaaaacaaatagcttggcgtgctctgtatttactttgcctttctcaaggttgcaacataaatttcccaactttgctagctgttaaggctgaggagacatttttgtgagttcagggccttt

SEQ ID NO: 63145 - DNA, 1803 bp, Bovine  19866881260441
aaatcgctcctgctgctgcctacctgcttcccgagctctgcaccttggggggcagggagcctggcgtccctgtggctcatggtgcccacggggcccacagcagggtgtcttgaattggatagtgctgggatatccaaaagaaccggtgagggatgaaacctgggtttttgaaagttgtgacaaattggggggcagatgtaaaaatccaagactcctatgccagtggtactagatttctggatgtgtcagaaaagacaggaacagaggagggaaatctgtcagctgagcagggacacagatgctcttaatagtacaccattacattttaacctaaatctgatgaactattatgattgacattgtttgggggctggcggctgattttcctcctttcccttggtctattacaccctcactgatctcaggaggaggtggggtggacagcagggggatgtctgtcccaggcttggccattcagaatccctccttctccaccaaaatcactggccatataaaatccatccctgggattacctgctgaaccatggcccctgtccctgcttccactcttccaggctgtaaatgaaaggatcctgaccactcaagctattgacaggacccataacgtgtattgttctaatgtgttagcacctgatgcaacccaaattataaattaccataatcaccaagggtagaatccaaggttaatgatgaaacaaattaatgcgtacttaaaatatataaacgtgttctgtaactactacaagatgaaataaggttaattaaagtaattttcaaaatattaacagcaccacagttccagcgagtgcaggaacattatcagcacatttgaatcattaaaggatttaaacaatttatagagccatggagagagcacttatattttcgaaggtcaaaaaaaggatgaactcttaagcgttcttgtgttgtgtgtgagcctcttttggttttcacatactgtggcattattatatataagatttaagccacgctaatattatttctactgaattgtagatttttatttatgaaagaggttatcttgcctataggaaaaataattgattaagtttaaccgttcacaaacggacagttatttgtaggtacttaaacatgaagatctatccaagtgtggtcattagtcatctttactgctcgtctgactgcgtataagcgctcaactgagtacaaaatggtgaagctttctatagtgctactgctgctttgattgataatgggaagatagagccaccatttttaatttttaaaatgcaagattattctggagtaaattaacctaatcacacagcacaagtaaattaatgtcacttcattacctaatagcaaaaataatattaacctaaagaatctaaatccacttctgacacatattcaatttttataacgttacgttgacagtttttttctggattatatgtggtggttttcaacattagctgctctgctaattggaaattctgggactgagagcacagatgtctccgtggtgtggaggaaggccaggaattgatccagctgcatcacacctcggacaccacgccactaaaacaccactgggtagtttgtgtggccagtctgccgtaaattcaccccgtgagaaagtctcagggctttcactcctgtggcataagtggatttttttcccaagcagcccacctggagctctcgtctgaagaattcaagttctccagctccttgacaccccaacactgtgtgcggcgccagagtccaaacagtgtctacaccatcttcccctgcacc

SEQ ID NO: 63146 - DNA, 1224 bp, Bovine  19866881291838
atttgtgctttgactcagatcctagctctgagtgtgaaatctcacaacaaaaggaattaatcattaaagttctatggggaattctggtcttttaaaaatcacttgcataccatttctctgggtgacattttctgatcgacaaagcttgagtcatgggtctgttaactttttacatattgtggctacaatgatataattcaggatcttcttaaggatgtgaaaaattttttgctatttagtgactaaggactttctattttcaatctgatgaggtgtcatttggagcgctatgaactttacatacccatttatacatccccctgatgattaaaatggagctagataacttaattaacaaaaagaaaaaataaaattattatggtgtttatgcaacattgaaaaagctacttcttgatgctgaaaggcacaaatgtaatcatcaggcatttgggcaatgtctaaaaattaatttcattgttgtcttcatctcccaatcaaaatggtattacgtttcctttctccttctctgcccattcagcatttagaagagaaaggaagtagttttcagcttttagctgccattttccaagtgcatgtggtcctgagcatgctcacctaaaatctgtttctctctacccctcacttccactccatattttttttctctttatgtactttaaaaagtttaccataacttttttaccataaacaaaaacatttaagaagtttaccataacttttttaccataaacataactgaatcttcgtaaatctggaggataagacacaagaaaaatatagaggaattaatcaaaacacaaggatgattttttttccctcttctgaatgtcagctttgaaaaactcttactgctaaaggccggaataaatgttaatgattcaaaacaaagaagaaggttgtatttgtagctgtactgtgaaaaaacacttgttagcttgagtgatatccttgaattgttacagttttcttctctaaaaatgcaagtatcttttctttttctgttaatttttaaaaaataaatttatctcatttatttttggttgtgctgggtcttcattgctgcacacaggctttctctctagttgtggctatcaggggctactcttcattgcagtgaacatgcttctcactgctgtggcttctcttgtggaacacaggctctaggcacatgggcttcagtagttgcagcactcaggctcagta

SEQ ID NO: 63147 - DNA, 1606 bp, Bovine  19866880434264
ttgaaaagaccctgattctgggaaagattgaaggcaggaggagaaggggatgacagaggatgagatggttggatgggatcaccaactcaacagacatgagtttgagtaaactccgggagttggcaatggacagggaggcctggcatgctgcagtccacggggttgcagagagtcagacatgactgagcaactgaactgaaatgaactgaaccacaattaagataaattaataaaaggcagttcaatgattaactacatcagagttatgattccagtagcctcaaagacctcaaagctaaatttctaaactgagttttatggtcaacatacaggtatggcaattgaatgccaagtttcaaacaacaaataacatctactcttaagaaatgtcagctgcagatatttttattgttaggaataaaatatttatatcatggaaggtagtgatttaaaatgtgcatttgcctcatgagctaagtctttgtgtcaagcacataaagtcattaattttttaggaagagggaactagataacatgtgaaattctaagtcatctaagtgctctactatttatgagcacatgtgctcagttgtgtcttaactctttgcgaccccatggactgtagcctgttgggctcctctgtctatgggattttccaggaaagaatactggagtgggttgccatttcctcttctaagggatcctctcaatccagggatcaaatctacatattctgcaaatcccctacaaatataaatcatatttataattattttatatttattttgaatttaactaaatttataatttaatttttgtggtattcagttaatagtgctttgttaaatcaactataatgttaatttaataaaatatcttgaatatttactgaattaatttttctggttaaaatgcaataagaatgtttccatctgaacttagcaccattgctgatagaacaccttaaacaagaggaaatctaattattttgccattgaaaaggtaacagtaagatcatttgtaatgatgtagaataactgcaagatgatcctgagcataaaaataattcctgaataaaaaacaacttgatttcaaaggactgacaaagacaagagggcaagttctatggaaattggacagtatgaaatgaacagtggtgaaagaatgataagtcaagaagatggaaagttaaacataaaatatcttattatcatatctattcagaatatataattctaacattaatgaatttgaggtaacgtcaaaaaaaagctagaaatagtatatttaaattgctaactcatgtggaaatgttgcattttctgcaacaaaaacaaattttatgattaactagaggttgttattgcaataagtaatctacttgatgttaatgacaatatgaattacaacagtttctgcaacatgagatcttgttcataatgcaaatatttgttttagaattagacacaatgctctaatctttaaatttatagcaagaagcttgacgatttagaagaatgatattatagcttctaaaatggaaaaacagtaattaaaagtactgaaactaagttttagttttcagtatagaaataagtccttccag

SEQ ID NO: 63148 - DNA, 1512 bp, Bovine  19866880453051
gtcttggttcatgcccacagttttctttgccaaaatatataatgactctgatttacatctcccagctcagatctctctaaattaaacttgcagttgatcatggtacaattgtatggttcccttacactgactgtttcaaaactgaattcatcttcttcaacacaaacctctaactcatgaactgacctctgtctacttattgatcttgctttacgaaaagcaaactattaacttacatgccattgtggttgaattcacaaaatcatagtccaagaatcctattacaagaactacaagaggccaagtaatttcctaatacaacttaaaagtaacagagtcagtatttgaatacttgttggccagaatctgaagcctgtcatctctttattatagtacttggtctttctcaaaacacacacacacacacagacacaaagtggaagagaactaagaagctttaacattcattgagatatactaattttcacttcaggttaatttcttaattttatttaactctcagctatgtccttattttagtgattgattttaatttacagctaattttttatcagtgtgttgttgatctttttggatgaatattggtataaaatacttaatccccagatagcttctgttatacatatattgtagatatgattcttcaagatcaggtatgtgtctaattttaatactgtgcaaaacaaactctaatcaagaagataaatatgccttaaaaatcatgcaaggcattctaaatttaaatagaaatgaaaatcatttttggattatccataacactattttccattcatttaagattgaatatatatgcgtgactctgtatttaaatatatactctactatataaaatacatatttaaatatgtaaaatatatacatataaaagtatattcaatatagacatacatttaacttattttaatgtttttaattccatataagggaatgtgatttgagagaaattttcttttgctaatcagttgtaatcaagacaggagtctttacttaagaaaattaacaattacttttgaaaaagtctaaactcaagaacagttcctgaatttacaatcggttcgtttttactgtagacatcagaatgtatttttccttaaagatataaagagctatgatgatgtatattgaaatggaaataaatcaatttcactttggttatcatcatgattgtatttccttttcttgaacttaatgagtgggactgtatttgaactttgcttctgtcctgaagatgtatgttttattttttccccacagcgtgtgcagtttctctctgcatatttctattttactttgtaagaaaacatttcatttttatcaaagtatataacatgcacacagaaaagtgcttaaatcataagtatttaaattaaagagtttatgtcaagtgaaaacacctagatgaactcacaggtcattactaggacctagaagcctcccttcttgcccccctcaatcactacatcatcacag

SEQ ID NO: 63149 - DNA, 1621 bp, Bovine  19866880464067
cttatatagtgagaaagtacattggtttgtacattcggaagagtgataggaggcagagggcattgtcttaatagtatcatcagtggtgccacttcattcattcctgtatctctgctctgtagttatttctgttctattgaattcatctcttttgagaagactgccaatagccattggagttaaatgcttccttattggtttgaagcagtaaaaaaaaaaaaaaaaaaaaggtggggaggggtgcttctcgtcattatctaccgcaatgcatgtatgctcatccatgtccaaatttttgcaacccgactgcagtccaccaggcttctctgtccatgggattccaggcaagaatactggagtgggttgccatgccctccttcagggatcttcccagcccctgaggatggttaaacaagatccaaggataccgtgccctcagcctcaggtccagggaacaagtgtctgctttcactcggtcaggtttctccttgctctctaaggacagttgtgtaataggaggagcagcagcagttagagagactcacgactcattctgccaggctcagattggcagtgagtctggagttttttccacctggggaatggcaacatgcccagcaccttggctcatcacaccaccgtctggcttacctgccgcaggttgctgaactctgggttagactgacaccagatagccacttgtgaatcatccttgcaaatggtgcatttcctttgaaaatggatacattgctttgtgtacattactgcatcgaaatctgcttctgtgtgttttccaagtatctgatgtgatagttctgagtaatttcctatgcaaccagctctacagtcaggcaaagtaatacagaaaggaaaaaagatagagagggtattaattggatatcctgagatacatatatttatttgtgagatatttaatctcccactttaatgaattactttctccaatcttagagaaggggaaatttgagatatttaatctccaaccttaatgcattgctttctccagtcttacagaaggggaaatttgagaactaagttgcaaaatttgtaagtgtcagagctgttaagaaccttcaggcagtgtgattcctaggcccatattcttcctatgtactcctaagggccactcccagagtcgaatatctgaacagagttcccttgtgagagttgctccatcctaacactatccttgtgacttcagattcaccccagaactggttttgatgtcctatatagaggctgagaaacctgaggcccatcagattttccccaagcttattagaactaaacacagagacgaggaaaggtccttctagatcagttccaaaagaaacctagaatggatctagtggttttcgatccctttgtctcagttcagttcattcagtcgtgtccaactctttgagaccccatggactgcagcatgccaggcctccctgtccatcaccaactcctggagtttactcaaactcatgtcctttgagttggtgatgccatccaaccatctcactctttgtcgtccccttctcacgccttcaatccttcccagcatcagagtcttctccaataagtcagttcttcgcatcaggtagccacagca

SEQ ID NO: 63150 - DNA, 1709 bp, Bovine  19866880570465
ctcaggggcttctgatcctgcctgtccccaagggctcggaggctccctagagccacagccacagccacctcttgcctggcagaaaaccactctctactgattattctagacctctggttctcaaccaggtgaaattctgccccctcccatacaccttggggacatttggcaatgttcagagacattctgttatgacaattaggggcgctgctcttggcattgagtggatagaagacaagaatgctgctcaacgtcgtaaaaaatgcacagaacagctcccagtgacaattgtctggccccaaatgtcaatagtgctgaggttgagaaaccttgccctggaaggcaacactccgctgtagttatggccaagcccaggtaggggtgggagcagaaaaggacagaaagtcaataatgaagataaccttcaaggttcctcaaggaccctaccagatctgtgtcagggttttcaagacaggagagtgaaataagcgactagctacgctgcgtggtttcagaacagctcagtgtgcacttgaatcgaggtggcattagataccctgtgtgtttgtttgttttttcctgttactatactagcagcattgccagggcaaccttgagactcttcaaaggttcactttaattgcttagtatctaatatatacattaaaaaaatgttcaacaaatggaattgtattgtgcaagacccactctaccctaatctttaatttaaatcagcacttaaggtggaaagagtgtcctgaatctgtgttttagtcagacggctgagtggtcattagtataacatggcaaacacagtcccgaaccagaaaaactgcctgtatacaagtactggctctcagccagatctgaactcaagagccagaagtgttcagaaggcttcagattcacagtggggctgttcaccctggttctggtatttatcgtgccaggtgacagagtgggtttagagtgtgttttgttataagctgaacttaaattcaacatcatgagaaagcctagagtttaatgttgcagttttggatacctgtctccctttggattctttagtcaagctcatggtattcctcgcatattagtttttgattggcagtttcaaggttttgtgaatgaaatgtgtggtttgtaagagtcgaattgtgagccctcacataatgcacggagcaccagtttcccacccagcccagcagtggaccctctcagtgcccatctctcttctcccctgcagggcaagattcactcaaggggagtgactggctgaatgtttttgcatcttcctaatcaggaacggtccttaccctgatactgctttccggaagctagtatgacacaatttaaaaccttcctgtgcagttaaatctggccccttagactctgaagaggaaaaaaggaattattacaagagaaaaatgccatgtttacagaagagtaaaagtggagtaagtcggtagatggtgagctggcaggccagaggtgtcaccagagaagaagcctgttcaaggctatttctttctttttgctccagaaatccagtggtaaagtcaccatcaagcaaggataattacaaaagcggtttcaatagctgtatactatgtatattttgtatagcaagaaagaaagagagaaatgtcctcttagtaaaatattcacttttgtcaaccctaaaaggttttgctggtgaccctgttgta

SEQ ID NO: 63151 - DNA, 2066 bp, Bovine  19866880605509
tcatagaggatcctgctgtgatatatgtcagagagtgttttgcctatgttctcctctaggagttttatagtttctggtcttacgtttagatctttaatccattttgagtttatttttgtgtatggtattagaaagtggtctagtttcattcttttacaagtggttgaccagatttcccagcaccacttgttaaagagattgtctttaatccattgtatattcttgcctcctttgtcaaagataaggtgtccatatgtgcgtggatttatctctgggctttctattttgttccattgatctatatttctgtctttgtgccagtaccatactgtcttgataactgtggctttgtagtagagcctgaagtcaggtaggttgattcctccagttccattcttctttctcaagatcgctttggctattcgaggtttttttgtatttccatacaaattgtgaaattatttgttctagctctgtgattaaacaactatctttaagtaaagcacatatgccatatttatcaacatttgaatgaagcctgtggtgataattttactgccttaaaacaacccacactaatgggttttataatttgcaaaataaagggcattcgaatgcttttaaaaaccaatttgtcaactgctgaacttttactactttgtgatccatttaattgagctgttctaacccatctttctccatagtacaactttacccctccaccagtctacttttatttgttatgataagctgaagaaatgtatatataattttaagatgatgaattttctttaaggattccgataaaattcagtcattgattaaatatttaccatacaagtgttcccccttagaatgacccagttccaggtaatggagtgtggtgagatagggaggacaggagaggcacaaactggaaacaaataagatatgatcctgagctcttaatgagatatgcatttgaaacttgaaactagtttctaaacatcctaaataaaataaatttcctgtgactttacatgagaacaaaacagatataggtgaatctctgattctacagatttgaaaataacatcaaactttcttttccaatgctcttcacatccctggtaggaccaatattctgttctgtcaacctttcacttcgtacactgccactctattctttccatttgccaaatcaagaaagagaacgttccatttaaagtctgaaatgaatagcatgtgatagcagcgctggagcagtttttgcattgatgtacataaggaactggagatcacaggaccccccgaggagtaaaagctagtcacagttgatactacacttgaaatacaccatggactgcaattttaatgatgcaggcatttaagtttatcaatctgttgtctttcatcaaaggagaacagcagtccttttacattcccagagtaatgaaggggacagggtaggaaatgaaaatcggagaaacgcacatcttctgctgaagtgactagaggtcagagaggggtttggaacctggatgaaaactaaccaatgactaaggtacagactgtgaaatatccagtcaagccagtctcttccttattagaacaagatttgattttttcttttttttcttcacctaaatcatttccacaaatatttatccagcacttcctaagaacaaggtacaacttcatattgctagtaatttcaagataatcattttttaagtgctcagacagagctttttaaaaatacgtatgtttaccacttcacagttaaataaaactaatcacttagcaaagatggcagcaccatattaattaaccattctcaataacaattgcttttctctttgtcctttgattctttggtcactgtacatgttacatgtacaatcacaccaattctgttaaacttgttttaattattggtagcaacctaaagtgttagtctatttggcagaggtctcttttaaagtggccaacagtaaatgattaatatagtgttcactgcaataccactgttggaataacctgcaattaatttatttcctggtaatatggatataagcacaattgca

SEQ ID NO: 63152 - DNA, 1723 bp, Bovine  19866880622215
attctgaagcttattatgttatatttgatattattttcatagtccaaatatcctcatgacatctttttatacttttaaaaatcatcttttcctgaataaatgcagaagagaagagatctaccatgttcctgtccttatttcaattttgttttgctcttgacttcacttttctttactctcttgaaatgaacataatttctggtatttaactttgtgattttcatctctctgttcagatcctcattagaccttgtctttgctcttcccaagttccttcaactcttaatgtatttcatacttttaaaatgatgagtgacttaagacttcttctccaccaaagcacacatttctcattattcaatgagaaaaagacattaatttttcaaactctagaattaaaattaattatatcacgttccttgaagaaatggtcaaaggaatggaaaggtcaagttgaaattatatttcttcaaactgatgaaatgttttcattaatagggtccctggtttacactctttatgtttctcattgttccatccttgattttgacagttttcttaatattagtgtactatcgaatatatagcagtaatggagagaaaaaatagatttgttgtaccaggggcttcaagacttgcatgacagtaagatagaactgacatttatttaaaataaggtttgcctgacaatatatagaaaaaaaatttgaggatggatgataaggacagtaaaaggcagtgaaaacatatttaatattatgacagtaaaatatatatctagtgttagttgtacagctttccaaaacacctgtttttctattattagaaagtacagacaaaagctttgaaatttcagaattcaaaactcaagaacctgaatacttggatgctatttcaagataataaaggaaatttattgttttgaaaatgtttataaaacacaagttgaaactcttttagatttatgatgtcaatgtatattctatatattgtaaagtataaattataatactaatgagccttcacattaaaaaattaaattctcatagttagggtcttttatcctgtacagtgttttctgtttcaattctagcagagcataaaagtcttaatgtcaagaacattactaaaatatttttaaggaagtcattgttattagtgtggctcatataccagtctgcaatgggaacacaacttaagatttgttaagaagacaaacttactgaattctgaatttcagatatgtgatggcaatatcatgaaaccagttccatggaacacacaattatcttatggctctagaattgctgagtatattcatactttctggactatatttaaatagaatattatttccattatatatattcaatctctatttcttcatctaaaatcactatctctaccactttgagtggctgccaataaataacacaagttctaacatctcaaaacttaaaaaagtttataacatgtattataatagcaaaggtaagctatatcaatcaataacagatatacattatttagcataggatatcattaaagatggaagttgtaattgcaattttaacattttaaatgtacaagtggaatcattgtgtgactattagtatcagttgctacactactgatcatcagcaaggataaaatattttcttattgataacattcatcttattgcagaaaaacgctaaacatgataatatactataattattac

SEQ ID NO: 63153 - DNA, 2239 bp, Bovine  19866880644772
ttttaaattgtaccaattgtattatactggtttcagttggtttgagacattttgaccccctgttttaaatatgtaactccatagtgatgaacttctaggataaatcaatctgtctctaactcagagtatcctaaaaatggcaatagaaactttgataaatataaagtggctacagaatcttgcttctgtgaaaacgtttgagcttcctaaaattgttgtaaactctcttagaacttgtttcctggtggttcagcagtaaagcatccacctgtcatgcaggagatgcaggttcagtccctacatggggaaaatcccctggagaaggaactggccacccactccagtattcttgcctgggaaatctcatggacagaggaagcctggtgagctacagtccatggggttgcaaaagagttgaactcgacttagtgactaaacaacaacaaaagatgaagctggtagaaagctatagaataccttcgcttttcaatttgtttgctatagttaaaatgcgatgtcaacaccagagtttttgttttttagtgaatttcctgtctgcagctgttgaagagttaaagaaacatgcttgaagtgtctaaaatacttgtttctcttgcccagaagaatattccaatacactttaaacatatcaaaatgctgattttttattaattcataatctattagttatttggctgggagaaccattaaggagaaattattatagatgccttaaaattacaaagcatctcatttcacgatgaacattctttgtacctgttccatgaaatgacacaactgtggtgactgatggctggaggaaggtgacagagtaaacttgcatgtcaaggtatgctcaagaagttgactctggagggacacgtctgcttgttttaaagtacaacacctgagaccaatctacatcttggcagtgctcattaggaagccaactgtagactaaacactctccctcagaggggctttaaccaagttggagctcattaacaaggagtccatggtgaccagaaatgtcttctgcagattatgcagacagaccagctttcttcatgtaagtctggttttaataattcctcccaaaatctttctcaattagagcaaattgacactacattttccttaatacatttaattaactcttcaatgatatatagggcattgggacatattctgttgctccaatcacttatttctcttgaaaatttctcttgaatctcacttaggccttatgatcctctgatattttctctattaaaaatgtaaatagaaccctggagcgactaatttgaaggttaacagttcatctgcaaatgatgtagaaatacaggacaggcacagccttgagaattaaatgttctttgaaaggccaaagcgttagatttttttcagttgttaaaaatgttctcttgtgctctaaatttgtattaactctttagcagcactgaaatccctttttgttgttgtttggtcaaacaaaaatactgcctccccaaatgcccgatatgattttaggaaagttaacatatttgttgtacaaaaaaaggcatacagtctggagttaggcagtcctgaatttaaaccctgatctgtcactcactagctctacaaacttggaaaattaacctctaagattatttctttatctataaaatggggttaaaaatggcacttctcagggttgttatgaggattataaaatttgatacatacaaaatactcagactaatgcctgacatatagtaagctctcagtaaatgtaagcttggatcactgctgttgctggtgttatctataaaacaagaatgattaaaataacacataggtagtgcccagcaagtgcttatagtaagcctttagtaattgatccttcctttccctaaggacctctgtgaaaagaatcagtcacatatttacaaggggaaaaatgcagcaaattgatataaatgggttccttattatataacaataaatttaaaacaggcaaaaactattgctgtaatgttaaatgactgcgtatggcaaaaagaaactgaaaatacccaacacaaggtcaagcgatcagccttacaagttaaaaatatcagtacatcgttcctcctgttatgtctttcccaactctcatcatcaacactgggatctctgtagactctctctgatgaaataaaaccaccagagttcagaaggactacaacaaccagagctcataattctggagccataa

SEQ ID NO: 63154 - DNA, 1619 bp, Bovine  19866880663329
tgtgaaaatctgttaatacaattaattcccactgcttaaataacaaagctactcttgtaacttgtttgtttgtttgttttttttactcatattaaagtcactaactaatttcatggtaatcactcattgattcatatgtgatattgttcatttctctgtttgcttcatttgtaagcagattttgaaagtctgggtaagatttaggagaaaatgagtcatgttttatacatagcaacatctcttgaccaagaaagaactcacatctttacaaaaaaccatggctttttctcttttagtcgtatgaattttcactttcagaactaacaagtcaattcatataattaccttgtattgcttagatatgtgcattgcatctcacaatgattcttcctgactcctccatgcttttggcaggagaaagacagactcacagctattctgcttgttagattaacatcagaaagcagaatttgcatctggccgctaggcctttactcatcaaatcggcaaatggaactaatgtggaataataataggatagctggtttttgagaaccgaagactaaaagagtttttataaaacatgcagttcacatttttaaaaaaatcacaaaagccattaaacatggaatccatctcatttttcatgtcatctaatgttatcattttcttttctaggacattcatgattcttgtgctacaagtaatgttgagaaattattgataaccatttaaaatgccagtcacataaacagtgtttcttgtctttggataaaatcctataacccgacctgtgcattttgcacattttaaaattatatttaaataatatcatttaattagagattttttttaagattatagtgaaatgtgatcctaggagatgatcacaaaaacggcaaatgctaaatatgaattttctgtattgaatgcataagcatcttttttacattttttcttccatcttatcttgatagagtgattgaaaatactccagggaagagagaagtttttaagaggttcttttaaaaaatcaacttaattatacagttaacttctctacatgcatattaatgtatgtggctatttaaagtatatgtgcatccttctctttctatcaaaaagtgagctaacataatttatcttctgaatgattgaaactaccaatattccctggaagaactagataatgccacttaaaattttttataaattcagattttttagttgcaaataatagaatggttaagaattttaattgagtgaaccaaccttcaagatgaccacgctaccctgaaattattttttgtttccctgttttacatgatcgttttctaccttgatttgtacacgtagaacatgtgcaatcagatgctagtcattttctcacattcataccacagtgtcactggaattttctccaggtctttttctgtgtctgtctcaatacagacactctctggtactcctctcagactaaaggtagatgataaaaattgaaataggattgagacctttgcagacatcctctcttcctcatttgccagattgtattgtttgctttgaaatacatcttggagacatggttgaaaaattttagagcagtgtgcatcaatttt

SEQ ID NO: 63155 - DNA, 3303 bp, Bovine  19866880665417
acaagggccaatctgctctttctgaaatgtctgctcaatgacttcccattcgacatctccacaactggggcctcccccttggatatcagataccaaattagacttgagccgtattttcctgcctctttatagatctagttccagaatcttggtgtcctctccagactctctcacctatgtttcatgtctattataccagcatgtataaagaggtatattttaattccctgctgggagcaaactactaaatttataaataccaattatttattagctaatttttaaactatcagaatatttctccctgagataaattattgtttttaacatgcaagtttaatgcaataaatgtttaatatcactgacgcatatttatttatatctcatcttgttgcaagaaagaatttgagacacagtcagaactgtacctagcattgacattacttgactaatagtgaaactagtaccatatatactacaactcagtatttttatgaactaacaaagggttaggaatattctttgccatctttattagtctattagctacatgttttgattaatgtaagatttagtctgatgatacaacactgtccagaatcaggtagcattaatgcaaaacgatgtaatttaatacacaaaatactctaatcaccatgggttcacctgttgtagaataactgcaatggaggactattgcatatcaaacctttattttcattgtctcacatactgaaaatttagggaaatcattctgatttagttatattttactctatcttctctggtatattaggtattttctatttttctacatttatcatgtgaaatgttggaatgtaatagaaaactcaatatgagttgtattcagcaaaaatggaacagttgagcataactgtgctgaaattagctgatgtatgtgtgcttgtgcatgctgtcatttcagttgtatcagactctttgcgaccctatgaactatagcctgatagactcctctctgtccatgagatttttcaggcaagaatactagaatgagttgccatgtcctccagggggtcttcctgacccagggatcaaactctcgtcacttacatctcctgcattgtcaggtgagttctaaagaactcgccactagtgccacctgggaaaccccctatgaaaaggaaatgtattcacattgtaagtatcctcagtagagcagaaggctccatagattatacctctttcattacagttcatcttacaacatgttcaatgctgcctccacttttgcactgtgtaaatattttctgatggcatcaagtcaccttttatatctgctttcccccaaatatgaaataagcattgaattatcatttttatatttaatatgctaaattataatgttttttaagcagaatgagtgtatatttaatgtttatactgtaaaatgtttaaaatgctggattaaaataaataaaactcagttcaaaacttttctctcaatttcaaatatctctatggacaatgatcctttggaataatgacacttaaatggatgcacttgtctttagatgaaaactggcaagaaaataaggattcgtgttctttctttctcacattgttagctatttttatgggttaagatattttttcctctattctactgtaataatattccaggaagtagtctttgaatcacttgccaaccctgctttcaaactcagagccagaagaaatgttttcctatgtgctcattatggtacctttttcataaggtagcatattttgttctatataaaaattaggaattttttttgatctttctcccagtagactataagatctttgagggtaaggactacgtcttgctcacagttctatctttcatgcctaacacagttcccaatatatgatttgttaaaagaatgttccatggcaggaaccctataatttaattttttgcagccttcattctaccaaggaaattctctcctatggtctgtgctcagttaacactagtatattgactagtgttaatatactagtcaatatatatactagtcaataatatactagttaatatactagtcaatatatatactagtcaataatatactagtcaacacttgactcctattttcatggagacaagtgttaatgaaagtcaaatcaggtactggctctgacatcaatttaggtatagaaatttgaagaagttaatctgtctaaattttagtcttctcagttgttgatgtggataataagactctgatttttaatgcagattgtgtattataactgaaatagtgcctgagaaggataaactactctacaggacagtggttgttcaactttagaatcactttgatgtcatttgaatgacattattaaatgatggctgagcaccactcagaaactctggggtttgggaatatgaatttctcacaagctctcgggtgtgactgatgctgtcaatgcaaagatcatgctttgagaacaattgatacagggaactgttactataaaatggttaaacatttttgtttgctcctgtattcatattataatcctttaatatttacatatttcagttattttactatcctaggtggatatgttattttctatttcaatacttagtagtttaaaaacttttatattttgaaaatttacttaataaaaaatgaggtaaaatattttctatccataaattttaatatattaaaatgaaaaattatttgatcagctctacagcaagatgaaaaaatatattaaagaactttttagaaaatgttttcaatggcatgtatattgcattatgatataaatccatgggtcataaaatacagttgaaacttacagaaagttaataaagttgaataacaattaactcacaatgtactaagctcttaacaaaaataggtttggatcttgaatttaaacagtctgatacattaatctactcgacccacactactaattggaatgcatgctcgcagcatactatgcgatagacttgttgaaagattatttctttgccagagcatattcaatattcaattattttcttgttaataatttatcctgcataatagagaaaacacagtaaataaccatctgtctccagagcagcttttatatttacaaatatacacaacatagaatctcagcaagaggcacgtagaaagaaagaacattccaggttaactgcttaaataaaagaatttgccagacttctatcttaaacttgctgctattcttggctcctagtttggataaaataatgacaacccaagagggattacaagggggagaagatag

SEQ ID NO: 63156 - DNA, 1972 bp, Bovine  19866880689775
acattctgatttttaaaagttaaacgatgactttgactttattaagtgttatctcctctacacaaggatgtcaggttttaaaaggtcattcaaatgcatagccatctacatatatcttctttttcaatacatactgatactctcttgaatatagaacagtgttttcaataaatggtacctgataaatgtgcttttgctgaaagtatattggttaggaaaaaagaaaagttctatggtggaagtggaaaccattattaaagtgagagaacaaaaatccatttattcttcacaagcaatttgcatatggttgagtttgagacttagaactgttctgaatactctcatctcattagtattgctgggttctttctttctcattgttcattttcccttattcaagctcagtaaggcagatagtcaattttattaatcatgctcagaaaaattatttactgtattggaagttacttggctatataagttatgatctatttgaaatttggaagttaatttagagaccattctggagtagaaactagattaactaaatagaaaggtcttttaattattataaaatctggtatctcattatatgtaagtttatctggttagcttaaatgtgtgtcagtcctgtaacctactagggctaacaatataattactgacatataaaaccatcatctacaaaattaacatacacaaataggttgtgcttctatacacttggaaaattgtattaaagaaataagaaaaagcattcccatttacaatagcattcagttcagttcatttcagtcactcagtcttgtctaactctttgcgaccccacggactgcagcacgccagtcttccctgtccatcaccaacttctggagtttactcaaactcgtgtccattgagttggtgatgccatccaactatctcattctctgtcgtccccttttccttccgccttcaatcttccccagcatcagggtcttttcaaatgagtcagttcttcacatcaggtgaccaaaatattggaattttagcttcaacatcagtccttccaatgcatattcaggactgatttcctttaggatggaatggttggatctccttgcagtccaagggactctcaagagtcttctccaacaccacagttcaaaagcatcaattctttggcattcagctttctttatggtccagctctcacatccatatatgaccactggaaaaaccatagctttgactagatggacctttgtcggcaaaattggctggttgttgtattgtctgttaattctcattgctaaataatgttctcttgactgaataaaccgcaattcattatccacagttgattccatttttggctgttatgtattatgaacattcttctagatgccttttgtgaatggatgtgccctctgttgttgggtaacagtctaggagtggaattgcagggttgtaataagatacttctgctttttcttgtcttttctttcaacatattttccttcacaaatttcatcaacaatttattctggatcatcctctaaaatgtgaatgattcgctattttatattccccatctctctgctctcttaagcatcagcaaaagtatgcattagtcattaaaaaaaaagtccaagttcaagttcttgactgtcatcccctctgagattgtggactcaccctcctgctacatctccacgtaaagaaggattacttcccattggaagtttggactcagacatctacctggtctgctacctgtgggaccacatatgaaatatgaaaattaattttgtccatttaatttaaagcctaggaagaaaaaaacatgtcaggatgaggacatcccccaccccctctttctagaaggccccaccctggttcccctctgggcttctaagttgaaagggtttaaagatagaatgggatgcctccatagtgggggaaagttccaacgcctgcctgaccacagcag

SEQ ID NO: 63157 - DNA, 2954 bp, Bovine  19866880772524
accccggcccccttatttcttctttctctctgaagtaattgtgaacccaggttatggaagctgttgatcctggagaatgcatctaatattctgaggatggagtagaaaaaaaaatctcattaaagacaatcaattaaaagaagcctgaaagttttcttgatgaggggatacactggctttgtgttcttttgaatggctgccttatcccagtcactctcttagacttgaaggaaaggcagtcaacctatacagactgtattaggagccatgcgccccaagttcctatgactgacagagggctttcacttgtacccaggtaaagcaaggacaagtgaagctgcattcccatgcttcagtgaagaacaacccttctgacacataatgcaacctaaatacagcagcaaaaatgattgtgttttccactttattccaccatttctctctgaaactttgacatggctcaaaacccattatctcccaaaatctatgaaggccaaggatacatacagtaaaaagtaggcaaaaaaaaaaaatacttaaagggtattagtaatttgtaaaatagtgaggcaaaactgcataagtaatatgtcccaataaagcaaagttgctgagtcaaaaaaatcattaacataaaatgaatgaggatcatcaaaggaatatagttagaaattattctataactaaatcctgattcataacttaaaaaatataatagtggaactaaaaagataaaagaccagctagagctcaaagtggaagaaattactcagaatagagagaagaaatgcaggaatataaggagcataagggaaagataaaagaactggagaacagatcctaaagatataccaacagtaagtatttcagaaggtgaagaagaaatggaaatcagagaataaacaaataatccataaactaataataaacaaataatccataaaccagagaataaacaaataatagaataaacaaataatccataaactaaataaacaaataatccattaactaataataaacaaataatccataaactaaaacaaaaacttgacccttcagatcagggatacatataaaaatattttcatgacatttcaaaaagatccacacaaaaaacaaaatattttaaaatatatgaaaattatactggtagattttatataagctaccaaagcaagaagatggtagaacaacacatagagattagaaaaaaggactacaatcctcaaatcctataagcaactgaaaaatccgttaatctctcaatacattacaacagtctcctgggctttccttaacttgagttatccacgttaatagaacctactgaccttttggtttcagaagttcatagaaatctctggtctataatgtcccccccatctactcttctcagtatttccatgaatatagtcacatgtttacatttcttcctttacttcagtggaatttggagacaataagggatataaatgcttgtacttgtgtgtatgtgtgtatgcacatatgtactcttctactgtatcttatacaaaaataggcttcccagttagctcagtggtaaagaatccctctgccaatgcaggagccacagagaaagttggttcaattcctgggtcagggagatcctctggaggaggaaatggcaacctactccagtattctcgcctgaaaaatcccatggagagagaagtctggggggctacaatctatggggttggacagtctatggggttgcaaagagttggacatgactaagcatgcatgtacattaacgcatgcacaaaagtatttaagatattttggttaaatgaatatgcatacatataaggatttttgtcatgttctttcagtgattagaagacaaactatgtgcatagagtaaaggaggtttaggagtcaaagattcctgttttgatttgcccctctgtactccatttaatagatggaattagtagatataagtatataagtatagtaattatcttaacactaccagggatcatatcagtgaattgattattttaaattgctgttgacagactccactccaattaaacaaaacaatagtgcttcacatcatattgaattgtccacttagatttttctctattaatacatgtctttcgttaatgattgcataattgcttttctacaatttctaattcatagttttgctttgttttctttttaattttacctagggcagactaagaaatgtgctcaaaataagaatgtgtggttagaaggcatatattaagttgctttgctggcaggcagcatatatttttatttttaaatgaaggtagtgtctatcttttgctggcaattgctactggcactcagccacccatatcctaattttgcaatttttatgcctctgtgctaggcagatgtttatctaaatcatttaaatctctgtctcctacattttagacacatttagtattaagagatgctccctgtataacagcatagattaaaagttaattaagaagaagttaaagaaagagaaaagtaattactttttccatagatatttgtttcatttttggcaggttaaaatttagaaagtcttgaaaatcaaatttttctaaaaaaaaaatcattattgtttgcttcttcatacactgagaaatgccaagttaattaagaaaagcaatccacttagtaatgcaggataagctaatggataagcaactttgctcattcagtagattattttataggattgatgtttttaaaagctctatatgtaaattatccatcaaaaatggaaatcatcaacatgtaattagaaattctcacaggatttcaaatatagtagggtataagaaagaatttgaagtttttcccaagcacttctaaaatatataaactctagttgaaaaataagtgtaatgaagtgattttacatatctgattttatgctactgggatttaatggggga

SEQ ID NO: 63158 - DNA, 1908 bp, Bovine  19866880828902
attttattatttgaataggaagctggaacctcacatttacagcatatttggcaagctttggaatgtaatgtagaaatcagaaccatctacaaaagatgcattcgccatactctctgatgttgagtatagccagattttataagtgaggccaggtcaagagtctccaggtgagaaaggagcttcagtatctgtgcctctccaatgggacataggtgactatcatttttctggccttgggaaactctgattccaagtagtaggcagtttgttacttcatataagctgaacaaagcaaagcaaaagaaaaagcattctattagatgtctatgcaaatgttcttaggactagagcaatcatttaaatcaggtgaggacaggcagttctgcctctcatcacctcgactatggccttaaccctcagccttgctttgaaaaccagacctcactttgtatcctcagagcaatattaattcagaacttacttggatttgttccttgggcaaaaggttaagtgatccataaatttatttccctgcagatttggaaaaagaaaagtaaatatcacagtgatacgttaggcaggttctgcagcatcaaaatcgacttcccctcctgttgccagcgtcagtgccacgtggtgaatagaaaataattaaactatttgtggctcactcatgtgaatgatgccagtgaccagaaagatcaaatcctcaaaaaaatctgattaataaggaatggctctaacctgatccttgtttgactaagaactaaatcccattacaaatgtgcaaagaaggataattcagctctgtgaaatggctttttgttaacataactccactatgaagaaatgtatagtgtccccaaaccaaaacatacttgttgtaaggtagaacctacatttttcatatctaaccttagattttgtggttccctatccagtgactcaacattagtgtaataaggacctttataattcctggcagatgctgctctgtggtgcagattttgtgattgaaggtaatagccttcagacttaaatgctctcgtggaggagggtatgcttgaaaagataatagtggtggagagattcttagagtttgccgcatcctctctaggcaacaatagctcagttattgaatatccatcaagtgcatgtcattggtctgtgcttactgaaagttttcatgttgaatcccagaatcttttttctaaatgaagagcattgccttcatgtctctttgtgtgtccaaatcattgttcagtttgcaaccagaaactggactttttcctctgagagttgtaaaaagatgtgccacatgcagaaaatcatagagtagaatgagtcctgtaagatcagcccttttgtcctcttccctctcttaacacaactaagggttaccaagtgtcacaagctcaaaggcttgccatgtgctccagacctctgtgcctctgctcatactgaagccccctccctaccttattacccctccttcactctcctattccttaagctacaaactccattcagtcagtaaacttcttattgagcacaatattcagcgttcatccttggcaatatatagtctaatggggaagacaggcagttgaacacactacaggagagaggtatagctactgtggaggcctataataagaggttctagacttagttgagaggtcacaggaggctggactagaattagaaagtaacttaataaggaaaaggaggtgcttggagaaaagaacattccatcagagagaatctaactctgggaggtgggagatacaagggggcaagtgatataaaaattaaacagaaggaagattatgtaaaccataggacaaatgggaattcatcaaaggataggcagggagtaagatgatcagatttagatttcttaaaact

SEQ ID NO: 63159 - DNA, 1850 bp, Bovine  19866880902063
aagttaaataagctgggtgacaatatacagccttgatgtactcctttcccaatttggagccaatctattgtttcatgtccagttctaactgtaggttcttgacctgcatacagatttctcaagaggtaggtcaggttgtctggtaatcccatctctttaagaattttccacagttttttgtgatccacatagtcaaaggctttggtatagtcaagcagatgttcactgtttccattaattaataaatatttctatattgctagggtgaggcttgataactatatatctcaggcctgatctgaaatttcagaaagtaattttctgccagtagataactagctacttcatactattgcattcagctaagcaagcatatttgttgtttagtcactcagtcatgtccaactcttttatgaccccatggactgtagcccaccaggctccgttgtccatgggattctccaggcaagaatactggagtgggttgccatttccttctgcagaggatcttcccaacccagggatcaaacatgtattggcaggcaggttccttaccactgagccaccagggaagcccaaccaagcacatactgggttttgttgttgttgttgttgttgttgttttttaatatttgtaagacacagtactagtcctggaccatcagaaattaacagatattcagttcgtattttcaaggagttgatgatttcaatctacctgacagatgagacctcatacgttctttgagatctctgaaagaaaagacctcaccacactattggcaactgccacacttaattctcagttctttgagctatttgtgtgtgtgtgtgtgcttccaattccttaagaatcaatgcatctccatttccttcttattccaggtgtcagaagagagaaagaacatttggtcaccatttttacataataagccttcattccctgagagttattgagtcatacctctgttttctctttctagattaaataattccaatccctttaaccttttctcaaaggtcctatttgccagccttcagtttaatcattttcactattccgctctggagtctctccaagttttctgcattaaaatttgttgctttgccattaaggtcactctaagacttattctttcacctaaaccaaggcaaaagaaaagcagcacccacccaacccccaaagtaagagagtatataggaacatagatttcttctttgaggtattcatgcaagatactcacatgctgaaagcaaattagtacttacggtcaccaacattaaggagaaagggccaagaccagaagaatttctaaatagtgccaaccattgtgcttgacaattacctaaattacttttaagcagataaggctattaacagcaaacttgaagtttgctctagttacagctgaagttctcagataggtgctactaaaatcactgttaatgagatcaaacaggagtttttgattcggtataatacccctggctgccgagcagactgtccagagattactatgctatttataggcagcaactttggtgaatcctgggaaactgcaaaagattcatctttgtattctgtcaatcaataacaattagtatttcctgagctgagtcacagacagagagaacagacttatggacatggtggggggataagaaggagagggtgggatgtatggagacagtaacatggaaacatatattaccatatgtaaaatagatagccaacgggaatttgctgtatgactcagggaattcaaactggggctctgtaacaacctagaggggtgggatggggaaggaggggaggagggaagttcaagagggaggggacatatgtatac

SEQ ID NO: 63160 - DNA, 967 bp, Bovine  19866880915007
accaggctcccccgtccctgggattctctaggcaagaacgccagaatgggttgccatttccttctccattgcatgaaagtgataagtaaaagtgaagtcgctcagtcatgtcttgactcttagtgaccccatggactatagcctgccaggctcctccatccatgggattttccaggcaagagtactggagtgggttgccatttccctcccttgaggcatatatatcccacaagaatagaatataatcaagacaaatcaggccgaaaatatttttcttgacttctatgcaggtatcacttgattgtggcagaggaaaatccaatatacattttaaaacaacttgtcattaaaataaattaaagaagattcacaccaggacaaatgtttttttagaataactagctccaccaagatgtatgcaatctaattagcatgatagatttatgccaatagcattttccagcaacagattctatggttcctaaaggcagaatttcatagcagggtaaggctaacgattacagtgtgtgcacggtagtcctagcctcagctccaagcacaaaagcaaatgcctttctcttaggtgttctgacaggatgatattaaagagcaacatgtgtcagaagatataggaaatcagctgccctgtttggcaggttttacagtggaatgtttgtactgtcagggcgatgggtatgacaaacctgagaggtgacagtaataggagcatttaggtaagagaacaagcttaatagagatgccactgttgacaataacatgcttatgttaagagtctttgctttcattttctactggaaattccaaagctcacttttgaaacaatgttttgttttgttttgttttgtttcctctaaatcttacaaaaacaccttttagttctttgcaggactaggagactaaagttccagtcatatctatttttcaggaaagctcagatcaggataca

SEQ ID NO: 63161 - DNA, 1477 bp, Bovine  19866880965653
tgctgtatcttaagatcaatttgcgtgaaggccaattgaaacttacgctctctctgactgagctacctaataggagaccatttactattgctctgctgcatgagcccttctccctggctgggtggctggctgctgagtttatgccattgttcataaggggaaattgggacagtgtcgacattgagtatctgtaagagtcacaaacagcttgagttttaaagggctctcagagagcatctagttcaaagcctttcattgtaaggcaaggtgctgaggcctggagtggtaaagtgaactgttcagtgttgcacaattagcttttgacaaatctcagggaagaactcacaccacctgaatccctccttagcatccccgtgttgagctgaatagtgtttcccccaaattcatgtccacccagtatttcagaatgtgaccttagttggaaaccatgtctttgtagatgtgatttattacaatgaggtcacactggattagggtggaccctgatccggtgatagggggaagggtctttataagaagagaaaacagacacaaagacacataggggagaaggcaatggaagcagaggttgaagggataaattacaagccaaggaccactgaggattaccagaagctgatgtgaagggccaactcattggaaaagatcctgatgctgggaaagattgagggcaggagcagaagtgggtgacagaggatgaggtggttggatggaatcaccaattcaagggacatgagcctgagcaaactccgggagatagtttaggacagggaagcctagggtccacgcggttgcagagactaggacaagacttagcgactgaacaacaaaccaaaagctagaagcagcaaggaagaattctattctagagcctctggagggaggttagccttgctaatgccttgatttcaaactcctagtcttcagacctgtgagagaataaatttctgctattataagtcacccagtttgtggtctgttattttaagccagctgggtttttttgacagtcctaggaaatgactatagtctcttttgcttaaccatggctcatctcaggcatccttgagatgaaaagcccacagtgtactgccactgccagcaagagtcctatctgcaaatgaaaaggacagcattttaatctgtaaattgaatggctcttgcactcacacctgacaaacacacttactgttgtttttgttccaattagctgtaagtcaccttaaatctcatcacatgaagcagtgatctatctaaattgaatgtaaatatattgctgcttgcttttataccaaacaagaacagaacatggagaaattacgtaggtgttgtgcatcttgaaatctagagttgataaggaagaatagattattggaggtcagggtaagagaaatattgatattctgggcaccaaatcaccatgaaattgactgcattgcaattttcgaaatcctct

SEQ ID NO: 63162 - DNA, 1641 bp, Bovine  19866881106432
ataaaagagccctccgtgccctagatgccgtgctgtccatgacagcaacccggagcacttgagatgagagtgaaagtgatggtcgcttagtcatgtctgactcttggcaaccccaaggactgtagcctgtccatggaattctccaggcaggaatactggagtgggttgccatttcctcctccagggatcttcctgacccagagattgaacacgggtcttctgcactgcgggcagattctttaccaccgaaccatttgagatgaggcctgtccaaaatgagatgctcagtaaatgtcaaaaacagatatcagactttaaagatgtagtatgtctttgaatagaagagaaaaacaggaaaattacttattgatattctttatatctacatgtgttgggcaacaatattttggatatattaggttaaataaagtgtactgttaaagttaatttcatctccttttactttctaatgtggctagtttagaaaattgaattttagaaaatttacttaaatttgcaaccaaatttagagaatttaaaattcagcatatgactcacatactattttcatgagatggtactggtctcaaggaattacagaaggatgaagaggtgttaggagtggctatgagaaactaatttttacataatttggtaggaagaaattctagatgttgtggaaaagggcataacttttccacaggggttctcaaaacacaggcccttgatcaacagtatactgtgaatatctttgaaatgcaaattctccagccccaccagacacttactgatcagaaactctggatattgtgtccaagatctgtgtttctatgtttcaataaacattctaggtgattttgatgcaagctaaaatttgctttaggaaaagcagaatttggatacaaactgtagaagatagcatagtttgagttttagaagatgcctcaaaatagactaagcttatcccaaaggcaatatagacttttagcaatgaatcattcctgagaagaaattatgagcaagaaaatggtggttaaatggttcaattactttcaagtttcagcattgacctgagctgtctttattgtgtttttttgatgtgtgaatgtacccacatgatagctttgagaatcaaagagtcatgtgtgaaacttggcatctgaaactattttgaatgctttaatgacctcactttccaaaaacaaattaattatcattggaaagaaaataatacatatttattttggggacagaaaaaggttggaaaagattgtactactcagttttatctaacttccacagaaaagatagaaatcctttaagcaaccaactttctgtgtctgacagcaaatttagtatcatctttaaaattgtcttctttattgatgaaaagtttgcaaacccattttcatttccttaaaatgcttgaatgaactcactagaatggaagttatgtgttcactgcagggggcggcgagacacatagggtgtgcttccctcaaagtgggtacacacagccacacgcacacacacaacacaatatccacacaacgttctttacgatggagatgaaacagaaaactttccagtttcactttccatgttcaaaggcacaaaatgtcttgcaactaaaaagaaaaa

SEQ ID NO: 63163 - DNA, 1437 bp, Bovine  19866881142401
ggttggagggaatgagagtagggatggaacatgaaaggagaaaagtaataaaatctacaaataattgtctgttacatattgagagttatggttaactcagctctttgtatttgaggaagaataagagaaagaagggagaaagaagctggatgaacagaagggacataaggaggaaaggggaggaggaaagaagtagaagaaggagaaagagaagctaaagcagaagcaacagataacacttattgttacaactaaatttttataaggataaatggttcctagtgctgcatagaaaaaggaagatatcaaacattatgaaagacatagtgaaaggataacagaagagcaaaacttcaaagtaaactgagtccatgagaagagaaatggtaatgtcatttacattacagaagtgcccatcttttttctccagcttcataaacagctatagtaccctttacaaaacacactctgatggcacctacagcatattatatgtggggcagtttaacttagagttttcaacactcccagtttatgatttgcacattcatgactattgcttcaatttactttgtaaatagaatcttacctgtctcttcatagctaaatcccagaatttagaatagtacctggcagataacaggcttacgctaactatttgtcaactgaatgagcataatttctacttttagacaaacaaaaatacaggggagaaaataataaaattcttggctagaaggcatgactgaaatgcacatatatattatgccaaatgcatattcattattccacttatcaaactcactatttcaaaacatttacaaagtactgattttcataatatcaataatatattgttatattcctttttcaatttttctttctttttgttgtagactgcatagtaggggatgctgcatgaatatgattttaaataatttttgatattcactccagttatagtataagtaagatactctgagatcaaccagatttgagaaaatcatatgtgaatattgtttgaaattcaattttagataaatataactgagtgttatcatatgtgccatcggggccagctccctctctaggagagcatgctatttgctctggattgatttgcacttctgttgaactgcaacttctcttaaaggattatcctattaagaagtatcagcttggctgattaaagataattatctattcagttttgtatacataatctactaaaaagaagatagattcttgtgctacttgactttgggctatgaggtatgtgtagactacagatttcaactgttattatttttaaattgagtacactatcatatgctactacattaaaatagtacattcctcttaattacataactatgtacccctaggaaaaattcaaaggtaagactgtactttatttctttatataaatgtattttt

SEQ ID NO: 63164 - DNA, 1974 bp, Bovine  19866881359440
gaaaaacaagatatttagtaaactaaaaaatgcttatagatcaaaggtgccccaaattcaactaaaaaagttattcctacacagttttctcacaaatagttaatgtcccttgaagtgaagtgaagttgctcagtcatgtctgactctttgtgaccccatggatggtagcctaccaggctcctcagtccatggaattttccaggcaagagtactggagtgggttgccatttctttctccaggggattttcccaacccagggatcgaacccgggtctcccgcattgcaggcagacactttactgtctgagacaccagggaagttggttcagattgtcccttacctttctcataattggaaataaaacacaaacatatgtgtaaataaatatttgatctttcctagaacttgcatcttataattaatagtgtgatgggattttaaatgttaaagaaatactaatttgccatcaacaagggtgggggaattttgtttactagttttgtgtgattcaatttgtgaaaatgtgcttcattgatctttgcaaaagaactttaattggaaatgaatatcacaatctatttgccacatcaataagcccaagttgctgcagttcattaagtaccacacctgatatttagctttccacagggaaaaaagtccttgatttaatacacctaaggatggccaggtgggaactcaaaaaacaatttgaattagtatttcttttactcatccaagctgttaaaatatacaccaaagtgttgcttgagataaatatgccctaatacttgatctggatattactttttccttttatataaatataaattattttcttaaatacaaaagtaatccatttaaataatattctttaaaaatatcacaaataaatgaggaaaaagtctttttctttttttaataccagtgcacacaggggttgtcggatcacctttacaagcaatctgaagctcagtggggtggggagaggagaaagaacaggcactttatgttaggatgaaaaccataggacagataccaaataaacaatatcaacagccaccctcaacagaatagataccctcaacaaataagaaacagcagtggagaacaagcaacaaagcactcagtaaattcctttagatgaaagaactaaaaataatgaactaggtgcctatgaaagatttagcagcttttagctatttggaaaatgaattcttacatcagtcaacaactggattttggggaatcctctgtgcttaagcttgaaactgattgatccatgtggggaccaagcccatggctctagttttgtttcaatcaccccctccacgaagcagttaggctgcaggctgtggattcatattgtgattgtgagcacaataaagtcatggtagtgccaggctaattagcaacctcctttttccctggagaataaactctcaccatgcaattataagttttacaaacaagtggctaacacttttctgatggtaggtgaagtgagagggttaatatctgaactatattttaaatatattcaaaattctcactaaaatttacaatttaaacattttaaaagatgtgttcctctattcaaaaagtatatattttgaatatatattcaaaatataacttcaatattcaaatatatattcaaaatataacttctataaaactttaggaaaatgtaatttattttttgcaaaatgtacttcattatcaatgtttctgtgatgcatttttccatcaggtgaggtatgtctgtatacaaattagaaacagaatatttagattttctctatcccagctaatcaatgcagttttgtctctttaaaaaagttaaccagtttattcaacaaacatgggtaccatttttgcatgagacttcaagatgaggaacaagtagggataggagacatatagataaattacatgtgataaatacttgggatgattaaaaaaaaatgacagtt

SEQ ID NO: 63165 - DNA, 2020 bp, Bovine  19866881539342
acccaggagtgtgtcagttgacagggtgcacatcccttctgtggatttaggagacaaaaaaaacaaatgcagtgttacagatgacttgtttttggtcatgcaaaccccccccattcccctgtattttagaaaaatctaagaaatttgaatgtaaattagatagtgatttagtgattatattattaatttttgttttgtttggttaaaaaaaaacatattcctttttcaaagagatgattactctctttgaggaagggatgtagggatgaaatgatatgcctgatacttgctttaaaatactcctggggaaaaatatagatgaagcatgatgcaaaatcttgagaaatgttgcatctgggaaatgggtaaatggaggttctttatataattttctcatttttttggcgtatgattgaaaactttcacagtaaaaaaatttctgctttgccatttaaggtcctgtgaccttgggtagaacatttaatctctccttgtattctggtttcctcaacagcaaagcagggatagctgtgctatgtggattgaatggaaaagggtcagtgcacagtgcagggcctgccacagagcaagcattcaataattatagattatcattagtaacgtgcatggatatgatcaggggaaatattttccaaccacttaccctctcactgctggtttgagttcctttctgatccctaagtcagccttatgttatgaaaaatgaaaatgtatacagacaaatgttaaagctgatgcttaattctaattgaatatagctctaacgacacatataatctcaaatgacagacataactgagaatcagtcattgaatgatgagaggagggagaagggagaaacttatgaaggcaaatataccacgaacgatgtttgctggttaacacactttatatttaacaaaaatagttttttaataatatattattttacacatcaaatattggtgctagaatcccctttttacagttgagtgtttagtttttttttttttctcactagttttcaggcacaccatttttcaaagattttagaaagtgaatcgttttttaacaggcatcagctgacaaacaggatgttgatcccttatttaaacagagctgtagttaaagccgagaaccaaaggcagaggagatgtaggagaattgaggtgacagggtggctgcaaacaaagctttcaaaaggaaaaaaaaagattaggaagcaacagatgaagccagaaatctgctgttcagagtttggagagaatttctcaatgacctaggtagaaggaagctgtaaagtgtttatcagttgatgagaaattctgtcacagtatcggttcatctctccctaaaggggcaggggaggggtgtgggtggaaatgtcagtgctacaaaatcttaaaggaaacatcttgtagtgagacactgtgagaaaagaaacatccaagaacagcaaaataatccctctctttggctggtaacaggccgctgagcagccttcattctgcaagccctctgaagagagtttctttatgggtattatactccattcttgaaaattcttgcagtgactatcactgagccaagactttgatgcaaaacgcctgtaccctgccttgcctgttgctctttccttctgttttctaaaaaggacagagtaactccttaataatagatggggtactatgctacatggctctattaatgatgtttctgggtttcaaaccttattcctgtcatttattattattatttctttccaagagtgtagatttttgaagctggcaataggcaacctcagggcaaagaaagctctataatacatctctgtctagacatacactgaagtgtggagtagtgcctttactttggagtgcaggaataaatcatgcagaattgttcatgaatgattcatgactgtctatatgatgtttctggggtggtaacagaaaagcaccaaccttggtgcaaattggtgttctaaggaaaagtggcttgatgcgctccctcctatgat

SEQ ID NO: 63166 - DNA, 1739 bp, Bovine  19866881562506
taaaaggctgatttgcaaaatagcttctgaagatgtaaatggatagacttaagtgaatatgttaatcctaataagtacataaaatgggcaatgaagttttccaaattctttacaaagaatctcatagttaaaggagttgaaagtcgagtggaagaattattagttggttcactaattatggagttgaagttattacaaagaataactgcaatttcaaataagagatatgttattaattatataactaaatatttttgttttaccttttaaagaatttttttagtttctcttttaaatagtaattttaaaccatagagatcataaatgtttgttacaggaaatttaggaactatagactagcaaaggaaagaaagtaaaatcatttattagcctactgttcaaagatatacactattttaatttttccttttataaattccttatttgcatttatgtttaggaagaccattcctgtcctaagagtgaattgatatttagattaaaaaatccctttatgatcacattttttagattgaggtctttaatccaactgatagttatttttgtgtaatgggtagtaatagaatgtaatttcacttttgtaaaaaaaataattaacttttatatttttagaataatatattctttcatcagatgcttggatgtcacatgaagagtatgttaaattgtaatgcaaatgtgaattactttctgattttctgttatatttatctatttttgttccactatcacactgtttaaaattattatacctttacatattattttaatatatctggtagattgaatttcccaagcttcccaaatacattcatgtacttaaaattttccaacttttgccaacttacaaaagaaaattacatcatatggaaaatttgatagatttacatttatctttagagaaatagcattctaacaaatttcagttttcacatttagaaattagtcatcatttttaaattacatttaaattgtcttattatatttacaaatagttctttgtaagattttgtgactttttaaaactttcatattatatatacatatatatctccccccacagattaatatttattttaatgttgttaagcctagtatctgttgattctaagtagatatcactgttatgcattactttcataattttgatccacttgaaattaaagcttaaaaatgtattatatgaaataaaaaacataatggtaaatggaagctaaatatattatatatcattaaaaatgttttgttattgttgttgtatacttgctaagttgtgtccaaatcttacgtgatcccgtggactgtagcccacaaggttcctctgtgcatgggatttcccaggcaagaatgctggagtgggttgccatttcctcctccaggggatcttcctgacccagggatcgaacctgcatctcctgcaatgcgggcagattctttaccattgtgtcaactgggaagcccagagagatctgctctctcaaatttttttctctactatcttactaaattttctttatagcagtttttagtctattttcttggatttttcaagtatattctaatatgcaaatggtagatgttctgtctcctgacttttttcctctgacttctttcttttctgattatattagctagttcatgcctactatctatttgaattttcagtaatagtgtaaagctttgtcttgttccgagcttattaagaagcctttaatgtt

SEQ ID NO: 63167 - DNA, 858 bp, Bovine  19866881608588
ctgtgcctaatgaattggtaatgccttatctttctcttttaactctctttattaaaagagagaaactgttaaatagtagatatttgtttcttttgaatgtatttctttagctcctgacccccctccttatctctcaaaaattgataaaatgagattttacatttcagaccataggtacagacaaaactagtttagaactttttatggagcagaggaatgctaaagaaaaatatttcatgctctatttagtgtttccacttgcatatttcaattatgtgccttttagtgtacattcttatgtttgtttatttgtttatggagcagttttaggttcacagccaaactgagaataaggtaaaaagattttcacactccctgcccctactcgtgcacaacctcccccatgatcgttgtgcctcaccagagaggtacacttgttataacttgttgcggtcctttaatggaccagaacctggcggtccagagttgacgataagaaagtgaaagagagaaagaagctaatattccctggtttacacagagaatcaataaaacccttgaacagggcttgcaccgctcatgaaggcacagggcgccctctcgagggggtcttgaaagcccaggtaggagaatgagctcggagggtgtctatgctccagagaattagtcggagttggggagagagacaggggaacccaagcctctagtggaggaagggctttaatgatctttctgtgggtatatataggctgttgtacaagaaatttcttttgacaatgataaagatcagaaaaccaaatgtatagcaaccgttaccaagggaacaagggattaataaggtcacgtcaggagacaacc

SEQ ID NO: 63168 - DNA, 1808 bp, Bovine  19866880434351
ctaaaaggagtatcatagaatgtggtggtggttattattgatattctgtagtggagaagcatttctatgttttttatgtttattacaaaattttcaaatatatagtatggtaggcataatagctccccaaagatacctacaacatcatccctgaatcctgtgactatattactttacaggacaaaagggagtttggaggtataattgaggaaatgaattttaagataaagagatggttaccctggattatccaggtgaacccagtctaattaaaagcagagagctgtctctggctggagtcaaagtgatgtgacagaagttggagggaagaaggtttgaaagatgttgatccacctttgctgaagggagaccacctggaaagaatgagccatgagccagattgtggcagcctctaggagaaggtgatggcaccccactccagtactcttgcctggagaatcccatggatggaggagcctggtaggctgcagtccattcggtcgctaggagtcagacatgactgagtgacttcactttcacttttcacttttatgcactggagaaggaaatggcaacccactccagtgttcttgcctggagaatcccagggacgggggagcctggtgggctgccatctctggggtcgcacagagtcggacatgactgaagcaacttagcagcagcagcagcagcaggaggatagatgtacctagctgacagccagcaaggaaactgagagctcagtcctatgactgaaaggaattaatctgcccttagaagcacattagttccccaagccttgagaaaggaactcagccttgctgactagttaaatttgattttattatattggaagtagaggtcccaattgaactattctgtacttgctcttctgatctccattcaagttaacaaattacagaagcaatagaaaactaattcatattttaaaaatgaaatatgataaacatctatgcccactgcttaaattcaacaaccctaaacatcgtcatattactcatttatgttgtattttgctcaattatttcaaagtgtgttttagaagacctgacttaatcactaagtacttaatcatgcatctcttcaaaaaaatactctcctacataagcacagtatcattatcacaattaacaaattgaaaatacagtcagttctgttataatgcttctcatgaaatgtgaatttgttccaatgcaattaatacattaggaacaatttgagcataacaggactttgaatttgcttatgactatgatgttgtcagaaagctataaatactttcagcttttctattatttggaacaggatccaatcaaatatcagattgaatttggttatgtctcttaaacacctttttttttttctaatgacactgattttttgttttgttttgtttttttgattgggccaactgtcttaatagactatcttagattgtttctgggcttatctaattgtatcctcaaaatttaatttgtttctcccttacattttctgtaaaatgttatttagaaccaaagttttaattacagtcagttatatatttgggaagagcaactcacaggtgaaaactaaataacccctcctctcctttctttcatcaactgggtctatttgttattctgtctaaatttctactgacaagtcaagaaaaatgtttaattcttccctttaccagttttaagaacaaggagtaggtgtaatagaaataggggatttctaggtaaaacgcagaagtaataaaagagaagattagtatacagtaggtataggtatttttaaatgaa

SEQ ID NO: 63169 - DNA, 976 bp, Bovine  19866880876702
ctccaactttctttagataatccagttatgatcatggaatttaatttatttctcccattttagctactcatttcacttccagccatggtaggtaagggagattttgtttgtgttgctttttactcccctcaaaatgttaaccaaagatacgcagatatgcccacctgtttaagagccaaagtgacttccaaaagggggttgcttttaattggatctatttatattctttttcatttggctggggcagtgacccatgccaggggcacttctgcccggtggcttgccccaaattgatacagtacttgacctgttacactccatttcctgagctacagtcctgatagagtcgatttccataaccctcagaaccctgacatcactgggatgacagacttttccttaaacaatagcctgcccccaaaccagcctccaatacactactctattattagaaatatatattttgttagctataaaatcatttatactccacagctgcttgattgttggggtatttccttatgaaagttctttaaattcaagctgtcacttcaccctaagacctgagcagtggtgagtgactccagatggagcttttccctccttcctcaattgattattatagtcatttattttttctgggatccttgataactttttcattaatagaaagattaacagaaatttagtgaaatcttgagaaagactcagtttgtataatgaacatacaattttctgaatggctgctagtttaaaagcagatttctatgctcttaaacagattgcgagagatcagtatgccatggaaagatgtccaatacatattgttatgttgttattttaaaaaattgtaaaacatgctccacataaatatgcatttgacttacatgtgcatatatatgtataatatacacacatacatatatataaacataaatgaagagagatgagaaaaagaataataacgcacatactg

SEQ ID NO: 63170 - DNA, 1425 bp, Bovine  19866881226450
aactgactcaatttgattctacattgtgaatcacttatcattcacatggttcactttatagacattgtgatctactgggtgaattccagattctaaattaaatagcacggagcatgacagctctccatatctataaacttctgtttagaacaattgtagattgcttaaaattggtctaaagcatctggtaggtgttatttcacttaaacatggtacatttttatctaaattaaaattttggaagattttaggaatcttttaaagatatcacagttatgctgaggagttggaaataattgggactcagtttcatgaccacctactgcaccaacatgcaagttcctcagacagcatttgttctgagtccccaggccactcaattctgactaggtcaaagaatggtacataaaatgaggaagatatgtgcaatgaaatatctgggaaactcttaaaatggcaaagtcctgagtttcaatcttatataggcatagagtgcagatagagtgctaaaatcttgattttttttttttactactagaaaatcaagtgattctgatagaggttgcagtagttggaatactcccttttccccagctcataatctcctgaacctgtgactatttaccttacacaagaaaggaaatttatattttgatattgaactccatgagctgtttgtttattttggatattaagcttttgtccactgcttcatttgcaaatattttctcccattctgaaggttgtcttttcctcttgtttatgatttcctttgctgttcaaaagcttttaagtttaattatgtgattgtggtaaatgactttgagatggggaagaagagcctagattacccaggtgagtccaatctaatcacccagtccttaaaagtagaggacccttcccagctgtggtcagaggagcaggctagagaggtagctcagagacatttaacgttgctggctttaaagatggaggtagatcaccgtgaaacaagaaatgtaggttgcctctgaaagcttttatgaaaggcttggaattttttttgtttttctttttctttttctacaggcttcagaaaggaacacagaactgctgacacagtggttttagccaatgagatctgtattggacttctaacccacagaactatactgtactcaatttatgttgttttaaaactgtggtgttggagaacactcttgagagtcccttggattgccaggagattcaaccagtcctgggtgttcatttggaaggactgatactaaagctgaaactccagtacttcggccacctcatgcaaagagttgactcattggaaaagactctgatgcttggagggattgggggcaggagaaggggacgacagaggatgagacagctggatggcatcaccaactcaatgcacatgagtttgagtgaact

SEQ ID NO: 63171 - DNA, 1628 bp, Bovine  19866881335635
attcttggatatttgacattttgattctcataaactgacgtgagccagcctcagagaccatgggaataggggtattatctgccttcattcctcttctaactagaatccctccagtgatgtggcagtgttatctttgccttgtacttgcttttctatttattacctgttttgattctatgtgactagagctttttgactgttcatgtatttacacaaactccagccattgtgtcacaaaaggttttaatgtgctaactgccaagtgagccccaatcagcaggatgtaacataaaggtcactaccctgcagtcatcaactggatttagctttcagaggagtttcttttgatcagtcaacagctttctgaaatactgaattaattagcagcctctacaaattaagagctttcacataaaaacatgaattctcagtttgtcttatgaagtttgaagatctgacaacaccaagcccacatccccatgaggcagtatcttccaggagctaattgggcactgcctcctttaagagcataccatatgctctctggcttgcccatgcatcctccactcttaatgcttcacaccctggtcagttttgctcatttctattacctatcttgcccctgaaagattttgagttgggattaatctgaggcataatgtggttttaaaataagaagaagaaaaaaaaaaaaaaactttggagttagacaaacctgggaacgagtccagcctctgccattgacacatgtgtgaacataagcaagtgatgaaactctgctaagtctgtttcattctccaagaaatgaaaatagaaagtcacctcaaaggattataaggaggcctaaacatgacagcacttgacaacaccttgcccagctagctccatcctagtgatcactctcccatttctcaaggggacctcttgcatcccttccaattttgttcatttcactttgctagaactcagtttctcttatgttggactcactgaattgggtgtctttatttcttttcctttaccatttcttttgtttcaagttatattttctttgtgcaaatgctgcttacctcagaaatgtcaattgcctcactggtctcatttttgctctctggtcttgccaatcattttaactgtgtaggacacatgtacatctactggatctgacttgtcatctcctctgtccacacccagtgaaagaaatatggagatatcccagtggttgagattggaaacaaccctttactaaccaaccctacaatcccctccctgctccatagaaaacaaagtacagactttcagttatgagatgaataaggtctgaggctcaaaagtataacatgatgactgtagttgataacaactgtgttgtataattaaaatttgctaagagcagagaacttcaatgttctcaccaaataataaataaaaggtaaatatgtgaggtgatggatgtgttaattaattgaggagaatcttttcagtgtatacatacagcacatcaccatgttacacactttaaacatcttaaaattttatttgtcaattatacttctgtacagctaagggtggtaaacaaggtaatattgcccacaatatatgccctgcactttcagggaagctttttc

SEQ ID NO: 63172 - DNA, 1620 bp, Bovine  19866881497461
aaaactattcctgaatgcagtgtgtctcaaacttcagtgtgcatataaactcccctgggtgtctgatgtagttggtgtggggtgaggcccaagtctctggttctaacaagttcccaggttatatcaatgctactgatctgagtacattttgaatggcaagtccacagtggataccttccagcaagcatttagatctccaacaattttataattaaaagtatcaattttcctttctgatgggggagagtgatgctaggagggcatgggttcagccaaagaaatgaacatggtatttcatgttctccttgcctccagacttggttctttgatgtctgggacctctctaggtttcccttctagacattctgggtaggcaaagtcaaagagtttaataaaaatgcagtagaaaaccatgcatccaatctgaatccctcactcaaacactcttctttgtgaaaagcgatgagaagtctgtgcctgacattctagttgctgcagggcttgaccacccattggtcatacaatctggtcttccagtatcaaaatgatgacacagcagtgcttcagtaatgagaggaaaatgtttctagaatgagcctgcaaaatgctgagtctccaacagataaatctgagaatgagagaggggggaattaatcaacaatttcactatagccacattttttactttcagaacaaatatacagcttttcccaaatcactcccttatgcaaacactataagaaaaaagcaccccactacaataaataatgagtctgtttattaacatcacagaaaagaatactctgaatttctgagggaagttttatgttctgaagactaagcctgaaattttattcaaacaaaatcttgatcaaaggccctgtcaagagaagaaatcttagaatccggttcttacctttttttccaggtattttgaaatgcatgaaactcaaataggagtttcccacaacccctaagcaggcacagaagctgtctccagtctcaaatttgtggcaacgtggtagattatgaacaaatctaccaagaacacatcgttttgagaattataaatcagactggctgctccactcacagaaaataaagccattatcataactttctcaccaggatctgaaagtcaccaaaacatgaaagcctgttatacctcctgatatgcagtaaatggatattaaagcatatggactagcaattatatcttagagtgataatctggcaatctttgtgctctctgagagcatagtaaaagtaaatataatcttaaatgtggtagatgaccaagacagtctactagatttacttgactaaaagcttgatggtcttctctatgccctaacatcccttttcttacagaatttacattagaaaacttgtgattgtgaaccctttccttgcccctttgatatgtaaatcttcctaaaagtttcttaccagtttcaccacccagaaatgtctgtctgaaggacttgggtgtcatctctttgaaataaagtcaaggaaacaaccataggtgtgaacaggtacacagggtatttggggcctccaggctctttcttttggaggagcttctacttcccgaagggtaagttcctcatcactcat

SEQ ID NO: 63173 - DNA, 1241 bp, Bovine  19866880357964
gcttctctgtccatgaaattctccaggcaagaaaactggagtggtttgccattcccttctccagaggaacttccttaacccagggattgaaccctggtctcctgcatcacaggcagattactggagtgggtaatctaagaatactggagtggggccattcccatctccagtggatcttcccaacccagggatcaaacccaggtctctcctttgtgggcagattcaaaccatgctctattgctattgctaagtcacttcagtcgtgtccgactctgtgtgaccccacagacgggcagcccaccaggcttccccatccctgggattctccaggcaagaacactggagtgggttgccatttccttctccaatgcatgaaagtgaaaagtgaaagtgaagtcgctcagtcgtgtctgaccctcagcgacccccatggactgcagccttccaggctccatccatgggattttccaggcaagagtactggagtggggtgccattgccttctccaaaccattctctagtatgacattaaaaagacatacaccttcagggctttatttctaagttctggataatttttgttattatccaacaccaccagagcaatctatttaaggtagatttttttttttaatggacttcagtcttgtagtacttacatgtcagtaaaaaatgtaattaatttaaacatagtcattaaagggggcttgaggagaactactgagagaaggaaacattttgattgattctttgagtggaaagtagttgaagttagatccccttcactaggaggacacggtgtcctgctactgtcagactagagaagagtcgagtaagagaagtcggaagaaatgagaaggccttgggacctccagcgcccacagagacagttgttccagggattattcagaaagcagctgggctggaaatcaggtgaatccatcctagactgtgatagtcctatttcctggcccccttcttgcccatgaaatgttttgtttaaaagagggaaacattctatacactcagtaattaatatggccaagctaagccaagcttaggcccacatttttggatagcaggtttattaatgggctggttgagagaactgaaccatgtggtgtttgggaaaattggaaattttaaaaataaatacttagcatcttttctctctgactgttaagatatgttcatttactaattcttaggaataaaatttccacattgaagattaatttgat

SEQ ID NO: 63174 - DNA, 3396 bp, Bovine  19866880424799
ctgaactgaactgaactggagctgttaactaatctatctgtgataatcatttcacaaaatatatgtgtatcaaaccatattgtacactttaactcatacaatgttatatgtcaattataactcaaaaaagctagaaaaaaatctgctgcttgataaaggaagaaatcccaaaagtgacaccaatatgacttatatatatatgtgtgtacacacacactggagaaggcaatggcaccccactccagtactcttgcctggaaaatcacatagacagaggagcctggtgggctgcagtccatggggtcgctaggagtcagacacgactgagtgacttcactttcacttttcactttcatgcactggagaaggaaatggcaacccactccagtgttcttgcctggagaaccccagggacgggggagcctggtgggctgccgtctatggggtcgcacagagtcggacacgactgaagtgacttagcatagcatagcatacacacacacatacacatatatatatatacacatacatatatgcactatatttttattcctcagggtccaagatctataagggaaatgggagaaactaacatttaatgggagaaactaacatttaactagcatctataatgtcacacattttgctaagcacattacttttattgtctcgtttgattagtttttctggcataatctcatcacatgtaagtgtagtttttaaaaatgtcactcccatgttgcatgtaagccaaaagagagagtgcatcaggagaaatcattttaactgtaaaaaagaaagttaggacagcaagagacagatcatcatccgcagtctctctggggcttgatcacagcttccttaaatggcttggatctcgtttttcacacttacagatgcctgtctttgtgttgctccctgccctcatgtgtatgtatcttagttcccagcaaggttacagtcaccttaagagctaaaactgattgctagtggcctcaacctacagcagcttgtagcgggtttcagttaggccagagtttgaggttgggtcacagtgttgagagcatcaaatcttaaccactagaacaattattggtcagtgacaggccctagcccttaagctttgcaaaaaatagaattctcataaagaaggaaagtaatcaagtaaatatttattaggaggaaaagggtctctacctgtagagagacacatgggcagactctgagagagtcccgctctcatggcagtttgaattacttttatgggacatttcctctgggtttcctttggccaattatatttatttgcctggctcaaagtccatatctggtatatctcaggatcctcccatgtgggcgcactcatctcgtagccaagatggattcaacttaagaggcctatggatagttagcattactccccttttgacttccaaggagcctttctacattgtgtagtcagggaggtcttctgacttcaagaaggagaaatatggagtctcttatcttctatctggccagagcccagcctcctctcccacttgtcccactattaatattttggagtttcagtccacagggaatgaatctccaatcactttaccttggcggacctatctatctcctgcctcaaaatcaggccctatttttctgtatctcttgaggatccaacaaaacattgggccagaaagaataagccagcaccctgaaggttgcatatggctaacagacttgttttgtttagcttgaagactgctggagaaaagaaaatgaattgaaaacatttagaaatcagaagatttcacaaaatattctctatatcccttttcttctttataaaatggaaaacatgggcatcttgggccagcatttctgcctgggaactgttatgtggggaagttagacatgagggacaagaggaggcctggcctgaaagggatgcaagcctgatctctaagatgcatcccagacacacccaggagggctcacagatatgctacaaagtaaccacagagacttttcaactcctgcacatgtgccctagacatacagtggatacacaataaacacaggggattctccaagtaaacttaggcagttaagggcccagtaagggctcatgaatattctatatctaattataacagactgaattatgggaattggactataaagaaagctgagcgatgaagaatcgatgcttttgaactgtggtgttggagaagagtcttgagagtcccttggactgcaaggagatccaaccagtccattctaaaggagatcagtcctgaatattcattggaaagactgatgttgaagttgaaattccaatactttggccacctgatgcgaagagctgactcatttaaaaagaccctgatgctgggaaagattgagggcaggaggagaagggggcgtcaggatgagatggttggatggcatcactgactcaatggacatgaatttgagtaaactccaggagttggtgatggacagggaggcctggctgtggttcatggggtcgcaaagagtcagacacgatggaacgattgaactgaactgaactgaattatgggaagacaaaaataacacagtctgctgttgtataacttacaattgtcaattggccttgaatgtatccccactgcatttcctttcgttgactggtgatgtgtacaagctctactttgcacacaccataaccaaaaggagactgggacgatgaaagcaagaagccaaacaggctcagtaggaaaaatgagaaggacttcctttgggatcagcttgctcctgtatttttggagtacctgtctaataaaatatctttctgcttgagcctaactgagctgtgacttgtctgtcatcttacactctttggtctgtcactcctaatatttgctgtgacaagaaaagaacagagaaagagaaataagctgacttgacagaaccatcagctatagttcaagagcagttgttgttcagtaactcagtcatgtccaactctttctgattccactggattgcagcttgccatgcttccctgtccttcagcatctcctggagcttgctcagctcatgtccattgattcagtgatgccatccaaccattttgtcctctgtcatccctttcttctccggccttcaatctttcacagcatcagagtctttcccaatgagtcagttctttgcatcaggtgaccaaaacattggagcttcagttcagcatccatccttctagtgaatgttcaggagtgatttcctttagaattgactggttggatctccttgcagtcaaagacactctttggagaaagagttttctctagcaccacagttcaaaagcatcagttctttggcactcagccttctttatggtccaactctcacattcataca

SEQ ID NO: 63175 - DNA, 2492 bp, Bovine  19866880433511
aatgctcctttacgccctgggagaacatcgtgaattcttctttaattctgaattttccttctatttacactttaaacaaacatgccagttgtttgcttagctaacaagctctgccttcattataagccattagtggctggcaataattgaaactgtgtttgggtttaaaaagtacaataaacccaattaatcccactcttagtaatatggaatttgtagtgactgacttgacctaggctggagtttgtgtctgctctcttcacaaagccagagttgctgaactgtcttatagccataagcaagtttgatagtagatttttttcataagaaaaactaaacaggttaaatccacatgtccataaggagtcaggcagcaaatataaataagcacatgggcagagcaccctttaagaaatacctgatcttctctacctgcctttgatggagacatggatagaaggaatatttcacttttctcttaatcctgttataagaaataggtagagggaagcacatatagtcacatgattataaatgacaagtggagtcagccagtggtgaggagatggaggagtggtggggagctggcgagcccaagtcccctttgaaagggtcagctgctgttcagctgcagttactacataggaatgtgagtcgagtgtagtcacatcttgcaaattttaaataaaattagaaaatctggatttctagtgaaatcttcccatttataaattttgccaattgatttttttttttttaagttaaaaagcagctgccacagtgcagattagtggctctcaaagtgtggtccctggatcagcaacatcagtatcactggatactttataaaaaaggcagatctcaggccccacccaggcctgtgaatcagactctttgaagttgtgggtccaacaatgttttaagaagcccttcaggtggactgccgggttcagcaatactgcaggcaacacacatgaaaaagttatcagtaatttatacgaaattcagatttaactgtgtgtctggtatttatctagcaactgtatctttaggtgattctgaaacacatctcacatggatcaagcgaaacatgcaaaagagagccaggctgcctatatctgaatcagctttgatacatactaactatgggatcttggcagagcagttgtgtaactgctctatgactcagtttacctgcatgtaaaatggggataataatatctctctcacagggttattgttagaattaaatgagttagtgaatggaaagtccttagaatggtgcctgagaaaggttaagcaacatctaagagtttaccatcatcagtcctttatttttcctttcctttttctccaccaccatcattccaactgtcagggaatacttgaatacagcttccttcagttctcttatccttgaacaaactttgattttgtgatagaactgattctacaccctaggccctcaggtagccctagtgcttgttctcacacaaagtaacctcttgctttgaaagctagctgaaaaatggtgtggctgtctgtgtaccagtggctgcttccagggctctctctctcagcctgcgttccgtgctgcaccaaggcctgtgtctataaccacctgccttttggcttcatgtgtgccttcaccagcccccagtacgccactgaatcacatttctgaccacatctcgcagtttcagatccccagactgcctgacggggccgtggatgcttgttcgccgttgtgaaagcaaactgatggccccctcccgattaaatttctgagtactctttgggaaatccccaccatttctttctctagacttgatttgcaaacccaaagtgcttgcactgtatttcaaaggaaactcataaccgcactgctcttactgagggtggtgcaagctgcctaaatgtgccccttcatgaagcagctttccatgctgccacatggtcacaaatgacagacttgtacacacagagaaaaccaactggatgagctcttcagcttctcagctgcgccgtgttattgctgttctgggaatgaagcacgatgcattattttattaaataaagattttccctgtatcacagtagaggctaattttattagctctctttatgggaacaaacgtcatcaccctggctggggaggccgggagttgggggtaagggagcggagagaatcacatttggtcatccacgtgctccagtggaggctgccaacatgttttaattggtaattacttaccagaagagttctccagatcctgcagaaaacgcacagctctcagttcataactcacttacagatgattcagaagacatcttcagctacaataaatatcgttgatatagtttgggtatggctgtgcccctggtgtccaaaacaccggagtgttcaataacttcaagaagtgaatcctttgttctcctctctgagaatccggagactccttaggcgaacatgtccttagcttcagaaacag

SEQ ID NO: 63176 - DNA, 1638 bp, Bovine  19866880434557
tttattcaaacttatgtccattgagtcagtgatgccatccaaccatctcatcctctgtcgtccccttctcctcctgccctcaatctttcccagcatcagggtcttttcaaaggagtcagctctttgcatcacgtggccaaaacattggagtttcagcttcaacatctgtctttccaatgaacacccaggactgatttcctttaggatggactggttggatctccttgcagtccaagggactctcaagagtcttctgcaacaccacagttcaaaagcatcaactgtttagcacttagctgtctttatagtccaactctcacatccatacatgactactggaaaaaccatagccttgactagacggacctttgttgacaaagtaatgtttctgctttttaatatgctgtctaggttggtcataactttccttccaaggagtaagcatcttttaattttatggctgtaatcaccatctgcatttagtcacttagaaattgtgaatctaaccactggacaagaatgacagcaaaattactaggagctcaaaacacacaccacattatggcaactgctattattgatataaaaaaaccataatgtgatcatgattgcacaaaagaaccaacatttgcacatgcaaagcacatataatttgaaaaatataatttctctggaatttgcaaaataaccaatcttgttttttttgaatgaccgttacatgtagaattttttatagataccactaagattaactatcctaataggcctttaaattatgctgataatagtacataatctgtgctaaaagaagcctacatgttattcccctaacaaaccacctggcttgctctgtgctaaaagcacgtcatggctccaatgacatggagtctcttgcatcatgtcttatcaagtttccacaattttgtgactgcgggattttctcctataagacttctgttttccatcatttgcttgtgtggcctctggccacttgcaggtgtttgtttggaaaggagaggcattttccaagatgacacaataagctgatgttctaaatcctgggagcttgagtcctgcctgtttctgattctgggagactttatatgattggccattacccatcctctctatccccatcattgccactgctgcctgtgactttgtcatttaaggctgctaagcacttttccctaaagaatagcctaagccatagaagggctgtggggttcactggttcattgtgttacttgttggtgccttggaaagtgggtcacctgggagttgaaattaagcactgaagagaggagggtaatccgttcatacctttatgaacaactgtggtgagagcagcactcaaaagtggatgataatcatttgtggtttcagaccagactgaagggcgtctatggactgactagctccagctttagccatacagctgacaaaactatagatgatctcaagtacatcagtggtggattttaagttattatgcattcagattttaattcagataatagctttaaagcatcactattcagtatgaatatgtgcaagtcacatttgtcatttaaaatgttctcactgctggggctttccctggggtcagggttaagaatcgcctttcaatgcagagga

SEQ ID NO: 63177 - DNA, 1625 bp, Bovine  19866880467481
ccttcctgaagctgtgttggctttgcagaattctccccgctcattagaacaacaaaggatgcagctgctcgaactgtagcctgccatgttgacatggcaacgggtggctcctggcatggaaaaagggccctgttgtttatgggagatcccacagtataaacacatggcctgcagaagaaagacaaagaaacaaagggggagaatctttcaaatgagttgtcactttccttaccaccatggtcgcaaatgttaagttgagctttcaaagagaaaatatctgagactttgtagttgattggtttcaaagcatcttgaactgacatctgccaaggcctatgtgaagagccgagtggttatttctcccaaatgaattacttaaatatgtaaagaggttttttttctaaggggaaaaatattttttggataaagttttaaatactagtctgccaagttaaaatttacattaccttgcccttccccttaggccttcaaaacaaaaaagttttagagacattcttacaaaacttttggaaaatattctggaaaagaaaatatgtttagtgatactgagatattaatacttggaaaaacaagccggtggtctcaaatgcagtgctggcgggcagatacccccaatcttggaaaccaccatttcaaatggaacccttgtgggaatccttgtgcggaggccaagaacaggggttggcacataaacaggactgtaggtcacaacaaccaggcttgtgatgggaaggccaagggcagagttgttaccaaagcaagtataagaaaccagtggcatgacatgggggcccattctgctaaaattaaaaaatacaaacctacacacaccaagaataatcccttccatgataagtcacaaagagaaatggaaaaaaatctctgagatcaaagaaatctattcttttaccaccactgagtagaaggcacagacagacccttgggaagaggtcttaggaaaatgtttccacttttcgtttttcaagagctatggcaaatatgatataggtttaatcagcttgatttatggagtaaatgataaaagtggagtgctacctctctttcataaactggttttcctttttagaatagttaacactattatgactgaagatttactgtattcttacagtgagcaagaacacacagaatgatgaccccactccatcagtcagggtccgggaaggaaaacacaaaccattgtaggtcttaataaacagaggtaatttaatttaggggattggtcctagaagtaatagaagtactgagaagccaaacagcagatagcgatgcaacccagagattagccacagtggtaaggagctgtgactccatgggttggaggagctgctgttgctgagtgttctgagcttacagcaacaggagtcatttgacagaagccagaatcacagtggagaatgtctgatgggtgcagggaccaaggagacccagtcattgctagagatgccaaaataagcagaaagaggagaggaaatgtgtgtgtgtgtgtgtgtgtgtgtgtgtgtgtgtgtgttagtctctcagtctctaggcaagaacactagagtggatagctattcccttctccaggggatcttcctgat

SEQ ID NO: 63178 - DNA, 2771 bp, Bovine  19866880609644
aaattgaggattagagaatttaagttacctgctagtaagtaacaggtaataaggagtaggtttgagagtcaacactaagtctttcagattacaaagactgtatactttgtaagatcaactagcttttaaaaataacccctccatatatatatacagtgaaatactactcagccataaaagatgaaaaaatgccatttgcagcaacatggatgcaactagagattattatactaagtgaggtaagtcagaaagacaaataccatataatattacttatatacagaatctggagaaggcaatggcaccccactccagtactcttgcctggaaaatcccatgggcggaggagcctggtaggctgcagtccatggggtcgctaagagtcggacacaactgagcaacttcactttcacttttcactttgatgcattggagaaggaaatggcaacccactccagtgttcttgcctggagagtcccagggatggggggagtctggtgggctgccgtctctggggtcgcacagagtcggacacgactgaagcgacttagcagtagtagtggtatatacagaatctcaagtgtgacgcaaatgaacttatctatgaatcagaaagagactcacgatacatagaacagacttgtggctgccaaggagagtagggagggaagaactgggagtttgggttagtaggtgcaaactattatctatagaatggataaacaacaagatgctattgtatagcatagggaactgtattcaatatcctgtaattaaaccatagtggaaaagaatatgaaaaaaatatatatgtgtgtataactgaatcactttgctgtatagcagacattaacacgcattgtaagtcaactcgatgtcaataaaatacattttaaaacaacaaaaaccaaatatataactaaaagtaaaaataacctcttgcctttctgatgtgccagcccttgccttcccctcaccccagcacatgctcttcagagtttgtccaataagtgactggttgtcgaacagctaaaagctgtaaatgctttgtcacttactttgaatttagttgttgaattgtcagtgtaacacaattatattttattaaggacattttttaaaatatttaaaaccatagagcttaatggaaaacactctgatggacagtaagaagactggtttcaatccttaatgtcaccatgaatccaaacaagctgtgagaccttggatacagacttaatttctgggtgcccatttctctcatttgtgaaatgaggaggttaaagtatgtgattactaatgtctctctctgttctaaaaacatgggcctctatgcctcttcttgttttgcttttgtgattctaaaatggcttcagagtacaaatatttcttaaaggagccttaattactaaatgcaaatcaagagaagtggataacattggggctttcagaattttttggaatatataagttctttactcttccaagcaaagctacattttccactgtgtttcccagtccaacattcccaccaaaagaaaagtgtatagtttcttaaataattcatattggaacttagattccttgagggtctggcaagcgttaatcttggataaggtgatgtaaaatattgccaatagccaacctcaggttgccaacccaaaatataagtccctccttgttcagtatatgaatttataacgtaaaccatttaaaagtctacctggcactattgaatagaattgacactgttgggcaactctgtaaagaagaaataaggcaattttgtggtccaagtagttaagaatatgctatacttaaagaaaattttactgcatcatttcagacccaataaagaaaaaactggccacgtgagtgactcaggatcgtctgtcatcagacatgggcttaatccggagaaggtcttcatgcaggttcattacttaaaggtaagcctccctgagtgacaaaagccaggactttttagattttacatgtgaacagtgaaggttagtaacaaggttggggcaaaacaaacatatcgtcaacattgtaaatgacatttgattgagcagattctgatcgtccaacaattaaagcatttcacacccagcatgaagcatgaatcaaaggaaggggaactgttcccttccctgtacctcccttctccccgcttcacgtcagctttgaagagcagagtcttaaaattgctgtcaggttcctactagaagacagagtgattttttttaagtattttaatttgtaaaatccttttctgatagctaaaggagagaggagctgggccccttttccctatttgtccgtaatggacatccaggtttcatgtaagctaagggcaaatgagacagtgacaaatgggttgaaacagagtagttgttccttaagctccaaacccagccctactagtaacaatgcaaagggctgcctgggcaggtcagtccaaatgttctaggtgagcataattgctggtgggtaagttagagttgattttctaagtatttttccgatgaacccatgatgggcatcttttttttctccttccttccttctagggctatttccttctccggttccttgccaaaagacttggagaggacacctatttttcatttttaaggaagtttgtgcacactttccatgggcagctgattctttctcaggtaattagtgagtcctcttgactccatgatatacagctggagaagggtgtggcatgtggtaactagattgtgtattaacaagtagggaaa

SEQ ID NO: 63179 - DNA, 1333 bp, Bovine  19866880628160
tggaatggttgaaaaagaatgtgagatcttcctatagtgtgatccctcatcaagcagagggagtgctggcgtttccttgcaatcctaaaccaaccagtatttcctgaatgcaagtgctcccaggatgactgacggtaaaaagggcacagcattgagctcacctgtccatcgctgaatgtgtccagttcagacgcagagcctaaaatggtcctgcaggagcaccagtcacagaaaggaaagactctccagccatccaggcagtctgtgggtctctcatttatgagctgtgggcgtgggggattttccttcataacctaacagaaggaagtctctgaatctctcaacttaactttatcgaactcacagcatcgtggctgcatttagcagttactttttgccttcttattttctgtaaaaaagtagatagatttcagcatgctgtttcctacaaaggatgtcaaaatgaataagaagttaagatattactatctacatgtggtatttatcataagacatttaagagagcttacataaatacaagatactctcaagaaattttttaaaattagaaaatattttcctgaaaagaggatattgaagtcaatgaatattttctccaacatgtcatctagataagacaaaattcaggcaagataaaggaagggaaatattcaatacaaacagaggtctgttaaaaacaacttagtgataattttttttaagaccatgtctcaaagattagaaattatgaatttgtgagcagtcatgtagttatcaaattttttagaaaaacaatttagtcttggaatttggggactcgcttcattcttgagatcaagaaaaccctttactgtttagtaagtggcaatgaaaggtaaggaaaaatgaaatgagtctggaaataaatggccagtttcttggcttcagataagcatttctcagagtctttcatgatattattgtagagcacatggagaactaaggcctgggtaatggtatagtctggtggatttatagttgattaaaccaaagaggtcaaacaggcaaagcatcaatgttatatgggaaagaaggcctttaaaggaaaggtctgtatttgagcttgcaatggagaaatgtgcttctcagatttgtaaagtatgtaaaactcatgattcaaaaagatctctaaagactaaagagatggacaaaaatcaacaaaatgaaatgtaatgtacatgaataaaaattaaaacctacatttaggctcagaaatcccactgttaaagtacgcaccccgatgttaagtttgtatagaacacacacacagacacattctagatgttttagttaa

SEQ ID NO: 63180 - DNA, 816 bp, Bovine  19866880638072
atttaccaggagtgcattcgaagtattcctttgagattgttcacagagatttttcaaatttatagttaaatactcaaggtatatcattacatcttaatagctgaaaacccattaacattctggataatagccttcttgtggcaaacaaaaaggtcttctcattggaaaaaaaaaaaaagtatgcaaatacctataaaaggaaagaaagaaattaaaatgtagaaacagatgttgtaataaaatacccaagttcttcgtaaaagttctgaatcaaaatgtagtcttattttagaacagcaatccaactaaaagaaaaattattttaaattatttcagtccctgttgtgtacctaatttctttcaacatattttaaccaaaaaatgaaaaaaaaaaaatggcagaggaaaggaaatgaaaactctgacaaagcagatttacttaaaatcacttttgtatttctaaatatcaagaggtattctttcatcaactacaaaacaacattacttgtttgacttttcaagtaaaattgagccctccctttttattggtttaagtcctcctcactttccttctaactttatctgctaatctcctagattatttcctttccttctagaatcttatttcaacaattaaacctattgaattttcattttctacctccctacaagctatttcctcatcaaaatctcacctagccttaaaaggatctggcttctggcagacttgtacagtctagtttcaagctattttccttgtcatggagaccacacccccttcaaatccttgtcctctagtcaaagggcatactcagg

SEQ ID NO: 63181 - DNA, 786 bp, Bovine  19866880643584
tcaaagagaaaagtaaataaatcagagggaaaatccatttcccttgttttcaggtgttctttcttgttctagcctcattgtatctgctcccatcttgtaacaggcagcacattcacaggcgggttaggaaagttggagcagtgaggctgtggtttggcgtagggtacgggtgtggaagaagggctgtggtttttgctcaggcaaagggttagcagagccaaattgtggtcaatattcttgaactgagacagagcacatattttatacttctccaaacaatttcttcatctgatcatttaagtcttttagaatttccaccactttggtctttattacacctatctctttacacatattagagataaaaacttttgtaaacaaggatgccttattcattctttcattctacaaacacatattcaagccactctactgggtctattgtgataggaagcccactacagtctgatgaagggagacagagatggaaatatccataatacaagacagaatgcattaagtgctatgatgaggggtaagacaatcactgtgggaacagaggaagtgatgattagttccaactgtagggtttcagagtgttccctgagatgatgacttttgagctgattctgacagctggggaaggaggtataggaaagaaagaaagagatggtgtataatgttggctgggatagacagagaaaaatggcttagcgggattagaaacggcaacggaaaggggaccatggtatgtaggcaaagacacgggaaatgcttctgtcactt

SEQ ID NO: 63182 - DNA, 894 bp, Bovine  19866880703634
ttttgttttctggtgtggcacctttcctgtttttctctttcagccaggtgtattcaggcctggccttccagtttcaaacaaaccatgagtcaaggaaattaacaattttttttctcattataaaagtgatactgtctattagagaaaatacaggaaatctaagaaggtgtaaagaagaaaattgaaaactactggtaatccagttatccagagagctacttactcttaatattttggtatttgtccttgaaatcttttggtggaaataaatattgaaaaagaatgagagcatgctttttattcgtcacttctactttgtgacttccagggtggttcattcagattactgttttttaaaaaaaaaaattcagtgattttgaaatgctgtgtctttggaaagatctttacttgtcataaaaaacaatccccagtatactggagtaaacttctgtaaatgcagactgtggtctgataccactatctcctgaatggatggttggactgggtgatgagggcctctggatgactccttttacctttgacttctgtgtgtgacagtcgatgttaaatgtggcagcagaatgctatttttcctcttctctcagtgtgaatcaaactgacatccgtttcaagatctgagggtatgctgccagctcgcctcgtgacttgtgtgtcgagcttgcagtcacaatatggaaattatggaagatgagcctctctgttcagcaattaactgtggggctatttctgttctactttaagaattacggtgaaattgatactctcgacttatttctaaggaatatgcagttacacaatggtctcctgctttctggcttttattaaaatgcaaatagtcttttttttaaatgcaaatagctaacttcaaagtag

SEQ ID NO: 63183 - DNA, 2283 bp, Bovine  19866880810257
gggctattgtaacttgttccagaaagtaacattagaaatgtcccaatttccaaacgatggtgaattggcagaacctgatagggtccatccaatatccattctctctctgttccttaccatcaatctatgactttatttggggcagcactgggcccagaaatcactcaccttctcttgcagccgagtgtgttcccacaacccagttctaaatgacaagatgtgagcataagccacggggtggatcttaaagtttatttttgttgtgattttcttctatcatatgcctgtgttaacagaagcttgtatgaagtacgaattcaagcatttttctaacccaggaaaattttaatacagaattgaagatcatgaaagccaggtgggcaaacacctggaaatagcataggggcagagtccttaatagggtacaacacccattcgcccttctcacaagaatgttggactgtgattagactccaaatttggaggtcttttcaaatgaactcgacaaagcagtggcagtagaccaagggaaggaaggcaggtgaggtgtgagtcttttcctctcctaaattcagtaattctgaatgtcacaaaggttctttgtttaagaaagctgcatgttccaagcaattcccggaattttttaaatggcttccactttcctggagaagaagcttgtaatgatctgcttggctctctgcctttagagcctctactggagtcacttaacccccaatttgtaggttcagccctgctctcaaccccatccccaggcagggggagtccacccagtctctcctgcctgtcctccccagtcacctggctcatctatgaaaagcaaggatcctgttagtctctggtagagatggccattttactcctgggtagaagtaaaaaataaatgatttgttaatttttaaagcccatttataaatataagatgaaggtgaaatcttaaaaaaaaaaaaaaaaagtgttccaaaacatccaccatgtatccgcactatgaggtggtcaaggcatttttaacacgtggagaccttctgtttccaaatggtcacaggaggcttaggcaatcctttaggatttattctgattttccaggaaacatcccatttaaaggaagaaaaaaatactttaaaagaattccgtgaagcctccactatacaacgtttaacatacagcctcttcccttaaaaacttacacatttccatactatcccacttttattcaggcaggtaaaaactgtgcttttttttttaacttaaggaaagtaatttgatgaaatttaacaaccctaatgaattaagctgaggaaaatgcagaaggctttaataagagcaaacctattgaaatgaaagagcctatacattgttctactgacagacttactagcagagcaaaccagatgtaggttgccaagggaagttcagcttgtaaattgtaagaaaagagtatactgccaggctctgctgggctgttatttcttcattaaaatgcactgtcaatcaggttgaaaagaaatgtctaattaacaccatagggcaccaaaaatttagtgtcagaaactcaactgctatcccgttttacaactgtatctctctaagcaactccatgcatctctttcaaccttcctccccgaatagagccccccttcgactcaatattctagcttatgatcaaaagcatctcagaaattgcaaaatacattgcattagtctcctctttatagctataaattaactagaactaaggtttctagcaacatcccttcttttgcattaggccctgcatcaatgtgaggaccaaaaatacaatagaacataaacaaccaacaggttccccctcctagatatggaataattaaaagagctctagcctgggagagtctagtgctggcttcaccactaaacagcttgtgtggcctggaggagtcttctttcatactcctaagtctcaacttcaccactcatcaagtagggataagtaacaaggtcttgtcagcctacttcaaggattgcttccaggatcaaatgagatggggcctagaagagggctttgtaatatttgatgcacgattattaataccctgtgtcagcggagttgtgtgaagtccacatgtgtttggttagtaggaagcttactgcatcctgatgcttcctgaggggttacgtagctcccctctgctcacacattgctcatattcaggtcatcggggccattgcaagctcaggatgaatccagggatttgggttggggtaaaagtcctaggagaagggaat

SEQ ID NO: 63184 - DNA, 797 bp, Bovine  19866880873219
ccgcaccacaggaggtgagcagcccatgagcaagtgagcttcacctgccactccccatcgctcacaactgcctgaaccaaccctaccccctaatctgtgaaaaactgtcttccatgaaactggtccttggtgccaaaaatgttggggaccactgtttcagggcattcggttccactggaagctttttttttttttaatctcagggaaacattattcagaggcttctctctctgacactcaggtagagcctgtgccttagcatcacccaccctcttgtttccttcaggctttttaaaagtctacagtaatgtagaatgtgataatctcattccacattaaaatatcctttttatcatgagcaacagcaaaaatcaggaagatcttctcattatacatttcctggtaaatgcacacctttaagaatttcattttgtgtgagaaagtcagaatctgattaagatagcagtttacaaatgttacatttggaggccacacaaaaaatatttcgttttgttctgattggtattgttgggctgagttttagtttcttttctcagctacctgaaatccatatatttgggttataccatcaccatttgttagagataggtgtcttcatagaatttgtagtagtttgggagaagttgaatgttctagaatcatagcatgtatttttgccacactattagcattctagctaaggggagtttattgttccagtttttgtcattataatagagtcctgtttaatgttgcatgatccgtgggttgccataaacttggtacaaattggagtg

SEQ ID NO: 63185 - DNA, 1013 bp, Bovine  19866880877804
caacttttggtgaggtattcacctccaaatatccacaatctgagatggctattaaaatatactagtgctttttccaagtgcatgtctatgtgaagctggattttcttatgcttcaaccaaaaaaacactgcatcagactgaatacaaaaatactgtgagaacctagctgtcatcttttaagtcaaaaaataaagaagtttgcaaaaatgtaaaaacaatgtcattcttgttagacaatttttttttcttggaaaaggtcagttttttgttaaaaaatatgctatttgtactaatatttaatcaatttattgttattttaaaaggaaatgataaatattaaaaagatttttaatttcaagtacggtaaatattgatagatagaacccacatttttaaaaaaggtcactgagatcctcaataatttttaggaatatacagtggtactgagaccaaaacatttgcaaattacatttccaacatactgaagtattctaaaaaaaggaaaacagaattggatgatgaagtaaagggtcatcacttacagcaaaaaagcctcattcacagcatcaaagaactcagggcagagtacttcctgaggttcatgtccatggtaggtgagcagagcctctaccagtggttcaaaatctggcaaagtaagaagtgggacacagattcgtgacagggaccttactcgttcaggagacatcctatggaataaataaaatgagcagtaagtaccaaaatcttagagccacacatagttaaaggcatataaaatcttcatgctgaaagaatttaattatttctttgagttattttttgattttaatttctttgaattatttctttcatttctgaggttataactaccaatattcatcacatttgcaattaaaacaaagacacctaaaatatttattaactagctaaaagtaacaaaaaaaaatccatttgatgttaacatgaataacattttttgttaaaaaataactatattttacaaaacaaaaaaa

SEQ ID NO: 63186 - DNA, 3673 bp, Bovine  19866880883177
acattactttgccacaaaggtccgtctagtcaggctatggtttttggatgtgagagctggactgtcaagaaagctgagcgccgaagaattgatgcttttgaactgtggtgttggagaagactcttgagagtgccttggactgcaaggagatccaaccagtccattctaaaggagatcagccctgggtgttctttggaaggaatgatgttaaagctgaaactccagtactttggtcacctcatgtgaagagtttactcattggaaaagactctgatgctgggagggattgggggcaggaggaaaagtggatgacagaggatgagatggctggatggcatcactaactcgatggacatgagttttagtgaactctgggagatagtgatggatggggaggcctggcatgctgggattcatagggtcgcaaagagtgggacacaactgagagactgagctgaactgaagatgagtgcaattgtgtggtagtttgaacattctttggcgtttcctttctttgggattggaacgaaaactgactttttcagtcctgtggccactgctgagtttgccagatttgctggcatactgagtgcagtgttttcatggcatcatcttttaggattttgaatagctcaactggaattccatcaccctccactggctttgttcgtagtgaggcttcctaaggcccacttgacttcacattcctggacgtctggctctaggtgagtgatcacaccatcatggttatctatgtcatgaagatcttttttgtatagttcttctgtgtattcttgccacctcttcttaatatcttctgcttctgttagctccataccatttctgtcctttatcatgcatgaaatgttccctcagcatccctaattttcttgaagtgatctctagtctttcccattgtattgttttcctctatttttttgcattgatcactgagaaagcctttcttatctcctcttgctattctttggaactctccattaaaatgggtatatctttccttttctcctttgcctttcacgtctcttcttttctcagcagtttgtaaggcctcctcagacaaccattttgccatttgcatttctttttggggggatggtcttgatccctgtctcctgtacaatgtcatgaacctctgtccatggttcatcaggtactctatcagatctaatcctttgaagccatttgtcacttcccctgtgtattcgcaagggatttgatttaggtcatgcctgaatggtctagtggttttccctactttcttcaatttaagtctgaatttggcaataaagagttcatgatctgagccacagtcagctcctggtgtttttttttgctgactgtatagagcttctccatctttggctgcaaagaatataatcaatctgattttgagtattgaccatctggtgatgtctgtgtgtagagtcttctcttgtgttgttggaagacggtgttcgctatgaccagtgcattctcttggcaaaactctgttagcctttgacctgcttcattttgtatgccaaggccaaatttgcctgttattccacgtatctcttgacttcctacttttgcattccagtcccttataatgtacttctatacttcataagtaatgaattatacttcatctgtttcataaataatgaatcttgtacttctcagactctttctatttctaaaattagcaaatttcacatcaacaagctgtgttcctatgactatatgcatttgactgtctgaggaaccatccccagaagcagtatatgttggtaatttaattcctgactttcattaagaatagtcactgtatcctaaagaatgaacacacttgcaatagaagaaaactgacttcctctgaacaagtaatctgtagaattaagtattttgtaaccattcccagtatgcccaatgctacatagtaagcacatatggaaaaatctctccttttcccctgaattgcctacaagaaaagaggtatggcagaaagaagtacagatatagcctgaggagagatgagagctatctggaagatgatgtttgagcagtaactttcttctagaacgtatgcaaaccagaattcatgttctgtaaataactagaccttgaatgtcctcagatgtcaaattccacagatatttgttgagaacctactatatccatggtattttacttaacataggcatgaacacagaggttaggagtcccaaattctttataggcctttggaggatggctggaggatggaggtaactataaaacgaggcagggaagtcaagggccatgagagtgatacagagggcttcgcagcttgagaggagaaagaggatttggagcgttccagaatggaatctgtttcacacatctgtaaatgtgctcatttctgttttggtgattaagggtgataagacagtttctttgctgtactgtagctctatttattagtatttaatcctttcccatttactccccaacaccccacctttcttaagaaaaatatcactgtacagtaaatctttcaaagcctctaatggtgttgctgagacaatcatttaagcatttaaaacacacaccacatagtacatttattttagaagcagcagtggttagccactggaaactaaccattgggtttgataaaggggggaattttatatgttatggcttatgacagagaatggaaaaatgctttagtgagatggactggcatttaaaattgaaacacaataatagcaaaaagtgctgaagtcaaagaactgcttagaaatatggttactatttgctgagagaggccttttgaggtggccagatatatgcgtttgcaaccacagtcagttcagttcttccctaaatgtggaactgtgaccctgattgataccagtgagagttatttacttgcagagaaatatttagatgattcataaatccagggcaagtaagaaataagtgtaatagcaacacggttttagtagacttatacattatacgtaacttaggctggaaaccatgcaaaggtaatgggtgatcttttgagtcttctgggtttgcttaaaaattctccttttttcccccaaagctattatattctgtattgattctagtccacaaaactgaaagaaaataatttttttaaaaaggtagagtggaggtatggaagagagtcttagcatttgatttatgacttgtacaatgtaaaggaaatgatcatgagagctggaggatgagaatttcaagaaaaagtatcagcaagtgaaaaagcatcagaaattgacgttgggcaaattgctttactctctggacgtcattatctttatttgtaaaactagagtgttagaagagaaccttaaggaatttttcagcttgagaattccatgaagtagactagttaaaatggacagaaggaccagatatggtttttgtttgcttattttctttccagtttcattgagatttaattgacacataacattatattactttaaggtgtataacataatgttttgatatatgtgtatgttgcaatgctttgttttaaaaaatggtggccttggaggtgtttgaaacgttggtaataggatggaggcatcagttcagttcaattcagtagctcagttgtgtccgactctttgcgaccccataatcgcagcacgccagg

SEQ ID NO: 63187 - DNA, 1011 bp, Bovine  19866880948443
cccaggcctccactttggaaacccagcgagacatctgcctttcacctgccacagttccaggagttcctgaggcggatgtatgaaaccttgaaagagatggtgagtagtggatcaaaatgaagtaatagtgttattctgtgacatcaggaactcttcaccagacttcattaagcctgaatgcagtcagggacttgtggtattgacctcacatactgaaggattagacagacaaattacctataagtaatggagacaggaagtggtttgctagtgtctgatttattatgactccagtcttttccttcttgaagagttatattgtcacatgagacttcctgaccaatcaagttgtttttaaataaacaagactttgacacttgttgtcaggtcataattggggttcttttaaaggtctttgtatctctcaaatattgaagagtttgaagaaatgcttactcttttctcaactctgttctaaaatgggctcaactaagagatgataaaatttaagatctcttctttcaggtattttaagtggacttttcttgtgactactaagattatgagtgtcttcactattgttatgtaagttattgtgttcaaaatttgatgtatttttgttttgacataaaatttcttagttttattgcaataggtatttttgtgaattagtgcattttcatattatgaaaacattatacttattttctaatttcaaaatgagaagcaaaattaccatttaatataggtattcttgtgttaaaattttctttccttaatcaaaggagcaagtaggaaatttgaagaataattcatagtgatgatgtcagttctcatgtctctagaaagtagaaatgttgcagtctgtatgaacaactaatgctaacttttttaacaagacttttgtaacttgaccttaaagtgattctggaaagtccagggctgacactaatgctgagacatatgtgaggaatttattgcttcagcagtaggaaatgcgtatcatttcag

SEQ ID NO: 63188 - DNA, 3303 bp, Bovine  19866880958583
gatcacgatttgtcagaactcttgactatgaccaagccgtcttgggtggccctgcatggcatgattcatagcttcattgagttatgcaagccccttcaccatgactgtgatccttaaggggatatggtcttctgttgttgttcagctgctaaatcatgtccaattctttgcaactccatggactgtagtaccaggcttccttgtccttcactattccttcagatccatgaccactgagtcagtcgcgctatccaaccatctttttctctgccacctccttctcctctgccttcgatctttcccagcatcagtgttttttctaatgagtcagctcttggcaccaggtggccaatgtattgtagcttcagcatcagtcttcccaatgaatattcagggttgatttcctttagtattgactggtttgatctctttgcagtccaagggactctcaagagtcttctccagcaatggtctttagtatgtcacataaaatttctctgatctctgtttcaatccttaactcatatttaactttttaactaatatctactgctatcaactcaaactattttagatagatgaaagaaatatacttttctgatacttagaagtattttactcctataactttcttattctcatatgtaatgatcatactcgtaaacagtactctcacaccattcttgaactggaactagaataattaaaaaacaatgtaagtgaaaaaacatgatttctgagttgaataatatcctccaacatagttctccactttaaccacttgaagggtatccagataggccactgaattgtacctatcaaaggaaataagtctattcattgtctaataaagaataaaatttgagactattaatcaataaaatcttaatggatacttcataaaacttttaattactggcagcctatttttctatcttgggcctgggaaatatttatttaattctttaaataattatttaattctccagccaagaattcaccttgatcctctttccctacctgggtaaaaggcataaatccaccattggcagaaatactataaataacatagttgtcctgttaacatttttctaaaaatactgattgaaatgtcaattcggcaaagcaagtctgcatctatatcttggaataatttagggctcagagtcttctgaatgcctttctggacccttcaaaatatgtagagatttccgtctctggtttttaagttgtagcatgtgttattgggaatttgaagagcttttccatgactcctttctcatcacactgagtttctagtgggttgggaccgagccatatttcttctggcctttaacaaagaaaaagaaaagaaggaggaagaagtaaaaaaagaaaaaaagggagtccacatgtctttggaccttaggatgcagtgatttctttgaaatcaaacagagggagaattattgcccctcttctgtgtcatggactgatgagtcaacatttgaaaagtccttgaaagttcttagatgaaagagcacagatctgtatgaagtattattattataaaaataactcagttttcatgtggttatattttttccaaaaagaatgttcttttgtttgctgtttgtaatcaattaaaaaaaattaaaaccaccaaaagtagaatattcttgcagaagaatattaaatcattaagacttttctgggattaaaaaaagcaatgcctttgaggatgctcaaggtgctgcctggatggtaatattggagaactgcattaataaagtttaaaactttttataattatctttaattaactatagcaggaaaatttctaataactattttctacttttttttctatttaggtttcaagagaaaccatatttctccaggatcacaaaataaaatataattctcttgtattttttacatatccattccttctttttttttttttttttgaagagaagcagcattccacattcaggctgtacacaagaaggactgtactcaatcaactactcatagtttcctcatcctccaccaagagtaggacttatgatcgtctcacttcactgagcacagtggctgtgattagactgaactatgttgggaatatatcatgtactacctaaatctttttatagcatgctgatgaaacagagaataagatattactgttttaaagaagttgtttgaaaaaaaatactaagcattttctcctgtttattaagccgataaatatgtatgaaatacgtgagtacaataaatagaatagagaaaatggatttttttctttatggtccgcaggtaacagctaggattctctaggttgatgaattcttgtgtacaaatcagatacagaggaagagaaaagtgaaatgcattggagttttgttgttccttcttccaacttggtccaagtctgagttacttttcagagctatctcataaccatccaggcaactgtaatttattaagttgtactctggctccaaagatgtcaggtgtttcccaaagtgatgagctaaagaccacacctcacatatgttagctccaaaaaattagaatcagaactttaaaattatattcttagtcaaaaggtataacaccttctttcatattctttcaaattaagaaataaagtagaggtgtggggaaagtattcaagtattttagcagggagttttctcctaagtttcctttggccactaagccaaagcatttttgacagataattggactagaaatagtgcccttggaaaccatcagccagcattcccacccattaattaggtgattcattttcatcttttttcccctccccaattttccccccagtttctttttcccacccttttcttgctggtttttctttgcatcatctaatacctctgctctcctactctatttatctgtgttataactcacagcctctggatatagttcctattcttattgcctctcacagcctcttggtacctctttgacagatcctcctgttgtaatacttagaaagtgaaagtgaaattgctcagtcgtgtccgactctttgtgaccccatggactgtagcctaccatgatcctgcatccatggtattttccaggcaagagtactggagtgggttgccatttccttctccagaggatcttcccaacccagggatcaaacctgggtctcccgcattatagtcagatgctttactatctgagctaccagggaagtcgttgtaatacttaacctccctctaaaaaaccttaaccctgttgtaagtgagaaacctctcggaaggctctcggaactgctccaacttc

SEQ ID NO: 63189 - DNA, 1492 bp, Bovine  19866880971918
cccccaaaattaagtttcacacatgatcccggatgcttgttcagtgaacctttcgtagtttgtgatttttctaaaacatttaataataaatgtgtttcctttaaatataatgtttacagattttatactgattatcttttctttctgttttatcaagcctacttattttaaccttcatttctgcagatgaaagccccaaaatcctaatatggtgcttgtgttgtctgattaagaaagatccacagaattctagagaatcaaaacttaattcctggacacggggtaagtgtacaaaaagccctgtactgctttaaattcaactgattatttaaaaatgctgctttgatagtctagaaactttcaaacacatccttcactgttacattatcttgctggttataaagtttttcaagagatttcatttttgtttgattgtgacttccgtatgagatagatcctcagggtgaacctcccctatgcctacaaaagctaattttgagcagttttagaaagttgctcttaggtaattgaaagaatgtactctctttccttctatgatagcaactgtttcttcctaccaacctacattaaatacttatataattcctcttcagatacttctatgcctctctcagaatgcattccgtactaaaactgaattttgtaagtgccctgggagcactttattttgtgtcctgaagttggtactctggtcagtgtgctcagactagcatctggtactgattggctgttgctgcaaacaccgtcaaatcagttacccaaccatgctagttcaggtagctgacagcttcctgaattcccgctgtctgtttctgctttcttttgaatgatgggcacaaagaggagaattttgtaaagctgtgcttagctgccctcaccaccagtaacttggctgttctttcttacctcttgctgtcctgctgcagtaaccccaaggacttacatgaatgtcaaactccacttactatgcatatggtccagattagctgcttagtattatgaaatcacccacccaaattaacgcacatggttttgtctgactggtgatatcattccattcactgctttttaccattcctttgttttatacaaagtggctggcagagataacagtgtattttttgttagattaaaaggagaattggaaggacggtaagaagtgaaaaggattgagtgaaggaagggaaaaaaatgcaccttttaattggaaagaaagttaatgttaagagctaaagaaaggaactgataaatagaattagggaagaaaagatccgaaaaacaggctatagaagtagaataacatatttagttttttaaatttcttaatcattgcttttgttgaatgtttgctctcttaatgattatttaggacatatatttttattggctagctcattcagtcctggaataggccatctaataaagtatttttagaggcatcaggttcagttcagttcagtcactcagtcat

SEQ ID NO: 63190 - DNA, 838 bp, Bovine  19866880992213
tttccctgtgattttgcatgaaatggtaaacaatgtaaattcgattgaaaattgttcaatacagattctagctttgactcatgttcccaaaattttgttcttgcgtgtattatcacatttgagctctttctcaggaaggcaaagaggactacatgacattaacaatattttttaacatgcttatgagattaacttaaatttgttacaggtcttattttttacagtagtatgggaggctgttgtttttttttcccccagataatgaatcaaaagaggacccagaaagttgagagattccctgcttttcatttttccccctttggccaaagacatgcaaataacttgccacaaataacaaagacgtctgcagagcactgccagtatctgagcgaagaagggttattgtggaattgattccagtgtctttggccattcctttggatgctcagtatggcatgttaggcggagcttgggaaggaggcagcagggcattgtctccaggcagtgcagaaagctaacctttttatagcgtattataaattatcctcatgctttcatccctttaaagacctaaaacatttggacttgagaatctttttaaaaggtgtgcttgaatcctgttttcattgctaagtgaacaacacccatctagaccaagtaagatccattcatggcccctgatctgggtcccagccagaccagatctctgcttctgactctgccaaggtccagcagagcgctgtacacagaaggccagatactgggaccaccagctgcctagatgcttttcaggccttttgtgtagttattggtcttgaacattatttcttccaaggaa

SEQ ID NO: 63191 - DNA, 1126 bp, Bovine  19866881022448
attatatcccaatttttaaaaaggctcagtggtaaagaccacaagtagagtggaatgagtcaggtaaattactagtgctcataataatgttacctgtaaatattgaacaggattccagtacagagatagaatatgtatttgtaagctgatgtgacagatgattacttgagtagcatgatttaacataagcagccagaaaaggaagaaaaaataatggtgaatatctgaaatcacattttattgaactggtagtccattcaacaccatttcacagtgccctttcctcgaatagtgccatgatgtcattgaagcttctctgtcatttttaacaaaacagaggtaaatctattaagtttttccaaaacatatccaaaattgtgattttcaaaatgaaatttgtgaattctataatgaaatcagagaagtcaaaatggctaggatgatactagacctatactccacatagagaaaaccagacacaaattgcactatgtggggaatctcattaaaattgtctccaaagttaatgacaagtgtgattctcagagaaagtagaatagggtacttggcaaaatgcttttctctagtggatattgcataatattcatgatacaagtatggaaaagcagttactgttatacaatagtacatgctaccagatctttttctttacatttgaggaaaaccagtgatgagcagattatgaatcaactcttcatctatgtgcagtgctcatatgaaagagaattgcttgatgagtttctgttcagtgaaaacccttgtcacagggaagaatgttttgtttgttttggttggtgattatcttgtgagccataaaagagaatgaaaaggtatgttggaatcagtagtgacaggtaaggaagaagaagggacattgctacatgaataaaagaaattgcactagaatgtgaataacagcattatttcattctcagagaacagtgggtgatctgcacggtgactcttaatcctgattgtagttgaaaggagtaatgaaaagtgtgtcaatttatcgcagtatgaagaaaatgagcagcaaatagcttagtggaggtgaaggtgcctcacaaaagattttagaatgtggaatgagttaaaaacttat

SEQ ID NO: 63192 - DNA, 1456 bp, Bovine  19866881073242
tccactggtgattgtggtaagcaaatagttggaaggctaaaaacagggcagggcaccttggtcaaagaaagtacgtggtttctaaatgactatgcagcccatgtggggaactcttcaaggggctgaaggaaagggggtatgagtgcaggggtggtaatctgaatcagcctccctgtgtcaacatgtggctgggacgctgcgtctatgggaaagtgtccatggaaaggttccaggcctgacgccactgtttggggaacttgctgagctgaggccataggaactggacaagttgaagaccacccagcatttctggatggcctgttccctatggattagcagacataattttccaaactaaataaattttattagttgctgagggagaacatgctatcacaagtaaaacaaacagcaaggagtccaggcctactcatggagctgctgccctcagctttccatccgagcactgtgggtggagaagggtggctagtctctaagcgggtcacctccccgccagtaagttctggagcggcttcacacagttttgcagagcatgccaaggagcattctccttgttccctttaattcagctcttgttgaaaaagtaacactggaaatacaggttgttaagaccatatgtgtcaataaaatacattactaaacaaatcagaaatatagctaccaaggtgaaaggcaaagagcattttgcttaaaagtaaatactttcaaaaactgctttggagggtgaaaatgccatgcggtggggtgagccactggaatctacagtgtatgctcaggggaatgacgtgaagggcacctgcatgtggagaacacttactgcgttatacagacttccgggtcgattctcatccaatatcttacagatataacaaagataagcaatcagactcctcagaaagttcagactcttgggtaaattttgaaataagcttagagtagacagaaaaaagactccatggttgtaaccatgaaaattatgttctgacccttttttaaagcatcaaataatttaattttctctttttctttctaaatcttaccttaacaaattcctaggttataacatttcattaaaaaaaaaaaaagaaattaagggcttccctagtagctcagtggtagagaatccaccttccaatgcaggacacagggttcgatctctgatctgggaggatctcacatggcgcagagcaagtaagcccgtgccacaaccatggagcctgtgctctagagtccaggagctgcaactcctgaatcccatgtactctagagcccgtgctcagcaacaagagaagccatggaaatgagaagcctgagagccacaactagagagcagtctctatacaccacaactggacaaaaaaccctgcccagcgtcaaagacccagcacagccagataaataaataattttttaaataaattaaaatatagactgt

SEQ ID NO: 63193 - DNA, 1012 bp, Bovine  19866881089404
atcttgaaatggaattccaaggtttccatttgatggtaaagaggggaagtggtcattttcagcacactgactgggaacatgaagggcagatttggtattccgtctttccggaacaatgtctagactttctgaggagtcacctctataaatagcacagttagttaaccaagaaataaaacatttctacttcaagctacttcgagctccactctggggttaaatcagggtggatttttgcaatgtactcacaaatcccatgaagtaatcagttttggtttttttttaagtaatacatctttaaaggtgagcttcctcacatctttggccttttaaagttactgcttcttttgaggaaaaagtagctgggatattcttccaattacattttagtggggagtaaagtgacaaggaaatctctggcccgctttatgcaaacaggcctacagggcttggacatggtgggttccagctgcacaatggctgtagtacgacataggcaatgttcccttgagcaggactattcatatactgcgctttgcttgagaactatttcccgagttggtgctttcctccaaaggagtctagccttaagagaaatacacacaccgctccacgccaaagcacagacacaacacagtccagaggccgggagcgtgtgctcaccccgtggagtggcttcaggagtgagaacgcacacgactgggaatagtccaactcagacaactctgcacattcaacctcatgcttctttttcacccacagtgtatattctattcagtaatgatgcttctgtagagaaataaccaaggggaggaacaaaaaagtatgagccgtttctttgcaatggaaaaatggaaaagcctggcttgactggccatttcaggctcaagggctggaagagattaggggcctatgatgacatcaatagagagagaagattacaaatgtaggtagagggggtgattgcttcaggaaggcctttcaaaggcctgacagcttctcttgaaggatg

SEQ ID NO: 63194 - DNA, 2551 bp, Bovine  19866881124077
cttgggggaggtccgcctgagagagtcgagagcgagcctcaaaaggaaacaggttttgaaaacttacttttattttagaagtcaaaaaacatacacatgcacttcgaattcaggtgactattaggtcagcaccttattattcatagtcttaatggaaaacacccagcctggaggccctgagaggccacagaacatttggagagaccatttcactttgtacaacctgtacaacacgtttatcttttgtttttgcaacatcttggtaactatagaacttctagggctaattctggatagtcccaagagatggaaacataattaacagtgctccatataaaatacaagttactagaccatcacactttaattattctcagaatctaactctaatgtaataggcatcaagttacttctagaggaaagcacagcagtcctatgctatccgagtcttccagatctttctgatacttccgcagggtcctgtcacggccccgagataccgtgctctgataagtgaagcagatgatgcaatcaggaagcacgttcttcaggttacccttccaatcactcggtcacgtcacaggcttattccagcctgcttggttgtgcggcaccgagggcccaggatcctgaggagagcagcccacgccaatcaaggacttgcagctctgtattgtaattacctccttgaaccgtaaggcaacagaggggttacatcctgccaatgccacaataaattaaacacaataacaccctctgaaatccccctttaaccataatggaagctctgcatgtctatacacatgatcctgataaatgcttttgtaaatcaactgacttcaaaactgtttgggggaaaatggttttaaaccgtaaagtggagactgaaggttatacaatgcaatgtttaaccggaatgcctgctttctctctctctctctgtcatcctgggtttactgataggctcaggcctgagggccacaggtaaaaagagctcaaagaagatttagaatcacaaggttgcagaatcaaatcaaactggaatttttccatagagagaagacttaaagaaaatttaataaggaccttgaaagcaaggaaatagctcagttactatattttgccactgaaaaaagaccagagaaaatgaaactatagcatgtatctttccgttagaaatagatttacctgacaataaaggtaatgttttgaatgggctgccaggacttctaaaagcctttgtttattttgaatattatagttatttttatataaggtacattcttatttctcaccttaatatgcaactttttttttttttttttttaatgcaactgttttgaaagatgagttcaagcagaatttccctaaaagtatctctctttctctttgggctctttcaatctttatatctattttcttttctttttttttctatcaaacattgtaaacgtctagatcagcagggtttgatttgggccagctaactcacagatgaacgcagcatggctgctggtcactgtgaccctatccacggtcccctcaaaggccccaagatgggacggcaaagaggagcctgggagacggggagaaggtaaagcagggccgtggtcacactcttgacctggtagggactgatcaggacccaaaaagagagctgggatacaggaagaaggcagcagattcaattatgattctctcacacagcctccaatttgaaagagagagaaaacctaagttctaactggattaaccaaacagaaggtatctcggtggactttgtgtaaactcagcccatctcagtgcgctgtatgagagacagacacaccctgcccccaacacaagcctcagctcagcgggcaggggaacactctccagtccagtttcctggccaccaacttaagatctgagtgttcaccatctatctctcttgaactaactttctccatctgtacaagaggaaacaaatctctgcaccatatctcccctcggtgacaaaagcgagtaagaaagccggttggagcccacgaggttcctgtaagatggaggcctggaagcatgacacctcccggagagctttgtttattcagagtgcattggtctttactccgactcttacaaaaatgcacataaattccagagctgccccccacagagggaaaacactggattggtcaggttctgaggacaccctgctagcctgggcccctgacactggattaggcaatggggcccatttggtccactgagcaccacactgcccaggcctgagttactgagtggaggggagcctgggcagcccctgcatagaggcgggggttcgaggatggcagcctgacaccaaaatagctgtcagaattctttgtagttactttgttgttctaaccatttttctgggggtgtcattttgtatcttttaagtatttgatttttcctccagtgaagggttagaagtttattttttgaatgattttctttgttaattgattcctcctcttgttcataggggcttccatggggctcagcggtaaagaatccacctgcaatacag

SEQ ID NO: 63195 - DNA, 1939 bp, Bovine  19866881251426
ctgaaattaaaagacttgctacttgggagtaaagctacaaccaacctatacagcatatttaaaagcatagatattgctgacaaaggtctgtctagtcaaagccatggtttttccattggccacgtatggatgtgagagttggaccatacagaaagttgattgctgaaaagttgatgcttttgaactgtggtgttggagaagactcttgagagtcccttggactgcaaagagatcaaaccagttagtcctaaaggaaatcggtcctgaatgttcattggaaggactgatgcttaagctgaagctgcaataccttggccacctggtgagaagagcctactcattggaaaagaccctgatggtgggaaagattgaagccaggaggagaagggaatgacagaggatgagatggttggatggcatcactgactctatggacatgagtttgagcaatctctgggagttggtgatggacagggaagcctcgtgtgctgcagttcatgggatcacaaagacacaactgagcaactgaactgaacctctggttgaatcagattgagttttttgaaagaacctgtttatcatcttcgggaaagttctagttgaaactggaaaatttttaattttattctagctcattacgtattatagggacttcaatattgttcattcaaaaattcagtacattttagaaactagctattagttgaccttagctttgtacatgtttgttactttgcaagagtactcttaaggctcaaatcaagttaaaattagggtagatggtgtgtacctatacagtcagactaaagctgtatttttttcctgtcgacacttgaatagaaaaaagtaacctaagaatcatgctacagtgtacagtcttattcaaaaccacatatactatagtatttttaaaacctggaaccaaaatgtagaatcattgtgtttaatagcagttaaactacatctgatattacttgtatgactctgctgctctgtttcagcttttggattacattagtggtatgagaatgatttttatatttaagtaagatacactgcttcactgcacagatggtatcagttttgaattacagtactaagtaaaaaaattctagaacaacaatgattttgccagtccgttcttactgattatttattttggatgattgtagtccttttgaaggtagcagacttaacctagaaactggagccaagaaccgaatgggtgggcactcctcctattccctactacaggtctgctcatttttcccaagagaatcagtgcaagttctccgtgaatgcaagactttacttccttaacaaaactactgtcttgattaacttcactctgctcctcgtttaaataaccacgggtcaggtaagtactctgtagctctcatatccctatgaccttggcacagtccctttttttttttctcatttttttttcatcctccctagattagctcatccctttccatggctacaaataccgtctatctgttgatggttcccacatccatgtctttagctcagatctgtctcctagcctacatactcattggacattttcacttgtgtgcctcaagtatcttgttctcaacacgccctaaactaatgcatctttcaatctaggtgtgtccttattgttctcttccttcttttagtacacagtggtaccctgcatctagttccctggtcagaaacccgaaagtgaaagtcactcagtcatgtccgactctttgtgaccccatggaccccaaggactgtagttgtctaggctcctctgtccatgggtttctctgggcaagaatactggagtgggtagccgttcccttctccagggatcttcccaacccagggactgaacccgggtgtcccacattgcaggtggattctttactgtctgagccacaagggaagccccggaatgctggag

SEQ ID NO: 63196 - DNA, 1035 bp, Bovine  19866881313992
tgcctccccgggccgtgggtcccgcgttgcatccctggcgcggagcccgggatcggcggcggcggcgcgcgacaacggtgggtaagatggccctcgtccgggggctcttgcgcgcaccggtgcgggggcggccaagcggggtagtgacggagggagctgccggggcgaaggtcacggcctcggctcgtcgcagacccgagggcccgcagcgttgaggcggcctctggatgccctaaaggtgccggtggctcccccaggtgaagccgaggaaggctgcgtcgtgaggccgtcgatcgtttcttttcttatgctgaggggtggccctggggacctgtcgtcctatgtttaaaatgccctgtggtttttgaacttcaggtcgcgaaatgggtccgagtgaaccggagaccccgaaaacggaaacgaaaggacagagaagaagtgtttgagaaggtaagggtccccgaaagagagcactggatggagttcttgatcagtctccccatctgcccccctccccccaatacttgatcacaacaatagggtagcattttttttttaacgttttaattaaatttgcagtaaaccttagatttacctaggtatagttctatagaaatactgattgataatccaagtgattatcaacgtactttgttctcaggaagtgaaaatgacccaggatgcagatttctttcatgctctttaaatagagcatcagaacaaaaagccagttccattacattattacattagaccagtaacatttagtatggtatatggtattattatgatataatatctctaaaaaccagggagtgttcggaataaatgacccacagagtaaggtttctctgtttgatcctgagagagaccactcacacgcgttaatttaggctatagatactctgaaaaatggagagagaagatgaaagtagtgtattacttttgaaacagtggagggattttgtttacttaaagcaaatgagaaatttgtttttctatatttagaatttcagtatgctcctttgcagaagt

SEQ ID NO: 63197 - DNA, 1058 bp, Bovine  19866881521650
gactgataagtaaagagcacagagaaataattatcaattactgaaatatcttcagtgcacttcagagcagagaaaaatgataaagctccctattacacgtggcttgttcttaaaagattttgattgtgcaataaaaggcttctgaatgcttatgctagttcctgactgttgcatacccaattttcttaagtacctcaatttgcgaataaacggtgtgcacaaacatgcccaagaatgaatgtaaccggctctccctccaccccctcctcctggggttagacagggtgttgtcctgtttattcttatctcccagccaatgtgtaatagaagaagcaaaccataacgtgctggtacaaagggcctgttgttttcagccttctaattgtgctcctttctattggggaaggaagcagtcataaatttttgtcattatcttaagtagcaaggtttcacagtttggggagtttttctttacttgttccttgttagcttccagttgaatttttgaatcccctgaactaaaaactgccatacttttaaacaaccctccgataaattttagggacttgtgacccttgatttcaaggcaggatgcaaccatagtgactcttcccttggggaaccggatttcaagccctaaattagtgcacctttcagctcaccaaggtttccagctcatctgctctctctgatgtgctgtggatttgggggtctatgtgtgagttttaattctttgttattgtcaccatttgtttcccagactttaataaattcttaaacttctttctgcatggattgttttaaaaaatattttaaaggagcacgtctttcccccgttttcctgtataactcttctgcttttacaaacaagtgggtgtgaatgatagaaagcagctcataccttcctttcttcctataaaattttaatccttcgtttactggcacccctgccgttcactggagcaatgaacagagtgtatcgtgggtagcaaggtccatgggtctacacaagggggctcagtccccctcaaagctttccctttgtgcttatttctcca

SEQ ID NO: 63198 - DNA, 684 bp, Bovine  19866881886965
cattctgagggtaaagcctgtgtttctctcatctttgaatcatgcacaatccctcacgaaggacagatatacaggctatattcctagaaagaagggaaggggcgggaaggaaggcacttagctggaggggtgatttcagatcctggaaaaagcttcctctggcaaatctcatgcatctggtctgggatgcttgacagttctgtcgaagcctaaggtctgatacagttacaaaggaaattttcaagggaaaggaaacacttttaatccctattattcacttggtgtctagtcttagattactgcaaatgagattcaaattctttctggaaatcaggttttgaaagggagtgaaaagaaggaaggctagggagctttcatttggggcaccaaaggaaaatgtctcctgtttcttcccggtgccctatgctgtgaagaggtcaatacatttttcagttcagttcagttgctcacttgcgtccgactctgcgaccccatggattgcagcatgccaggcttccctgtccatcaccaattcccagagcttactcaaactcatgtccattgagttggtatgccatccaaccatcttatcctctgtcatctccttctcctcccgccttcaataaagattgaaacatcagggtcttttcaaatgagtcatttggatagtgtcaaatcagatac

SEQ ID NO: 63199 - DNA, 918 bp, Bovine  19866881942555
ccgagatctctgtgcagcccgtcaccatggctcaggacacactcagctgccagagccccgagagcaccagctccacaagggacctgctctcccagttctcggactccagcctccactgcctggagcccccctgcaccaggtggaccactttcatctttcgctgagaagcactatgctcctttcctcttaaaaccaaaagccaaggtaattaccaaaacagaagactctattcttcaaaaaataacaaagcaggcgcctttgaaattcattagattgcttcttcagatgtgatacatatcaggcctcctaaggagtcagcccatttagagctggaggccattttaatgagctcatcttctacaggcatgaatctatatgtggcaaatgtttctttcaaatttgcatcaactccttgcatttttaacatgttatactttgtgagcttgttttaaaatgcatttaccatgattttctgtttttattgctctggaaaaacgacccctacatgctatttccaggcagtattatggtaagaatgaggtataaaccaaacagctcatctttgtcgagagaggctcggttatgttcctctgggtctgatctcgggccccttattctgttgcaggtcgtggtgatcttccttttcctgggcctgctgggggtcagcctttatgggaccacccgagtgcgtgatgggctggatcttacagacattgtgcctcgggaaactagagaatatgactttattgctgcacagttcaaatacttttctttctacaacatgtatatagtcactcagaaagcagattacccgaatatccagcacttactttatgaccttcataagagtttcagtaatgtgaagtatgtcatgctggaagaaaataaacagcttcccaaaatgtggctgcactactt

SEQ ID NO: 63200 - DNA, 1488 bp, Bovine  19866881038483
tgtacagcataatagttagatcactgtattcactccactccaaccagacaatcaatctagctataaaaaaactgaagtctactctgttaattcacatccaactaattaaacggtgcagacctgactgatgtatctctgtagtatcaaatcatataaagtcactgtttcattatgtcacagggctgtcatcggttgaataacacctggaaataaatatttatcacaattcagtcagagaaaatgatgattttacttggatggggtgaaaagatctagaataattaaatgaattgatgcaaatatgacatattcataaataaacacaccagtaatatctaacaacaacaagaaggaggggagaaatacctcaatttagaagttcatagaattgttgaagagaaaaatgcatgcttttggaacacaccccatgtttgcaccggtcatatttgttcattcaccatatgttcttgtttcaaaagaacttctactctcatggatcaagtaacgctacagggataaaaatataacttttacaaaattttaaaaaatctaatataacagttcattatatataaccaagaaactgatactaataatatcattatagatccatgatgaggaaagaccatgtacttcagtgccgatttgatctactattatttatcattaactctcatttatacatgctaataggaaaagcaatggttagggacatacaaaaaagataatgaaaaatcccttttaactggttctgaaaagcatgcttcctttacttttcccacagcaagtttacacttttaactctccagcaatgattacagttaaaacttacttcacttacctgagaacattctaggtgcttgaggtaaataaagagaatcatcattttgctacagcttgttcctagagatgtcaaatgcttcagcaaataaggaaagaatatttcctgagagcttaatatgccaagtgctgtttaagtgcttttaaacatactgtcattgtatccacattaccctgtaaggtagatattacttatactatctttatgtcataagtgcaaaaacaggttcaaaatggtaagcttgcccaaggtcacacatcaaccaaaacacattattactcaaactgctaagtggactgtgatatccactttgaatagatacaaatactgcacccttttgtgtatcttttttatccagagataaagctagtagaaactgttagaaacccacagaaaagatttgccacagcagacttcctctcatccccactaaataagaccgttgcagggggtaaacagatgtttccaaccactgattctactacacagtgggtttataaatcaaacgtgaagtatagacatcatgcattttattacacaaaagacagtcgctggagttattttaaaaactctaagtaaaatatgatatattctgtagtgtattctttcagaaatatatgagtatcacagcatttttatttacaggt

SEQ ID NO: 63201 - DNA, 889 bp, Bovine  19866880207817
cttcccaggtggcgctagtagtaaagaacctgcctgccaatgcaggagacatgagacaagggttcaatccttggttcaggaaaatcccctggagaaggaaatggcaacccactccagtattcttgcctgggaaatccccgtggtcagaggagcctgggaggctacagtccatagggttacaaagagtcagacacaactgaagctattcagcacacacacagaaatgtaaagtctgcacatatggatatgctaaattcattcattgattttcagaatctcagatcctccaaggattttcctgaatctccacgatacctcagaaagcttgttttgcatccaattctcttagttcagtaaaaatggttcagaaattcacctcgctagcctccagtgtacaaaattgagctctttctcttggacaaattggtcttgggcaaagtatgccacataaattgcttccagatcatcttgagcctgtgggatgactaagggcttaagacaagatgcatttcacagcatcattttgtactcttcctagtaaacatggaggaaagagaacaagagatacaatctgagtttgcctggatgcaaggaaatctggcatctgaatgccacacttcttgggactgtataatactctataatagcggagcatcaaaacaagtaatagtgtaatactttcatgatgataacctataatttaaagaagcccataaaatgtagaattctgagatctccagcactagcctctgagagtgagtcacaaactcaattctcaattcaaagcaattggcacttctgacgtttatgtgtaaatagatctcaaccaatctcattaaatattcaatctgtattcaaagttattaaatattgaacatgatttaataaa

SEQ ID NO: 63202 - DNA, 1488 bp, Bovine  19866880357863
ctgcacgtggtaggtcctttgtacacaaaggatgagctgaagtttgggtcatttgtgtagaacggggtgatgcttatgtctttatgactctcagttaccagtttgaaaaatagtcatgggatgccagcatgctaacatcctaggctcatcgtattagatgttcagcaggatgcatggcacctaggggctcaactgcagtctggactgctgaagaacagatagaaaatcacataagctgttaccccaaaggaaggggtggtcactgtgcgagccggcaagaaacatcacgagtaggaccatcatgagcccaaggatcacgtttcatgtcccccccccaacccctgcaggacaccatcgcctccccaaacccgcccaactgcaagtctgaggttaggggtcagggtgccccctcccagctgcacattctcgcatccctgaagctctgagtcaggtttcccgcctcctgcgatttcacagctccccgccggccaagctgttttgcagacccaagttggtaatgacagattcttctctcctggccctccactggtgaaaccacggaaagtatttgaaacacgcagccccgggaatgtgcaagcttccattcgctgggcttggcaaggaccaacagtttctcagccagcacttttgactaagacttgaacggctcaggtttcccaggagctcctcagctcagtgtttcaacagcatttatacctttttttttcccccctccttcagcacattaaccctaaagtaggttctggatcctccaatccttggaagcatggctttctctgttacaggcgcggttgtggatgggccacaggagagctggcctcggcctgggaggggaatctcctacccaccagggctgcttgggcctggacagcgtgaatcagagggttctctgctgaaagggatccctggaggacttccagattttctgcctccagagagatctggttaacctattccaggcctctgtaactttgattttaaaatatcctcccctggggttgaaggaagggagagaggatggaaagatcacagaatgtggacctagatacacctatgtgtcaacggcacatctcctccctttggagtttcatcatctgtaaaatggcagtaataataaccatctcaggttatggtgaggtttatttatttttaaaatttatagattttggctgtgctgggtcttcgttgtggcatgtgggctctctaggtaggacgcacagccttagtttcccctcggggtgtgggatcttagttcccagatcagggatcgaaccccagtcccctgcattggaaggcggattcttaaccactggaccaccagggaagtccctatcatgaggtttaaagggcagcacaggaaagcacctagtgtaattcctgcacacagtaggtgcacagcactttcctctcttccttgttcttggtcactgattttacaatctcatcacaaagttgtttggtgaatga

SEQ ID NO: 63203 - DNA, 903 bp, Bovine  19866880365382
tggctggatatgtggggccgagtcttgccgactgacagcctcttcacccacatcctgaccacagaagggtgcctctgagaacaaagtctagtcccttaagaaacaggctaagggacttccctggtggtccagtggttaagactccgagcttccactgcagggggcacaggttcgataccgggttagggagctaagatcccacatgccactgagtgctggtgctggtgggtgcgggcactgaggctcagtcagcgaggcaactgcccctgctcacacaggaggggggcatgaaactggcatccagactccctgtccggccctttccagcacccaggagcagggcaggggatgtatggggcacacaatgggtcatcggttcccttgtggagatctggaccattcctctgccaagttcttggatgcatctgtccctgggaaccttcgttcacccagccagagtttatggagaagggacatggttctaggctaggggcgtagccagcggtgaacaagactcaaaccctacttcaaagagctcacaccagcttccgccggtagcaagctgctttctgttattcaacaaacattcaccatcggtctggtccatgcgcctgcatcagacaccagggtcagcccaggcacacgtcctgcgctcatgctcctgtggcctttcagatggtcagcatctgccccatccagggggaggagaagccacctgagacatggacaggtctcagctctttcctctgctcccaaggcaggccgcagagcatccactcaaacactgggagtggactatttaccaagtgcctcccttcctctggcaggaagtcgctcccagcacggtggttttttttcctcccccctcaactctttctgggcctcgggttggaaagagcaaag

SEQ ID NO: 63204 - DNA, 1748 bp, Bovine  19866880430305
gctttctgcccaagtcgtttcctgtttcctaaacatttatctcctgcacattcatggttttttctcgtatcatccctctgcctggaatacttcttcctttccagaatcctcctggcaaatgcctgcctgtcctttaaaactcacttcctgtctctggcattccctgactctgcgagtctccctctgctcctggaggactctgcaccactctctcttcagagatgagtgatggtgacaaagacggtggtgatggcggtgacgaagatggcaatagcttaccgttatcaccctcttcttatggtctaggcactatgttaagtgctttccaagcattgtttcagtttaatttttacaaccctatacaggagttgctatttgcacccccatttgatagaaaagggcttccctggtggctcagatggtaaagcatctgcctgcagtgcgggagacccgggttcgatccctggattgggaagatcccctggagaaggaaatgacaacccactccagtactcttgcctggaaaatcccatggactgaggagcctggtgggctacagtccatggggtcacaaagagtcggacacgactgagcaatttcactttcactttgatagaaaaggaaactgaggcagagaataacttgctcgagccacacaactggaagcgaaagagctgagatatgtacacagggaacctgttttcagaacccacacccacaattgttatgccaaaccacttccctgtattattatttccatttttattacatttaatttattgttacagttattaaaaattgatgatagatgtgttcctttgtccttgtaccctcagggcctggcaccagggtggacacccagggagcactgaaggaaaaaacctgccactgttcactctggcagttcagttcagtttaaacgaatcaaagctcagttcaaaggcctcgtcctcactgctggaccccctgaccaaccccaaccagatttgagagctcctttcattgagccccttttatgtctttatgcttctccagtggcagacacttttagtactgcaatgcacacatgtgtatacacacacacacacacacacacacacacacacacactgaggattcttccagagggtgcaagagcagctgccattgatgaagccctactgctcatcagcactctggtgacttacatacctcaactcattgatgcctctctcaatttaatgaggctgtatcccacttcaaagacaaggaaagcaaggtttggagctggtaagggaccaaggaaccatgccagggtttgactccatcaccctctggctccaaaacccatttattcctcctttacattctcctcatccagtctcccacatccctgaatttcccacccctacaaccttgggcaggcttccctggtggctcagaggttaaagcgtctgcctgcaacgtgggagacctgggttcagtctctgggttgggaagattccctggagaaggaaatggcaacccactccagtattcttgcctggagaatcccatggacggaggagccttgggtgggggttgcagagtcggacacgactgagcaactttacttacaacctttggcacacagtaggactgcaataaatatttgctcaattgaactggattatggtgtgggtggtccaagaaaaatgtgccacaactcaagcatttcaagtgaaatgcatagtttccaaacccaagcttggaggagcccgctatttttg

SEQ ID NO: 63205 - DNA, 1741 bp, Bovine  19866880439189
tttatatgtataaggcgctcagaccagtgcctggcacagagtagttgctacatagtgggctattgtttttataatgccacaaatacttatggagcctctgggtgctgggaagatggggtgaataaggcagagcttttccaggccctcacggaacccagcatctactagggtgaccagctgtcctttttgctagagccctttcctaggatgtgggtttatcagtgcccaaacagggaaagtccgtggtgagctggattggtgggccaccctaccatctagtggggatacagataattaagaggccatcccaggctgtccagcagaaaagtttgggggtcatggaagcactgagttgggggtgagtgaagcttgggatcagggagggcttccgaaaggagaagggcatttaagctgagacctggaggatgagagaggatgagctgagtgaaggagaggtgcgggagaggggagtgcacaagcagacaaacgcatgtgggcagagctggaaggcagtgaggttgtggcccccaggtgggtgctcggggaggatgtaaggggcagtgtggcagagatgaacatgcatatatttgcttatatacaacggttgtcttttggggaaagcattgggggagggggtgctggagaaaagggttagaaatcctatggagcttttgaactgtgggaatgtaatacctataccaaaagataaaataatctaaaccaacaaccacgcatgcctgtgctcacccctcccctacgcccagctcattccagccgggggcctgcagacagcgactgcaggaccccctgacaagggctgtcccagtcccaggggcaccaagctggcccaggaaggggaagagggcgcagccaaatgtctgctgcctgggccttccccccaggccagctgtagacggaactaaacaggccagcttatcagctgttgccactacgtcccactcagtggagctgggctcattgctggaaaagtggcccccagccctttgccagggacagcactggcccagggtgggggaccctgggaggcattttcccaggggtcagcctgtggtgggaggtctgggggagtgtagagagccaggcctggggtccaggagttggtctgctgcagactcactctgggatattaaaggataaactttcagtgttttaaaattatacaaatattgagggtgagagaaggggcagaaagtgagatcgtgggatggcatcatcgactcaatggacatgaatttgagcaaacttcagaaggtagtgtaaggacagggaagcctggcgtgttgcagtccatgggattgcagtcaggcatgacttggctactgaacaacaacaatctcccagaatgcattctctttgtaaaataatcacactgttcttcagcatatgaaatataagttccccttctctggaaatggatgtgttaggtaccaggtctgggctgtatctgtgaggtacacactctcagtcagtcctcacagacccatggggaggtgggcaccttgtgctcatttatcagatgagcaagccgaggcccagatggtaaaggtttgttcttggtcccagggcaggggagtggcagagctggcttcaagactccatccccaccagtcctgcccgcaaggcggggtgggacggagggcctgtcccggggtcaggagagctaggccccacccggtcttgaagggtgtgtggcctcggccccccgaccccgtcttctctg

SEQ ID NO: 63206 - DNA, 802 bp, Bovine  19866880448799
ctggccccatcactcagcgccttcactccatatgaaacactatggattctgttctctagaagagtgctgtccaatgggggagccacacatggctactgagcacttgaaatgtgaccagtctaaactgagatgcaagcataaagcacacaacagatttcaaagactgcacacaaaaaaagaatatagagataatttttatagtgtttacatgttaaaatgatatactggatatgctgggttgcgtgcatgctacgtcgcttcagtcatgttaaactctttgccaccccatggactacagcccactggggctcctctgtccatgggatttcccaggcaagaatactagagtggattgtcatttcctcctccaggggatcttcctgacctggagattgaacccccatcttctgtgtctcctgcatttcaggcagattctttaccaccgagccctgtgttgggttacatcaaatacattaacttcacctgtttatttttcctttttaaaaaataacatagcctcaataacatttaaaattacataggtcactcgcatatatttctactggacagcactgctatagacaattgaaagcattctttgtaaattaccgaaagcatttgtttacaaagcagggaaatgtagatgcaatttacacttctgcaatgctcactctggctgcaagtagagaaggaagacaattagaaaattattgtaataattggtggtgggcagtgataggggcctgaattaagatggaggctgggtgatgggaggcagatcctatagggtctggtggcagat

SEQ ID NO: 63207 - DNA, 1150 bp, Bovine  19866880449810
acacacacacacacacacacacacacacacacacacacacagaaaaggaaatgtgcttttcagagcaaaaaatgaataagatttctcactctctattaagtcaccatgtcactttgggcaagtcacccaccgtcccagggtctcaattcccacatttgcctcgtttgagaggtaagacaagctaatcctcaaggaccctccctctcccaccttccatctccctgaggctagtagttgcctcctcagtgttccccagaactgtcccctgaccttggggactcactgctaatgctgggatatgagaagagctaaggcctgggccctgccagggtaggacaaggtcagccacagtctcagagtcaggattcagccaccaaccccggcctctggcttgcctacctgagatatctatgtccccttggtagcctcagaggttcaaaggggatgtcagcttgtagcttattatattttataataccttaagatataataaggctgtgatttcagagcaagctagaacagttgcaaaatgccacattgatggttttgagtgtattttagggccttgagctctcttcccaaattaatattcatagggacaggcatgccatttatttgcatatgtagattgttgctcattcactgcaggataaaaaagttttggggtgtttttgtttattgtagttattttaagcttggatgataaaccaatcaatttcaggcaggggaagggcagcttccaagggcaggagtaggttttaaagaatttttgatccgaggaaaggcatatcccagatacacaggagtgaatcataccgaccctgaccaatgagcagaatcaattccaggacggctctttcaaggtcatcccattcagcccctacttcagaaagcttggccatcccacatggcccccacaggtccttgggaaaccaaccccaccattatcacttaaggtcacagttgagaggcaggcacaggtttgaggtgtgactttggacaagtcacttgagcccctgtttctgaggatggtgacctggtttgccaagttgttgtaaaatacacactagagagtaatagaaatgaatggtggtgatggtcgcataacattatgtagtatttaataccagtgaaatgtacacttcaaaat

SEQ ID NO: 63208 - DNA, 3677 bp, Bovine  19866880464759
agaaggaaatggcaacactctccagtgttcttgcctggagaatcccaaggatggcagagcctggtgggctgccatctatggggtcacacagagtcggacacaactgaagcgacttagcagcagcagcagcagcagcagcccatcccagcagatgaaggcaatattcccttcaattaccagaggtctctcctccaaagctgttgtcctcaaaggggctggccacaccccatccctttgcctgagacacatgcactcacgtgtgctgtctccccgagaaaggatcctccctccaggcttcaggacatttggtgatgggtcgcctgctcagggctttttgctctattcttggcaactcattctattccagagggattgggaacccaaggagactgccaagtccacatttacctgggccaaatccaaaagtcatcagcagatcctgtgtccattgccacctggaggtggaataggcagtcacccaaaaagtctcacccaaaagtcaaagtgaggccaaagattggaaatgggcgggggagagaggactatgggttgttctattacagacctctgggaacagccccatcccaccccttccaagaggagaatgaagcatggatgcagaaaaaactggccctggtgaactgaggcatggtccatgggaaaacctctgggctagggatcaagatagctggatcttcgcccaagccttcccggacctggcctcttctgtagaagggcgggttggatcagatgaaccctagtgctgtaagtgatatgattctgtgcaattttccagataaagggaagaccagtagcctaaaccctgatactatataatctggaaaaccagagttatatccttcctgaaacccagcccagccccacccctggacctgtctctgctattagaagatgctgctcctaggagctgccccactcctctcaaaaggactcagagccccccttcccggcaggcacttcctttcctagccccacctccattccccaggccaccctccttcaagcctgaatatctagaactgcactagtcagctgagcagccacctgtgtctatttaagctaattttcattaatctgagtaaaactcagatcctcagtcacacaagccacatttcacgtgctcagctgctacacagactagcggctaccatattggaaagtgtagatataaaacatttccattactgtggaaagttcttttggacaacactagtctaaaaattagcctttgttttcacaaagggcttcctctggcttccctaatttcttcctgcttcagagtcagcccatgttctctagccttctgctctggggaggatcctaggtggttttagaatggaccttggccacaagtgaccaaggagtgggtggttcctatctgcctgagaggtagccctagatacttgggtcacccacggaaacatttgagaggaggacagtcagttcaacaatcatccagtacctgagagaagttactcaatattcatgagcattccttagccagtcacctccttcttccccacttgatatgtcccttgctaattccccttgttcaaagatgctaaaccttgaaaaggggcagaggagaaggagccagagagtattttcggagtcccatgatttgagagatttctgctgatgtgagtaaagaagcttagacaatgccagagaaagaatgtccctggtgttgtctccatgtttccagtccagggggcacaggttcaatccctgatctgggatctaagatcctgtatgccatgtggtacagcaaaaaaaaaaaaaaaagaaaaccccagagatcattttagggttctcctcttcccagaaacttttcatatacatggctggaaaaatccccacaaggggttaaaagccgagaaaataccttctctgatagcatagaagtctgggaggattcagggttgggtagcaggatccagagagctaaatgggttatccagaaattacaagagccttttaaaagtagaaaacatatcatatgtcaagcctataatgtatagacagtaattatttttgactgaatatttttgtgtttaattttgtggtgacgatctcctttacatcatgtattcagcaatcactcttccccttgcttaatatgcacagtcatctttctcctcctatgtcacatattcaataattcctctcctttggttccaggggtggtgagatgagaggaatgtcactttttaaattggtaacagctgtgtttttgttttttcaatttcacctggaccaatgccttgtaaatagctcgagctccaaaaaagcaacatgggcggctgggggctcagtttgtcttgatccccaactcagcagcctttttgaggcctcttctctgagcacgagatgtgcctcaggaacctgctgctgctgctgctgctaagtcgcttcagtcgtgtccgactctgtgcaaccccatagatggcagcccaccaggctccgccatccctgggattctccaggcaagaacactggagtgggttgccatttccttctccaatgcatgaaagtgaaaagtgaaagtgaagtcgctcagttgtgtccgactctttgcaaccccatggactgcagcctaccaggctcctcagtccatgggattttccaggcaagagtactggagtggggtgccattgccttctcctctcaggaacctaagagaccacaaaagggagtgttgagcaactgtgaaggtccatcccagtcagtggaggacacctggccgccacatgaaagtgggctcttgtgtggggcgggttccaccacggtctatttagtttactgtggactctgactctgttcatatccatgagcacttttgtctgaattcccagatgttgactctgcttcccctcagatgtacaagagtggacagcagccaggatagcaagacctgggtgaggaaaccaggcactgagaacatacaaatttaaggaggctctgcctctcaggtgccaaccctacactcaccaaccgtgagagccaggatctccttaaatttttcagccctaggtgccgtgattgcctcacctggcctcctggctcttcagaagccttacagatctgagaatcagaatcaggagacagagagagacaggaagtaggggagattcaacaccatgaagaacaagtgactcaggaagggagttcattaaaatgcttcaagggactccaaactgcaagaatgttttttttaaagagaggaatttagcaagaaatcaatcaacacacacgctgataacttgttccatgacaaaaaagaaacaaaaaccccatcaatttctcagcctttgggtagccagtgtctactgccactaattaattttctagaactttcactctccagataccacaaaacatggttaatctgtcagccccaggaggcactgccagcacctgcttcagggggagcctggtggttttggaacctgtgccacatgagggagggtggggcacagaggtgcccagagcaagctcaggctccctcattctgccctcttctgtgacatccttgcagcacctgctccactaagaggagcagtgtgcaagaaggtaggacagtgcatgccacagcacaagcctccctgcctcattgtccccaaaagcaaaataaagagattgcatgcagttggttt

SEQ ID NO: 63209 - DNA, 1564 bp, Bovine  19866880466137
ggtgttattggaaggactgatgttgaagctgaaactccgtactttggcccctgatgtgaaaagctgactcatttgaaaagaccctgatgctgggaaagattgagggcaggaggagaaggggaggacagaggatgagatggttggatggcatcaccgactcgatggacatgggtttgggtggactctgggagttggtgatggacagggaggcctggcgtgctgcggttcatggggtcgcaaagagtcggacacaactgagtgactgaattgaactgaactgatgagggattcagttccacaactgggtagtttttagttgaggatccggttgtggttaaacatttttttctctctctctaatttctaatatacttaggagagtccttccagctacatttttttcaccagattgtcatcaaaatggaggtcagaattaaaggagacaggtatctattgaagagtggcatcaatgcattaaaagataccctggtggccttaaagacttaatgcagctttttaaaatagctaatttatacaccaggctactctagctcaccctggcacactagatcacattatacagaaaagtagatagaacacacatataataggcaatggccaggctccgttatgaccttattttcactgataaagacaaatctcataattcactcgtagcaatgtcagtcttttatctttccctggactcatgaggatacaagtcacatccactgagcctgctctctgtgtgacaaggaaactcaggcagccaatcatcgcaaaggtgattcattcatctgcattcagaaatcctgttggttaaaaagcaataaaagtgttagggacttttttttccccctttcactctataaaaagtggctcactgttaaaatatatgtcttcactcatctctcagagctgctgtaaaaataacatttggcagtgggaagtggaacttttgcttaaagaactggcgtgtgtatatagtatttgtatatttcttagatgtccacggacacttctcagtgctttcgtgttctagagacttgcgtggataaaatttactatggcatgggttcttgatttttaaagtgtttgtgcggctttgtagagtgtggggttgcagaatgaagtgataagagaaacaaggggaccggagcagtaggatgggcgacatgaagtgaaatatctaatttgactcacacgaaccagttggttgtgagaaaactctctgctctcttcccctgtgccccctgcctgctcttgctccatctcagagtcctcgttgcccacatctgcttcaccctctgtcctgttctctgagccctgatttggccacagaggccagttgagggccaagcaacccagacatggcctcagaacacacagcagattccagaagaccccaagttgctcaagggaaacaagaaagagcatcagaggggtggagggttgggtgtttccctgttgctgaaggggggtttccaccctgctcccccctgctggagcattaatccaataggggagcctagatgtttattttcaaagcaggagtcgcatcttc

SEQ ID NO: 63210 - DNA, 2988 bp, Bovine  19866880493467
tgacattttcaaagaaaattttttaaaaataaagcagttcatttatatggacagaaaaatctaccaaaataaaaaaaagtccaaaatgaaaaatgaaagcttttcttcccactcagtaagtctttctttctaaaggtaattactgttaactaattcttgattttttttcttctaagatggggaatgggggaaaaaaacactgaattcattgaaagagagcaaacaaagttagtataaaagaaaaattaatttgtgtttacagcttgtaattatgagtaatgctgaaacacacatctctgttatatataaatctttgtgcacatctctgatgatttccctaaaataaatttgaactgtatgcattatggacattatatgaaattgtttttttcccaacagtttttaaactaagtatgaatgacattgagttttgtcagtttctaagtttggccccagattcttagaactcaaaagtgtggattatgatctactcaaaccattcaacttatgccaaatatgtggcatatttcgagtggtttgaagccacttgaaattgaaggtaagtatgaaaattacagaaagaggtggtagataaaggaacaatcatcattatttatggcatgatcaagatctttagtgtcattataattggagatacttgaaaatgtcacagccaaacttagctgatgactatcaaataaaaccaattgtacctatctattacttggcaaggtaccaagaggttctagaagatcattaacctgggaattagatgtgttcctgttctacccctaactagctgtgtgaccgcaaagggcaccacttaaaccctccaaggctcagttgtactatttaattcaagttctaaaattctaaaaggaactgtctcccactctctttacacagaaaccccatatcaggtaccagacaaggatttagttataaaggtctatctattcagagaaagcacacacaggagtaagaataaatagcagtatggctcagtagtaattataacgacaccaaattgctatcagtataatgacaataacaatattttatattttatgagacagtaccatgaaaacaatctggaacatcacagagaagagattccttgctccctgggagtatgaagtgaaaagtgaaactgaaagtcactcagttgtgtctgactctttgcgacccggtggactataccgtccacagaattctctaggccagaatactggagtgggtagcctttcccttctccaggggatcctcccagcccagggattgaacccaggtctcccacattacaggcagattctctaccagctgaaccacaagggaaacccaagaaaactggagtgggtagcctatccatcttctccagacgatcttcccgatccaggaatcgaactggggtctcgtgcattgcaggtggtttctttcccaactgagctaaaacacattgatgtaccaatcaatataatttaaaatatcttaaaatacatataaacccgagactatgtgtcatgcactgctcatttgtggggacgaaactctctttagacaaattctaagctctctacaagatgacctggcctctgagcaggagtatgaattataaaaagattgatagatgttacaatgactctacctgtgtaggccctgtattcttttatcatagctctcaaatctgtagattaaatggtcactctcattttaaatttcctgcctgtaatctttgcaaagcacttgacaggaaaaggatgatgctggggttttccattgagtagaagcaagaatggggaaaaaaaaaaaaactgaccagtgatgacaagcattcaaataaatgttctgggaaagatttgtttcatctcagaccagattagagattaagaatatccgggaccctggactgtgattgcaaaggaagtcaagacttccttccccacagctgccctcgaggaagctagtatgtcccaagtatatcttctttcattgtgctccccaagggagaaaagcaaagtagcacatctctcacggatgccaagccagggtgaggtccctacccccactcccctccaaaaaaaggtgccagatctgacatcctgtctggttgaagccacatccttagacagcaattgaaattgcatcagccttcaccttgctggggcaccttttcctttaaacgaagggcaagtgaccattaaatgtggctcccaaaataacccagtggtttcattgcatttggaatgtctgacatctagaactgaggaagtggatgtactgcctctgaagggggagggggaagggtggtgttaccctgtccactgtgacccttcactcagttactcaataggaacagctgccaaactcacaggagcttcaaaatctagacaatggattatattccttagctgtttatttaaacattacaaaagtcagccccacctggcagaatgaattataggcaaagggagttttaatgacagtaaaagcctttaataaagagtcagagttctctcatgactagagagtaggaaaatgtggtataaaaatgaattaggaaattccctggcggtacagtggttaagacgccaagcttccactgcagggggtgtggatctgatctctggtgcgggagctaagatcccacatgctacttggggtatggcaaaaaaaaaaaagggaaaacataaggtggaatttcctcatatggattaacttttgtttaccataacttgacttttttaattttgaatttcccagttgaatttgtcataataagagaataaaaggtcttaatttgtaagaagcaaatatggacttgctgctaaaataaaactcataggctgataatatcataaacttcactaatcctaaaatattaactgtgtgagcatggctagtacgaacacaggactccataatgtaaatggcagtgtttcatgaatggttcttattatctttttatactattctagtttttccccccat

SEQ ID NO: 63211 - DNA, 757 bp, Bovine  19866880499269
cttgttcctctgcagaacaagtagatatcaaactcctgagcaagggcatttagggccttcagaagctgatccctgcttgttacctatggccccatgttccacccttgtccttctttcctgccccactgcaggcaggctacctgccccattcccatctcctagtctctgctcatgctggttcttccccccagagtgtcttagtcaccttagtcaccacaccatctttcaagacttggctaaatgcaacgtcctctaggaagacctcctgggtttttccacttgggtctgagctctctttccactgaactccccagtaactacatctgtctcctggtatacagacaattagtgtttatctaggtaactcgggttgaagatgtccagttgagtagctcctcctataggattgattccatgtctgctccttatctgagtccttctaaacactgaaccttccccactggcatacaagctgcagagccctgactcccatcctgtcttgcatctcctctgagcgcttggctttagcccaaagagtcttctcttgtggaaggaggtcttggtggtcgaggagaaagatgctagccttgggccagactcctgttggccctgcccttcagaaggcagatggctgcccagcacacaggctctagctgctgagctgtgtgtgggaggctcgtgtctgggtgcccagaataaagcatcagatccatggtcagtgcctggctctttccttcaaggacagaagtcataactg

SEQ ID NO: 63212 - DNA, 1149 bp, Bovine  19866880539509
tctggctccccatcatacaccagaacacacttcccagacagcacaccaccttccttcccgctttattgactggatccacccagttttgaaaaaaaaaattattatttttcaagtcagcactcccaccatatgtggcatttatttccagaggaggccggctctgggtttccgtggacagatgttgctttgtgcctgcctgacacggctggcggccggcgtacagctgccccgagcaggtggccaaggacggggtccacttctggcccggcatcaagagggacaatttatgtggagctctggccccggggaccctctgctcattcctccacagccagggacccctactcacacacacaaactcagtacacaattaagacgttcaaaggaggccaagagggagacacagaaagctaggatacctccccccctcaacacatcccaatttccagccaggcgcagctaagctaagagaaggccgtggggagtggagagaagtcactgaccccttctatcagccatctgtgagctcctgccagacctagctagcgcgaagtggaggataaaggaggtccagacagatggcaaagcgctttgggaaggagggctccgtaggaatgcgagggccgatgcgaggcccactttggggtgcgttttgttatctcctcggctccaaacccccctcctttcggcacccacccgcaatctcagactgaaagaagggcaaaaaacagtcgggggaggcgggggagaagaccccactctccgccacttatctctctcatttgaaagtcagagcactgcactgcaactaaagtgcgtgtgtgcggagggggcgggagactggcacaaccgaatctaaaaatactcgataaaaatgctaatcccgaaggcaaagagagaacgaagaaggaatctgtcaatcacgaggctcccgctcctcacccacagccccagctgtacggactgcattcctggtcgagaaggaaagaagtggggggacaggaatgaagaaaagaaagggagagacaccaccacctctccgagcgcgggccgcgggggcgggaggcggcggcggaggaggggctcgggcccgcggagccgaacaaagcgggcctcaagttctatcccgcagctccctggggtgtgggg

SEQ ID NO: 63213 - DNA, 1291 bp, Bovine  19866880552024
ccagatgtcctgtgtttgtatacgcctgtcaaagattccctatcagggtttatgattttgctctggggtttggcctactctcgagtaggtctccttgattgccaatgtctgtccacaaacctggtgcctggggcccctttaccaagtcccagcctctgctctgactgcttcatgggacagttgtttgaatcagaggagatggtaaaaggaagatgttgagaaatttacttcttggcaaagggaagggccagcggactaatactggtggtgggcgccagggtggccgtggggctggctcgagtgcagcgaagggaatggggcccgtgctggggacgctgtcctgaccccgaagagcagctttcaggcctccctagttctctggccccgacaacgagagactctacttaaccaacaggtagacgcaactgtgcaggctcttagagaagtgacttcagtgaaagagaattgaaggttggctcccatcccctggcacacacatttttaaaaccccccatcttctgtgcttgtcgggtcaagaataggagtactgcctccatcccaccctcctttagtcttttttctgtagcctcagcaagcatacaggtcttactactccttcctcccttgtgatccggtgataggcgttgtgtcttgccagcggaggtggctgaagcaacagacctttcagtcttgattactcatggtaactgactccttcctgtgggtcatctggccaagactggattctgagtggaaaacattggctttctgtcttgcttctgtagcagcttgtcactcctctgctgacagttctgaaccagggggaataggggccatggtgtcccgtgtccataagccaaggactggctctgtgatgagggcattcgtggtcagggctagtctgtctgggcagcgcttcccagtctacctgtgtcagttctctacttctctgttttctttcccctacagatgtcaagccgtccaacatcctagtgaacagccgtggagagatcaagctctgtgactttggggtcagcgggcagctcatcgactccatggccaactccttcgtgggcaccaggtcctacatgtcggtatgagcacctcgttccatttctcgaggttcttgtctcatcaggaataggagccaagtgggtgtcttcccatgtggagccagacccttgtgcttgggtgatggggatggcggggaaagaaatgagggatgagccttgtggtccctccctgaggagatcacagtctcaggggagatgggctcggcctttcacaagcc

SEQ ID NO: 63214 - DNA, 1312 bp, Bovine  19866880552590
ttttattctcgcaccagtgtgaccgttccagtttagagccccagggattagggattagggagaggctcccagaagtgccgatttggggaccccagtgactccccggataatagctggagtcaggggtcccttgggcctttgggaatcaagtgccccgcagaaaatgggcctcagagtcattcgttaagctcaggaagaaatgaatgggggagccttagaacttatctgtagaggaaaagtttcattacaggatgctggaatcctatgggaaacaaagtatccgaaattcaacagccagtaaataggagagagttttgttttcaaagctgtgaactcgcaagaagtggagcaaaagggcagtctttggggaccttatatattctacattagcttcggtgggaagcaaaggaacaccaggatatcgggggtgctctggggcttttctctccgccaacacaattcaggggcgtctacccacagaccgctcactctgcggtagtcagcagttaccccaggcccccagggcctttctcctgcagcccctcccctaccagacctcttagcctttgtttgtttttaacagcaggaaactcccttggtgagaaagaagtgatccgcaaaccctctagcgggtggggagttacagagccctgtgaggtgtggcctaatccacaagtcagcccagaagctgcaggggtccctgcctggaaggagagaaagagctctggcaagcctgtcagctgctggggctgagcccagggctcccctcctaattccctgcctgcttggaccttaaaggagagtcccctgaaccccaaatggggcttaatgacctgctccccactcctggccggtgctcggaactaaccagcagccactataatctggtttcattcccttcctctggctctcatggaaaaagagaagggaggaaggcaatagacttttattgatggctttcttcattccaggtagaatgaagaaagtgctgccctctgatttcatcttcacagtgactcttgaactagatgtccctgatctcccatttacagctgaagtacctgaggcccagagattataatactggagagctctagctgcagagttaggatacaaaccagtgatttctgaggcctcagcccacactgcacccagctagctgccttctagagttgcagaggtagaaggtgacatcccagatggagctctgcaaaaccaaagttctttacacaggtgcactattgtgctactagaagaaatgtttgctcaccggaaaatgggctagagatagctttcctcgcagtctgttagg

SEQ ID NO: 63215 - DNA, 1711 bp, Bovine  19866880599971
tccgagagcctcatgaaaaggcgctttcaggctcgggatgcagcagaagcaaactccagagtgagactgataaagcaaacacctcacattcttcccagcatgtgggtatagagagagatttctatcttctatttatagaatacacacacacacatacagcacttctctgtttttttttttccttaataaaacaaaaaagccaagtttgcattcactggggtaaatgccaaggttatcatcccatctagccgatcttccccttcatctccccactgctctcagctggtccccagtccccaagccccgctctgtttactggcctcgctggggtctgattagtgcagatgaaaagaggagccacgatcagcccataattaagagcttcacccttcgccttgatgaagcctcctaccctccaggaatccctccaggagccgggcttatgttgaaggctttctaatctccctgcacttaaaaaaagttaaaaaaaaaaaaaaatctgtagctcttaatctccaaaagagtgattccctgaccgcagaagagcagcagaaattcccagagtcaacatggaggccctgccaggagtctgcccactgggatcagtcgggattagagtcacctcctgagacatggtaaacgtcctcgtcctagggctccaccaaaccggtaaattctgctttctcctcgcccgggaaagctcgggctgcaaatcctgaaaacggcaccacggagaactgcagtacccattaatcagggtcagaaggctggcctgcccctgtgccctcacgccccgcggagaccaagtagtcttgacattagtcaggctcggagagaaatagcagcatatcctcggggcaggggaggagcgggaaggcagatgggtagaaaccaacaaattcatgaagcatccacctccctctcctacagacacagccctggactctgaggcctcagccttcccattcccaggcaggcaacagctgtgcccccagcctccagcccctctaaagatgaagggagaaaacttactgtgttcggaggccattccatttctcacagagcaattctctccatctttccatttctttgcaaatcagggcacactcatctggcctggccaacccagaggctgcctgagccccctccaacccaacccactacaggcctgctctgctcccctctcccacttgttctgtgggctgtggggttctctgaactgggggagtcctttgcgccctggcattaagttatggccacatccccaaaaccttcacagacaagccagtcactcagggccatacagccccacggggattggtccccattccctcctgctctgcaaagaacatttctaaaacacgagatgcaaacacagatgctcagatgggaaaagagctctgaggaagggggcctgtagaatgatccatcacctggtcaagtctcccccctaaactgatctgtgaaggtgaaggctggacagcaagccacgtgggaccagaatggcacctggacagacctgggagcctcacgtgccaacacctcatcccactgaagggcaaactactcccaggtgacttaaagtcctcaggtcacatagcacactgatgccagcgctcatggaagggaatagcagagttggactgacatggcttcaaattctgactccaccttactggttacacagcctggataaagtcatttaactact

SEQ ID NO: 63216 - DNA, 1798 bp, Bovine  19866880611995
agcccaggaatgaacccttcaggaccagactatgggttcctgggggatccaggcctcccaggaagctgctctctgcacaccctctccatgcctatacacacctccccacaaccatcctccaccccagagccctctccacgttcccctcttccttcccaccccgtccaggacaacttctccaagcctcagtcccctttactcctgccttactcctcttatagaaaacctccagcacagcagactgcccttctacactcatttcttgctgcttcctacccaggctctcaactcttcaggggaaagggccctggtttacacagtttccacatctcccacagcactgccgtctcacttagagctgaataggtgatggatgaaagctcttcagtggatggcctgctggaaagagtaaggcaggttcttcttggcttgatgaaatgcccgggaagaaaccagccccaactcatggtgtgatccggaagcacttcctgctgcctttggccactgaatgaatagggaggagccgcttcttatcccaccctctaggaggcacctggagcatggagaaataaagggttgggctttggaatcaggaccccaggctcaagttctgattcctgctgggctcccagagaaatctgcggcttctcttcgagcctcagtggcctccccttgcagagtggcagatagggtcatgggaacttatgtacagtgtctggcacagggcctaacctacgaggatgctccctaagtgccagcgcccctcagcctccccaatgatggctctggggcccatccagtgcccagcaatgggtatcagcagctcggggcagtgatgccccaggtcccatcaacccggatcctggaacgtggccacctctggagcaggactgccaatcagttccccagagacaggcaaaaacccctgctctgacacctggcaatgagcagctttgcacgagacaggcagcccggcagcgccagcaggcgtggctgaagtaaatgagagtgtacccctcgctacctgaaacaacatcatcataactgtcagagcaattttccacctcagtagtttaacacctgaattgttgatgcactcctcccccaccccgccaggctcactctctccatctcacttcactgaagtcagcctcactaggaactagccagcccttctagaattggtggcaaacagtctttgcccccaagagccaagaggctgcagaattaattggcacacggggtcttcagagaagaggagaaaggaaacaggctcaaataatctatctggcatctgtcaacatctgggttataaataatccagagatttaacagggatcccaccgttagactgcctgtgacttcctgtcatgaagatgcagctatttactgggatcatatttattttcctagaatgagaagcaaagctttggagggatgtgagagacagaggcatctctaagatgccatctgtctgttgggacctaccagagaaagacacacacgctggggatgatacttaaaatcttctaactggtgggggagaagaaatgaccaatcatccttacgctgggcctggaggtacccctttaagttgatggatctcggtatggtctcagtgaaggtcgtgggtcccaagggagagcctggggtgacagagaagcaacccagctatttaccaatcagcatggaagtggttcagtattttaacaaccatctctctctctctctctctctctctctcacacacacacacacacacacacacacacacacacaccttcctccctggttactc

SEQ ID NO: 63217 - DNA, 1390 bp, Bovine  19866880622968
ttttgtaggtgcgaattgtaagccagggtttgaaaataggtcatctgactgcatgttctgtatttctctccctgtatcatgcttcttccttccttctctcactcatgtgtctttaagtctattcaaatgccacctcccccatgaagcctattgtttctgtctgaatctccattggccttcctctctgtctcttctaagtcaaccttgtgttaggatattttgtgcatatcatgttcctctgtaagcctcttgagggcaaagactacatcaatttcacctctgaatttctccctcctgaatttatatacataggtacacacacacacaaatatccattcagtgaatgaatactttagtcacagaattctttaatccggttaaatggaaaatctaagccaactatgaaagaaagatcaaaggacgatttatagtaaaccacacactcgctcctgtattttttcttcacaccctgttcccttctctcatatcctggttttcccaggcgggcttccatggggcttggctcattcactctggctagagaatttcctaacattctgtttattagtagtaatagcagtaggactattactatgaatagctgagatttacagaacctctaaatgtcatcttccttgagtgcagagactgtggagccccttggccctggctcaggtctggcccactcaatattttcttttgttttaattgaagtatagttgatttacaatgtttcagttacatagaaaagtaattcagtttcatatacatatatatattctttttcagattcttgtctattattataagatattgaatacagtcccctatgctatacagtaggtccttgctgtctacctatttatatatacatatacttccaatagggctgcccaggtggctcagtaggtaaagaatctgcctgcaaatgcaggcgattccagttcagtccctgggtggggaaaatcccctggaagagggcatggcaaaccactccactattcttgcctagaaaatcccatggagagaggagcctggcaggccacagtccataggattgcaaagagtcggacacaactgaagtgactgagcatgcacgcacacatactttcaatatgtggggtcttttggataaataggcctgtttattgccaggcatttgcatcagactctctaaatacattaactttcaaaactacccagcaaagcaactatatgcaaataaaatggacaacttggaagaaatggacaaattcttagaaaagtacaactttccaaaattgaaccaggaagaaatagaaaatcttaacagacgcatcacaagcacggaaattgaaactgtaatcagaactcttccaacaaacaaaagcccaggaccagatgcttcaca

SEQ ID NO: 63218 - DNA, 1334 bp, Bovine  19866880655633
gacatgagaaaatggtgtgtcatcttgaaaaaggagctctgagaggggttaggtcctgggctgtagagcagacacatggctaggagacttgtggttgcctttctttctggggtttcaggccgtacgtgctcacgaggcatcccttcgccccagacctcattacccagccagctggggctcttgcatcgtcattgtttctcttccctggctgtggagctgagacacgtgagcatggaaaattcttcccctcactgctccaccagtcaaaccccagcaaaccttagtcccagcccgggaccgtggacccctaaagggaaatggaggcagagcgttctggctccaggaataagctaatggaaccttgttaattactatgtaaattactttaatagcctggatccccttcagacaattgtttgggggcttaaggccctggactgggaagatggggtctccgttgaggggaaagagcagcctttccttggcccaagaccctcttgtatggtttcccacagggcagaacagatgcacagatgggcaactggaggaaaagatgggttcacacctgcccctggacggtgggatcctgaacgtgacactgagatggaggaaccgacgccatccttgaaggcgggaactggaaaggacctcagatggtctctagtgtaccctcacccccttattgcatccaggagaaacagaagcccagaacaggtgagtgacttgtccaaaatcacacagcaaggcgactggacaggcaaggactagtctcctatctccagctcatgcaagcatgctcactcagtcatgtccgactctgcgacggttgtggactgtagccccccaaggcgtcctctatccatgagatttcccagccaagaacactggagtgggttgccatttcctcctccaggggatcttcctgacccagggatcgaactcacatctccagcatcttctgaattggcaggcagattctttaccactgtgccacctgggaactccaatatttttatttatttatttgactgcaccagatcttaatcgcaacacacgagatggagttccctgaccagggattgaaccccagatccctgcactggaagcacggagtcttagatactgggccaccagggaagtccccatctaccccagtggttctcaaacaggcacctgtgggatgagctggacccaggggtcctgtctaaaacatcatatagtgagactttcccagggcacaagaaaataattcaaaggtaggcattttactactgccaggtttataataaatagctaatgagagtctgctgatggcacagggagctctgtggtga

SEQ ID NO: 63219 - DNA, 662 bp, Bovine  19866880664075
gaaacgggttggctctgagcggctgagcagcccctcccgtgaggcctggagttgtttttcttatctaaataaactctgcacaaacatggccgcattactcatgagtaagttatttgcaatagcgtattccacagatggggaaattagttcacactggaaccacgtcttaacctggtaaatgaatgggcaagaggaaggagttttagacctaggtcgcagcagcagcagcggaattcaaaacctactcttttgagcatgccccctccatctcaagcctggggaacacttctgcacctggtcctacaccctgtgggccccatgaaggatgggcagcactaatctgtgcccagggcagagggccagtgacctccaaggacccaggaccctgtctcccatcgtgtccacattttcctgccagcttcttctttttttcaagtatttctttaaaaacatattttattattcttattgttattttattcatttttttttttttggctgtgccatgcagcatgtgggatctttgttcccccaccaggaatcgaacccatgccccttgtattggaagcacagaatcttaaccactggactgccagggaagtcccaccagcttcttaagggaagagggtaggaaagcttgctttatcctcaggccttttgtg

SEQ ID NO: 63220 - DNA, 3487 bp, Bovine  19866880665805
ggtgttctttggaaggactgatgctaagctgaaacttcatactttggcccctgatgtgaagagctgactcatttggaaaagaccctgatgctcagagggattgggggcaggaggagaaggggacgacagaggatgaaatgtctggatggcatcaccgactcgatggacatgagtttgagtgagctccgggagttggtgatggacagggaggcctggcctgctgcgattcatgggatcgcaaataatcggacacaactgagtgactaaactgaactgaactgagaggacaaataatccagtctcattcactgtgagatttcagtagtactgtatgtttgataatgctgtaaatgacagattactcttcaaataagataaatgaatggctataagccaataatttaacacttcatatattagaagaaagaatggtaagtcttggatggctgagattaaagccctttttatagttgaggacagtgacattgttaatgttaatttacagtggacaaactagatttttacactgataatttggccacttattagactttcagggcagggataattagtattgctgttcagaagagatgctgtattattatttataatttcatgagtataaaaagtaactttacagattgggaagaagatgaggaccaacctggaggccttgcagaagaagctggaggagctggagctcgatgaacagcagcggaagcgcctcgaggcctttctgacccagaagcagaaggtgggggaactgaaggatgatgactttgagaagatcagtgagctgggtgccggcaatggaggtgtggtgttcaaggtctcccacaagccgtccggacttgttatggccagaaagctaattcacctggagatcaaacctgccatccggaaccagatcataagggagctgcaggttctccatgagtgcaactcgccttatatcgtgggcttctatggggcgttctacagcgacggcgagatcagcatctgcatggagcacatggatgggggttcctgggatcaagttctgaagaaagctggaagaattcctgaacaaattttaggaaaagttagcattgctgtaataaaaggcctgacatacctgagggagaagcacaagattatgcacagagatgtcaagccgtccaacatcctagtgaacagccgtggagagatcaagctctgtgactttggggtcagcgggcagctcatcgactccatggccaactccttcgtgggcaccaggtcctacatgtcgccagagcgactccaggggacccattactccatgcagtcggacatctggagcatgggggctgtctctggttgagatggctgtcgggaggtatcccatccctcctccagatgccaaggagctggagctgatgtttgggtgccaggtggagggagatacggctgagaccccgcccaggccaaggacccccgggaggcccctcagcttttacggaatggacagccgacctccaatggcagtttttgagttgttggattacatagtcaatgagtggagtattcagtctggaatttcaagattttgtgaataaatgcttaataaaaaaccctgcagagagagcagatttgaagcaactcatggttcatgcttttatcaagagatctgatgctgaggaagtggattttgcaggttggctctgctccaccatcggccttaaccagcccagcacacccacccatgcggctggcgtctaagtggttgggaagcagcagtccctgcccaggggcatgccatgttgcttctgggcagccttcccatgcctgtctctgttcagacgtgcatttcacctatgacaaaggatgaagaacacagcatgtgccaaaattctatttgtgtcattttcaatattatcatctttactcttattactattgttattcccctaagtggattggctttgtgcttggggctatttttgtgtatattgatgatgaaaacatgtgcaatgtagaattacagtgaaactctggtgactgtgggtagtcattcttactgaaaactgcactgctttcccacaccatgaactggctggtcgcctctattttcgggattctttcacacttggtggtacttcattcttgccaggcataccttctaactgagtaggaaggagccttgtaagatccttcacaggcagtgcatgtgaagcatactttgctgctataaaaatgagcatcagaaagtgtgtatcatgttattttattatgttcttgcttttggtgtagaattcagcaaattttcatcaaaatctagccagagcccttcactgccatgatagctggggcttcaccagtctgtctactgtgatgatttgtagacttctggttgtatttctgtatttatttttaaatctaccgtgtggatatttagtgctatgtctctttaagtttggattagtgtttctaaaatggtggagttgctctgaatgttacaaatggatcaaggcattaaaatgaatgagatctacctttcaccaagtactgatgctattgtaaacaacagtgtgtatagtgcctaacaactgtatgaaaatccttttaccattttaatccagatgtttaacaagcctaatctcttactctaataaatatactatcaaattcaaaggatgaaaacagtttctgcttttgtggtggcattttcagtgtctgcagtggataaatcatcaaatgatttagcagccaggcattaatgagaggggaaatgcaaagacaggaaggaggctgcaaggtggaaataccacactaaggacaagttcagtgctttgaaccagtgtggcttcctggaattctaatctttggactttgtccagttcttctcagcaagcacccttatcgtccagccacctttcctgtgggcctgtgaacagatcccattgatttcttccatctcttcatccgagaggaaagcaggagagggggcaggactggcgcagctggcactggggcctctaccggggctgcgccgcgctgcttactccactgagcgatggctccccgctcagtgggtacacctgacacaggttcctgcagaggagaagggtgcctggactgacttccgtgcctgtgggctggcagtgaaactgcaaaaaacccacaaagcatgtcctaactggtcaccttcctttctttgaaaagtaacttttgagatttaggtcatatctatgaggctgcctagtcagcgcctcttccctcatttgagagagcaggtgatagaaaaccaaaataaataaataaatatgtttaaacacttatttcattttcaaattaaaaacaggaaatctcctaagtaggcagttccactgcagatctacgagagcctgagacacagccaggattttaaatactggtcactactacagctacaaggctgcctcagccaatcatttcccccaagaggctaacatctgttctctaagtcaacagtctaactcacatgttt

SEQ ID NO: 63221 - DNA, 2538 bp, Bovine  19866880700856
ttgttaggctgactccattcagagtgacagaggttaacacagcaggcactatctgattcggggcattaataattaaataagaaaatgcccctggtttcccttcagaggaagaaaacttgtaaacagttcagccggttccctcccctctggtccatgctccccacacagtaagccgcagaggaagggagtgaagttctagaagtggagaaatttctttcccgattggctgctttacacctgctcaactggaggtgaggctgacacctgcccacatgtatagctactctgcacacctggcagggccttaactaatcaaactcctggagtactacttgcctagccctgggctatgcttccaggatgcaaagaaataacccaagtcaactacagtccattttcagaggctaaagcagcaagcagttgagtcccctggaggcttatagaaagcttggtggagcagatgggactaaagacagaccatggacagaggagcctggtgggctacatacagtccatcgggttgcagagagtcagacatggctgagtgacagaatacggaaagggaggacagataaagggccttcggggcaagtactgcagaaggcagcacgtggaggcaggaaggtgcaggtgccgctggagagtctaggagggtttgcactgcggagcagaagtgggcagcatgggaaactttgccaggcattttccaaaattgggttctatgaagcactagccccatgagctactgataaaatctcccagacgaaggttgccatgagtgaccaagttcaggaaatgctgcatgctgtgtcctcatcttaaatattcagtgtatctgagcagaccttgggctctgggaagacccaaagtaaagacacctgtttggttgtttcacccagtctttcccatagaactttctagtgacctctgtagcaacagagttctttgggatgctagtttggtcaattctgctcctctccatcaagcctggaggaagtcccagtcctgaccatctgcatcctcagagttcatatcctcctgtttatgctaacacttgagagccttctgtgcctggcatctggtgttaaagggactctaccactgggtattaaagagacatcatagctgaccctgggcttttctgtcctggcctgggtcagccttgcaggctgagcagaccttagagctggcagcatcctctggagatcccatcttctcctgggcccctgccagcaccagcacctgcagaatccagcttgtctctctgatggcaacaaacacctggccagacaccagctgttcacattaggcaagatgcgtaaaaccaggacagagggcaggcagacagatggcctctgccccaggatcagttgtgatgacctcacagtccatctgtgcaaaaatcttcccccacctgcttcgcttccaccacctgccttgtcatcctgaatgtgccaaaatcttggacactggaacctggtctgtgtacctggaacctgctctctgtccatcccagtctcctccagggagcccttccttctcagcaactttgcacgggcagcaggggtggcagtggtcaggctctgggccctggggggtttccagtcacaatgctggggatcgattggtagtagctacttgcaatgctctcctgaggaatggggctgaagggaacatgctgcggttgattagtgatgtctgttgcaggcacaggatgggaaagggacacatgggtgccacgcaccttgctgtccctgccctacattgctgaacggtcgttttaactttggaaagtgctcctctcgtatatgaaccatctggatatggcctcagctcttctcttggagccttggaacctgtccatcactttccttccctttgtgtgtgtgtgtgttagttgctcagctgtgtccgactttttgtgaccccaggatcgactgtccatgggattctccaggcaagaacactggagtgggttgccattcccttctccaggggaccttcccaacccagggatcaaaccgatgtctcttacgtctcctgcactggcagttggactctctaccactgtgttacctgggaagccatctggccactagttcatttgtagatggccggacagcacagtgactcgggcttcatgttaaaatttttatattctttttcttaaagaggaccactgccaaactgtgtaagcttcaggccccacaaaaccagatccgcccctgcccctgggtgaaagaggagacgacattcaagggaaattgtgaaacacattttcctactggcaaaggagggaaaaaataaggtatataaaaaaagtcctgatgacaaaataaccgaagcaggaaaatccgaaaatggcaaaaattcagcaaataaaaataaatcctctagcttatagcatcctccttcatcagcagttttccttccagcagccagggcatccccagggtccagcctggatgacaagccctgaactagctttcagaaaacgtccactcagtgttctcattcaaaacctgccttctccccttg

SEQ ID NO: 63222 - DNA, 782 bp, Bovine  19866880705113
tatagaagatgaaacttttcctccgttcccacctccagcctctccagggagagaagatggtgaaggcgctgaacctgaagaaggtccatgacaccagagtggtgtccatgtccagctatccctctgtcagctttcaaaatgacacatttaaaaatgaggcttaaataagtaatattaaatcttggtatatttcaccagagtcagggagaggagcgcctgttcctgtacctccgaagagaaccgttaaaaggaatatacccaagctgaatgctgagaggtacatttactatttccttaaacatttctacttttctttccatcgtcttttccctcttatgttacaagcttttggttgggatgattttgggatcagatatttctaaaggcatttttttcagtttaacagataacatttttttcttatggtcttgttttggccttgatggctttagaaaacttaaaatttaaaaatacttctattcacagattaatttcagagagagggctgccagcattaaggcacgtgtttgagaaggcaaaattcaaaggaaaaggtcatgaggtaagaagtgtctgatttgtattttagacctttgtttcttaaagtattggtgagactgtgtgcccattctcgtgctctcaggaatcttagaatgtttcacagatgctgtcattcagcatcatctctctttagaaactgtgatatgtggaaaggacattgaagacatttaggaactatcaatctctgcataagtgaacatttaaaaatttcctttgcatca

SEQ ID NO: 63223 - DNA, 4055 bp, Bovine  19866880705916
tcactgtgctctacattagccatttagatataagcgttgagtcctggctgcgtggtttctggcatgttacctaacgtgtctgagcacctattttctcctctgtgaaagggacaataataatagtgcttaattcttatagcagtacgtagggctgttgtgaaaattaaatgaacagtggagtaaggggcttagcttagtgcatgggacataataaagacttagtaagtagatgttagcgtcaccagttctcacgggctccatttgaaagcagaggttctgtagtatgtcttttgtgccctagtaggaattgtttatcagatgctcctcagactagcaacaagcctgagtcccttcagtgtctttcaggaagtcaagttcccttggctgtgtttacttttccatgggtggaaggatttccagaaacagcataggaagcaggagattcttggcctgtgtctccaaggatttggatcacttcccccatcaaaggggtagctgtgtctggtttccttttcaaagtcatgattcatcttctctttggatctttgagtaaagccctactggcaccaacggccgtccacgattgagtagattttggcttcccagaaaacagagattaaggcaaaacttggtgctattgcttcccctggggtaggggtgcagttccagggaaaggagagggagaagaaaagggaaggtgtgcaacaaaggaggaaaaacaaatgccaaccagccacagcttcacaaggaagtgaggaaagaaagccagttgcttcctcacaagggatgtttgtggttaagcccaatggaaccagtgtgactcagaacagtttgctcagggtggaagagagagactctatctgccagtatcttcgtctcttgttgctccaagttttccccatggggaaactcccttgcactgctaggtcacatcacctggtccctctgggcagccactggggaagccgaatcccagaccctgtagtatggtgtctcagcgagtccagaagtgagaagccagcccctcctcttccagtggacagaggatggaacctgggcactgctaggggaggctgtgccagagtctcaccccaggggagaggtggtaggatagaggtggtgttagatgagatgctggggtggcagcctggttctcctgtgagaaagtagctgatggatattatgggaggcagctgcagcagagcaaatctggggaggcaccaaatgggctctgattcagccaccattactcagttaattaatgcacatttgggaccaggtgctggagtctggaccttcccctgcaggcactggggagccatcagctttcctgagcaggtgagagtcccactcagtgctcagcgatgacagagtatgtgagtctgctcagaccactgtaacacagtaccatagactgggtggcttaaacaacagaaatccatctcctcgcagttctggaggctggaagtccaggatcacgattctagccaatctgagttctggtgagagctctcctcctggcttgcagacagctgtcttcttgctatgtgctagcatggcttttcctgggtgtgtgctcactcacaggaggtagcagggggagagaggtagagagagtgctttctggtgaccttcttagaaagatactaatcctattgggtcagggccctaccctcataaccccgtacatacatgtgtgcttgctaagtcgcttcagttgtgtctgactctgtgtgaccctgtagactgtagcccaccaggctccttgtccattggattctccaggcaagaacactggaattggttgccatgccctcctccaggggatcttcctgacctagggattgaacctgtatcttttatgtctcctgcattggctggtgtgttctttaccactagcatcacctgggaagctctcttatgacctcatttgaccataattacttccttactccaaatacaagactcttgagagtcccttggactgcaaggagatcaaaccagtccattctgaaggaaaacagtcctgaatattcattggaaggactgatactgaagctgaagcttcaatactttggccacctgatgcaaagaactgactcatgggaaaagaccctggtgctgggaaaggttgaaggcaggaggagaaggggacaacagaggatgagatggttggatggcatcaccgacttgatggacatgagtttgagtaagctccgggatttggtgatggacaggggaagcctggcatgctgaagtccatggggttgcaaagagtcggacacgattgagcaactcaactgaattgatgaatatatatccttttactagaaaagtcccagagtggactattctaggttgattgctctaagttctggaaatttgatttaataggtagatttatatcgtcttttatttcatgaatgttttcttaaattacagttgttagtgttactttgccccattgctctgatttttcttcttcagagcccattattgtacagaagttttcctcctctagttctactctaatcacttctctcaaatctctttaaaaatatttttttattttttacttagaatatttttctccttccactttccatttctcttcaggttttattcattgtgttcatttactatttttaatatatttatctgtgccaggtctcagttgcagcatgtgggatctatttccttgaccagggatcgaactctgacattgggagcctggagtcttaaccactggaccaccagggaagtcccttgtttactctttagtttcttcttatcgagtgttaatttcttaatttaaacttgtttaattctttccccagtcctttattctctctgtcaaatctccattttctccattcatattaaagtgtcttcaattctagtttatctcttctttagtaattcttattatttaaaaacctttcttttcatctgttttgaaattataagttacatttttcagatttttgtagggtatgtctgacatgttttcatgatctctagggataccttctacattatttgacttcttattcctttttttgggtcataattcaatttatttctgttgctcattttaaagtgaaagtgaatttctttagcaaagagatacaaacacatggccccatattccttagatcttcctctgttcccttcttccatttgtatttgatcgtttttctcctttgcccctattttctgtcctatttaattgaatcctatttccagtagtttttccttaatacagagatttgacttggaagagagcttgagagtttgcaggagccaacctgcttcagcaacaacactcagacctattgccatcccgttgcactcacctacagattgcatcctccaggactcccacctggtttcagctgagttcagattagctttctgcactttccagtgagtgtgtgcttagtcctcagtcgtgttcgactctttgcaaccccatggactgtagccccctagcctcctctgtccactggagattctccaggcaagaatactggagtgggttgccattccctcctccaggcgatcttcccaactcagggatcaaacccaggtatcccacattgcaggagaattctttactgtctgagccaccagggaagcccaagaatactggagtgagtagcctatcccttctccaggggatctttccaaggggtacgtgatggcagttttggggttctcctgatgctgttcccactagcctctattctgaggtttgagggaatgtataatcatctagttttcttctgtatattctggaatttttgattttgcaaactgactgttctgtctggggttttggtggcagggggtggggcaggtagagaagagaggattcagagattttcagaaaatatacaactaaccctaccccaatcttattttctttatattttttgggtatattaatatatcttctctcctcagcagatttcccaatttctcaacacaaaataattttcagaaataatacccatcatttatcaagtacttactacattctaggtactgaaggg

SEQ ID NO: 63224 - DNA, 1144 bp, Bovine  19866880719824
agacaggagacctgtatccaagtcctggccctgccacacgttccacatgcagccttgacgagcccttggcttctgtagtctgtggcctgcggatcggtaaaatggtggtaaccatcacagctctcgtagtctcaccagatggagaccagaacccattggatgaactgtgggcatttacagagcacacacgtgacaggatcacaaaagaaggattctttcacggttgcaccccacgaccggcagttcacggctccaaacacccgctccctcacttgcccctgctgctcagacaccactccccaggccacagctgctgctcaggagaggctgcactgcctctgtggctgatttctgttcacatggcaagccagcctccttttttgcaaacttatataacgccactttcctccctctctggctgtcagctcctgcttcccccactcgccccagggaacactgcctgggagactgagacacccatgcagatggaggggggacggtgtttccctgcttggaccacattcatcctggaagccaaatgcacacacagggcccctcaaggtgaccctgaaggcctgacaagaagctgtttggagacatcctaacttcttccactccagcacatgtggctggagcacatggtcctccctggcaccccagcgaagtcaggctcttttctggggacagaaaagaggtcagataaggcctgagaggctgtttcctcccactagcagcctcctggatttgcttcccacagtccccgcccctccttcctctgctcccgtccccagcagcttcctcttccagccggtcttacacagtacctactggcgcgcctccagtgagactgcccctgcacacagcctgcagcggctcccatctgcctcccagcacaggccaggcccctcggcctgcacttccaaagtcctgctcacttctccaccttcttgccgcagcacatctccatgtccggctcgcctgcctaactgatccctgtacctaaaacatcctcctttcccacctgccctctcacttcttcctctggtagaagcctggttcttctgagggcctttcccagcgtggaatactgccctgatactggagcccggggaggttttagtcaggcttcttccctcatcttccc

SEQ ID NO: 63225 - DNA, 1733 bp, Bovine  19866880794718
gcttagttgtgtccgactgtgtgcgaccccatagacggcagcccaccaggctcccccgtccctgggattctccaggcaagagtactggagtggggtgccatggccttctctgacatacagctcttagagacctcatatataaatcagggcagatcatgtcccaaggtgatgaaagaggacttagtgggttgctttaatggtcccacagctctccttgtttcactcatgcctcctgtattcttgaaattattcatacattttgatactgggtaaacctctgcttcatgagagtctggtctgacaattcaatgcattgtgtcttctcagtaggacagtatatgcagtctcatctccagattcattaaatgtaaattttctctgtcttttgggccattgtctctcattgagctggtgtttttaggttctaattacacctatcaagtcttcaaaatgcctttgtccttgactgtgacccaatgggtaactcagagtctcacatcttatcagccttcaagaattcaacatttcctcccataagaaccccttttatcaattccatctgagcccctctcttcaacaagtcctctggatttcaagaaatcttgccaagaaataattaaaatagtttttccaactttaaattaatcaaagacattcataagtccagagcttctgatcagcatgaaactacctgccatgtgaacttaacagtgtttcagataaaagcagagaaaatggtctcttaacatgcacggatgttcaatgcagggtaggagggagctctttttgaaattttggaaatacttcttaaagagaccccaggttggaaaccactgctaaatatattcctttattctcgctcactttgttcctcatctaccatttctctgatctctcataaagttcttcaattttccctacagtttatttgctcccatcttagtattttaccacccacatcatttttttaatatttattattttttttttaatttggctgtgccaggtcttagttgaggcacacaggatgtttagttgtgacatgtgggatctagttccctgaccagggatcaaacccagccacccctccaccactgaagcaccaggggagcccctcacccacatgatcttaatgtcatcagcaagcctgaagctcaccatgaatactgaccttcaaatcccatgtaaaaatgttaaataaccatctcaggagtaacccactgagtgtgactctgaacccacccaagggccctttcctctccatctagatgtcctcctcatggttttgagtcccagcaaccctctgcatggccctggcccagcttcctgcccctccatggtgggtgttctccaaagaggagtgaacagagtgacccattgttttcaagggaaaaaaaattaaatctatttatattatttacctaaaaggtgaaaaataatttttatttaatacttagtatatacattgacaagcagcacatatatatactttattaataaaattatatatgtcagagtggaactcaacacttttcttaggaaagtgctagtttcttagtcatgtctgatgctttgagatcccatggactgtacggctctgcctggctcctctgtccatggaattctccagcaagaatcctgggagtgggtagccattacctttcccaagggggatcttcccaacccagggattgaacccaggtctcctgcactgcaggcagattctttaccat

SEQ ID NO: 63226 - DNA, 1540 bp, Bovine  19866880869488
cagccaaagtaatgagacagggacttcttctggtggtccagtggctaagatgctgacctcccaatgcagggggcccaggtttgatccccggtcagggaactagatcccacatgcctacaacaaagatcgaaggtccctcgtgctgcagctaagacctgctgctgctgctgctgctaagtcgcttcagtcgtgtccggctctgagccaaataaataaataaatatttttttaaaaaagccacaacagagtaaggagacaaggccatggagagaatcaaggccaggcatctccgcctggcggtcagactttgtgagcctttctgtgtgtcctttgtttctgtatctgatgcctgatcagcccaatcagcacctggaagaagatgcccatcccccaaactcaatgcccgtctgggccggttccttctcttcccaaaggggaaggtctcaccttctctgggaggagaatgcgtcgaaatgcccggcagccctagcactgtggggctcagggagtgcggagtcagtctctccaggcactgatggagttggcagggtgagctggtgggggagtgaggagtggctgcggctggtgactgctggacactgcgaattgtgcagaatcgcttttctctttaggttagccgattttcagaatccatttacccagattatctgcagatctcaaacagagagaaaagcctcattaatcatcaattggacccccatggttacatagaatttgtgacaatttgtttatctttgaaggagctgctaagaaagagtttaacagggaaagtgttgaggcaggggaggagagagtttaacctttcacgaaggcagaagctccatttggcttccctctgagtacagcctgggggtgcgtgcagcatccctgctactattcactgcccccaagaaggctgagtgcttccttgtcggtaaactctgggccaacagactagaaatcctcaagcatttcaagcctggggaccccttttcaatgtcaaaatattttctataccctccctgcccccagttattagaagctgccttgttttttttttttcctcagtatggctgattgagaataaaagctcctctgaatttggtaaagcttttaagcaaatcacaatcacatctatgaacacatgaaatatagcgctgtctctctgagttacagtattctttcagtctgtagctgacgttggagcacgaatggattgcaggtcccctggaggtagctctggggccccctgcatcccaactaggatgagaacactcggccagttctctaaggctatagaaccatggagtcctggacaggagggagccttggaggtcatttcagctattcctacccattttaatggttctctgcctctatgaggagccctctgatagggaatcctcagttccagggaccccagggggttggcagctgtgtaggcccacttaacacctgtcttaggctgtcacttcaggggctgggatcaactctacaagccgcttcctcaaacctcttaccaggctgtcgaagcccttca

SEQ ID NO: 63227 - DNA, 1223 bp, Bovine  19866880901861
gcgcagtggtaaagaatcctgccaaagcaggagacttaagagatgttggttcgatccgtgggtcaggaagatcccctggagcagggcatggaaacccactccagtattcttccctagaaaatcccatggatggaggagcctggcaggctatagtccatagcgttgcaaagagttagacacaactgaagtgacttagcgcgcatgcagtgaggggctgggggtaggaaggaagtaggtgtaactataaaacagcagcatgagggatccttgtggccttggaaatgttctgtaccttgactaaactagcctaatcagctgtgttcaggccaacatttgtactggactctcaagaacagcttcccttgtggctcagctggtaaagaatccgcccacagtgcgggagacctgggttcaatccctgggttgggaagatcccctggagaagggaaaggctacccactccagtattctggcctagagaattccatggaccccttggggtcgcaaagatccggacacgactgagcgactttcactttcgatcaggaacctgttcccattggtcaatgcctcattctgattggttgatgctatgatgtactaactgtcaaatattttgaccacaatgctggtaagacactctcctgacccacatggtccataagggagccatatggaagtagttcctcccttcctctgggaatactcaaaatgccaggatatattcccttccttatataactcctcctgccagcagagttagagaaaaacatgctgattcactgccctaaggaccctgatcactttacagacccagggcacaggcctaggaaaacaaaatcacatatccccaggacttcccgggccgtctagtggtaaagacttttcgcatttactgcataggggcaggttcgatccctggttggggaacaaagatcttcacatgcagcatggttaaataaaaacacagatattccccaaatatacatcgaccaaaaagaccattgtgttccacccagaagtgtttaactgagcagaggttactgaaagggactatttacacaggtgagggtaggataaaggaatccacatggaatgttagataaaacactcagagattcgccatagtaggaagacattaccaccctgataactggtcactttgaaggaacaaagtgaagaatgagtgataggagctagagaggaagggactgcagttgtga

SEQ ID NO: 63228 - DNA, 2434 bp, Bovine  19866880931041
ccccttctaggaatttattctaagggaatagccagtgatgtgcacatgtgcacgagggcccttaccaggaggccatgcttctgagttacaaaaaaaaaaaatcactgcaacaaccaggatactagtaaggaaatatggtacatccatgacacgaaacgctaagcagacattcgaaagcctacagaatatatgttgaattaagccaatgttctcgatattgctaagagcaaaacagagcactacaaatggctatatatacttttaattcagttcagctgctaataataactcccttcttttcatttggcagtatgtacatatacctatatagcagatttctataatacttcccattttttgctaagaaagaggatgacaagaaaaatactatttcaagctagttagatgataatttcctttcaggtggtagagctaagggtaacctatttttcctctgtgcttctcttgttttctaaatgctcaaaaaggaagaaagaggaaatgctgctggggcggggcttgggccagctccttcactaataagccatctaatgtctgtaggcgtctttgcctaaagaggacgtcagtgacactgatagctagatggacaatccctgcacagccactgtatatcactcccatgccacacaaagcccttccaggaagacacccactttgcagacacgaaaactgactccatgccagaccccctgctcaccatctaagccccaccaccagccaccccaagagaacacagcccatgtcaaccctgcagcattggctgggagtagggggtggggtgggaggctgggaaaacctgcctcactgcagagccaccaacccttctgagaaacggcactctcagctgctacattctcactgcaggggacgctcagaatgccatgggagtaggccctgcagggtctctggctggtgcatgcgtccacccattcgctcagccttcccggggcagctgctacagccagggtgactcatggaagagcagagcctggttacgtcccgaggtggaaactgaggcccacagagggaaaagtcacgctgccagggcatggccttccgcgtgctgaccatcaaggggcagcagctctggaatgcaggatctccaggtggggggggctccaagaaaacaaatctcagggctgaggattcaggtagaactcagtaaatgcacccccaccccaaggccagaagcagaggcaggtctcgggacagagggctgagtgggcagctcggaggataccatgcccaagaacccactgggcttccctaagtaaggctggggttccagagggggcaccgactgtggagagggtcagaaatgccaggcatgacctgagacccaccagctgcatggcggggatggagcgggggtgccacagagtcttcccctagggaagggacaaccagtgagagcatcatggctgagtccccttcttgggattaaagttactgcccagagggctggctagacatctgtgtaggcccctgagactccaggcattggggctgcagaggaccctttcctgtcttgactgccccacacagagttcacggggaaaaggcatccaccatctccccacctggacccaaaagaaccagaaggccacaggagatggagatccatttttttattattgttattttttaaatacgaattctttccagccggaaggcagaggggtgagggccattggaggcctccggccgccggcacccagccagcctcataaatgtctggcagctggagggagactcagctcattgctatcgaaatgagctcgttactgctaatttccctggctcaccaactgatgcatccagcgtgttcctgaatctccaaagccgtttccgaagccaccctcatgggatccgccaagagacacggagtgtaggcggaacttcatggtggcctcagtttccccaaccagagtgtgggcaggagaacagggaacaggggtgtagttcatccaactgcggctgagtcaaccacaggcaaggccaaccattccgccagggctgctcattcctgcgggcaaatggggagacggcaggacagcacaatttctcggggtcactcagaacaaccccctccacttaccaaacacccagtaggccccaggacgatactaggcacctggcatatattatctctcttcatttacaccacaaccaggccaacaggaccttagtaaccactctcatttccaaagaaaccaaaacgttcaggaacccaccctgaagtacatagctcaggaatactaaggccttcccctaaagtcaggaagaaaagcggctaaacgtggcagggtcgatgcccactctggaagcacacacgatctaggcagggtgtgcaaaagctcctccttcctgggagttgacagaggagggcaagcacccatggccaccccaaggt

SEQ ID NO: 63229 - DNA, 680 bp, Bovine  19866880932313
cttgagcagcccagctaggccctggagactgggggactcggggccagcttcctgtgaatgccctgagccttcacatttcccttccttggagtctaagccatccggagactttaatctgggcacttctgtggttcgcctcccagggtgggcaagtccaaggcagtctggcgcggcggaaaggggaagtcacgagggaaacaggctgcattgcgtgtgttcaggcttttggagtgtgcggcccacgggggagcgcacaggaacgttcctgccctttgttttgacagaaagctgctgattcaaagaagctaaaggctttccttgggatttcagctttcctcgccttccccagactacagtgggtcccataggtgccccagcatccccacaaaattacacattgggcttgcaggaccctcacttggtcaagaggcccagaggaaggaatgccagccattggaggggctggctgcagtgcaggggagaggacctcccgctgggccagtctcctcctgtccatgacaggcatccaccaccctctggtggcaggaatgtgggcgccacccagaggccaggccacccttgtccggcctgtcccctgggccccctgggagccctgctgagaccacttttaggacaagccacagagggctggcctttgttgtcatcctttcaaggcgtcg

SEQ ID NO: 63230 - DNA, 3257 bp, Bovine  19866881011588
gatttcccaggcaagaatactggagtgggttgccatttccttctccagtacctcctattattaatgcatattaatgcattaattcccataatcaattatttcctgtaatttgtgggcatgaggaaaatccttgcctcctctctccatggggagtttcatttgagaagccacaagcagttggcctggcccaatgcgggagtgctcagagtgggagagtgggatggtcactgtgcaggatgtgtgcagcagataactgacgcaggtggttccctccctcaggggcagggatgaggggcagagctcacgagcatcatgaaaacctggcctgggcagcacctctgtgaaatgagatccagctcccctttcagtgtccttgtctgttcagtggggctaataactagcctttcacccatcatctcttccttcctggtgtgtacagactccagacagggcctagggactatcactgcagaagaggaatggagagggaacaaggacagcaagaccgcagagaacggctgtgagctgggtaaaatcaggtgggaatatcattcaacggggacagacgcccaggtccaggccccactggggaatccatggccttcccctctggcccccgacacccacgactggccatcccccgacccggcagtaaccgaggccagacttccccctgaggtctctgcctcctggatgtcctgtccttctggatctgaagcatccttcacacctcacatagtcctctgccatccgcacgttccctgcttcctccttacggctgtttatggaaaatgaaaagatttcccacaatgctgcaactaaagatcctgtatgccacaactaaaacccagagcagccaagtacatgaaataagtttaaagaaaaagaagtgaaagcaggagctcagatatttacgcacccacactcactgcagcattactcacattagccaaagggtggaaatgaatggatacacaaaatgtagtgtatatatatacacacaacagaatatcgttccgccttgtatgtgctacaacatgaatggaacttgaagacataagtgaaataagacacaaaaaggcaaatacctatagatatgaggtatatagaatagtcaaatacataaagacaaaagtataatacgggcttcgctggtggtccagtggttaagaatccgcctgccaacgccgagaacatgcgttcagtccctggtctggagagatcccacttgccgagaggcagctaagtccacgcaccacgactactgagccggctcacctagaccccgggctccgcagcaagagaagccaccgcgatgagaagcctgtgggtggcaaccagggagcagccgctacccactgcaactaaaggaacaccctgtgcagcaacaaagaccaaaaagaaaagtgtaatgtaggatgccaggggctagaatgggacagggatgggagtcactgtttggtgggcacagagcttcaatctgggaagatgaattctgaagacagatggtggttatggttgcgcaatggggctatacgtcactgaactgtatacttaaaagtggttaaaacaataaattgtatgttatgcacattttaccacagttaaaaaaaaaaaaaaaactgaagaaaaaaaaacaaacctaagctttgaactccttgtggtcagggcctgccttttttccttctttggactctgttcagttataacaacaaaggccatgcctgtgtggagaaaaggggaagagaagagaagggcctctctgggtcagtggcccaccaggcttggagacagggagctgtgggtccattcggttccctgcccccacagcacgcatctcccacagaccctttttccagacctgcagccctggctccaccctctcctggcctgaagcaggtactgtagccacacacctcatgcctccaggtaccctaccagaccttgcccgctccattcctgctgacctggaaggccacatcactcaccattcccctttgtccccttgcgttcaaatcacatccaaaaacattgttcccattaaatcacatccaaaaatattgttcccagttgtgccatattctccccatttcgatgtgcctttgcaaggaccgtaacttttgtctggaaagttctgtcttacttgctacctgataaagcccacctcatccttcatgtctcagttcataccccacctgctctctgaggcccagcaccctgctcagcacctaacatccagacctgtgattgccagcatctcccactggatggtgggatgatggagcagttcgtgctgattgtacccatcttccccttcccccactctccattttctttcttgcttagagcccaacttttgttcagctgctccttttctgcctggccacctcagtgagagcaactggcatcacagtgcagctccagggagatgaagcctgattggcttacaccaatcacagtattctattcctctctctggtattggctgagatggggtcatgtgatctaattctggccaaggaaatatgaggggaagtttgcctctgcttaaaaacacatgggaaggggacaaaaggaaaaaggtactcttctgcctctgggaatgctcatcagtacttgtcaactggcattgcttcagccaccctgtcaccctgaggagtgatatcacctacatattgggggtgggaaggcagaaagatttgttatcaggcagggtcctggcaggaggtgggaatcataccagttatgttagggagaatttatggtgaataattgctcactaggtgtagaagatgttaatcaggtaacagaaagggtaaaaagaaaggtagccagatactagttttagggttgagagaacataggaaagaggctggaatcagtaacacttagaggaggggtgcgtggcgctgaaatgccgacctctgggaaggggctgctgcgtggctggtgcaggtgtctctgagctcaaaggacaagtccactggggcctggacccagcttctgaagagaagatgcaatgatgctgcgtctgtgagagtgggaagaacagcaattcattcagccttccgaggaatggcctctgtgtggtgaagagaccaagacggagggaagctggtgggagcaggaagccctcgggaaggtattaacagccccaaggctccctctagtgtcccctattgactgacactggcagggagcagctggcaaagcagaagtggggctggtggccttcaacttgtgtcataaagcagaag

SEQ ID NO: 63231 - DNA, 1208 bp, Bovine  19866881014592
taaaaagtcttttccaaagcaatattctttctctgagcaaggaggagcctttgacccagggatgtgaagtcaagtgtcaaggtcacccagactacctgcaagcccttttggatccattgttccaaagggacaggttcttaggaggctggcatttttctctgagtgaagctgcttgcaggagctgctgcaggggctgtggaatggggaaggagctctttgtcgattccagagcggatctggctgtgaacaaatgaggaagtgctttagtgtaagcctggctgaatggataattaaacagacagcaaaatggaatgctgttccccatccctcccgggagccagctgggggggataatacactttcctgttgtcagaaggcacaggaggaaaaacaactgggcctggccgttggctatttaacaatattgcttttgtaaacaagttgaaaaatccaataactgttaaacttatggcatgtctttaaaagcctgtgcctgtattccccataaacgaatgagcgtttcgactgaaggtgttctgattaaacagtccatgtccccaggggaacgaggtcatcctctggaagaaggatctgctctcttccagtgacctcaggactggaggtaggggtggtgagcttggggtgcaagtgtgttacagccaaaaactcccctcctcttcctgtgctcgaccactagcggtgaagtgaaagtgttagttgcttagtcgtgtctgactctttgtaacccccatagactgtagcccaccagggtcctctgtgcatgggattctccaggcaagaatactagagtgggtagtcattcccttctccagtggatcttcccgatccagggatcaaactggggtctcctgcattgcaggcggattctttaccgtctgagcgaccagagaagctcgaccactagaggtgcctctgaaaaacaatccagcaccaagtcaaggaagcaaacgcttaagatggaaccgcagcagtgagtgccccacccccaccacaggggccccgtgaaccagagcttcagaccggaaagaggaaggctattcagttcacccacagagaaaacgtttggtgttggaactgacagaaaagtagatagttccaggcccagaggagctcacagctttgatggggaatggacagacacacaaacacactctgaaaaggacacaaagaggagagagtcaagggag

SEQ ID NO: 63232 - DNA, 1850 bp, Bovine  19866881062664
cacaaacaagcaagtatgtgcacacgtcctgggctgcctgtctttacagggatctcattgctgcaggtaacagcccccagtgaatggagaggaaaagctcctacatgtgcactgtttaaaaaatcttgaaatatttgagattaataagaaatctaaataacctggcaaaaaatggtgaggagtagagtataataaggcagagtctcccctccttcaacctataggcaatctcagatgagcagagaggagggaaggaaagaggtttctgttctttggtgttaggctttccagcctcataagctccctgaggaccacatcttcttttgtgactatacagatatagtcacaattttcatgtggagacacttgtggggacgctctatcaatgtgacgacctggtatgaaacataattcccaaacaagtgtcagggtcgcctccaagtagaatattactgaatattattgtatttcttggtgtaacttgcagagaggccctagaaaagacaccaaggtcaccacccagaggagactggtgtggtgaggttgcctgcgcttcatctacttcccgtgtccaggctacatgccttcacttcttcaagaggaatttattgtcctcactccttccaatctaccttcaagtctccacagaaaattctgggcttcctgctcatctgaacttcatagtatctctttttctctgctatcatacactgctgtaaagccctcggtcacacagtttgcttaggaaatgctatacaaaatcaaactgtactatgctactgggctacagagaaaagtaattttcacaaaaagtagaaaaacgtaattttagtcaactgtcctctgcaggaacaagacatgatgtattgcaacagaaaaaataagtgacactgccattaatatccagcgcccctggatttttctggcatgttggaacactttttctttatagcagggccaagaaaattctattggcaaatctttagcaatacatgctcatgggaacctttataggatctacaattcaaaatccaactagatgttctgtaaactgacacaggtaatggagggcctcattctagtttctgaatcaaaaaacaatattcaccattgaaacctgatcgaccaactgggcaggcagaagtgaccagtaatctcttgagagattaacaggcatcctattctccaaaaaggtacctaagaaataggagaactgtgttggtcagaaagctcaaaaaacagtcactgataatgctgctgttacatggacaccaagctggtccaacagccttcacagaagtaatatcacaggtcaccccttcctttactcttactgacccgcgcccaaggtcacaagtgaagaagtgtgaatagtagaaaaagaagattggcctttaaaacgatgttttgtgtatattcagcaaaacggttttggagtcaacagagcttagtgattaagagctttggagtctgactgcctgggttctcaccccagttctatccctctctctctgtgaccttgggcaagctgctttagcctttctatttcctcaccaataaaatggggatactaacacctgtctcaaagggttgttgttagaactaaatgaaataatacactcagaacagtgcctgccatagataaatgctggctattagttttaggtagaaccatgtaaaactgcctttttgtaagtcaaagacaacagaatgttggcagttttataagattcaacctatcgtcattactactagtattattgttatgactctaaacatgtgttcactgtcaatagggatttactggtctgcagtcttagaaactgtaggccttacagtcacagggagtt

SEQ ID NO: 63233 - DNA, 721 bp, Bovine  19866881090373
gcttataaaaattccatacctagaccacacctcaaaccaattcagaatttctacaggtgggccctgggaatcaggacttttaaagttctctggtgtgtagccaggattgagaatcaacagtcctagatttttttttttaacatttattttttggctacactggatcttcttgtggagtgtgagctcggtagtccaggcatgcgggcttagttgcctgtggcatgtgggatctagttccctgaccagggatcaaacccacataccctgcattggaaggcagattcctaaccactgaaccaccagggaaaccccagctctagatcttaagtaaagctgtggttcagtgtttcgggcatctcttctcggggaaaagtgatagtggttggtttaaaaagaaaaagcacatgtacacagaaaaaagttctagaagcatgttgattgggtaatcacagctgccgatggtggatagttgcctgaggtttggagcctcagttttctcctatctctgggtcagtggtttctcaaacatctctgaaggagtggaaccatctgtagttggttatttctgcttgggaaactcagagtactaaggtggggcgaggggcggtggcaagagcagaggcggagcaggaatggattaaacagaccattacacgcacccacacttcttttgtaaaccaagtgagaggcctcagccagtgctggcataccttagtgttac

SEQ ID NO: 63234 - DNA, 1991 bp, Bovine  19866881254433
cgcagccccttcttttcccttcctctcctctggcagggcagagagagcaggccctcccaggtgtgtgtccccttcctccacacacacggaagcccggtccactggccactggggcacatccactgttctgcccctgaaggtggaagtctgtcaactggagtctcacaatcagggaccaggccaagggaggctgctcctcacacccagcctctgatgatgccggcaagaaggctccgggtggagctggtgatgttacagtagtcttgtgtgtgtgtgtgtgcgtgtgtgctcacactcagtcgctctatcctgtccaactcttttgtaggcccatagactctagcccgcctggctcctccatccatgggatttcccaggcaagaatactgaagtgggttgccatttccttctccaggggatctttctgacccagggatggaaaccgcatctctcgaatctcctgcattggcaggtggactctttaccactgcaccctcttggaagtcccaagtagtcctgtgtactcacacacaaagcacttcctctccggtcattgcacctcacttacagccctggcagggcgacggcaccactgtcaatccaagtttacaggaaggaaaatcacacaaaaaaatgttttccagggtcatgggacttgatctcaacagaccagagcccaagcttctgttcacttccatgttctctgccctttacaccaagtcccacaagctccctgaagactccagccagcatcaaacctaagcctccctatatcaatgtcacttctgtgacattttgataactgagctatggttatgttaagagagcgcccttgctttggggaaatatgcattgaaatattaaggggtggtgacctgaatgggaaggaaatctaaaagagagaggatatgtgtatatgtataactgactcactttgacatacagcagaagctaacgcaacattgtaaagcaaatatactcccataaaaacttttaaaaaatactgtttaaaacaagaaatattaaggggtatagcagcaactatcaaacagttccgatacacacacacaggacagggcttctcagcctcggccctattggcattctgggttgggttattctgtgcagaggggtgaggggacccctgtcctgtgcatcctgggatgtgtgacacgtccctgccctcttccaactagatgccaatggtacccatctccggcctatgtgtgacaacaaaactgtctccaggcattaacaaatgggggtaaaagcgcttacagtttagaaccagagctgggagggaggcgggcgggagagagtgtgagccagtgtgagttggagaaagcagaagtggtaaaatgttaaccttgatccttgtaactttcctatcaatctgaaataattcccaaataaaaattaaaaaaaataaagttctatgagcacttacaatttttaaaaagaaaggaagaaagaaaaagaccttgccaagttctcagctctctccagtccgtcccaaagatcccaaatcactttgttcccacagctgccaacatccactgggtgatcagagcctgcgagaccttccaaacacaggtgcccgctgaagcctcacaccggcccaccgagggcaaggtgcgggtacacccattagacatatgcggagcccaaggccaggagggagcggccgacttgcccgaggccctgcagggacctgagcgcagtccgtggactccaggacccctgctcccctgcgggctgcgcaggcacgcacccggcttctcacagcctccacggagaactccctggcagaacgctgcaagttaagcgcctgtacttttcccctttatttccctttcccgagagggactgttggactgggcagagctgcctttcagatgcttccaagtcagcagattttgcctcctgcctttgctttacaatctgtgattatttcaagtcaaactggccagctgccattaggagcaaattga

SEQ ID NO: 63235 - DNA, 1325 bp, Bovine  19866881313591
gtcacctcctccatgaagccctcctgcactcgcctaggcaacccccactgggatcccagagcaatctattgagatctttataataaacagttctgtatgtggcttttaaattacatgcctgctaccatcaaactgtaagtactgagggtgatgtgaccacctagccaagtgtaaagaattccaagcacagaggtgaggggactccctatagtgacacagcaagccaggccagaggtggccttgaactccttctggacaccagcccggggtttcctccccaaatccctccaccccaaaatgtctataatctgtgagaaagtggggagagcacttcccagccaagacttccaacactgacccactaaaatccatgtacggctgaaagatcagtgccctgggggactcaagaccctggcaggcttgctgagcctcagttattacagcctgcaaacgggcaatgcctgtttgtccatcaatgggtttcctaagaagcaagtgaaaagctgggttgtaaactgcttttttttttcttaaaggcaccactaaatgtaaaggatttctattatgtttataagcaactataataaaacggactttacacagccgcttcctacggaaggcgtaggaagaaagcacgccagccatccggggcctggcccgcggttctgctcgtcaataagtcactgtgtctcggggaagtcactgtgtctctgggactgtttcctcttcccaagaaaacaaaggtttggttggctgaccgccaaagcccctctggcactaaaaacctgctccatgcccagcacggtcaagacactgagaaggcagggtgcacagatcaggggctcaagtcccagggagcctaaatgtttgggttgaccaaaaagttcatttggggttttccatatgatgttacaaaaaacccaaaagaactttttggccaatgcaatgtgttgatgccaggacctgcctgagacaggtgagcgcggcggccagagcgtgtagctggcccatctcctccccgctcccaggttggctttgtggtttgctttgacctcgacgcacacctgtcacatcaggaaaacgctgtgacccagggggctcggtgaccaggttcagtcttagttcttacgagcctcagtttcctattgtgaaagaggcagtgacagaacccttcccactggccatggtccagcacgctggaagggctgcacaagctctcagtctgtgagggatgggcgtgggagtggccttttcttgagcatctttatcctgggcaacaggctgagcgctgtactggctcccactccaggctcatggtaagctgg

SEQ ID NO: 63236 - DNA, 946 bp, Bovine  19866881314712
acccctggcctggtttggggggcagaaactacttttcctgcatccctggaagccccacaggccagtagtaaaatctcccctgtgaatgctcagtatgttagattggaatacaattgcaccaggaaagacaataaatacgccgatttattttatctcacctgcttggagttgggggtctttctcgcactgaaacaagcaaatttatgcaaacgatatgcaaataagacccttcctggattaacagaaaggaaattgatgctctgggtagagcccagggcctggcactgcatagggtgtaatgtgaatcgaaatgtgccacgcagggtgggtgaatggagtcccctggggatggagtgaatgtcctcagctccagaatcgggtgggagctgaccggtcatctggagtggtgtccctctaggaggcgggtccaggaggggaaagggcctcgaagggctttgcgggagcaccgggctccaggcctgggtttactgctcaccagctttgtaagcccgcacctaaaccctgagcccggtccttagcctctcccgtgtgtacaatactgggcccttgggtgggtgtgaggattagacaaaaatgagaaagcgctttgtcaaccgtgaaatgtgacacccacattaattatgtttcctgtgcttcccttgctcactgtcatttgtgcccctgcccagcgctcctccactgttctgcgccccctccaagaccagatgttttgcaactttgattctcttggcttctctagtgccggaggattctgcttaatccttcccgcttgacagaacacaggcaacctatctccctgggagagttgggtggtaattaggttaactaatttaaagtaacttttaatttttaaataattctaatttgcattcgcgcaacttacttttcctctctccccattcctctccccacccccaccgccttc

SEQ ID NO: 63237 - DNA, 805 bp, Bovine  19866881411300
tttgaatgtagagttctctgaccccttgggtttacagtggaactggtgagagaattcaggagaactgaccctgaatcccagcccattcctgtcatcaccccccacttagagggccttcctgtacactcgtgcagacaccccaaggctgaatttcatccaatttctccatctcccagcatgacccacgtcatcagcccagggtcaacacagtctcccttccttaggcagatggacctggggaagagcccacctgggacctggaagcaggctcaagatcacgggggctgggaacggaagggtcgagacccagtacaccatttgaaacaaggaagtgcaggctctacacgtgccatccctgggcccacagctctaccccgtggaaaggaccacatccagaaggatgtgcaaaggatggtgcactaagtgtgagccccctgacacacctagagggcagccaaaggtaccaccgtccatgtctgggtcattttggagccatgagcttccgggactgaacattctcacctgacaaccaagcaactggtgagggggtgcctggagccagaactgccttccaaccaggcctcaaaaacacaccagcaagagtaaacaacagacacttccacacatggatgggcaggctatcggtgacaggcccgtgagtcacggcatttcttcttcaggatcttacacccaccccccacgccaggagcactgattcatcaaagtttgttttcaatactattatttttagtcagccaaacagttttaaaaatgatgatggaggacaggagtggggaggggagaa

SEQ ID NO: 63238 - DNA, 1783 bp, Bovine  19866881500365
aaactttagtgccccaaagataaaatacagtaatggataaaatcagcccctagtggcaaaacatggaaacagaaaacattacagctgagagaacgatctcacttcctatcgacatcctactggtagtttccttaacacaactattcctgaacaaaataaaatacttttggtatggtttttataaaaagaaattaccttttcccaaaaatgttaccttataaaatcctggaatgtcatatgcatctatgggtgttacgggtcagaaatagctgcaaagatgaacaagagagggcacggccctctgtggttctttcaacccacaccccactccctcagaagaaatggggcccagataggcactcaggatgtggcaaactgcccttggtctctgcttatggggacccatcaggagagtgatatgggagacatgctaaagcactggttctcaaagtgtggccctccaccagccatatcagcaccacttgaaacttgtcagaaattcacattctcggccccacccaggcctacagaaccagaaactcagagtaggatccagctgtctgggttttcacaagccctccagatgattctgaggcaaactaaagtttgagaaccactggcctagggcccagcacacggggctgagagttggaaaaccttggttctaatcctggacctggcagtcccaagggtctgtgacccttgggcaagccagtttctgtgggtcaggaggctgggccgagtctagctggccctctgcctcctggttcctcacaggctgcagtcatctgagctcacctggggaatgcgtctgcaaccaagctcactgatgggcttgttggcaggagttggcgcctcatgtgtagctggactgcagacctcagttccttgctggccttgctcgtccctctggctattgaccagagcccagctgcatgggcctctctgttgggcagctcacaacatggcaactggcttcccacagagagagcaaaagtgtgtctcagatgaaaggcgtgatccttttgtaacctcatatcagaagtgatgttccatcactttgctgcctttggtttgtcagaagccttccctgtggctagcccacatggaaggagaggggattttacaggggcattagtaccaggaggcaggggtcatcttagaagcccctaccacatctaagagtcccttggacagcaaggagatcaaaccagtcaatccaaaaaaatcaaccctgaatattcattgcaaggactgacgctgaagctccaatactttggccacctgatctgaagagctgactcactagaaaagaccctgatgctgggaaagattgagggaaggagaaggggatgacagaggatgagacggctggatggcatcaccagcttgatggacatgagtttgagcaaactccgagtgatagtgaaaagaaggtgtgctgcagtctacgggatctcaaagaatcggacacaactgaatgactgaacaacaacacatctgcaaaaacttgttccaagcaagccccaagatggagggaaccccaaccctgggagaagcctgagaagtgtgcctggtggtggtggggtggtgtgcctgacgaccctgatttttatcttcactatggggcctatctgatggtggggggtatttgcagccggcaggagctgcattccagggctgggtacttaacattccagaggagctctcagctaattactgccttgcccagcccagtcccggaccacccggctcccctgagctcccagggctggccagagga

SEQ ID NO: 63239 - DNA, 1184 bp, Bovine  19866881599383
accttctacctatttgtttcttttgagcaataattatttattaggtgcctaatacgtgtcaggagccgtgtgaggttctggaaagtcgggactcaataggaaagacacaatctgcatgcccttgaggattctacagtctgacaggaaatgttccagagcatttacagttcctttagttgtgagggtgcgggcaagaatgaatgggtggcttataaaaagtacaatatctaccgtattttcaaatgatccatttgtttaaatatatttgagcttttaattcaagtcaagccctgaaaaaaatcaacatgtcccagatattaaaaacatattccctttttaaagcaggatcaatcttgggcattttttttctgcattattacctattcaagccatcaatttgcagttaagtaggctaaaaaggaagaattctagtcctgtgaagtctaattcatgttttattttgttccaacattttcactaagctgtcaaaacaagccaacaaatgatttcaagatactaatgttaaacataaaattttaataatgtaagatattctaaagtatttttactattatagttactattctgtcaaaaattataatgaaaataagaacacccatatgctcttgatgacaatgcaaactggcccaatttttctggaggacaacctgcctattcacagcaaaagctatttaaattttttatgccctttgacttggtaatctcactttaagtattacattccaaagaaaatgatcaaaagattaaaaaaaagtgatgtttatgaaacatttgaagtagcaccttttataatactgaaacattaaaaatcccaaatgctcaacaactgaggaaagcttaagtaaactagaatacatcaatatagagtaatttgccatcattattaacagtaagtaggctatgtcaacacatagaaataattttaagtgcaagaagcaaaaaatagcctgtgtgcactatgaatatagctatgcaagaataataaacacaatttatgaggatttttaacagatcataacgtgacagaaatagctgatgctttatgttcacacaatttttgttttctgtaaaggttacaaaaatggtttcataatgagcatgatttttttgatacatgggtcagagatgtatacccaagaagctgcttcccacagctttctgca

SEQ ID NO: 63240 - DNA, 1430 bp, Bovine  19866881624529
aaattggtaactgatgcaaagtggcaggtgggagcctttcactaaacatcttttggaaggtgtgaattttcagcttcaaggacagatataaactttaattacaacaaataaccacaaaactccctaagttcatgatccttgtgaaaaacagcctcaaccagggaacatatatgtacaaagggacatacatttgttcttagactttgactttaaaaagtcaacaagaggaagaagcagcctcccagctaggcagaaggaaaggagacaaaaagaaaagaggagtggaagggaagggaaggtgcgagcaataaagctgcccccaaacagaggactgggggggaaagatggggtgggaagggcggtgggaaagtagcttagaaaaaggaagtggccacaagcaagagctaccaggcatcacagaaggaccaggacgagttctgacaatagaaataatgaaccaactcacctatcaacacctcccaggagggagcacacgtcagcgctgaggatggcgggcagcatgtcatagcgacggtccgctaagtagtaagtggtggccctgtgaacgacacatgtgcaggtccatgaccttcagcagcaagaggcagaactgctgatggcacaggctgcggtgaggaaatggctgagggctcagcgccaattccccaaggctgctgcttttcataaagtgcagcaggctgggcaacaaagctatgcctgtgttcccacttttctaagtgatgccgctttgggctcaatattcttccactgatataaaagagaaagacagagtggcacaaatcttagttgtgtaggaaaaattaaagtgtaacgatccagtatttatagaaaataggatattactacatgaaaaatttaacccatttcactgtagcatacaacatgtgaaaagattttgttaaaaaaggaaaggcaggggcttccctggtgtcgaggggttaagaatcacctgccaatgcgtgggactcaggttcagtccttgatctgggaagatcccacatgccatggggcaactaagcccttgcaacctccctcaagagaagccactgcaaagagaagcccgcacactgcaactagggagtagcccccactcatcccaactggagaatgcagccaaaaaacaaaggaaacgtaattgatcaagatactacttttctcaaggaaaaggggaagtgaaagtgaagtcgctcagtcacgcccgattctttgtgaccccatggacaggagcctgcaccaagctcctccgtccatgagattttctaggcaagagtactggagtgggttgccgtttctggaaggatcttcaggactgttcccaattgtgaaatctttgttttaaaaatctgaaactagcatgggcttcccaggtggtacgagtggtaaagaacccacctgccagtgcaggagat

SEQ ID NO: 63241 - DNA, 1651 bp, Bovine  19866881830881
tggtctaaatctggcatggacacgtaaggcaccgcttcgcgttatttattgtttctaagatttttgctcacgtgtctgttttgtccctggttgtcttacgctgtcactaggcattgctttcagcacacgtgctcagggaattagggaaacaccaagcatctgaaacagtcttgagaaatagaatgcaaaatgtgccaaccagccttctctccacattctcccccagggacccgctgatgtcttcagagctctgccctttaaatattctcagttaaagaaatcctaagctaagtagggaaagaatgagaaagttctcttgctgacatgaatttgagggtccagtgtgtccccaggggtcctttgcctgccctcttgatcagattgtccaccttctgttgagagaccactgggggccaccccatcatgcctggcatccattccccagtcatcatcatatatgtcctggaatgggacccacttctttccccgcttctcaggcctttctggtggtttataattcagcctgtcctctgtgtcctcctcagtttttgccctaactgagcctggctgcccctacagaccactgcagccactgcagctctttccagcagatgccattgttttcccctcacaccccacataccttaggagagtgtctgccttgctctttgttgttgcttccaaatgatttctccttcctcctccaaaaactccagatcctttgaagtccgtgctatcagacaagcactcctaaccccttcctactgctgtccttcaccaacctcctcttatttctgctcatgcactgaagattttctcccctagctcactgtcatccccctttcctcctgtcaccatgccccacaaggcagtttagacctgtaggtgacaagttttcacactcatgtgctccagccccttggccagattgccagctctagggagccatcctggcatctggtcgcagtgtccagcagagcgctggatgggaccctccctcgtagatgctcacagatggaagggaagggaatggtgcacaggtgtgaaggtggaggcggcagaggactgggctcagactcgggcccccggggcaggcttagctgtcactggcgctcaccactccactttgaccctggccttcactcccagaaggacccacctcaccttaatgacgtgatgtgccgccttgtacaggcccgtgccctggagcttcaggccaggtgcatggtggcccgtctcgtagccctcttctgccattgtctgcagggatggcaagtgagaaccacaggacctgtgagaagtgacagggtgcgctcttggctggaaagtgggttttcccacctggagcgggggtctgcttacccgaggatcactgaaagtaacccagtgtttcacacggtccccaaaagcctcaaagcacaggttggcataatcactgaagtagttggccatgctcacgttctgccacccgccgtacttggcctggagcagctgcaaacagaggggcggagagagaagcaggtgccccaggggttcgtctccagaaaagacttttggggtcaatgggccaagtttgtggaagaaactttgctgattggagctacagaggatgtttagaggaaaggggagcaaagatgcagggtctcaggca

SEQ ID NO: 63242 - DNA, 1124 bp, Bovine  19866881860375
aaaagccgctaatgggcacaaggtttctgctggggtgatgaagaagtcctggaaccagatagtggtgatggctgcatagcgttgtgaatgttcgtaatggcactgaattgtatgtttaaaacggttataatggttaacggtgattatgtgtatttgtgatctttcccccatccatgctgcctcccgcatagcagactccttggtgtgtcagagagtgtggacttttgctgctgtgccttctggctggtaggactgcccggagtccaggcaggagggcaggtgggggctttggccagtggctcgccatgactgggctggccgttccatgccatccccttctttaagaatagagagacacttaaaccctggcggcatccccgagaaggtgctgggacactgtcccagagctcttgatccaaacaaaagaggtgggacctgggtgaccatggcctgccggccaccaaagccacgccatagtccagggctgggctggagccagagccagaatagatggcctggtgcctgcctggttggcctctgatctctgtcccttggcactgctgaaagttatgactctttcccccacaagagccttcccctttgggaggaaaattagggaaggaagtcaaaaccttagaggctgacattttttttagacacacataatgaaggatgtagggggaaatgatgggaggtactttagccaaaacaaacacacgaataaataaaaggggctaaatgaagcaatcttaatcattgttgcacgagtgagagttagctcaggttggcttctgagaagcagagcctgagatggggatttggacacgctcagcttacgaggtggcgtgtccttgggagaagcgagtgagggaagtgggatggagcagtaagggtgtgggctcaactggggtttagcctcagcctgttccgcggggagctctgggacgggcactgcacctcagagttgggcacacctggaggcagggggtcagctttttgttcccatctcattggctgcgggtaggtgtgcacacagacacgcatgcacacacacctgggagggactgtaattgcctgaccaggacagttcttccagtaaggggcatctgtgaaccattagcagc

SEQ ID NO: 63243 - DNA, 1540 bp, Bovine  19866880379166
gactgcaaggagatcaaaccagtcaatcctataggaaatcaaccctgaatattcattgaaaggactgatgctgcagctgaagctccagtactttggccacctgatgggaagagccgactcattggaaaagaccctgatgctgggaaagattgagggcaggaggagaagagggcatcagaggatgacatggttagatagcatcatcgactcaatggacatgaatttgagcaaactctgggagatagtgaaggacaggggagcctggagggctgcaatccatggggtcgcagagtcggacacaacttagcaactgaacagcaacagtaactagacagaggagagactttggctacattctctttgtttttaatgtttgtttttggttgagttgggtcttagttgctgcacacgggatcttccttgcagcgtgtgggcttctctcggtcatggtgcacaggctccagagtacatggactctgtggtttgcagcagacaggctctctagctgaggtgcctgggctcagtacttttgacttgcaagcttagttgcccctcagcatgtgagatcccagatccccaaccagggatcgagctcacatcccttggattgattagcaggcagattcttaaccactggaccaccaggcaagtccatctgtgtggattttgaacgtggggcagacagggtttgctgatagggtggatgggagtgtgagaggcagagtgggggaactcccggcttgctctgaacttgtattgtagacggcgtgagagttgctatattcctgctgtacagtgggtgccccaacaccagctactctaggcctctgactgagaccacttcctcacccatctgtctctcctaggcccaacggaaccctgccagtctctgctgtggtccagggcactcagctcctgattcatactgtggacgagaccatcaatgtgactttcatctgccttgtcaccaacgccctagggaccaaccaggcaaacgtgaccatcctggtcagaggtgaggagccccctgggtggggaggacagaggaactcaggatagatatcaaagaggatatcgaagtaggattccctctgagggaggggtttataggtggtccctggttaaaggagtccctcaaccacaagaatgctcccaagctcccattctttctctaagcccctgcatggaaggttcaacgggctcagctttactgtctgttaactcaccatctgaaccgttggaaccacggtacagccacctggacacagcccctctgcaaacccaggctggggtagttgcataatgcctcttcccaatggactcaggaaggcttttccaagtatattagacagaactctgtcatttgcaattgatagaagctcaactcaaaatagtccaggcaaaaatggtactttattagaacttcaccttcaggtatggttagatccaagtgctccagctgtgtaacccaggaacttttcttgacctctgttgtctctgcttctcttttgctggctttattcccctggcaggctttccc

SEQ ID NO: 63244 - DNA, 1375 bp, Bovine  19866880391862
tcccccttctcctcctgccttcaatctttctcaacaaggctttaggtccttattaacctgtctagagattcaggcgcatttgtactccttcacgtgaaaggcaatggcaccccattccagtactcttgcctggaaaatcccatgggcagaggagcctggtaggctgcagtccatgaggtcgcgaagagtcgaactcgactgagcgacttcactttcacttttcactttcatgcattggagaaggaagtggcaacccactccagtgttcttacctggagaatcccagggacgggggagcctggtggactgccatctatggggtcgcacagagttggacacgactgaagtgacttagcagcttagcagcatgtgaaaggtgaattgggaaaaccttttgagagggaaacctaccattacactttcaaatattttaaagtgcatattttttgactttgcaattgctacttcttggctaaggtctctgaaaaaggatctttacagcattgatgataagtaaatatctgtaactaaatgtactttatttgaattgagtaaagctaagtcaccagttctaaggaatactatactgtacggtcacaaaatgaaagagattatgataaaactgcttgttcaaatttattgagcacttattatgttccaggcaccagtgtaagtgatttatatatattcattaatgtgatcctttcaaacaccttgtgatttagataccattatagagaggaaattaagatagtgagaggcgagggaatttgcccagtatcctgtaattaaagccttaaagtgtgaacttagcctatgctttcaccagctgtgcgtgcagcagtttctggatgtggctcgtacttttaaagcacagaccagaagctgtgcacctgtcctagagggttactgatggcccatgacctttgcagacgttagaaacagtgacggagtggggtggtagggaggtgacaacgccgtcactgagagaaagagacaagtgttgggactgaaaactgcctggagtccctccaaatcagtaacctttttggggttcatcttctttatcctgcttgatgctgtccttccagtggaggttgtaagattgagttgacacgtgtttgatgttgtaggaggccgtgaccttcaaggatgtggctgtggtcttcactgaggaggagctggggttactggactcggcccagaggaagctgtaccaggatgtgatggtggagaacttccggaacctggtctcagtgggtgaggacgggcgccctctgaccctgaacctcatcccccttgagagtctctgatccttctttgtttgaagggtggacctttagccaattttttttttaactgaaggttagtttta

SEQ ID NO: 63245 - DNA, 1284 bp, Bovine  19866880398640
tcttcacattttccaatcattaactcttttaaaaaaagttttaaaaaatatttatttatttggctgctttaggtattagttgcagtgcatggtcctctctgattgtggtgcaaggacttagctgccccgaggcatgtgggatcttagttccctgaccagggattgaaactgtgtgccctgcattggaaggcagattgttaaccactggaccgcaagggaagtcccctaatcattaactcttgagtcagccttttagttcaaaagatacggacacagaggcttgtatacggtttcaagtcctatttccgcttcctcaatgggatggtggatttatgggtaggatggaaggaaggaagtgttcatcattgactggatagatgtatgaacagctgagttggtgggtaagcagatgaacttagggacaggtgtatggacaggtgattgggtggacagattattagaagaatgattgataagggtactgaattctacccaggcattctgtccctaagcctattacctgtcaggactcaacatttctacctcttcctaattttcctgcagagacacttccccagcccaatgtcacagtcaacaactcagccccaggagcatgtggaatccatcagcctgcacagcttgaacccaaagagcgctgtggccatccagtggtacatccggggccagaagctcttcactgggggccacagggagctgtcctctgaccacaggatactgtatggaacatcaccaggaatgactcgggcttctaccagtgtgagagctgcaactcagccaccagcagcatcagcaaccctattctcatcaaagtcatttgtgagttgagggccttgctaaaggtgggtggggacaccacaagagtgtgtctgaggggtgaagcaggggttgaaatccagctggttctgatggccaagctgatggtgtctgccctaaggcagggggcttgtattatttgcataaaggcctcatgatagttgagggtcctgttttaagtttctccaggccagagatgctccatcccactgtgagacatgttaccgacttctcgggagcagatgatccatctgagcacttgggaaaggcctgcaaaccctatgtgcaggacatgaaaccctagctctggcagcaatgtacgcctccactgggtgggagactaggtcacggatctcttttcggcacccaagtgggttctcagtaaatatgtgttaaatggatgaaattttacatttttaattagtttgtttatttttggctgtgctgggt

SEQ ID NO: 63246 - DNA, 2283 bp, Bovine  19866880439272
ctgcttcttggctttgtccctcttccactggacactggttgtaagattgagctgagattatttgttgtaggaggcagtgaccttcacggatgtggctgtgaccttcacggaggaggagttcaggctgctggactcggcccagaagaagctgtaccaggatgtgatgctggagaacttccggaatctggtctcagtgggtgaggacaggcaccctttctttttaaaaaaatgtgtacttggctgtctcgagtcttagttgcagtatgtggaatctagttccctgaccatggatcaaaccctggcctcctgcattgggagtgcagagtcttagtcactggaccccccaagagaggtcccaggcaccttttctaacaaggtcatctccttggtttggctttgtgtcctcagatgtggaaggcttttggggtattgaaatggcatttggggacctgactttcataccaaagctttttatcaaaataaaataagggagaaaaatatcagaatttgtcaggaagaatggaatacattgcaggaaaaactctggccaattgtgtgagtcatataaaaaccagtaaggggagatttaatgaaaataggcactggtgagaaattggtttctgtaatacttactgtatttatgtgtccaggtcttgaaatattggtatcttggggtttttttgtgtgtgttttccttttaactttttgactgcaccttgggccatgagggatcttagttccctgatcagagatcaaacccatgcctcctgcatagaaacccagagtcttaactgctagaccatcagagaagttccaatattttttcaaataggtcatgttttcttaaaaatattttaattacactcgttttgactcattgatcaacattaaatacaggaatcttaatttccagtaaattgtactgttagtgtattcattttcttttttttctgactttaaatttatttatttttaattgaaggataattgctttacagtattgtgttggtttctaccaaacgtcaacatgaatcagccacagtgtgttcattttaaatatgttactctgcatgttcacagggtgtcaccccttcagacatgatatatttcacttagaaaaggaaaaaaggctttgggtggtgaagacagcaacccaaagagaaggaaagtcaggtaagaaccaggcagatgggggtccttagagaagccctcccatgtgtttttgcttctctccaaccctttggctggcatctcgtccaaactgccagacctcttctttaacacaccttagtactggttgccctgccccgcctatagtctgttttccaggtagcagccaagagtgatgcttaggcaagactgccattgctctcttccaaatcttttatagcttcttatttttcttaaagtggctctgcagtcctccaggatctgctcgtggtcccccactgtctctctgattcctttcctctcgctccttgtctcctacccatgctgtacaccacaccaggctcagactcgccagggatgctgtatcacccgcggctgcctgaacaaatcactgcacacaccatagcttaacacaacacacgttgaacatcttacacttccagaggtcagaggtgtggtgtggtttcactttggaggttctgggggagaatctgtgtttgcctttccagtggctcatggccaccttcctcaagcttcacacctagcgacatcgcttttctctgccccgtcctcccttgtcacatgtccctcttctgctcttttcctgcatcatgcttctgcttcataggagacttttgattgcattgagcctcccactccaccccaaagtagaggatgtacttacattttaaggtcagctaatcagcagcctcaattctgtctgaaatcttaattcccctttgccacataatctgacatagtctaggctccaaaaatcaggatgtgagttctttgggggacagttactgtgatcacagcagatacttccacctatgagcctttaactctgccagacctactcctctacctctggtcttccaactccctccctttctgccttcaggtcttcgctcagttccaacatcatgagagaggccttctctgaccaccctgtgtaaaattccatcctcccttttctctcctctttctgcatcttactggatctcacagactttgcttgtttatcacccctctctgcactggagtgtgatcaccaggagtgtggagttttgtctgtcttgagtacccggagcagcccagttgggcaagcat

SEQ ID NO: 63247 - DNA, 1543 bp, Bovine  19866880716484
ccagtggttaagaatttgcctcccaatgcagggcacatgggttcgatccctggtctgggaagattccacataccgtggggcaactaaacccacacaccacaagcagagagtagccccctcttgccacaactagagaaagccagtgtgtagcaacaaagacctagcacagccaatcaatcggttacacaataaaactctaaataaataaataagtacatcccatcagttctaatattgcaaatatatagtcgtgaatgcctatgaaaaaggaaaataagaaagtgaaaacagctagtctgtaaggagggtagcactgtaaattatgtttgtctattttaattttcccttattttttcaaagattgctttgtgaagcaaagaagatgataaaacaaacaaaacacacagccagcagcagcagcagcacacaatgtgcactcaagacgtgttgtgttcattaagctttccaaggaagattagggacaaagatgtccctaatctctgagaaatagaatcctcagaagacagaaagcaatgccttacttacctgaaacttggtcattttctcatgttccttctggggaaagtcagagtcctgagaaggcataactggggaaggacaaagaagccatgagatgcaggccacggctttcatgaccccatgtggatctttgcagaaattatgcacgaacacgcatgctccaaggcagatacgcccacatagcttggtaagcagagcttggagtagactgcagctatgaacaagactgtcagccagcagccaatggacaaagaacaacctgcacgaccacacacagcatccctattgtgaatatttctgctcctactatacacaaaacaaaaagacaacctatggaataggaggaaatgtctgcaaatgatgcgaccgatgaggaattaatctccaaaatatacaaacagctcatacagcttaatatcaaaaatgtaaacaacagggggacttccctggaggtccagtggttaggattccaggctctcactgctgtgacccaggttcaatccctggttgggaaaccaagatccctgcaagctgtgaggtacagcccaaaatacaaaataaaataaaaataaatttcaaaaaaagcaaacaacccaatcaaaaaacggacagaagacctaagtagacatctccaaagaagacatacaggtggttaaagggcacatgataagatgctcatcatcattaattattagagaaatgcaaatcaaaaccacaatgaggtaccacctcacactggtcagaatgtccattattaaaaagtctacaaataataaatgctggagagggtgtagagaaaaggaaacccacttacactactggtggcaatgtaacctagtgaagccacctggaaaacaatatgcagattcctcaaaaaaactaaaagcagagttgccatataatccagcaattccactcctggacatacactcagataaaactataactcgaaaagatacatgcatcccaatgttcacagcagcactatccacaagagccaaga

SEQ ID NO: 63248 - DNA, 870 bp, Bovine  19866880802244
caggcaagaatactggagtggggtgccataccctcctccaagggatcttcccaacccagtgatcgaacccttgtgtcctgcattggcaggcagattcctttacccctgtgccacctaggaagcccctttttatttattattatcaccgttgtcacatcagctctccatggcacacattctcaccagcacggggttagcggctggggcagcatcttgcctttggtcccattgctccctcgctctctcttctccctcccaccctcctacaaggcaccctgctcgcattcagtacctggtctgcctccttggaactgctgtcctctgtgtctctggaccccttgactgaaggagccaatgcccacctgccagtccctagaagcctggatagggttctcgccacctcttggttccgagggcatgaagtccggccagaagccatgatcttctctcccgagggcctcccagggcctggccacactggccgggagacgctggacacccagggcagcctgatcttcagaaacgtgacgactctagatgcgggcagctacatggtggtactggaaaccagcaggggacgcaggagtgcgacggagcagataccgatcaagggtaatttcacgcccccacccctccctccatggcagggcgggagggacagagttctcagtctgcagggccccaggggacccattctgaacccatcatccgttccaaacatcccagaacttagaagggcaaccagtttttttttagctcttgattcttgtcaacagctctggtctcagctaattttagccaggctcactctggtgtctgcagtcagcaggttggaaggattgcctaggcactggtgcagaaggcctcctc

SEQ ID NO: 63249 - DNA, 2701 bp, Bovine  19866880340327
tatttttctgggctccaaaatcactgcagatggtgattgcagccatgaaattaaaagacgcttactacttggaagaaaagttatgaccaacctagacagcatattaaaaagcagagacattactttgtcaacaaaggtccatctagtcaaggctatggtttttccagtggccatgtatggatgtgagagttggactataaagaaagctgagtgtggaagaattgatgcttttgaactgtggtgttggagaagactcttgagaatccctgggactgcaaggagatccaatagtccatcctaaaggagatcagtcctgggtgttcattggaaggactgatgttgaagctgaaactccaatactttgaccacctgatgcgaagagctgactcatttaaaaagaccctgatgctgggaaagattgagggcaggaggagaaggggaggacagaggatgagatggttggatggcgtcaccgactcaagggacatgggtttggactcatggagttggtgatggacagggaggcctggcatgctgcaattcacggggtcacaaagagtcagacatgactgagtgactgaacggaactgaactcaccactcagcctggacctgtactgccagcttttctgtgtctgaacttcttaccttctctactgcatgagccagctgcgtgcaacctctctcttctctcccttcccacatcttcccctctctctccgtatacatcctgtattttctgtttctgtgaggaaccctgatgaacaagtgcattggttttctgttgctccatgaaaagattaccagaaacttagtggttcaaacaacacatgcttgccaacttgtgacagccaagaggccagacagagctgtgtcctctaactgagggcctcagaagatggcggtacaggtgtcactgtggccacacctaaggttcaagaggggaaggacccacctccaaactcacgtaattgttggcagaattcagatctctgtgtctggggaccccagtgcctcagtttcattctgggtgttggcaagagattgttctcagcttctagaggctaccgtcagtctttgctacatgtgtgtgtgtgcatgcaaaatctcgagtcatatccatctctatatgaccccatggactgtagcccaccaggctcctctgtccatgggattctccaggcaaaaatactcaagtacaagtgggttctcatgccctcctccaggggttcttcctgactgagggatggaatccaagtacaagcacatctcctgcattggtaggtgggttctttaccactgagctattcgtggctgccagcttcatccaaaccagcaaggcggagaattctgcagcagatggacacgacagtcttatgtcccaccatcatgaaagtgacatccctcacctttgccttatgatagtgattaaaagcaagtcacaggtcctgtctgcactcaagaggaaggtttgcagaagggtgggaacaccaggaggcgcgtagcagggaccacagtcgatacagaagttatgggtgactgcctttgctgtgggagatagccatttgtctccaggctggagctctgacaaggagtaagatacagaccaaaggcgactggcagtctgcgaggaagacagactgattttaaggcttaaatgtagagtgaaattcagttactggagtccgactatatgccaggcactggttgaaaactttacgtgtgtgagctcattcaattcccataactcctttaaaaatgcagtaaaatgcttctcaggcaagggttcttactggcctgttttacagataaggcattaggggcagagaggttaagtcacctgcccagggccgcacagctcatgagcactagagccaagatggggacccaggtggtctgactccagcagtggaggagcctcctcaactcagctgctgaagtccttaggctaagaaagcctccttctctctggagtgtgcagctgttttttgaaaagcacaggctggggaagaaaagctggctccagctggagtagaggagaaatggggtagacagtggggcaaagagggcacagtgaaaggaaatgaagatgcctttaaaatttccaagacaggtttcccgtgatgaaacgtgttctgatgggagagagcaaagaagcagtcagaaaatgaatgtctccagttcaatcagaaaattcagaaattatgaagaagctgcctttgcacttaacaccgacctgctatcagaaagtaacttatctgtaaataagcaagagatagagtatttcctttaacagcagtaaaactcttaaaagttttactggcaaagacagcctgcaggaggtgtgtaactcttgtcttcctgtccatgatgggccttctcacatccctgggcaagcgggtcagtgattaccggagtgaattatggtcactgccaaaggatgacattagctagaatcctgcttcctgccaccatgatggaaaccctccaggtacatcaaagaattatggatgaaggtgcttttatagcctttaagaaacaaaatctgcagctcagagtcagcgcactgtgttctctgcccaggctcctctgggctttggtgacccaggctgtgcatggccaagtcaatgccgagaggtctcctgtttcttgagatttagaagcacaggctttgacttagacctatatgcactcagacagca

SEQ ID NO: 63250 - DNA, 1506 bp, Bovine  19866880400038
cctcaattaacttgtgcttcgattcctgcgtgtttatggcagggtctctcctagttgcctggtcgatatccattcccgttcccctcccttccctgccccctgcttttcctcattaatggggccttcattatgtttcaggcaccaggtctcctgctaaaacagacacatttccagactttcttgcagttaccagtggctgaggtgatgcttcttcacctcccttccttctcctcttctgcactgaggtcagcctgcaggaacatttcgtaagaggagacaagtgttctgatgaggaggacggccacaaaggcagtgcagtgtaaagatggaaatgcagaactgcctagatcctggaggcacctgaccagccttatttggtggcctcctacatttttatgttgtgggtgaaataaatcccaagctaaagtattgcaggtcattattttcagagtgttatttgaaactggaagtattcttaaccaaggcagcactaaacacagtggttaaagcgatatattgaataaaataaacagtgctttttggcttgtttttggtcaaattttaataaaatgggaagtggccttgaatttttgtcctgatccatgaatattagctgattgtgatggggaaaggcactggtcagggttttcctcttcaaggccaaattgtttttcttcaaggagaaaaaaataacagacatcacttggataaagggaatgaattcattgttcatccaaatgctaaagagtagctcactgagatggtttattttagcagatgtttaacactcttaatcaacaatttcaagggaaattggaatacatttattgcagatgacaagattgttgaagatgagcttgggaattggatgaagacaattgatcatgaaggggattaatcattggagactgttggctcatttacatgtgatgaggcactgcatttgcagcaaaataaagtagatcatcagctgcctctcctcactaagaaacagttgtgacggtcgcgtgaaggactgaccacgatgcactcctgtgcgcagcccccaagcccctcattgtgtaccttgcaatgggtgaaatcgtcagcttttgccaccaggctccaaactccagaacagttgaggggtcccttgtttcattcctttggccacacaacaaacttgcaaatatggaatgaataatcacagagaggatcggagaccccttcagtctgccatttgtgcaagcaattggcctccaatcaagataaggtgttttttgagatcctcactagacgcagcctagactttgcacagtacgataacctgggcagctttgagggtgtctctcatcagaattactctagagctatggatagaaaagtgataaaaaaaacaaaaacaaaaacactgacgccattaatattcaggcatttacgctagcctggattcttgagatactgagctaacaggtcaaggaggtaaaaggacctggatatggaacctgatatgcagagacagctttt

SEQ ID NO: 63251 - DNA, 2833 bp, Bovine  19866880440240
gggctaagggcctgaatgatgtaagatggcatagggagcacttagctgtgagagaaacaaatctgacgtcttagagctcaagttggccatcgagaacacgcaattcaattccatactttgtagatggagaagctaaataaagacctgaggggcatgatgggtagtctttgtgctacatgcttatttgtatcacctgatttcaacccctcaaaaagctttatgaagttggtactattatttccttgcttataatttcccttaaataaggaaattaattacatggcttataggtgaagcaggacttgaattgaggaatcagactccaagcccatgtttttcaactgtgtgagagctacaagaggatagggggctgaatgtttttatgacagataaagaacattctacagtgccagaagcacatatttcctctcctggtacaggaaaacaagtttgatttggagtgactttgaaagttgagatgggaccagagtgcatcccaagattctccaccccacactggggtggaggcttcctcagcaatcagagcccccagaaaaaccattcccactggtctctgtgggaatgcatgggcatttaggagttttagatctgggagtaatcggagaatttcagaggcattggtcatatttgtcatgggaaagccaatcaaaaacttttacactctgtgttttaccctgtattagagaagatctaagcatgatataatgccgtttattttaaacttccaacaagggcctatgagtcatttcaggaaggggaacactccagttctttccagaaattctcataattccacatttacattgtaaaaaaaaaatatatatatatatatatgcatcaatcctagttacaacaaccccaaaacatcaatgcctgtgcgtgctcagtctttctgttgtgtccgacgcttctcaaccccatggactatagcccaccagacttctctgtccatgagactttccaggcaagagtactgggagtggatagccactccctactccaagggatcttcccgacccagggatcgaaactgtgtcttctgctttggcaggcagattctttactactgagccacctgggaaacccaaaacatcagtaaacacccctaaaaagatactttgctgatcaatgacgggagtccttgtcagacagactcattaactgcataatatggtatatttgcctgcttgataaactttatgaagtttacaacaaatattataaaggcctctatgttctttgcacactcaccctaaacagtccaattggcaccattacttataatgagaacaagactgtcatatggaaaaatagaaatatgggacgttcagtgaaggaagaaacatttcacttatggacaagacgatctcataagaacaatagaagaaagaacattcttaattaaaaaaaaaaaacacgcacaagtgcctttgttcaagagaaatgtcatgaacaaaccttcagggaaagaatagaaagtgattaggaaggcatttgagaaaatataccaatttgtggattgttactcatctctttgatcaatgtgctgtcttatagaatcaatgactaaattagtgtggaatgctcataggagtaaaccaagaaaaaagaaactagattaagtaaacaagaaacagaaaaatgacatgcaaagatcgtgagaagactcataatgtaaatagctagatcattatgttgggacatatagttattgttcagaattcatgtggcaactcattatcttaaaagtggcttcataaattaccctgatttcagtaattactgtgtgccatgttaacttgtactgaagcagagttaaagcataaaaatctatcaatgacaaaaatattttaaaaaaattttttctattgacataacacaactgaaatatcatgtagaaacagcattaaaaattccaaagaaagaaaatgtcatgttttgaatgtcttgatcagttcaatgaatacagttaagagttcaatcaatgttcttcaataaacacatgaattagtattttatagtatgtttcattgagaactgacatattatctatatcctgtatctgaaaaagttaccatttttgtaaaataagaaatttgctgcttttgaaaaataatcctctgtatctttaatatagcttcgagtgttaaatgttcactttgattatgagttgatgcatgtgaaacaaacaatttatcatgaggaaagtaacttaaattttatgttgaaattattttcttatgcaaggccaactcttaaataattcaaagcaaagtttaatataacctgtattgctattgtagaaatgtccctttttccctaattttatggttactcatatttctttcattgtaaactctaataataaaggaaataacttttgtcacatatttctagagattattttgaatttacatactctataattttagttatttagtcaagcatcaaaaatagaggcaaaactcttaccttagaagacgaaattggatgacaccaaaacatatgcattgtagaaatcaacagaaatagaataaaattgaattttaatgaactgcagaggagaaaaaaaaaattcagaaaagtcttattcaggcaagtataaattaaaaagcatatacaaatttaacatttttctttgtggaaaaatgcaatctcttacccaatcattctggacttcctgagatctctgcagatgggtgattttattcccagattcctcactgttactgtcagatcctccttgggtgatccttttataccagaaaagttcaagagtgaaaatgtcatcatgtcccatcataggtgacta

SEQ ID NO: 63252 - DNA, 1210 bp, Bovine  19866880517593
tgtctccacccagcagactcgctgaccccggggctcagcaggaagcactgagtggtacagagcaacgtgtccttccgtatcatccctcctcaactagaatctgtcttcctactctccctgggatccaaatggggctattttgtgttcagagttttatttccaaaggtatgttggtgcaattggcattgcattcaggatcatctttactaactgtcgttgtaaatctcccttgctctcgttggctgcctgtaggatgcaaggccctctgtatggatggaagattgtggtcacctgcccagagttgcacagaaaattacagaagggtgaaactggcagccttgaagttgcagttttcagtccatgaacgctggtgtgtgtgagtgaagggcactttgttgatttaaatttgcaggaatacaaaacctgctccaagaacgggagcgacagaagcaataacaaatgggccttgaacacttttctatcgagtggttgctccaatcttcacactgtttaatctcacatgaagttgcaaagatgactaagtaagcataatgcttggaacaaaagctgtcacaaagaacctatagcaaggccatgtgaggacctggagaacccaatatcctgcaggatgtatgaaatggccatcagagaggagaaagcttccaaaagcccttgaaagacactttggctgatggttcagacactcgtgtgctcgtaggtgctggggcctggaggacaggtcgcactgacccagaaatggtgataattgagtctgagcttcagatggttgcctgggagttcaggaaggcatagagagtacagtagttacttctaagggttatcagatcaagaaagagttgacttcattaagtggctgattccagctcagtgtttgaaagggctttctaacaatacaaaccaccctttagactctacacaagcaagactattcctgtatgagatattaggatgatttgagagcctgggttccactctttaccagctagatgaccagttggatgttatttaactcctctgaccctggtggctcattggttaagagccacctgcaacacaggagctgcaggagggtcaggttcaatctctgggtcaggaagatcccctggaggaggaaatggcaacccacttccgtattattgccaggagaaccccacagacagaggatcctggtgggttacagtccatgggg

SEQ ID NO: 63253 - DNA, 1914 bp, Bovine  19866880619476
cgcgtgaactagaaggttcattatagtgtgttcactcataacatgagtgttcagaggggagcggatgctggccagagacagtgaaccccgctgaccaggaggcagcgcctggcctgctgagctccactccctcgtgttaaaatgaggatgaaagcccgtccacatcctcaagtggctggatgctgtgtgaagatctggtgcgcctgctcattgccctgttccgtgagtgtgggagctggtacggcacgcagagtggggaccagcgtggagaccagcgaccatcagaggtatctgggggctggggaactaaggtcaggaggagggcagtgcaggcaaaggagccagtgagacacagaggagacctcagtgatcagggctgtggttcacagcccatgagcaaggtcagacacagtcctgaccctgagctggccaaggtctgaacagcgggaaccagactgagataaggtttctgggctcagaccctcactgtatccgatgaagagctcccctgctcagctcaaattatgctagttttttcatctgatgtctggccactaaaatacatggatacttgtattttaatataaactgtaagaggaatacaaaaggagactggttatgtgtttacgtttacaaagagcaaaagaaaagaagtcatggcttcttcctaatgtaaggaaatggaagcattttttatcggggtctgtctcttaccttctaccgcaaatacctggggaagagaggaaaggagatggtttataacagaaaaactcccggcggagtggacgaactcaatccatgcttttttttcacatttccacggggatgcaaatcaatttaagtacttaaaatagccacagaaagggggaaaaaaaaagatcaacctctattagttaccatgggaattactaattgaagcacttcttttgtcttttcaagatccttgccattcctgtgacatttagaatgataaaattaagggagccagcatctatttcctgccatttgatgattataaaaatatcattatggaagttcaaattgaagaagcttcttcggaagtaaaactcacttattgtagtgacatacttattaaggaaaaccaccttggatggaatttcgcaagtagagtctagaatcttcatagggttatgagatttgggaaaagagtcatttaaagcccaaatgcttccagggcgtttcagtgggagaatacacggaaggccggctggctggaccctgtccctcacccagatcacagctgcctgccagagaacctttccgaaaaatgccagcatctacaagagttctgaaaatcagacatctgaccacgagcgcttcttgaaaatgaaacttttgatggcattcattaggacagtgcctttgggggttgttttttaaatcattacttgcacagagtctgcagtacccaaaataacactcccaaatgttaccaacctgcgtcttcacaggatggacagccctgtaacgcgaacacccttggaatatgagatgggttgctgaggcacttgggtttaggaacaaaaatgtaaatctttcccttaaaattgagaactgtttactgttagactcgggctgaatgaagaactttgctaatacttataggtgactagacttaccatctatgaaaatagattcttaaaagtttaaatttaataaagagaaaggataccctggaagccaggagtaggcaatgaactgctattacactgggttcaacttcaaatgcaattagctttgcaaggagtggtctggacaggaaagaggttggacaacacaagtaggaaggcttaaaacctggacctggtactaaccctaatgcttgctttaagaaaagaagactgattccctgaaccaaaggatgagcagtaaaagagacgaaaggtagggaaa

SEQ ID NO: 63254 - DNA, 717 bp, Bovine  19866880727492
cgagccccgggtctcaggcagcctttgctcctccccacgtgtcccgcatgcatatggccttctctggggcatataagtgctcgttttcaagctcccacaaatgaaaacgattagacattcagcaagatatcccagctgcagcctaattatttcataccgtgagcggtgacagcctcctcttttgggagctgggttagcaggaggggagcgagaacagtgtgggcttgttggggagccgtccacaaggcgccggtgctggagaattgaaatgcttccttagagccctctcttcggggccggggtgcggggaggtggtgtttggaagggggtcttggtaaaggccaatggcagccttggcacttccctgcgggaagatgccgcctctttttctgcccaggactggggacagtgcgacaggacactgaaccagcagagatggggctcccccaggaggctgtaggaggtggggcccggcacctgagagtgaacagagggggcgtccggggtggaggcatcttcactatggtggactccccttcctcaggaggctgctctttgcagccgtgtgactgcccccaccagcttcatctcttcatcactgttacatgtgtcattgtgtgttaacatcgtcattcgtccctctctacacgcagacacacacgatggtgagccgcactgagcagggccgggaccctcttgctcccacgctgtcctggg

SEQ ID NO: 63255 - DNA, 657 bp, Bovine  19866880756876
ttcttcctgatttattttaaacttcaaaaacaaacaaacaaaaaagacacaataccagtgccaattataaatttatttgtgagtgttgatttccactagagatgagccatctctcctgacactttttttcccctgctggatttggggctctgatttctgatgacatagtctgggcactggcagctgctagcttcacaaggacaactacagagggaatacccacgtaaattatggatcgcctttcgcatcagtagcctgcctggcaatgttcagattgtcagtcagtgagactccggtgccgtggacatgggtttgaacgagttgatcacctcggggctgttcagaaagcctggctctgtaagtatcaggggatgaggaacacagatgggaaaagggatttccggaagctgctttatgtctctggcttaggttgggagaaaaatgcattttccaacagtttttaaaatgtaatatctaatgttgcctctcactgttaatttaggaatgtcatagcaattctattcccagtcaagtttctctgtgagctcatgctaccagtttgtaaaatgtaacatccgtgtaggtggtgagtgaacagttgtgtccaaatgatttgtgcagattttatgtcttcctatgcgttaaattgctgtttaa

SEQ ID NO: 63256 - DNA, 668 bp, Bovine  19866880838706
tgctctgcctctgtggcctgcttacattatatacgccctggaaacgatcaagtttgccctcctatgggtggagggcaggggactccaacctccaggatctaatgcctgatgatgtgaggtggagctgatgcaataattacagaaataaagtgcgcagtaaatgtaaggcccttgaatcatccccaaaccattccccacttcccacttacagaaaagctgtcttccaggaaacctggtcccaaaaaggttggggactactggacgccagggcgcccgcaggacaggtgtcgtgactgcattgtaatgccagtgttaagcccaatttgagtataccacagatactcaatagatgtttacatctccatttgtcccttccatcccaccttacagactactttccaatactacccacatttgatgaaaaccaagaaagatcctttgaaagaatattgttggctggctaagaataggcctagcttggcacaattctgtgcaaaattattaaatttctggctcttgcatctttatattatgctaagccaaaatcaggactctgctccaaggaatttaaatgagcagactgataccatctccaatacatgactgagctttagctgatgttcgcaacacggctgaaaagtaatttattgaattactgatgcacttaa

SEQ ID NO: 63257 - DNA, 1133 bp, Bovine  19866880867538
tcaagagcacccagtcttctatatggtctaactcttatatccatccatgactactggaaaaaccatagttttgcatccccaaagtcctggggccagagttctaggaggacctgtctgccacggctgcttttttctctccagggcatgaaattctccaggaagcctctcctgtccttgtgtaccacactaataaatggcatccacattaatgatgggtgtcacattaataaatggattcaggagcactaagggtgagcagatgtcactgaggtttacaatggagggaaacgccaagcaaggtgctgcttcctgcttgggtaactagtacttctgagacagagacaatatttttgcaattcaaagcaatggaggaaaatccttgccttctcaagatcagcatcttttggaggacaaagctgtcctatgtctgggatcttcgatgcccattggtcagtgcttcatccctttcttttgggaactgccctacaatatgattctcatgtgattttcaatcacaacacactccaccttccacaaggaaaagtagtcgacctgactctcaagagaatctggaaattagtgccaagctgggagctgggacatctgatccaaacctttgatagcttttttggagacattctacagagacttaagacaccaagcgactcaacacccatggttacttttggtctctccttaaacccagctaaaattttaagaaacaatggagaaaatcaatgaaaccagaagcctatgctttgtaaagattttttttttagatagattggccaaagaaaagaaaaaagagagaaaatacttaaattgttagcatcagagatgaaagaagcaggattgctaccaacagtttaaaaaattagagctatgaagaaatacatgggtactcaatatcttgtaataatttataatggaaaagaacttgaaactagaaagaaaggaagagaagatgacacagatagcattttgctgagtgaggagaaatcactgaagcaggcttgagggaaggtgtctattgaaacggagctcagtaacagacccacaacagacttgagtattcatggaacgtgttactgtcagatgtggtgaaagtggtcctaacgaaggaggatcctctg

SEQ ID NO: 63258 - DNA, 1736 bp, Bovine  19866880936961
caccctgagcacaactctaccttcctgctgaaaaggaggctgggaccatggggaggagatgctgcctgaagctctggctgccaagcgcccctggcgagacagaggtcagaagtcggactcccacacagtcacccagcagctttcagggaaggaacttccaaatctgtgactggtttgaaacggtgggagctaggggctcccaagtcatggggtcactcaactgagagccaggctgacccaggcacagcctggcagcaggtcgaccagctgaaagggcaggaaaccttcgggcaagcggctgtggcaactggcgtagaggggctgatgctgagccgagagccgagggaggcgaaggttggccacgtttaatacatcacgatccgcacctagtttcagaaggagatgagtctgggggcccgccctcccgcatttcatcgcagcatggttgggacctgcagcttttcatcggcagcaggtttaacatccttgccaacccatttgaatgaacagtacctctcgcttgggatcctaagacaagaagggatggtggacttcctataattaagtctccatcccactaatattgttcctgtaatgaccctttgattcccaccctggacatttgcccgaggaaagcatgccactcagaaccatccacatccaataattacagggtaaagaacatggacaatggaatgagttaagtaggaaacagaagttttcctcttctttgtcttgataaatcattgactatatttagcacttttcgagataagcagaaacagtccatatgaccagaacatccttgatcatataccaggaataaccataagcatggatgcccagatgaaaggcacagccttgaaaaaagggggccaaagaattgacccatcggccttagaataattctgaacagagtcaaggcttttcaaacaaggtgatacatttgagaaaggcaactgcccacatcccggttcactcacgaaaggcacgcacacaggagggcagaacaaatgttccctgcccataggctgcagccccttcaaaagctcttagatggtcttccctcaatttctttaggaaccttgaccgcagtaagttgatgaagtgaacacagaaaaggtgacggggtttctttcctaagtaccaggacctggaggctgtagcatactgcctcaaaaggcaaaaaccgatggaatgccaacactggtttttctttctttcttttttttttttttttactaaaagtgcaatccagaaaagctccttttcagcagttttccccacagtagatcaatttaagaagcaattaccatcaaagcaattatgtccctgtgctcccaacagcccccgaatgtgtgccactgagataagacgaggcccttttcagagtgaggacaagtcagtgacggaaagcatgtggacactgtgttctcaacaatgcatttcagggctctgaggagctgagccagattcgaaaaaccaaaaaaaaaaaaaaaaaattatataaccaaaagcgtgatatgggcctgctcaagccagtgaaggcataaaattcaaatataacacgctgaccacatggccttctttctctaaaagataatgcttctctaacaatgaaagccaacacattctttttttccactagttaattacacaccagagataatttttgaaaagttttgtactcaccaagggaaaacgagggctatagtctgaaaaagaaagagaaaaaa

SEQ ID NO: 63259 - DNA, 1070 bp, Bovine  19866880938990
tctgtaattcgttgtttctactaaaaaactttgcattacatgagcaggagtagagcaaccctaagacttagtgatgtatctaatgaagaaatcaaaattcttagaagacaactatgattagatataagcataattagagaaacatttcctcagataaaaaaaaaaaaagcctgattatatgcagattgaaaatggccaccatgttccagacagaattaattagaaaataattacatttctgaacaagataattaaaaggcagatcctagaaacacctgagatagatgaggtacagtgctcataaggacagaaaactcagtggatctcagacatctttgaaaaaccagagtccagaaaacagaatcgaggcttacatgctcctgggggagaagtttttcgaggtccgattttatacccagccaaattttgatcatgtgcaaaagtaatgcaatgatatctccaaccgtgcaaggactgagatacagtcttttaaagctcatgttgacatatacaccccagctaacagagaaacatgttctcattaaatgctccaggttggggtacttattaaagcacagcttgtgagaggtaagccaattaaatagacagctaaatgtgaatactcaccactagagttctagaaagactgtaaatataagtaaacctttttgaaaccagaggaccacacaccataagaaatgcataccatgaggaatgcatgctacatggctgaaatgagaataaatgatgataataataattagagcttcaaaccaagaatatgtggaattcttccttttacttggggcaagatgaaacaagaagaaataaattaattcttgactttgtaattcaagaaatgcaggtttacctgtttctaagaatgcttaaagttatactccattagtatttaaagaaaaaaaaaaaaaaacagaaaataaccaaatatagttaagcccaaggagaaaaattaaacaaagaatacaagcataaaatgaaactatgtgtaagataggatgagagaaatgaagtgaaaattatcctttgtggcaagaaatgaaatgctttaa

SEQ ID NO: 63260 - DNA, 1537 bp, Bovine  19866880951527
ttttacctattaagtgacaggcgaataactatgtgtgggaaccgaagtgtattggctgagtgtctgtgatcttgggttagggtgaggtgtaatttcccagacacttgagtgtcgaggaggaggaaatgaatggaaagacaatcccccttgtgctttagggaaagattctccacctgagtctctgcagggcaccgcaggggtgcaggttagaggacggcctctggttctaaggaagcagctgacactgcctcccaagcactaaacagacctgttggatacctctggggggtcattccagcatttgttcttaatgagcagctccccctgcctcagcaagagccagccccaggtaacgtaatcctcaggacaccttcacagatgacacagaaaacctgggaacgggaggcttgaacaaggacacagtttaattgttcacagtgagcactgctcttggctggtgagccgacaccccagatggcaggactccgcctgtcagcagctaatcactcagagggcaaaagaaccagggcttcccatcaagtcaaagcaggatggatgaacgtgctttcaagaagttatcctggggcctagaatctgcgttgaaggaatcatcgttttattttccaagtcccttcctttaagtgcagaggtgatcaggttactaattacaaaggatagttgcagttcggaatgaacagcccaaaccacctttgaacctttgtggtattaacttcctataatgtgcttgagtgtcattttgccagaagctacagcagattgaatctccaggaaggctctccagctctgtaacaagcactgacgacgctttagttgataacagtgttgtttctaaaagagaaggtcatgggcttagtctttgcttaagcaaggtggatgtgcattgttcggccccttacaaagctgctgctttcaagaaaaaaaaaaaaaaaaaaatcaacagctgtatcatgtgtcctgtacagtaactggtgaaacagctgtcaaaacccagactggatccttctggttctgattttgtcagaggcataactggaaagcacgaggtttaatgcagcatccccgaagccctgggcggtgaccccacctttcctgtcccccgctgcctcgtagaagacgtggcagaacaaagtcactttttagaaagctctttatttattcaccaagtgttatttctgtacgttgcttttcaaagaagggttcatacatattgcataattcctttaaatactgaattattttttgtaaacagagaaagagattttaaaaagtgtgtcttatagtaattttcctggtgagcaaatgtacgtgaaattactgtgaaggatgatgttgtcagaatgcattttacgggtttaaaggcaagtgttaaaatatgtttttttcacagatgagtcatatccttaatgtaagagattgttgctactttttttcttagactgaagtcattggagggggatttgtgttggtagaaatttactcttcccttaaactatgttttaaaatatgtcctgtacac

SEQ ID NO: 63261 - DNA, 1115 bp, Bovine  19866881003036
cagcgcgtgggtacccaagacaacatgagcccatatttcagagtcaggcatttccagaagcacagtgagccatgcaggtgaggctcaggtaaggatgctgaggctgaccgtggtgctaacatcatagagcaccttctctggctcaagacacgggtccaagcactttacagataaacacacatgatgctcacggcagctctctgagatggtatgggctctcacatgcttgccctgcagcagaggactttgaggaccagagaggttaagtaacctgcccaaggccacacagccatagaatggcagagcctgaattcaaggccagttactctccaacaaccagactttggaaaaccacatctctgaggtcaagatgagctcaccagacctgggaagtattccgaaacactgtaagattttatcaggacagggttagggaacacgaggctccatccaaactgtcaggcatttcctttcaagataaatggacacacattctgtaaattccaaaaattccctgaaaatatttactttaactctcctaccaccgatatgaccaaaaataaaggaaaaaacccacgaattggtttggcaccaacggatgttaacatgttgtgggctggagatcccaaacaggtcaactcagacacttcctcttatctactatacctgggaaatgatcctgcatcataaaacaagtacttcataaatatttgttcattgagggaatgaaacgggccaaaggtttacccaaaaaaagcccgagttttcttcaatcggttatctctataaacaccagcttgttgttgtccagtcgctcagtcgtgcccgactctttgtgaccccacggactgcagcacgccaggctccccagatgcatctcctcaaatatttatctacacagaatcacgggacttgatgtcctttgagaaagactccttgttctgttacccaccagaaaggaagaaaagaaacctcaaaggaaatgaatgtctcaatctactaggcagacaggtaacagaaaaataggaaacaggccctgagagttgagtttattcaaccatgtttagaaacactgaggtcaagtaaaggttgactggctcaagcaggataccggt

SEQ ID NO: 63262 - DNA, 703 bp, Bovine  19866881128032
cttccctggtgactagatggtaaagaatctgcctgcaatgtggaagacctgggtttgatccctgggctgggaagataccttggagaaggaaatgacaacccattccagcattcttgcctggagaatccccatggatagaggtgcctggtgggttacagtccatggggctgcaaagaatcagatgcaattaagcacagcacagcatcttatggctttaatactaaggatttatataataattttaacacgaatcaagattgataactttatttacatgacatataccatggaaataattaacctgaaaaattacagttgacagaatctaattacataaatcaccatgaatgcaaagcatcttctaatttttattttacagtgcatattcaactccttcctcccgaatacaatggcttacagttgtaacttgaaatgtataccaatccaaggtttaattttgcttttaagattaagtagcacatgtgtttgaaacagcaaacaatgccattgggcttacaattaatgaggttttgacaactgcaaacaaattgaatgcataaatctattcaaagcaatctctgtatttaacaggcatgtcactgtgtgtgactatacagttaattttcgttcttcagtgtgaaagctgatttacagtgacattgacctcatgcgaagagttgactcattggaaaagaccctgatg

SEQ ID NO: 63263 - DNA, 1472 bp, Bovine  19866881225927
tcatcttaatcagtttcctctcactgctgcggttaagttcccaccagcttagcagctttaagcaacagcccgttctgaccccacgcttctctcgggagggctctgcccagcgtcgcatagaatgagatcagtgtgccagcagggtgcctcccagctgaggctctgggaggaaggacctgcattcaggtcatgcaggtgaggtctgtgtccacggtggctgacagtggagggtggtctccgtgttctagaggctgccccattccctggctccaggcctgcttcctccatcatcagactcagcagtccctctcctgtttccaccatctgtatccccgaccccaccccaccgtcatgtctctcctctgctcctttcctgcttttaagcactcctgtgaccaccctggagccaccccgagaatccaggatcctctctcctacgttaaagtcggcagattaggaatctcaactcccctgctaagccccttcccagcagcacctggatcactgcacgctgggtgggactcttgggggatatttttaaaattctgcctcccagctccctccacacccacgttcacatcaaaatgacaaaatttaaggttctcctgagtgactgttcgcagcaaagggatttgtttccatttctgagacaatatgtgcagagataattctgtgttatttacacatttggtgtttacgccttgcagactccattatacatatctttaggaatactctttacataaattaagatgatttgtctctttcctgaaaacagcaacatgccacacattctggatgaaaatgagggattgtttacatcagggaccaaattaaactcttggagaattctgaagtaggatagatggaaatgtgctcgagtctatggcatattttaggtttcctaggaacctccttgtcagtataaccacaaattaatattgccaaactagttaattatgagatcatctagtatcttaatatgtgtctgagattctctggcatttaacagagaaaggaatcctaaacacatattatcttcctcggtgggcttgcccaggaccacctctgtcacttgggaagacggatcacccccatgtggtggaggtctggcgctgggctcagaggatatggattcttttttttttttttgactgcgctgggtcttcactgctgtgcctgagccttctctggctgtggagagcgggggctcctctctagttgagatgtgtgggcctctcattgtgggggcttctcttgttgcagggcacagctccagggcgcagggctcaggagttggcacacatgtttagctgccctgcagcatgtggaatcctcccggaccagggatcaaacctgcgtcccctgcactggcaagcgttcttatcctctgtaccgccagggacgtccccagagggaatggatcctattttccccctccagtcctcctcccctcctggctgggccaagtt

SEQ ID NO: 63264 - DNA, 1024 bp, Bovine  19866881773543
ggaaggactgatgttgaagctgacgttccgatagtttagcccctgatgtgaagagctgactcactggaaaagccactgatgctgggaaagattgagggcaggagcagaagggggcaacagaggatgagatggttggatggcatcaccaactcaatggacgtgagtttgagcaaactccaggagagagtgaaaggcggggaagactggcatgctcagtccatggggccgcaaagagttcatggggacacaacatagcaactaaacaacagcaaccactgcatccatggatttaggaccacccgggcagccaccccaaaacactgggtgagcccaagcttttctgccagcatggtagtggtattgatggcaacggtgatggtgatcatggaaaacatagcaacaaaggatgtgaaccacagtataactctaataaaggaaatcaagttatgacttcagagaatagttcatcttaaagaagcaatagttaccccaggaagtcagtgatggctcacagcacagaccacaaatagattgtaaaatgtaataaatgatctacttgtgcaatgctggtctgtgacatcataaattggtacagtccttttcaagagctatttagcaacacatcttaagaggcataaaaatgtgcatggactttgtgagaatctcactttagggacctatttaaaggcaaacactgtgctctcttccctctgcccattgttccctttgatgctttttctgctttggtccacagtggcagcttcagcttcaccccaaagctgccaggtctggaatagacatctctacctttgccctcaggtccagttccaaattgatgactgactgagcagtttccatatggagggattttttcacaagaccaattttttccaaaacgagtccctgacagcccgcttcctccttgctctgaccaggctgcaacctcagcacccggttggccacctcccctgcagaacctttgaatccgtcagcaacaaggcctcctgccccacagccctgcctc

SEQ ID NO: 63265 - DNA, 1377 bp, Bovine  19866880440246
ggggcgagaaggacccaaagagtggcttcgacattaaagtgccgcggcgcgctgtaggaccctccagcacccaggttctcgttccttgctctactgagtggggtgacccgtgagctggggaggtggtgggaggctgggagtgaaacgacctcaccatggccaagtacagtctgggtctttttttgctcctttattgcttgtccaagcgaatctagggtatagacaccccatgattcccaggtttggtcatttgcatgcagaacttaatttgactgcatcaactcctattcccaaaatgtgggtgaaagtctatgtgtccatatttacactgtgtttcctggtgtttaaatgtgtggttataatttttatgtagggtctaaaaaatgattattcctaaagataaaatttttggaaatttgaaaacatagctttgctatatccctggtcttcagctttcactgctggtctttctcctggcacactcagctccctcctgccccttcaagcagctttcctctgatcctcacatctgatttaattgccctctgctttttcccctcctgtctggaactttgttctcgtcagctctgtgctgtgggctttttgaatctcttctgtcagcctttcagagaattgccagcagagcgtgttgctggctctgtataaaatcttggggtacttgggcggagggtgagggtgccgtccggggcctgtccctcccgtctgccagcgtgcacatcccctgctcatccgcgtgcccccgtgactaacgctctcctgtctgtccgtgtttagctgtacctggtgcgcaccatggtggagtccttgagctctgccgagctgctcaggcagctcaagtctgtgggcgcggaaagactcttgcatgtggttaacgcgtttctgaggcagtcctacgtctatccgccccttttaacctttggtggtaagacatcatttgtttttcttgttgacgtttatgacatgagggtctgctctgagttctttgtcccaagcagcaacgacttggccgtgtggattggtgctgcccttgcaaggagccagcgcagtgtcagtgggcagcccttctcgtggtttatctgtgtttgttgtaactaatgtgccatgtatattttctcccctacaaatgtttccttggataatgcagctttacatggtgagaaccatgctagagtccctcattgcagacaaaagtggttccaagaaaaccttgagaagtagccttgaggggcccaccatattggacatagaaaagtttcatcgagagtcattcttctacacccacttgataaatttcagtggtaagacctactgctgaccagtgtctgctccagcatattctaacaccactaacaatgt

SEQ ID NO: 63266 - DNA, 1532 bp, Bovine  19866880498048
ctaaaactcaaatatgtttagtagttaatttcaatattgcaaaatgttataaaattacattaccatggtttatataaatcttaattacaacaagcacaaacaacttacatgtgtcaaatgagttactataatattgttcctcatagttacttttccatcaatcaactggaatataaagagcttttttacccctgaaagtaacctgaaatgaaataaaaagatgaatataagtctaaaaaatattcactacagtaatgtctaggaaatttaaataaagattctgaagagaaaggtgagggagggcaaagaggtaagataattagaaaataaaagacatcagtctttttacctgattattttaagactcaatatattccaatttcatctttaaaaaagtccaaaacagtgttgttaaagcatttcctcacgtaggtgatggtcaaaacacaacttcccacttttgagaaccagaatctggaaatctcagcaggtaacagcactagattaggtgtctaaggacctgttttgggttcaaatctaatggcctatttttaatatacatgtgaataccctcaaacacctttctttaaaaaaccaaaattctgcttctcattaataaagcctttagactatgaaattaggttaatggatcttaccatagggtttcccgaataacctgtgtttcagtaacaaaaactctgtcatctggaacatataacgggtcactgctgtacaaatgttggtccctattagataacaaacatcaaatgccaatgaaaagatgtctcattaagtaaagttagaagtctcaaagaatataagtaatttactagcaatttaacaagtattcaataagttaataaacataacacatgctttaattttcctcccatattcattttcacaagtcaacggaaatactctcagagaagcactttcagagtatttgttatgtttattgctgacttaagcaatatttaaaattatgtcttgttgttttgggaaaaattgttaaactatttttacagtaagttcatgaaaacagaaatcaaacaaatggcctaatatataccaatccatccactctgaaaataaacaaatcaaagacagaccatagttaaataataacctcattatgaaattaaattaaataattaaagtaattaattaaaagctaaatttatcaattcaactgaaattgacaaaaatttcaagaaaatctgagatctgttttcccttctcacttggctgccttgggaataaacccttttctgctgcaaccttggtgtttcagaatttggcttgctgctcaataagtgaatagacctagtaagtcgaggaaatgaccacagggtaagtggcaagtgtaaagtgttataaagaataagtgattcaggagagtggccaagatggcagagtaggaccttaagctaataatatcctctcataagcacatcaaaatgacacctactgcagaagaaaacctgatgaaaaacactggaacataccagtataaaataaatattaagtaa

SEQ ID NO: 63267 - DNA, 937 bp, Bovine  19866880789705
ctcagcctcccgcatttatacccttggcccagaaaagtactgtgttaaaaatgtgttaaaggaaacagattccattcatagcttagaacatagtgttgtgttatgaagtaagtccaggttttatgatatttcaaaaaatgtgatttgttcagtgtaaaacccagatttttctttgttgttttcaaaactaaaatgttatgaaatagaagtaaatcatagtttttcaatttgcatttaataaatgaagattattatctttagtatatgttaaagataattagtattttcattaaaaatagaaaatgtctaatactttttgagacattggttaaagcttcttcagccattgtcatttaaatctatcttgttaacctatttttattcttcccacagtggaatctctagcactatcactcatggctggcatggaacaaagttaaatatcttcagtgtagtaaatacctcagatttaatcttcatacatatacatttccaccatatggagctaagaaatgggactcttattctggtttatttttaaactgttgtctactgtctaaacaagtgggttttatgtgtattctcttgggattattggttggtatatagagttatatgtataaaactttatcaatgcaaagtgaatacagtctgtttacacttatatttcctactgtaagcaatagctttatggtattggtacctttaaatgtaaaatatatcatttttgaaaatgtaattaagatttaaaataaagcactttattcccccttttgcttagtcacagaagttttttatagttttacatactattttccctaaaggttgtcatagatttggcagttgaaaaatgtatttttatatgcttggaaagttccaggatagaaaacaatttcaaccaatgtcaataaatgtaaagccagctgggtacaagaat

SEQ ID NO: 63268 - DNA, 3016 bp, Bovine  19866881070512
ttaacgggaccattcaaaagatgctgtcattctgaagatctacgcttgcatgcagagccgactcttggtgatgaatggaacacctgaacttatttcacatgaacaatgagttcatgtgagatctagctgggagatctagctgcacccccactgctgacccaagctcagatctgtttcgtgcggcatctcaagttgacttcattttaaagacacagcagtggttgcatgattttagatgtgtattagggttcagggtaggctgctcccaaatatgccactgtggcatactgatttattctgaattagttacttaaacagctgcagcaagtacattctgacctcctctgtgcccctgaaagcaggaaagaaacctcccacatgaaaggtaacctccctgtaccaggaggtcaggaggcgtcctcatcaccagaggctgtgtgaacaaccttcctacctcctcactcactgaccatgccaacgcaaacttcttatcaattcttcacaggctactttttctttgtttaaaaggttacttctttgggtgtcatatcttgggaccccccgccatatttattaaattaaatttgttttgctcttattaatttctgctttcttaaaggcagttctcaggcaagaacctagaagagcacaggagaaatcactttgctttctctacaaatgaaaccacagcctattcagatgcaaagtaaatctcttctaattcacttgtatagctaagtttcattgtctaacaaaggaaacagaagtcagcatctcattccagccaacttgttttaacagtctagggcacagactttccctagagagttggttacaggacagctgctctgatctacctgccaccaacatacgcagtcttacagacacactgctgtgacatgcccacctagaccagacgcgcaggctcaaggcagcacatcatcctctagggtgatgggagcccagagctccctccacacataggactacaagaatgctttgtggggctcgtgatctgtctcaggcccagaatggcccttgtgggtgccgcaccccccacacaaaggcgcccgggaacccaggtgcgctcacctcttgtaggctgagtggtcattcttcacactgcacttcatgttcttcagctcgtccagcacagcaaacatgttgatgaacttgcccagggtgatcaggtaggcttcggacacgaagtccttccttctctccgcatggcacaggcgcctcacctccccacaaaaacgctcaatggcatttctctgtacagaggaagcagggacaaatacactgctttcagggacgggccaaccccagactcagctccaagcacagagtccagactcacattactcgctgaggaaatgcccaaccaacaggtgcatatttacagctcaggtaaagagacattttctagaaagtgatttccacatgtctttgctctataacaatcatcatcgattttgcactttaccaactatgtccccaaagtaaaagaattttgttgactattccggcaaagttactgagcaaaatgctgcaaaagaacatctgtaaagcagattgctttagctttcagagttgaaaaagggagtgggaggatttccacatgacaattttttaagataaaacaaaactcatcatctaaggagttttatcttctctgtttgctaaaggaatctataataaaaaactcacacacatttaagtatgtctttaaaaatccaggaaggcccctcccgtagccaccctgcctaacccaagggccagaaggagtcaagaccagggtgaggcccaccagagcagacaatgggatgaaaacacgtgaaaaccagatgaatcgaaagtacaagcatactgatagaaagcagtcttcatgcaggaaatacaaagtcactctcaagggaaggagagaagtgaaacataaaagcagcatttattctgaagcagccagtcaagcttcagcctgtcaaaggtttagttccctttggcctcaaagctgttgtgaccgtctgaatttacatgcagtttgtttagtcaggacatggtgccagcgccccactctctgcactaaacccctgggattatttcaccgttttacctggaagtacataaaattcatcagtttcgtgacctcaggctcaaggacctccacggttttctcataaatttcaactctgttaggctgttcattacatttcacctggaagtaaacaagcacgaccgagagaggcttcaacccacagaatgtgaggagttgctggaggagggcagaccagaggtggggtgtggtgtgactgggcaggaaagcctggaagggatgaggcctagtctgtctggagtggggtgtgcccagtaggggtggggtggagtctggctgggaccggcacctgtgggatggcccgagagcagcttctccaggtgtacagcatgacagcatattcttggccttcctccagcatctcattctgcaagggtataccgggcaaatcaaaggcaagcagaacagtcaccaagtgctaacatatacagccataaaccagagggagaggcggggaagctgactacagtctgaaatatttttaagatgcgttaaaatgttcacaaggtttgatctaataacttcacttgtacaaatctagccggggagaataattatatatttaggaagatattcatcatagaacttattataagaaagcaaggcaaactaagtaaacatgcttcatctggtttaatgtaatgacataccaaaatgttcattaaattattaatatacatagttataacagcaatgcaattcacttctgcgatctaaatcccatatgggtgtgtggctggtatgcttgaccacaagtataaacaagggagagtgggcttgctgatgctgacaaaggttttctctgggccacagaagccagattttcagaaagagcatgcactgttcttagtaatagaataataccaaaaaaaaaaaagacatttgccattcagatgtgtcaac

SEQ ID NO: 63269 - DNA, 975 bp, Bovine  19866881488696
accacgtgacactgcagccagcagccacgccggctacccagcaggccactctgtgcattcaacacagtagtgaaatggtagatgggtggagggaggctaactggaccctcatgtgctccagcaccccagaatggaagcatgcaaagtgtcgagtcagccagcacatcccaacatcaacagacgtaaaagcatggaggtggtgtagatccagcaactgcaccacagatttgaccctgggccccacgggagtgccctcgacaggaaccctgacctgcatgtgttctgcacatggaagccatgaccacagaaccaagggctggccctgggctgcactgtttagaggagatcacgagggcctgcatatcctggacacggggaaagatgggcccagagaccatcctttcttgatgcccaatgacagggggcacccagagctgtctgtgaggcgacatgcttaccggttggtggagccattgtagcagtagttgggcaggaagtcatagttgagctcccagaagacatggagggtgattctcccgtagggtgcagacacattgtggttggcctcccggaacatggcatcaaagctgtccagagtgaggtacttgctcagcagcttgtgtgtcatgcggttgatttctaagaggccatccagctcctacgggaccataaagtcaggcacatgagaagagtcaggtgtggcatggtggcctccaccctccacacgggcagggccgtggtgggggctggaggcggaatggggcggacaggacacagacaggaaggcgctgcaccgaggtggggtcagcgtacgaggcaaagacccacgtggtgggggtctgtggggacccggcgtgaggacctccacccgtggcaaaggtcatgaggaaggaggctcaacatatgcaaaggcaggatcgagcctcaggagtccccctggaaattctcgagcatctacccccaaaaaaccagagt

SEQ ID NO: 63270 - DNA, 875 bp, Bovine  19866880440970
tcaggagaatgtaccgaataaatgaaggagaggatgaggatgcgctgacagaagtgacaccgggcaaaagcatctcattaaaaacctctcagatatactttatgacattgaaagcacaaaggacaaaatgttggaggctgacgcatatttagaaaggaatatgacaatttgccaaggtacagaagatgcttgctccatattgcacattacacagaagtctagcacagtttaaactacttctgatgtttttcacaaagaaataaaaacactttaattctcaatatttctaatgtttaaattatattctactaaagaaatattagttttacaatgttttcattttcctccttataactggcagtaagagggttttcaatgttttgacaaacatttttagcgtatggaacaatgttcatcttcctattgattactaactttgcatgatttcagtttactcagtcatgtttagggtcctgcataaccattcagagtgagcactgtctgcagtctttaaagcagggttacaaactcaaatgacttctagagccaggaaggtcaggaaaatgagggaagcaggaaggtaatagataaattccccagcctttgtgggaaatggtggagactgtgccctagagagctttatcctgtctaagaaaggcagcctctactcaactctatggagagctgagccaggagaaatgctggccagggttgccagatctgattcctcaacagctgcctgaaatctggatgtgaaacctcacaaattttcaacaaacacggtgtttcaaaagttaaatgttctgtgaaccaaagaaatgaaatggatattaggtgacagcctttatttttaaaagcctgcaatagagccaggt

SEQ ID NO: 63271 - DNA, 2300 bp, Bovine  19866880374239
aaaatctagaaggaaatacaacaggagggcaaaagtgtttattgcagagtggaatgattatggtactttctattatttctttaccttttaatgatgaatgtgttgtttttaattggcaatttaaatgaatgaactaaatcaatatttatgaagataaatctctaaaacacaatgtcgaagataacacacaaagcatatattaataaaaataaagttcattttaattttaaaaaggatctctgtgttgatgagaaagaaactgttgatgagagaaggcaaagacacatgaaataatcagcaaacaatgaaatattcagctctgatatagatggtaagtacaataagagttatgagaagagagaaatgtctagggttggagcagattaagatgacttcgtggaaaaagtgagatttagccagtacttggaatctgaatgtcaaagggagaaacagagggacattaatattaaggtgaggcaagagcctcacatggccatcctagatatatctcacctctacaagccaactggtaacaactatagaacacttgatctttgcctataagagtgtttctgcttctttcatacaagtgggatttacatgccctgtataatataaatatatagtaaatagagtgtcgcatatcctttgtaacatatatttttgaagttacaccagatattttttagaatagccctttgggggaggggtcattttatctggaaaatctgtagaactggactttcccagatatttgcctagaacaaacaccaactgttctgcaagagcagttataacctgtccccttgtaagtgttctgacatccacaatcagaccacaaatgaatccaaccaattggaactcagcaattctctgattacacatgttacagagtgcaatttttaagccagctttccagttcaataactaaactaccactactagtattagctacacatactatctgaaagagtgaatgaattgtctttagcgtctaataacaaactaaaaagttatgcccatctcaaaaatgtctgcaatgggaaagaacaggccagactatgaatgtccatccagtattcctttagtatggaagtactgccagatctagagttgctactgtagagaggaaaaggtgttccagatagggggatggtataacaaaaatatcaaacagaaagaagcaggtcatttttagtgaacaacggggacaatggttttactagtgctgaagtggtctatctaggaagagtgagatgaaaggaagatggagtacgaaagcccttggtgaccaagaagtaggtttaggaaacaattctgtagagggaatgatcaagtccattcttgactgtaccagccatgtccccagctctgagcctttgcaattacccttctctttgtctggaatgtcatgtcccctatctctgactgtccttctcctgtttgttacagttcaaatgtctcctcctctatccccaattcctctggaaaatgttattggctgcaactatgtggtccccaaaacttttcacatcggtactggaactttttgtgcatgtgtctggctcttccacaaggtcatgaattcctcaaagggcagagactgtatcttattcatatatgtgttttctccagcaccttgcatatggcatcttgtacatacagaagttcagcaatgtttgtcaaactaaaagatgagagatactactaagaaatatctggcaacactttgaaaactagattagagtaacagaaaccaactaggggagcgctgtttgtattaatccatgtatgaagtgatgaggaatgagaaaggagggaaagtaaaacacatttggaaaaaactgaaaaagcacagttaacagagtggacaaaggcatgaaggagagaaagagtccaagatgaccccagggtgtctaggctggaagaatgctgagagcagataactgatatcattgctacatcaacggatagatactgagtgcctctcaagttcaaggtactgtgctgagtcacagggaggtcacagggaggagtaagaacctaggaagtatacctaggagtataccctaggaagtaaaatcatgttattttaccaaaagcagtttagattctcttagtattatatttttatcacttaaccccttttattccttgataattcatctaggggattgatgagtgagttaagaaatgactctctccctttgctgcctcacggtcatatttgtatttttctttgagctgcttgggaaaagtcatttgaaaaatatgtcacggaaaaacaaacaaagcaaaca

SEQ ID NO: 63272 - DNA, 1191 bp, Bovine  19866880441622
tttttttagaaggtcctttttaacaattttgcatagcaaaactgggaaaatttcatacagtgaaaccagaataaattagatttctgatgtggatgagatttccttgtgtttccgatgtcgattctggtccctcagtgaagtagattttagttgccccaatcctgagcagtctatattatgctgttgtggttgagttactaagttgtatccgactctttttgaccccatggactgtagcaccccagtctcctctgtcctccactatctcctggagtttgctcaagcctgtattataacagaaactaaatgctctgaggacaagttcagtctagaattttccttaagaccgtgaatataagacatgacatgcactgcggtgttaatggatgcttctggatgaatttctagacaaatcctagatttgtggggatggtgggccatagcctctgtactcttgttctgtactcttactactgggcttcttgtaatatcccagttatagtttttccccttcgctccttaactttctttttttcccttctaatatttccaggagaaaatacaaaatcctcaatttcattgcctctacactaggaggttagtaaaggttttcagtctctcactcttgtgtgtattaagatgtgcaagtagagaaagagagaaaaatactacttttcccaaaacttacaagaaaaattaaggcctaaaccttgggttgcatctaactttgttctttatctttaatatagcagatgcttaataaaatttagctgcagttctctttataattatcagtattatttttagtagtaataggatccaggatttggaagcaggttgtctttataacaaagcaagtgtggggaacatattgccctggacctaccttctcaataggaagtggagattgtatatattagctggagttcacccaagctacttttgggacaaacagatcatgtgttctgaacagaggtcaacagctgtttctcctctgtggcttccagaaatggggacagatgtattcagactgaccttccttattcactgagtgtgggaacggttggaaagggtaggggggagggagataaaacaagagggagggtgggaagattcccatgggggcccagtaatatgagagagcattgaaagcaatgttcaagttaacagttctatttcctggagggtctg

SEQ ID NO: 63273 - DNA, 3295 bp, Bovine  19866880456563
ctgggattctccaggcaagaacactggagtggattgccatttccttctccaatgcatcaaagtgaaaagtgaaagtgaagtcactcagtcgtgtccgactcgtaggaacccatcgactgcagcccaccaggctcctctgtccatgggattttccaggcaagagtactggagtggggtgccgttgccttctccgatggatctgacactaactccaggtaaatagtgtcagaactgagttgaattgtaggacaccctgctgggagttggggggacaagaatcacatatttgggaactccaatggcaaaaagcaaaggacatgaagtcccacagtcgtaggagtcaaactccatctgagtcaccttgtagccatataatcttagaaagtcataatgtcaattcctcatgtgtataatgaggatcaaagtgcctccctcaatagggtgcatatgtcgcacaatgagtgaatctctccactcttaagcccatcaggctcctctctgtccatggaattctccaggcaagaatactggagtgggtaaccattcccttctataggggatcttcccggcccagggatcgaacccaggtctcccacgttgcaggaagattctttaccatctgagccatctggagagcccactctaaagatagaaataagatttaatgaacctccatgtcatgtttattacaagggatgaagaaatatttattggatcaaccaaaagatcattgaatgtttgtttgatctacttctgtggattcactttacttcatagcaacagtgctaccagaatcatttcagaaatcagcatagtactcctcttagccaggcaattctttaacaataacataaaccgatataaactatatgaattatcattgaagagtcttcaagaatcagagttgccaagtcagtcagtgggaaacccttggccatctctaactcatataaagcaagcctaccaagataatatcttctttgatctgaattcctgctagaagcttgtctttcatattagtttctaatttttcccaaacctctgcctcacagaggttcaaatgctcacgtggtggttgtagggaagtaatgaggcctgagattctccctttgagctatggggtatcactccagctatttgtatgaaaatcttattcaaaaaagcagataaaaatgaggtttaaaaacctgtatattaccacaagccaccagaaccaaaacctgaaaaaaaattatactgccactagaagaaattaaaaaacactaaaagaaacaaaaaccaagaaataattgctgtattgatggactaatcccaagtaaagaaatattaagaatgatatatttgcagaaagaatctggggggctttatcaaggatttcatgaaaaatacagtgaaaagtaactttaaacaattatctagggacttccctggcagtctagtggttaagatttaaccttccaaagcagggggtgcaggttcaatccctggtcagagaactaagattctacatggctcccagtcaaaaaaccaaaatagagaacagaaaacaatctagtaataaattcactttaaaaatggtctacatcaaaaaactctaaagagagaaagaaaaacaattacctaaaaatcttttaggggcttctctggtgactcagtggtaaagaacctgcctgccaatgcaggagatgcaggttcaacccctgggtcaagaagattccctggaggaggaagtggcaacccactccagtattcttgcctcatggacagaggagtccatggggtcgctaaagaatcagaaatggcttaatgactaaacaacaacaacagaaatcttttgaccacttggcctgggtgggaggggggtttggaggagaatggatacatatatatgtatggctaagtcccttcactgttcacctgaagctattatagcattgttaatcgcctatactccaataaaaataaaaagtttaaaagaatcttttgaccagtaacagaggcagtcctgtctctccacgtgtaaaagcagtagctagaatgacatttcctgggagctgcctgctagcaggtatgtgctcagcatcatgtactcattatctccctcaatctccacaacaacccaaggtgttgttataaatggagatataaaatatctccattttataggtgaggaaacagaagtttagagaggttaagtaatctacccataatcacacagtaagtagcaaagctgggatttgaactagattcgaacatcatgggaaaggaagacaccatcccaaatagaaaaaccaacagcttgaatctattactgacagggcagtggctaagagcaaggtttgtaaagaggcatgcatcttcctgatggacacatctatgcttcagcaccaacttcataaaaattcagcaagaattctacaggatgtgcagagccttccttcagtgcagcagtacggggttctcatattttctctgtgcttagttgctcagtcatatccgactctttgtgacccccatggactgtagcctaccaggctcctctgtccatggggattctccaggcaagaatagtggagtgggtttccatgccctcctccaggggatcttcccaacccagggagcaaacccaggtctcccacattgcagatggattctttaccatctaacccaccaaggaagcccaaaaggactagggtgacattcaatttatgtgtttgttaaacctaactcaactgactcctccttgacatggaggaataatttcttcatgtatttttcatcactccattctgtttggtgcttcactatttgtgaaaaacagctacatgtcaattggtaaaaatcttttagtatcaaacaggaaacaaacacatagagtaacagtatttttcagctttcatacatctgtttaatcatcatctactcaatcaacagacgttgccggagcacctccatatatgaagtatgctgcacatgtcatgaggaggaaaagagaacttgcacaatcataattagatttcacaatatacatttccatcataatgattcttttctagcaacatgaaaaaaatctgcatggagtatatactgtgctattttcttgtgaactagagaagcttgtggagaaggcaatggcaccccactccagcactcttgcctggaaaatcccatggatggaggagcctggtaggctgcagtccatggggtcgctaagagtcagacacgactgagtgacttcactttcatgcattggagaaggaaatggcaacccactccagtgttctgcctagagaat

SEQ ID NO: 63274 - DNA, 2237 bp, Bovine  19866880624474
tggatgctttaccatttgagccatcagggaagcccaagacatggttgctgcttctgctgctgctgctgctgctaagttgcttcagtcctgtccaactctgtgcgaacccatagatggcagcccaccaggctcccctttccctgggattctccaggcaagaacactggagtgggttgccatttccttctccaatgcatgaaagtgagaagtgaaagtgaagtcacttagttgtgtctgactcttagtgaccccatggactgcagcctaccaggctcctctgtccatgggatttgccaggcaagagtactggagtgggttgccattgccttctcccgagatgtggttgacgtaggtctaaaacaagacatggaagacatgaatctcctttgatgagcaaatttgacacaagaactcgaccaactttctaaactttccttacaactgtactgcagtttaaaggtgtcaacctaaccatctttgctttcttctctcctttgctcagtgtcagatatgctctcttaccctcccctcttttctcattttctctcaagcacatttcccctaataaatgtcttgcatgtttaattttgtcttggtatcttcttcttggaggctctaggccaacacactatttcatagagttgctgtgacacttaaatgatctgatgtacacaaagaaacttgcaattgttagaacatagtataacttctggtcctcctcatattcactggccagacaccaccctttcttagctgtgggcttcctcatagttctttcctccttataatggtagttgtccaatacttatcaatggattttgtatcttctagaacaaagccatctttagaagagtctacagcttcagtatccattcttctatttttcatttttgaagtaaaactttccaccccactgagtttttgcagaacccagggccatccagttgaggactacattttccagtcttccttacaatgggtggtgatgatagagctaagttcataacagtggaattataaacagaaatgatgtatgcattttcaccattaatttcttcagacaaaattgcttgctccctctttttctcttctccccacatagctgcactgaaatgtagttgcatcagtgagataggttcaaccatgtaggtaaggaaaatgccataatagatgtcagaaaaatgagatagaagaaatatgggtctctagatgatcttaagagaaggcaatggcaccccactccagtactgttgcctggaaaatcccatggacagaggagcctggtaggctgcagtccatggggtcactaagagttggacacaactgagcgacttcactttcacttttcactttcatgcattggagaaggaaatggcaacccactccagtgtccttgcctggagaatcccagggatggaggagcctggtgggctgctgtctacggggttgcacagagttggacacgactgaagcgacttagcagcagcagcatgtcttagaccacccacctacctctaacttttgcttcaaaagaaacagattatcttttttgagtcattgtatttttagggattctttgttacagcagctaagccagtaccctgcctaatacaccatctttttgatctattgctacattctctctactttggttgacctaggactggttgatagtgctttttccttaatccattaaagtctaggcctcaatatggcatttaattacatttgatgactttgaaggacagcaaaactagttccctttgggcaaaggattatctcaagtcagagttaatagccttaatggtttaaaatggcactaaatggttctctacatttggccaaggccatctggtcatttgcagataagcataataataagcacccgggcagatctccacatatgggctgaacacagacgtgttccaaattatatacgctataaaatttactatctttcactaaaacccaagccacaaatgatcccttacttgaattgcaataatgagtcaccacttagacaatatgactgaaatgaatctgactacaaacaaagctctaaaaccacagtgtccagattccagtcaaggtcaaaatacaattttaattctggggagatcctttgagcatgcacatcagaaacagccgtgggactctgcccacacatgtccgtggccaatgggttgtttaaatttgagcccgacaacggataaatcatagctttgctctcagaacat

SEQ ID NO: 63275 - DNA, 1507 bp, Bovine  19866880625889
ggtaatgcttacaaagtttctttattgctccaagactcagttttcttgtctgaaaaagagtgatatttaagaatgctgttgaaggggaattccctagtggtccagtggctaagactccatgcttccctttgcagggggcccgtgttcaatccctaatcagggaactagatcccacatgccacaactaaaaatattgcatgctacaatgaagactgaagatcctgcatgctgcaactaagacccaaaacagccaaataaaataaaaaaaataacaataaatatttttaaaaagaatgctgttgcaaatattaaagtaaataatgctcataaagcacatacaacagttgttggcacatcagagcatgcagttagtgttgactagtcttcactataactcagtatccctttgtcactctaagtctatagaaggtttaatgcttggatttattatcattgatttctaagcctctgtctctccctcctctgaaccaccttgcagatgtctgccaagtcaggctttctagaaagtctcttccatcattttacatctctgctcaaaaactttcaagggttccctacatcaggaagatgtctgaactcctcaggctagaaacactgcaggtagcctagctcggatctgcttttccagccttctgctccagctagaatgatggcttttttctttgtatcacccatctgatacatatttttgtttcacttttcatatacaactactaggtaggcaataagcagttggaaactatttgcaagtgttatttttgctctggcagtctggagtaaggatgtttatgtctgaccaaagcaaaagatcctgaaggctatggtctaatcagaggaaagttttgcacagaagctccggtctgagcacaatggatgctgggaaactcagcaacagtaagaggggtgagctaaggccagtagcatggagctatcataatgtttagcctcagatgtgcttaagggatatataccatgtcttaaagctatttttaacaccaagggcttccctggtggctcagatggtaaagagacctgggttctatccctgggttggacagttttcctggaggagggcctggcaacccactccagtatgcttgcctggagaattcccatggacagtggagcctggcgggctgcactccatggggtcacaaagagtcagacgcagagtaagtgactaagtgcagcacacagcaaagctatttttaaataatatccctaatgaagagttcagaaattctccagtgagagctctctagggccctagaggatagaaagccataggttatcctaactgtagatcttatgcattcaagtttctccccataggagcacctatgctaagaagaatttattttgatttatttacacagagcaacaaactaatctctccttctaatcaacaaaaacttccggccctattcacaaaattgacttaaaacttaactgttgtgatggcttgcttccttcatggagccactgg

SEQ ID NO: 63276 - DNA, 2664 bp, Bovine  19866880649822
cttccctggtggctcgatggtaagaatcccgtgcaattcaggagacctgggttcgatccctgagtcaggaagattgcctgaagaagggaatggcaacccgctccagtattattgcctggaaaatcccatggacagaggagcctggcaggctagagtccttggggttgcagctgagcaactaacaacacatgggctctaattctaacaaagggtaccatgataacacttggggactccaagaattgatgttatattagaccctatatccattaaccttcaatatatctggttattcccctttccctcatctgagtaagtggtcataagtcccttgggagaaagactcaggtaactgtcacaatatattcttaccacagtgctgaagggtccttcttcctaggcacctggtcacctcttcagtcaatggattctagatctgaaaattggctcaggtcaaggaattgagaaagggattttgacttttatttgggtgattgtcctcagactcctgattctccactcttgcttcatttttcttgtagtctcatggctttccagagctctgtcatccccatagatgttaataagcccagacctgtgatggcttgtccttgtcctaccataatccctccatacagaggaggcaactactgcattgctgatgtccctctccccagcacattctctatgaccttggtgaatgatttgtccatgcccacttcatcaggctctttgttccttcctttaccatcttcaagggcaactcaagcatttccatttcattagtagtggcctttgctttatccagcctctaggtgagtttgacccatcccctaatttcactatggtgttaaatcccgtatctcaagaaagtactcttaagtcaactaatccataaaactgcacgttaacagattaaagaaaaatagcgatctgagctgttgttgcctgggaaatgtttaataatctttcacaaaatggccaggagaagatggagatccaacttctctggaagttgctgcctgtctcttgaatcatccacagtcccacacctgttttttttgtagatcaatccacttaacctatcagtctctttgaaacttattttgtacatgtaactccttctgcctgggctgccttatcttttcattagcctggtaaatgcctactctttctgtgaattcttttcttctccttcatctccatcccaacagatttaccactctttcttctgccatgaccttatcagcatcttttgttaatttgtaggtctcctcattatattctattccttgaagacagggaccacatcactttcatcttcatgtcatcattttgaacagtaagtgtgcacataataaataaaatgcttgaagattatctcccagaggagatgagaacatgtagcataacttgacattcatattttgttttaatctgccctctttgcatttcttttctttggtcagtcatcacactcatctatccattatcagactacctcccgctatggtggcttctgaaaggcaataagaaaacttttccataagtgccaacagtctgagtttacatgtttggaggttccaggcaggtgtcaaaaatcacaatgaatattccaacagtcagacactgagacttttaaaatatctagatgtggaatgttcaattgaaaaacacgtggaagccaaatcagagctttccattttaatctggacatagccctacttttactaggaacctggaatcagtttcctaataaaggaatctcaggcggctcatatgaatttgcaacttcccaattgccttagagttcatagcacttgttgagcctccaacatgcacaagaatgaggtcctaaatagtttccaggtgtctatggaaagacctattcaatggctttgggctaagaaaagaataataaaatgatattcttaagattcctgcatcacaaactcttcacaagttgctttaaagcaaacttgaagtgaagttataactgtcaatacacacacacacacacacaacccaggacccacacagcaaacatctcagcgatgttctatcattcccagaatagtaatagcttaacagtgagcatggagtgtgggagggaggctccaagaaatctcccaccctacttctcatctacattctcccacagttttcagcgtaagcctcactcacactggtccagaagaaacataaggcttatcatatgcttgactgcaagccataacttaacattagaaatgtacgaggaactgggtgtgctggaaggaaatcaagcaaaagcatctgtaagctgaaaatatgttgaaaacatgttacaacatgataacctaaagtttcagtggctttgctaagccagaaagaaggaaaaaaggaaagaaaacacatttttcacttcttgagttgcctcatttaaggtaaccaaatagttgtccagtagacttcctcaggtctcaggctccaaaaaagttgaatttaaaagatgttgtacctggttcagttcttcctatagcctataaaattcaggagttttgaaacaatgcctaaaaaatgaaagaaagtctttaaaaagtctaatgaggagggaagggaagacagataggctgccctgacacaattccagcttttcctttttcactcatagcccctccttca

SEQ ID NO: 63277 - DNA, 2602 bp, Bovine  19866880686741
ccagtgttcttgcctggagaatcccagggacgggggagcctggtgggctgtcgtctatggggtcgcacagagtagggcacgactgaagtgacttagcagcagcagcaatagcagtgactgaacaacaacagcaagaaggatggtctcagtactccatgcattgatagattgaaagtctcttatttcatctctatcatttctccttcttagggtatgtgaatgccattgaatttcaagagtaaatgtgaaaggtctgtaatgaattgatttgtttctttagtatgttaaaaaaggaaggcaaatgccaaagtttgtgtttctttatattctaaagagtgaacatcaaatacccttagtcaagtaataaaatcaagtgtacttaactactgttttgtgggtttgtgtaaatcagctaacctctctgggcatcaacatcctctttcacaaaataaaggagctagtctatatcactgcactcctttccgactaaggttgattcaattaagcactaccacatacatggtatcaactagatgctctatgcttgaagtgtatttcttttctatgctgctattaatttgctctttagtcttttgttattaatcacagaaaatatgggggagtctttgtttctactgtacatattcttaatctctatggtgaattttagagtcccttgttctagatctgggtggtgtggggactccagaataggggtaagctttcagagaaggatatcttgacttatttatttatttgactgtgctggatcccagttgtggcactgggatcttcagtctttttttgcagcatgcacactctcagttgcagcatatggaatctagttccctgaccagggattgaaatgaggccccctccattgggaaggcagagtcttagccactggaccaccagggaagtcctatcctgccttttacaaattgttgctagaaagacagtagggtaagatagaagttcctctatatcttcgaggaactaggaatactgggtcaaatttgagaaatgaatcttctctagaagatgtccccctcatgactggggacatgacttcatcattttcctttagttcaaaggtgtaagtgaatcatttccaaggacagattactccaaagggcagaaagatatattggtataggagagcggaggtcataaaaactgtgtgagaaaattaaaatatggacaaagagggtctactagaatgggaaatatttttgatttgtcacttgccagacaagaagaatggaggacatgaagtcttcttgcacttatagctaaatcatgaaagatgttcaatatagtacttggaaatagcagaaatttgttaattccatcaggggattgttagacaacttatgggcttcccaggtagctcagatggtaaagaatctgcctgcagtgtgggagacctgggttcaatccctgggttgggacgatcccctggagaagggtggcaaccccctccagtattcttgcctggagaattccatggacagaggagtctggcaggctacagtccacaggttgcaaagagttggacatgactgagcaactaacactcacagacaacttatgaggtgattatagaatgaaatattatttatcagtttcaaataatgtttataaagaatgcttacaggtcatggaaaaaatgctcaggatataaccgataatagtatagatctgttgaaaactataaataaaaccagatattaaatatgtaaaaatcttaataaaaaaggaccagaatgttaacagtgtttatatcagagtggtaagatcatagatgaattttgttttagtgattcttttgacatttaaaaaagtaaaagtatctttttctaaattttctatatgaaatatgtcctctttttatcgttgttgttgttaagtcactcagtcgtgtctgactctttgtgaccctatggactgcagcatgccaggcttccctatccttcaccatctcccggagcttgctcaaactcgtgtccattgagtcagtgatgccatccaaccatctcatcctccggcatccccttctcctcctgccttcaatcttttccagcatcagggtcttttccaatgaatcagcacttcgcatcatgtggccaaattattggagcttcaacttcagcatcagtccttccaatgaatattcaggattaatttcctttaggatcgattggtttgatcacttatagttagaataaaaatcaatatacaaaacattattattattttttaagacatatacataaacttcaaactaagttaatcacataaagcttagatttttcaagaaaccagaaaaaagttactggaaggtttttgaacaagctgtggagtacaagatcctgagacccaggctcccaaagaggatagtggggctggccatgacaggggaaggcccctaaacacagaagactttctcagaaggtaaggcctgcagaggcgtgactccaagcagcctcctttcatgcctgtcacttaacctctaatttccttgaggaacatacagaccacgagacaccaagaggcttttgtcacctcactgccccctaaagacacaggatactttcgactc

SEQ ID NO: 63278 - DNA, 1578 bp, Bovine  19866880732527
cagcatcagggtcttttcaagtgagtcagttcttcatatcaggtggccaaagtactggagtttcagcttcaccatcagtccttccaatgaatattcaggactgatttcctttaggatggactggttggatctctttgcagtgcaagggactctcaagagtcttctcccaacaccacagttcaaaagcatcaatttttggcactcagctttctttatatagtccaactctcatatccatacatgactattggaaaaaccatagctttgactagacagacctttgttggcaaagtaatgtctctgctttttaatatgtcgtctaggttggtcataacttttcttccaaggagcaaagcgtcttttaatttcatagctgcagtcaccatctgcagtgattttggagccccccaaaataaagtctgtcactgtttccccatctatttgccatgaagtgatgggaccagatgccatgatcttagttttctgaatgttgagttttaagccaactttttcactctcttctttcactttcatcaagaggctctgaagtatattgttcttcaaatacaagtctttaaaaagaggaaggacatctacctatgacctacaaattccaatcctttatccaagagaaatgaaatatttgtttacaaacagacttcaaacaaaaatattcatggtagttttcttcatagtagacccaaactggaaacagcccaggtgcccatcaacaggaacaggataaacaatctatggtacattcaatatttgtacagttgaatatattatgccagaataaaaaacaacgtggatagatgtaaaaacatcatgttgagggcaagaaatcagagacaaaggagcacatacatatgattcaactaatataagattctagaacaggcaaaataaacatgtgatgaagcaattgtggctgcagttgcagtagagaaaggaaagggcaccgtcacagaaatgaaaacatgctcactgtgaacgaggaaaaattacgtcatttaacactactgaattactaaattaaattttaagtgcgtacatttaattcaccttaactaattcctgaaagcataatgtaaagtccaaacttaagcttccaaaataagccaataatttcaattgtggtaaagaataaattttattaaggtctcattttgtcaaaatttgtctcatttcttccacaaacatttctttctaattagtaagaaaatcagaatgtcttgtcccaagtggttatttttaagattggtttcatacactatgaagtggaacttaatataaaaggctcattattatcaacaataattcaataagagtgtacagtgatttccaaaatggaggtgattataacccaggaagtatgactgatgatccattagggtataaaaaatattaggagttccatttatatttaatcttttcttaatacacacatgtattttaagtacaatatcatgtaatacaatatatgtatatccttaacatacaaaatgacactggcctcttcattatggccacctgtcagaaagtcacacatcacatatgttaagtaatctaagtatt

SEQ ID NO: 63279 - DNA, 815 bp, Bovine  19866880733185
ccaggggggaagtccctcagtataattcttattggtgtcttttggacacagtctatccccatcttatgaaaagctctcctcttttagaatcgtctcatctgtctacccttacattttagatttcaagcacagcacccgtttttcacagccctgacacccctctacagagcatgatttccatgagaccatcatagagtgactgatactctttcagtgacaagaaaaggtttgcctttaaaagaagaggaaaagtcagaagtcatcaaaacaatgtaatatcctgtgtgaaatgtttgaggtttgagtcccttgatcatgtgccctgagacaagtaagttggcggtggtggccgcggatgacgagtcgagtcactcaagtgtgtcttcggttcccctcacacttgggcttctcagggaggaggggctggagccgtggcccaccgtcagcaccatgatcctcaggctgctcctggctctcaacttcttcccctcaattcaagtagcaggtaaacagttttgatttctttcttcctccagcgttttcttttgaggctttcggttcattttatttcatttatttttcaggaaaaaatgttttaaaatcatgcactctctatttggtatatttcaaaaggtgcaatacttttcttcatttatcagtaaatggttcattttaaatttcgaagaactcaggacatttgggcatttgaagtgtagtttttgctatgaaatggcaacctgttattgaagaaactcattgattctcagactagagccagcaaaatacttaaataagcattcttggaagaaatcaga

SEQ ID NO: 63280 - DNA, 830 bp, Bovine  19866880740036
tatggaatccattaactcctcatttctgcttgttcttagcaaatttttgtctggtgacaacacatgaacttagggggtgtttttgttttgcttcacaccacgggactctgacttgctttagttttgaggaaaattggggaaaaaaagcaagctgtggttggggtgaaatagctaattgcaagtaaaactgggtgggatgtttggtttgtgagaaagcaggacactcttcagatttcagggggattccagagttgccagtgttctgggaagaatattccttcaatttcctgatgaaattgaataagaaatctggattctcttgctctctccaaccacacctcatggtataatgctggttgaatggattgcttgcccttactttctaaatttttgttttctaaatataggagaaaacagcaatgtgcctttgcaagacagctacatatctccagcttaaaaggcgttacataattatatcacaccagtatttagaactaaagttactggtgtatgactggaaaaaaaaaaaaagaccgaagattggaaaatgttaaagaaggaagacaggctgagaactttatttagaagataattatcttttattttttctgtttaaagtaattaataaactaaacataacaataagccctttcacccacagtcagcatcaggggacttcaaacattgcctttgaagtgggcccccagttgggaagaccccactgttcaggctactttatagtggtaatatactgcctggaaaaaacagatgccaagaaaatgcacagatgaatctcggagcatctaaaacctaaaacttcagggggccaa

SEQ ID NO: 63281 - DNA, 1358 bp, Bovine  19866880762833
gttacctatattaacttttgagtaaccttaacaccccatttctcacccatttttcacttagagaaagttaataaacctagaatttttattttgctcagcagtcaccatgtattaaaaaattgaggctaaagagaggaagcaacttatgaaacaagctgttgttgtttattcgctaaagtcatgtctgattctttttcaaccgtgtggactgtagcctgcctatgggatttcccaggcaagaatagtggagtggattgacatttctttctccaggggatcttcccaacccagggatcaaacctgcatctcctgtgttggtaagtgtattctttaccacggagccacctgagaagcccatgaagcaagccagtgacaaatagaacttaggatggagtccaaactatccgtgctttcttctccccttctgtctctcctcccatccccatctctctctccctctttatctttcttaagtctttatactccttttttaaacaaatgattttctgcccctccagaaaacaagattttggtgaagcagtcgcccatgcttgtggtaaacgacaatgaggtcaacctcagctgcaagtacacgtacaacctcttctcaaaggagttccgggcatccctttataagggagcagatagcgctgtggaggtctgtgctgtgaatggaaaccactcccatccacttcagtcaacaaataaggaattcaactgcaccgtgaaagtaggcaatgaaacggtgactttctacctccaggatctgtatgtcaaccaaacagatatttatttctgcaaacttgaggttctttatcctcctccttacatagacaatgagaagagtaatgggaccattatccatgtgaaaggtaatgtaccacttggccaatgtctgctctcaagtaacggttttcaactacagtcttgaaaactaggtcatgatcagtggtgggggttggctaactcccaaagaggaaaaccagagaggaggtctacacatgttaagctagtgatattttgcgtattttgtttcctctcacattctgccctgggaagaaggaaggaaatgtactcaaatgccattcccatatcatttaatgtactctattctatttttcagagaaacatctttgtccatctccccggtctcctgagtcttctaagccattttgggccttggtggtggtaaacggagtcctagttttctatagcttgctagtaacagtggctctttctaactgctgggtaagagaagcaacattgctttcatgtaacttttctattgcataagcaattggacatattcaagaattttgcctatgtggcttattttccatttaacatgtgattatttt

SEQ ID NO: 63282 - DNA, 1297 bp, Bovine  19866880795306
gactgaggttaagatatctttccactagcctagcggaatgaagcttgcagtcagaaatcaaaatctgaaactgagttactaaaatgaagacaatgaactgaaaatatcattatccctttcctaaaattcataactgctctccatccataggatgctgtattgcattgccttgtgtgatcaactctggtaggaatcaacacttcagaatactagggaatccaagatactattcattaagtatttcttgctagctaagcatccttgaagtacctggatcagatcagatcagtcgctcagtcgtgtccgactctttgcgaccccatgaatcgcagcatgccaggcctccctatccatcaccaactcccggagttcactcagactcacgtccatcgagtcagtgatcccacaacacatatatagcagtctccgtgaatactgtttgctggctgactggttgtctgagcaacccacatatttaatgaaacactgaaatgactcccttcctttatcttagcatgccagtttgatacagacagaaagctatttgaattggtaaaatgtcagcagagactgggcccttaataatagcttttaccagattcatttcctcagattattccaaagctttagcctgcaagaattccatccttttcaccagggagctgaccttggaaggcagacagctgctgtaagtgtttttacaagaactgtaaaggcgttaacagtattgaagctccgggagcattgtgaaatttgggatgctatgttctgaagtgtgacattcacctttggcagctgtgctgtaaccagacatagccaggtgttaactgaaattgaaaatagccttttcaacagtcctaggtcctcattatttttaacatcatagttcatgttgctaaaaatattcctaaatctctccctatggataatttggaaggggaggtattatattaagaaatagatggataataacccctccctactggaagttcagaataaacgccagtgaaggcatcaagatccctctgaggggtggccatgttggattctgtccgttgctgcagaggctaagacacacttcaaacaacagtttctgcatctcttctcatctgagagtgacaggatttcacatttcactttaacagtcactgttcaaaagtactaacttaccacccacgaatcctgttttgttgctttcttttccttaaaaagattttttttttttttaagtggggcttagtatttaagtatttaagcaaggaaacagggaagaggtatgatttttaaaaccccatcg

SEQ ID NO: 63283 - DNA, 1021 bp, Bovine  19866880797106
aaacaaagcatttgcttggggaaaaaaaaaatcacacgcacacattaatttgtaacacgaaattctacttcatggcatttatgaaggcaaatcatgccttcaagtaagcaggcttacctgcctcgctggcggaggggctcatgctgctatgctctttccctcccactgcactcgccaggcacacattgattcattttaaagatgaaatttttggtgcaacggaaaaaaaaaaaaaagatgggaaggattcggtttcagcaggaaggtacaaaggtcatcgagagggtgcagagccccatagagcagttgttcctgtctgagtgatgactctactaccaaggggatttattaaaatggagcctattgctgttacaccgaataaggctctccataaattctgcgtgagcctgtcagtggctaagcccatatgtaacgcgtcaatacagcgcctgcgtctgcctgctggtgtctccaacaacccagcctgtggccgcctctccaagccccgaagcatgtgtatacacgccccaacccaatcaaaaacccagggcctgagatgctgtgcgtgctcagaaacggacacctcccattctcacggaggatgtgcgtgtgtatgtgtgtttccagcaagacattgtgttttttagactgtgacggaatcaaacatgacgcaaccacacgttctgggtcttgacgacctgatggggggatgggaaggggatgaaaagagtatggccacagcaatttcaggccatgcagcactgtgacctcctcactctgtccgcttacaaaacagaagaggggagatacgtgccaggcagtgttcaaggtacagagaactgtcagtgtcattagttataatcaaagggcaggggccagagggtgaatgccttctggtctgcctccttaagtcacctgaggagagaacacaaacctggggagagactctgcttccctgagacctttttttagttgttgtttaaacccagtcagttggaagcctctttatgagttctctcgt

SEQ ID NO: 63284 - DNA, 1485 bp, Bovine  19866880858609
cacacagagtcggacatgactgaatcgacttagcagcagcagactccttatcaacctgcttaggaaatgactctctcactatgaccaacctagatagcatattaaaaagcagagacattactttgccaacaaaggtccatataatcaaagctatggttttcctagtagtcatgtatggatatgagagttgaaccgtaaagaaaactgagcactgaagaattgatgcttttgaactgtggtattggagaagactcttgagagtcctttgaatttcaaggggatcaaaccagtcaatcctaaagcaaatcagtcctgaatattcattggaaggactgatgctgaagctgaagctccaatacttgggccatctgatgagaactgactcattggaagactctgatgctgggcaagattgaaggcaggaggagaagaggatgacagaggatgagatggctggatggcatcacgaactcaatagacatgagtttgagcaagctctcggagttggttcatggacggggacgccctggcatgctgcagtccatggggtcacaaagaactggacacaactgaacaactgaactgaagtgatagagtggggtgattcagttgagtcattcattggagtttgagtcgttgagtatgtgctgggtgctgtgtgctgagctcagactacatgggattacaaagctgaataagacatagcttggctccaagaaacttagaccatcatgagtacatccatgtttatctaatgcagaaatggaaataatatggcagactttaaaattaaagccaatattttcttttggagtataattgttttaaaatgttgtgttagtctctggtatacaataaattgaatcagctatatggatacatgtatctcctcactcttggacctccctcctacccctgtatcccaaacatctaggtcaatcatgattcaaaaggacacacatatcccaatgttcattgcagcacaattaacagtagttaatggaagcaacctaaatgtccaatggtagatgaatggataaagaagatgtggtacatatgtacaattactcaaccataaacaggaatgaaattgggtcattggtagagatgtggatagacctagagtctgtcatacagcatgtcataagtcagaaagagaaaagccagcgtttttgttgttgtaaaatggttttatgtttagaatcaattttactattaggtatattttaaaatcaagtcccttgaaacatctccctgttgtgaaagttggtttggtctgggctgctggagaaaagggctctgcagattcagggtgcagaaactgttggcataccacctgactctgactcacctccaattaggcaattagtcccacattatttgagtacccaatttacttttacattttaaagttgtaaaatgcataatgatttttttcacttcctaattatgagtaataaaaatttaagggaatataaagtttaa

SEQ ID NO: 63285 - DNA, 2737 bp, Bovine  19866880882474
aagagaataatgccggaatggtttccttctttgatattactattactatttgtgttgtgttgtgtgcacaggaatgccatttagtgaattaattcagccattctgtcaatgctgtcatgacaaagagcaattgctagcattcaactttgtcctacaaacacgtccctcacccagcagaatgtgttccacccaataattgtgttgtaactataaaaggtgatgttgagctacagtgtctagaatattctgttagacgtccatatctacctgaatgtctcacagtcacatcaaatgctgcatatcttgtcatttttctatttctgttgcagtgagctgtggctcattcatcccagtacctcttgtgcccagcacattgctccatgcatgtttatggagtgaatgaatacctatttggataatataaaaaactctttgatatgtataagtatttaccttggtaatattaacagtattattgtcatgtgcagactggtagatcaagatggtcaaaagttactttcctggactgtttctcccaactcttgaatatatttctatgtgcaattgtttgagtgtattctgtcaatgcatagtaaacatgtattcctgtatttctcttacagcttcctaccctatgagaagaaatgtattttcttgatagaacagataaaattctcctactggtgttgtgttgtgttgtgtaaacacaataagcatcagtgcctgatacatgtttttctgctgaatggtatattttgaaatgtatttttaaaaatacatgtataaatatttataaatatatactttctgaagcctagtttttaggtatatatttatacatttattaatataacttaccttattttagaaagtgtataaggtcattggacaagatacatgtgtatattataatgttcaattcaattaagaataaatacttgagaaaatcagggtaatagaaaaataagggcagtcataaaaaaggatatccttcaaagaatttaggatacaaaaatatatcatgagttcctaacttacatgctctaagctctttaaatcagaaagataaatctaggtctcagctatggctcaggtattcttggtactatagcctgaaaaaaaaaattgtcacataggtccttattgagaggacactgggtaatgcagttgataaccttaaacaatgatctcataggaaatacagtgagttccacagtatttctggtaatgtccctcagtgtaggctgctgatattgaagtcaacgtacaagcaattttatagagaaacagtgtgatgaggtcctggaatacagctctctgccatctaactgagtttcaagatatattttcagagggtcagggtcatgggtggacatccataaattgtttctttcaattaagccctgggtaactattggaactatatatgtgagttcatgatgatacagttattgataggggaatgccccaggagccatggatttctgaggtctcaggaaatgtcatagagactaatgacagaggttctaggaaacccactggctcttggagatcctccagcattgagtaaaagccaagactcaaatatagctctaacttgtttatgtaaaaaaaaaaaatcactatagtttccacttaaaaacttttaaactttttaaaaaattgtttagggacatgcatatgtcctaagaatatgtcctgaaaatgaaagggtagtaataaaaaaaaatctaaaaatggaaaacctgctttttaataaatgataacttcttctcattaattccaagatcaaagtttcttacctgaaaggtgacttcagcatctgtagattcagaatagaaccccaaagagtcataaacagttaatctcatctctgaagcaatgtcccagaagaaaatgtgttctatcttcagtaaaaatatagatttagaatatacttacagggcaggttacatgcataagtaagagagaaaagaattctggaacaggtactagtggtgtttggatggctacaaaaagcattcagccaccatgacctgtccattgtgtaagtggttggctggggaagcagagagagcggatggacagggttcatgtcatttgtattggccttgctgagtagacacaaagctcttccttagtacttggggttttaaaaaccatcagatggcaccacagcaggctaatgtggtggcatgttctggagacattcatttgtccccccaccttttaaatagtgggaaaaagtgaattttagtaattaataggcacttacccttctttcgtcatactgtcagcttcggttggtttctgtcttgccattaacatgtctaatgcatatgtcaagtggaaggctgacatgctagtggcaaacagaatattatgtgaaggcggcaatgtgttaaaacaattgagcgaacaagcactaaagtttgctgctcaggccatatgttgcagtgtttaatttcccgtagtggagaaacatggttgtcagagaaaaagatgatgaatacatttactttgggcaacttattacaatgaagaatgactttccagaggaagagaacagaagaattaggcttgcatggagagcatatgggaggcattcagacgtaggcaagggtaacaggactgcgtgctttcaaatgaaagacatttaatcaatgcctgtggctggtgttgacatatggaagtgagaaatgggttttgattggaagacaggaagaaggttaacggt

SEQ ID NO: 63286 - DNA, 2109 bp, Bovine  19866880959635
acatgtcatgttagtaaaggaattgtgtcagttaaggttttcttatgcttcctgagtcactcttttttaattttactctaaagatcttttataatgtcattaaaatcatgaagaatcaggttcagctttgaccttcataggataaatatttaaagctatgctttgggacgaagagttagaactgttaaattggtcaaaaaaactgtccttcacacatagacgcaggcacacatctcaacacagagatagcattagtctttcacagtcctcaagaggatggctccactttgaccagagaatttccttaactgtaactttttcatggagggtaaagaggagagaaacaaaaagcacacggaagattttgcaccactgattagaagggaccagacattttcatatcctgtaattattttttctcataagttttcttactgaaagaggcattttgaaagtgccttctcaaaaaaaaaaaaaaaaaagagagagagaaagaaagaaattgccttctctacccctttcctacttcattagatggccactcagcaccaaatcttaaaagtgattatgggggatgaactggcatttgaaacatagatgtacctcaagtcaaagacagtttccatgtgtgtgatcttttcattgcttctctcgctatcccccttttagtaaatgtgctaaaggaaacatataaagccttgagtcttacaaaacttgtctccaaaagggagtgaatgaattgatgatggtggctgtgcacagttcccggttttaaatagttttctgttggagtgaggcttctctctcctttctgcccattctttccggcctaataaattatgagattttaaatagtctttaaaaataaattttagagatcccttaaaaaacagacattgaagattcttttaagtatgtttgttagctcatagtgctgggtattaacctatctcatcactagctcatgtcttttattatatcaacaccttttataagtacacagaatttttaaggtgctcactggcacctcaacaatgcaatggatgggtgtattgcacaggttgggtaattacactctttggaacgtggtatttaaaggacagcaagaaatcatgcaatccccatactaccaacataagtgagaaagacaatggaagatgatggcctttcattgtatcttatatggaaaaataactacccttacttcaatatgccgcttaacccctatctgtccaattttcgagccaagtaggaccattttctaactctgagaacaagttgaatgaacacctgactccagcccacccaagtaagcaacaaactctttctgttgggaactgtgatttaccaaagatgatctaaccctggacatatctggagctaatacattataaagcacatcctattagatggagtagcataagagcacaggccctagagtcagacaaagggtggttcagaccctggttccaacaactccctacatatagatctttagccaaattaacattccttcccccaaatctttatctgaaatggggttaactgtgatcacatcaagcttttcatcttcatccccatcatcactgaaaacttaaagaatttcaaccacttgaaatagatatcaaccagttgtttaaagaaactaatttattagcatctgtatggcaccagcttgtgtgacagctccagaattcattctggcaccctttcagttcaggtagacatggcaaaacagtcggacaggacttagtgactaaacaacaagacatggtaattatagccaacatttatcttgccggccaagcattgactgtgctaaacatttcacatggttgtttcattttatcctcacaatgaccttgagatgaagttattatcattccctttttacagataaggaaactgaggcttagagagtttaaatactagtctaagctcagttatcaagaaatagatctgtgatatgaacccaggtagtctaaatccagggctttcagaaccaacctgcatatacagcaattttcttacatttaaaaatatatatgtatatacaaatgctaaaaattcttgggacattaccaactaatagttaaataaatctgattt

SEQ ID NO: 63287 - DNA, 719 bp, Bovine  19866880959997
aatagtttcatattttactgtagaagaaattatttctagcattagaaataatataacattacttcagatctcctaacacagtgatactttaaagtgaaagctctggaaatgaacaaaccctaacccccttatttatttattttttaaaatcctcaaagtattggcttgtctcattttcttagtcaaagcttgcttctcagttttgccctgctaatgacctcagctctctcttgatgctttaggaccaagggctctttgattaatcattctctgtgttaatatcaaacagcccttgcattcttcaaacagatcactgcttctgttaaataatgccctaaatatacaaagcagataaatgatgaccattgagccaatgggaacagaactgggctctaagactgtgttgcaattataatgaaaagacacataactgatgagttccatatccgaacttaaaatgatttgtgaagcataagatcaagagaaatacagactgaggtctcaagttggactttctacgatgaagtatagaccgggggtagaaagcattttaaaattgcttggtgtgcttgtgtctctgtgtatttttttttttttcctttgaaatggttaaatgcttcaaggagtagaacctctttggggggaaaaggcccagcatgatatgtatcagggttttatttcattccagtctcttgcttattttaatttatgaggtgtgg

SEQ ID NO: 63288 - DNA, 3379 bp, Bovine  19866880974823
gaaatcttggtttttggccccctcaccaaaagcaaacaagtaaaaccgaccaaaaaacccagcaacctaatcagtcaaagaaagataatggaggaggaattaaagttagggcagtggaaaacaaaagaataaaatcagatttccagccagaaatagggtggttttatttggggaggacaaaaaaaattctgcttaggttagaaaggaaaagctctactagcttaaataagatttaagcttcagagtaggatgtagatgtcaggtatgtcataattgtacagggtaagagtagagatcaggtcaagagggagtattttattttcctgtgaaatgtctatatttctgtcatgtgtagtttctaatggattttattaggttttgaatccagattgttagcaagataatcctagttaagtaaaaatttccattgctcccaaattttaaagatgtacttgtacactaatatttgtcttccttgtatattagcaagggctctgcaggattcctgcaggccagagtggccgagcatcactagccacttgatggtcaaagcctgacttcttcacagtcttggttcaggcaccatattttgtcctctctccctagttttttaccttttttttttttttatcattgtcttcactgtataggcttccctggtggctcagctggtaaagaatccgcctgcaatgagggagacctgggttcattccctgggttgggaatatcccctggagaagggaaaggctacccactcccaagtattctggcctggagaattccatggtctatatatatcgtccatggggtcgcaaagagtcggacacaactgagcaactttcacttcactgtgtagttcttagtcggcaaaggtttttgttctgttttcttgggtgacacagagcatttttattgtctggggaaaattgtttggaaatccatcagtttcctattttatggtgttttatatgtacataatttcagagatgcctaaacttctttatagtgttttaaattcaaggccctgacattcctttctttttttgacccaatatcttatctagtgccccttatttacttttttaataacgtgtatatttgtttatgcaagaggattttgagagtagtagagtagacagagtctttgcagagtaatctcatccagaatcaatgagccgaaacttgagtggatgagagagaataatatttaaaggaaccttgggagcttttgaggacgtgaattattgagaaatatagaagtcaggtcagcatcatcattttaggggaaaaaagctctttaattttcatatcttgagatccaattaaagatcagaatcttatctacataatatcaatttcacatcagctgagtattaatcattgccatcatgatggaaacttagagatgagaattaatgattcctggtgtaccagtgtgcatcctgcttcctgtattccctttcctgatcttgtcattcttttaagaagaaagtttgagaaaaagagaagtatgctaatgaaatgcagactgttctgtacttcaaagtaaataagatagacttaggtgatctgttttttttcttctctcccttttaaatgttgaactctgagcagggtaagaggtaagagtggtcatggtgaaaggttaaggaggatgtgaagtgagaatggaaggagaggagattaaattatgtatttctgtgtgtggatgtagttttacttctatgtacttattgcatagaaagagaaatgaattgttaatggttgctgttgatcatcaatgtgggggttgtagagccagactctgtagatttatttaccctatctttgattatttttggttagggagagaggggtgaggaagataattagtgcatttatgaagtgcagttgggagaatttaatgtgacactaaactaatttgaactcatctaagaagagagtctgggaaacactggcttacctgggggagaaacttcatgctctcagaatgaatgaacaaaattagtgtagggaaatgaggtcaaagactaaaaaaaaaaaccagtatgcatcaaagccctgatggtggagaagtgatacttaagggaagatggaaattggtagctgggttttattaaaacacattttactacctctgagtacagattgtatttcactactggcaactctgaatttattgtgccgagacttgctaatcacacgatacatacgctcttctttttgtaggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacaggtattttctctacctcagtgcaaaatgggatggtcatagcaccattatttgttcagataacttcagctaaatctctctcattttccaagcactaagttcttttcctcacactactcccccaaacctcatctgattccacctctctctcctcatgttctgatgcaactttgagcagccaggaagttgaaaaaggacagacatctcaaagtgcaaactcttctgcaagactgatagttatagttgacctgaaaaagaaaatcactgaccagatacggggaatttcacgttgttttttggtggtactttacagatgaaaaaccatatgcaataaaacattaatatggcataatatgtcatgatatcattacaagtaaaattggacaaataatttgtttaggaaaattgttataaaagctatttcttcagacagccattaaactggaataaaagaaagtaatattattttcatgtgttgagccccatcatttgtcccttatatttatggagaagttttgtttttctcaatttctttaatatacgtttattaaaaggtggccaaaacaagtttcttgaactcaagttttttcccttgctttataaagaaattcatctctgaaatggagggcttttgatttaccatctagtagctatattcatttcagaacattctggaaaatgctggtgatgtcttcctgtgcatagatgctcatgttttggtggctcttatttctgtagcagcagcgggagtagtggaggaagccacccaagtagtcggagcagcagtcgggagaacagtggaagtgggagtgtgggggttcccatcgctgttcctactccctctcctcccagtgtttttccaggtaaaacatgaattgtgcttcatcttcatctgtcctttctgagtttgtcctttcagtttctaatttaattacactgagctttcttcataatcaggattttttttctcttgaagactctgtaaatgttgagaaatctttctgca

SEQ ID NO: 63289 - DNA, 1702 bp, Bovine  19866880990563
gtattgtataataaagcagatcttttcaaagaattctaatcatctgaatctaaaacaacattttatttatttcatgtggtcagtggtgtcccgaatgcccctgcaaattagattaaaaattatccagttgatgtgtaaacatcccccttaatttacctagtgtctgggtcttttatttgatgttcaggaatttaaataatttaaggttgtttagctctcagttcaacttttgctttctggatatttacttggaacttcacagtatttatttaaggctattagaaatgctgggggaggacgtttttttttttactgcccgggaggctggtatagccctggttcagcatttgtaaagataatgtggctgtgggcttacagcagtcttgtctgctcagtgtttctcggaatttctcctgtcatgaacccacctgaactgctcagctttgttgagattcccacctgtgcaatggaactggcagctctgaacaaaactaagaagacagccaaatctttacagcattccctgtctgtcatttttaaatttaattttttcttccactgctagaagctatggagtcaaatacaggtatattcttccactttctcactgttaggtcttcaggaaattgttcaatttgagtctcagtttcctatctgccaaatggaaataagaaatgtctttctggaaagatgattgtggggatcaaatgatatgacttgggagagcatctggcaagattttgggttaatttactgtcaaaacaatcccatcttcttgtatatttaccaagaccctcttcttaattcaagatatgatggacgctttgtatacccccaaacattctccctttctctgcttttagttaagttagttaagtcgctcagtggtgtttgactctttgcgaccccatggactgtagcccaccaggctcctctgtccatgggattctccaggcaagaatactggagtgggttgctatgccctcccccaggggatcttcccaacccagggatagaacccaggtctcctgcattgcaggtggtttctttaccatctgagccaccagggaagtcaatattcctattgagtattgtttaatcatattggtattacttactgcatcagtgaaagaaacaggaactagtaaatgtaaacacatcaggtgcaatggtccccagtcttttggacaccaggaactggtctctggaaagacaattttttcatggagcagggtggtggggatgttttcaggataattcaagcacattacatttattattattacatcagctccacctcagatcaccaggcactggatcccagaggttggggacccctgagttagaggatgtttctgactcaagggaattattagtagaatgaccttataagttgtaattttaaagtcagacaaagccatacaaagaatctgttcagtctaatgttatatggtcctaaaacataaaagactgaaagacttcatcaatttccaagatctttaaaatgacatttcttgtgatcgcattaaatttaaggtgtagagttagaaggagaatgacccttatttgtcttaaggacttaccaacttgagtgggagctgcaggctctaagggttgacagaagaacaggtcatgtgcttaactgaaatccagggggagggggcaggtgatcaccccccccctcttaaatttaaggtactat

SEQ ID NO: 63290 - DNA, 710 bp, Bovine  19866880993170
tttcttttaggattcgtgtctgcagcagactgtgcaattgccctgtgttcctcatcatctaacacaactttctgcaccatcacagctgctatcacttaaactacaaaggagtaaagatgctccttttctatgtgcaaggtgtgaacataagagtttcctttaaactggaggtgtggaggagatcatggcctgaaatcattcaaatgttgcaatagcagcagggcttgaaataacgtagctcaaaatatggaaacagtgattgtctctgccaccaagaatctgaaataaatgcttcagactgagattacctagccacaaataacatgggagaaatgggttccattaaatctttgacatttccaatgcccactatttatagctagctagcaactttttagaggtggagtggattattcagtatcaaagacaattttgacttgtgctccaaggttttcttactcctttcactaaggtaggtaaacagtgtctggtcctgtttcgtctttagtaaaatgaaaatgatactaggccaatctcaacttgtcctaaatgacaatcaggcaggctgtgagtacctttcaggtggagagagctggggtgcatgatagattaaatatcgactatttactcttctctttctatttctgctcgatgattaaggaataagatctagatgtgtgatcctgggcaagccaattttcttctcagca

SEQ ID NO: 63291 - DNA, 1423 bp, Bovine  19866881039416
tttattttgattttccttggttgtggtattttcttttatttttgttgaaatgaggaagtttcttttacagactacagaggaagtcttccctctgtaatttgaaaggtctgctacacttcttggttgactaagtcactgtcatattcaaagcatcttaattgaatatctatttattattgtaaataataaatcataatttaataatgaaatgataaaatcataataaaatcaataatgacaataggcttgcttgacgtgtttatcccccaccccctgcagtgacatgggaacttcacgatgttctcttttcactcttatattttctgtttagtgcacccttgacccttacatggggcttcccaggtggcattagtggtaaagaatccgcctgaaagtgcaggagacacaggagacttgagttcgatccctggaccagtaaggttcccctggaggaggacatggcaacccactccaatattcttgcctggagaaccccatggacagagaagcctggcaggctacagtccataggctcacaaagagtcagacatgactgaagtgatttagcatgcacaccccatatgtgggttttgttgaaataaatgaaaacttgtagttgcagatcattgctaagttttctctaacagaaattctcctctgattgaaggattctctccttatactcacatcacctcttttcaatggcagcatcagtcttgccatctgctcctgccttatcatccctgttcttatccaatgttcagaagacttctattattttcttcagataccttgaagtctctgaattccagcatgggtaaagatgttttccttttactctgatgaataactaatatctttcctgggaataagattcctgatctgtcctcttttctcttaattgtctgtggatattcattcactgtctgctggcttctagggttgtgggtaaatagttccatgctagtctgactctcattactttgcaagtagcttaaaaaaatttctctggagtctcgttgcttccccgatggctcagacagtaaagtgtctgcctgcaatgcgggagacccgggttcgattcctgggttgggaaggtcccctggagaaggaaatggcaatccactccagcactcttgcctggaaaatcccatggacggaggagcctgataggcctacagtccatggggtcacaaagagttgaacacgactgagcgacttattggaatctggaattccactaggatatgcctaattctgtgagtgttttcattaacattgtttgagactgagtgagtcttttcaaactgaagatttcagttctttattttaaacttttgggatatttttctcttcccgtggttgtttagtcatatctttgtctttttttccttctttctagaaatgcttattattttcatga

SEQ ID NO: 63292 - DNA, 2623 bp, Bovine  19866881045147
gtgtgggggggaagcaaaacatttgaacaggtattttgccaaaaaagataaacagatggcaaatgggcacatgaaaagatgttctacatcatcattcactggggaaatgtccatcaaaaccacacgacaaactattaaacacctatcagcatggctgaatttaaaaaaagaaaaaaaaaaaaatatatatatatatacgtaaagacaattacacagccagccaggctcttctgtccatggagttctccaggcaagaatactggagtaagtagccattcccttctcaggggatcttcctgacccagggactgaactcagggctcctgcactacaggcagattctttactgtctgagccaccagggaggcccttacggcagtaccctgtactaacacgtatgcagagtgactggaagtcttacgcactgctggtggacgtgcaaaactatacagtcactttggaaaacagctatccagtttttatcaagttaagcattcatttaccatacaacccagtaatcctactccctaagttatttacccaaatgaaatgaaagcctgtgctcacacaaaagtctgtgtgcgaatatatttggcagttttattcataatcacccaaaactgtaaataacccaaatgtccctcaatttggattgaggaaaagggtaaacaaactggtaaatccattcaacagaacactactaagtaataaaaaaaggaatgaaataacaaaacatgtaataatggataaatctcaaatgcactgtgccaaaaagccagattcaaaagagtacattatgtatgcttccatttgtgatattactacaaaggcaaaactttagagggggaaaaaaaaaaacagatacagagcttgccaggggcaaagagtgaaatgagtaaaatggaaggaccgagtacaaagggggcgtggaggaatctggggacgtcagggctggtgtgcaccttcactgcagctgtgcttgtatcactgcatgcatctgtcaaaactctaacaagtcactagaaagggtgaatttcactgtatataaatcagatcttaataaagagaaaaaagtatctggagattcaaaaacagtacattacagagactatataaattgttattaaggcattaattatgctttttgttttaaaaaaaacacttactgttcactcatacaacagatattgactcagtgctgactaggaaccagcacctgttattaaattataatgctgactctaggtggagatgaatctgtactttgtaggcctacagcggatttcaagatgtattccttactccactgatgtatgagcgtaacaggacttttacatttaactagctgtagtggcctaacagagctgtatgtagagcaaaaggacaggtcaggtttaaatacccccagtacagaatgcttttcttaaaaagtgttggtacagaaactaagccataatacaccatccaaaatgcgtgaattaaaatgaattttttaaaatgtcttctaaaacattaaacacctagatacagtagcagcacacacatacattctatgaagtactttactaactgggcttcccaagtgcttcagtggtaaagaatccacctgccaatgcaggaggatgtgggttcaatccctgcttcaggaagacccccttggagaaggaaatggcagcccactccagtattcttgaatgggaaaccccatggacagaggagcctggcaggctacagtccacgcaagagagtcagacacaatccacacaagaaagtcagacacaactgaactactaatcacaagcacatcagaaaaatgagaaactttactctgatttcctcaggaaattctactcttcggtcacgggccattttctagttagtacattattctgcagattttttttttatacaaaacacagacaaaaaacatgaagccagagttccaagacgagccagagccagacgactgaatcggcctgcgaggaataagccaatactcacctgtagggggagtggaagaaacaacagggggagttggagaagtgaagccatcagcaagggtctgggcacccccagcggcagcatctggggcagtggaagaagggacagttgcaggaacaagaggggtgggggcagatgcagaagtagcaggaaggggtggagtaccagcagagccagcgggggctgaggggagagaggagtgagaggcagcattagtgaggcagttccatcaggcaggactagaacaggcaccggagaactcagtgttagatactcagtgctgatcaacgccaaagaatagaagagagtgttaaaaaaaaaaaagaatgaagcttatgttaaaggattatgaggtttacagcaagtaattcaagatgctaaggataacgtccagacttttaaaagcattcctttttacctgatagccaacacactggaagaaaagccccctttatgttgttgcttttaacgtaacattctgtaaatagtatacaaagctaaacataacacagtagaaaacaatagtattcccttctgaatcatacaaaccagaaaataaagatttcagacataaatatcttaccaggtaaaaagaatgagagaaatacaaacctctttttca

SEQ ID NO: 63293 - DNA, 788 bp, Bovine  19866881060062
taagtgaaagatttttttcctaaatattttttaccatctttcctatttatattttatgcttttatttctgtaacagaaactttctttcctttaagtattgtccaaacggacctttaattaaatatcagtatttgtttagaatgttccttagctagatcatatttccttaaatttattctagaggaagacatatgtacagctgccattgattatccttgtctatatatcatggttcatagaatcagggacattaaaactgtatgtacagaaggccaacaaaaaagtttttaggtctcagtgtaatgtgaggacgtgtgtctgtctctttgtttaaggctctaggaagtagggagaaaaatctttttcctctagcattctctaagcaggagagcaactgaagaatatgtcaccttcatgcagattttatcacataaaaatgtgtactcctagagtgttgtatagaacaaagaattatcatggatgattccatctgaatttctggcattgcctaatcttctctgggggcttctctgatggctcagcggtaaaaaatccacctacaatcaggagacacaggagatgcagtttcagtccctgggttgggaagatcccctggaggaggagatggcaatccactccagtattcttgcctggaaaatcccatggacagaggagcctggcggacaatagtccatggggttgcaaagagtcggacacaactgtgtgcctaagcacgtaaccttctctcgctctatccacgtctaccctagaccgagcattcattcagg

SEQ ID NO: 63294 - DNA, 812 bp, Bovine  19866881099193
caaagagcctgtgagccacagtgagaactcagtgaagccactaaagaaagaaaaaggaaagaaaagtttaagccactgatctaaattaacaatgtgattttttattttatattttcatacatgtttaacgtaaaaatctaatatattttttaaaatacttattattttatactttctaaggcctgtctttcctatttatttaataaattattaaatttaaaagttataggaaattttagctttattccaataaacctgattgacaaatatcaaacataaaatatttatatctgtaaaacttgggaatgtgatgatgggagaaaagccaaaacaatggcatttattttggggaaattatcctggaagagttataataaaaaatttgaaaactcataggaattaaacttgaggttatttggtctagcccctttacctactgataaccatgaaataagagaagaccctgccattaagtgaaaaatttcagggacatcctaagagtaaaccccaatcctgatactctccaggtcacaaaaatatgttttcctctggaatctgaaccaggaagtttcttctcacattactcctaaaagacaaccccaccagatgaatgtcaagaaaaaccaaccaattgaattaaactctgtagaaatgtatgaaagagaagactagagaagggcccccagagagaaattgttatggtatgccatgttttttgttttaactattgttcatcctggatcattcctgttttgagatagggatctaacctattccataaagaactcagtaatcaagcttcaaaaagtcaa

SEQ ID NO: 63295 - DNA, 1033 bp, Bovine  19866881276429
gcaaaaaatctctctcccacttgagaaccattcaatggcttccgtataagaagaccacatgctaatttaatggaacccctggcattcttgccgtgcttgggggaatgacgcgtgagcctggttacgggtcagacctcagacaactgggaaatgactctggttctcaccagggtcattcagtcctcatgataatgaatggatgagccagcaccttcccctcctagcacgagagaatgggcctccaggaaatgaaatatctccaccgacaccaaaccccaaaccaatgagaggaagcacgcttctggctttaatcttactcgactcagctctgtggaaacaagactgctggcttgcaaagaaaccagaaataacacttcctcttctggttcaggcaagagccgacagacaccttgagaggttaccaggttcatgcttctctacctagaactaggtctcccttacaaagcatttgggagactcggactttcagttggggaaaggaaaaagagcgccaggaggagaactataagcgccatcatatgcgtttctgtatctccagtgtgaacaccgtaactggcacaaatgaagagctcagccttctggtgggtgctggatctggctccccctgcccatggagccagtggttaacatcacttctcaactccgcatttagtgacactatattgttagtctgaagttagctgggtgggtgtctgtacaccctggccatcggcaatactccaaatccacctcctcgccttccccagagagccagttgttaaccatttaccagctcggttaacgcttgttgttgaatgtctggactgcttgggggcttcccaggtggcttagtggtaaagaatccacctgtcaatgcaggagatgcaagagaccatgggttcaattcctgggttaggaagataagaaatgtcatcccactccagtattcttgtctggagaatcccatggacagaggagcctggtaggctatggagtcacagagtcagacacgactgagcgcatagcacacatg

SEQ ID NO: 63296 - DNA, 1303 bp, Bovine  19866881300857
aaatttgaagtgtttccctaatgtatttgtccttcagatgcttttttcaatgggatattctcacaggacatgtgtttaatagaacagaccttggggaatgctaacctaaacaagatttttggtttatagtaaagaatactatggaccctccagctgaagtgacttgcctaaagttaaataaccattactggaagatatgggctagaatccatatcttctgacctcactcacatgctgtttgtactgcctaatgctttacaaattgcaaactcattccagtaccttcaaccaatcctgggggggaaagattctataaaagaattatgaaatacatcctctcaaatgaagtttcaaatcagtaattttttgagctatgataattttgaatgattactactttgcgctgtgctcaattgttcagtcatgtccaactcttttcgactccatggattgtagcctgccagggtcctctgtccatggagattccccaggcaaaaatattggagtgggttgccatgctcttctccaggggatcttcccagcccagggattgaacccccgtctcccacattacaggtggtttctttaccgtctgagccaccagggaaacccaattactactttaagtaagacaaaaagatttgtacatcggaaaagtggggcaaattattaccttagtattatctttctgataattcagcaggagccttatagaatgaaatcacctagccaaataggacattcttctagctgccctagccctgaggtagctttgaataaaataaactttcaggaacagatagaaatattaaaagtctccccagaaatctcagtgtcgatcccccctctccatactgaatgaaaggacaggttctaaaatatgctgagactatgaaaatccacaccagatttttacttcctctctggcacaattcccctgattctgaaaactctaatagctaatggatgggaaggtttttatatcctaatttcatagtcctatttcccagaggagaggctttagtacttcctattcttagaaaaacaagacaaattgtttgttcccaagagacttcttgggaccataggacagctttcattttaagagtagtttctatagacattacttttgaaactcattatcgctgtcaacttatgtttcagcaatattgtaaagtatttgcttcatttccaaatgctgtagtcatttttagtaggcagactgaggaccatcacatgtaggataatgaataatttttttttttgcttaaaaaataagtagttacaaacaatggaaagaatg

SEQ ID NO: 63297 - DNA, 1409 bp, Bovine  19866881323135
attggaagggttttttattatacacatacacacacagtagggaaaaaggttagagaagacaacttttgtaagaatacattcagcattctcagagtaaatcaatatacttgcagccatcaaatacttgtagaaatgaaaaaatatataactggatattttacttgattctacatgatttaaaaaataaatatgttttcccaaaaagctcgcaggaagtaaaatcagtcaaggcttctgttagccaaataatcatctaaattatctacacagatgtcacaacataagagttattaatgcattttaggcaacactccagtatcaaacactcttacaggcaggacagataatacttctttaaataaaacccttataccccactgtgaataaacataaacaacaatgtttttatttaaaactctttagtagaagttttaatttgtgattagagaacatttcttaatgaaagtttgaaagaatacaattttcaaggataaaaaaacttcactgaatatgctacagagccttgtactccttatcctagcaactatatttctagaaatgtactaaagaaaaaaacacagatttcatattcatcaagttggcaaaaacagtaagtgtgataaaatgaagaggtggggaggttgtggagcaatgagaaaactgccaggagggacatatacttcccaccctttgggagagcctgctggagattacgtactttatgatcctgcaataccacttctcagtgtccaaacatgtaggagacaagcaccaggagaaatatagcaggatgttcactgcagcatcctctttatctaactatccctgctcagaaggggaatggaaagctggcttattctgataaaaagaacgaactggatctataagaaactgtatgaataatttcaaattacagttgagtaaaaaatgcaaaatttaaaagatataattagttgtttatataaaattaaaagcacagagagtaataagtatattttatggacacacatttattaaatgcactaaaatatgcaccagaacaacatgaaccattttctgggggaggatttaacctgttacttctccttaaacaaagtatttgaagcaaaatataaatgactgactactcctggtggtaagtatgtagatgtctatcatattttacactttggtttaaaatttttccaaatttaagacagtattaggaagaaattcaaaacacaaagattgtgaacaagtatggttactaaagccaaatattaaacacacacacacacacacacacgggaggagaaaggcaactaaatatcccacaagaaaagaaaaactgagtaaattcaagtgtgttttatgtccatcctgtattacaatacagatgggggtaaattcataaagcatttaatgcaagg

SEQ ID NO: 63298 - DNA, 1156 bp, Bovine  19866881402794
ctagtagtaaatatttttgtctttgaagccgatggtctctattccaccttcagctctgttgtagtgtgaaagcagccatagataatacataaacaaatggaaatggcttcattccaataaagctttatttagggacactgaaatgtgaattttgtgtaattttcacatgtcaccaactatttgttttcttttgattttttttcctccaatatttaaaaaaaatgtaaaaaccatccttagctcacaggctatacaaatacattggtgggctggatttggtccatgggctgtagtttgtgacccctgacctaggaagccgttgtattggcatttttgactatggacaaggggaaacacaggactgccctggatccacagccctgtgaccacagcagtattttcaccctctgccgctccttcttacacatttctcttagaagatgtggagtatttgtgtgacctggttatatgccacagaaaactcaaactgcttaagcaaaaagaggatgcactgagttctgttcctccaggagaagttgatccagggttcctctgtttctctccatctcttggcttttcttctttctgtgaagatttgctgtcaggatccatgtgatgactggtccatggccagcagaaaccaggccaagtttctcctcctccaagagttcacacaaaagctcgggacctgattacctgggttttgttatggagcttcgtgtccatctgaaccagctccgtgcctgggggaacagaacaccacacccaggcagggtcagccccaagaatccccaggattgttacctgcatcagattcccaactaaaatgggagtccactcaccaaggaaaggtgaccaggtgctgggaggcaaaaatcaacaaatgtccgcttcccactggggatatcacaatatgacatttagaattggaatgccttgaacaaagtgggtgggcgagctgcgcagagcaggaagttgctcctcacaccccgtcttctgaaagggatgcctgcctttcctttggcagattctctctgcaggttccagtttctcctggaacagactttctaggcttgacaaacccaaagctactgaatgctttagatttcatttttctgtgcaatcaggtggtctagactctcagcactcagttgat

SEQ ID NO: 63299 - DNA, 1193 bp, Bovine  19866881453473
cttatatctcctgcattgacaggagggttctctaccactgtaccataattagacgatggctaaaacaaggacagtaatgcttgttagtttccagtaggatttctgaacagtcagagccaaacattttaacaagaattcttaatggcatgtgaattttaaaattgcataatactgttgtcaagaatcaaaagtttaatctttattatgtatccatgtgcctctgtgtgtgtacaaatgtgagtgtgtctgtctatagctgtgttaggcatgatatagttagagtatgagatcttcatgagtcaagaaacatacttttttaggtcaacctattgaattcaagggtgggaggaattttcatagtatgaatcaaaaagcaaccataaaaaggaaaaggcttatgaataatggaggagagagattcaggtcacactaagcccagaagccacacattttttctgcctcaggtaaggagatctttaaaaatatcatctttataggtataaaaaacattttctggaggtctttcctaggagatagtttaaagataatattctagaatgtattctatacaagctttgctgagttttcctgaattttcagcatttgcatggaatatatgtaataacatttaggagtattatgaactatactaatagacacggttaattagacaagcggttgaattagaaagtttgggttaaaatggaacttggggaagagaaattggggatgtgttgtaatttgtgtgttgctgtcagatttgatacaagaatgtggttgttgtagaatgtggttgttgtttagttgctaagttgtgtccagttcttttgcgatcccatggactatagcccaccaggttcttctgtctgtggaatttcccaggcaagaatactgaagtgggttgccacttccttctccaggggatcttcccaacccaggaatcaaacccatgtctcttgcattggcaagtggcttttttattttttaccattgaaccaccaaggaaagaaccccatttaaataatgtagctctgtattttttgacatggaaatatacccatatcacagaacattaaatgacaaaagcagatttccaagtagctggtataagcaatgaaatggaaaataattataattatttcataacaaataagtaaaaacagtaattatttctgggtggtaggaattcaggt

SEQ ID NO: 63300 - DNA, 955 bp, Bovine  19866881472580
tttatgagattttccagagatttctgaagaaattcctggagcacaaaacaagatcaaacacccacttttcctgtcaaacaggacaaggaatgttcaatccatagttacccctgcatttacctcagtaaacatgggaagaaactttggcggcagtgtctgctttgcaaggagccgagggccttgtgtggtaccccagagcaggaaaacatcgcaagatagagtctgcttcctcacagcacgaggggaccagccctgcgagcctcctgcctggtaccaaattcatctcagaggggagggccgatcaaccaaaggtggtaactgtggaattttcttcatccagcaagactgcccccgaatgcaaaaagaacaaagtgtcaaccggctccttgtctcttcagacttcattcagtggtcacagaggtatttcctctgcacatattttcgttcagcagtgtggtttctggcccagtgactgtggctataatggttagcttagccttaaccacattagggcccgggttagggagaagatttcttgttgttcttattgtttttgttgtcgttgctggagttgaggcagggcagctgctggggttaaacacggtttccattgttattgttttctttctccctttgtgtgtcctgaactctgaatggcagaaatgagagccccacttttgttagtggagtggcttctgtgagcaaattccaacccctggaatgtttcgtgagctgcaaagacaaccgcaagagtcttggaaatttgtctgtggagtgtatggctggggcccccttgccatgtccctcctcccttccaagtggaaataacagccataggacaggtgggagaggagtggatgggagcaaatcaggaagagagggcacctagctgagctgtccagccacaagaaatttgtgctttggggtaaaataatgtccccgttaacccttccag

SEQ ID NO: 63301 - DNA, 1501 bp, Bovine  19866881582339
gagctgccgcacatggaagttagaggaacacagcacgatgcctccatatgtcacaatccctttgctccctaaactagattctatctaaactagaaaagcagccttccttgctctaaattcatcctgcaattaacttgaatgaggcctgggcaagttctttcttggctgaaccctgaaataataaccacaggactatggtaataatgatcacaatgccgacaacaacagaaataatggttaccattattgacggctggccacaccaggaactcaccataaccacttaaagcttagactactccagctggtaagagttaccacctgatgggaacatgtgtctgagttgccttcctttactgggtgccagaaggtcatggtgtttgtccaaattgaatttggatttacataaagtacctgtatcctctgactttcaagtgttcttttaactatataaaatctcatttgcagcatccttccatctggaaattcttgttgctattccaagtggccatgggatgcattagccactgacacacatggttactgttaccaggtacatacagaaaaacttgcactagcagtttctattaagaagcctagcaacagactttggaaatctctgagaggtccatgtcatcacttggcttgtgagtaatcatcacctggatgattctcacaccagcatgaagcctttcagctcccactgggcaagggatctggcctgtctcagtggcagggttactgaaaatacaggctgtactgattcagaaaccaaaggcatctttcaattaaggatttgacacagacaaaaaatactagtttaagggtcatttgtagagatgtggatggacctaggatctgtcatacagagtgcagtaaatcagaaggaggaaaacaaatatcttatatgaatgcatacatatggaatctataaaaatgatacaggtaaacctattagcagggcagatatagagaatggacatgtagacacaggggaggaagggggaaggtggaatgaattgggagattagggttgacatacaagtaccctgttaaaatagctagctagagggaacctgcttatatagcacagagaggtcagctcagggcgctatgatgacctagagaggtgggatgggatgatggtgggagggaggtccaagagggaggggatatatgtacacatatagacaagtcacttcattttacagcagaaactaacacagcattgtaaaactattatactccaatttaaaaataaacaaatacaattaaaaaataaaaaggcagaaaaaaagtagtaaaatactaaatctactttgtggaataaaacatatacagttttatacactattcattaaaagtggcatttaaccctctgtgataccaatgtctcctcaatagagggggcaagagtaataataatactcacaataacagcaacaataagttctattttttgagtacttttatgtgccagaaacttcacattcatcatccc

SEQ ID NO: 63302 - DNA, 1186 bp, Bovine  19866881648103
gacgatcggataaaattgggacttagggggactcctgcgctccaggaaattctccaagtctccacttatcctcaaagtgaacaagaagcttcagtttcaagttgagtgcattttccatccatggattggcttgttttgttcagttttactttgagtgtttgaggttatctcttcgacgtagcagctaaacccacgtcttcctttctcgtaaaaccaaaacaaaaaggctagaaattcatgtgccttctgtgtgtgcacatgtgtagtatatacctgggatcaaagccagctatataaagtccttgattctgtgtgggttcaaacacatttcaaagcttcaggatcctgaaagtttttgctctgcttcctgaagacctgaacaaccgctcccataaagccatggcttgctctggattccagagtcatgggacttggtggacatctaggacctggccctgcactgccctattttttcttgtcttcattcctgttttctctaaaggtgagtgaggcttttggagcatgaaggtggaggaggtgtttctcccactgggtttcatttcttttctcagtcaagggcagagatttacagcaaagccagaagctaaaggtgagactccagtctcctggtttgggcagctctgtattccaaggcaggcaagggacagctggaaggagcaaaacagcagagacacagctagtaacagcttactgggcatggagtggaagcttagtgagtacatgtgagttggtcttggagacaggagaaatttcagacacttctataagactggaagaaaatactgtaaaggtaagtgatgtaagagagaagagagaccatcctaaatccatctgggcttggaataagggttagctcaaggtttcctttttaaaaaacattgattgaataaaattatgagatatttctttcttatcaatcaaggttttaaggtcttctgattcatttttataaacaaatgacgcctgcttgtttaacattgcggccttctttactcaatgcaaggttttaagatccacttagtcaactctataaactagttagctagtaattatttttaaaattaagcagtttgaagtagtaaaacaaaaaaaaaggcggggggaagaaagaagaaagaaataaaaaacgaaagaataaaagaagaacaaaagaaagggccatcgg

SEQ ID NO: 63303 - DNA, 3697 bp, Bovine  19866880169357
gagaaacagtggaaacagtgtcagactttatttttttgggctccaaaatcactgcagatggcgactgcagccatgaaattaaaagaggcttactccttggaaggaaagttatgaccaacctagatagcatattcaaaagcagagacattactttgccaacaaagtttcgtccagtcaaggctattgtttttcctgtggtcatgtatggatgtgagagttggactgtgaagaaggctgagcaccgaagaattgatgcttttgaactgtggtgttggagaagactcttgagagtcccttggactgcaaggagatccaaccagtccattctaaaggagatcagccctgggatttctttggaaggaatgatgctaaagctgaaactccagtactttggccacgtcatgtgaagagttgactcattggaaaagactctgatgctgggagggattgggggcaggagaagaaggggatgacagaggatgagatgtgtggatggcatcaccaactcgatggacatgagtttgagtgaactccgggagttggtgatggacagggaggcctggcatgctgcgattcatggggttgcaaagagttggacacgactgagcaactgaactgaactgaacttgagcaatgaattgtttcatgcaaatccacctacctgatgggttgaacacaattatggaagatagcacatttcattcggtgtgtagaatgaaaatccttgagacccccgtgaagtttatgtgagaaatgagttaggagccacacatccagctctcactgcagtgctcatggagcagagtgcactctgcactcctccctttacacagtgcagttgccctgcacagaggcatatggggtcctagtttccctaccagggatcgaacctacactcccctgcagtggaagtgcagagtcttaagcactcaagactgctgcttcccaagctgggtccacagatccagtaaccaggttatacttggaccatttccaccaactccagtagaagagtttgaagaccccagctttaaaaccacaacctcatccaggccagttatgccatagtattcttttgaagtcctccaagaaaacaagagtctaaaaccatctcctattgtaaatagcagctctctgaacatttttccttctacccacataaaccttttgtacttgagagactggttcctcttctttgccaaggaaggccatcatctatctgcatgattttttaaaaatatttatttatttgcctgtgccaggtcttcactgaggcacatgggatctttagttgtggcatgtggatcttagttccctgaccagggaatgaacccgtgcaccctgcactgggagttcagagtcttaaccactggaaaccggggaagtcccctacgtgcatgattgatcccatctagcctctggcctccatctcgctttgtttgttcacagcccttacccttctcaatttttatgttattatttgcccccagccctcctctcccccacttgagagtattccttcttgctgtatctgtgacagtcttcagtttattcatttctctgatcagcattcctcttcccacctaaataagtactcccaagcttttatctccagacctctcttctgcttttcttctgaggcgttttgttccccttgatagagcttccttgagcacatctgggaagatagtcccaaatctttgttcccttcagccctaggccagccttgttaagtttctacttctctgcttgcctgccagacccagactcctcaccttccactgaactagcttcttcctctggctgcctcatctaagtcaatgtcagcacacaggctgcacttctacacatcgctgagcttaacatgaactttctccactatcatcaccattattttcctgcttcattggttccctgaaactcagcagctttccatttttttacttcgtggtctcccttctgcagagggaagaacaaaatcaaagtggttttgaacagtcctaactttctaaacttgcttacaacccagagctctggttttctttgacattcgtgggcccagacaagacccatccaatttcttccccaggtttatttcaagtggaatgaacctagaaggacccttgacaccggggtcctggaactgctaggatgtgaccccaagactttacatttggtggagtgtacttgagatactggttcctcttctttgccaaggaaggccatcatctatctgcacgatttttaaaaaatatttgtttatttgcctgtgccagatcttcactgaggcacatgggatctttagttgtggcatgtgggatcttagttccctgaccagggattgaacccgtgcaccctgcattgggagttcagagtcttaaccactggaaaccggggaagtcccctacgttcagggaagttccctgaacacacccaagctttccttctgccatggtaatattcccttccctcctttcctattagttgaaattatatctagccattgctcaaaatttaccataaacagcaaaatctgtaatctctccctcctttgaaccattttgaaccatgcctactatgagtgtgaacttttttatcttttgtctttctttttttttgtcactctgcacagccctgtgggatcttagttccctcaccagggattgaacctgggcctcagcagtgaaagcatcaagtactaacccctggaccttcagggaattccccagtgtaagtttcttagtggctaaatggagtttcccattcatttctttatctgctaccaccccaggcaccacccccatctcccacctgggcataaggccttgaagacaactgtatgataaatgttgtctccttggtgtccaagaagtatgtctgatcatcattttttgtataatacctatttcttttattccagcacacacatgttttacaatttaacattggtgaagtcaggattcatcctataatcgttgactgctataatttaattagcagcattttttcctctcagtggtacataaactatggggacatcttagattcagtgaaatcaagcatcattcaagcatctctgataacagctatgtttactcctctgtcctctctctatggtgaatcattctcttctcaacatttctttaattcctgttctccactcctatggttgtctcctctttacctcatttaaatttctacctttctcacatagagtcacattattataataagactgtgctaaatccgcaggtgtcattggctcatgataaaatgctgtttacaattctgtttgctatagaatgaatgccaattcaccacataagctagttaaaatacatctttatttttgttaagtgtgaacagcccaccatgctataggagcttccatttatgaagacaacatggtcagaagtcaagcactattgaaattaaatatgacaactagagcaacaggatgtatttttaatgacaatgtaattattattctttgagcagcagtgtggcctagagagtctccagagagtataggtttctaaacacttccagatgccctgtaccatgcaatttccttctttatggaccttcattcttcatttgtttacgaggctgggaaagccactggtcttgggccaggcaactacgtggaggggacgctgtccccatcagcatgggtgtgtaggagaggttggggggc

SEQ ID NO: 63304 - DNA, 1029 bp, Bovine  19866880385788
aatgagtaggaaggatctcattcaaccttttgaagaagcatgacaggtatctactctctgaacacagggagatggagagggaggtgaaaccccagaatggagtttccggcttacctgagcttaattttaaccggattttttttcgtattccctctgaaatagacctggggaaaagaaacgtgatgatctcctatgttttcttaagatatgtgtctccctctctccttcaggaaacatcaatcagaatgaatctaagcagtacctgcacaccagggaagagtaagtgactgattttcttccaacttctgaacttccccaatcccaaagtcataactagaattttactcggcaggatgtgaaatctctcttctgaagtcctttggccttcttcagatttgtccccatccctgtcattccccatcacgagctattagaagaatacatttcttttccttgcccatcagctctgaatttctctccaggtaggtcaccagtgagggctaggtgatcccccaaggtcaaagtacccgttacctttcagtgtgactgtttctttcttacacttttccagattaaaggcttttccaagctagtccattgaataaacatccagagatacagagtgctccattcctccaggaggcttttatgagatcaccacagagtggagatgagatggagtttgaagttgcattcgtgggcagtcagagcaatcacacattaatcttgctgaaaggaacagaatccagtctgtaagacattcgaatgctcctgggagctgactggtctgcagttcttcccagaccttcagttcagttcagttcagtcgctcagtcgtgtctgactcttttcgatcccatgaatcgcagcacgccaggcctccctgtccatcaccaactcctggagttcacctaattaatgggaattcctggcagaggggcctcatgagagccaaagcagacagtgggtgagctgtttgggagatcatgcttgcttatttccaagtggacacacggtctttgggcatct

SEQ ID NO: 63305 - DNA, 1310 bp, Bovine  19866880442158
ggatggggagcctggtgggctgctgtctgtggggtcgcacagagttggacacgactgaagtgacttagcagcagcagcagcagttaactcataggctgttaacattatatgttaatatcatcggttaccaagtacttcatagtttgcaaaatacctgcacgaacattattacattttagtctcaccattaccatgaaaatgatactgggcacatttaaatgccctcctttcacagactggaagactgaggaagaggtagagatgtttgtacaaaaagcccaaactagctgcagagacccctcaaggggctacgtctcccaaataaagtctggagttctttccacttttcctccctcatacctaaactaatttagtatctgaggccctgcccccttttcttagctgagctgtggcatgggggatcttagctccccaatcagggactgaactcctgccgtggagattggagtcttaaccactggaccaacaggaaagtccctgagacccattttatagagaccggaaatctgcttcttctgaaacatctgattctgaatggctaacagaaatactcagtgtataccttaaactaacacaacattgcaaatacctgtacttcaatttttaatggtttaaaaaaatactcagaaaatatagggaataaagtatatcaataaagcataccaaacacatttataatgattcaatgcagtgaaaaaataattttaagaaactcagaagacagagatagaaactaacctctaaaggctgtgcatggtaatgatctgtgggatctttcaattctgctgcttctttcatcaaacgtttaacagctaaaacaaaattcacaagatagagacttttcaaataaactttttccatgtgattagcagatttacagacctaatgaataagttcctacttcaacaaaaaacgtgcagaggacttattcaatacagcatatgatttaattatgcgataatagtaataatgggggaagaaaaggcagctaggcactagaagagttacatattaaattaaatatatagggaagtttcaaagagacactatttttctctactaagtactattatacactccttattaggtagcactaaaatattaactcatgtaatcctcaaaacagctgagataggtgctgtttttatccccattttccagatgaagaaactgagacatggagagattacacatgtccaaggttacacagctggtagatgacagaactaggatttcaacacaggcagtccaactgtacctcgttaaaagatctccattgtcaagaaaca

SEQ ID NO: 63306 - DNA, 935 bp, Bovine  19866880473199
tgaccccggggacagttacctcatgctatacagcacctgcccatctgggaacactctcagcatgatgttgtctgtggtggtgtcatggatgaacgaccttttggagtgaacaaagaacacatcagggacccagatcttcttcaccagccggccgtcgaaggtcatactcttgttgctggcactggggaaagccagccgctcatccttccagtaatgccgcaggtacaaggtcatggtgaagtcctgtggagcaggggtaagaccagacagagatgccttacaaaactcccttcctgaccgtcccttccaccaccatgatggatgcctcaggctcagcctccagggtctgggtgacagtccactgtcctgccggacgacagccaccgctgccacaggaaagaggactcattcttgtgccttgtgagattggagcccaggagaccgcacagctcctccttcaggctttgcaaagggaaaatggcagctgtgatgccctctggctggcgtggagccagcaggccaggatttccccaaagccctgcatgctcaccaatacctgtgcacacacggctccttacctattggctaaccattcaactcaactcagtagacacttccagaaacctggacagtcaagtgtcccatttaggaggatttcttagatttgtaagatctttgaaggcagaattgtgtcctgcacaccactgaatctccagaccctagtttagtgcctggaagagcagagaagtcgatgctcaataaatattttcaggatggaaaaaatgaagggaatgaatggatgaagagataggcagcagtgtaatttcagcctggaaacttattctgttaacaagtgtttccatggttgtgtcttaaactaagagtgaagcccttacaccgcagccagagctaagacacaaatgcagatgagtctt

SEQ ID NO: 63307 - DNA, 1564 bp, Bovine  19866880487233
tgggactgagtggtcctctcccattcagagactgagatgggtagaaaaacgtaggttggagaaagcaggagagagggtgctgtaaagtaaattcttggaggggactggaaaaggaggtataagaaaaaagtgtgtgctaagagattaattgtttttatgtgttgcccatgtaattatatgttatagagggatatagtgaattagttttagtcaatatatattttagcttgaaatatttaaaaaaatattcagattacttttcacctttagaattctaattgttttctgtgtcataaatagtttttttaaacaatagaaccatcctactgcagagaggagagtagtcacctataaagacagtctgctaatactttgtgatgtatttaaatatgtctttagtctgttttaaatctgtgtcaagtcccctgttgcatattccagttatccttattgcagttgtaatttattttacaattatttgttgtctatttcactccccagaatgtacgttccttgaggatcaggcctctccactgcactgtatccctagtgcctggcatagtgccttgtatatagtaggtcgtatttgttggttgaataaatgaatctgaggattggcactttaaaaatatactaggaatacaggtaaagaaatgacaaagtttagtaaattagatcgcacaaacaatacttttgttatttcagtagtcttttctattttgatttcttccttattttttcttccggttttattgcaatgtaattgacatacagcactgtataaatttacaggtgtacagcataatgatctgacttgcatatatcatgaaatgattaccacaataaatttagcaaatatctagtagctcatagatacaaaatgaatggaaaaaaaaatttttttctgttgtgatgaaaactctgaggatttactctcaacaactttgatatgtaacagcaatgttaattgcattaatcatattatacattgcatccttaggacttatttatcatgtaactggaagtttgtaccttttgactaccttcatctgttttgcccacccctctggtaaccacaaatctgatctctttttctctgagtttgtttttgaagtttaatctacctataagactatgttagttctgtgcacaacgtagtgatttggtatttctatacattacaaagtgatcaccacccattttgattttaaagtacctaacacagaactcttcttcacaggtataggtaggtaattgataccaattctggttaaaacaataaattgcatttagttacaagtttatctcttaattatatttacatacagattatctcagagtgtgattatataatttgatcactagggaggtaattgaaacctggttttggctgggggtagctgctttacatcagagaaggcgatggcaccccactccagtactcttgcctggagaatcccagggacaggggagcctggtgggctgccgtctatggggtcgcacagagtcagacacgactgaagcgacttagcagcagcagcagcagctgctgctttacacgcca

SEQ ID NO: 63308 - DNA, 784 bp, Bovine  19866880506821
cgtatgctgcacagtgtggccaaaaaaaaaaagatcttaaaaaaagaaaacccaaaaaacaatttaaccccttgcaaagccgccttgcagacttgaccccaaaagagtttccctgctctggggggtccagcagggttggcatggatggtggctgcccctctcaggaactggagaaaaaggccacggggagagaggagcctggacggggccagccatctgcaccgacaaggcaggggggaaggatgggactcacaggatgcatgagacacaggcccaggcacccctagtgcaggtggggaaactgaggcccagagcatggcagctgatgcaccctggccagagagaccctggcaggctggtctctattcccctttatcttgctcttgaagttctctcaggtgccagcgtcctcttggggcagcaggaaggagcaggagtgacttgtgagcaagccaccgaccctctgcttgtggtttgtgaagtggggaaagtaatccctccatctgtgggggctgtcaggattaaacgagatgatgtatgtaaagcccccagcacctacgggttcacagccccttagaaaaagccagctgtcaggcctccctcttgtgtgactgttaggggattaggatgttaatctatcccaggggcctttgcattttcaaagcctctcgctcagttccctgagctctgacacttgccaagcaggaggagaaagcaggcgaccgatgacagtccctgcctcttcttcctgctgggacagaaagctgctcagccaggcatccag

SEQ ID NO: 63309 - DNA, 1984 bp, Bovine  19866880540754
cataaagatgaataacactgagcttagcatgattgcagcctagtgggggagacctgcaggaaccaaaggattagatgcagagagaggcacggacaccaaggaggtgtgggcagggagcgacaggtaacaggaaggtgaagtttcctaggcagcaagagacaataacaagtgaaattcacaaatgagatgctccatcacactaggtagattgaaaaatcaattccatggttcttgaattcccagtcagtttcaagatttgagagtcaatgattgttgggaggaagagatttttcttgggagagaggtgtgggcatgccatttgctggactgcagaggacacatgtgtgcttatggttgggggacactgcagttagagggtgagagaagagctgtctcaccactgaggggcagagctaggaggagttttggctcttatggggccagtatgcactcccaggcttgttgggaatagttcagcatgtgtggcatggagactggtgagccaagagatggagtggaagatgctgctggaggatggaggtgcccagtagagggaatgaaggacctggggaaaaagtctcagcttcaaccacatagtggtcccagagagcttgaaaccacctcaccagagaaccatccctctcttatctcacttctacccatgtaggaggtgattagagatgggcagacactgaccactcaaatgccaactctgtgccttagctgggaagggggagcagaagtctcaatgtgaatgaagtttgaagtgtcgataccttggaccaaaattctttgtttctgaactgagatatatttggttacttctgaggattttgactgcctgttacatgagaggggtaagcaggaaaatctcaggaccggccaagcttccaagggaagatgctctagatgaaataattcaaaaggacttgagggaaacaacagtgagcatgggtgagattacaccacatgctgggcttgttcaatgcgtgggaaacaagcagaaaagcatcaagtcagggtgccaagaacaagtctgataatgtctgtgattctaaaaaacctgttcctgtatcaactgacaacagagagaagagctgtttaatactttcgttcatagcaaaacctacctgcatttgacatctgatgtccccaaagtttgccacaagtgtctctaagcttagcccctagtttctttcttgctggtgatgccatcaggtatggttgtgctggtgatgcacccatagaaatgggagcccacccattaggtgtccaagtcagaggctggcctgaccacccccccaaaaatacatcctgtgtatcagtattcccaggggagataagatgatccagctgctaacaatacaagatccctccctacaacactcaaatggaatgaggaaaataaggcaaatatctggataactgagtttcaaaaaagctcttttccttgaaatttccatttaaaagtgattttttctttttggccatgaattatccagataattttcataacttatacatagccaattttctgtggctgaaggaaacatagtatgttcaaagctaatgactgttaatcataccctgccatggaattccacaccgggtgggagatcttctacgactaacaatctgtctttgcttattctttgacgcaaaagccaattttcctgtgtaaactccgaagcaaaatcattagatgctagcaagtgcttgcatgttgatgcataagatcttccagtgtttttccatttttatgatctctatggaattatccactaagaacacctgtgcccactagtagatgttattatcaatatagaaatatcaacattgtaaaaaaaaaatagaatgcctaatttggcaactggcataaatacttcatgaatattattgtaaaaacattgtacacaaatagtgaatgtcagtaaaatcaagaaaaggaagaatttgaatgaatctgaaacaggagagcaatata

SEQ ID NO: 63310 - DNA, 1362 bp, Bovine  19866880588318
ctattagcagaatgacagattactacataccagaggctttcacagtcaaaacctcgtatattaaatctgacgtcaagctttgaaacggcataataacttagcaccaaagaagaaaagaatgtcaaaaagtctcctgtccttccaccagatataaaatactgagcttgataagaatttatcatttatgtagggtattttttcctgtagctgaacggggaatcacttctttattgcatttgtatgtaacgttcactctttattttcaagggattttgcctgcccaaagagtttatggaagattcagcgggagaaggggcgactgaattccatgactacgagggaggagggattggagaaggcgagggcatgaaggatgtgagtgatcagatagaaaatgaagaacaggtatgttttcatggccatgaaatatgtaaattggatgcagaagcatacactccttttccagtatttaaattacacatataaatgtttttgctattaggttaatggttttcagactgatttaggtaccttaagaatactggagtttagggagtggctataaattaaaagcttgaagacaatagaaaggatattttttttttttttttagttctaccaggttattgctaccaacccatgaccctccaccctcatgcacacatgctcagtcatgtaaccccatggactgcagcctgccaggctcctctgtccatggacttttccaggcaagaatactggagtgggttgccatttccttctccagggaatagaaaggatattttgtagctcagtcattggttgtacctacaatttgggaaggaaatagttttaaaattttttattttaaatgggaacatttttgctgattttctagagaacacttttggtagtagttcatttaaggaccaagagtttggctattttaagtaatgactacattaaacaatagtgccagtgtttgttattaataggttttattgttgtatgtctttgacatgttcagattttaaatatctatatccttttttagttggaatcaagaatgcttttgaaatgtttagatgctttggactaagattcgtgtattactttttaaaattcaatctgatttggatttttttttaaatattctttttgtcatttagtcattagattaatcaactgtgacttgaagaaagaacaagtagtggaatttcattttatcatctctattctaaatgtaaattagtccacaaatttctatttaaggtatggtcatacctattaaaaatagaggaacaaaccgatccagacttcctctcttcctttgaagggaaaattggaaagatataaagaaaccaaaagaataagctcgcattt

SEQ ID NO: 63311 - DNA, 1087 bp, Bovine  19866880625927
ataaatatttacatcagtctcacccattcaacccacagggtctgtcagtaactcccatgagaccgatttaatgaccagggaatgggttgataaccacagcctgaaaaacatcgacccaggtgatcactagagtctttttctatctctaaattccattataaccaacaactggaaaagtaaactggcatgcaatcaaattgtggtaatctgaccaagcagaaagctacaattaaggaaaaagggctaaatgtgtgcaaggtgtttggaaggcattggacaaaataaaatgggaacctcggatggcatacttaagtcacgtcgtctgcagacaatctgttaaacaaaaatacaaacccattgagttcagtgggttatcgtgttatttgggccacataatgcttgagtggcaagtggtcctaagagctctggtcacttttgcagggtgccctcatcccacatccgtcatcatctggatcagttccctcatctctaagccctgctgaagctgctccaagccatgaggtcttcataaaattctcataaaaacatttttaaagagcaccatgcttccagctttcaaattatcattagatacagaaacttccaaaagcctgaagcccctccattctgaccacagtcctctaggctccctgcctcctgctgtagcgccctcgtcccccaactctcagtggctgtccaaatcctcaccaaatgttatctgatgcaatcttaaggtattctctttccttgaggatatttttatgttgagctggaaaatcaaaaaggatgaacttctaaatgtaaaattttaggcacaagggaatgaggagacatgtttagggaaatcctttctgtactcctttgaaacacacctactggggaactagctctttaccttctcgacttgacagtgagccagcctggctacagatacatcaacccacgggcagctggcatccttaataatgaacaacttccttctgttctgtcaagagcagagacaaagatgtgattcaggggcactcaaattgaattattgtctttgtttaaaccttcccactcagatgggagctgtcagctgccgcag

SEQ ID NO: 63312 - DNA, 1803 bp, Bovine  19866880763656
tccgactctttgcaaccccatgaatcgcagcacgccagccctccctgtccctcaccaactcccagagttcactcagactcacgtgtaaaaatatacaataaagctaatggaaatacaggtactccgatgtcaaaaagggacataagaggcacttttcagaaagaatttgggaatttgaaaccagattgttggttacgatttgcggagtttatttcacagcattagcatctgaagatcaaattatcttggattagcagctatggtggatcatcctattgtgcaacgcagaaacttgggttgaatttgatcttgtgtaaaattcatgtagccatcaactgaaagaagacaaataggctggtcatggattggcaattttggcctttttactcatttaatttagcctagtttgttttcttcatcttcaccttcattgtgtattccctgggctaaaaatggcatatttatgtgtgtttaattgtacatattgcagacttaattttaaaaataaaaccatttagacaagactacagcagtgtaaacatttcacagctgcaaaatgtttccttactacccctctttttgtcgctctctcctttatatacattgcatttttcaatttcttttcatcgtttctctagtattgtaaaattatatggtatagggtcttgtctgttaatgacaagtataaaccttgactatttctgtgtaataactttgactttagaccttttattcccatttcaaatattaattttggttcacttctattcagtagtatacactgttctacagttaactttgctctgtgttgaactctggtattgaatgttatggtcaaatctgggttttgaagctttcaaaccaaggtgataggtacattattacatgtccttatgattgcagatcactagtcaagtgttcctggagaaagaaactgacttcttggcaacaacaacacttaggtaaaattataaactaattttagacaagaaaaagaaaaacacagaagagcatcaattgctgctttttttttttttccatacagtccaaggatacagaacttttattaaacagcggatagtgggagtgggccaacctcgagggacagaccaattgctgccatttgatatgaattagacaatgaataaaatatgtttttctgaaatgataagtgacattctagatttttaaaaactggccagctatcatatttccctgaaaaaaattaaaatattgaatgaaatctctcttctctcataagtgagcttgaatgaacttttctcctaagccatatcaatttataacaaaggaagctagtttcagtgaagttaaatagcttataataacaaaaattaaatatgtgttaactgacataaaatgcattagagcaaatagagaggtgaaaagcaccttttgaagaacattttaatctgattcatacttattactttaaaaaaacatgtaatttcaaggaatgatctctagaaaggaaatgaacattttcaattctaatgttatcaaaaaatacattaacagtttttaatttttcaaggccaatacacaggaagcctttattaaaaatgtatctagttttgttaagtgtttaccatacatgtctctttttagaaatactttttatcatagcctataatgagagattactcaaaacaaatcatctgctttgctgatacgtagttatctagagctgctgatgtttggtagctgttatagactgaattgcacttccccaaattcataggttgaagttctgactcccaatgcgactgtcttttgaagataggg

SEQ ID NO: 63313 - DNA, 1853 bp, Bovine  19866880821800
gactctgtggggtcttcctgggacagacccttcccccatatcctctgctatagctcatctctgaagtgcccaggtaatggtatctgatgcacacacttccggagttgttttacagatgctaaaacccccaccaaatggaagaaattaactacctgatgacaatgagaccccagacccatgggagcctaaggataacataaaccacccagttaccccagcgtcaatcagtcagagaactgtgcaagagtgggccacatgccctgagatcccctcgtccctcacctgggttttaaaattgctttgctgaagctcttcggggagctcagggtattctgagcacgaggcctttccagcctcacacacacccagctcccttgcttggccctgcaataaaactcactctgctccaaagtccgcttcagtttgtttggcctcactgtgcatcaggcacacaaacttgcatttggtaacattaatgagattccaaactgaatatattcggaatcaatcaaacatcttcctcataattgtgttgggtcatatggtttaaacgttcctgtttgcattcgtgtttatcatctaatgcaggtggctggactgctgagaacacaaaagcaggctttatctagcaatgatacgtgcaaaggccaggccaggtcatgctgggcagtggggtctcaaccacctgaccaagacaatgggtaggagaactaagctatcatggagcgactggtaaagacaggcctgctgaacaaggaacccgggccacagctctcacttccaggtctgggagcaaacactatggatcccatctctgtatacaccaacttacaacagttttgtcatggtaaatgtaaaagtgaatgcaataacgtgagtgattttcatactaacacagaacaaagggaccaatctaatgttttacaagttatatggctaatttcatgtacgtctcctatcatgttgctgaaggttaattttttttttccttccagtatgtctagaagttaaatttggctggaggggaagacagcttgaggactacacttacgcatttcatattactttctcccacacataaacaattcttgatcaatgggagaagtcagagcacaggaaataccaaatggaggtgaactgccttgttttttatttgattatggcatgctttatggaagtcattttgtggctaattcatttccttaattatacttgccctagagcaatattacatgagtttatattccccaatattggaaggggaaggtcccagaacacacaggatatgagaaggaagccaagctgaatgtttttttaaatttagctgaaaaaagctgttaggtgtgaattctgagaaaggatgaaaattcagcaatacatatccaaagcctctaactgtggtttgctctctgacccagaaatcccactttcagaaactgacccaaaagtagtacctctagaggtcagaaaggatttacttgcaagaatatcaggaaaggggtcagtagagatgggttcagtcatggaatgaggagatgatgccttatagtaagtgtttactttatgcaagggtctattctaagcactcaacatctgtctcctcatttaattctcaaagcagaccagtcgagcgggtatgattgttctccccattttacagaagactagggggagacacacagcagttaaataacttgcccagctgataagaggcaaaggttgaggtatgcacccagagtctgactctagggtctctgccctgtcctctcaatggatctttagaagtcatgtaaaatgatgtaatataactgcgatagaagcatagaatatctcattttcatgagatagtgtga

SEQ ID NO: 63314 - DNA, 1475 bp, Bovine  19866880874139
aatttccttataatattttctcatattagtcaattaaaaaaaattttttttggtctgaaaacaagcatacattttccttctgtttcgactagcctactctttgtatcttcaatggaacatttttttaatggaactttaaatatatatatataattttaatttatttttggctgtgctgggtgttcctttctgtgcaggctgtctctagatgcagagagtaggggctgctctaactgtggtgctcaggcttctcattgcagtggcctctcttgctgtgaagcacaggctgcacggtgagagggctttcagtagttgcggtgccagctcagtagttacggttcccaggctctctagagcacaggctcaatagttgtggcacaccaatttagtcgctctatggcatgtgggggagaaggacatggcaccccactccagtactcttgcctgaaaaatctcatggacggaggggcttggtaggcttcagtccacggggttgtgaagaatcggagatgactgagcaacttcactttcacttttcattttcatgcattggagaaggaaatggcaccccactccagtgttcttgcctggagaatcccacggacggaggagcctggtgggctgctgtctatggggtcgcacagagtcgaagcgacttagcagcagcagtagtatacaaactgacactgacaccactacctggtctgaaaggtatgaagtactttaagagaaagacagaagatccacagtgtggaggggttgactatggtcctcatttattaatttcagtgcattaagatacagaagcagtttacatgtgcccagttaagaggatttacagatttagattttattaaataaaaaatgggcaatattcccacaaactaaagataattccaataacattagcaaaaaccaattataaaatggcagagataataattattttactcttagcaatatctaagttagaaacaatgaaaatctaaacaaagtcacacagttgtgtctgactctttgtgactccaaggaattctccaggccagaatactggagttggtagctgttcccttctccagaggatcttcccaacccagggattgaacccaggtctcccacattgcaggtggattctttatgagctgagctaccagggaagcccaacagatactataagtcagccaaaacataaaaattattaaaagactatttaagtataagaggagataagcaatctatctgataagatatttaaagtaataatcataaatatgctcaaagaactcaggagaagaatggatgaacagaaagagaagttttaaacaaagagttggaaaatataaaaaagaactacacagagctaaacaatacagtaactgaaataagaaatacactagaagaaatcaacagtagattaaatgatacagagtaacagatgagcaaagtggaagacaaagtagtgataatcactcaag

SEQ ID NO: 63315 - DNA, 1450 bp, Bovine  19866880896124
gaaggaagttaaattaagacaggaatcaggagagaattcctatcccacgctgttctgaactcatgccaccctgagcaagtcactagctttatttcacatcacttctataggctaaatggtggagagaaattggccttgacccacttgataagcgtactgggaggtggttcattttcctaaaatgctccgaactgctccaaaaaaagtagggagccaaaaactcaatgatgcaaagtgaaatgatctttgagtaacagaaaaagaggtcacatggtatttaataatggaagccaaaggagattctattccagtggtacacaatctgaggtttaggactattctctattgtaaattttaccatattagggaggagagagtcctaaaaattatgtttttcctataccagaaaagggcttcccttgtggctcagctggtaaagagactgccagcaatgcgggagacctaggttcgatccctgggttgggaagattcccctggagaaaggaaaggctacccgctccagtactctggcctagagaattccacggactgcatagcccatgggggtgcaaagagctggacaaggctgagcgacttacactttcataccggaaaataacttcagaagacatgtgatctcatcaacttacctgagcaatcttggttttcttttgctggaatttgcagagccgcagaatctgggaccctgagtagtcactaaactgttcgtggaatggatgtaatagctttacagactctccaaaacttggaggagaaaaaccaaacaatgggaattactttttgtcatggcaaaaaaggttgggtttcccaaagggattaaaaggcacctttacctgcatactgcaatctgaccaacttccagaagggttagagcatttccaatcacagccaaagactcaaaggcaagctgtaaaacagaaaacggagggttgaaggcatcagggtattcttgacaccaatgcctttcaactctttatacaacgagtcccacaggaaacgctatttctttggtatggcacacaggggaacaccatcaatatggctgttcaccaactcagaggccttggtagtcttcggccctgactaatgccacaggcaccaaacccagtatctgttatagtagtaggaaaggtctgctttagcattacccaatataagtgatctccggaaacttggtccataaattatggtttccccctgcttttttgactacataatctctcatggataaaagattttattagcctatttattctaatctatgcatacatgatggtatagttttagaatttaaattcaactgaaaagaagatatttatagcaactaacacctactgaacatgtatcaagtacctggcactgaaccgagtgctctatatatgttatttcatttagacttcataacaactatgagtttgagttaagtatt

SEQ ID NO: 63316 - DNA, 790 bp, Bovine  19866880935903
ttacctgcagcttcagtatattgttctgtatgattcaaggcattagacccaatgtaaaaatatggatgaatcccgggaaccacaaaagaaacatttccaaaatcggtagatccttggaaaggtaagacgaatcatgaatttttaattgctagtccaacagagcacatgtaccttaatctctatacatctgacatgatttataactccttcccttccagaaattctctacccttttggtttccatgactccactctctactgactggctttctctatgactccctctctagtcacttctgttgcctgtttcctgagcactggtgatccctagggcttcatctctgggttactccttcctctgtgtcctcaggcaacctcctcaacattgaaacctatgtcttcaatcacctctcatgtgttgacaacccctaagtctggacctagacaacttttggaataggctattgaacagctttcctgagaagtcctatgaagacctcaaatttaacaaatgaataatttataccaacccaccctacttcagcctgctctttcccttgaactcttatctcgttgaatgacatcaacaccctgtttttatctccaagtccccctgagtctacatcatcaatatctaccatattttaggagatacatttctaacatgtaaacatgttaacaataatgctctttaaagcacacacaaaaaaaacctaaaataacctgatatacttatgcatgtttaaattctaatagttggttggtatttctcagaaactgaaaatgtccc

SEQ ID NO: 63317 - DNA, 967 bp, Bovine  19866881000586
gtcttgcattaaaaataggaatgtattctacaggcatttggtctccccagggaattcattcttgctgcagcacaccagccgcggttgctagctattttcctgcccttggtataagccgaacactggccaaagcagaatcagccccctgcccataggagctgctgccctcggggaaatgggggcagggttttgggcagaaagggtattcagagggttcctgttgatagtcattttcccatctccaggatcaacaattctggctttaggaatgaggggagaaaatagtaatattagcacaggtcaaactcaaacccctcttcctttctgtgattactcaagttgggaagttggttttctgctgcttcaacaagtggtcttggaagatgcacctgcgatgtagagggcctttgacagcccttgaaagagctccctgccttctcccttccccttttcctgcagagactctgttcagaggaggatttctgagacaaactatcagttcacaaacactgggaacagtttctcaaccagcccctagtctcctgtgctgctgcggtccctgtgttgggaaccctctgcctaaagggctgggttgggagagtctctgggtctctgctgttcccacaaagcgaacatctccctaattgctgtcctaaagacagttccttacagatttcaactcttctcatatcccccctcctttacaacctgtgcattcatctctgttttactgctgaaagaatgcagacttcgtttctctgtcgtctgaacatcattgacaagcattccacccatctgtgaattattccctgactctttgatcagagcggtgttacaggtcctctgccagcaggagggagcagtccaacaaaatctgaagacccaggactttgagaagctgtgccgggcagactaggaagccacaaaacattgcgagctgaggatgtcctagtatgctttttccatg

SEQ ID NO: 63318 - DNA, 1019 bp, Bovine  19866881263742
tttgcttcctaaaagcagatgagtatactccactgagttttcagtgaaaactgtaccagtttttgtcaggtgtttaaagaggtctgctaaagctcgctgcttctgcatgagaatgtgcttggcttccgaccgctgcttctccttctctgcggaggggtccacctttaagctctgaagctcactcataaaggagattacgtcgcctgcagggaagacaagggagaaacatggaaatccccaggaattcttaatatactcagattacccaagaccaaggacattttggaaacaaacaccaagtgtcattcatctttatatctaacagccctcagcactggtaaattctcaataacaactgatgacacgcatgacaagagaaaaatcggaaacaatctatcttgacaacaaacaacccaaataaaagtagctaatctttttatccaggggttttataatcagtcaagcaaaaaacacttattgaacatggatcatgtgccatgatttacactaggaactttaaaacacttgaatgaacttcccataactacaatatgaactagcttctatgctgtaccatgtgcttcgaaaacattcttttaacctgtacagctccagaacttctttgtagccactctaagaggctcagaaagtctagtcattttccaaaggccattcagctacagagcagacttgaagccaggacttgaaccctggctgaactgactccaatgcccagattctttctctgccttcctgagtagccacaggaaccgagaacacgaaggtgctgccaatctgccacaggtagtgtcatgtcctgccaagtccatgccgaagtcctaatctcccaggacctcagaatacgactgtgtttagagatggggcctttaaggagcccatgaagccttgtatgtggactctaatctaatatggctggcaaccttaatagaggagacagggacacagaaaaggcatctacaaggagagagcctcagaaaaaaaccaaccctgctgacatt

SEQ ID NO: 63319 - DNA, 921 bp, Bovine  19866881402516
ttgggtaataatgtcttttctcttagaaaagtgagataaagcatcctatggttctccttcaaggaaagtacttgctagtacaaatggattcactgcttcttctagttggaacatatttatttgcccatatcttccattctattgattcctctatctaacagtgacataaccatgaaaacagaagccaagagaaagaacagatcacagtgttggctgaattcccagacaggagcacacctctccatccactggtcggggcaagggggtgcatggccacaggcacactgagccacctcttgtctccacagacaagctctctgggtcacagagcaacagagattaggcctcccgtgcttacgactcctaaaactgactgaggttaacaaagcttcctatgaatgcccatgacagcatttttagatctgtgtggggcaaataatctcaaccatctttttaacccctaacgttccaatgcagaagatgaacaaatagatttgctcctcaaagcaccctttctgctttctaaatggtcttccattgcacagcatgaggagtgaagggaccaggagagctccgtgcggctgctggtggaacctctccacccggcataaggtctgactttcagcatcaggttatacatgtatcttgggaacattttcaaagcaagtcctcctgaccgcgtttcctgcatcctttatttattactccaacctgggcccttcctgctgggctggcctggccccaagctggaatgctgtaagtggaaggcctgatgcagtctgggcactgtgccaagtgaggaccactgatgctctgtctctttgagtaggaactaggctccttaactccctgctgccactgaagggttttattactcacttaaggtcaccccagaatcaggtcacacaaaaagggattcca

SEQ ID NO: 63320 - DNA, 1760 bp, Bovine  19866880110382
gcatctggtcccatcacttctggcaaatagatggggaaacagtggaaacagtgtcagactttatttttggggggctccaaaatcactgcagatggtgactgcagccatgaaattaaaagacgcttactccttggaaggaaagttatgaccaacctagatagcatattcaaaagcagagacattactttgccaacaaaggttcgtcctagtcaaggctatggtttttcctgtggtcatgtatggatgtgagagttggactgtgaagaaggctgagtgccaaaaaattgatgcttttgaactgtggtgttggagaagactcttgagagtcccttggactgcaaggagatccacccagtccattctgaaggagatcagccctgggatttctttggaaggaatgatgctgaagctgaaactctagtactttggccacctcatgcgaagagctgactcattggaaaagactctgatgctgggagggattgggggcaggaggagaaggggacggcagaggatgagatggctggatggcatcactgactcgatggacgtgagtcttggtggaactccgggagttggtgatagagaaggaggcctggcatgctgagattcatggggtcgcaaagagtcagacccaactgagctactgaactgaactgaactgaactgtggtccatgtgatcagtttgattagttttccgtgattgtggatttcattctgtccacagtctgacagataagaggcttatggaagcttcctgatgggagagactgactgagggggaaactgggtctttttctgatgggtggggccatgttcagtaaatctttaatccactttcctgttgataggcagggctgtgttctgtccctgttgtttgaaactatggtggaggtaatgaagataatggtgacctccttcaaaaggttccatgcacacagtgctgcactcagtgcctctgaccctgcagcaggccaccgccaaccctcacctctgccagaaactcctggacatgcacaggcaagtctggctcagtctcttgcggggtcactgctcctttctcctgggtcctggtgcacactgccactgctgcttctaggagactctcctggagaggtgggagggtgtgtcagcaggagccatatttcagacctcattctagaagctggtgctggagacttgttagctcattggtggcaacacctggccacacttggccccacctgacatcctggaccaaatgcctcaggttagatgccttggcttctaattcactgctaaaagctactgagcacagcgtgcctgtttctggtcactgtgtccctagtttgtttgctttctgcacccaagtccctgttcccaccccttgcccatcctccaaatgactcttggcccctagcctctgtccccagagactggagtcccagcacaaaccaattcctctggccacagccctgctgtttgctaactggcatccccaaaactgatacagtctgggctttggggggaagaaaaggactcttctacatcttgattgttgatccttcaggcatctgggatatgtgggaagtcagttctctccctcacaggtgaagatgctgaggcctagacacaaacctaaggccacacagcttacaagtacagaatcaaatttcaaaccagacttggcaaggccaaagacagatctgtccgaccttaacactcacctgtacccactgtactttgtggttttcagactattccccaggaatttaaagtc

SEQ ID NO: 63321 - DNA, 1501 bp, Bovine  19866880384718
ctctcttagctgttgtttgtgacctttacttcgctaagctgggaggaattccccagtgctggagcgctggtgatgctgcattcactcatgactaatttgaattgggcgtcattgaatctgcctactccattattacacagcgagattgtcagctctacactctcagcctccttccaacacccactcactcccaaacatgcaaacactccaaattgggcagtggggaggtggcaaatgcttgcagtgtgagaaaggggctgggtttccttttgaatgaatgttaaagctttggttaaaaggagagcatgagcattgcattatcctccccacagacaggttcttaactgcctcctcaaatccacaaatgctgaagggaacagccccaccatcccctgagttctgaatgactgggaggacggagatgctgttctggtcactgggacaacagtctcagtatcaacccagcctgtgggcgacagctgtcaccctccccagagcaggcctgaggagcagtaggtaataaggctccagatcttcagtggacagtcatacctgcctgacctcagactcctggatggaccaagggagatggccagtctgtggaaggttggctgcgcccatccattgaggcaggtcccccagacagggttctgaggccaagccagagaacataccaagcctcagactccagtcatccctggaggggctaaactctcagagaactggaccacataaggagggccagaggccagaaagcaggaatgaggaggactttaagttccgcaaagtcagaaggcagtagggtgaggtaagggggtgaccacagtgggcactgccaggaagaggcacagaggtatgcccatggaggggctcctctaggacacacttcactgatgtgggttcatgccatgcccaagcatcctgggttagaccctggaccctgaatctggattcaaatcctggctccaacccacttactcaaggtgcagatggagtaaattctttttttcttaacattagcattttattttattttttaatataaatttatttattttaattggaggctaattactttacaatattgtattggttttgccatacatcaacatgaatctgccacagctgtacacatgttccccatcctgaatccccctcccacctccctccccataccatccctctgggtcatcccagtgcaccagccccaagcatcctgtatcatgcatcgagcctggtctggcaattcttaacatccctgttcttcagttacctcttctgaaatgaaaagaataatatttcctacagtctaagattttgtaaagattgaattaatatttttaaaacctctggaacaggcactacatttgttttagtaaataaaatttcttctttcagcttttaaccaagacaagaacagaagctgcaaggaacatgctcccatcagaccaaaagaggagagtagcaatgtaggtcaacttctttagtgattattgaactg

SEQ ID NO: 63322 - DNA, 1643 bp, Bovine  19866880387293
aaaaatcaattatcattcacatttgccttcacactctgacaaagacttgcattgagggcaactaaaaccaaagcacagtaacagtgtttgggagtccttggaaacttgtattcacaggcagctttgaataatgtggcatcacagggaacaatataaccagcattacataagatattaaggaacttcatagtcaagaaaatctatattgtttcaatgcaaacaggttcagaaaaaacctgtttttgaaaaacatttttaaaccattttaaatttaagtatgtataattaacctatcatgtgttaatttcaagtgtatagcaaaataattcagatatagatatagagatatatcatgtatatactttttcagattcttttccattataggttattataagatattgaatatggctccctgtactgttcagtaggtccttgtttatctgtgttatatacagtgctgggtatatgtgaattccaaactcttaatttatctctcccctcaccctattatctcctttagtaaccataaatttgtcttctgacaaatttgtgtttgtgagtctatttctgttttgtaaataagttcatttgtatcattttttagattccatatataagtgatgttataggataattgtctttctgcctgacttacttcacttaatatgataatctctgtatatataatgatatattccattgtatatacataccacatcttctttatccattcctctgtgatggccatttaggttgcttccatgtcttggctattgtaaacagtgctgcagtgaacattggagtacatgtatcttttcaaatcagaattttttccagatatattcctaggagtgggatatctagattatattgtaactctatttttaggtttttaaggaaacatcatactgttctccatagtggctgtttcaacttacattttcacttaacggtatagaagggttcctttttctccacactctctctagcatttattgtttgtagactttttgatgatggctactgatgccttctgtgagtatggtttcagtgtgtttgccctctgatgccctcttgcaacacttaccatcttacttgggtttctcttaccttgggcgtggggtatctcttcaaggctgctccagcaaagcgcagccattgctccttacctaggatgaggggtatctcctcaccactgcccttcctgaccttcaacgtgggatagctcctctaggccctcctgcgcccgcacagccactgaaaccatactcacagaaaactagtcaatctaatcacagtaggaccatagccttgtctaactaaatgaaactaagccatgcccgtggggcaacccaagatgggcgggtcatggtggagagatttgacagaatgtggtccactggagaaggtaacggcaaaccacttcagtattcttgccttgagaaccccatgaacagtatgaaaaggcaaaatgataggatactgaaagagaaactccccaggtcaataggagcccaatatgctactggagatcagtggagaaataacttcagaaagaatgaagggatacagtcaaagcaaaaagaatacccagctgggatggactggtgatagacgcaaggtccgatgctgtaaagagc

SEQ ID NO: 63323 - DNA, 1229 bp, Bovine  19866880403765
tatggatgtacagttggactataaagatagttgagtgccgaagaattgatgcttttgaactgtggtgttggagaagactcttgagagtcccttggactgcaaggagatccaaccagtccatcttaaaggaaatcagtcctgaatattcattggaaggactgatgctgaagttgaaactccaatacttcggccacctgatgcgaagaactgactcattggaaaagaccttgatgctgggaaagattgaaggcaggaggagaaggggacgacaaaggacaaagtggttggatggcatcaccgtctcaatggacatgagtttgattaaactccgggagtgtccgatggacagggaggcctggcattctgcagtccatggggttgcaaagagtcagacacaaatgagcgactaaactgaactgaactgaagacgggtagttaaataatttttttaaatatttaaaaattggaacttgataagtgaaatttggaaaatactctacggatgacttcctttaagtaactgcacattgaacctaaatctggctgggaataaaaaggatttgtcctttatgaattcacatcaagcaggctgggaaggtgatcagaggggagggtggccttctggccctactgaattgtgcccatgaaccaaagcccccactgctgagaagtaaggctagccctatttcagcagcacaatgattgggagttctgccaagaatgaaacaactatcctgcagctgttatctcatttgtatgagtaatatgaaaaacgctgcacaatttaatatgccatctcgtgcttttattcttatctcaccaggagggcaggtggtagtatacatgtttgaaagccaatgcagattgatatgggggagggccccaagaaatgatgtgagctgctatctgagctgagtaaaatgatatgagcacagatattattttatataggcaatctcacttgtatctttgccggtgagatcttaatcacagcatgcaatgggaatggaaacctcccctcctagttatctgggtgtggggcgacagcattgtcatcactgggagaacggttatctgttatttcactcgtgagataccaataggaacagtatgagggtgtttgtaaccaaactgtgcagctctgagtgataaaagcaggaggaggaggctcatctccaggagcgtggagataatgcctcttgctcggggaggagatggatggtattgtt

SEQ ID NO: 63324 - DNA, 4564 bp, Bovine  19866880420556
tgaagtgatgggaccgatgcctgatcttcgttttctgaatgttgagctttaggccaactttttcactctcctcttttactttcatcgagaggctttttagttcctcctcactttcttccatgatggtgatgtcatctgcatgtctgaggttattgatatttctcctggaaatcttgattccagcttgtgcttcttccagcctggcgtttctcatgatgtactctgcatataagttaaataagcagggtgacaatatatagtcttgatgtactccttttcctatttggaaccagtctgttgttccatgtccagttctaactgttgcttcctggcctgcatataggtttctcaagaggcagatcaggtggtctggtattcccatctcttgaagaattttccacagttgattgtgatccacacagtcaaaagctttggcatagtcaataaagcagaaatagatgtttttctggaactctcttgcttttttgatgatccagcggatgttggcaatttgatctctggttcctctgccttgaggaaaaatactaagtcccatctccttctccctctatcccaacacctaatttttcatactaggaaatgagacaaaatagttaagtgactttccccaaaccacacagctgacccatggttataccacgatttgaacccaggactgtcagatttcaagtgtataccacaatgctttccattttctgtgtgtactcaaacttcatgatcttgttcttcatgattttgttctgtatgttctctcaggacctttgggtttgattcttctgtttctgaatatctgacctcatatgatggaagcagctgttacttgagtagctcttatttcagtttatgtcattaagaccctcttgaccagtaagcatgtttccctggtggctcaaacgataaagaatctgcctgcaatgcaggagacctgggtttgatccctgggttgggaagatcccctggagaagaaaaatggcaacccaatacagtactggaagtgggatctaactgcttgctgctcaaaagcgaataaagagggggaggttagttgaaaggaaagcttgctttatttcagaggctggcaacctgggaggggagagggggaagggtaaactcatgtccaaaggccaattcctgcccctccagcccccacctgaccccactgacaaaaaggaggcaagagctttaataggtggagtgaggggactacatgcagaaacagcacagtcattctgacagtcatcttgaaattggttatgcggtggttattttgatcagcttcactttgttttaagtactgttaatcttctgttccatggtcagttcattatcattttttgaggctaattcttggaattgcagcagtttatgtcaaggctacaatctggtcatcatgtagttaacttcttccacctggtggggatctcagtatctacaagacacctcgaaggattgtatttgtttagtgataaaactgtttggtcttgtttgactattttcctttgcttctgcattttctcacttctctgattgggcttattctttgactgaaatttttctatagacaaaggcgggtggaggatatggagatagggaagaagtatagcgtcctgctctgtttcaagtacatcctctggtgctcacggcagaccagggctgctgaatgcatgctgctctgggggaggtggtgcccaaaaggcttgtgtctgcaaagcctggggtcaagaccacagcagaggcactgagagggctgtggcccccagaagcctacaccatcctctgcagctgatgctgtgggctccaggggccttcccatgcttccttcagcctggaacacccttctttttccttctctgaggaaggttcatgtcaagagccattgcagctcagttaacgcctcatgagggcttttcctctaactgagccagtgagtgaaatgatcacagctctcctctaagtgggtgaaacagagtttcaaatttctcagctgtttccagaaccctagcatattttactgctgggaggacagatgcctgctcaagtgtctgatgaaaacacttaacttttatcgttgtttgacattcattagggaaccgtcttctgtaggcaaaatacaagacaattctttaggcaagagacataaaagggctaatggtgggtcataggccagatggtatggaaacaagatgagctgagccctggagccacaccagctttgtcctccactgcctcggagaaatgagtgggtgtggagaagagagaaagaaatgactccagggcaccggtgagggtgccattgagcaaacatggaggcccatatgtggggaggtgggtcacacagtcccctttcccagctgagatttgaagaaacagttgttgaattaatgatcaggaaatgaggaccagtgtttattggagcccaaagctatgtctgcaaattccttgggttctcacagtaaacctgaagaatgcagctagttccagatcctgggatagggagatgagggtgagataaatgaaattgaccaaagacacatggttcattagtggtgctgctggagttcaaacccagatctacctgggtgtcaagtccccttttattaatatttccctacacttcaagaatcctgaaaccaaatacttattttttacctccaaagaaagagcagaaaggggatgagggagggaaatcaacaagcgagggctatagggtaaggaagtaaagtctgaaatctccctcactttgctataggcatctcaagactcttctgttactgtttcctagctgactcttgaggtgcagatggaggactaatgggagtttgtgatggcagagcattggctcagcgtccagggagcagtgcctcctccacaactgcccctcagaggaaggaagaagaaatgattgacttgccacagggtatttttaaattagatatatagatgggaggctttactgtgaagacttcttcctgattaaatgtttctggttcctttgatcacatctcctcagaaagtttctcttgctttccccaatgaggtcacggaatttcacaaaaggaaagtccctattaatcagcctaatgtaatttgggggcaatctggcttgaaagtggggtcatctctgcaaatttctccagatgtacatatgcagagatgccaacattttctgtaccgaaccaagtattctctaactatttagcttagttactgctgcctacttatatattttaaaaatttatttaaaaaattttaatggagtataattgctttatgatgtgctagtttctgctgtacaacaaagtgaatcagctatatatatatatatatatatatatatacacacacacacacacacacacacacacatatcccctccctcttgagcctccttcccaccctcctatcctacccctctaggtcatcacaaagcactgaactgagctccttttaacctgaattttcttttccttccccaaccccagtgccttctttcctatcaacccaactatatgttcttaaaggaaaggaatctccctcttgcttggaaattcatctcaagttgctggggctgggctatttccttgattgtgaagtagtgaaggaaagcatccccttggcccccttctagggagagggctgccatatactaagactgattaaactccatctggtgggtatgttctgatgagtttttcctcgaggaagttttaagttgataccagttgtgggtttcccatgttttaggggtccaagcaatctaaaatgtgggagtcacctactgctctctgtccataaagccatgctgtcaattgaaggaactaagcaaagcagatgcatgtgaactcacaatctcagcatggtttcattttaatgctagctgtcctatttggagcaagagtaattagaaaatcagcagcaagttaggggaaaaaaatgctgaggtttataatgacctgggcagggagagagaatctgggatccatttactgaaggtctcattaaattctccaccaggagagtcaagctgctactgcagaactgtggaagaagcagtggaggcagctgtgaaggaaggaggccaggaatggggctgggggccacgttcaccttgtcctgaagcctggggctctctgtgctttttgcgtcctactaactgtcacctccatgttgtgcttggtcagagggtctccaggtcagtgttctcacatagtctctctccttctgtccagccctccccttcctttcctcattgatcactccatgtagcgccccaaccccgaccctgactcatttctctctctccctcctccttggctgtggctgggtttatgtgtgcgtgttgggtttgaacatttgtaactctcaagcagtcatcagggatgcaatgccctttccacatgtatctagtggtaggttgaattgtgcccccgtcctctaaagagatatgttgaaatcctaaccccccaaaccccaccttttgggaaataatcattgcaaatgtaatgtaaggattaaatcacactcagtcagagtgggctctaat

SEQ ID NO: 63325 - DNA, 2067 bp, Bovine  19866880442266
gaggtctggcgtgctgcgattcatggggttgcaaagagtcggacacagctgagcgactgatctgatctgatctgatctgttctgatatttacacagatgttaagaaaaagagagaaaagaaagctggggagagagacacagagaaacatttctaaaaatgagaagattctatgaatgctatttataaatttaattttttttcttgaatttaacagaagataaagaaattaagggtttcccagggagctcagtggtaaagaatccacctgccaatgcaagagaagcaagctcaattcctgagtcaggaagaacccctggagaaagaaatggcaacccactccagtgttcttgcctggaaaatcccatggacagagaagcctagaagtttacagtccataaagtcacaaagagttggacatgacttagtgactaaacaacaaagaaactgaaggaaatttgactcatagtacattaaatgtttcattaacttaaaaattaaggttaaagaaaaattttaaatgttatgagaaccatggcaagttgtagttacattttttaactagaattttaaatagtattgactaacttgctgcttcaagtagcatggaggtgataatactctcatacttcctcccactcctctacccttcaatgtctactgattaggctggttcattttgccagagttataatagtagcattctatgctgcaaccacactttgctgagaaaaaaaatagttttttattcaaatgaattcattgctcaccactaacccttttttatagctttgtcaaacctgatctcattgccaaagagctctggtttatgtaagcgggtcatatttaagactgctgtctgttgccttcttacgtgggcaactgcttggctgcatatagttttcttagtcttactttccaaacctcagaactttataaacagtgtgccatcatctttgaacataggaagttatcatagaatatagcaggatagactcatttttcccactgtcaggaattgctttgtgcctacatgtctgaggaatgccttctttattctttaaattcaatcatttaacctagaaaaatcagtcattctctctctctttttttttttttttttcatttggggggtacccttccacatgtgggtttgcaagtttgaatattctctgaattcttcctctttgtaggattctctattacaagaacacccattaccttattttgaatcacttttgtttcacttcctcttccttctaactattaattctttttttttcttcttcctctatattcaatgggattatctctagctttcacttcataccattaattcagtttttagctctgtctattctgttctttgctattttatgttgtaaaaagtgaaaacgttaatagctcagtcatgtccagctctttgcaaccccatggactgtagtctgccagactcccccatccatggaattccccaggccagaaaactggatcaggaagccattcccatcttcaggggatcactctgtttaattcatttccttcagttcagttcagttcagtcgctcagttgtgtccgtctctttgagaccccatgaattgcagcacgccaggcctccctgtccatcaccaactcccagagttcacccaaactcacatccatcgagtcagtgatgccatccagccatctcatcttctgtcgtccccttctcctcctgccctcaatccctcccagtatcagagtcttttccaatgagtcaactctttgtatgaggtggccaaagtactggagtttcagctttagcatcagtccttccttaggtctgcaatatccttttatagctcatcctgttgtattaccatctcatctttcagattttgttctttcacatttataaccctactaatttattctccacaaagagtgtccacaaagagtcagacacgactgagcaactaaactgaactgaatttattctctaatgaaaacgttggtgaggaagccacttctgccacctgattcgtgtttcttccagactgggctcttcatctgactttttgactaattg

SEQ ID NO: 63326 - DNA, 1369 bp, Bovine  19866880503878
cagaagcaccactccctcactttacttctaactcattggccagaattctgtcatgggtaagcagaatgtaattaacaaggtcaattcatacgaagagagatttacctcctgggactgagatgaggtccagtaggtgacagctgggtacctaaacaaaatcggttctgtcataaggcaaggaatgcactttcaagcagtccaagccagggaagaaagccagagaaagatggtactccctattggagcatggctccttctataaagtcactacagaggaacaaaaccctttctgaaatgttccttcagggcagaaaccagggtggaaactgattcttcacaagcccgtcccttggacactgtcccaggtactgtatgatttgaggtactgtatgatttctcagtcatctagaaagactcagtccctgggttcttccaggatccatcatttcaagtcaaaatgtctgagagcttttaagggcaagcatacagtatattttgctccacaattgaaagtaaagattcagtagtttcagagacagttcttattcaggcctgaactcattcttccgcacgtctttcagagccattaaatcctcagtgatgaggcactggatgataactgctttccctggatgctatctgacgtcactggtaagagcaatcctgcacttccaagcactctcttcattactctgatagacatcatatttaagactaattcattaggatgatatttcatattacattagagaatgcactatataatccgaatgtgaaggtgaagaaaatttctcctcctctctcttacctgctactgcaaaatgaaagggcgccatcgacctgtaaaaggcaacgacctcattcactttaataacctctaccctttgcccgtggtgtgtgcactctcaaccaaggcagaagaatttatgggaccacttgggttctagtccaccatcacctttagcaatcttaattaatctctgaggtaatcattcccatttcttaaaaatgggccaagttaattggcatgaagttcactttaaaattctgtctcccttcagatgctctacaagtttctgaaaagagccccttagcatgaaaatgaagagctgaggtttcccagctggtggagatttgcaaaggactctaaaaggtgatacatacttagatttattttctttagttttaggttggtacaactttaagagactaaggattgtttagagtggggaagggtgccatggagccagccatccgcacctctgctggtcagatagatggaaaagagttgtggttgacatggcacaatgccaagagcaccagaaaatccttccaaattctgtctgctctaaaatgcaacaactgtctt

SEQ ID NO: 63327 - DNA, 1643 bp, Bovine  19866880739044
tttcatgggtatgcaagacgatggcaaaagttaattcggggtaaacatgagctaatcatcactgaccaactaggaaaaatacaatttacaaaacacggaggatgccttcctgcttcatttaatcagagtgcaaaagaacccctccccagccccgttgaattttgctggattattgttatcaaccaatgtggattaaaggatgaagcagggattgatcattgtctcctctgtgtctcaggcctgtacatgtgaaccgtcccagacacttagctcatcttgggtcatcagtcaggtcattcacactcctagaagcagatctctgattaactgctgccctgtggtgctcccacaagctcagcctggatgcttggcaggcccacaactaacccatggtgggtttggagattaaatccttcctgcccaactgcctatcaataacctgtatgtcctattcagctctggatccacacaggtttcctgaaagctctgcaagagaagaggccacatgctcaagacagctcttctacaggcattcagggccatgtttgggatagttgtcctgaggtcatgacctggacatgagatgatagaacttaggagttggccagagcaggagagatcatcatcatgatctctggcaggctttgtttaggataatgaccaggaaggacagagacaaagactggcagggaaagcatcactatggcagagctctgggtgcctgaggttacagatacctagaaaagctcggaacagaattttctctgacagctctcagggacctctgctacctctaaatcaatgctttccaaccctaaacactcactttcattaatctgattttgggttggtggggttttgtttttgcatttaaaataacatatataagcacatatgaagtgactttatcatggagccacttttcttgggtgaataagatagtcttgacagaaagtttgcttctctaacacctggcacttgccatcttgtgtcatccttaccccgtcttcatggtgctagttaatttgtgtttccaaccagtatggacactacagggttgaacacaatcctgtgtgtggtgtctactgggaaatgccccatgagggttggttctctctgaggggggtctatgctgtgagccagcctagaggaggcaagtagaaccctcatcctggagtcatgagtggctaaaattttgggtgtctgaacatatggttcaggacctcaaagagagccctgtgatcctccattcctagatcccacccagaaagttaatagtcatgatacctctggctccatctcactcatctaaggctggccaggatgagataatgccttggacaggactgctcctcacttccctctaatttctcctttctaaacactttttatatccatagattttcttccccaccctttccaggtatgggatcatctatcaaaagtggccaccaggaaatgatgtgtattagcaatgtatacttcagtgaggactattctactggtgtttctgaaacacagggtttcaaaaataactataggttatcactcaaaattattttagatgctatgcagaaaacattaataattatatattttaataccaattagaaataatgaaataaaaccagcataacaaactt

SEQ ID NO: 63328 - DNA, 1545 bp, Bovine  19866880781239
cccttagtgaaggtctctcgtgtggttgagagagagcgtgtgtgcccatggggcatctcccccacctccccaggtgcggcgggaggtgcagatcacgtgattactgcaggcaagattaaagaggtgggaagggataaaagagggcagttgctgcctcgagagactcccatcgaggaattatctccgagtcttctctccccccaattcttcctgaaaactgagcacacatcttgcatcctccaagggccccaagagcagttccgttctgacggcaggaggctgcccttgtccaaggacacaggcagcttctgaggggtgaacacctgccttccgggcggagcagcagcagagtagatggtggaaaatcagcatgaggagcggaagcccacccctctcctcgggaggctccctcacgagaccgtcttgtatgaaccggtgaggggtgactggggttttggacctgcgctgtctgtactcgtgcctttgtggtgtggaattaggggcaagcggccttcaggttcacatttgtaaaaggtctcaaatgtagacgtgtgctgttacttccaagtgaggctaagtggacaagtatgactcttgtgtgtgtgtgtgtgtttcttgttttctttttgacacaaaggagtctacttgttaaatgtaaccctttaaaatagaccacatatttacaactctgttttggcatttacaatcaaccagtacctttcagaagtggcccgtgcccaccacccctgtctacctctgaaagcctagtttaacttctccccacacatgcctggcaccttgcagtagattgctaatccatagatgctgccacgcattgataaatggctggtcaggcccaaacccacacatttgtgtttagtgcactactgagtcagtaccactggccttggggaagaaaaaaggaaataaagccaaggcatatgggtttaggatggagtttagtactggatttgcactttctgacttggctgcccgatctatttcccactggcctttagaagcgtgctggattgaattgcatttcccattgcaaattttaaataaggtggatgatacagaaggcattactatccacagtcccctgagtatagctgcaaatatgcttttaaacctcagagcaatttccccagtcatcaccaagcaataattgctgttaaaaagaatatacacccacacacacacacacacaatccttatagctcagcaatggggaatatcgattgctgtcaatttttaatgcaaaaaataattaaagacttagctgttcaaaatatttacaaacagatttactgcaagtatttatcttcaagcaagcaagatctagagataattccttgggacagtagctgattaacacacattttgtttcaacagtaaaagtttctgagcctcatattagaagatgtatggaggatagactttccccagtcactgaagttagctaagttggagaagggtgattctccgcaaaatgacagaggattcctggattcttccaaatgacatcagagagtgaggcagcat

SEQ ID NO: 63329 - DNA, 842 bp, Bovine  19866880783429
tgattagcttgcaagttccagctggatttgggttgtgaaggtgacaccttctgctggtgggaatgctgaggccattaagcatgcacagcacatctccccaaccataacagtcaggctccacgcctccaaatgtaggtcggtggtgaaaaaaacaaaaaaacaaacctttattttacatttcaaagtgctgttgggggagaaaggctggcctactgcttggaagtgagttaatctggcaggagccaacttttaaagaccaggatgtatctttttgatagaaaggacaagggaaaatctggagtgacagacatcaagctcagtcagccggaacagtgactgctaacagagtgcccccaggcctgcagcgctttgatgacaatcgacagtataatcttttcacgtgggaacagataagtgaaggttagaaccacaacttgtaagagttaagagaccccctggttcgctcccaggatcgacaacagaaactccaggctctgagaaaagatgcttgtctggagtcactcagggcatcggtggcagcaattgaattagaacccggggttcctcttgttcagcttgggcttgtgccatcatgccaccttgcagctccctggaacaggggacccagaatgcaaataggaactaggcattttctcacttccaatgtgacaagttttcagatttgaacctctttttaatcccatcccacccctcttccattggtgggaggatgagctgttagttaaaataggatgccttacagttggtctggtgagctttgagtgcttagagaaacaccaaaccattttcctgccacatagctaaaatgacctctgtttgta

SEQ ID NO: 63330 - DNA, 792 bp, Bovine  19866880942731
ccgcttccctgcattgctctaatgctgttttttctaaagaaatgttaatgttgctaatcaaaaccatgtggagcgactttttttttttccttactgttgctaaaagcaaacattttggaagaatgaaattctacattaatttaagaatgggtgcagggcataagcctggtagattccaatttctcaaatcagaagagccctccagtgaggactagaacaggctgtagagttctgcagatctgaaatcagatcttgacactgcagcttgctggctatgttgcctgagtaggtcatgtaagcctctcaatctcagtttcatcccatttaaaaagaattaatagacctaagtagatctcactaatcgtgaggaatgcttgtgataatgtgtgtcaagaaccctgtttcagggacagtcacagggtggggttcaactgggactgacactttcacctcctctttcagacaccatctggttcactcgctgcccctctctgataaatctttacaaaggaggctccagtttcagaatagcttcaggtaggagatttgctgagcactcttggtcacccagcccactgtcattagcatccctaattttctagctttcactaaagcactaagctcaatggggagcctcacagctgaatgaacaggcaatgctgggccagggagccaagacagccagagagaaaccgaaaaggttggttaagaagacccttgagaaaaacaggagatactgaaaccactcagcctgaaaccttcaggccggcttaaaggatttattaacagtcc

SEQ ID NO: 63331 - DNA, 1026 bp, Bovine  19866881001110
agaagctgggaaagcccatttctggcttctctcttggagaggcatagattcagaggtgagaaattctccaaaaataggaaagggtgtccaagagggctgggtgcccaagtggcttgacagctatcctacaagtagcttgactacatctgttacagtgttagaaacaccttgcatccaagaaatcctccctagaggctaaccaaactcccacttgctgcagagccctatttaaccagagtcctctgtatgttgtcttcagtggaattctacaagagcttgccatcaccttccaaatgtttgaacactgactaagtcccccgcagtttcctcttatgctggttaagacgctacaatcattttctccttctcttccttatgactcctcggtgctttagttgcctctaaaaccatcctctcaaatattcagacctctctccaatgctctaaaagtttcattccttgttctgttctccacttaattacacaacttgtcttattttctctcttcttgctgtctcccaagttcagaccctgagctacctgctccaattaacagcatctcatgttcctcaggctcatccagtgctgcaaggatatgctgtcctgtggctgaaacacaaaggaattttgctgtgacattctggtattatggggtgtccagagctaaaagctcagcagcccacctaccctcttgtcattgcatagcaaaaatgcatgcccagctcagaggtcactagcataattgaggctcaaagacgcaagtgggcacactactgctatagaactgaactctcccccacagacttagactagctgtgtgacctcaggcaaagcactctacatttctgaccttcagactcctcatctgagatgcttagataataatagtatttgccttacagaattgttgagagggttaaatgggggtgaagtatctaaagtacatgcagtaagtattcaatatatgcaacctcatagagatgacttggagacccaaagtgaccatgggtgtaaaaacactttgaa

SEQ ID NO: 63332 - DNA, 1825 bp, Bovine  19866881017181
gatctgggtgtaggaataggcatcagtagttaaaaggatctcaggagaatcagtgtatgtgcagcaaagtacagccccatgtgtccccagtcggataggcgggagaatacggagccagcagtcaggaaagcaggcttcagttcccgcttcgtcactcctgacagcccagtctccaggtactaacaccatcgcctttctgaatctctgaatggaaggggtagaactagacacagatttcccaaactgcaggtccacaaaaccctgccttctgaaatacagttccatggtatttaataattttccatgggcttctttatctcaggatttttcatggcctttacagtgctaatatgtgaagtgaatctccaggagagtgataaagtactcagtacttcctaaatttatttgaccatgggaccttttttccaaggagaacctattaacatttcccagaacgggtgctgctcagaacattcttgggaaaatgatggactgcacgggtctttaagaccctttctggctctcatcttatttgaataattttagtttgtgtattcctccacactcctgtgggggctgcagttggaaaataatttgtgggggctggaaacgtctgcttatttataagcgctatctaaggatgaagacaggctccaggcacataggcgactgctgctgaatcagtgctctgcctcttcctgctctgatgtttaaagtgctggctggctgtgttctttccatctggttgctctctttgatgggctgagtttaaaaacttaaacggaggagaggctctcggtgattaggcaaatgacatatggcagtggtttggaggaactctcatttgggacctggaataaatctcagcctccccacctcacccctacatcattcccaggctcttccctgccaggcctggttctatcccgagatggggctctgaggatgaggccagacccacatcacgagagacagcaacgagggagccttgaccttcaccctcaggcaggacagagacgatgcccaccacttactctgatgtcatctgggtgaccagctggagggacgtgaagccggcagtgaggaagctgtcccctgtactggaccatcttgatggcgctgagccagtcatccacggtggtgaaggctgtgaagtctgggatggagcggtcgagtaggggctgggaaggcctgcgagacagacagaggggagcagtgaccctacagctgcagggggtcatgggcagaccacactctgggcggacggtggacttcatggcggtttggcgcccctggtgggataaggattatggaggaaaccggggctgacccttccttctctacacagttctgagctggcacagctcctcaaggccaggtggcccatcccccctgtccctgggctctgtcccatgccagtcagcccggaccagcagactgacacagcgtggagtctgaagggaagagaaggatcccactcctttgtaaactgaaatctaagagcttcaccaaccaaagatatggttcttttacaaatatatgaagttcactgtagcctccacaatgtcagcaacattctttcctccttgttccgtcctctactgactgaaagaaatggaatacagcagcccactgctgaccttctctcgcatactctcagagcagacccccaggtaccacccccagaaatcaaggtgccatcttcacatcacccttaccttcagcatccacacccaacccttcaccaagtcataaagattttactttcaaaacctctcaagctcacttgcttctttctacacaattagcctattcaagacgctat

SEQ ID NO: 63333 - DNA, 1159 bp, Bovine  19866881146918
gataaaaagcctcatgtattcaccaacttgcaaatttttgcctctctcaaaagtttttaaagctcctctctcctagttttttttttttttaatttatttatttttaacggaaggataattgctttacagtattgcattggtttcagatatcaacataaatcagccatagctctctccttgttttaatttttatatccctggggttgagcacatttcctcaatttttgaccatttttacttcttttttttctatttggatggcataacaaagactgctggttacctcctatgacccattcttcctttatctttagtaataggaaccccagcttttacataggtgcattgctgccagcatccagaagattacatttctgggcttccttggagctaagtataactatgtgagttttagctaagaatacataagcagaagggctcgatgtaactttctgaagcctctttcaagagagaaggcactccctcatcccttcacccaatctgtatattggaacacagaagtaataactggagctctaacagccatcctagaggaccgtgagctcaatgagccagaaaatcggggtttctgagcatttggtggagctgctgcaccagacctcaacttctttcccataagagagaaatttaacttctgttttgtttaaacattctctctctcttttttttttctgttatatacaatgtagaaaatgctttttatttatttacaggagttctttgggttctagatactcaatctttatttatgaaaattgtacattttcttccaatctgtaagtcctctcccattgtcagtttttagttttggggtcaaattttcctatctttgcttttatggctttttgatttgaattttttttttttgctaagtttttttttttaactaactttttaatggatgtctttcctgtcctgaagataaaaacatagtaatcttacattttcgtatatgttcttataacatttaggtctttaattcatctgaaatttatttttgtgaatagtgtaagggaaaaatcttgttggctattcatttgaataatttttctagtaagtggcatgtcagattactaattaataatttatctatatatgtatagatggttttagtactctatttgttccatgatcttca

SEQ ID NO: 63334 - DNA, 1789 bp, Bovine  19866881190204
gaacatctgatgtggtttggtgaagacgcacataagataacatactagcacacaccacgtgtcaaaccccgcactctcctgcctcactgaagctgccactgcagcttctcctggctgccttggccccagtctgctctccatctgccctctcctccctgaaagagaggaaatgacagaaaaacctctccatctcccctcgaatcacagaatcatagcattttaaggctaagaggatactttggagggccttcacgctattttacagataacaaaatgttcctatgaattcaaactatgctaagaaaaatgggacagtgagacccatataggtgggttatgtaaccaatgtgtgaggcaggaataatgtccagattcttgcctgggaaatcccatgcacagagtaccctggaggggtcacaaagagtcggacaccacttaacgactaagcaacaacaaatccataatgatggataaatcttccccagaatgtttttctgtgtgatgctgaccctaacttcccacaacctctgtggatgtaaacaggttttaggactcagaaactgagcagatctgagactctggcgtgagctgagatgaaaaattaccggagttgctggagcacattcacttactttaatctgcccaattccatgtggtcaccgttaggcctggactactgtgagggcaatgaacttgaaggacagtctcagagccttctctcagagcaccgagctcctcaggtggcttcaccagttttacccccattgctctgcctgccctagactttatctgccccttcaggacaaagatcagggaggaaatggccagcatcttcagccccatcagccctggcaacagagagatggctgaacagagccccagggccacctgcccatggctccagctcttcacaaaatcagcccaaaaacagtagagaaaaactccttgaaaccaaagtgtgtaggtatttctgactgtggatatcaatcacctactatggacattaagctgaataaaagcacaaatgaaaacagcaatgatttttgaataaatattaaatatgtagcttctgatttcagattgatatttcacagtggcagggctcaaacaccccagagctaataaagacacatcgtgctttcattagaacagatattaggatgaaagtaccgcttcgacacatctttatacagtgaaatatagtatgagcagttctttcattagggatgggaaaatcaaattttaaaaccaatgtctactttagaagtttttatactgatcatcaattcagcactcatttccaatattaataactcagctaagcacctggcaggaggcttttctctgctgagttaataaattttttctgtgagccttcatttgattgattacctcatcataagggtgaccacataagttgtcctggaaatatgattctctgaaacaacagttaaagaacaaagaattactgagaataacaagttctatttaaaattttttatgactatgctaagaaaagtggaatcaaaatagatataggagaagtgagattgttgacaaaatttaaaccaaaaaaaaaaaaaaaaaaagaaaggctttttgcatcatatatatgcacttttgggggaatagtttaaccttaaaaattcctaaagggttttcttatccagctggaaaaataattaaaataaatgaatatcggcagcaaagtcaaaggtaaagtagatcaactttgttttccactcaaacctatgggtttgaggctgaaaatgacgccagggatcagctt

SEQ ID NO: 63335 - DNA, 996 bp, Bovine  19866881199653
tgagcccaccaagccccttcccttccctacacctactgagcagagagcatgggtgacgtttagacccaggataaaatctccagaaggggagaaacaacccaaggaggcaacacagagctagaactaacccccagacatccaaagaacaaagaaaggaaaaaaataggatgactgattcacgcatttgtccctagaataaactctgagcatagctgtctgaagcaggaagagtcctgacccaggaaacttagatggacagttaggccagaatagtagagaaatgactccagaagacttacactcctggaggggttagcccccatcccagaaagcaagctactagtttgcaattccttcccttcacttcccagcctgcaccaccttcctccccgccccccaaagtcacccaagacagctggagtcagcacttatgtactcaggcaaacaggagtttcaaattcaagtgcaaacaatagttaagaatgtccaaacatttaaggaaaacagacatcattaaaaagaagaaccaaagtcaacaaataaaatagctaatgtctatgggaaggaagaaataactttaaaataagtgtaattaatattcagatgtgagatgctggtacaccatcaattaacaatgagtgttgtgaaataaaactaattaggattccatgatcaccaactagtttaggaaaatttaccagatgtgctgaatagcagcatgaaagtgaaagctgctcagttatgtctgactctttgagaccctatggacagtatagtccatggaattctccgggccagaatactggagtgggtagcctttcccttctccagaggatcttcccaacccagggatcaaacccaggtctcctgcattacaggtggattctttaccagctgagtcacaagggaagcccaagtagcagcatgggcacagataaagacagaattcagaatcagagagttaaaaaagagaaaaaaaaaataaagaggaggaaa

SEQ ID NO: 63336 - DNA, 952 bp, Bovine  19866881297934
ttcatgggatgctttaggctatatacagtttccatcttgaacccctgaaaaactttatttctgagattttttaggtcatttgttacacagtattattgccacaataactaattgatacatggtgcttgataaatattgctggattgctttccaaaaatattgtacttatatttatactgtaccaagcttgccaaactgaacattatttttatttaacttatttaattgaaatgtaattgctgtacatcactgtataaatttaaggtgtgcagcataatgtatttctgtttttaacttctaaaattttaataagcttagtcatatttttgttattgtgttgtttttcagaaacatttctaaacttcccaggcacctgtgagccatgctggcaagaagcattaatgggtctcatttcccttctggtgggtgcaccagagggaaccctgcttggcagctggttgtagaagaagccaaaattaaagttgacagcaaatcatgaaaccgctgggatggtgtcctatttaaagagatcaccttgtttccaaacattcatttatttcctttctgactcttaatcctccatttgcaatcttgtattttcagattactcctatttatcatgtgctgggcatggtataagccatattaggcattgcacccataagaagcaaatttgcttctgtgccgttgcaaccctcttgtttctagttgctatttgccccattgtcagctggctctgaattcacattctggccctgggcactgtgttgctccctgcatttctcctagcctactaagaatttgagggcttttactcaaacacatctcacctagcacattgaaatacagcagcagcagcaagtaagttttctggtgagtgagtgaggtgggtgagggggcaagtgatcttttctcatttctggactcaggtcctacatgtcaatctgtttta

SEQ ID NO: 63337 - DNA, 1032 bp, Bovine  19866881345772
tgctaagtggcctctggtccgctcttctttgtattcatcatgtctatgtctaatgctcaagggaggctccaaatcctgagtgagaacacgctcaaggagctagagttcaggaagaggttgttgtttttttttattttcccccaaacccagtgaaccaaatccactggctggagtcagaacagtctctatgcccaattccatcaagcattgccctgtgggctatcggtttcctcaacaggagtcaggcagataagaaagagttcctgggaggtggacaggactgctttggggattctccaggcagtgcctagtatattatgggtcctcagttaatattcattgaagtttcattgaggtttgatgagatggatgaaccatacaatatgtcaataaagttaagtattaccctaaccacattcttaaagttattaaaaatgtcaagagcagggtgatttatttgctcattctatggaagtattgcaaagacagtatgtataaaaacgttcagtgcttaaatgataatgatttatctttctggctccatctcaaacttagtgtcagtgactgtttctgatgttgcttgtctcttctaggtctttggcctttcgacaccgtttttggctctaagagggatgggagattgtaggacaggctggaggttcaggggctgatgcaaattccttccccagccgtctcccatctgtggatgatgccaagcagctgcctcagggtgacctttcacatttgacatcatggcccctgagtacataataggcacttcagcagggggataacaaagctctggcctggatccgacacctgaaaaatgtggttcctgctctgacaaagcgtgtctccctagagaattataagcaatagcaactgtgggtagttcaggaaggagtgagaatcagagttacttgctttgggagaatgtgttcacgttgtatcacttgcattcgacttgcagcacagcctgctgaagagtaaagcccctggcagtgccagcctttaggatttgtcatcctgggt

SEQ ID NO: 63338 - DNA, 754 bp, Bovine  19866881399311
gtttgctttataagtgattgaatccttacccttgttatatactttcccttgatcttcattgtctgcaaatattgtgctaaatttcccgaacagcagaactacaccctccatgtacttcttgtttcagagtttttttaaaaaaaaccttttgcttgtctttagttttttttttccccccacaagttttggcttgttcttggctttagcctttctgacacccttctcgtggatatgacaggcctgggccagcaatttgttcttcccattgcacgtcatatctgtgggattatatttacctcattgtgcaaagatgttgaatacattttgtttttttttcgctgattctgcaccttacagacttgatctcaatgtctatggacactgcttctaactcatttactggatgcttccacatgaatttcatattcattttgtgctgtagtggttactgccatgacacctggtttcatggtgttattagaccaatttctccccactccttccaattttgggtaaaacctctcaattagataggtgtttcctgtcaaacaggtcttcccagatttagtgcaaaatctctgccagaagctctggtatcaaaaaccgccatctagaaaactaaagcctgatacttaataccaggattagccaatacttcaattttcactcctcattattcttcactaggggcaacctttaaaatacaaggcaacatgattatgaccactgcccacctctacctttagccttccat

SEQ ID NO: 63339 - DNA, 1011 bp, Bovine  19866881403502
tcctgctgcctgccactcatgcccctcattaggtccttagcgtctgctgctcttttccttgaccctcgcatctactgataccaggccctgataccagatacaatgaccaagaagccctggttcctccaatgtaattttatcttaaagcacttatatttaagacacatttaagtgtatcaagggaggtgagtgttgggccttctctggtattccagaggctacgactctgtggtcccaatgcagcaggcctggattggaaccctggtcagggaactagaccccataggcagcaaataagagttcacgggctgcaattaaagagcccgctgctgcaatgaggactgccgatcccacaggccacagctaagacttggtgcggccacataaacagactgttctaagagtgggcggagggggagtaataagtgccaaagggagcaccgctggtgaccacacaggtgcataagaagcccagcaaggagctggatctcatcaggaagcgggggcaaaactccagcgggacgacaaaaagaccaagaaaactgggacagggatgggatgcggagcccaaacatcatagccggaaagaggctgaatccacacctggaatgctttgggaacagggaaggaaggtgccggagatggctggaatgccagagagaggctgttggcaggcctggtggagagtgtggtgtgtgagcagtgctgtgctccagactgaagaaggagacattcagccacacagccaacagtctgacacaccagaatccctattcagcaatactgattccagaaacactgaataagttcattgatattttattggaggctgaaacttttcactttaattagattaattctctaggtttactacatttttaatgtgtttttattatgccttggggtcatttcccccataggaatgattctagttttataatttaaaaatgaatcaacattctgaatttaaaatatggatttttttcagatttaactttcctgggtcaaagt

SEQ ID NO: 63340 - DNA, 965 bp, Bovine  19866881413222
aatcagctaagaattatcaataaaacagttgaactaaataaagtgtataatctctaatgaagatgcaagaagtaatatcaagaatagaaaaagtgaacggtcaagagttaatacttaaatagggcttacctgagattcagggctacagcccccaggacttttcccagacacttgaacaaattaaacacttcagtgagtatgctttaactggctggataaaaggatgcatgcactgatacacaggtttcaaacaagccttaaataaatacatctccaatccaaaaactaaccaaaggccaatgtgaaagcattagtgatcaaaaattaaactcttacagatatagcccatatgctattagtagtttacatttcactcatctgtaaaatgaaatatatttttcagtttattcacagagtgattaaattgctttcaaagaaatttctgatcttcaagtgccaaccaaagaactcttaagaggtgattatctgaggcagaaactattgagcccagaggaaatctatttacccccatctggccactggatggcaaaaatcagttgttcctaatgtgattttcatggcaataattaaccatcatgactttacagatgagaaggagctctctatactctctatacattattccgtgtgattctcacacccattctacagatgagaaaaagatgagtttcaaagaaggtaaataaatggtcccacaaagtaaatcaagattcaagagctcttaccctctaaatcccattattttctcactagaacaaatatgtccatcaccaccttcattctcagcaaagatggaaagcaagattgtatgattattgcccccacaggggtagttacttcttacctcccagggatttacacctgatatatcttcgcaaagattttctgtttcataaaacccacagactatcttcagacagccccagaaccttcatcttccagga

SEQ ID NO: 63341 - DNA, 875 bp, Bovine  19866881417904
cagagatcaaacctgtgtctcccacataggtaggcagattctttaccactgagacacctgggaagtcaaactttcactgaaacctcttcaatgcctccaaaaggaacactttcaaagcagcaatctgataaatgccagatccatccttagtctagactggagcgagacatcatgaaacatcagaggaatgacaaggtcttgggctctttggcagaacactttatggtggtccatttcctcttgtgtacccatctggtcctctgaatgggggcacattgtctcacactgcaggattctgcttgcctgggaaagggtagtcaggtcgctgtaaggatgaaatgatctcaatagtttttatttcttaaaactttttttttgtccaaactgagaataaacaggaaaacaaatcccccacatatttctggatttctttcccagtcctcacatctctaaatatatcaaacatgataattttatgagcaaccaagtttatacataatacattttatgttcttaaatgtatcaagtgattttagatctgcgcaggatgctaaaaaacaagaacacacagcgcccaatttgtacattaatttgggaatataacttttttaagtgggttgcttgaactcaaaatgttttttcttatggaaacaatggtggttgagttccaggtctacactacaaaagcccacatgcttttgtacgctgcagtctcgtcatttactaaacatgccagtacatttaaaatgcctctcctgtatggctgactctttactccatctttatatatgttagctcgatgatctaattctcacaacaactctgtgtcaaaaggaaccaaatctctgatagcttaagtagcttgcccaagtaca

SEQ ID NO: 63342 - DNA, 1575 bp, Bovine  19866881511420
taacaagggattaatctccaaagtgtacaaatagctcatgatgctcaaatatttttaaagagagaccaaaataacctaatcaaaaatgggcagaagatttaaataggtacttctctaaagatatacagatggtcaagaagcacacaaaaagatgtttggcattgctaattgttagagaaatataaatcagaacaacaatgagtatcacctcacacttatcagaatggccatcatcaaaaaaaaaaaaaaaatctacaaaaaataaatgctagaaagagtgagaaaagggaaccctcctcctacactgttggtgagaatgtaaattggtacagccactgaagaacaaaatggagattcttttaaaaaactaaaaatagaactatcatgtgacccagcaatcccactcttgggcatatatctggagaaaaccataatttgaaaaaatacatgcatcccagtgttcactgaagcactatttacaatagccaggacatggaagcagcctaaatgtcattgacagaggaatggataaggtaaatgttgtgcatatttacagtggaatattactcagccataaaaatgaataaaataatgccatttgcagcaacatgaatggacttagagattgtcatatgagtgaagtaagtcagggagagaaagacaaataccatatgatagtacttatatgtgtaatcttaaaaaaatgatagaaatgaacttatttgtaaaagagaagtactagtcacagatggggaaaacaaacttacggttactagggaattgggggaagggataaattgggagattgagattgacatatacacactactgtatataaaagagataactaataaagacctggagcttcccttgtggctcagatggtaaagagtctgcctgcaacgcaggagtcccaggttcaatccctgggtggggaagatcccatggaggagggttggcagtccgcttctttcctggagtatcccatggacagagaagcctggtaagctacagtccatggagttgcatagagccagacatgactgagcgactaacgcatacataataaggacctacttactgtatagcacagggaactctattccatactctgtaatggcctgtatgggaaaagacatttttttaagtatatatatttataacagattcacttttctatttgtttcagttgtatagcaaagtggatcaactatattgcaataaaattttttaaataataaagtgagtttggaagtagtcccttttcttctgctttttggaagagtttaaggaggaccattatagtgtttttaagtgttggtcttggttgtaatatagtttaaattgtactcatagtggactgttggttaaagatggaacatgtgtgaaacacatgtcagaatatcgtaaattaatgaagcacatgaaaatgataattctgtaaaactgtttcaagatgcttttatggaatatgtaatttgcatttatctgatcaaaatttgtatgaaataccaagatgtttctaatacttaaaaaattagattaaaagaagcgggtaaaggtataagggaattc

SEQ ID NO: 63343 - DNA, 1622 bp, Bovine  19866881945576
ccttcacatcctcatgcaggagactcttccattcccatggttttgctgatcatctagaagaaggatggcccccaaatctatataatctacccaaatctctttgctgaattatgaaccctgtgtccaatggcccatcagcaactcaaattcaattgttaccccctctctcatatcttcctcctttcatatcttttatttctgtgaatggtatcaaaacccactcagttgcccaagccacaagtttggggtgtcctcctcaactcctcccaccctcatccctgacagccaatctacctctaccttctgctggtcttacctccttcatattcctcgaattggtccacttttcttcatccccaatggtactccatacccccatccagaccaccatcagctcctgcctgcattattgcaccagcctcctaaccaggctcccagaattaaatctagttcctccactacattttccattttgtggccagagtgatttatagaacatattaattcccttgcttcagtccactttccaccattcgcacttagaacagtacccagattccttatgccacataagacccttcatgatgtagcccctgcctacctgtccaggcatccacatccaaaatcttcttctccagccttgttgagcagccagtgatcccacaaacatgccacccaccctatggctttcaaattttcatacgtgctgctacctcctcttgcaaggtgagtttcatcacggacatctcccgcttcccgattttataagtcctttccatcctcagtgaaccgcctcaccaaggcctttttagaccctctgggataatggcagtgcctttctctgggctcccatagccatgtttgtttatttcccaactaaagttatttacaaaatttagttcagctaccaaagatggtagctggaaattggcatggtaatctgagtcagaaaaccatttccaaagctacattaattcatactgttgttgccaatatgaatttaaagatcagaaaaggaaactgaagtctcatcggaatgaagaaaacctctctcttttagaacagcatagcatgggctcagcatctcggtagcgtagacgtggcttatttgcccatcattttgttttttgatttcaccttttcctgttgaatgtgtggctacaggaaatcttatagtggctttagaaatgtaaaacaactcttagaagaaattcatagggtacaaggagtggcaaagatgaaataaagtttccttgctcagggaagtcctgcccatcctttctgccaaatttgacattgtcctgaagggacagggagctggttctgctttcgggaggatgaccattcagtgtgttcctttgcccttccagtttgtctttactgtcccacagacgacgtcgctttcatttctgcatctgcggaacttcgtacagtgactgacactcggtgggaggctgctctcccagattggtactctgggggaagttcatgacatcgtatcaaagatgcagggttgaaagggggcgtgttaaacttcacacaactaaaattagaatagcctacaattgattgcagttaagagcaggttagaaggattcccactgaatacctagcaatttatt

SEQ ID NO: 63344 - DNA, 970 bp, Bovine  19866880209309
aatggagtattactcagccattaaaaagaaacatttgaatcagttctaatgagatggataaaactggaacctattatacagagtgaagtaagccagaaagaaaaacaccaatacagtatactaacgcatatatatggaatttagaaagatgataacaataaccctgtacgagacagcaaatgagacactgatgtgtagatcagtcttatggactctgtgggagagggagagggtggggagatttgggagaatgacatttaaacatgtataatatcatgtatgaaacgagtcgccagtccaggttcgatgcacaatactggatgcttggggctggtgcactgggatgacccagagggagggtatggggagggaggagagaggagggttcaggatggggaacacaggtatacctgtggtggattcatttcgatatttggcaaaacaaatacaatattgtaaagtttaaaaataaaataaaatttaaaaaaaattttcagtgataaaatttgatttgattctaaaggtttattctttcttccaagaggatttccagactggtgagtctgaaggtacataaacttgtgctattaagtttgaaatgttaaatttctctctctctataaatatctttatatacacctactcataaagacaaatggtgcattgatgatgtttgatttaagtttgtatagaattttaacaaaataaacaacatggttgacatgttttcctaattgtttttagtatgtaatttaaataaattgctccatctccagcattccaactgacataactttctcaggaatttgatctgtcattcttccagttagcagagccccgcagccatgctgcagaatggttttgtaatatatcttgagttttaacaaggaactttttgatgtatttcaattatgatgtacaaagtaacatctccttaattaaagaagaaattccatttgaagctctttaa

SEQ ID NO: 63345 - DNA, 2569 bp, Bovine  19866880467000
tcagactcatgttcattgagtagtgatgccatccagccatctcatcctctgtcatccccttctcctcctgcccccaatccctcccagcatcagggtcttttccaataagtcaactcttcgcatgaggtggccaaagtattggagtttcagcttcagcatcagtccttccaatgaacacccaggactgatctcctttaggatggactggttggatctccttgcagtccaaaggactctcaagagtcttctccaacaccacagttcatcaattcttcagcgctcagctttcttcacagtccaactctcacatccatacatgaccactggaaaaaccatagccttgactagacagacctttgttggcaaagtaatatctctgcttttccatacgctatctaggttggtcataactttccttccaaggactaagcgtcttttaatttcatggctgaaatcaccatctgcagtgattttggagcccccaaaaattaagtctgacactgtttccacacacatatgcctaacaaattaactaaaaagtcagcatcttaaaataacaaagattttattatctttgattttctgggaagcagaaatctgagagaagttgagctaagtagttttaattcaaggtcttaaagatgtgaccacaattttattctaaggcttgatccacttccgaactctctcatggttattgacaggcctcaagcttttggctggctgttctaaagacttcagttccttgtgtcagtgatcccttctgggggttgcctggcatggaatctgagtaaacaatgaaagagagaggagaaaaaaatcctaagatggaagtccacagttttttaataaccaaatcttaacagtgacatactatcacatctgccacatgctcttgtcacattgaacaacctttggtgcactgtgggtggagacaacacaaaggtttgaatatcaggagttacagatcactggaagatcctcctagaggctgcttatctttcttgggaattgtgatagactcaattttgacttgtttgagtcttaacatgtgctgtaaaatatattattgtttggttgttgtttttcagttgctcattcgtgtctgactctttgcaaccccgttgactgcagcacaccaggcttccctgtccatcaccaactccggagttcacgcaaactcatgtccatcgagtcggtgatgccatccagccatctcatcctctgtcatcctcctttcctcctgccttctatctttcccagcatcagggtctttctcaatgagttggctctttgtgtcaggtggccaaagtattggagcatcagtttcagcaccagtccttccaatgagtattcattccaatgagttgatttctttaggatcgactggtttatactttatttatttatcttaaatatacttgtgtcataattaaccaatgtcccaaatatgtaaatattagttacaaattcatttggggaaaaaaacacaaattatccgactgtcgcattttctctgacctgtcatagggttcaagtaatgtttggtgtgcacgtgtgtgtgtacgtgtgtgcacatgtgtgtgttttcactgcaatctaagatattacacagtgcctattattaagaaagattattatcttagttatatatatatatatatgcatacagtagttacataagatttcaaacataaatcttagtaaatattaaggatcattttaaagagtaatatgaatgcggttatatattggtactaagttaaaaaaatcaaattgtttgctactaattgatgtacatactactgtgttctttcataaagggaattttttatttaaaattatttttaaacaatttcataatgttatgtatcagttaagtaactttgtattgaatgaaggaaaaataccttaactttggggtcttggtctgtgcattaaattacatttgtaaatgcttcactgaacagtatttttcaaatataatccacatatagtaatcatgtttaaaatataatttttcatagttatgacccatctgctcaatactgataagaagttcaataaagctagctgtaaaaatcaatgctgttaaatgtttattaattatctaacacattgcttagcttactgagcacatttaataccccaatacatatttcaaggtatatatggaaattttgtacttaggtttaaagatacattttaagtatcctttcagctatgttctcttaatccaaatttataagcatttcgcttattccatttaatctgatctttcattgaggatacaatttcgctgaaggtaaggcagacagtttctatctggggaaaaaaatcttaaaagtacattgtacattaaaaaccactgaagcataatgggctaaactgcacatggaccaaatttcaacatttgccaaaattatcagtaaatttaagactcattctaattttctcagccattattttagactccagtagcactagaaactgatttaatcaggcagtaaagcataaagtattcaggtcaagtagatcagcacaaaaatgttttctaattcctttcatt

SEQ ID NO: 63346 - DNA, 819 bp, Bovine  19866880900109
cctgttgaggggaactccctctgccagacgctctcaaggcaccagtgtgaaatcagaggtgtggaaacatctggaaagtactgagatgtcagaagccaaggttctctatccatgtgggcttctcagctcctgagaagaactgtgaagaaacaaatcaggtagagaaaaacaacaactaagcaaataagaagtaaggaaaaaaagagggaaaaatagcaataccagcatgaattaagatctgtcacttctgatacgtgattctgaagagtggaggtacactaggtgtaaattcttgattttcattctcttttccaaactttattgcttccaccaaaaacctgttaggaggccagtgggacacatctcaaaacgatctgatcctgttttgactcttaacgaggattatgcataaaaattaatcatttttaaagtatatgaaacttaaactaatgaacaagtgatgtgaattcatcctaccctgccagatccaaactaacaaaaacttcttggtaataaatttacagcatttgaacttaaatttctaagaatttcacatgcatccatggctcgtcttgtacttgtatataatggttgctatgggtgacctagaaatgaaaccaatcatagcactgtaatttaaaactaaaacagctggcaaaaatctttcctctcagagcgtgttgtcagagaagtaaatgaaaaggtcgggagacttttcatttgcttctgtgataacacagactacctgaactaaggaacatattaatgtttcctctgaagctttctattatgtgtcaagggccctattccagaatatca

SEQ ID NO: 63347 - DNA, 1037 bp, Bovine  19866880936970
tttagtgtttaaggggaattattgagacccttgaattctaaaacatatgcttctaaaaagaaaaacactaataattttccaaaaactccttatcttctgcttactcagttattagatatgagaatattttgtactacattattaggctgaatttttagggaaaaaaataaacttaaaaggtcaaaatgtaattgttttcaaaaatgttcaaccagagatttgctgtgaacatagtcaaggaaatagcaacacagaatgtatttttgtatctcttttcctaatagcttgttatatagtccttagggggcaagtaatttttcataatgatagtaattgcaatagagtttaaagcagctgaaagccaaggccatgtcaaacttttatgtcaaataagtagaaaggtaaagaggggaagaggcagaagaagaggaaaataataggaaaaaaagagaaaatatgtgtgttccatcattgtagacatggaatgaaagtgaagtatatgaagttcaagactattaccatgaaatttgcattctagatttttctttttttaagtgcgaagagcgctatttactctggtgtgttgtgacagaaaatagaggatatttcattgctaattatcccttctaacattccaaacacatttgacagcagtatgatgagggaagtcagtgatctacacctatttttgcactatgccaatggttggcataatgtttcaaacaactataaagcaaactttgcacagacacagggaggaaaacaattgcctccttgccatagatcccaacaaagtgatatcctctccaatgtcagaaagtgagcctagtgtagaatacagcatgagagcaattgtgtattgttcaatggtttatagagatcttgcacatggaatatccaatttactacttgcagcaggtctttaaaggagaaatcattaatgtattacataatttgtccaattcacagttcgtatgtaataggactctattgactaccgaaagaaacatcttaccactgcataatcaagaaatctt

SEQ ID NO: 63348 - DNA, 1050 bp, Bovine  19866880568996
ctgccatggaattctccaggcaagaatactggagtgggttgccattctcttctccaggggatcttccccaacccagggatcgaacccaggtctcctgcattgcaggcagattctttaccatctgagccaccagggaagccccaaatactgtccctttccttaactatcatactgtccattcatccaggatagactgttaatccgaacattaggaactgttattatattaactgagaccgtagagagagaaaatgcttggacctgtggcacacagtattttctcaataaatattagcacatcatcattattattagctttagtattagcattattactgcttggtcaaagttcatctctttcaaggcaaaactccagaaatcctgccaaactcagaatctttctgaacaatggaatcaatcattaagtaacagttttctcaaactactttccttcctttctttccttagaattcttcaaaactaacctgtaaaaaaacacaaaatgaggttgctctaaatgaaatctctttccacttccttccaccagcaagtcattccttggttattgagggctacactaaaaagtctttaaaagtctgtgtttcacatctttggtgtcattattctatcgctgttttagtatgatgtccatcttgatccttttggcttgacctaagcccgttattggagaaggcaatggcaacccactccagtggtcttgcctggagaatcccagggacgggggagtctggtgggctgccatctatggggtcacacagagtcggacacgactgaagtgacttagcagcagcaggcccattatatgtgaggccaaggtagagtgaatttttacaaaactctttatttctttagggatgtgaaaccgaaccttgtcccagtggcagcagcatctatttaaagacaatctgattttgtaggaacttagatggataacaatgaaaacaggaactgtctgctgttaaatatgtttcctgtaacccaagctcagtaaaattgagtctcttcattttgctggtgttccacctctgg

SEQ ID NO: 63349 - DNA, 3311 bp, Bovine  19866881063093
agagcaagagagtaaataatttaaaatgtcaaaaccgggaaataaaaggaaaagcagctctgctgaatataatccagacctgtaagagcattataggaaagaagaaaaagataaacccctcaatcaagttccaatcatgctctagccctggctagatcctatagtcaacggatgtgcttacaagaaatatacaagtctgcattagttcctaattaggttaggatggctgccaaggaaagtagtagtgtttttaaatgtaagggtttggttacaaatggatatcaaaagccttgacacttaagtggccatgacaataactgccaactgaatctacataattggtcccccaaggttgcgccagcgacttgggtttcattctcgtgagggccgtccctccaagaatcacagcctctagagggtggtacaatgtcaacaaattaattgatgttattaacttggattaagataaagacaaaatgcaattgatttaaaaataaccgtgggctttattatgctatttacttctaccactcacctgggaagagggtcctttgatagtagtttctttaaaaatctctgatgtggattcaggaaggaaaaaaaaattaactgtttctagacaaaatgtgcaccatttttttgctccacaaaaaccactctaagaaataaaagaattgactaaattttccaaatcaagttaaactggtctttcagtttaatttgcttttattagccaggtaaataaataataaaagtagaccatttggaatcatcatcagtggcactgtctcaagtaaaaggtacaaatgaaattcttgcagatcacaaatctaaatgcattatgtcttagaatccaacaaaatgtcatcaagaggctcacagaatccatttttccactgcactgccaaagaagaaatgggcaaagttcaaagtgtctggagagcagagaagtccttttgaaccacacttgccaattagcacatttattttgcctttaatgaatcctaaaaatatttattgaaaatggcatttattgttaatgaaaattccttctttcctccagcagaattcagtgctggatcaaaagtagcaagtgaaaataacctgcaaaagcaacacgccactattctccacgtcagaattatatcaggaagcccactgcagtgagtggcacctgtctctcacttaggtaccttgtcagtaatatgaaaacatgaatctaatttctaaggaatacacctaataaaatgttatagaaatctaccaaagccaaactcaatttcacagctcttgggagagacaatatgaaccatgtggtcctactgctgaagaaagcgacttattattctttacctagaacagtggttctcaaccaagggttatgtccctcaagggcaattttggcaatgtcagaaaacatttctagttgtacaactaagggtggggtgcgtctggcatctcgtgggtagtgaccaggaatgctattaaacattttataatgcatgcatggcaccaacacccccaaaggaaaaacaaaacaaaaattaactggcccaacatatcaatagtccatagaacaaaataccagagacaacattctagagctattgtactatagctatgggaatccaataatttcacttttatttttttagcttcatcattcagatcctcaaagcattatgttaagatcaacaacaaaatagctcacacttactgagcagtttcttcatagtatgtgccttcctaagtgttttcatatatcatttaatcctcccaacagtccaatgaacaataaactgctatcatcatttcccagttaagaaaactgaggcatagggaagctatgacccacccaggacacagagctacaaaggaatgagatgcaaacccaggcccatctgactccagaagcaaacacttaatccacgatacccccacaagacagccccagagacagaaaccagaggagagagcttagagacaatttcctaaaagagaaaaaacaagatttttttaatgagccgccagatgaaactaaattatacttagtcagctccccaataccagcacttaatccacagaggcccagcccctctcctttttttttttaacacatgagaatgtctagaaatggcccaacttacaaatactgaattagttcagtttccatctgggtggttctccaaatctctagctttaccttatagttaaaaaaaaaaaaaaaaatctgtttctaaactaattcagagctgacttgtatatataaaaataactaatattttccatggaatcttgaggtaaggtttttggcctgaatgatgttgagtgggtggggagcagcaagctaactgttcctccaaatattttgctttgtgttggagccccaattagaagcactctaaaccagctttggcatggtacccccaacttagcctaaacaagtcagtagagttggaccctagagccactagcatgtgaagaacacacacacacacacaacacaactgtaattgtgaatggaaacagcaaactgttgccatctgtgactaagtgaagtcaccttagtcatgggtatggggcagaatcagggatggagggagcataggtaagttatataaaaggaaaacagtcaaaaatattcttcataagaaagcatttagtggttgttgtcatctgtctggtaaagaacatccagagacgataaagagtagcgttcagcaccacaccattgctgggccttcaacttgatggccaataagcataaaatagtagcaactttttaggtgttgtatcagagtgataaatggggttcattcgattggaactagtctgagataagtgttcctaaactatgtaggtctacttgatcccaaatcgattttcatcattctgtgattgttctaccaaagtcctgattctatcagcatgtcttgtgcatccttctattatatccctcatcatatagcactgatttgttagtctccttccttaggctgtgagtctcctgataccaggaactagaccatgttcacagtttatcctcaggtcataacatcatttggtatctaacaggtacctaagagaatattgacaagtgcagcaatgtcatcatgaagggagatcctagagaaatgcaaccagtctataactgttaaatattttctattaatgacttgtattaatatagaaagctcagtaatatttttaaatagcacaaggatggcagggttagctaaatatattgtatgacagaaataaaattttaaaatagcctctagaggcagactattaggccaaaactaacgaga

SEQ ID NO: 63350 - DNA, 836 bp, Bovine  19866880410457
gcccttccttttcctgctgtgtagtattccattgctaaagtgtagcacagcttttaatccactcaccagttgatacatatttggattgtttctgacttgagctattatggaaaaagcaaaattatggattcagaaaagagacaagtggttgcctgaaatcggtgaagaagtggggtttcatggcaaattggtaaaaagggactttttccacagatggaaatcttcttaaacaagatgactggataaaaaaatttttttctaaaattcatttaactgcacacttaaaatgggtgcattttatgttacataatttataacaaaacttttttttaagagctctaggtaggaatataaagtcctgtgccccaccactagtttttccaactatgtctcagttcaagtacaattccaaagcagacaaggcccaccagactaactgctgaccaaatcaaccaccagggttaaaagactaataagttaccaaagaaactttttgaactggcacccagcatggaagatgagtactgtcagaaaaaaaaaatgagtttagaaatgatagcaaatccaaaacatgtgctcttaaaaataaaataagacatcctggctgaaaaaacaataatcagagcgaaatttttagaacataagaaacaagatgatacttttcacagttggactgtaaataaagcttctttggatggatcccataatttttcttttgtttcttttttaatgttccatgaaatactattatctttctaaactgctccccaggccctcaagaaaacagataatccaaatatagcttttgcttcttccagctaagcacacaggaaaaa

SEQ ID NO: 63351 - DNA, 1831 bp, Bovine  19866880431308
atggatgattgatagattcatataggtagacgtgtccatacggacatgttcctctcaaagatggaaggctcagttcaagaagactgagtaaggaggcatcagaggctagacattccaggaaacttcatctcatttaattctccagaattctagaagggaggcattgctagcttgtgttacagatagaatgtttgagggatttccctggtggtccagtggttaagaatctgcttttcaatgcaggagaagggggttcgatctctggttggggaatcaagatcccacatgcctgcaaccactgagcctgtgtgctttagagcctgtgctccacaattagaggagcccccatgtgtcacaactagaaaaaagcccacacaccacaatgaagagcctgcatgctgcaatgaagacccagtgcagccaaataataataatttgagaaaggataaagaagctgtggtacatatatacaaaggaatattactcagccattaaaaggaacaccttagagtcagtgctagtgagtggaagaacctagaacccattatacagagtgaagtgagccagaagaagaaaaacaaatattgtatattaacacatatatatggaatctagaaagatggtactgaggaacctatttgcagggcagcaatggagacccagacacagagaacagacttatggatgtggtggtggtggggaggggagtaggaaggagagagcgcggcaaatgcagagagtagcatggaaacatatacactaacgtatgtaaattagacagccaatgagaatttgttgcatgactcagggaattcaaactgagtctctgtaccaacctagaggggtaggatgggaagggaggtgagagggaggttcaagagggaggggacataggtatacttatgtctgatctatgttgatgcatggcagaaaccaacacaatattgtaattacccttcaattaaaaagtaagaaaaacaaaccaaaaatgtaatttgagcaggaagaaagagttaagtgactcactctgagtttcagagctgggatctgaaccagatctcaatgacattaaaacccagggcctttcttctgaaggggtaggagagaagagaaattcacaaactgaggagaaatgaatctttgcagtgagaccactgtaggggcacttttccccaaagtttaaagagagggatgaatgggagacactgattaaggatatgcttaggagggcattccatagacagagagacactgagacacagagacagagagaccaatggaaggaggtagagatagaaaaaaaaatagagaaagggggggacatggagaaaacctgaaagaaaggacggggacttaattttcttaaaatggacaaggaatttgaggaattgaaatggtatcacagaccagaataagaaaaatgttacaattttgagttacaaatctgagttgtaattttcacatttgtatgacagaactaaaatggtgcttaggacagggttttatggctgactttgctaaggaaattattatgaaatctatgcggttaataaacactattcacattaccagtctctcagccctctgactattgtgggggtcgaagcataacacactcaattaattttacaacagcattaaatatccctctttgttagacagaaattgcctgcacaaacaaggctgcagcaattaaattttggctacccttgggagtatggtaataaagaattcttttgtccaattaacaacctcaaattgattataaacgggactttgtaaacgggaggtcaaggcaatagagaattaacccgtgaattttaagccttca

SEQ ID NO: 63352 - DNA, 1452 bp, Bovine  19866880437939
atcagtcctcagaatgcagtgtgcagatgtacgctgaactattctagggacatcattcacagtcagtgtggtgtatctttgagttgggcagtacctgcaccgatgtatacgccaatcctagcactggtgatggtggttaaatgggatcatgtgtgcagagggagttgtgattattgactattttagagttgagaaacctgaggtttaaggagattaaaaattagatcccataactaatagcagtcaggattctattgtgagtgtaactcactccaaactccattctgtcaactactatatttgcctgcctactatcttgtctagagaatgttcatgatgacaaaataaactttcgtgctgtaaaatccctctgggagtggcctcaactgtgaaggttaataggtggatgtttgaagcctttgataaaataatgtaagtgctctttctttcctcaaatgaaactgataacaaacacatctaagtgcttctgtgagaaaaacaaacttcctgatgaaattctccttcacggcagctttgcgagattttagcaaatccccccatcatgccccaaaccagaaaggcaacactgacttaaagtttgtctttaattatatttaaatcatgaagcttaactgaatgtattgacatttatactgagaaattcattgacattctattaacctcgatcagcaaattaattcttcaacctcagacctagagcatgtgaggggctggagcacagttacacattgatcatgggatatggtgtggcttggtcatgtgggaatcgactggctaagcctaaagaaacagacccctggcttgcagaggagaaattcactagatacgtatttgaattattttttgttgtgaaagaataaaacatctgagcctctcacctttcatttgtcatgtcagatgggagttgagaaaaccattgggagagccaatctctatcaattaatagtcgtgtttacattttcacatgaatggagattctactccacaaattcagctacatgcttaaagagatcatggctagttaaagaaaatttgtctctggttatcgtaacttccaggatcaagctgatgttgttagatttttgtgctaagattttgcatgcaatgtaactgtcagaggtgtttgtttagggagtccaaccttgcttttctgatgaagacagttctttggccatcacctgtgagcggtagcactgactctaagatgagttactaaaagccctgtcaagacacaaagaatttcatcccaaaatgtcttcctttgacccgtctggtgacatagcccttcagagacagagtcttagtagacgtttttttctttagtgtgctctcttaacaaataaatgcattaaagtggaggaattagaggaatttttttttaatttttgaaatactaatttgaaaattttttatattgaactggtagttgat

SEQ ID NO: 63353 - DNA, 1376 bp, Bovine  19866880444361
atggtaactatctccttaatcaacaatccagttttaaaaaatctaacttgataaaaattatctgttcctcaggtttttttttttttaattcagatatcagtcttgctgtattagcagttctatatctgagcattgccagggaagttagataggaaattcagcgaatggcacactatactaatctttgctagaactctggagaatacaatcacaagatcagcccatcatgtctaaatgctcacaggcagctggattggatccacaggggccagtgcccctgtcatttattctttaaatgtcccgcctcactgttcagaggcaacttggggcagatctaaatagctggggctctatctgccagaaggctaatttgcaaagatcgctgcaagatgaaagtgatatgaaacatgacaactgaattttccagcagcaaagagaatagccaaaggcacgaacagccatcttaagctacaaacagagaaagggaggggaaagcttctcttaggaaaagattaaagccaggtgagatcaagtaagtttagcgtgcttgtaagctccctttgtatttgacacatataagggtatcatattgggaaaaagaactccagtttcaaacactacaaagaccaaacaggtcacacagtgagggggcacaatgagctaaaggaaaacagtagtggtagagactgttgacaactggaggaggttctgaaaaaaaatgcagtattggcagatcttctaatctttttcaaagaaaagtccatttaaaaaaattgaaagctccttattattaaacatggataactgattaaacatgtataacttttttttaaaatttcttaaaaccaacatgcaagccaaacaaatacgtcttcaaaccaggtttggcacaaatggcttgcaatgtcttcaaggaaacttagagactggatgtttcacactgtattgccatgaagctgggaaagtgataaaggtttccggagactcctcctgacctttgataccttgggctctgagcagggctggtctgcatggcgcttgtgtgaattagtgcactgccccctctctctgaagtgacagctcatgtcagccacggcactggcaatagaatgaagttggggttcagagccccttcctatagaagaacttaaataatcagccttgtccatgaagggcctccattaggtctttttaaaaaaaataactggagtgcaattacaatgttgtgttagtttctgtgcaacactgtgaatcagctatatgtagacatatatcccctacctcttgagcctccctcccaccccaggacttaatcttagtagacaaagtatatgctcttccctccagattttatgagttcgcttttctacataaaa

SEQ ID NO: 63354 - DNA, 810 bp, Bovine  19866880516862
aacttggcccctagaaaacatctaagttatgcagtgcaccatttttgcaatggatacttagcaaaacaaatttgactacaaaagctcatgaccctttcaaaataaaaataattttattttttgcatgatgcatatttattatgcatatatgtgttattataaacttagacatgtataggtaagttatcagtatggatatatatgaaaatacagatgcagagataaagatatacagatatatacatatcaatgtagatacagactttttttttttcctttaagacttctactgataatgttctccatgtttggaaggaaggacactaaggactatgaatttgtggctatagacacacacgtacacacgtgtacacacacatatccagtgaagtttcaagttcagaaatttactatttaatattgtatttaatttactatttaaatttaatattgaagacaaatattagcccatggttttcttgatgggatattacatgtcacaccagatacttctgctactgcagacatttttcatcatttctgtgaaggaagaggcaatatatagtggcttggtatgactttgtgaaatcacaaacctgggcaacccaacattagccatgatctacaaccctggagtgtgcttatgaaatattctgatgaacaccagccagtggcatcatataattattgctgctattaggttattatttatgctgcattcgtgtagctctagcagagaaaacagttggcattttttattatagtgccctggatatcctacccaaaacaaaggcagattctctagtaaag

SEQ ID NO: 63355 - DNA, 1470 bp, Bovine  19866880529600
tttcatcaagaggctctttagtttttcttcactttctgccataagaatggtgtcatctgtatatctgaggttgttgatatttctcctggcaatcttgattccagcttgtgcttcctccagcccagcatttctcatgatgtactctgcatataagttaaataaacagggtggaaatatacagccttgacatactccttttcctatttggaaccagtttgttgttccatatccagttctaactgttgcttcctgacctgcatacaggtttttcaagaagcaggtcaggtgatttggtattcccatctctttcagaattttccacaggttattgtgatccacacagtcaaaggctttggcatagtcaataaggcaaaaatagatgtatttctggaactcttttgcttttttcgatgatccagcggatgttggcaatttgatctctggttcctctgccttttctaaaaccagcttgaacatctggaagttcacggttcacatatagctgaagcctggatgattaaagtgcattatatttattgtgcactttatttctactattattgcatcaactccacctcagatcatcaggcattagattttggaagttggggacccctgctctagaatataccccaccgtgatggtaggagtcttgccctccttggttcacagccaccttccccaaagtctacaccagtttctgatctgtaacaaaccatcaagggttacttgtggagtgaacagataatgggtaaatgggtgaaccccattccaggcaaagctagaagagatcagaatggattgtcattggagacacagaaataataaccaagtgtccatcatgaaagaacaaattatgaaaagatatactcacatatcaattaagaacaaagtggtaaataatggatttttaagagcatgcttccagaatttcaccctgaccatgcacctagatagagctgtcgactttccaatgactggcttctctccaacccaaaagaacagaagaaagccgaatacttcccagaatgatgaaattatactggacaacttaatgaaaaattcgcagctgccactgaggcattaaatggttggtttccacatggaagcctccatggcttgtgacaagctcttgacaaactgtttctttattttttcatggaaatgttatggatgagaaagattaaccaaaaaggttttccccaactgcagccttgtctgagcttcactgctcaccagtcaagacacagccagagacaggaccagaaggtcccaagatagatgacactctcccatccagtgaaaatgaagtattaatcctgtgttgttgtttttgtgtgtgtgaggggacttgcgttacaaattgctcatatagaaagagggctcgtttcttcttttccagtgtagtttaccacccctgacttccaccaggaaaaataaagcgtcttctttggagattttcaaattcaa

SEQ ID NO: 63356 - DNA, 2553 bp, Bovine  19866880624801
aaaataaaagtaaataaaatgtgaaaaagagcagtcccaacatcagtaggtctcttagaactgaatgagttaatccctgcaaggaggaacctagaggcatatctggtacataataaacagtacggacctagaatcatcatgactgacggtgttttggggagttagtgactcaacagacacccaaaggaaagggtacgtcttggagcagagatttttctcaaggcctgttgcagcatcttaatttgcacttggttgagaaagtataaaaatgaaagcagtgctatgctatccaatgtgattgaattttcaaaaagtctgaggaaaacaacagagggtatctggcatattaattagcaggctgacacaggaaaaggatatcatgaaaagtcaaataaaaaaagagccaaggaatctgctttgatgacaaaaataaaaagaaacttcattactggagccaggagagagagtttttcttctataatttgggacccttatctcaagttcagatctcaaaaggtgacggtcagggcacgtgacctgtgctaagttcacagttgatgggggatgaagcagctggtgtgaccctacaagacccatacggctctagtgagtggtaaaactgttctccaggcttctactatgggtggtaccatgccttcagccaggaatacaaatgtgaagggacatggattaataataaccacagtgtttgcaggagatcatccaggcaaggtggtgtgcaagaagattaactcctgaagatcctaaaaccaggggaaggtatgggagatgaaagggcagttcatttgctttaaggagacaaatgtattcaattcaggaaagcttacttaaaatgcatttatttcatcaggagctttacaatagcaaattatatggtaatgaacgtgggggtgagttttgtctctaaggtttacagaaatggaatttctgctgagtcctggatttaggaggacatgccttgattggcaagatttaagaagatgcaagtgagatcaggaggaaagaggttatttgatgattactttcttgaaatccccaaaattgtagaagaaagaactcaggcctcagtcaaagaagagaaggatctggctatgtctaaacttcatggttccctgggacttccctgggtccagtggctcccaatgcagggggcccagattcgatccctggtcaaggaggtagatcccacatgctccaaataagagtgtgtgtgtcgcaactaaagatcctacatgctgcaactgaaatccagcacaaccaatatataaataacacaattttttaaatggctgctacctgctcttgtctggcttatgaggcccttaactaaggcaaactcaagagaagaaggcatttggtttggacataaatggtaagtcaggagtggcgccctggagtctcgcttcttctattttggaagagggacctggacatcagaaggatttaggtggagttcaaacaataagatgacataaggaaggactttgaaggtatataaaaggacattcagagtttatgtctttccaagcatcttgggtacagctcttgctcccagtggtgtgatctcaacctgcaaaaagaactgaagagcgtttgaattccccaacttgattgttaccctcacaaatcgtgtggtagtcacagaagaaggtccaataagaatcacgtcgagctgtgaagatccaggaggactccctggaggaggtgggcaggggaaatgggcttatacagagaattctgagtgatatctgttctcccatgagtgtcatgtttgaagaaaggtttggaatatatcaaattgcacttcataaagagcacatggcacatctgactgtttttgcttaaaaactctgttggccttccccaagcatcttcagggctgggtctggcagacacatctgtactcttatgtcatcttatgtaaatgccatggaacgtcaccatcaccaaggcacttttgattattttcaaggataactgcctgtccagactgtatcttgtgattaatttttatctaaagttccaactcaattctaataactaaaattcagggacttccctggtggtccagtggctaatactccatgctcccaatgcagggggcatgggttcaatccctggtcagcaaactggatcccacatgcggcaactaagtgtttgcaagccgcaactaaagatttcacatgcctcagtggagatcgaagataaataaagtcaaataaataaataaatattaaaaaataaaattcagtggtcaaggctgagacacagcaaaatcagaaacatcagaagctcagcattaagaggagggtgtgcccttacaatccagaggagagctgagtcacccacatccatcctacattcagaacagccatcacagttatggtacccaaatagctaccgcccagcatgaatgaaaacactgtttgttttatattaaaataaagaacacatgttaataggtttgaaaggatattcaactaactgatacggcattcaaattgatgaatatcagtctcatcatctttgaat

SEQ ID NO: 63357 - DNA, 1303 bp, Bovine  19866880707721
tcttgttgcagattataggctctaggcacacgggctcattaattgtggtgcatgggcttagtctaagacccacaggtttgggatcttcccggaccaaggattgaacccatgtccacgcctgcaatggcaggcagattcttaaccactggatcaccagggatgtccctggactactcttatgcccatttcacagatggatgagagcacgtagtgtttgaagaatggcgccaagcgattcaggtgagacactgagctggaattagattctagatagatgggctgcggagtctgtgctcgaaacctgtgtgctgcacctccctgaaaacagagttaaggctgttgatcagttcaatatgtgggaagacctttggaaaatgcaatgcaagaatgtgcactcgtaaaaatatgaaattgagaagtcttaactgaaataggaaaagtcatctgaaaatgaattatttattacacacaaagccactgccttttcttttcagcccactgtgctacctttgatgctcgctaatgagctgtcctctccagaggtgatttataatgagacagtggtggctgcacctcggtgcttttaaaggtacatgatgcaaaacaaatagggagacttactgctattgttgtttagtcgtgtggttattacagccccagagactgtacaactggttgttctcagtgaacaaatgctcatgatgtaactcattttgcaggtaccccagaaaggcagtccattgaagaagcatttactgagtttccctctatgtaccaggcactggcctttgtgagaaggggataacagcatgcatcgcactcatgggaggtggctggtaaaaaatgtaccatatgatccagcagtcctgggcatccatccagacaaaactgtaatctgaaaagatacatgcacctcaatgttcatagcagcactcttcacaatagccaacacatgggagcaacctaaatgtccataaagagatgaatggataaaggaagtgtggtgtgtattgtattaataaatggactactactcagccataaaaaagaatgaaataatgctcttgcagcaacatggatcgacctagacgtcatattaagtgaaataagtcaggcagaaaaggacaaatatcatgatatctcttaatgtgtggattctaaaaagaaatgatccagatgaacatatttataaaactgaaatagactcacagacatagaatacacacttatggctaccaaaggagaaggggggataaactaggaagttgggattaacatacacacagtgctatatatcaaacag

SEQ ID NO: 63358 - DNA, 610 bp, Bovine  19866880717279
catcgaaaaacaaaaaacactattatgtaagattctgtcttgtgtgcttgctaagttgcctcagcagggcccagctctttgtgaccctgtggactgtagtccacccggctcctctttccatgggattctccaggcaagaacactagagtaggttaccatgccctcctccaggggatcatcccaatccagggatcgaacccatgtctcttaaatctcctgcattggcaggtgggttctttaccactagcactacctgggccacctaagatattgtcttatttatttaaaataaaatgatcagggatacttgtgaatgtatatatgtcacgtgtatatgttaagtgacacacattccttggccctatagttttgacaactgcagttgtaaatgttatttggccttgaccttttaaagaataccatttttatgtgctatattcctgtgagatcatttgagggaaatgggaatcattagggtagaatataattatctctttaaaaacttttattattttctaaaatatgcaaatagtattcttaaacagtagacgagttcataattacagacacacaagggattcttaaaatcatcattataaaatcccaccat

SEQ ID NO: 63359 - DNA, 1627 bp, Bovine  19866880724060
aggtttacttagacaatcctaaaatacaatctcacattctcatgatttctgaggctgctaagaaaagtagcttggggaaccaccctgcaatttctcttctgaaaaaaaaaaaatctgattatatccgagagacgtgcttatttctcatttaaaaactttctaaaatctccagacttccgaatatcttcaaagcaatatatgcaaagaactatcaaaagtttgcagcagatcctaaattcaactaaggctaactcccagatgggaattggtaatgataaatgccttgaacatcctgagacctggattctaatgatccaggctcagaacaatttctccatctgtgaaatatatgtcttagaccaaacaccgcttactcacaatttctgtgattttcttaagtgatgttggcgaccacaggagagattaaatgccaagtattagataatggctttgtaatttggccaaagatgcaaaatcacagaaaaacagatgttaatatattccctacttgaagccacagatcaaatgaagagatactcagacggcaccctcccaaagatttaaaattttttacataagaagtactcatatatagaaacctagtaatttcaagctctatatctttagtcattttaaataaatgcttttgcacactggctggaaccagaagttcttctttttgtgccactgttgcaattccatgacatgtattctaaaataaaatttgacatttttatactaatttgcggtatataagcagaacggtaatctggtgtataagacaggtctgcaacgagcagaaacccagcttcgactgctttttgccaataaacattattggcaagtgtatgtgacaaatccagggaaagtactaacttcaggtaaagcttgacttaggtgtaaaacatggctacctagaagacacatctaattttacgtctttctctgtgcatactattctcagaaagagtcatgccacattatggcaaattaattaccagcagctctgagtctgcatcctaccattccatgtagaaggagcagaagaaaacggaaaaagcttatttcctgtaaaagttgtaggaatggagacttcactggtggtccagggactgggacttttccctcccagtgcagagggtaggggtggaggttcattccctggtcagggaacgagatggcacatgctgcagctgaagattccacatgccatagctcaaagatcctgcatgctgcaactgggacccagcacagttaaataaatattatttttcaagtcatggaaaatgacattcaaacctatttttcatctacctagaccaggggaactatgtggatttggaccatgtccctctctcctctagagtcagagggtgggcttggttctactctaagcaagtgaactgagaagtggggaggactggccccaattttatctagttatgcattagtctgtctttggcccctagaatataagctccatgagggcagtaaacttgtcagtcttctttactactgtatccctagtacctataataccgaatatcacataataggtgcacaatgagtatttcagaagaatgaaaagaagaatagatgacggtcagccaaaagcaacagaagtcca

SEQ ID NO: 63360 - DNA, 1811 bp, Bovine  19866880735239
tgccctgtggtggccgaaatgggaaggaaatccaaaagagaggggatatatgtatacatacagctggttccctttgctgtacagtagaaactaacacacattgcaaagcaactgtattccaataaaaattaatgaagaacaatcacagaagtgatgctggatgcattttgcaacctgagactcggtttcttcatccttaaaataggaataataactgtacctagggcttcccagggagggggttcagtggtaaagaatctgcctgccaatgcaggagatggaggttcgatctctgggtctggaagatcccctggagaatggaatgactactcactccagtattcttgcctggagaatcccatggacagaggagcctggcggggctacaatccatgggatggttaaaaagctggacacggcttagcaactaaacaactaaaaaaaaagtacctgctttgtagcatgctgaaaggatttaatgagtttatacatagaattcagggcagagcctagcacagacttagctatcattattattatgattcaccaacttgtgtaaattccaataaaacaacagagattaatacacagtgctttgctgtttgcaaggaacatccacatactctcaaaattattgttaattaaacgttggatgatttttatagctagcaatataaatagcaatatttacaatagagtagaattttatttttaagcagtatgcatacactttatggtaaattggtgttctttttataataaaaatataacatatttattctcatctcataggataacaacatccttattaaagttattctagaggcttatagctttggtacattattttaagatgctggtcatatctttgatttacctgatacagagactttgcctaaaattcacccccccccccccccgcttatgatttctatagaatctatgaccgttttacaacagagtcctgaatgatagagtttctaggaataggatgtgataaagcacactgtttattcctctctgcatgtgagactgaacaaaaaaaaaaaacacagactgaaataaagcaagagagagtcgggcgaggagtgagaaatgtcttcgccgctggcatagaaccctggatgctggctgaaagaaaagaaagaagaagaaaatcgcactctggaatgttgagagtcactctctgaggccctgaaatttttttcttctgggctgaaacagctccccatttcaacgaaggcaatattctgaacacacttgtgcggacgatgagaaaagtatgttgacacactctgtcatccactctgtgcaaggtggtggccacagcccttccatccctttcatgaacgtctctttgcaataggacctgcccactcctcccataaagtgggaggtctatttccccatctcctgaatctaggctggtcctggaatttgcttttactaacagactaggtcagaagtaatgttgtctgacttccaagcaaagcttcaaaagggcttacagctcccaccctcgccatcatgggtcccttgaggtcaccccacaaagaagcctgagagagcctcctgaagacaaaagaccactttgacaaagatgcctggctaccacctgcatcaccaccagacactcatcctgtggaccaaagaaccatgctataagagctgtagcaaaactcccagggtctttcctggtggcccaagggtttagggagtctgtctgccaatgcaggggacacagggttcgatcccaggtgtggggaggatcccacatgcagtggagcaactaagtccgtgcgccacaacta

SEQ ID NO: 63361 - DNA, 844 bp, Bovine  19866880787710
tgagtgccctgtgctgctagaactggatgggggcttctgccttctggtcgggcccctcctacagagcagcaccggagaggcagagaggctaagggacttgcctgatctctcacgagatctgagcagcaaagccacagtgaagactcctttctctgagttctttgctttcccctctgttcacagacaactgccaggaggggtccggactcctgtaggcgtcatgtatcagaaaatgtgctcacgtgggcctctgaaacaggtccgcctgatgaatgtcagggcctgagttgcttttattgcaaaataaccagagagagtgacagggctaatgagaaggggtctggataatttgtggagctttgcctagaaagtcagtgtttccagagccagtaatttccatttctaaagccccttaaattggttcttgaattatgtaatctctgtttctgtgtttttcttacagaatataaggcacattgtaaaaataacatttttggattctttttctccctgagggcgggatatgttcaggaagggggtggggggagaaagactttctgtgcattggtgtcaacacagctttcacgaaggatgtggaggccacaaaagtgatggacttcccttgcttcttgggtttttagggtcacatggactcgacatgatggggttgggtcatcgcatctatttcaggtttccttccagcagtatctttccaaggtcttttctgtccatctctcagcttagccctaaggaaagtacatgatgtgcaagtgatttatgattgtccatctttaaagtcttttatcatgttcccaggtaaatgtgtcaagggtagagtatgtat

SEQ ID NO: 63362 - DNA, 1233 bp, Bovine  19866880840746
tttgttttttttttttcatggtgttcctttttttttaaataatttatttgcttctagagtgcttgctgccatctctgaggtggattttgcttacaactcccattttgcatgtaaacaaatgtaaacccagcaccgttacaagagtttcctcaggttctgtggctctgaagtgaaaatccagtatctgattgcaggcagtctggctctggtgttggtttgattcccttataattgtttaaactttgtcacgaaagtccacatggcatagaggcagagtctgacaaattttcataaaattagtcaggtagttagctgacttcatgtaaatgaaatgacagagtgtggactctcccattaacatgagctcatccctactgttgagtacaatcatggatcgttaattctcatagcggtattgtgttgcattgtgtgaatacactggaatttattcatcctactcttgggtatttcagtagtctcccagtttgggccatgttctatgtacattctagtccatatcttctggtaacatacatgcacccatttcttctggagtataattcactcaggggtgtaattgatgggtcagaatccatccatcttaaacacagcaccatgttcttggaaaaacttggtggtggttgaagtactgtaaaagcctatgagatttcaataacaatcgaaatttccattctgctactgaaaaagaacttctatgctaaaatattcaagagtcagtttaaatatcaaacccttctagctgataatcaaatgtcaattcagaagccagtttacaagactctttctttgaaatttaccacttttcaagccactatcatttaagtcaaggttagaacatcagatcacagttttttgagcacttacattctttccagcccattaaactgaaaaggggtattcaattaccaagtattactgtaatcatccctgaaaaatcatttctaggcaatacttacagtatagagacttgctccagcaaaaacaataattgtcacttgtccatcatattgaccagtagggctggactcgagatccctttagcagggcagtttacaggtaaggtgatctgtgaagtggaaaagtacaggctacccactgttgcactgtactgcttgatagtagaaaacataaagtcctaaacctcaagtattaaacaaaatattgattcaatgaaagagaaagaagaggagaccctaattattaccctaggaa

SEQ ID NO: 63363 - DNA, 4306 bp, Bovine  19866880860346
ctgcagctggaactggcaacatctgaacatgttgtcttgtagaatggatatcagttcagttcagttgcttagttatctctgactctttgagaccccatagactgcaacataccaggcttcccggcccatcaccaactcccagagtttgttcaaactcatatccgtcaagtcggtgatgccgtccaaccatctcatcctctgtcgttcccttctcttcctgcccccaatccctctcagcatcagggtcttttccaatgagtcaactcttcacatgaggtggccaaagtattggagtttcagctttagcatcagtccttctaaagaacacccaggactgatctcctttagaatggactggttggatctccttgcagtccaagggactcttaagagtcttctccaacaccacagttcaaaagcatcaattcttcggggctcagctttcttcacagtccaactctcacatccatacatgaccacaggaaaaaccatagccttgactaggtggacctttgttggcaaagtaatgtctctgcttttgaatatgctatctatgttggtcataactttccttccaaggagtaagcgtcttttaatttcatggctgcagtcaccatctgcagatttttattgtctctgtatttccactatctaaaagaaggaggtctgacattcagagggtattcaagatgtccttacttactgaatgaatgaatttactgcttacccttgccaagcttcagtcatccatacatagcatttttacttttgccacgtatctaagcaccatttctgttattatcttttttttttctattttttggttgcaccctagggcttgtgggatcttaatttcttgaccaggaatcaatccagatcccgctgcagtgaaagcatggtgtcttaaccactagagcactggggaagtccctattacttttttttttttaccctaaccttcttccaagtgaaatatttgcaatcccagttttgatatgttacttacagtttctaagagattaaatgaaacacacaaatattgtgtttcaaaagcatccatctatgatctatgtaccacctagaattcttacactggctatgagttgaatcatgtccacacttagtgataccctgctggactgcagccagtccttaattgggtccagggcggtctgacttcttcatgaataatcaggaagtctccaaatccctttctcacttagagctgctctttctaggttaggggtgaagcaatgggggggagattgtttctcgaatgctcttagcgtatgcaaactgtgaataaataaaagatgatgacatctgaggctggcagagaagatcctcgaggcagtaactaatcaccaacagatgtgaggtacaaattacagtgaagagagcaagcaaatatgcccaggatttattgctataaagatgaataaaccttgcctcctccaaaagtctctaaaatggactgtgttttaagaaaaactacttgtgagatgaagggcatgatactttgtgtccctgggacatttctcctacattgtacctaaaaaattgtaaaaaaggatgttctctaatgagacattatttctcaggccagctcaagcaacctgtttctagctgcctccttttggtccaaaccctgcttatttctcaccaaagattcccagcctgggggactcttcatcccgtgagtatatgatcttttcaacatcagcagggcagtttctgactctcacattgcattaatgcaactttcttttgtgatttatatttatgccaatgttcaattcttccactttctccttcccacagcctcaatgtcctctccaattcttttcatcctgataatatcctttttgtagctaagtcataggctgtcactttgcatttgtgaatggagtcagagatgtgcatgattatttttatgaatgcccataatgactaatgtactgagtgaattctgagggaggggctttaacttctgcctaatggattgtctcctccccaccccaacgaaacgcttagctttttaacaatctgcctgtgtggaacaggtgatgaaaatctgtcattctttttcagggttttcagagattgtgaaaaaagccaagcctatcttccaattgcttgaattccagaatcactttaagttgtgattcaaaagaagagggaaatgcacttctattttaataagaattggaccagaatgagcttagcctggatatataaatactccttcaaagtcataattaggctgtctgaaaaaaagatgatctgtttttcaagggaaagcaacatggtgggctgagacgacccagcacgtgatatccagagctagatttctatgtcacttctgacttggctatcagataccaagaatgtcatttaacattatgtgtttctgcttcctcatttgtcttacaagtttctgtaaatgaggagaatataagaaagtatttgaaaacctataaagtgctatataaatgaaatcatcctaataaagcaaggctgcttaacaaaattgattattgttgcaaatgcaatgatgctttgtctacctaacatcctggaattaggatccttagccttccaagtttgttcttttacaagaaataattttatttatttatggctgtggtgggtctttgctgctgccggggctttcttctaattgcagagagtgggggccactctctagttgtggtttgagggcttctcattgtgatgggttctgttgttgcggagcacggggtctagggcgagaggacttcagtaggtgcatctcctgggcttaagagcacaggctcagtagttgtggtgcatgggcttgttgatccaccacatttgggatcttcctggaccaggaattgaacctatgtctcctgtgtcggcaggcggattctttatcactgagccaccagggaaggcctcaagtttgtttttgtcatgcccaagaaccttctagacttagcagaatgaaatctcctataggggtgaggatgtaaggcaaaatattttgcagaacatacacctcccctccccactgatcgcaaactcctttgagaagcactgcattggatccagagactgtctcagtaattccagcacggtccagcaccctcccagctctagaattggtcatcattttttggatgaacgctggatccactgagggggcttggatcagagaccatgctatgtgaaactaggcattttcagaagcttctgcagggagatgctcacatcctgagaaccgtctggggagggagatcatcggggaagagtagattctggctcccttttccccattgcccccaggaagctcctctgcatgtggaaggtgtgaaatctccttattatttgattaagacttctcttttgagggacttccctggtggtccatgattaggacaccaatgcagggggcacaggtttgagccctcatcttggaactaagatcccacaggcctcatagcccggcaaaaaaaaaaaaaaaaaaaaaaaaaatctctctctaagctcatgtgtgtacttgaatttccatgacaaattcacatgcgatatggttctactgggctcagatgcagctgccatttataactataactcctgaatattcattggaaggactgatgctgaagctgaagctccaatactttggccacctgatgtgaagaactgactcattagaaaagaccctgaggctcggaaagattgagggcaggaggaaaagggggtggcagaaatgagatggttagataacatcactgagtcaatggacatgagtttgagcaaactctgggagatagtgaaggacagggaagcctggtgtgctacagttcatggggtcagagagtcaaacacgacttagcggttgaacaacttgaacttcagaaaatcttcccaccacatggcaaaagccatagaagaaagcaggtctccaagagaagtctaaatattaatttaatttttaaaagaaacttattattttttggccataccaaaaggcatgcacgatcttcactccccaaccagggattgcgcttgtgcccactgcagtggaatcatggagtcttaaccactggactgccagggaagtcccgagtacatctaaatattagaaacatcacttttttgttctctgtgctagaaccaggtgaatcctggtcttctggaactctccatcccctattcactttgcttggatgactctttctacaaccctacagagaatacatttcttttcattacaggcattaaaatccattttgaggtttttgctggggcctctgagaaa

SEQ ID NO: 63364 - DNA, 815 bp, Bovine  19866880915911
taaaatgtttcctacccaaggcaccatttcattgaatagcaccttttatagggaactaagtcattggcaactctgaaaactatactgttaatctgtggggagcatgcaaaaatttttttttagagatagctttcaaggacactgatgataaatctatgaaaagaactcttacaagccagggatttatggaatttgccatttatttgtgtctttgcttttgtcaataacactacgatctgctgttggtgtggaattatccactgacccaaatcctagcaagctatcaaaatctgtttctcagctaaagtcgtgcagggggagatacatttatcagtgccaggcaggtggccactccacagagggggctatttgtgactcctttcagtgtcggtcgaaacggagaattagggataaatcacaacccacttacacaaatagttttcaaccattactaagcactcattgtttcaaaagtaccatcacagaaaggctgtctcctggtttcctatgaacttttaaaggataatgacacccaatttgtttatctaatgcacagccctgaaaattactgacacggccaacatgatttattgttctcacattatgcaaagtgctttggggagatcatggctcattatgcaaaatcaaaaccattgctgttcacttcaatgagtctcaatgtgtcactgccaggtgccctccttgactgacgaccgtgtttgtcagcgacctgctgcctaagagttcaaggcaagactgaaatgccaagtatagagtcttatctggggagatgccaagtggaccaaagtcggtcc

SEQ ID NO: 63365 - DNA, 1349 bp, Bovine  19866880938362
cctcatagctcagtcggtaaagaatctgcctgcaatgcaggagacccaggttcgattcctggctcgggaagattccctggagaagggaatggcaacccactccagtattcttggctggagaatcccatggacagagcagcctggcaagctagtctatggggtcacaagagtcggaaacgactgagtgactaagcgcacacgcaaagtggtggttgtggtaaagaaaccagcagtgcaggcagacatagaaaacatggatttgatctttaggttgggaagacaccctggaggagggcatggcaacccactccagtattcttacgtggagaaccctatggatggaggagcctggtgggctgaagtccataggttctcatagttggacaagactgaagcaacttaccacgcatgcatgcaagccctaccatctaattagtatgtaattaagacacttaagaaagtaggattttctcttgctaataatggaccttggtaaaataataaatgttgtggcaaagtggcagatgtttttaccacttcctctgcttcctaaagaaatttttaggaatgagaactttgtactcatttaggagagaattaccagacagctctggcaatttgtgaaacatcatcttaaaactggaaacctggaatagaaatcctaaccatgctttgcactgtttgaaaaaaaagtgtgaaaattccctaatggctgcagtctttaatatttgatttttttaccttgaatttttttttttttttttggtagaaaagtgcaaacctagaaaaccttttaccaagagtttaaataatgaattagagccaatcctttaagggcactaagtcactgggaatcccaccatctcttaaaaagggaactcctggtctcgtgagtgaaaactgagaaatagtgaaaaaacaaatgtttggcccacccttcctcatggctgtgtcacatgactaggaaaatcaataacagtacaagcatccaatgatgatctcatttttttttttttatggagctgcgtcaattcactgctaaatgatggcacttcataaaggacacagtcagataattccattgtatctgaagtcgagtacgttaatgtagcctgaattaatttccctggtgttaaagtgcaaactgggctaataaaagtgacacattgacttttccagagaataatgtgcagcttatgaggaatggcagcgtaaatgaaaattagcctcaagacaatgttaattatcctctacccattagcagaaggggaattgaatgactcgttttacagcaaagaaaaccctgctggcttcgtaaagggaaactatagtatttaatgttctaatta

SEQ ID NO: 63366 - DNA, 1165 bp, Bovine  19866881099332
ataaatcttgatggagtgaaaatgtgtatcatatgaaaattttagaatggaatttcccatttatttgatgcattattcattgaaatcaaattatctgttaataaaatgcagttgtttagacagggcattgaggatttgttgcaaataaaattgacttgtatcacaattgaacataaatagatacatccttaagggagaaaccaattcatcattaattctcatttttaaaagtataggccatgtgcttggtaccctatgtgcaaagtatatgacaggagaatcataaagcagactcagtctgaaacagtaaaaataactaaagattcaaataattaaagatcttatgcaaatcatcaaggaaaaactaaacaacaggatagaaaatctagcaaacgacatgagtaagcaattctcagaggaaaaaaatgtcaccagcccccaggatgctctgtcttcaggaatcagggaaacacaaaatgcacaatgtcgtttcacatttatcatattggtggaaagagaattctgacaagaagtgggataatgggcatactggttcactggggttccctggggacaggtgtgtaaattggtgtgtctcctcaagggaacaatttggcaataaagccaagcagaaggtcttcctctgtgaccagcagttctgctagacagacacttgtgaaattcttggcatctggatccagaggcagctacaaagatgtccactcattgcaataaagattgtgtttgggggctcagtcacatctgattctttgtgaccccatggattgtagcctgccaggctcctttgtccatgggattttccctgcaagaatactggagtgggttgccatttcctccaaagggatcttcctaacccagggatctgtgtctcctgcatctcctgcattggcaggtggattctttacctctgagacacctgggaagccctagagaaagattagaaaccctctaaacttccatcccaggaaagaattaaatacaaaccttgtgacttatgcgtacagtcatgcaatgtatgtgagttaaaatagagcttatgcatcaaaatggatacattcctctcaaactacaaacaaacaggaaataaagtaagttgtagaaaaggtatggtatgaccctatagccatttaaaagacatgcaaag

SEQ ID NO: 63367 - DNA, 1338 bp, Bovine  19866881099897
atgagattatatacacttttaattattgtcttatgtctttggacaaatgactttgatgctcaaagccttttcaaatggggatcatcacaccctcgttcatttggctgaagagaggagtcaagatgagggagacaaagtggtcacaccgggcccacccccttacatttgtagacttggaacaagcacgtaaatggagcttgtgcaccatcttggtttggattctcccagaagcagaagctgaaacaaacattgaaatgcaggtatattttgtggacaaaaaggggaggggaagtaagacaaggaagggcatagagccaataaaaggtggcatcaagcgtgtcggtcatgtggatgacggcagacttcccctgatggggtaactgagggtgaacacccctgagtggagaacctggagtacttctgtcccaacacccatcggtcttttgttggaagttgctcctgggagacccatttctctcatgttccgcctgctgttctggcagcagagcagactccagcaggaacctgaagccccgaggcacagagatgcagtcttgacaattggaagtcaggctgagtgcacctgtggggaagcctgggaacacgaggaggggtgaggggcaccctcagcatctgctgcacacaacatatgtctccatactcaagagttataaatcaagtaaacaagctgataaataaaagatgctctgtcctcccatcatggctaatctacctttgtaactacctgggctgccacattaggatccagaattcttggatgcaagtcctcagattctgccttagaatctgtgtcccatggcacaatcaacctgggcccacttccaaacctccccacctggccaaccacgaggggcatacacaggcatttggagagcgtcttcagtgccctctgcaaagagctgcccctcaccaccccttgggtttggctgtaaacacatgggcagtggacccatgtgggttcgctgaagatgcatccagggaagaggatgtgcagatgcagaagtgggttggtccactgggacaacagctttcagggtccccaggcgacgaacactgatagtgcctgactgctagcgcctccatccttactgtgcccatgaaagctgacctcacagtggccgaaggacccccagaagtcgttgtcgtaatccctagtgtgatggtattaggaggtggggtctttggagggtgagtagatcatgagggtggagctcacacaaatgggattagtgcccttataagagcttcctggagaaggaaatggcaacccactccagtactcttgccttgaaaatcccatggatgggaggagcatgg

SEQ ID NO: 63368 - DNA, 647 bp, Bovine  19866881167797
tgcaggggacgtgggttcgatgcctgctgagggatcacgggaattaagatcccacatgccgtggggcaactaagcctgcacacctcaggtaagacccaacacagccaggataaataaataaacatttattcttaaaaagatatgcaggatttttaaaaataaataaatataccccaaaagctcctctcaagaaatctcttttgggcacaaataaagattaattaattaaatgagtatttcaactcaataaacagaataaattgaccctatgtagaaacatctgggtctatctgctaatctttacctatgtctctgaggattatttccccagaatctattgaaccccctcaagtctgacataagcttttaaaacatgtcataaatgatatctgaagatcttatccaggcaaatcaagaaaatagaggcatggtataaaagaaatctgcatctgagttattttcaatcactaaaaagctatctggcaaaagccaattggcttatattgattttgaaaatcattctctgtattaaaatattctaaatacaaatcagtgttctttgctcaatatttattgtttcacttgccttgaaataacatgagttgaagtccttacatatatatcatttcctttgcaagatgagctca

SEQ ID NO: 63369 - DNA, 1410 bp, Bovine  19866881254431
ttgtggaagaaagaacattgcttggctgactcagtctggaccccctaatgttgaaagagtaaggccttaagcagatcacaaaggaggaaattacactcatcagtgtggaaaaagatgttggcatgaataatgatcagggtaaggatacattttggaaatgttccaaagatggtaaaaggcaactcaccagccagaaatattcgtgtgggaagaaaagaaaatatgaatctctgtactactaataatattatatttcccaactgcaacttatagtggggggagaggaagtcatgaacccccagtataaggagaggaagaagaaaatcctaaaggtttccatggctttcttgaaagtaaacactacatattgactgaacctgaaatgtagaagtctattgaaagtcatggtgcactgattattttctatttatctcttcttttgtccaagattcattctccgcctcctgtgaacccagggctgactgagatggaccacatcacccaggggctcagatcaaggtccccattagccttcagcttccaactgggtttgccaatgggattttcttggcatgagaatagaagacagaggataggtatcagtcttctttcccacttctctgctatattccagattgcatatggctgctgtattccttcaaaaccctagcttgtgacaggtggtcccctatctctgagtctacctcttactgggccctcctccctcgtcaagcaagagtcgtggcttgtgaccacccttgggagtctgagggaactaacactgcaatttgccttactcctgctcacacctcattcttcactgaagtttctcccattccaaccatctggagtttcctgctggaaccctggctcatatgaaataattcagtttgtttaataaggtatttgaacacatctaagattcaaaataatctgggggtgtcaactggctagaactacaagttagaaactatccattggttttcagaaagttttttaaaagtcctattgtttgagattacttagccacacaatttcccaggcttggttgttggggttcctctttgagcagcagaaattaaatagataaaaagaagtcacactaacaccattccccccgtggctcaccttcccacatgaactcagacaggaaacaggacataggatgcccaataataaaatgttccaggggcttcttggtgagaagaaggcactgtcagaatgaataaatgcaaaggtatgctgtaagcttcaagatgagacacgacataccaagatctcgatattagaaacagtgctatttgcaatttcccaaatccttctcagaaatatactagttggcttgggtcagaatgcagagttttaagtacataacaatacagatacacatttaggcaaataaaagtaagt

SEQ ID NO: 63370 - DNA, 1591 bp, Bovine  19866881425976
cagcccatttatttcaacagataacttctctcctggtggatccaaacactcatgttctatttctctttacacagtccccagtttctgagaaagctctcttgcataacctcaggtgttttgtttttttttttctgtggaatccagcctgggtgctgccttcagaccagcaagatccccaggggttctcatcagagctgggtctaacgagggaagcttttgcacagagtgtcgactgattttcttccctcctgaggtgggagtggtgcgggtcagaataatgtactctaccctactccacagaagacaaatgatgcctctttggttcccccaaaggacaagtgagtccccagtccatatgtaatatctctgcaggagctctctgtcccaaagatataacacagcacagagcgtactttcttatcatgctggcggaaagtcaactcctgctttaacagtaaactctcctgacatctccaatggagataattacggtgcttaagggaacttttggccttgctaaaaatacttagcaacagtttgcatggcaaggaaggcacttacaggtgatccaggaaagactctggagccggtgtttgcgaattcatcagggtacccccctggctgcctgtccgcctccccatctgacgtgctttcattcctccttcatcctcctcctccttgacctcacactcctgcttctgacactagcaagcttaggtgaactccatcctacccaacagtgaggggaaagcaaggagataaagctgtttaattcagggactctggcagatgctgctaagggttcaccaaaccctaatttcctttccacttggaaacacagcttaactaaatttctcagggttccttgtggtagaagaaagcaaatgcctgaggcatggtcaatagaaatatgggagaaaatgatatcttccaattaaagcatggagcaaagaaagcctgtgggtatcatctctgtgtttcccccatccaccagctaaacggtgaagccctagagaagggcagagctacaagatggaaagaatctgggttcctgagtcaccatgtggaagatgcctactatacacatgctccaaactgttaaatgaacaaggaacaaactgtgttagccactgtttatgtcagataacccatcctgactaatacaaaattcctgacccagtgttcctcgtactcaaattctattgttcagttgctaagtcatgtccgactctattcccaaattcaactgggtcttccaggaatccctggaagagcccatgttggaatactacactctacgctgagctagctacccacaatgtacttcttcattcattatcatccttatatatgtcttccacctgctaattctatcctgtatgcgtttgctctaataaaacataatcatgagtatgtcccttggacagcaaggagatcaaaccagtcaatcctaaaggaaatcaaccctgaatattcactggaaggagtgatgctgaagctgaagctccaatactttggccacctgaggcgaagagctgactcactggaaaagaccctgatgttgggaaagactgagggcaggagcagaagg

SEQ ID NO: 63371 - DNA, 917 bp, Bovine  19866882032756
actgaagtctctgtttttttttccccctatctgataaggtgaactataatccacttaaaaaaatcttagcaggaatgtcataggggggtggcacagggacagagcagttgcaaattgatgtttctctcctcatcattttaaagaattaggattctatcaagcaaataataactgaagtttggcgatgcatcatgcaagattaatgtatgaattagtctctgatgagattggttttaattaagatcacaaggctgagtgaggacagcaaagtgaaagagtgaaattatactaagacaagttttctgtccagcaaatctatttggaagtgcccttaaggtttcttaggaaaatgctttaacacaatacaaaattattgcaggaagctggggacgccctcccttccagggcccaagagtgggctgttgtctaacacttggaaatgaattgtctgagcagacacttgtgctcacaaagcaagagacttcactgggaaggcgtgcctgggctgagagcagcagggtaagtgaacccaggagaactgctctgccacatggctcacagccttgggttttatggtgatagagttagtttctaggttgtctctggccaatcaccgtgactcaggttccttcctcgtggcgtgcacatcactcagccaaggtgattccagtgaggaggattctgggaggttggtaagacatgtggaatctccttttgacctttcctaaattcttccggttggtggtggcttgttagttccatattccttaccaggacctccttttgtaaaataactcatgcaaatggttactgttgtgcctgtgtagggagaatggtttcagccaatgtttccactaacaaaatcatcatggtgtttctactggaagttgcaaaccctgtttagtagatgcagacat

SEQ ID NO: 63372 - DNA, 752 bp, Bovine  19866880467278
ttcctagaaagccataacactccggtaaccgccaatgccttctaactggcctggacaaatttagctaaattctgtctgatgtgagggatgcacagtaagttagaattcagtggtgcaggtcatgcaggtacagagtaaggagcaattaactttggggcttctaggaggaggagatatttggtttgaattttgaaggctatgtaggagttctctgtgaaaagaatagggggaaaactccttgaatgtggggaaaagagtgagaaaagcaccctggatgtttggggatggatagaaatcaagtgaggctgagtgttgggtttacagagggtggcacaggcagataaatagctgggtctgggacacagagggccttgagagtcatgctaaatggcttggaattaaccgtataaacattggtgtgtgtgtgtgtgtgcatgcatggagtttttcagagagtgatatgatcagatttatgatttgtaaccatggctctgggaatctgcagggagagagttggtgccagggcaatcaattccccaaccagattgtaagtttcttgggtgaagcattaagttagtagctttccctctggtatttttccataacacctagcaggtgtggggcatgtagttggtgctcaacaaatgcctgctgtatgaagtccatgcatgccccaggacacccatgcatgctggtggattttagtagcacccatagcctgcttgtggtgctgtccatggtgctaatatgag

SEQ ID NO: 63373 - DNA, 1592 bp, Bovine  19866880674186
tgtgtctgggggctgcgtgcgaggctgtggttgtgcccgggtgatcctttatctgtgtggatctaaggtcacatttctctctcggttcgggtgaagggctggctttgtgggtgcgtgtggtgctctgtgtgtgtgctggtgcacgaggggcccaggggtccccgtgggtaggaaggaggtttgtggctgctcctttgccatcagctgtttcggtggctctgatgtgaggctaggggaatcaggagccccctttctcggctgtaagggggcgtgcttccaagacctggggtggccatgggtattagcagctcccaggaggacagcagaagttaggggacgctctcccacctcagggtggggggattgatgcacgggtggaagcacatgcagacccatttgtgtgtgtggaagagcacacacctgtcctgcgcacacgtgtggagacacagacccatgtatgtggacacatgcaggcactcagaaacagggatacacgctccccctagtgcacatgaaccacgcacagagacagcccttgtgctcacaagagcacatctaggcccacatctcaggcatctcagcccacccaagacagcctgaaggtgtgtgcgcacaaatgcagctgcacgcctgcccagaaatgccccttcgagtgccacctgcgtgcctcctcatgactgcctgcacacgcgcgtgcacacacacacacacgtatgtacatgggttgctgggcttctaaactaccaggaatgtgtccgtccttaatcccagctcttaatcccagagtccagggagcccaggccaaaggggcagctggtcagccggcctccttagaggtgattaaggcatgggcgggggcgggtgcaggggacgcagagctgtgtcttctgcctgacctccagggatgccacagagctcagagcttgggttccatctgagacttggttacatggaatttaccaaccctggggtgcagacctgctgaggaggccagccaggggtgtggctggtgtgtctccagggagagtgacagctgtgtcagaccagggaaggcagtcccttgatttaaccacctgcctgctggggtctcagtgggaagccttctgggcattctgacctctgggaaccctgtttctggctggagcgcttctggaccaagcaggaaaatgaggcccaactgggagatgctgaatttggggtcctgagtggggaggaaggtggtcactgagacaagggtgggatggggaggaagtgggggctgagctgggcctcgaaggtgtccgcgcctggggcattcggaggtgcacgaggacacgttggattgtcacagtatggggggtgctgctggtggcatttactgggtgggggtcagggctgctacagggccgggagaactgtcccaccccggtgtctgcagtgctcctgtcgagaaccgctgtcaggtcaggcagcctgggaggggtcagtgtgggccacagctcagagttgagactgtccccagcgcgccgtgggagggaaggccatgcatactgcccagggcgccatagaggggcactgaggttgtgcaggcagagtcctcctagcctggcccg

SEQ ID NO: 63374 - DNA, 1495 bp, Bovine  19866880717337
tattccattccatatatgtaccagagggatttcccagtggctcagtggtaaagaatctgcctgcaatgcaggagccacaggaggcgcaagttcaatccctgggtcaggaagatcccctggaggaggatgtggcaacccactccagtattcttgcctggagaatcccatagacggaggagcctggtgggctacagtccacagggttgcaaagagtcagacatgactggagggactgagcacacacacatgcatatatgtgccccgtctttatccattcctctgttgatagacatttaggctgcttccatgtcttgggtattggaaacagtgctgcaatgaacactggggtgcacatgtcgtttcggatcatgtttttcttcagatacatgtccaggagtgggattgtagggtcatatagtagctgtatttttagttttttaaggaacctccattctgttctccataggggtaaatgaatcttgttgagagtaagctgagacttagatttagttttttctttctgttcagagaaaagttttcttggaatgccatttttgataacagattatatgagtttctttgcctttaaggaggaaacggggcaacctttgtaagtatgacataacccaaggacattacataggctgattagaagcaaaataggtggcctagtcgacttccactggaccttgagcctcagtatacgctctttgtaacacatcagcagactaagtgaccccaagtaggtggtggcacaattcaatgtaaagaaacttttagataaagaaatgtaaatgaaataaaaaaattttttaagataaggaagctttaaggaaagaaaatacaaataagagctttaggtgaacttttagaaataattacattttaggatctctccagatattcaacaaatcgaaagttaaaattgggctaattaagtgataagtttaaaataagtttaattgagtaaatgaactttaaaagtaagctggtacaaaacttcaatttggcttttctctctgttaaaaagagacaagactttaaattgccattgataacaggtttttaagtttctttacttcttaaatgatcggttctgtatttgcctttgaaatcatttattgttactttggttaaatgaataactatttctcacaatgacccatgctcctatctgagtgtcctaaactcttttgatatttattgacaaaacttccttaattaaattctaatgaagtacttttgacctctagctaagattggtatgcttcaaagggcctctgaaacattccaaagagagatattaaactaattaggttaatttggtatgttgaattgcatgggaagtattgtgaaatgagtaataaatctcctcaggttatatagtatgataaatgttactaatatagaataccctagaaatcatatggaattcctagaattctaatatatcctggtagaatgttatcagtcataattctagttactatcttaa

SEQ ID NO: 63375 - DNA, 2558 bp, Bovine  19866880783914
gggccgctgtgccgctgtgaacagcctgacggagtagggtagtgtgaggagggactgtagcctccagccaatagccagccagaaactgaagccttccgtcaacaaccatgtgggtgagcttgcaagtgggtcctccagtcccatcgaacccacagaagatgcggcgtcaaacctcacgtgagaccctgagccacccacctaaatgggtcctccagtcccatcaaacctgcagaagatgcagcgtcaaacctcacacgagatcctgagccaccacctaagctgccttgcaactcttgcctctcagaaacagcgtgagatcagtgctgctttaaatcactaaatgtttaaaggggatcttttgttatgcatcaatagatagctgacacatcctggattatgtcctcttatttgagataacaactgtttcccctgccttaccccatctaaacaatcaagatcgaagcctggtgtcaggtgggtagaccacctggtctagcacagctggttggaccaggctgagaccttcttttaccaacagaggtccgcatagtgaaagttatggtttttccagtagtcatgtacggatgtgagagttggactataaagaaagctgagccccgaagaactgacggttttgaactatggtgttggagaagactcgtgagcgtcttggacagcaaggagatccaaccagtccatcctaaaggaaatcagtcctgaatattcattggaaggactgatactgaagctgaacctccaatattttggccacctgacgcaaagaactgactcattggaaaagaccctgattctgggaaagatttaaggcgggaggagaaggggatgacagaggataagatgacaggttggatggcatcactaactcgatggacatgagtttgagcaagctccaagagatggtgatggacagggaagcctggcatgctgcagtccatgggatcacaaagagacacaattgagcgactgaactgagatcgtctaggtattcttttttctcttctcttttttccttttcacctccttccctccttttctgtttttctttcgacaggagaagattgaatcaaataacatgatggaatagagtactaggtaaactctggggggagcaggaccatcaagatgatctgtggaaagaggaaattgaagtgagagagaaacagggatgagggaccccggttgtggagatatgtgctgcctgagggcctggcaggggttggtacatccagttgtactgctggcgactgaattctgggaaactcctctgatgcttaaaataaccctccttttgacttgagtttctttaaacttctgcttttcccaatcaagtcatttgaagtcagtaatcatcgtaggcaacattttctttgaatagacacaaaatgttccactgagtggacgtgcctgaagtttgcacaacccttctctgcttggacattaaggttatttcccatttctctctgtcataaacaatgccatgatgaacatctccagcccttgaagctttgtttcacatctccagcaatatcttcaagagagcttcccagaagggatgagtgagccaaagcattctatcagatgactttccagaaaactgacactgatgctttcaccagttgtagaagaaatcactcatctcaccggccctcaccagcctcaggcttctcttgctggaggctgccttgtcctggcacttactgggtctaggtggatctggctcagtgcaccgtgctgggggcagagcccagatgttgtagcagccacatcgtgccagcgcctctagcgtctaaacagtcaggagagatccacatagtgttcttttatttaaaatgaactggattctaaacaccgcttaaaagtacattaataatggtgttggtgtatcattcatcttgaacaagtgacagatatttcccccagcaaaatgccaaagtgggaaagtgggttagggagttagattgatgagtttctgtcaaggggctcattacctcttgcccagacgatctcccgactggcccccctgcctccagctcccgcacctcccaccctggccccatctgctccctcccatgctgatgtctagttaatcttgctcatgggatttgtggcagtgggatggcgggaggcctggagtcaggtggccagggttctgaccttggttcggtcactgagttcctgggggatggtggccacctgcttctgttcaccccctttctcaggtcaacactctgatttttcttttagggtcctggtccttccttagtcctggggtgtcatgtggggctgacacggctctgcccacctgatatccactccaacaagaggcatattatacctaggcttggtcatcgagagttctgcagacccttggctcagtaattagtccaagggatgggcagcatgtgtcccaagctgagccagccattgtttatggcctggatccaactgtacctgaagttcatgcttcagcatcctagttatgtgagtcaggtcccctcttccttctctgtttcttctttttcctcttcttttaaaag

SEQ ID NO: 63376 - DNA, 1372 bp, Bovine  19866880905351
gaccatgttgtccagtcttcagccaccaggcaatttgcactgtggggattctgaacaactttattttaaaaaattatataacttggcagatctcgcttttcctcacctgggttcagattgcgagtccgcactgtagcggaccctgcggtccggaaccatggcggttgttgtctgagtggtttattgtggcgcttgaggctacaagcccaagtatcttcagctcaggaagaagttagaagagttctctgaccgcctggacatctgcagcgaggggactccccaggtcactgatttctttgaagtgttcgtagcgggaaagctgattgactccaagaagggaggcgatggctacgtggacacagagggcaagtttctaaagccgctttggcttgatgtgccctaaagacagagaccagtgaccttggcccagcccctcttagcagaggcttcatgacaggaaggactgaaatgtctcttggacgcctggtacttccctgatgttcccatggccgccggttggagcaggatggacaccctggtctttgcctgtgtgtgtgtgtccccagaagcctaatgttgctcactggtcctgctgccctcccccatccctcacctccctgcatctccctgcccccatgtcttccttctaccctctgttgtttggggtggtcctgctccaggcttccttttcaaggggaagccgagagcaggatcaggatgagtgagtgtcagatttcaccagcaacagcaacagttcacaactcaataaatggtgatgaggttaacaacaacaacaacaacaaattatataacttaattcagatagcttcctttgtggctcaactggtaaagactccgcctgcgacgtgagatacctgggtttgatctctgggttgagaagatcccctgcagaagggaaaggctaaccactccagtattctggcctgaagaatcccatggtctgtacagtccatggggtcgcgaagagtcagacacgactgagcggctttcactttcttcattttaattcagagggatagaactctgtctggcgtctttaacaacaaaacgcaccgtgccataaaatgtacacattttgggcttccctggtggtccagtggttaagaattcccctgacaatgcaggggatatgagtttgatctctggtctgggaggatccacctgccttggagcaaccaagcctgagagtcacagcaactgagcccacaagccctagagcccgtgctccgcagcaagagaaaccaccacaatgagaagcccgagtacagcagcgagggagtagttcccgctcgctgcaacttgagaaagcccgagggcagcaataaaacccattagagccaaaagtaaataa

SEQ ID NO: 63377 - DNA, 1493 bp, Bovine  19866880971331
ttttccagaagaaatgattaaatagtatttcaggtctagagaaattgtcaaactgttttcttcttcttcttcttcttcttctttttaatgttattttccttaaagtaatacatagctattgagttctactgcaaaatatgaaacataagacgtctcttagtgggctccttacttccctagagtgagccactttgaaatctggggaatttgtttctaaagcacatacattttgtactttggtaaactgggtatttcatgaatttacttttttggaattgtgaaatgttctttacttagtttcctcattgatactggagttaaaaggaaggtaaccatatctttgtataaggccttcatattcttcaaaatctcttttcaagtcttcatatcataccagcccaataattaaatgtattagttattcccaggttgtgaaagatgttttaggtaacttataagtagcagagattgaagaagaaattgatggccctccagtgggttaatgatctgctcttctgagtagagtctgtgtatcttatcttacgtataatatagttctctgtattttttggaatatttttcttctcttgtttttaaagtaaattgcagggcaggtgtgactcctacagccttgatttttaaattgttcacttttaatttatgaaatcttattacagcatggaaaatagagacaaaaaataaaagcaccccagatccagtgtctcaacaccctgaccacattaggatcatctcctagaccttgtattggtttttatggacttttgctaggattaggaaaatagaagacagaacctcttaggtctctttttggggtcacagtcctatttactgtcttgttcagtgtatttaatgtctcacccttgtatagtgttaagtattagggttgtggtctgataataagtgagtagctatttggggcccaactctctcatgtataacaactaataaattgttgacaaaatgccagaaactacctgcagatattagatggtgaccaggaacacagcgataaccagaagtgagtagaggaggttgttgatacttgaaagaaggttcactgcattgggaaaatttcctcctcctcctcccacacctccttttttgggaaagtcgggagatacataattgacaggtaacattgtgcaggttttaagtgtacaacctgttggtttgatacatttatatgttgtaatattcctacaataactttagctgttatgtcacataattatcattttttgtgttgagaaccattaaaaatctagtctgttagtaactttgaaatttataaaaggtgttgttgactataattaggaaagttttagtctgtaggctaagttaggatcactggtgttccgagaaggcagtgacaggggagaaattctggaaaggaagagaaccagggaggcggggggagcctaagtttaaactttgtacatctggttcactcctgaaccaaactgcacaggacg

SEQ ID NO: 63378 - DNA, 1700 bp, Bovine  19866881162391
ctttacttacctgggtttaccctcccctgttagatggttgggtctggtaccctccatgacctgtgcttggccattgttgacgttggagatcacagatggcaaagatagggtctcatagagccaaacagatgaggaattaatcttccaagaagcctcatttgctgctgaccttgaggtcagagcccaggccaaacaagcacagcccagcgaggtccctctaaggtttggccctggatttgtctccttacagcaatgttgtggagaagtgtgtcactcacgcctcccgtacagagcgcgctgtgcttattgacgaggtgtgcaccatgaacgatggtccccacagtgccttatacaccatgatgaaggaccagtatgccaactacgtggtccagaagatgatcgatgtggcagagccagcccagaggaagatcgtcatgcacaaggtaggccagtctgtgcaagtctcaatcagagaggaggagccggccctcgcgtcttctcagttctgcaatacaggagggtgggcatcttgctgcttcttgcacagtttctcactagattgtgacttctttttccttttatctggagtggccgctgtccttgtgtttgctgcccttccatcagtaactcaattggtgtgaatgttaaagtcagtctttgtggggagtcccctcccggtcttcaggccatgcttctacctgatggctcccaggagaccagcttctcagtctagcagatcagcctccttaccttatttcctttcctccctctcatcattgattccaccaccattactgaacaagctcctgcctaaggcagcacctggtctggcacactgatctggtgcccactgtgtgccagtcgccagcacagagatggccgagactgagcactgcccacagagcacatgtggggaaggggtgacgtgagcgcctgtgctcacgcctttgagggcagactttgtaggaggagaagtccaggctacagaggaggtagacaggaaaaaatgggacagaaatctgaggtgctgtgtgctgtgagtgggagctgacacagaaagcacatgaagaggctcatggcctcagagctgtcatggaggaggtccagccggctccacacagaccacggggcggagaagcccagccagcccccaggcaggtgtgcaggccgcactgtgtctgcgggaggcagtacctcgagctttgggtgttgcccatctgaaccctcagcctttgggctctgaattcacccagtccttctcgatggagggggtgaccgtggtctggcagtgatgagccacttgccctctctgagaacagagttcggtaatgagactctactctggactcaagttctgagccagacgaggcacccaccaacctccagttcaaaacaaaacaccatgctggtgttggcgatggcagttgaaggctggggagtccagagtccttaagctgtgagactcagatggggctgtcaagatgctggtgagggcggaggaaatgtatgggacacacagcaggttgggagttcattccactcagtgcccagcacaggaggtacagcgggaagaggaggatgttgtgtgtaagtgattagaagcaggggtgaggctactagtttgttttctcctaatgttcagatcgttatcagttttaattttccctgggatgttccaggatgaaaatatgatgactgaa

SEQ ID NO: 63379 - DNA, 868 bp, Bovine  19866881229485
tgtattagctgtgtgacccagacaagttacttaatctctctggacctcaactttcccacctatcaaatggagatgatgtgatgagtgggataatgttacatggtagggatacggggagtaggaggaagagttaacaacattcacatatgcccctggatctagtcagcactcagtggtgtgagtcatttttatcaagggtccaagagcaagcaatggcctctagatagtgggtatcccatggattacaaagtgacagctcaggagaccaaatgcaacccacaaacggcctctgtttggcccacacagtgtctttcttttttcctttctttttcaaattttgccaacatttaataatcagatttcacatcaaaatccgaattttctgcttctcttgaaaaatataaacaccgggcaatcctaggcccgctttcccaccagttaggtaccctccagagccgagtggccactgcccagctcccccagcctttcctgggtccagccacctcccctgctctgccctgcaggccctggaggctgcaccccctgacctggtccagtgccttcatgaggcacatggggaaatggggctctaaagggggcagaaacccagccagggtcacacagcaagtcagtggcagagctgaaattaggactcaggtggccagatccccagtcctcccggaacactgcggagacgctaacgagagaaactggccatgcccccaaagctcctgcatctacagcccttagacacgagcttcactgggcatggaactactgccctgagccttaatttcttcatctattaaatgggctaaccgtcccttcctcagagtatgtcaagaagaaataagtttttaaagtaagg

SEQ ID NO: 63380 - DNA, 1876 bp, Bovine  19866881385345
taaaatgactcaatgagctttcatgctgaccttgagggtgcagaactgattcttccagggagtatgaaccatttccaagttgatttatgaggccgtgatgctggtgagctttgccatcctctatctgggagctataaccagggacagtaggtgtgatggggtctccgtgtgaatgtggggatgctgaaatattgagcagcctggatgccagcatcctctgcctctgaggagactccattctctaccctgaactgagagacagtcgtccatattgaacattttccttgcctactgctagaaaagtctacaactacgaactgggggcaactgtttcagacccaagaaaactctggaaaattcgattcctaggcctgagaaaacttctgtccatggctctggaaaaccctccatccttggatctgggaagcattgcttcttgggcacagaaacctacctcagtacaggctctgaaaaacattgttcctgaccttaggaatcactccattgctggctctagaaaacacaccatcctaagctgtacggaatactcccttcatgattgacaactactctgcctagggctctagaaaacacagtatgcaaaaatctagaaaaatgttcatcacaagatctggagagcttcccactctaagtctggaggtctgagcaggatgctggtaaccttagcaatgggctcttggtgggagaggggagctactgattggtagcatttgctgattttcgtggcaattggaatactccccatcatggctgattttgaattagcagtttgacgttgctgaaagtggatttgggaggggacgctacagtcacttcatacaatcactagtaagagtcggctgccttatccttcgtttctagccctggagggtggagggcctaactgtagggtgtagaggactctgagtcactgggtatggaagacttggagcctcagagaggagaagattcggtctggagtcctcacagtctgaaagactaccaggccctggctgaagaggacgctaggccacacgtctggctagtcccttgtcacttgatttatggtgtccctccatcagggaaccattgatcattaaccgaaaccacccgtcttggccaggcatgatgataaccacttgcttgagttatcttacaacaggagatcccaataaagaactcggtgccgatgcaaactaaccggaagaattgagcagaggccaaaaggaggaaagaggacaggatatgtcttgccctaacctcccagaagccctcagaactggaatccagtttggctgagagatgcccccaccaccaggaagaaccctgagtcaccagatgtgggccaagcgagacgattggccagagaccacctggaaactaatccctttatcataaaacctgagactgtgaggcacttggcagagcagttctcctgggcccccttgccctgctgctgtccaccaggcacccctccttcccagcagtctcttgctttgtcagtatgtgtgtctcctcggacaatttgtttccaagtgttagacaagaacctgctctgaagctctgaaaggggcccccccttttctgccacccctccctaaaccaataatttcaactcaaagatttaaggggacatgataggcaagaaagttctgaaaagctgacattcctaatgttctggtatgtcctgcctgccattaatatgtacatattgaagacgtctccccctgtctgtgaggtctggacttcgatcgtctggaaggtgaggtctatttcaggctgtcacatggatggaaatggttgttattacaggcccacagccccgtctgtgtgagcagagaggtgtgggacgtggcatgggtgagttgaggggagg

SEQ ID NO: 63381 - DNA, 2636 bp, Bovine  19866880418709
gcaggagtactggagtggggtgccagtgagtttatgtaggattaaatccctaacctgtggaatttcatttccaggtagatattgttagggttgagtggaatttggctgccagtacctaatacctgcttggtgttgtgaaggacaactcccattccctccaacctggcagtccgcccacccaatacacacatattgaaattggatatagaaaactaaaaggattgagataaaatcacagcaatcatgctaaagatttctattgcttttaatccttagataactatgctttcataaatctcattctgtgtcagtttctaaccatagcttttaaaagttgttgttcagtctctgagcagtgtctgactctttgtgaccctgtagactgtatcacgccaggcttccctgtccacagaattctccaggcaagaacactggagtgggtagcctttcacttctccagggtatcttcccgacccagcgactgaacccaggtctcctacgttgcaggaagattctttactgtctgagctaccagggaagcctgtctttaaattctcctggattttgctcaaattcatgtccattgatttaggaatacttatactagcaaagagctgaaaatccctttagtgggtttaaattagtagggcattatgttggtcactttcaaagaaatctagagatcctggttgctgtcaacagggtagcacttaaaatgagttgcatgttagcagtgtcattaaggcacaaaaatttttctctagctatatacacttccatgttgtgtttttatcaaatgtatgtgatctcataaggccctgcagctctaggcattaggttcaagttcaagaaggaaagaaggaatatcaccaactgttatttgtcctttttttaccaggaaagaaacaatgcttttctaggatcttctactggacagaatttccctgatgtctcactgaccatatgtgggtcaccctccacatcaaactacaaaggagttgggttacctaaagaattgataacgcatagaactgtcaccattgatatagaaacaacatgataatcatatcatatgtggttggacccacagcccacacaaaataaggaaatctgtaagcaagagcaatagtagaataaatatcaggtgacaatcccctatccagtacagtaaatgctttccaacattataatcaaataaaactgcaactcacactttgacaaatggccaggtgaatatttcacagcgagtaagatgacaccgagtctgtgtctccccttacactgaggcaaaaccttcgttcacatgcctcatcattcatctgactcaaatatttttgaaaatgttgtgagaaaaattaatgataaagcataactgtctgaaatgctccatcataataagaaaaagaagagtgctcagaaaacaaatgtcaatctacatttttaaagagtggattctttcctaagactcttggaataagacacaaatctcttcttttttgaaacataatgagagtgtaatattaacatacccagctagcagtttttgatggttttcaacaagtttatgagtgcacattgttttgttttgttttgttttgtttttgcctagcaaaataatccctttggacaaatccaggcatgaagtataaagcaaatcatctaattataacaaaaacctgtgtattttaatccatattttaacattcacctaatgcaacgcttatgtttcactgggagaaatattggtatctctgattcttacagatgttttaaaaaaagcagcatggggagtggattgaattattgccactagagttttggaaaatgtatttgcttttaatttataaacgtaagtatatctttgatcattcttcaagggcagagatgtatcttggaggtaatgtttcatttaaatctttgatgcctggtaaaatcccaaagtattcaagttgaaagatttgatagtctacagaggagagagaatcttattgctgccatctgtaatgaaatttgctatttgtgctttagttaccttgagcaactggtgtatacaagcatggtgctttgccatacactgggcaatatttgcacagatttagggaaaagacacatattttatctgtgctacattctgtccatgccttcttcctcttcccctcaaaaaatttgatgctattcctccacaattgatcatttggaatgagacactatcagatgaatagaagaacttaatcatttttgagtgatgtgtgacattcctaaccttctctttaaggcacagtcaacatcagcagtgggttatttaaaagtgtgtatgtctccccatcaatctttaatccatagttttaaaaaatgcatctcctcttgtctttgctggagctgatcatttgttttatttgactcaaggatctgcttggtttagaagctggaaatacacatctgtagtattggcaaaaacctattcataaaatgtggagattctgccatatatatcagaggaaaagcaatgtggcaaagtgaagtacaaaattatttctgtcttcacattatttttgagtcatatatctctgcctttttatgaacagcaggcatatttggaagaattacatcgagtcataaatcccaattgcctagga

SEQ ID NO: 63382 - DNA, 1020 bp, Bovine  19866880573395
tcacttcagtcgtgtccgactctgtgcaacccccaaaaagcgcagcccaccagggctccccgtccttgggattctccaggcaagaacactggagtgggttgccatttccttctccaatgcatgaaagtgaaaagtgaaagtgaagtcactcagtcgtgtcctaccctcagcgaccccatggactgctagccttccaggctcctctgtccatgggattttccaggcaagagtactggagtggggtgccattgccttctccgttgacttctctactgtcagacaaactgcctctcacataataaataggtagatagactaactagatcataaactgatggcaaagttcccttttacataggcaaagtccctatgcagagggacaggatcttatatctgacctccacttgaaaactgtgaatagaaaatgagaaatatatgccaattcttttttaatactaatattaattcaaatttcaaaattcttaatgcactagttctgattttgctcatttaatgtagtcaggttcaaaaatttagtgggtgcttaatgaagatcattttatgtggatgaggctaaacctattaaaattataaaagataataggagaagtcctatagtgtagaaaaaagaaaaccacatgcatttagcaattgtggggagagaagatcattaaataaaaactggtgtctaagattattataaatattgctaaaatctatagatgtgcaaatttgaaccaatatcatcaaatatataataaaataattgactttatgttagcactttgataacaagatacagcttgttttctcaggtccaagtgattgagttggtcaaatagattagaagtaaaataattacatctggtagtttgaggttttattttctacttatctaatcacagtaattttacagcttaatcaaaggattaattttaaataggaatgttcaaagaagtaaggaaagaaatcaaggtaaagaaaaattattaagacattctgaaaaattattggcctgta

SEQ ID NO: 63383 - DNA, 2049 bp, Bovine  19866880593598
agtctggcaggttacagtccttagggttgcacagagtcagacacaggtgggcaactgagcactcacacatacttttattcaaatgtctgaatccataccatatttttgtacatttcttccctgtagttaccacttattaggttaattatgtattgacacagttagtgataagagctgtagtccatatcgtaataggaggacagggtattattggagagtgattttcaaaatatttttgctaaaagctgctacttatggttgccaagtgagagattgtacccaacttaagctattcctcagggaatgcagggtgatctttaatattacaagcaagaaagctgactctgaacaactgttatagcagcttaatggttcccagtgggagatagttacaggatttatttcttacatgctgatttgggaaaagtcatgcttgtacccatgtcatgtataaagaacttattcagaataagccgttttctgatacagatatgtaaattgaatgctatacataaagttaattaaagggaaaagtataaaaaatgttcattggttgaaatcttagtattttaatcataagggaaataaaaatttacatgacaaatcaaacactaggattaaattgttaaagaagccagataaatttatggtatatcagaaaataaaataaaacggaaaattaaggaaggaaggaagggagcaagaaaggaaagaaagaaggaaagagaggaagaaaggaaggaagctacaatatttgaaaatgatatggattttaaacctgtggtagattgcagtagtcacagttgccatttattcacatctttatctatccactccttcagtagcctccatacactctgattcttggctatgtgacaaagtgtgtccaatggtcagtagcaaagataacacaagtacaatgtacttgaatttatgtgcttgtccccctgctgctcttggtagagaggaggggccccgccaattcttccatgtgaaattatataaatatataattttggtgatggggaagacatatgccatctcagctgagtcatctagaagcagccattcacagcacaccacagaattataaacagctctgaccaccatcagctaggtgtaatacagactacaggaaccaagagccgctactttaccctggaagaaactttttaccaacattcatgacctagataagtggttgttgctttaagccacttgcataattaagccacaaagatttgttatgcagcaaatgttaatgtgattttccaatttttggtgaatatgattggattttatatgaattattaaaatatgttcagtaacatacatttctgttgagaaagtataattttaatcatatctatgtagttgataagttgactaataaaatatttaacttcacattttatattagaatatagttgattaacaatgttgtgatagtttcaggtgtgcaacagagtgattcaattatgcatattgatgaaagtgaaagaggagagtgaaaaagttggcttaaagctcaacattcagaaaactaaaatcatgatatctgatcccatcacttcatgggaaatagatggggaaacagtggaaacagtgtcagagtttattttgggggctccaaaatcactgcaaatggtgattgcagccatgaaattaaaagatgcttactccttggaagaaaagttgtgaccaacctagatagcatattgaaaaacagagacattactttgccaacaaaggtccgtctagtcaaggctgcggtttttccagtggtcatgtatggatgtgagagttggactatgaagaaagctgagtgctgaagaattgatgcttttgaactgtggtgttggagaaggcttcttgagagtcccttggactgcaaggagatccaaccagtccattctaaaggagatcagtcctggggtgttcattggaaggattgatgctaaatctgaaactccagtactttggccacctcatgcgaagtgttgattcattggaaaagactctgatgctgggagggattgggggcaagag

SEQ ID NO: 63384 - DNA, 1018 bp, Bovine  19866880631452
tatcagaaagggttgggaacagctgctgtatgatggatgccccattctttttaaaagtactgtataagatacaatcatttagtattattgctagtaaaatctgataatatacggttgaagtgattgtagcttcttacaacattcctaaaatatcaattattaattggctaccaatatatttaatctaatgagtgtgtgctttctacaaaatgagtatgatcccctttattcagggtcatgttgaactttctgttggcttcgtattgaaagggaatacaatttgaaaagggagcttttaaaactacacctgttttaaaatcatgttgaatgagtacattgtttttatgttaaatgtgctcattgcaattaacatacttaattactacatacctaggagagctcttcctagaaacattttccttagtgttgaggtcaaattaattaagtacttgaattttctctgtaaataagctgtcattttttttgttgtcttccatgtaattattataaatcattcagttattttatgttcccattgtgcactgaaaattgccactctggctttcaaacatagaggacctgaaaaaagccatttatttctctttcttgcttccctaactggcatagtagaaatggaattcatgttgaccactcaccttttctaaaacataaggaagcttaacacgtgaatgatgaattttataattaagaacgcagtagacacaacaaaaatattttgtattcagtagctgaagatcaaggattagtgactaaaacatctgatagtcaggctgtcaagagtatgtatctcaaggggaaacagggaatgcagagtttatagagggtcatgtcctttggttcaaaacaaaattaaagaggacagttgtctgtcttaaatgcagtagttgtgactagtgaaattttatctcctgatggcttttacttgatttgtgaaaataaccatgcttttagagcgtggactacatcatcaatgaaaaaatgatttttacaaaaattg

SEQ ID NO: 63385 - DNA, 1234 bp, Bovine  19866880914264
tttgtagttataccatgtggaaacaatctgaggagagcctttggctttaaaacagagcaatgttcaggaaataccagaaatttgctgaaaaaattatgcttaactatgaacaagattaaatgaattttggtcattttttatttgttacaagttgtactacatcttaaattattctttgagaatagcttgattttatatttagataatgaattatttgctattaaggcatcaattaataaatttgcagtggtgtttatgaattgtcctacaaatatcaaaacagatatactgataatcctatgagtttttctgtaatattcttatctataatactaggtgattgaaatagcaacattgagttcttaataactatttgtctgcttaatatgtggttttcataaaaatgtcaatatagatttaaattctcttgctgaggcaggcaaggcattttaatatgtaactaaaacataagcttattcttggcattccaactcgactggtgggtgatctctgggtagatccccatctggtactctctgtgggccaatcatttataatatttaatgtacttagattatataaggaaatgtaatgttttcattcccagacttactttatttttaatggacaaatcaacaaacactcaaacatcacttaatacatctacaaacagtttaatatggaaaactgagctttcatcaaacatatataaaatgttggaaaatgggattctgatgttatatttactgtctactgttctttcacagtaatactgcacatttagaggattagatcagcacacacttgttatctcagaatttctgtgggtcaggagctaggacaacacttagcaatgtcctcatgtctgaggtctaattaaacttcaatacaggtattggtgggagttgagtctcatctgaggctcagcttggaaaggatctaattctaaggtcacatagttgttgttcagttgctcagtcatgtgtccaactctttgtgaccccatggactgcagcatactaggcttccctgtccttcgttgtctcctggagtttactcagactcatgtctatcgagtcaatgatgccatcaaactatctccccctctgtcacctgcttctccttctgccctcaatttttctcacatggttggttagtcgcattcaatttttttgagggatcttttgaggtcagtagtcagtttcttgcaatagaccaattaacccagagtctg

SEQ ID NO: 63386 - DNA, 881 bp, Bovine  19866880996537
atgatttctttatattgaacaatgctatatttataaaaatataattgatgcatatggacccataaaatgaatatcatttaaaatatgcaaaagaaattttctagaaattacatcttttattttggtctatatcttgccagtcagccttctttttcctgacatatttttctgtgctaacaagcagtcccagcatttcagtgacttatatataggttttattgttgcctctgagtaggttataactctgttatgtagctacaaacccgaaactagactgaataaatagtccctaaattaatcttgtgatgtggttcttctgaggagagggacagacaaagggcagagacatgtgatggcccttaaagaatgtgtgggtgaagcacatataatttttacacataccccattgatcacaaaaagtcacatatcaatggtatggaatgttagactcctcccataggaagcactgtatactatatgacagtgggcagggatatgtaagcatctgaggaaatgagaatttgaaacaattttttttaccaataattaaaaagcagactttcataaatctctgtaaaagttaagcaaaaatggctttattgtcaggtataagtcattgaatattttacatttgttcttcaaactcaaaagaaactattcaagataatgtatatgaaccaaaggtcttgcaattgacttcacaggaaagcttacttaaagcttcgagttttcttttagttcttgaggtcaaaaattgaatgacctgagagatatagattcctcgtagggctctgcaacacatgctatatggattttataaacacagaagatgtaagagaagtgcttgtcccccttttctattaatcaaaaacatagagctc

SEQ ID NO: 63387 - DNA, 1411 bp, Bovine  19866881255170
actttgcataacatcatacaaaattggaatgcacactttatatttatagaggttttgaaatatatttgaaaatgtaagaacttgagtatttggaataatcagctgactgatagtgatcatgcactgttcatccaaatattcactctcttcatcagtgtgtcacatttataggaatgaataaggttacacagtgcttgctttgcccgaaaaccacttattttgtcagcagtgattgtgtttaagctgacagtgggctgttcctattattgttaaaattactatttataagctctgaaagcaagtatttctaccaaaggtatatgggaaaccagttttacaaaaaatataaatgcatatttatccatagatcatacattttaaaaaccaaaaccagcagtataatttggctatgaaaaatttttcctttgctatagagaagattggagaaggcaatggcaccccactccagtactcttgcctggaaaatcccatgggcggaggagcctggaaggctgcagtccatggggtcgctgagggtcgaacacgactgagcgacttcactttcacttttcattttcatgcattggagaaggaaatggcaacccactccagtgttcttgcctggagaatcccagtgacgggagccttgtgggctgccatctatgaggtcacacagagtcagacacgactgatgcgacttatcagcagcagcagcagcagcatagagaagacagactttgagtatataaatgcaaacatgtaaactgtattgaatatatattatatgctaggatctgaattctgagtgaggccctaaggataaaagatggaaaaaataatatctgtcttcaataatagggttaattattgacttaagctctgataattattttttaatgttataatgaagttccctgaacaaatgagtgactcagaataaaacagtaattaacattttattttatgtaactaggtgcatataacctaaatttttaattctttggcatacgtagaaaatgtcccttatgaaatgtgtgtgtttatagtgaaaatagtttcccataggtctaaaacataattaaacataaataatttggagacagccaccttctgtactttttgctcagtgtttctcatctagaaggctttgataaacatcaaagtactaatgctgaaaaagtagaggcttttagattccaaggtagacaatttgctttacaaactttcttcaggattaaagcacatacaagtcattgaaaactggaaagtataagacaaatccaaaaattgtaatatatatatttttaagctttcatatgtgtgctgtgttattttaaggaacagaaattatgaactagcattctgtctttggccttgacatggagatatattgatataacacatatatatg

SEQ ID NO: 63388 - DNA, 1001 bp, Bovine  19866881404128
aatcaaatggggaaaattttagatccttttgtgaaaaagagttacttgaatataaaataaagtactggttgcaaagagttttaacaagtgcccaggaaaaataaataatgaagtaatattatctattacttttgcatgccattagatacagcattgtgttaaaactgtagttacttaataaatagggctttcctggtaactcagttggtaaagaatctgcctgcaatggaggagaccagggttccatccctgggtcaggaagatcttctggagaaggaaatgacaaccactcccatatctttgcctggaaaatcccctgggacagaggagcctggtgggctaaagtccatgggggtcacaagaattgtacacaacttagtgactacaccaccatttgtgggtgaatcaaactgggaaaattttagcgtcctcttgtgaaaaagagttacttgaatataaaatgaaggactgattgcaaagtgttttacctagtgcctaggaccaataaatgatgaagggatattatctattacttttgcatgtcattagacagaacactgtgctagaaacagagtgattatttaataaatgcctattgaatggggaaaacaaaaccagcactgactgttacattctttgtatctaattaggcagtggctcaaaatcactgatgagtaaagcaaataaatgtaataccaggctaagttgatgacaatgccaatatggcagtggtactcaacaattaaacccttaagagtaacaagctctgtaacttcttgaaaactgtgggatcacattgacttcaaattctacacagccaatatccataatgtttttattttcccttccttctgaggaagtaaccactttagtgaaatttgaagtaaccaccaaagtaaccaccgaggtgaaatttggtcagtcatgttttatttgaagggagggttagattagttacaaatacatattagaaactgcgtggcaatgactaaacatatttt

SEQ ID NO: 63389 - DNA, 1575 bp, Bovine  19866881469322
acagggaggcctggcgtggtgcaattcatggggtcgcaaagagtcggacacgactgagcgactgaattgaactgaactgaactgaaagtcgtggtataattaattacttttttataaagctttgatataagggaaaaattatattttatttaactatagtaagctttcattccccagcctccaaacgatatagttttaaagaaattttaggtataaaattttgttcagtagtactcattcaggtggctaggtataattggtgttattaattttggttcacaactccttggaacaagctggatagtacatttaaaaccataactaaatattgcacagtgactataagcttcatatatttaggtgattattatatcataaaattgtcctcatttttaattaactgatttgaatgggtttggttgggtttaatctgttttatcagtcaataaacctaatagtctcttgagatagctgcatcttgatttaatttactttctcctgtttagttgaaaatgcaaacaaaacagttctatcagttcaaaaaataatgcttttctattgaaatgccaacattaaggagtcaatctaagatgactattgattaataatttagtgtttatacacaattaagtggcattcaaagtccaagctgattttatacctacatacattcaaagacctcaagaaaattgaatattctgtttgtctatataccatgcagcatcttagtattcaaaatgtcccaaaactttgtaaaatcacattaaataagatcaattcctaggcaaaatggatttttaaaaatccacaagcatgagattcagtatagtctattttgcaaacagtccaatcatggtcaaatacatataataagtataaaactatgtaggtgtattatgaaatttcttatgcatataaaaatatgcaaagaaatttagtgtgtaatgtgtactcaccacctatctttaggaataaaattttacttattaaattgaagtctcccaagtgcatattccattttctcattcactcccatcccatcagactgtttctagagcactgttttaaatatattaaagcgtgcaaaatggacttataatttgcctatccttagcagtatgactttataattcaatataatattccaacaattcatgtgtatttcacaaatgtagtcagttttgcacattttgactactgcacagttttaatgtatgtattctggtatttatttattcctcccttggtgttttaatttttcttcctgcaaatgagtctactataaagcttcttatgcatgtctgtctgtacttgtacaaacaaatttctaggatatctggaagttgaattttgtggatatggaatgcacatttttaagagcacatatactgaaatggaatttaaagaaattatccctattgtctacatctttgttaatacttagaactccagtggttgttttgctaggatgatagttaaattgtactttttatgaatctttttaattcccaagtttctgatttatcccttccctctcacattttcccttggtaatcatatgttgttttcaatatc

SEQ ID NO: 63390 - DNA, 1197 bp, Bovine  19866880363129
gaaaatgttttgccctttacctgtgcgcaaatacctcttagcacgcttcccagtctccagggtgaatgccctgcccagatctgtgctcgtgaccactgctctggggctcagccggaattggccccccagctgccctcgtgggcttgcagtgtgtgccggccctagacccctcctctagcggcctcacgagcaggcctagtggaaagggacagtggggagcagggagcacccactctgaggctgcccccgccgaccacggctcagaaccacacacacctggtcattcaggcccacgttcaccatcatcatttctccaaacatctcgatccagctggtgccacagggattgtgagagttgacacctcttcggaaccaaacctgggaaatcagaaataaacacacccccctagagtgccactcaaatggaagggttttttttctttctttaaagtctcaggaagaataaatgagtaatttggtcctttggttcaggccacagatgagcacagcacaccattcagaaaggatgcccttgggcctccctggtggctcagcggtgaagaatccccctgccaacgcacaggacacagatgtgatccctgatccaggagggcctacctgccgcagagcaactaggcccgagtgccacaaccactgagcctgtctctagagccgcaccgcgccgggctctgcaaccagggaagccccttcagtgagaggcctgcgcactgcggctggggggcaaccctcactccctgcaactggaggaaagccccaacaaccgagacccaacacagaaaaaataaatgattcttttaaaaaagaaagaaaagatgccctgggatgagagatagtggaagcaagaagaaaagagattgtgaaagcaactcaaaataagcttatttcactggacttgcctccgataaggtaaaaatgagcacttctagacaggagggggaggcagtcagttagctgcgagtttgcttctgatatttggaatgctgtggcctggtgagggacagtcattctgtgcttgctacaggggtgcaggcaaggcggggggaggggtccccaaagagctcagagatcatctgcgacaacagcggaaaaacgcacagggtgcgactgatgccggctatgttctaaagagtacaattttattttttactttttaactactggcagtgctggggtctg

SEQ ID NO: 63391 - DNA, 1698 bp, Bovine  19866880445128
aaacccaagctgcaatgacctcccttgcccaatgctgcccaagcaggggccgtaggctggaggccgggggctacccaagcccccaccccagcacaaggggtctgatgtgatggtaactccaaccttttaaaacaaacataacatagtaaaatgaaaatgtgccaagctgccaaaaacaaaatggaaggtttaccaccagccggctgaagccccagggaggcagaaggggagcaaaccgctcttatgcagccaagaagaaacggcagaggctttcagaggaggaaaggcgcacaccgggccgtgggttcaggcacctgagatgtttggcatcagctgttctcatgtttccccacttgaatcacaataaagtcaaatgaaattcgcaatctctgcactgagctaacctctgcacagaaccttcttgtgaaagattgaggttatttttctgatatgactgttctctctgtggcaaataactgtaatgccaaggcatggttccaaattagtcattcgctacaatttaaaaatacttcactccaatattttgccccgacacagatttcactgcatttcctcagggttcttacagtgtcttcatatgaggagtcacagaaaaatagagatttgaatcgaaaaaccacctcagatagagtagtctgttttctaccaggaatgcttgtccagcttctcctttctataatatccctttccccatgtctgagtaatacataaaaatttccgagtgaagcaacactagaagcctgcaaacacacatgattttaagagtgagtgagtgagagagaaaaagcaagtctgtcacattcatctctccgaatgacattttctaaggggaaacctcagccctgggctggtccgagcacagcccgggtgaacctgctgccttcacggatgctttctgcgagtgtacaatttttgtttgggatcaaaccaacttagatcacccgcggttcctttaaataagttaaaaccagcagtcgttcacatccaagagctttagtcatcttgacattcaaaaacaggtttattatataaaagaacactgatccagatcatcttaaaaatttctagcataattccccaaggctgtgaatttcaagaagcaacaacaccagcctatagatcatacttcagtaagccagatttctctctaaaggatctcatcttcacccatcacaacttgttattttgagaaacaaagacttttttttttaacatctgtaagtttcaggctctccatgtttaagcggctcccatgctgagttccttctttgacaacagcgcctaccattagtcaactctatgatgacccaccaaatctacaaagaaatctacgctgtcaagggcctgacctgtagcagacatggctaccctgtgatagcaactccttaggtaaatatcatcactatccctttttaaaaagttgagtgagtactaagaagctcggagaggtcaagtgacgggccaaggtcttaaaagctattaaagtggcagaggaaggtctcatacccagaccaactccaaaggccaagttctggctgcaggacccactcctcctgtgattggtactcccaaccaggctgaattttactcccaaccgggctgaaaagttggatcctttttatagtgcctgcctgtgggacttttttgaggacttgtctgtttaaccatttcagaacc

SEQ ID NO: 63392 - DNA, 1156 bp, Bovine  19866880490153
ttctgaattacagttttgtccagatatatgcccaggggtgagactgctggatcatatggtaggctctatttttagttttctgaggaatctccatactgttttccatagtgacggcactaattcacattccccaccatctgctgccttttcttacttgtgctgagtttttcttggaaagatgagtaatttcgattgaaacctggacatattgggtcttgtgctatgagactccggatcttatttaaattgtgtattttacaaccagaaatctcaaagtggttttaaacacctgattttcaacagaccacatttaaaaaacatatgctatggtttacttactagtatggttctccatttttcaagaaagtgtcttgttcctttgggcttgcgcttgcttttaactccttcacgattactctcgctacactagtgcctgtgtagatctctccaaggagcacctaaagccaaagatgagaaacgcaacagttcttcacaacggttttcattgtaaccatgctatcttcccattaaaacgtgctttaagtgtcatatggggaagtaggggaaggaggaaaaacaaataattggaggaggatgaagagcttctaaaattcccatctcttttccgttcttatgccaacaattagaaaaggctctgataaagaaacagaaggccttcttggggaaactcacacacccagaagcgctgacgctcacactcctacatggtttcaggggccaatggaggtcaattgatgccacagtgtgtagagagatgtgcaatgtcacgcacagtaagacttaagcagctttgcattctaacagtgtaacaggagggaaaaaatgaaggtgagcagactttacctttccaaaccagccattcccaatttcctgtatgtagttcagactgtggcgggcaacttgggacttcaaaccttctgtaggaaaaagaacatttaagaagtaaagattagtatttaacaaaaagacataataagtatattacctataaagtacaaatgctaatataaatttaacgtttatgataataaagacagaaataaatacttaagggcttctctgatggctcagtggtaaagaagctgcctgccaatgcaggagacacaggttcaatccccgatctgggaagatccca

SEQ ID NO: 63393 - DNA, 1677 bp, Bovine  19866880571834
gggagtgggtgggaatcctggtttgcttaagagaggactggggctgggggctggggagggaggcggggtggggggacgaggtttgggtgttgtgggcgcaggagctggtgcctgtgtggctgagacaccggggtttggggagggaggctccctcctgtctgctttgattttcctgaagcatggagtgaccatttcccacgtcttcacattttacatcattttagaatttttaatataaactgatggattattgaagatcattccattattcattgggtgagacacgcttaccttttgagagcaagcatcattttctatcaatcctttgaagtgcctggggcttcctggcaccagccacatgcccccacctccaggagccgggagaggagcccttggcctgtggattctgcatgcagtgtggacaggtgccccgtgtcccaggcctggaatccaatcgattcctggggcgatggaggcttacagctgttggggtttcagacagccagctctgtctctcaacagcctcacctacttgcttaaaattccagaatttaatcatcacgctcagcataaaaataagaggggtaggtggcgggaggggaaaatactgatggaaatgtgtgggaccacaggccccagcttgaggtgggaagtgtgtttattcccccggctgagcagagtggattctggcattgaagctgatggctctgtgcagctggtcacccaagcgccagccagcccactgcttcatccacgtgggtgcagcgggggatgtgggaccgtcctgccaaggttgcaaagccagtccttcgagagatgatgcaaccctcccagcagggcctgtgaacaaggccatgaatccctgcggggtgacatctgtcctggttctccctggtccatgcaacggtttctctgaggcagttttgactatgtacacacacattttgcttggagcaccagcccttcacccccaggaaatctggggcgtccttgcgttggttcattgtttcatgccgcctctcactaaaggcgttactgatctcctgtcatgcgtgggtcaccctgcttcatgtcaaataaaacaactgattcccaaatactgtttccaccaagtgatccaggcaattgactagagggtttagcgtctccgtggactagaagtccttgtgcagactaacacatttggatgggtttagccctggctgcaataagctttaaatgtggcttcctgtgaacaatagagcaaatcattcatcaattctgcacacctccagggccacttctcaggggtgttgctgggtcttcaaaaatgtttccactcctgaggcaaaaagactggctgttccaggaccctggttttgatcagtgttgcaagcgtcttcttcctcgatgccaggcagtgtctgagaccagcattgctctgtgtttctgaattgccaccctgccaagaaataaatccaccaggttctacgacttagccttcagagctctcatctcccactctttccctggcttgtactcggaggcattccaattgagaggcttgtctgcctggaagtcaaggaagccggtccggctctgaattaccggtgtggggttttcacttttatttataggacgtgttgtctgggatagccaagtgcggatcttccaggggatcaggaggaaacattccca

SEQ ID NO: 63394 - DNA, 1781 bp, Bovine  19866880595143
ttgaagcaaaccatctgttcccagcaaccacaataatcagtcaagatcttagcaagcaaaagcttctttcattgtcgagactagtggaccttttgtttaaaaaattctttttttcagaagttagctgttaagtcagtttgccaaggaatactcctaagactaatgactttttgtccccaagtctttggtgctcatatttagtgttttgtgagtcagcgtggctgactgccttcatgctctgctctttcatgagaatctactgagtgaccagcatcagagctggtcattgaaagatactggggagactggcctccactgcacccccagccccacctaacaatgttggggtgctggtcgggcttaggacaaagctcacttcagctcttcttcatccaggtacccactctggtcgttgtctatgaaacgaaaaacatccttcacctgactggctgacatcttagcaaggcccgatgtctggaagaatttttggggttcaaaggtatctggatctgaaaaacagagaataggttattctgatgctcgttggactgcattctgtctctggaccaaagtgatgtcaacttaggatgttaaaactactttacataatatcattgagctacagggatgctctgtttaaaaaaactttttttaaaggccaagtagggctgtgactgggtctggattctgaggcagccaagaccatatgccttcatactctcatctcctttccccctccccagatttccctctccacttgactctgtccatctcctcttctctggcctcctctcgtctgtgcctcctgatgccctttattcaggctgggtatccaggatggcagccccactggtctaactgatgagagaaacacaatcataggattcaaacaggctacggggatccactgattccttttttttttcttcatgtttagtaagtttctttcaccatacagaaagggattctatgctcagatctcctatttctatcacgtagttatctagttaataagttcttcctctgattcccatgcactttcagccagtttgcattttaatttttgtaacttttcaggagctaccgatttgtgcgagaaagccgccgccgcctcgcttcccatttaccttggcactcctgcagggctgctgcaatgtcgtcagcactgaggacatctgtgatgctcattttccacctgttctcacaaaataatcgagatgtggtaaatgcctagcagaaacatgcacatctcgggggagcacaccccccaaggcccacagaaactgcacatttgttgagcaattttaaagtgtaataagcgtatgaccagctaagacataatatccaaataaaaaccaaatactgaaaagattccagcccccttcgtctcagtgtcctctcttgaatatatgccaaagatgaaattaaaaaatacaaactgaagaaagatttgatgctgctttcttgtaaaaaaaaatatatattcacatcatcaaccacttatacagacatctacaagccattcagaagtagaccatgttacaaatgcaatggcattttaatacactagccagagaaatgcaacattgcaagtttcacttacagaaggacagagcttgggctgcttgcagactgtctacagaagggatgcccttctgtcccgaaggatgggaatcagagacatcaaaaacccatttaccagagatcaaagatccacccatgtgtcaactccacgggaaaagaacccgagcaccgcatgcaccaacctaaaatccatgtag

SEQ ID NO: 63395 - DNA, 1964 bp, Bovine  19866880680249
agaatgaagagatgagaatcaacagaaacgtttttcagccctgaagatgtacttttctctatgggtagggtctgcttgagtgccagtaaagtaaattaaaaaaatacccacactgagacagaccactgtgtagtttcagaacacaggaataaagagaagggttccagaaataagccccttcccctgccccatctcatcaaaaaaaaaaaaaaaataagtcatatacaaatgacagctgacttctcaggagcaaaactggatattaaagacagtggagggcttccctggtgactcagtggtaaggggtcctcctgccagtgcaggagacgcaggttggctccctggatccaggaggctcccacttgcctcagagcaactaagctgatgtgccgcagctgctgagcctgtgctcccgagcccaggagccttggctactggcacgccctagagcctgtgcttgctgcagctagagaaaagcctatgcagcagcaaagacccagcacagctgaaaataaataaaattattttaaaaataaagacagtaatatataaggagcaatatcttttaaatcctatgggaaaatcactttcaacttgaaatactctgcccagcgaaataccaatcaaacatcaaggtaaatataatttcagacacttggggactcacatctacctcctatgtcatttctcaggtcattcttagagaatgatctccagcaaatagggataaatgaagaaagaggaagatgtggaatccagctaatgagactctcgtcacacgggagaccaaaaagggacatgtgagggcgacagcgtggcgggagacggccaggccaggctgagcgaggacagagagtgcttggggatgttctgggagaaaaaaaatgaagattaaccaacaacttcggcttgaaagatgtcataggcttctgttagatctcatggagtatgaggaagatgcatggaaaaatctaaggaggcattggaatgagacttgttaatctcaggagaaacgaaaaggtgtatcaagaaaggaagcaccattcttggtacattccttacattgtagtgaccagtatttacaaagtcataataaatactgactattgattttccaggaaactgctgttatgtagggaatactggaaacaaggaaagtagagttgtttactgtagcagaaggccagtggttattgtccaaagtcgagaagtcaagaatattaatcaaaactgtggcagtaaatacagaagagcactttcaatggggctgttacaggggagtgaggccaggggtgcagaagggttgaggcaggaattattttccattttttgtctaataaaataaaagctgataaataaacttttaataatattaaataaaagttataatgttctttaacaaagaacagttataataaaagttattatgttctttctcccctgctaacatgtaatggagaacctctttatcccgaaaaatacatgtgtcatgtttctgcccctttgaaagttgtgtggtttttttattctttgttgcttgggcctttacaaacaaggtacacattttggttgaggtgggcggtaaagagatttgactggtctacctggaaagattaatattgtgaagcttattgtttgtaggtgggacaaatacattcagtcaccaaatatattcagagcctcataggaatgatttcttatctgtaacatcagatttaggatagcgttttaaatttagactagtgttctaaatagttgcctgtcttatacttgtcatagcgcttctctctctgtttatgaccttctattgatgttgaacttacacttttaaaaatgaaatccgtgacatctgcagagataagagcatcatgaagcccagaatgggaaaccacgtctccacctccactgctgtgagcacaggccctggtgcacactccacaaatatgtaatgaatgaactgatgg

SEQ ID NO: 63396 - DNA, 869 bp, Bovine  19866880725813
caggaaggctcgggtactcagtaggttctcagtgcttgtggaaaactgactttagatcactggggttagagtagattcagctgccagtgtcttctgatagaacagtaatctccttgaattcatcacaccatcagtggaatgtgtggttaacgtcaatttgtctcttgtcagattcctcaattgaaaagcaagtggccctgttaaaggccctttatggtaaacatttctataaatctttattttactattgtgaatgcacatgtgtgaaaatgaagaaagccttttgtggactcaaatacagattcttgataatgcctgttgaattgaagagatgtgtttgctctctctctcctgagatcagaggtgatggaccttgaatgcatgtctcataagaaaacaagagacgtggtatggtcaggcagttattagcagacctcagaagtctcacagacctcagtttgaatctgtggcccatgtaaaccacttaaaactattccttttgctaaaacattgcttttattattaataatttggttagcatttatggttttgctatattcctcaggatagtacatgaatgagaaatgttgcattagtttaaaaatctatttgttttataattctctttaaaaatgtagctccttttaaacaaatctattgtttgctaattttatctttctttctataggacatggccagctttctcacaaaagtaagttccaaattattttgacatttatcaaatgcaaatataaattatattgaattccattttatataatatctaatttttctgttgtaatgtaggatttgatatttttaattaacacgatttaagagtggaggatactcaattacatccagaacat

SEQ ID NO: 63397 - DNA, 2139 bp, Bovine  19866880768576
atggggctgtcagggaaggtcaacattaagacagcctccagggcttccttggtggctcagtggtaaagaatccacctgccaataaagttcagcagacacgagttcaatccctagtctgggaagatcccacatgctgtggagcaactaagcctgtgtctgactactattgagcctgtgctctagggcccgggagctgcgactactgagtccaggcatcgcaactactgaagcccgtgtgtcctcgagcccgtgctccgcagcaagggaagccactgcagtgacaaaccagcgcgccacgactagagagcagccccactcaccgcagctagagcaaagcccacacggcaacgaagacccagcacggccaaagataaatcaataaatgaaatgaaaaaaaatgacaccatccataacataaacgggacgactaaggagcccatcatgcaagcatcaaggacatgaacactccagacagtgagaagcacctgtgcaaaggtcctgaggcaggagtgggctcgccatcattggtgctgacacacggagacaggtgtgggggaaaacccggccccgggaaaccaggaggctgggttctgagaccatcccttgacgagctgttctaagatcatcccttgctgagttgccactgagcaggccgctacccagccaagccccacacagcccggacaggaaatctggactctgcccacatgcctaggtcactgagcatcagaactccccagagtcccatgctgggcaggcattttggttggttgacagagtgggagctgccgggtcctttgaggcccgggcacatttctgcatgtcataatctgcagggactcctgtccatgagctcttccccataatgtacagagaccctgtgggttaggggttctttccctgtcccccttccatggtcagctcatggcagcccagcctgcctctccatcccctcccaccgtcaccaccataagggaaactgccctccatgagctgtcatttctacattttaggagcacattcggatgagacctcccgtctcaatcagatatcctgcttaatggagcatcacatccgtaccttccacacatctccctttctcaaagaattataaagcaatcaagtgcatttggcacgaaaacctcagtgaccataatttaatctggctccgacagacacagagtctcgccaggaacttgtgttgcctgggggtcataattacgagtatcagttactatctgtgccgtcaatgtgcagatctgctgactaacagacattcctggcggagaaaatgcggcatcgactgtctcttacgatctatcctctgtgccttgagaagtggcacatcagatgaagactgtcagtcttctagttcccaccaacacctgtcttaatgaggatgtacggcaccctatttacctgccctcattccctccgaagcttgcattctcagtgtatgatgtctgttttcagaacctccaaaatgccggtgtcctcggctcagggaagaccttcagcctcacgtcaggaagctgagtgctgcttacagatcggcaggctcctgcggtcccttctgcccttgccaatcgacgcacgggtaccaatttccaccaccaggccccagcaattagaccctgttcaactgctatcttagatgaatacagcaaagtctttcaaaagcccaaattaatcacagagaaaaggggcgtcatgcaatccaggatgatattaatgtcaggaagaggcagtaaattttatttttattaatccacatagatggatgttctcattatacctatcacactggcaaatgataaaaagcaagggtaaaaacactggttttccatacgggagatcttatcaactgtattgaggatgtgatcattatacttaggcgttatatagagctgttttcttaacagccaaaagcactttcatttaatattaataataataaaaaacaatgtttggctgaaagtagccgggaccacgtatacatgtcatacattcacaagcagcagcacctccaaccacaccgttctctaagtgacggacatctcccagcccagaggctcagcctcccagcacaaacttcgagttaccatagtcccagcccctctcatcttcccgcatggcctg

SEQ ID NO: 63398 - DNA, 1177 bp, Bovine  19866880831805
aaaaaaaagatttggaaataaatttaagagactagtatggaacatttaaaaaatagatatttggagagtatctatttatttcttgttttaaaagatgagggcattaacacccaaaacatcctcccatctgccttacccccacctcctaatttttatagttatattattactttaacattattcgagtttataacattcacaattatttttgcttctctttcattagttgccttcttttcatcctatatctaaacagatttacattcaccacaattcttttaatttagctttgccattgtcaaatttattttcaatcatcttttatttgactggatgttgctgtcaagcaatttttttcttcctcaagaagaaatcaaacatattgcattcactgagttctttcatgccagtaaatgcctctcagtggttcccatgcttgaatggcatcttgaatagttgtaatatttttattttgttttgttttatttcattctattctattttattctatgctgctccccaggggcatgtggaacttccttgactaggaattgaaattgcaccccctgcagtggaaatgcaggtttgtaaccactggaccatgagggaagtccagttaaaatattttaaaattaaatttcatctttctcaacactttatggacacttcttcattgtcttgtagaactgagtgttgtggagaattctgagatgggataatatttcctcctgcttagatgtgatttgctgttttgcttaagaatctggaattctttctttatcctttacatttaatagttcacttaggatatgtcttattgttgatcatttcacatttaattttcttaatgtgtcatgaactttttgttttgcagattattctctgttcattttggggaaattctattgtattatgtctttgtgaatatacctttaaaatggaaattccacttcaagaatattatgatcttttttttggatcataatatattttattatgtatataatattgtaatatgtatatttcatatctgcaatattcttccaaacttctttcttcactcttttacttcacattcacttagattatcttaccttttcctctttctgtcagtaattgacttttgtgtcagtaattcatcttgctgaatctaaactgcttattatttccataaaca

SEQ ID NO: 63399 - DNA, 891 bp, Bovine  19866880833893
cagcgctgggccctgacattttcagtaatttgttttcagaacaactccagaccttctgtaacatttccctctgtctacacggagcctctgctctgactctgaatttccacgggtctgtgagagcaataaacaatgagagaatgcaaccttttactaaaaggggaagtattagccccggggatcttgaaattcagcacaaagtgaaaatttccattaggcaaatgcatacaacgataaataatttagcaaagaccttgagtagtaatttatgtgtttcgttaaaaatgtccccaacctattgacattgaccaggaagtacaagaaagcttgaagatcaatggaaaccctgctgagccctaaaggcagactttgccatgtaagctggtttgtaacgtcccctgagtaccccacgactataaaacttttaggatgcgttggctatgatgtcaggcagtacctggggcccaaattcatggtggaaagagctttgctattttaatactctccataggatgcacttaccaattaaaagcttgcattctaggccttctctgttgtattaatatttagaggtatttgaagtccctcgtgggtttcccaggtggtgctagtggtaaagaactcgcctgccaatgcaggagatgtaagagacctgagttccacccctgggttgggaagatcccttggagcagaaaatggcaacctgccccagtatccttgcctggaaaattccagggacagaggagcctggcgggctacatgccacggggctgcagagagtcagacacgactgagcccacacacacacacacagtccctgctggtccagtggctaaaactccccactcccaagggagggggctcgagtgccatcccggtcagggaactaga

SEQ ID NO: 63400 - DNA, 3094 bp, Bovine  19866881047772
ccctactccgacagatggtgggtaacttcacgtcaccttctctcagaaggcgaagaaagtctgtctccacaagtcttagttatatattccctgattttcaacagtaaatgttatgaaaagcatttatatattattcatgactgatcttagaattaacgtctagtttttaaaatgtaatactgtttaaaaaaaaaaagtgtagaaccagcaggaatttctgtcttatacatgtgataagaaacttgttaagtctgagttaattctaagaatcagtttgagggcatttgctatcgtggaattgtttttgaacaaggctgtatgtgtgacactcagcgtgggacgagacaggtagcacagacatgattgggtttgaattggcacctgaggcagtttgcataatgtgtattgacatttgcaaaaacaaatttacttcttaagagtctccagacccgttcttacctcagtttccaggtagagtcgggctcccctgtgtcgaggcccctgtccgtgccaccctgtgctcagcgggcgttgcccctgcatctggttgcccttatgtgtgggcactgctcagcccctcacccgacttgctagaactaactcacccagaataactggatgtttctgccgtaaatttaataccatgacatcgtcgtcctgtcttcccttccactcacggccgcagtttaaggcgttgcccgtattcagccaaccctttgaagaccatctcctggctgccacctactctgggcttctgtttctgctcttgctctccaccctcagctcctttggtggcctgagggaagcatgtgctgcagaaggtcgtggtgttcctttctgtcgggggaatcgttagagagtagtcaccacggcctgtgtctgtgtgagtccttgcaaaatagagtgagtaagtctcatacgttagacacgtgcatccttgactaagcaggagaccgatggcagttgtgttcagaggagagcattttagggctgcttgtaaattcagtggctgagcgcgtggaaaacaccagaagaacaaacgacaaggccagaagaattgcagtgatgctgcacagggtcctaaggatgcagaaatcagtggccagattttctctctccatttccactttcccccagagctcaccatgaaccagactcctgctggtggccagcaaagtgattcaagtgttgggacttcttgggtgttgagctggcctagggggtccttgtgaggtcttttcttgttttaaaacaatttgtcatctgtccactaatctcctgtctcgctcaggtatgaagtcttgcagttctgctggctgtcaccagataagcggccagcagcggaggacgtgcaccggctgctcacctacctgcggatgcaaagccagagggacccggaagtggactttgagcagcagtggaacgcactcaagcccaccgcaaacagcagagacgctgcaagtaacgccgccttccccatcctcgaccacttcaccagggaccggctcggcagagagatggaggaggtcctcactgtgaccgagaccagccaaggcctgagcttcgagtacgtctgggaggcggccaagcacgaccatttcgacgagcgtagccggggccccccggatgaagccttgtcctacaccagcattttcttccccacggaagcgtttgagagctcgctctcagaccccggtcctggcaagcaggatgacaatggccaggatgtccccctgcgggcccccgggggtggtgcccgttttcgatgcccacaacctttctgttggaagcgactactacatccagttagaggaaaaaagccgtagcaacttggagctagattacccgcccgctctgctcacaacagagatggataatcctgagaggcttggggatggcgcatcccagtgtctgacgctcaggagcctggagcttgaggagtccagtacagaggaggatttcttccagaacagtgcagaccccaaagacgccagcagacccgaggaggcgcacagcaccaagggccccgagagccctttcaacagtttatttaatgaccttgacaagtcagaggctttgcccagtcaccaaaaaatatttgacttgatggaactaaatggagtccaagctgactttaagcctcccaccctgagttcaagtttggatgaccccaaagagtccgtaatcgcacgccacttggagagggaaaagccccgtaagctttttgactgtgagcctctttactccacagacagactcatacaccaagatggttttgatcagctggacagtgaagagttgtcagaaaactttttatttcttcaagagaagaacttactgaaagactctttgtccagcaaagagcatgtaaatgatctgcagacagaactcagaaatgctggctttcctgaacccatgttagaaactcccagtagaaagtctgtagaggctgagtctaagtttgctgaaaataaaccctactcttcgctgcaggagagcatcagcgtgcacggcaaggagtcgggtgcagcgcccaagggtggcactggggcagcggcctccccttgctccccacagccgcaggtacctcctacctcgctcgaaacccaggggccgcctcatgatgtccccccgggggcggccctgaagcagggcggagccaggcccacgcatccagagggcggtgtctgtgaagatagcacctgccgagaggcaaacccagactccacgcccgccccaccggacacccccgcccccactggcaacgggtccccggccctgactcagcacggggagggggccgtgagcctggcccagagcgaccccagcctggtccaggacaccgctgccagcaaggtgagtatagggaacggcctcccagaatcgaggcagaacttaaaaaaccagctgcctttggaagaccacggccctcgaggcccgcgggagagagcccgggaggccgccgaggtcctggggcagctgggtcgtagagatgctgctgcagaggagggcggcttggtgtccaccctctcctcagactcggccagtcaggacagcctcctggaggacagcttgtcggcgcccggccccgcct

SEQ ID NO: 63401 - DNA, 1108 bp, Bovine  19866881251160
aaaataaggaagactactcaatcaacaatttttattgtggtgaaatatacataacataaactttaccattttaactattttaagtgtacagttctatggttttaagtgcatccacgctgttttacaaccatcaaccaccatccatctccagaatgttttcatcttcccaaactgaatctctgttcccccttaaacacgactccccctttccccctctcctggtggttacccttctgtctctgcctccacgattctgactaccattaaacacgactccccctttccccctctcctggtggttacccttctattttctgcctccacgattctgactaccattaaacacgactccccctttcccctctcctggtggttacccttctgtttctgcctccacgattctgactaccattaaacacgactccccctttcccctctcctggtgattacccttctgtctctgcctccacgattctgactacttccaagtggcaccagtggtaaagaatctacctgccaatgcaatagattcaactgctgggtcaggaagattccctgtagaagggaaaggtaaaccactccagtactcttgcctgtaaaaccccatggacagaggagcctggcaggttagagtcgcaaagagtcggacacaactgagcactgattgaggcgcctcagagtagtgaaatcacagtctttgtccttctgtgtgaatcaacattttgatccccagattgcacgtagtgggattcacgtcagaatcctggttacattcctgattcagacatcatttactgggtctctgtttatctttaggttctatcagaaaaacagcatgaatatctaaagcgtctcggtttaacccatatgctgttttcatttaaatgagcagatttttaaaaatgtctttctatggacaagttgtaaaccctgccacagaaagaaagaactcagccagtttctatggcaacttaatgtcagcaacctaatttcttaagacctattttcagaaactgtgttgttttttttttaagactgggccaagtggatgctgtctggaaatcttgttttcaggttctttttgctgtttttatatatctattcatca

SEQ ID NO: 63402 - DNA, 852 bp, Bovine  19866881274416
atctgcccggcccgccagcccccgccttcaggggtccagcggattcttaccgagacacacctccgccgtggggtagggctgggctttggcctccccgggcctgcccaggagggtccctgagtccggaagtggcccgaggtggtctaaggccagcgggcacttggagctgaggtcgaggttggcgtgaggagccgtccgccctgggaccgggcgggcgacaggcaggacggagcagccctgagcatccctccttcgcctcagggcttctgctggatgcacgtgggcaccgaccagcccttcacctccgtctccatcggcacctgctaccaggtgtggggccgtggcgagggacggctccgccttctaccgcagctccgtgtccccctccaggcccaacggtgagagccctcgcctcaggcggtctccctgcgcccgccgccgccgccgccgccgccgccatgttgggtcgagcgccaggggcggctacggctacttccgcttccagaggaagccagtggacggggctccgtttaatcaacgagcgtttacccggcatggggccaggctgggctacccccagagtccacaccccctctgctgggatgacccaggggtggtcaccccgtgacgggttgtccttcaccaccctcggcctcccgcccctcaggggacctgcctgggcgcccccccggcccatccacagtgtcgacctcgactgctctccaggagcaaaggtcatgcaggcttgttcttggctggacatctggacagtgtccggcacaggcattgctgggtgggtggtgactggcttatccgtgccctccacctggagcagtgggttcgcacagcagc

SEQ ID NO: 63403 - DNA, 923 bp, Bovine  19866881310956
cgactgagagacttactttacttttactttctgcattggagaaggaaatggcaacccactccagtgttcttgcctggagaatactagggacggcggagcctggtgggctgccatctatggggtcgcacagagtcggacttagcagcagcagcagcagcaaatcacttataatgcttgcatatctttgaaaaaggagttaaaacaaacatttttaataatgcagattattttagcgtgcttgaagttgtaactttattctttacttgcagttaagagactactactagactattactcaggtaatgtaaggtatttaaaataaattcagacaaattagccagtttagaattcttctgtggtaactctaaaaataccaggaaatgagccataagtctggtatcaatgcagaacaaggtacaaatacatttagattttaacctgttagcagtcagagtgatttaccaaaaaaaaccaaaactgatcatctccattctttaagtaattaggaatatggcgttgcctttttctatgaaaaaggattttaaaacataaattatttatcagggaactcaatacacttaccaccctgatttcccaagaaagcctttttccacagcagttccatgtcatgtcatcctgggtgttgattcgccttgttctcatgttcacttcactctttctgttttcagtgacttagccctgagaaactgctttcttacctcggacttaaatgtgaaagtgggtgattatggaataggattcagcaggtacaaggtaagccagaggtttaaagggttctctctctgatctaatttaatgctcatgaaagtggtcatatcacaaaatgccatgcctgtttggaaagggagggtaaataattattgctgctttttaataaaatatacacatcatatataaatatt

SEQ ID NO: 63404 - DNA, 1250 bp, Bovine  19866881359273
ccccccaggatcctgcagggccctgccaatgacatttctcttatttgttcttgaaaacaaacccttcagaaacagccctgggagcctgggggcacttcctgggctgacatttattttgatcctgttttctcctccccagttgtaaattccccttttcttccacagggactgaggccgagcagggaggggcgtggccacaccccccccagttacctgccttctcacctggcccagcaccttctcctgacgaaatccttcatggttttgtacttgtggtacgagctgcaagaggaagaagctgaagtcagcaccattctgtggaattttctagaaagcaacgctgcacactcattccttctcccggggcctcagtgtgagctaagcaggggcagcaggtaacaggacaccatcctcctgcttcaggggcctccagccccacccaggcctccctcgggagggggtctccctggggtcagggtctccctggggctgggacctcactgaggccacgacgtggcagctacctggaggtgggttggtggtttctagctaaggggcctctgagccctccccatcccaggcctcatatcactcttctgggagccgtcaagttcagggcttgaggtcaaagggaaggctcagatcaggataaacctcctccccgctggacttcatctgctcagaagcctcagctcaggctctggctcggtctttctcggctccgtcctccatctgaacgcgactcgtgtatcgtgaagggcctgcgccactgggcagggtggaggggcttcgcccgacttcgccaggcctgacactcggggccccagcccccctgagggcccctgcccacacagagagagagagatgctcacgcagggaagtcactggcatactgccacccctctgggtccgtgccgccagggacgctgaaatccacgaaccagtcagaaacctggaggaacaggcaggtcggtgtgggcagaccccctactgcaacctctgccccacccgcagcccggagctcacccaggtccactgcagggacgggggcttcgtgctggccttggtgcactcctgcaggcccgtggcgtcactccacatgtaccggtcggtgggcagacccctgcacgggacaccaggggtgaggtgatgccagagagaggggaacacagcaccgctaccgcccgccgcccaggtgcctgcatctacctgtggggaggggtggggcgggcagaaacagaagtagctcc

SEQ ID NO: 63405 - DNA, 1111 bp, Bovine  19866881498816
tcactatatgcgcggcatggggtgaaagaggtgctttcaggggaacacgccgaaccatgttttcatttaattacttacgaattgattttaatgtacattaagaaaacagcaaacccatgaattcatacccactacatattacttagatcatttcctctctaaataagtttattaaagggattgatttgaagaaccaatattgataggctaagaagacaggtgttataggtatgtggcaaagtgaaggctaactgagctctgtgaaacctgcttcagtaattccagagaaagtgtaagctgcaaagtctcacgaaacagcatgtcctctttggaagacccattctttttcctgcagtctttaaatcctcatcctaaaagggctcgcaggtggttcagtggtaaagaatccaccagccaataaaagagacgcagattctgatccctgggtcaggaggttcccctggagaaggaaatggcaaccctctccagtattctagcctgggaaattccatggacagaggagcctggcaggttacagtcctcgggcttgcaaaagagttggatgaggctgaccacatacaaaacattagagcaactccagttattttgtatttgtattctgtgatttatttcaaatactgttctcagcatcttacaatagcttgctttctttaagatatgtgactttacatattttctgcaattgaacgtgcgatttttataacatttcaggactaggattctttttccttgaggaacacagtttcaattttatagtgaaagtcggctggaattcaagactgcatataggaaattagagacaaattttcaatatctttttcatttataaatgagttgcattgttattaaaaagcaacgctattcaattgcattcctttctttattttacactccacctcattccatatagattagaggcaactctagcaagaacacgtgataaagttaaaatttaaaaaactaaccctgggaattaaaagaaagaagccaaggggagggaaagtaaaaaacaaatatgcaaacttcacaggcccaagtgggtaataaagtcgagtttcacatttggcttttgagatccctggcagctgga

SEQ ID NO: 63406 - DNA, 3200 bp, Bovine  19866880366536
aaattgcatgagaaagagtttcaggacccctccctgagagcagatgaggtctggaaagtgagggatggtctatttatcacagatgattctgtgagacgtcccccctccctgatcaagcctgcctaagctcctctagttcaagcaccaccaccttcctcccatttgtgagccagacatcctggattgtgaagtcaagtgggtcttaagaagcatcactatgaacaaagctagtggcggctgctgctgctgctaagtagcttcagtcgtgtctgactctgtgcgaccccatagatggaagcccaccaggctcccctgtccctgggattctccaggcaagaacactggagtgggttgccatttccttctccaacgcatgaaagtgaaaagtgaaagggaagtcactcagttgtgtccgactcttagcgaccccatggactacagcctaccaggcttctccgtccatgggattttccaggcaagagtactggcatggggtgccattgctttctccaaaagctagtggaggtgatggaattccagttgagatacttcaaattctaaaagatgatgctgtgaaagagctgcactcaatatgacaacaaatttggaaaactcagcagtggccacaggactggaaaaggtcagttttcattccaatcccaaagaaaggcagtgccaaagaatgttcaaactactgcacaattgtactcgtcccacacgctcacaaagtaatgctcaaaattctccaagccaggcttcagcaatatgtgaacttgaacttccagatgttcaagctggttttagaaaaggcagaggagccagagatcaattgccaacatctgctggatcatataaaaagcaagagagttccagaaaaacatctatttctgctttattggctatgccaaagcctttgactgtgtggatcacaataaactgcggaaaattctgaaagagataagaataccagaccacctgacctgcctcttgagaaacctgtatgcaggtcaggaagcaacagttagaactggacatggagcaacagactggctccaaataggaaaaggagtacgtcaaggctgtatattgtcaccctgcttatttaacttatacacagagtacatcatgagaaatgctaggctggatgaaacagaagctggaatcaagattgctgggagaaacatcaataacctcagatatgcagatgacaccacccttatggcagaaagcgaagaagaactaaagagcctcttgatgaaagtaaaagaggagagtgaaaaagttggcttaaagctcaacattcagataactaagattatggcatccggtcccatcatgtcatgacaaatagatgggaaaatagtagaaacaatgacagactttatttttctggactccaaaattactgcagatggtgattgcagccatgaaattagaagatgcttactccttggaagaaaagctatgaccaacacagacagtatattgaaaagcagagacattactttgccaacaaaagtctgtctagtcaaggctatggtttttccagtagtcatgtagggatgtgagagttggaccataaagaaaaatgatctctttagaattgatgcttttgaactgtggtgttggaaaagactcttgagagtcccttggactgcaaggaaatctaaccagtccatcctaaaggagatcagtccttgggtgttcattggaaggactgaagctaaagctgaaactccaatactttggccacctgatgtgaagaactgacttatttgaaaagaccctgatgctgggaaagactgaaggcaggaggagaagaggatgagagagtataagatggttggatggcatcactgactcagtggacatgagtttgagtaaactctgggagttggtgatggacagggaaccctggcgtgcttcagtctatggggttgcaaaggagtaggacacgactgagcgagtaaactgaactggacggaatcagatcagatcagatcagatcagtcgctcagtcgtgtccgactcactgaacggaatagggaagaacaaatctgactccatattagatctgtttcttttacctttagttttgttttgttgttggttttctctctctctctctctctctctttttttttgtattttacctttgcattctattgtttttacttagaatcaagaatgtttcctacagtctgacctttaaggttacaactcctttccattcatatagagataaaaagttgcagaacagagaataacatttgttttgctgaaggttacaggaacattgtgacctgacctatacagacagcttcaataacaaagggttccaacaggaagtttgcaacaaccaactaccctctcccttagcttgctttttaaaatgctttcctgagacgctttggagagtttggagtttggggccaggagccaccccttattcttgcatggccctgcaatcaccctctctctgctccagactccgacattttggtattgtttggcctcagtgggcatcaggcacacaaatttgcttttggtaataagttctgccatggcactcagtctcagacactcaacaaatccctgaactgcattctgctttggcattactgtatgtctggggaccctgtttacttcctttagaacaggctctatgaacacaggttgaacacattaagctgactcttcagatgctgaatttacttttatttagggatagctgcaagttccccatgtgtaaaataatctgaagatttaccttgaaagatttttgcaagaaagttttgctcactgtagttgaagaagaatggactactactctgcccaataagagttcacatacagagctcaaatcaagatgaatacaactctttaaagcaagaaaaatttactcttttagttggcccatagagtaccttactttacttccatctattagaaacatgttataaaaggttggattcctaggaaaagaccctttaggaaaattgtcttaaaaattgttaaatccatgatatctattgtatgcccgatataccctaaccttgtgcagtgtacaacctatacaactgtatgtgataatgcttaattttatgccagaaaggattactgttctcgtgggactctggactcacttcctggatgcaaataaaatttagaatgcaaatttcaccatgagcatgtctata

SEQ ID NO: 63407 - DNA, 934 bp, Bovine  19866880367599
ctccatccagctttgagatgactgtgtctccagtggacatcttgaccataacctcatgagggacctcaagctacaagctctcagctgagcagctctccaatttctgatcacagaaaccatgagagagaataactgtctgctgttgcttcaagtctcataagttgtagggcaatttgttatgtgaaggtagataactgatatggctgttttgatgtggggagagagagaaagcacagatgcactggctaatggagagagagaaaggagaagtactagaggcagaggctgaggattaccaaagggcaaccgcaccatgttgctcgtgggcacagtcctggaggcattttctggaagagaagcaacagaatcgagtgtgccaagtgctttgaagtgcctggagaccctgcagggaatggcactgggtaaccaggaggtcgtgcttttctctttatcatctctgccattaactggagcggagctctttgtgggaaacatgcaaattgcttaaaatggggttgaattccctccatctctctttaactggaaatataattgcaactctttgcacattgctctgatttttttttttttttaaatcctgtcacgctttgttggctcactgcttttcatcttactgtttattaaaatagcctgagtcctctttgatgctgaaagcccaagtatgtgattgggagctattgccaaattacagttcatttttatttgatactaagattctagactattcatttttaagtgtgttttttttttttttttttcaactttggagttggggagtgggagtagggaagggagaaaagtaggaaacagtgaatggtcaatgggaactctgtcctaacctcaccaatctggcagttattgtcaaagcattcccagaacatttccagtgctctcctctcctgtagacttagtc

SEQ ID NO: 63408 - DNA, 1791 bp, Bovine  19866880445999
tttcggcaaaagcccatccagaagccattgcctctcaactcttcctagctctgcttaactctctcctctgctctggttataaagcaggtaccacgggtgtcgcctcattcttgtctcatgtacaccacgttgtgcattcttatccatggaggattaaggatcactgaaagcagtgactaatccatggctgggactagttagccgcctgcctggtatgtggctgtggctgacatagagaactgagcctgagagctggtgctttcctcctgctttaatgagagcagtgctgagaatagacaacagtgtgggtgatgcatagttaatcaagactttgggtgaacactatattcccaattaaatatgatttaattctgcttatagtggcagaaaaagattcttacagttcttttgtctgattacatcacttgctacattaagttcattaggaatattaggcaatgaataaaggccaaaggaaatgaaccatttttaatgaatgaagaatagtatggaggccatttactagccaagatgaatagtagcaataaactggagattcatttctttgacactctgtttaaatgcattcctgttgcctcttccattcagaagcatagattgagcaggccataaaatttacaatgttatttggaacaatttttttttttttttaggaaatgctatagctgaaatagctgaagaatcttaaatgatagactgtggataacatcttgagagctaggtcttcttatctagttgggatgaggggaatatttcatacatttttctgtttcatttagataactaggtagtttcactcctaactggaaggtgctcattccaagccatctacctttcagaaacacgtgcaaagcctttgccccagtcttgacttggagccggactcctgcagccaaaggctttttcagagatttgtgaccgtgaaagggaaaatctttccaaagtttaaaattctgcaaaatttccaaagagatagccactgcacttttggagggattttaatcgaaccaagaaataaaagcaaagccatcatatcttttcatcactgcctaacccttttaaaaatatgtattaaaatttatatcatttggatattcatgcctatggccttcaaaactttttctttaatccactaccttctccaacccctaggagaaaccacagtgcagatagcaattaagagacagctggtttcttccacaaaatgggctttaaaaaaaaaaaaaaaagtgccttttcaaaccctctgcttgtagggagttgtgctccttgtcatttctgccttctccataggatacccactccctaggacctcagtattaaaggctgtaccagaatttgttgttgatagctttcagctatcaaaagttaatttgtttatactttatatgttaaaaaaaaaaaaaaaaaaaaagatatgaaaggcacctgagtctctagcagaactcaagagactgaggccaagtgaaaaagatggtctctgtcacactcaccaattctgcctgggaattctgtctcaaacttgtcctttctccatatcatcccagtacaggcccaagatatccttacctgtcccagtaaaggcccaagatatacttttgcaagaaccatccctacccatgtactactgcaggcagcctcttatgttccaggatctcactaccagagttgattcctaacaaatgcaggggtgtcaatcctaagctaaagtctcagaattgagtactttccctttgaaggaaggatggagtacatgatccttccatcatt

SEQ ID NO: 63409 - DNA, 1254 bp, Bovine  19866880475064
cccaaatctgtataacattccaaatgaatgattccctgaccaagttctatgtgaaagaatccaagacatcagagccaccatcttccctcaaccacaaagctttttaattttttttcttattttacgtattctaaaagattggtttgtaacaattttaagacacaagatgctttgatggtgaagcctgtaatgtagcagcagaaatgcatttcaggttccctatgtgaagaacaaggctgcatgttttctgtaaaatgtcatgacagtttctttctagagcctgaagacttggaggttgttaaaggtatgggagcagccaaattttctatggatcagtagttttacaaactaaaaataggcggtgatttgacctatcctaatgcaacactcaactaaagaggctgtttggatccccataatcaagtatctcaaaaagtcaagtcttttcaagtaggtgccttcaagtatttctgttacacagagcttaaaatttttttttgcaaatttacattcaaattggtatatttttcatgtgcccattttataaatgtgacaccagaagacccatttccccatcagaagacctgtaacatctttatctcacatccatttggggggaaaaccttagatgtccaccctccctccactgcccattgtggagggtgaatccacaggtaaagtccaaagttgagaaagtgaaactcatttcgtgggggcagtcaggaattaaggtggctcagaggttaagaatccacctgacaatgcaggaggcatgggtttgaatcctaggtcaagaagatcccctggagaaggaaatggcaagccactccagtattcttgcctgtgaaatcccagggacagaggagcctggtgggctacagtccatggggttacaaaagagtcaggcatgacttagagactgaaaaataaccataggagttaaggacaggacactttcttgaggaggatgtggaaacgtagtcaggaagagtgcagacgctgtgtttcaggctgccaagtcgagacacgaagctttgggaagcaagattggattggagagttcctgttggaggcaagtgggaagagaaagatctgacaggtggggaaatctggctgcctctgctaagtgttctactggtatggttctaatttgcaagttagacccttgctgtttctctgcccttgaattttgtcttgagggtcattttccccttttactaactatacaggctctgtcttatttcttcgtatggt

SEQ ID NO: 63410 - DNA, 2361 bp, Bovine  19866880558372
atgctagagaagatagatgcataggattcattgaggactgagttgcgtcgtacacagtaactcactgtccggaaactggctggctgggttagagtaagcatgggtttcacactgaatcctctcatacatccggtatctgggaacatctgctgacattcagattgatgcatcacatattcattgaaattcctccttgaagacttgcttttggcctctccctgccctgcacaccaggtagacacacccaggcacgaaatgtgatgtgtattcatgtgaccccatggactgtagcccacctggccactctgtccaagggattttccaggcaagaatactggagtgggttccatttcttcctccagggcatcttccttatccagctatcaaatctgtgtctcctgcgtctcctgtgttggcaggcaggttctttatcactgcatgtgatgaactgccctcttttctatctgccctctcctatagcaaaaagacagccattaacattcacaagattcttcatatattaaaaagttctttcatcatgtgtatcatctcagaatttcttccctgtggtgatgctctgaggtaggtctcattattattctcactttaaagatgaattaaatgactttctggcaataacataaccaatacaagatagttttatgtctaacgattaaggttctgactccaaattatcatatatttgtatatatatttgcatttatgtattcatacatacacatatattttacatgctttttgaaatataaccacctgtctcagaattaagaggtataaaatatggataagaaggaaacagaagcatagaactaagagaaggctgcaatgaggagtaaaatggactcatactggtatatctgaaacctcagaactttccagagtatataaatgatctgtctttcaacatgatatgtccatattaacaaaaaaggaactcccgggtcatagtatagtttcaatttgagtgaggtcatgcttggcaaaaaagctcaataaaacgtttgttgaaaggacccttcttgagcaaactagacattggagacagatggacattttctactctgagcccaggaggaacaacaaatggtgttattaattcagaggtcagcttcctgcagttactgttgttcaacttgtatcaacagactaaccacaactgtgcaagaatctgccctgtgtctgacttcagcaaaattctgaagtttctgttttttttttttaagtttatgcttaataaagaagtgtgctgatacagttctaagcttccagtgatggacttggccttcctccacacctggatgatcctgctttagtaaagctgttcaagtaagaggctgatcgagcactttcaagggatggccagagtgagtcactcccctacgtggaagtttactggataacttgaataggcatccagcttctaaccagaaaggagggtttcttgtaaatggggtaacagatgtaatatgagcaaagtcccaaggagtttcccaaagaaacttgaatgctttctgggaaagaaaggccattttttggtcacattctcttagcttctaatgcctctgtattttgatgtgtcacaagtgactcagcttctagggagatgaaaccagcttagaggagccactaaaacatccatgagcaaatagacttgggtgcaagactgaaaacgcagagtatgtgagagaacggggctggatagatagagcctgtgcatatagtcttggggagaacgtcccccgacacagtggatgaaaattgtattcacactgtatggctgagggccgtgccatttaatggatttctgaaaacactgcagctcatcccttgcaaaggaagcccgttaataaaacgagggtggcgggtaaccagccacagatagcacggccgctgccagcttgctgtgattagaaagcttgctgcacttaatgcattcccagccacagtgaaacagcttcatttaataaagcggtagtactgctgacacaaatgtattaaaaagtgggcacaagcagagtctaaagctctcaggaacattccacctgctaggggaaagggtggcagaaaggtgcagtcttcaaaggacttgtatttcatgagcgaaacccagttctggcattctcctggacactaaagacaatggcagaggtatgccatttcagctaacaccagtgagcatcataaatgtaaaatactgcttacagtatacatgcatacatatatacatatatatacacatgctatctatatacaaagtaaatacaccacatactatattatagtatacacacatacacatatacactttagctaaataaatctgtgctttcctaaaaaagt

SEQ ID NO: 63411 - DNA, 1954 bp, Bovine  19866880567445
tgatattacattggatgagaaactcactcggacttcctgtgatttacttttctggtaacattccttcctgatgcttggtttaatgcttgccaaggtaataggaatttgaaaaagtcaaacaactttgagattctgaagtaaaaggaaccatataaatagaaaatacattttcagtcgtctcctgatgttgaagtccatttcataataatagtcatcattgtgtcaaacagtttttcaagaggtaggatgcagaagtggctttgagtttcttagtaaattaagtacaagggaaaaattagtatttttgccttcatctaaaattataggattgatttttacctgggtagttataattagatctcaatgattggtgattgattttctggtgctgttatcctgtctacatgaatagttgctgtagtgatttatccaataaaagactgaagtaagaaacctggtattttaacgacttgaaactgttaagacagtctctaatgatacaacagcaaaaagtaaaatgactgctaatcagtggcactatcagcctctatttaaaacgtggcagtttgaggtagttaattttatctagtgaaactatctactgggggatactggaaagagcttagaaaaatgtaatgactgctcagaagtaaatcatgttataatgtcaatgctgactactggaaaactttcaagaatgggagagaggagaatgaaaaattattcctacagaatttccttaaaagaaaagagaacgtaccatatcttattttctgaaactttcttttatagataaagatgctttccaaatatggaaattcacaccattcatgacctagtctttaaaatcaatagctatttctcttttattttcttttaaatcagacaattcctctaatattaatttcagattcctctcatcttaaatgttctggttgtgtttttgcttctttcttctcccatttcacttgagaatttgcttgattagtaattctatttttccttcatgttcagtttcttcttctgcacttgttcagtcccctcagcctgtaggaaaatgtattctataaccaaaaaagaaaatgaaataaaattgactaccataattaaccatattctcatatttccccctttttttttttttttgcttagtgttaaggagtgattccaatctacttgctgcttactggctattacctctttcagcttgtcatctgctcctgtctgtcctctatgtcctcatatgtccactatgtctgaggatctcgggggaccctgcattcatggaacctttgcactcttattctctagttcttgactgcttcaactttggagggaggaaggtgttgaatagtattaactatactttccctttcattgtattacttctcatttgcaagatttaaatctgtgcctgagaagtaggacagtctggtcacaaccacgttgagctgaaatgtcatcatgacatacatactctatgtgagctgtcacttgtatttctgcctaatttttcatacctcccatctactttctcatgttttcttctttttttcctccttctatttaaatgtattttcttttcttgatctagtttcggttttctcactgatctggtgttcagtggatggaaatgttggaatgtgaaagtgagaaatgatgtgacgcctatattacaggtggatgagggtggcaagggaatgtaatccgacatggtgaagggactgagtgggagagaattgtcactccccagggagccagtgctccagtgttcactccctagagtgacttcaactgtgtgctggtctcagggggtgcactcatattccagaatatctagtccaaagaaggaggtgaagcagaaggattccaggtggcagcagtcatttcaggacaccagctcctgaaatggggtcatggagaaaaagtttctgggtatctgatagtaatagca

SEQ ID NO: 63412 - DNA, 1580 bp, Bovine  19866880592286
tagttcttcatacattttaaaataagcttctactgctaacatgctctcaaaccattcagtcaatgattatctctcccaactgacaatgcagttggggttgttgtttgttgttggttagttgctaagttgtgtcccattctatgaccccgtggactctagcccacgaggctcctctgtccatgagatttcccaggacagaatattggactgagttgccatttctttctccaatgcagctacattggcgagtggtagtgtcaaatctttctttgagaaatatttcataagcttcctaagtgtccttgctagagttaacttatctgatataactatttatttatgttttgtctgtgctgggtcttcactgctgtgcatgagctttctctagttgcaatgagtagggatcactctctagctgcggacaaggtctcctaattgcagtggtttctctttttacaggctctaaggcacgtgggtttcagtagtcgcagttctcaggccctaaagtgcaggctcagtagatgaggcacacgggcttagttgacctgtggcaggtgatatcttcctggggatcaaacccctgtcccctgccttgtcaggtgaattcttaaccactggaccaccaaggaaatcctgacataacttttgactctcttacattggattcaaacagtttatgcccattcaatgccagttaatcagtggtactcagaatgaaatattcaggtgtctaaacagatcttttgtggtaaacagtgtctgagaggatacaatgctggggataagtggctgactcggtgtgggagtaaaggatggaataaaagatcatctttatccaattgtgatttgtgaatttgaacagccagattcataaacacttggaccttaagtaaaatagcactaatcttggaaccggaagacctgactctggcattttctatacgtaaccagtgaaccatccctttcctcatttatgcaacaaagaaaatcatgctggccctgcaaactacatctttcacccttactgtgacattataaagaaagtcaaatgaaataatgtctagggaagttctctgcaagctataaaaatgaacatgcacaggattaatattaagggcaataagcagtcagaaactgagtaggccttcagaatacacagaagaatcaatctgttttttagtgtgggtttagggttctgaccaaggtgtttattctccaaatatctttttcaccttcacctatgctacctaaaattccatgcttttgaaatgtcaaatcttctgggctaacaaactggatatttgaaagtatgtctgtttgaacggagagggggagaagtcctgggaggacctttctaagtgagaaaaagaagtctactaacataatctaagaaaattaacaaatctggacttgtttatggtgtttccttggagaaggcaatggcaccccactccagtactcttgcctggaaaaccccatggatggaggggcctggtaggctgcagtccatggggtcgctaagtcggacacgactgagcaacttcactttcacttttcacttccatgcattggagaaggaa

SEQ ID NO: 63413 - DNA, 947 bp, Bovine  19866880592356
tgaaacagcctccccagatgattaaaacactcctgtacaatgtacatttacaaattgaaaattaatgaggaaacatgtttaaaaattgactatagctacccaagggtttaaaaacactttaaaatgcatgaagaaatcacttggctatgcagccctccttaagtgacaaataagtgacattacttctcagaattactcctgctgaattaactttccaatgtattggttattatggttgcataccaatattatattttgaaaaatactacaaatcatatccccccctactcctgttttctggggtaattcattttgcatctttccaacttaaggtaaatgacccagaacaaagcaaagatatccctcatggatgacgggtgtaacaacaagcacaattgtattctgccagtggggatgttctattctccattaaaagtttctctagtattcctgcccacaaacacaaaatagattctgcagcactttctggccaacacagggttccctgcaggctgccttcagtcagggcattccatctagcagctttggggatgggagtctttatcagggagataaaaagaggaaggaaaagacataattctcatcctccaagattcaacagaatagcagaagtggaggcagggctttgagtgggtaattgaccttttttttttttttttggaataattgctttaggatgttgtggtattttctgctgcacgactaagtgaatcagctatatgtaccatgtatcgcctcccttttgttccgtcctcccccaccctcaacttcagtcatctatgtcagcacagagcccagagccgagctccctgtgctacacagcagcctcccactagttatctatttcacacatggcagtgtatatattcctaatttcccaattcgtcacaccctgccctccgctagcccatgtttacattctttct

SEQ ID NO: 63414 - DNA, 1085 bp, Bovine  19866880611162
caaatgcatgaagctcacttaaattcaatatagagagcactggactcggagtcagggtggacaggtggataatctcagtttgtctcccagctaccaatgtaactgtgagccaatcactttattcctctgggccttggtagtttaagctgtaaaattataaatgttatggaggatgggctgcagagtttaaatgatctctgaagtcctttttagctctcaaattctgtgaatctataagcattccaaactcatgtagcacttataacatgaatattcaatctaaattctcaacattgcttctacagaatacagcaaaacagtatctaatgtcttgattaatcagccaaaactatcttccttacgaatgaagggaaagatgtttttccccgtctcatactgcagaggagtcagttatttaaacctgctctctctgacactgttcttgttgtagcaaacgccatagaaagttcccggggagggggaataaactaggaggctgggattaatatatatgcactgctgctgctgctaagtcgcttcagtcgtatacgcactcttatgtatcaaatagataaccaacaaggacctaccacatagcacagggaaccataccatgtaatgctatgtgtatgtaataacctataagagaaaaaaatctgaaaaagtatatatatataggagaaggcaatggcaccgcactccagtacttttgcctggaaaatcccatggacggaggagcctggtaggctgcagtccatggggtggctagagtcggacacgactgagcaacttcactttcatttttcactttcatgcactggagaaggaaatggcaacccacttcagtgttcttgcctggagaatcccagggacggggaagcctggtgggctgccgtttatgggatcgcacagagtcggacacgaccgaagcaacttagcagcagcatcatagaatggctatgccgcacacctgaaatttacatggtcttgtaaatcaattatgtgtgtgctgcgtgctaagttgtttcagtcatatccagctctttatgacccatgaactgtagcctgccaggctcctctgtcca

SEQ ID NO: 63415 - DNA, 1032 bp, Bovine  19866880689828
aatccttatgaggaaaagcagcttcaagtctggaaataaatgatttcaaaatgttttcttacaatgaatctaaaaataattggccccatcatgaacagatgtgagaaaaagaattgaatgccttaaaattccttttttctgtaaatgttttggaacatctataattcatgctttgagaagccagctacctaaacataatagcagtttttaaaaagatccagtgaaccataacagctggagacctgagagatgatatcctatcacaaactagaaccctattctcaacatgcactgcagatgttttttctgtctgaattacatatatgtcacccaaccctggtggctcagacagtaaagaatctgcctgcaatgcaggggacctgggttcaatccctgggtcaggaagatcccctggagaagggaatggctacccactccagtattcttgcctagagaattccatggatagaggagcctggcaggggcgttcacagggtcacaacggctgagcgactaacactttcattatttcttcagccattcccaaccccacaatagtaaaggtgctgttgaaaaccacaaagcatctctacgtattatgtgaaccgtctttgttccccactgcctcccccagaggagaatagcatatgggggacccaactgcatctgctagttctttggattgctaggatggagaagggctaagagccaagaccccatagctagactgcctggacagggacctccaggcatccccacttagtgtcaccctgggttcattacctggtttcatgtcctcatctgtaaacagcctattctatctcatagagctgaatgaggattacatgcagtccatttatagaaagaacttcgaacagtgcctgatacaatgtaaagactccatacatgtcagctataatttagtttacattttcatggacagtgattttacaaacttgggctgatgacagcccacctttagccacagtttttacgtaaggaactgggtcacaaaaaggacagctgaggagt

SEQ ID NO: 63416 - DNA, 2257 bp, Bovine  19866880744998
gctgatctcctttagaatggactggttggatctccttgcagtccaagggactctcaagagtcctttccaacaccacagttcaaaagaaagatcagaacaaatcccagcattagttacatcctctttgacttgttggctgaatttctggatttaatagctgtcattccctccaaaagcttttattcagtacttaccatgtgccataaatgctgctaaggacaggctagacgtggtccctgtgagactgtttaagggatcgaattccatttggaagaggaagtgagtttcccattgaccctttcaactgtccctctttgaccgtccttcaccttttcctttactcctcattggtttcaaataggaaaaaaactgcctcatgcttagtcactcagtcatgtctgactttttgcaacccactagactgtagcctaccaggctccactgtccatggaattctccaccaagaatactgaagtaggtagctatttgcttctccaggggatcttcctgatctggggatccaacccaggtcttctgcattgcaggtggattctttaccatctgagccaccaggtaaacaactaatacagtatattctcagcttcagacacatttccttgattcatcttcgagctgagactgggaccgtaaagacaatttgaagaatcttagaaatatttaaaatgttctttgagaactaaaaatgccttacaaatactccttttggggggaggaatgtattatattttgccattcagtatacagtatggggcctagatgatactctgattagagtatctcaactgcaaacaataccttatttgttttcttgacaacactcagagttaagagtgtggttaaatataaccaaacatagccatctttctcaggggtaggcataaagccctggtacaagggaaacataatcaattatcaagtcaggatcccttcaagaaaagcagaactgttcagagcattgttgtttagtcgctgagttgtgtctgactcttctgcgaccccatggatggatcctgggttgggaagatcccctgtagaaggaactggcaacccactcgagtatacttgcctaggaaattccatggacaagggagcctggtgggctacaaatacaaaaattgagctttgaaaataataagtagcctgccacagtactagtaagtacaagagacaggattcaaacatagattttctggttccatatttcagaccaacatctcccccactggatagtggtgcttttttgcattgtgttcttagaaaaattacttgacttttctggaccttggacttcctcattagtcaaatggcaatgttgagttcttatcatttgtaagattccttatggctccggggattggaaaaggtcattttccctttccaccccaccccctgctcctttggcatttacttgtcctctggccagctcttgatcattaaaaatgaagatgacactcaaagtaatgtctggccaagaggacaccatccgaatgttttccttctgacctctaaatcagtctgcacatctcgcctgtagaacaaaatccaagaacgaggcagagggagggactggggactttaattatatttttaaacaatggctttccattaaaattgtatttttctacacctttggaaaattacattgtagatgagataaatgcagcctcgcatttgaattaaggttatctttagactggtaatctcatttgctgtttagcaattttaattcaagtcaaggcagtgtaattagcaccctcagccaattgccattcctcactgctttgtagctgtatttactgctgttaggacaagactactcgtgtggaaagtataagtcaacatactaaattattgaaggtggcatacatcgacagatactccctgtgcatcctgatgcttcagattccgaggccttacatcatcaggcccagggaggaccagtgccttggctggccgtagcggaatgtcactattttttatacagagagaaataaactggagattttgttctatagcaaatatgccaagtttagcagtgctttaaagtatttttttttattttaattggaggctaattactttacaatattgtagtgcattttgccatatattgacatgaatcagccatgggtgtacatgtgttcatgtacaaaaataaagtatttttaattggagctgtttagcataatttaaaaatcatactttatgacagatttctttttcacactaaggtatg

SEQ ID NO: 63417 - DNA, 1102 bp, Bovine  19866880755056
gtcttcccaacccagggatcgaagccagctctcctgccttacagattctttactggctgagtcaccaaggaaagtgacctctatggtgtctttcaattctattcagtccttcagtatctgtttttctctgactgtgtctctgctaaatgtattctagtaagtgtgaaagaaagtgaaagtgaagttgctcggtcatgtccacctctttgcgatcccatggactgtagcccacgaggctcctccatccatgggattttcccagcaagagtactagagtgggttgccatttccttctccagaggatcttccccactcagggatcaaacctgggtcttctgcatcgcaagcagatacttttaccatctgagccacgagagaagctgtttgtaagatttttcttaaaccacttcatctgtcttgactcttgactcatatattattggcatgcattattcattttataagccctgataacacctaccacatgcttctgcctacattgattctcagtacaaagactgctgaaatttgcattgaagatggctagaagttaagagttgagaagacttagaaaaataagaaggaaagaatggagcaaaagtttttaacacaaagaaggcactgtaatagagaggccaatgcagtagctggtacctggtaactatactgaatctattctatgacttcacagtggaacagttttccggagctgagctagtgatagcttggccccagtgtttcccaaaatggggagccgaggtggtagacagcatccttttactataaatagccaagtgtttcatcatgtgttgaaactatttctttgtattttaacatgtgatttcccatttatagaagtaatagagttttcttactaaatttagaaaaatattcattaaattatagggtgggtaatctatggatttaacacaaatcatgaagatactatttaaactactaggttttaagaaatcccttagtttttcaaaggaagagactgacttggcagagatcacaccatgagcaactggcagaaatgggctaaatcccagatgcactacagagggtctgaggaccgggtgctatacccctgtctgtgact

SEQ ID NO: 63418 - DNA, 1182 bp, Bovine  19866880873749
gtaagaatactggcatgggtaggcattcccttctccaggagatcatcctgacccagggatcaaacccacatctgctgcattgctggcaggttctttaccactgagcccaccagggaagcctgtacctgtttatattatagcttaaaacctgtaggtgaatatctacaggtggttaaaaaacagttaagaaaattaatgagttaagcttctgtttacactattgagatgacaggtaatctttggttatttgaataaaattttcatgcattaatatagctaacatttttattaatattaattatagagattaatcataatatattgttattggtacatcagtttaatatatatgctctgtatttatatatgtgtgtatatgcatatatattatttaacttccaattcctgatatgaagagtgacttatattcaaattcaaacataattcaaactaagtttatcttttctggtacctactaatgactttaatgaagaaaatctgtattttattttgctttttgcattttagttccttgagaacagggagctttatcaatttgtattccttgtgataatcagaggacttagttgcagactcttggtaaatgtctgttgaactcagttatctgaagagatagttgactattcttgacaatagctttctaatgtatgcatgttctcctggttttataggctgtatatttaattcagcatgcctacttctttttctccactccaggaggactataagcatatttacagacagacagatctgttgcctctttgcagaaaagtatatatcacttagaactttcttagagaaatgttagcattgtaaatttgactttcatgccttaggaaaacaaatctaacagcatataatacattcatgtgaggttttggtttgtgaatcttgatgtaacaattttgaaaggtaaacttaaaggttccatttgggcaaagcctagaagttgtttatattaacaacgcaagttaaaaattataggcacgtgttaaacagagaaagtaagccagaaagagaaaaacaaatatcatatttatggggcttccctagtggctcagatggtaaagaatctgcttgcaatgcaggaaacccgggttcaatccctgggtcaggaagatccactggagaaggggatggcggcccactccagtattcttg

SEQ ID NO: 63419 - DNA, 3026 bp, Bovine  19866880916331
atatacatagtactaatttttgtgtaaattttatcttcttatcatactatttagaaatttgcttggtttttaaaatacattttaatttgggagatgattttaatttataaaaggtttcaaaaatagattcccatttatactttgtccagtttcctctaatatttacatcatatataacctgtacatttaccaaaacaaagaagttagcattagtacagtactcttaagtaagtgctgcactttatttggatttcccccagttcttccactaatgtctttctcctgatccaggatccaatgtggggcctcacattgcatttagtgcttgttttgctttatctaacagtgttctggacatcttctcatctctgtacatatagttctgccatgttgttttcaaagagtgcatacttttagtcaatttagttcacacagtataatttacttaaccctccactgagtgttgatattttttcatatgaatctgaaatagcattaacatgtgtgaggactttccatgtattccatgtttcaccttcaccacaacctgtaactttgggatgtcaaaccaaggctttttcatctgtcctacagtggttccatgtataatatatgccactttgttatttttgatgtatttttctttgacaattgatctcttcaaactttagttgtgctaattttcattccatagaagtttttactttttgaatgatcaagtttgtagatgttttcatttgtgatgtctttcattgctttaaagctgagggaattattggaataaccctgttttaatagctaagatggggacttcccaggtaactcagtggtaaagaatttagctgccagtgcaggggacatcagagacatgggttcattccctgagtctggaagatctcctagaggaagaaatggcaacctgctccagtactcttgcctggaaaattccatggacaggtgagcctgatgggctacagttcatggagtcccaaagagtcagacacaactgagtgactgaacacgcacacacgtatttggaattctatgccttacttgtggttttccagttgttgagtaaaactagcagtgatcctgaactgaccagtaaattagttttgagacagtggtgaaaaaacgaatcccctggctttatgagcacaggattataaattggggttctgtcccccaaaatttattttattccataaatccatgaattaacaaaaagtgataatttttttttttttggtctgtcttcttttttttccatttggcctggtaatagggtctgtgtatggtcattaacaccatatttggatagataagattccttgtgtccctcaatttactacaatttgtacagtctttcaggaatcacttcatgacaggtactgtcaaaatgatgagatagatgaaaaccacaaagaggaaagaaaacatacccacattagctgtgactatgtgtctaatgtccactgtcaagttgagagtaggcaagggcttaaaatcagcccaattccccatctagacaaacataaccaggcaagagcctgagagagccacctctgagttcagcttattgtcattcagcttccattcttatgcagtttcttccctgttcagtatcagtttataaaagcatgttgcatgcccactgaccccagataactaactaaatcccagtttgtagtcatagaacgaagtcccagttcgtatatgtacaaatgcctgctgaagatggatacaaggaattcaaaataaatcaaccattaaatccaaatctcttagtggaataaaactaggaaagagcagttcagttcacatactgtccgcccattcatcaacccttgtggtacattatttattctctttgctggatgtgtgttttgggaggacatttatgcagagttggttaagggtttagagtcttggaccccagaaaactgcttatacctttgtgatatatactgagaattctatgctagtcagatctcccatttggatgaggtggcaatatccagcaacttataagtcccctgataaatagttctgcaattctttttcatacatttcccacagaaatctttaaaatcatgttcacaatgagacttaaaattacttctttctcaaaaaagaggatataatccaaaaggtttataaactgcatttgatagaaacttttggcctgaaaattaaaataagttcattttaatgattggcaatcaaaaaatataaacctcattaaattctaagacgatctgatgtattaagttttgagggaaagtatacataaaccactttgtagatgcagagctaactagtgtattctagttctttcttttttagtccatcatcctgaacatattagcctccgtttcctggtaatcaaaataatggcgtggtgattgtgaagggaccgtgttgtataaagctgttctgccatttaaatgaatatttcacttcttgtttctgaaaatcaatgttgttggttggctttgaatgtgttttgaatattttaatagaactgaattctctggaggaaaaaataaaagtatatctgtggcaggaccacaattccacttcttggttgtaaaccttcttagtagcatgagttcaaaatgtattcccattgaaataaattttattttaatgtcctaacatgctgattgtggaaagactgtaggaattcaacctaagggctcagcctggcagggggagaaatgtagcctgtgttttatgttaaaaactaaaaaggataatctgttttggaagaggtgcgtgtgtgctcagtcactcagtcatgtccgactctttgtgacaccatggactgcagcctgccagacttctccgtccgtgggatttcccaggtaagaatactggagtgtgctgtcatttcctcctctaagcagtcttcccacccaggcgtcgaacccgagtctcctgcattgacaggcggattctttaccactgacctacctgggaagacatattagtactaactgagtatagcatataagaggggacca

SEQ ID NO: 63420 - DNA, 1057 bp, Bovine  19866880929743
agaatcccatgaacagaggaacctggcagctcatacagtccttggggttgcaaagagtcagacatgactgagcacctgagcactagtacgacaaccattttaaagtgtgcaattcagtattgccttttaatcctgagttaagcttctctcctaaagtgacaattggctagtcttttacaaagctattaactggttctattgagctgacattacaataatattcctgggtaaaacatttacatttaaataagggtattgataccttaactcaaagaactaactccattcttccctgactccctgtcatttataggatgagggtgaaatttattagtgatacacagaaaatcttcttagactggcccctgctcattcaaccttccttagctttctctcttatgtcatgagccccagatgtgctcaaatatttgcacttcccctggtgagccacgttctttcatgcttttctgtgtatttctttttcctgtttggtggatgcctgtgtatctttccttgagatgaagtccaaacattaagatgcctgtgaaaccttctccattttccccaggcagagttgagaggtggtactcttcattcattttctgcctctctctctcccattctctaggcaactttacataaccttcaccatgctgatttgtaaccttcagttcctttgttgttcctaataagactgtgaatgttttcagcataaggattgtttacatctccactgttcaatgatcttgaaatagagtagatgctcaaaagcagttactaaatgcaggaaaaaaaaaaaaaaaaaaactaatgctatttaaggatctctggcagactggttaaaaactttttttggtggaatgtacctttgggcaccgttcatgtggatatctactctaaagctatagctgatgagcaatatttgtcttgaaatcattgtaggagtaagaagccagaatgctgatacctctggaaatttttgaaactccctagagaatgatgcaaactattaattagatacatatcatgacaatatgtattttataggattaataaa

SEQ ID NO: 63421 - DNA, 2671 bp, Bovine  19866880951339
ccttgtgtttcccaatactggttatataattgcccattatttccccgattgtgttttttttttttggtgggggggaaatctaacatccaatgagttctctttgttagatattttcctggaattctgagggtaacagttgcttttctcaaaatgaaaacaattcatccattgtgctagttgcttagcctgcattttggagaaagaacttttgctcagataccattcataaatggctgcctcagaattctgaatagtttctcacgatcaaaaagtactaacgacattttgtgcaagtgattttcttgccctgtaaagtccaagtatcaatccacaaagagagcactgaagctactttttcttcagcctatcttggtgaacttcagttcagtatgaaatgcttgttttcatcagaagttttcctagaaggaagaagttaattgaggttttcattttcacatgattgcttgtcagtttttaggcacaattccttagattattaagataacaataacttattttccacagtagctttcaaaggagtcaactcttggttgttcaaagaaatttactgttttgcagaactttaatggactctcagctgttacagtggtgtacttgaagctgtacttgtgattgcttttcattctggagtaacatggtgggtggtcaggatttcaaaagagctgatctctcctgggcattgaatggaatttggtacatgggtagagattatgaagatcagagtatttaataaagaaaatataattgctttacaacagggtttctcaacctcctcctgaggaacattttaggctcataattctttgttgtgggcactgtcctgttcgctgtagcatgtttagctgcatacttgacatcccatcagatgtcaatggtaccatgcacccaaattgtgacaaccaaaaatggtactgaaacttccaaagattcactagggcacaaaattcttcctagttgaagtcacttctctttaatatatatatctcataaaatttaaattatgtgtactcaatgccctgtacctcattggttaatttgtaagaaacattatttgatatgaagaagtgacaagataagagaagaaatagatgacattctatttctttattgaagttatctctgaaattgcaattactcaaaactcaccagtttctcttataagtaatttggtgaaaactcctggtccccaaatgattcccctgtgatctttaatggtccctaaaatctcattatttaaagaatgtcttaatattctgaaaggtcttccaggaggggatacttaactgttattcaaatagaagtatttaattaggatggtctcactgatttctttttaacccaggcaaagctgaaactaaggctctgaggaaggaggacaggggcaggtgttggagaagaaggaaggtcgataataaattgggagatatgtgcacaatgaagagaaaggtagatgctaaactccacccttattaccagtaacgttctggactagttattacatgagactgactacaggacagacatctcacatgctcagtgcttattggctaaatgcttattaattgagagttaaattggggttggaatttcttcaattgacctgatctcctttggtacctcctggtctacctttgcagtatgactttctaataattcctttaaaagaaaagaaatatgtcaaacgtttctgcatttaacaactttccttggagccctgacatacctcaaacttgcttcctcagagctttaacttttaccatttgctcaaccaggagtgtcttcccatttctctgcctagtcatctctttctttatcatctcttgctttatttctaaatgaaaagatcagaagaatgcaagatacattacaagcagttaaggggaaatatgtgttgtgaatctagtgccacattgtaagtcacattcaaggtgagctcagtacacaaaggcaggaagaacgccaccattcctaggtcaccatcactggccttgaacagactcaactccccaaggtttgtagatactggttacagaaaccccaagacctagctgctcaaagtgtcgcccctggaccaacagcatctgtttttcttgggatcttgttgacaatgcagaatctcaggctccacgcctgacctcagtctgcattttaacagtattcccgagtcccatgactttcaagtttgtggagttctagcataagagacatcgttttcgtcactagaagtccaaagcactatccgttgtgccacagagccacctagagaaatcgttttctagtgtgtgtctccatgagatgctttctggaaaaataggagtatggcctcaaatgcatattgggaatctacttatagccactttttagagatccacaaggctcatggccactgagaaaggcactttggaaatcccaaattataatatcaagccttgggggctgatgagacgctacaatcccagacattttgcaattcagatttggttagaaaacaattgaagggactgacatgacggaagtaatgtttggggtgattagtttgaatggaccttattacttttaatgctaaaatatggataaattttcaaatgtcatagcagtcagtttgctcagtgctattaacttccaaattacctgtcaaaggcagtccaga

SEQ ID NO: 63422 - DNA, 1767 bp, Bovine  19866880956304
tttaaggcccaatattgagaataaaagaaccaagatccctggagttgaaattcaggaacctatcacctataggaccatcccattcctgctggccttactgagaattgccaaagaattgtccctcacacaaaccacccctccacctccctgctcggcataactgtgactgggggaaaaggaaggatcatttttggaaattgtaattttcattaaagtggttctttgcttcattcatcccatcttgtggaagatggaagaatatgtatccctactctgaaagcaagagaacaacccagaaatactgggagactgcaacaagtatagatttatactttattccatatatatatgtggaatatatatatatacatacatacacacatatacatacacacatatacacatacatatacatgcaggaaaccctggttctattccttggtcaggaaaatcccctggagaagggatagactacccacttcagtattcatgggcttccctggtgcttcagacagcaaagaatccagctgcaatggtggaagacctgggttcgatccctgggttgggatgccatgggaaggaagccatgccctggaggagggcatggcaacccactccagtattcttgtctgaagaatccccatggacagaggagccctgtcgggctacagtccatggggggttgcaaagagttggacacgactgagtgactaagcccaatcacatatatataaaacatacttagccagtggactagctgaccagcacttgtaccagcagaatgaggaaactggaattggagacggaagacatgatggggagttgcaaataaagaagtgcagatcttctttctcttccctcgatttcctcattctggtgaagcaggaacatcagacctgcttcaagggttaagatgcgtgctcccaaccagaggctacaggcaaagggattactgcaatcaaggagctgttcaaagaagcacccctcatcagcagcatgtgtggcatccatcttctgtctgtgttggctctatagacagtgagtccacacagactgagattcagccaggtcaagagaggagactgttctgtttctacttcaatttctgcagtccaccagcaccagtattaaaaagagacatgttttgttgaaagctagaccaagatgcccttttccctttccccttaagcctcaactgccatggggagagatgactctctctgaagcaaatagaagattgaaactcaaagtttttactttagagtgaatgaaggagactgaaaaagtatcaactctgatgaattttgttacaagagttattgcaaagcaggatagggggattcatcatatcagattctgggcagctttaggcaaaactgaaaaccatcatatttacatgtcacatcagaatagcttggtggctcagctggtaaaaaacacatctgctaatgcaggagaagcaagagatgcaggtttgatccctaagttgggaagatccactggagaaagaaatggcaccattccagtattctttcctagaaaatcccagggacagaggaacatgacaggcctgcagtccatggggtagcagagttggacatgtctgagcatgcatgcatgcacttacatctctaaaaaataactttcatatcacatgttttcaagctccctttaggtcataaccacactcagtctcaaaatacatttccttgctcagtttattcctggaacctggctcccagcattgtggaaacccacaccttgata

SEQ ID NO: 63423 - DNA, 2425 bp, Bovine  19866880966343
tttatttatgtttctatcaaggtaatagataaaacggtgcaccagacggtcatatatgttgagaaaaaaatgagaaagagcagattccttcatggcagtgaacaatattcaaataacatgcagatacccatgtgatgtggttggcttctgttggcattgagctatttttagtatataaatttaaaaatttattggactatgcttggtctttgttgctgtacacaggctttctctagttgcagtcagcaagggctactctctagttgtgttgtgtgtcttctcattctggtgacttctcatggagcacaggctctagggcacacaggtttcagtagttgtggcacatgggctgagttgccccgggaggcatgtgggattgtcccagattagggattgaacccatgtcccctggaatggcaggcagattcataaccactggatcaccaaggaagtcctggcattgagcttttgattcttgccctaagttttaagatattcatgaggctagagtgccaactaagaagaccttatggagagaatggagttgggtatttcatattcaaagcattcttttccatcagaagaccccctccacctccaccatactctattccatccccaaaataacacaataagagttgggaatttcctagtttgaacactaagagagaaagtttgggattgcctactgacttttgcctgtttgtacctacaatttttgaaacaaaagttgaactatttccttccagtgttcattctaaatgaggtaaatggaaagtccttatattatctaaacaatgaatggaaaaccgaagggctctcccaagtagttttttttttactaaactttcctaaaaatctatgaattctaggttacaagggtaaatatcaatagaagacaggctggttagatggctacttggaagtatcgacaggaaattaaatttgcaaaacagaagtaaaagccatggtagaatttttgtatgcagggacaaaaggaaggaaattgatattgagatttttgtagcattcttctctggtgatatcgaattgaagagcacacagtgtcatttatcaaaaggtcaaacctaagatgacttagcggaatgttctaagaccaaaaatcatgtgagagacccaaatctcaaagatacagaggcctaggcaaatgagatatctccaagataggtatctcagcatgtttatttatttatttgcaatttttagagatgatgcccacagagttttactatgtaaagtcattctggaatatcagcacccttttctaagtaaatatgataaatgtttactgaaataaattattgattttattcacaagttctgtaatattaataataaatacacttggggtatgaatgggatagccaacagtataagaaataaattatgtctctgcattctgaactaacaagaatgggtgcatgtaagaattttggggggaaatttccttttgttttttgatggtaatatctttgaccacctgatacaaagaaaccactcattggaaaagactctgatgctgggaaagattgaagtcaggaggagaagaggatgacagaggatgagatggttgaatggcatcactgactcaatggacatgaatttgagtaagctctgggagatggcgaaggacagggaatcctggtgtgctgcagtccatggagttgcatatcagttggacattactgagtgactgaacaataaaaatatgttgataaatattctggcagctgcagatttaataaagaagtgaagaggtagtatagaaagagggcagttcaaaagacactttaaatttattttaaaaaatgaataatagccgtacatgtatttgggtatttattttaggaaagaaaaggactggaaacagctacaaatttgagatgaaatgatggaatgtatagacctcttatgggggagacaagaagtcctctgtcctaccaccaaacacctctgaaaccttataaagggaaggtgggaggtgaggtgtctttgagattatttcaggctcagccattctctgcagtgatcactttgttcagatatgtatttgcagagctgccttgatgaaagtgaaaaaggagagtgaaaaagttggcttaaagctcaacattcagaaaacgaagatgatggcattcagtcccctcacttcatggcaaatagatggggaaacagtggaaacattggctgactttattttgggggggttcaaaaatcactgcagatggtgactgcagccatgatattaaaagatgcatactccttggaagggaaattatgaccaacctagacagcatattaaaatgcagagacgttactttgtcaacaaaggttcatctagtcaaagctatggtttttccagtggtcatgtatggatgtgagagtggactataaagaaagctaa

SEQ ID NO: 63424 - DNA, 1827 bp, Bovine  19866880968915
aatttctctctggtgccctccccacccttacccttatacctctttaccttgggcatttttttgtttttcggtgcccttgttctgcttgaccacatagataaggtttaaaataactcattaactttaacatgctaccagcccaaagagtttcgaaggttttctaaaagaagggcattctggccaagttgatgagcgttgggggctaggagaggactcaagatacttgctgatttattcttcactcattcatttaacaaatgtctgtcaagggctggtcatgggcctggcactatgctatgtactgagtgtagagatgaaagctctagttgtggcctcagtgggctagaagtcaagtaaggagcagacgtgcaaatagcagagcacagtgagagcacagctatacgacaatgtaagagatgggcacggagggctgcagccgaatcttgaagggcaaatatggaagggacaaagacaatctgagtagaggaaccagtgcatggaaggtaaagaggaaggagaacacagggggcactcaaggaactggattcaactggatgggctatagggccaacgctggagagataatttgggtggagggattggcgagagctgaaatctgagggcctagaggactctgccagcctcgtgaaggactttggacttcattgtaatgaagagtcattagaaagtttgctgtatgtggtagcagtgtgaaagactgagtaaaagattctttggcctagatgagactatggaaagagaaaaccagcttagagactagtacagtcagctaagtagaagctgaagagtgtttgaaccagggcaatggcagtggtgtgggagtggagggtatagatacgggagatttgggggtggggggcacaggggagacttggagtctggctaaggtgaaaggaggagaaggacgtatcatttgatttagcctcctgcctttcgataagcaagatatcgcataattttacaggtgagaaactgaggtttcgctgtaagtgatttccctaaagccatatctattaagtagggcttccctggtggttcagatggtaaagaatctgcctgcaatgcaggacccctgggttcaattcctgggtcgggaagatcccctggggtagatttccagcccactccagtagtcttctctggagaatcccatgggtgataggtctttggggctctgggtcacagctgtgtacagaagagagagagaatcagtggtgtttctgtagttaactgtagggagcaggactagacagaagctaggggttggaattccaagttcctctgaacagtttgtctggaggaacaagcaaagtcagagaagcacaaaagaaacaaaaagtacttgaattttctcattttcattaaggatgctcctgaaaagtcattcttgggagctctgtcggagtcacgagccctgccagaatgttctatttccttgcatgtataattcaatgtcatattgttagagcaagggacctgctccttctcacttcctatgttagactaggtttctttaccaaaatcttcactgtgtttttttattgtgggtaaaaggcaatatgtttatgaatttttaatattcctgtcaagatcttacaagaagatattactttgcaaggtatatagggatgctagcagttgggtggaaagtggatcataatctcaaaatagtaaatgctagctcagtggctttcccacagagaagtaatgtatctcagtaagacaagagagcatttgtagaagagggtttatttgcagctttccacttgttcccttctcctgcaccaacccaatctcctgggctct

SEQ ID NO: 63425 - DNA, 1161 bp, Bovine  19866881081626
ttgctaacgtcaaactgatgattacctattgcatcgattcactgaaaccaaccagcctacttgattattcaagccaaaatgagactttttttcctcttcagaaaatctctttgtcctaaagaaactcttatttcctgatgggccattcatttttgtttgtgactgactgatcacagtctttgtcacccattgtgctaatgacagttgggcatctcttgcctcctagaactagctcagagatttctaagctaaggtccttgtcatccacacagtgggtgcacatcctgagtaagccctgctgaatcaaaggctgctattcacttctgtcctctcttccatgtgctgatctaactacatgatgtttctaattgggtccaaacacaggacatttcatagactaactatagtactactgcaggatcagacatttaccatccccacatcattctgtacctttttatcctctaaggcctcccacgctgccccacgcccccaacctcaccgcccccaccccaccccctccatttcctgaaaatgtagttgttacaagtagatcatctgggcgtgggtcatgcactgttacaaaagcagttaaaaaaagatagtgacactgctctccctgctagaaattagccaggtgcaccattatgtaaggagctcaagctagagagcacagtaattaaaataacaatgaaatgatagcttatgcaacactccacaaatatgatattttcatttgtagtattgtacaaaccaagcatatcaggcagagatgttctgtgatttgcagaaggccaagggaaagtgaatgaggacactggaatagagttcttctgcctccctctcttgctatgccagtcaaaggcctgttatgcacaagagggtgttgtggcacatgaacatgtatggctgatgtctgtctcctaggatgctacaagtcaatgacatttacagcatgtggtcttgaaaaggaaaggggaggtagaaaaattgcccactggcagtagtgttgaatacagagtttccattttgtaggttcccttgtgattttttaaaagttcattcagaaatggtcagataggatggacaaaatctgatcaccaagctcataggggatgattattaaatgaggttcatattttatttaaatacttacaataa

SEQ ID NO: 63426 - DNA, 682 bp, Bovine  19866881152537
ttttcatttttccgaggtgctcttaaaggtatatacctagacttacctgtttaatcaggttatttgtagttgactgatgaaatggttggttcagaagaggaaccactgacatttggtttaattgccttggaacaggtatgtcccaggtgcttccatgatgggcatcttggataaagctaataaataaattgagtatgcagtgtaaatcaaatgccagctccagattttttccacatggcccaacatgtctaatgaaagcatctactctctgggacatgtggagatccaaaaggtatgcctggggtttacagaaaatgctgagggaaatcattcacagctctgatttagtttaaatgttcaatctgctttaagagctactctaaggcagtatttatctcttaaatgaaaacagcagactctcaaaaggcaaactttgtaccacaggtcaaaagacttcaattagaatttcggttgtaccacattgtgtgaccttgaacaagtcacataccttctctgcctcagtttgttaataatgggaataatcagcactgttaattttaccctcttcatgtggtttttgagtagtgagataatacaggtggcatttctgagaacaatatagtactgcataagtctaaggaatgatttattaacatgtaacagcaccacgtgggcttccctg

SEQ ID NO: 63427 - DNA, 731 bp, Bovine  19866881173355
acaacaaattgtctaagtactcagcgtgtctgtttcagaggatcactctccatttgtgtcttagcctctttttcacccagtctgctgagcagaggctcatccttcagttggttagtaagttcttgtcaagatggatggacttttagacttattctgaagtgctgcctctctccatctgctttggaaacagctcacaaattcttcttcttgtttcagatgtgatcatcgatctcctgccagaggaaattaagaactgttctttgtttgttgggtagaagaggttctggagttctgacccctaatttgtttctcattctttgtgctttgcctgtagcatctgactcagtatttgcagtcttctttcatttcttgaaactcgtggtcttaaatttgtttgatcccacgaccattccatttgggcagatttatcaacaaacaaacaaatacaaccactctgtagcctagctcttgtctgccatcttccaagcactgttatatccctggagggtgtgtctgacctgccacaggttggatacttgatgacgtgcccaggggatgtgccatgtctcttggtggggagggggttgtaattgactggctctcttcccacttccagtggtgggggaatatgtttctagaacataggctattgttccctagaaatgaagagaagttactaaatctgtatcacagccagtttatgcagtgaaacaacaaggtttctttcagta

SEQ ID NO: 63428 - DNA, 1067 bp, Bovine  19866881187243
ttcattttttttttaatgtgtcagccctgtggcagatacaaagataaaatggcatggtagattctttgacatgctcacatataaaaatgaataaaagaaacaatataagttcaaaactgatgtaatatggaaaaattcagaaacctaccaagtaaatatttaccatggttaaacagaatggaagggactctcaaacaagaaaatgtgacttgaattgaaagagtttggtgattccatgtagtggaggagtaggggagatggcacaagagaaaacatattaagatgattccccaggcatgactggaggtgaggacgtcttggaggcagtctggctggtgggaacagaaatactcccagggaagtattaatgggataaaatacagatgctgggaaaagtgcatgtagagatgaagtggaagaagtattttagaaccaaccagtgatatctttgactatgtttgtttactgaagagcatatttaaaataatttgtagtatataatgaatttgttaaatttatgcagattaactgcaaccaaggatagctgtggactttatttttataagcatataattgttgttcattcgtgtctttaactctttgcaacctcatggactgcagtatgccaggctcctctgtcctccactatctcccagagtttgctcaaattcacgtccattgagtggatcggtgatactatctaaccatctcatcctctgcatatgatagtggacttttaaaaaatctgtcttttctaaatataaaaggctatacattctaaatcctgataattgtggcagagtttattgcttatgaatgtgtgtatacatgcactggtaggctctgatgaatgataaaatgcaaaatcaccagtggtgggtaatattaatgttaagttctgtgtttactatgactgtagttaatcaatatcttatttctgcaaacacgtttcacagactggctctgacacagtaggtaatctatactctaggaaaagctatagctcttctgacagtgctctgcattttctagttacttttttaaaggtgtaacaggtttcagagaag

SEQ ID NO: 63429 - DNA, 1282 bp, Bovine  19866881192066
actagacattgagtatactagtagtaagtgtattattctgttcccagttctgtgtctacagatgtgaacacccagaaggacagagaccaggtctcattaatactttcatcaatatggtgagcataaacgtttgttgaaaggattcacaaatgaaaatgcttactgttttgatcttagtggctcactagattatcctccaataatttcttcttagcctcctgcactgtggccatatcaatttccccagaggagatatgacactccttcataaacattctattgtgttccaaagggcatccattatcttctcagttaggttaaccctttttggatgtctgtgttccagtgttatacaaagactctgtatgatttaaagtattatcaacggatgcacatcaaaatccagacttcaaaggagaacataacatcctcattaagtacaaagaatatttgtcaggccatgctgtgtttcttgaaaagcaattaacgtattgcacattattcctgtgagaggcaaaatgtatctttctcatcttaatttgcgtacttaaaagtagacagaaaaagatagatgagtttacactcaaggtgtatgcatttccctcgtggccaatgaaccaatttccttttcatatttgcagaatattgatacaattattctttcatcagacatgaaatctgagtgtataaccggtttgtggaaatcacctagtaatttattaggttgataacagcaattaagtcataattgcttctgagaaatataaattgactttctgtgttaagtggataatttaacattccaaatcacagacatagagtgtaactaatttgagggataagatgtttgtttttcctattattaaacttagaaaaatttaaaccattgacaatccagtaactaattatttggttgctggattattgggttcatgtcacttcttgattcttttctcaggttgcttgccatttttactatttaaggatatatggaggagaggattttagacagaaacataacatgtggataagccctagtttttttttaaattatttaaaaacattgttcttgtaagtgattaaagtgaaagttgctcagtcatatccagatctttgcgatccagtgggctgtagcctgctaggctcctctgtctgtggaattctcaatctgttaattggcaaatatttatcaactacttatgtgcaaagcattcagctgggtgtagtagaagatacaaaaatgtgggggaaaaacgtcctaattggtggtctcttcctaacc

SEQ ID NO: 63430 - DNA, 1135 bp, Bovine  19866881305079
tttcacagttctcctcttttccttctgacctctggcaccagaccttcccatggctaacccatcatcagagagggcagcacaactgcccgcctgcccactgagcaatctgtgctctgggcagaagctctgagggaggctgatgctgatcaaatgcccaaggctggccctgagccacacgtcagctcaccacactgtcttaggggctgcagatggagacaggggagatggaggatgctatgcgctgcccagacaagctaataagcagggcccagggcccagggtgcttgccctcagtcagcctcagtggattctcctcatctgctccttaatttaaccaggcagaatcaaaggacccaatctctgagttaaatagggcttaaaagaaccccacacatttgaacatctccagtggtaagggatttgtgaataatgatattaagtagatgattattaccaagtgccgggcacacactgtctcctttaatctgccaaacaacacttctggttgggctgtcgtttccctgttctgcacatgtgggaggtgtgaagtggtttgggagatgctaagtcatatcctgacagtctgaccccagagctcagtgaggagaactctgcaccatgttgcctcttagggccttccagaacagctcatgttccctttaaaggaaacctctttcttacactgacacaatctatcttcttataacagccccctcagccctgactttgcttgtatttgatcatttctaccattgataaagacagcccatccaatcaattgtaatatttttaagataaaggacaattagaccagaaaacagtaaaccatgcgactgtgcctttgttctgatacattctttgttgccagtttgaagcagctcaatatgttttcctctcttccactttgccctttcatttttctccagcagcacattaacagaagccagaacttttgacaattgtgcagctaatttctaaatgattgaaataatttattattattccagtcaaggaaagtttctataggagccaggacagctgctaacagtgcccatagaatgagtattatttcattacacaaaagcctgacattcagtggaaatcaccctccaggaaagtacgggggtggggaata

SEQ ID NO: 63431 - DNA, 1923 bp, Bovine  19866881327073
gtcgtcactaattggagataaagacatagaacagagatgtcctcgtgctgggaccttgaatcaagctctgctgagactcttatgtagacaagctgtcttggcagggatcttgtgggtctctgctggagatgtttatctttgccctgatattcctgtaaggagcagctgaagattaatgatgggcatctcaggtggcccagtggtaaagaatccacatgccaacacaggagatgcaagagactcaagttcgatccgtaatcgggaagatcccctggagaaggaaatggcaacccactccagtattctggcctagaaaattccatggacagatgtgcctggtgggctacagtccatgggaccacagagagtcggacatagccgaacacatgtatgtgcacatacacacacacaaatacacacaaaaagattaaccctgctctgggttgagatttaatacacaaagaaaaaatactagatttccttcttgtgttgcctactttgttaaggaagactatgaatttgcttcactgaaatatgatctactttaattaaagccagtggcattgagtaaattagaaggtaattgcattttctgtgaatttcacacagcttacattttagcaaaaggaaccaagtttcagttaatgcctgtgtgctgctacctgcaatcaaggccttaataaactaaacaaatcatgtctttatgcaagttaaggaagcataaatacaaagccaattcatatattttctaattgctgccatttgcgaaggcagagtttggaaaagtttacttaaaaggaaagctttctttcaagacaaactatctcaggaaggctgggtttcctccatttcaataatgaattgtcctagaaagtttcttccctgacacatgactatttccatttattttgaatgagataatacaatttcaagacagtggtaaaaggaaattcctaaatttgggatttggtcagtaaaataatatcagttttgaaataaggtattttaaaataaggaacaacaaaaaaacaactcttgtataatatgtaactattaagagagagggaaaggaacctgtcttattgggacctgtcttaacttctgtgtgtatcctgcttttccatttatgagctggataacaacctcgctgtatatcacctttcctcaaaaaaatgagaacagataaaaagcatagcaaccctgtagggttactgctagtattagacactataaaaataggcatgcctgccaagttgcttcagttgtgtccaaccctttgcagtcctatggactgtagcctgctggactcttctgtccatgggattctccaggcaagaatactggagtgggttgctgtgcccttctctaggggatcttccccgacccagggattgaacaacctgtgtctctcgcatctcctgtattggcaggcaggttctttaccaccagtgccacatgggaagtccataaaaacaggcaaataatggtaaatacaatcattttttgtttgttttcagagtcagaaacaagataacagacatgcactgatacagcacatgaattgtggggttatacctgaattccatgacgtatgaggttatgaactgaagtctcatttgaaatctcaccttcaacttacttcttgggaaagtgagactaactacctacgtgaagaagtagatacttctttgcttactcgatcccctcagcagagccctcagactcactggtttctaaggctccagatggtaccctcacctccagtaaattggcctggaaaagctacctgtgacttcacagggggtttgggccaggaagctttctacaaatcactctctttcatcttgctctcatgtgttcaattaacttaataattttttatagtctttaaggaagaaaacagggtcttaaaaatctttcaaa

SEQ ID NO: 63432 - DNA, 1079 bp, Bovine  19866881366030
atccatctgcaggcactgttgctcatgagagctgtctgaacatgaaaaaaccccctaaaagttctaaggagattagacataatatctctaggatgaaaaaaaaaatgagagtgaacttccttccctggcttcctccctggtctctataacccatctaagagctatttcactctcacttcaaactaatctaggactttttaataaattgcttgaaaaattacttatacctccgatgcacaaagttcttgtaataatggacacaggaaataagagatggttctggtgactattaagtgggtggttttatttttattttcccctgttcacacctctacgttattgaataaagaagtgaagaaatcatgaacgtaaaaggaacataagataaagcaacagctgaagggaccattagagagatgatgaactgaacagcacatttgttggagggcatttagtaaacagtggtatgaaaaaatattggaaaagaggtcagagatggaggcataaaccatcaggtgagcatcacttcccaggtggctcagtggtaaagaatctgcctgccaagcaagagactcaagtttgatccctgaatctctcaggaaggttccctggagaaggaaatggcaacccactccagtcttcctgccgggaaaataccatggacagaggagcctggcaggctacagtccatggggttgcaaagagtcggacacaatatagcgactaaacaaccacaaaagcattgctttgcagggcctgagagaatctggaacaggagccatagaatctggaataattaatgcaccagctaagtgggaaggaaaaatggaatggtgatttcaggagagaggtcaaacactcctcccagaaacaagctataaaagatcaaagaaaactagggtgaagaaggtaggatggaaatgttataaaagggtgaaattgtgactccaggacaagaaattagactgaatacagaatacatgttgttgaggataaaatccaaagaatgtatgtactttagttcctggacgcctgccacttgtgttttttcaactaggaaaattgctctcaagattagt

SEQ ID NO: 63433 - DNA, 1217 bp, Bovine  19866881409615
caggaacgcttccaagagctttgtggagggacttgttactgtcctggacctgagcaatctcttcttcttgatttgttctgactctttttaatctgagttctattgttctaagttaggctacttcttactcatccaaatagatttgattctatccacagttgatccataatcctgagatattctgccttaaccacacagtcttcattaatggtattactattgttcttcatatctttctcatttatttactcactcattctgaaaatatttatataatactttatcagacttgtgctcagcacctttaacagtttgaactaaatcatttctgttgtaggaaactgttctgtgcgtggtagaatgtgtagcaacatcccatgcttacccactagttgtccataacacccctgcctccctctgtgacactcaaaaatgtctctagtcactgttgagtccctgggggacagaatcacccgtggttgaaaactactacattttgtccatcactttgttaggtactatggatcctggagtaaacaaaatctcaaaatagtacaaatgaatggattataaaaagttgatgtaagaaagtctccttggttactgagcatcgtgtgctacctgagatgaatacttgtgtagaatcttctgcatgctgagaggctatgacaggtccagcaggctatagatagtagcacaaggtcctttctaagttcagttctccctagaagatccttctagtccaccctgaaaacacttctttctctgaaatcattcatccattcatctaaaaagtatttattgattgtccacttggtcccaagcatgttattatggctgtcttttttttcttactttgattcattctatctgtagcctccatcactagctactagccactgttggatgagagtaaaagctattcatttatagtaccatgctgctccctggagcaattctctttcactgccatgtgcccactccatatgggattcacaagaggtctagaaattcatgatccaattaaacaagagcttaattagtgcctactctttgtgaggcacacaaaggaaaataacgggatgcattttctcttgaccagaagccattttgaaagttggtacatcttgtttcagaagcactaggagcattttcccagcagttgcaagtctacaagagagtatactgttcatggcggttgccacaaagactcactc

SEQ ID NO: 63434 - DNA, 615 bp, Bovine  19866881574004
taaaaaatatgcaatgcaaacaagcataataaaaataaaactcccaaagcaatgagcatattttagggggaaggttattaaagtacgcaaaagaaggttctactaaatattaagaaggtatatttttttaaagaccacagaaaacaaaacaatttcagtggatgtattttataaccatattaagagaacaatcatttgagtatatttattccaatgcaaacagaagaaagagaaagtgactgaaaaggaccagattttcatagaaagttaaaccttaaaaaggcataagggtagattggaatcagatgctctaagtatttcaactatgtagattctgcattcatcagtcactcaacaaactcagacacaaacaacctggttctgtgccttgaaattttgtttaataaaacactaacagaaataataaattctatgtttaataagtctcattagcttgctaaaactccattcattctgtgttcaaaatcctgtgatataactaagagctcaggctgggccctctggtttttcactgttccaggtaatatgattacatcggacctttagtcctctccacctatcaatgccaatcttcttgaactgctccatgacatc

SEQ ID NO: 63435 - DNA, 1713 bp, Bovine  19866881688747
ggactccctccaaatctactgaatcagaaattctgtacgatgaggcccaatccatctgcattttagtaagtcctccaggtcattctgatgcttgctaaagtttgagaattaccaagttagggggatgtcctcaaattacctagaatatgaatgttctagatctgtaaagtaagaaaagcaagttgtaagccaataaataacatttacagtaaacaaaacttgtgtatgtgtgtgcagaataaaagacgtggtagattatttgccaaactcttaaaataaataaaacttataatggtggcatgaagatagatggataaagggtattgggggcaggggagagagatagagaaagatagagggaggaagggggagaggtatggagagaaagagagagacagagaggaatatagacacagtatatataggacaagcttactaactgctttctcatactctggttttacctaacgccaaatttgcattccttttgaatcctttattcttttgtgagtcttagcagtttatttttcttctagaagcctcatgctaagatctcaaaagcactgcctatgagtgtgtgcataaaaatgaacaagatataggtgtacttaatatgtgttataattctccaaagaccatggaaaggtctgctcactaagtggctgtcaatcaagattaaggataatatgtgctggtttctgcatttccaaagaaaggcaggccatgggttgacagcagtttgccaggaggacccatttcacaaagatttttcttttcttctttgggcaaagtataaagaagttaactgagcttaaattagcctccttaatggagtcagacctgacttatccataaagtcttaaccaagttaagtcgtgaagaagtaatttgcattcaaagctttgatgttatagttcccagggaggtttgagcatttccaaagttaagtttgggcagagaaaatccctgtgagtcttggagcggcacataggatcacccaatcctccagcacactgacactatatggatgtcccaagtctctgcctgctcaaccagctctcacacattgactctgggtgttcattcaggcctgcaaagatttaagtacccttctgtaggaattgagaggtgtctcttatgggaatcagaacaaggtgacaaagggaagtcagcagagcatacctaaagcagattctgttcctgtaaaaaagaaggtgattgttaaaagcgctgaaaagcaggaggagggcttccctggtggctcagtggtaaagagtcctcctaccactgcaggagacactggctagatccctgatctgcaaagatccccttagttgcctttgagcaactaagcctatgctctagagcccaggatccacaactactgagcccacatgctgcaactactgaagcccgcacaccctagagaccctgctcaacaagagaagccactgcaatgagaagcccgttcactgcaaccagaaaagtagcccctgctctccacaactaaagaaaagccagtgcagcaatgaagacccagcacaaccaaaaataaataaaaaaaagtatatgttaaaaaaggaaaggggagaggaaagaggaagcgagatcaactagtaggtctgtgtggggtgtcctggcagagatggggtacatactagattaggggctctagcacttagcgaggaagtgaggggaagctcccacttatca

SEQ ID NO: 63436 - DNA, 1045 bp, Bovine  19866881863707
agatgtggtaatccatacttccctgtatactcttcgctttggtgaggaaaggtggtaagtagatatgtctggacctcgtgccttgtgatgctgaactgcttgcttcaattacacagacaaaaacactgtgtgttgctctagattattcattgaaaattaatccacagctacaatttcttaaacaattgcacaattaaagtttttttgcataatgatagcagagactcaggtggcataaaggaatgactttgtggtatcatcagtattaaagtgtggcaggtaattttttattttatttttatgaataattaaagttctatatttttacaaaatatttgagttaacttttttcaaacttcttgaatcacctaagtgaatccctggggacagtgtgtaaaccacaaatgtaatacacatatgaaaagtgcatgtggccatatatacttactgtaagtgccttatagtagattgtcatagcttttgctatagaatgtcatttaatgtaaagggagttccagatggaacctatttgtgaagggttgaggtctgacatgagacctcaaaattgtcatttccaaccagcttccaaccataccccaccaaggcttcagcatacagaagaacataaggaacatgtagagtgatatccagggcctggggagctctgaaaagagtgggctttacactgctttttaatagtgcaaaagaaatatatgttcattaaaaaacaaaaaaagatggaagacaaaaatgtattcacaagctcaccctctaaagataatcatcattgataattttgtacgtgtctttccaatgtttttaaacttatatgagtgatatatttatacatacagagacatacatatgttttgcctggagttttaaaagtggactctttgtaaatggtgatttgtaatctattttctttacctaatatattaggactacattaccataacaataaacattctcaaaccttatgttgactgactgcatagtattttatcatataaatatgcaatatttcatttagaagcaattcatt

SEQ ID NO: 63437 - DNA, 863 bp, Bovine  19866882213124
ccccattaataatgaaggaggtgaagatggtgcaaggacttaccttgcttagatcagggcagaggttgaaatcacttgtagctgggtgactcttgaaatgtttctcagtctctgttccggttcttagcccggaaacttaaagccttgcagccacttcactgtcatacaaggttcaacagaggaatgagagcattcacttgaaaaaggctttatgagctgtaaaattctatggaactctgagagacacttacagctgtgggactctggcacccagatccgcagctttgtgtcacgttcctgcttcccttttaccccaggaacagatgggaaactcgcgtccttctgacttattttgacctcatggagtagaaaggaggcttctgtgagcttatagacacctctctgggagaagaagggtggtgtggaccagactgtttagaaagcacagttgttatttatgtttccttatctctccctcagtcaccctgctgtgattttaaggagggttggggaggcagagctgaacccctgtggtgaagagtaatgagtttccctaactctatctgtgaaccagctctttggaaagctaacctcctcccgaggcactcactgctaattaagaggagggtggcagtgttggtagatggctactgaagcagctcttttttttcattccttgtacatcagcttctctttttcttcttaactctcctatgagtagtcatgcatgggaggagctggggagtctgtggacccagatttctggaaggggcactggagctgatgaattcagttggctgcagtggctgcctgggtgtgagtcccagccctcactgctgtctgactgtgcatctctgcacata

SEQ ID NO: 63438 - DNA, 3572 bp, Bovine  19866880342488
ttggactgtgaagaaagctgagcgccaaagaattgatgcttttgaactgtggtgggggagaagactcttgagagtcccttggactgcaaggagatccaaccagtccattctgaaggagatcagccctgggaattctttgtaaggaatgatgctaaagctgaaacttcagtattttggccacctcatgcgaagagttgactcattggaaaagactctgaagctgggatggattaggggcaggaggagaagaggacgacagaggatgagatgactggatggcatcactgactcaatggacatgagtctgggtgaactccgggagttggtgatggacagagaggcctagcgtgctgcgattcatggggtcgcaaagagtcggacatgactgagcgactgaactgaaatgaactgaacttatgcctaaggaagtgtgtatatatatacacttctatatacagggttagatccctgggtcaggaagatcccctggaaatggcaacccactccaggattcttgcctagagaattccatggacagaggagtctggtgggctatgggccaaaaggttgcaaagagtcagacacgagtgagcaaatataaatagaatatacatatatatatatattcatgtatatttttctactctcttgttttaaaaaattatgaaagtacacttcacacactcttctgtatctagattttctcacgtgatacaatatacctgggagatcatcctcatcaattgtatatattagtttggcatctctctaaaattgtttccccctatttctcataatttatctttttctgtgagaccaattaatgcatttcatctaagtctttagaccattcttttctaaattgtctttcatattcatggacgttcttttccccatcttatctccaaataagtttgggaaatgtcaggttaaaggataatcagtaaggttttgcatttttgtttgtttgcttgttatatgacttctctgaacttcagtgggctttatttattttagtatttatttatttatttgactgccccgggtcttagttgcagaatgcaagatcttttttagttgcggcttgtggaatctagttccctgaccagggatcaaacccagactctctgcaatgagagctcggagtcctagccactagaccaccagggaagtccctcaatgggctttaatgtccggactgactctcaccgagagcatgttgtgcagcttttcccagctgtactggattttgaaactctttccccaagcatttcagggaactgaagggagctgacaaaaagacattgaaaatgctgcctcagtctctctctcccttggggagtaatggataaaggctgactagttcctgctattcaactcccctcctttcgtacttgatgccgacaagtacttttctgctaataattttcctccacacaggttagagtccaatcagttgggttaccactttcttagtcagtccttggtcactttgattagatttgagtgtttccaaatcagcaaggcattcacaggttatttctcagagtgagtaaatgtctatgtttatatcttccatgctgattcttaccagcttcttgctgtagagggtcttcagctccaaacttggagcaccttactccactccctaatgactaactacagaccaaagggctttgggttccacctcccctgtgctctctaccctacagcctccccagcccctattcccagatttgatcgtgaaggctattttattgggcaccagtctcctttctccagcataacttaaaactctttcaagtcagaaactgtcttcttcttctttgcatgtcctataccaacaccccccgggacagtgccaggcacactagagttgattaatatttaattgctttttttattataataactttatgggagagggttgttgtcatagcttctctatctacacagagaacaaaaaagatgtattgctcaatgacaactctgacctggcgtgaagcaggcacttggcaaatgccaagggacacagattgcctatctagttgaatagtcatggaactaatgattgtaaaggctgggtatttttttcagggttcatagagtctgactcccctcactttacttaaaaggaagctgccaaagagggtcatatcttaccccagttcacacagagctgagactcgagtccgggtctgctgtcctgccctggatatctgtcactggcaacgttgccttgtttgtaaaatggggttgatgatgctccccttgtaggactactgggaggtccactcagctgacagggtacacgcagagatgctgcagaaaactcttgagagtcccttggtttgcaaggagatcaaaccagtcaatcctaaaggaaacctaccctgcatattctttggaagggctgatgctgaagctgaagctccaatactttggccacctgatatgaagagctgacttattgggaaagattctgaagctggggaagattgaagtcaaaaggagaagggggcagtagaagatgagatggttggatggcatcactgactcaattgacatgagtttgagtaaactctgggagttggtgaagtatagggaagcctggcatgctgcagtccatggggtcacaaagagtcagacgtgacttagggattgatcaataacaagagttcttagtgcagaacctggagctgctatcgctcaatgtatggtggtcattattgttaagcagatgtccttccacccaataccgtgtaagctggaaagaggaaggctgatttctctgcatttctaatggctatcagtctcttacacttaataatgccccgcatttgatgcccatttgatgcacatttgatgatgacaaccaagcaatctgattgctgatgaaacttccatctcaaaacccccggtgaaactgaccatgttctcttcttaaggaccagagggttgactctgaaggaaaacaattcctgcatgactttataagataagactctaaacttctttctgcctcaatttcccctgttggctaactgagctgggtctgaggaagaaaatgcagcaagccgtgattgatggattcattagggcttggaagaggtctctagtcctcagatccaagcactgttatttaaagaacactgatggaagagaggagttgggtattcaaatcaccctcggaggactgacaagggagccagtcatcgtagggctttagagagctaattccttacttcagtatttaagatcttcgaaaaagctacattcatcttccatgaaggaaaaaaatgttcttgcttcttcctgctacctagagattatttagtgctctgatattgacaccgcttctgtagaaagatttaaagataaaaatgcaatgtattcaagtgctgatcatttttcattgtcacttagtgacagtacagcctggagtcaattgctgcagatttatcttttgtgatatcgattgtgtgaatgtgtgcctaagctgtttgcaagtacctgctccatcagcggcggggcaggggcggggcctgcaagtggtggggaacagaggtatg

SEQ ID NO: 63439 - DNA, 676 bp, Bovine  19866880355111
tgcagcccaccaggctcctctgtccatgggattctccaggcacgagtactggagtggggtgccactgccttctccggaggatcttcccgacccagggatcgaacctgcgtctcccacattgtaggcagacgcttttccgtctaacctacatacacatacatacatgcactcacacacacactgccccacgtacatgcgccatccaacacgcacaccctgctgccgacgctctaatcaatctgtccttttcaatggtagtctttatttttataatcaatgctgaggtgtgtcccaaataatgtgttcccagtaacagttaaagcacaggagcttgtgaattatttacttatatcagagcagattcaaggttgtccccaacacatctgccactcatttgcatttcagtaagccttcttgagtgggaaagaaagtcacagcattatagctagctaggacatggatttctggaaggattagcccaaatgccacctacactttgttctaaaacctgacgatgctggggaaaagagagggccttggcgtagtcagagactggcccctgctagctgagagtctgctttcctttctcatcgcaccactacaatgcttctccaagacctgtggcgcctcctgccatacccctgagccagactcagactgcggagaatgcaagtaa

SEQ ID NO: 63440 - DNA, 5801 bp, Bovine  19866880356148
ctcacttcctgtgtgacactttcccacgtcaccctgcttgtgaccttcttctcctgattcgtagttaagtgctgttcatgtgacatcacaagaatgtcttagtgtttcctgagttggtgataagtatgatcaggcctattctacagtgtaagaaacattttattcctccaggttccttgggcttgaacccaaggactctttgtggtgttaggtttaagagaaaggaataactttattttaaaattgtgtaacgcctcctgtgtacacacattccaattctttttttttttttttaaagaaattttacctttccttgtcctctttggattgcctccatttctttctggcagcgttctcagtttgctgcttttcctgaggattcagtgtgtggttagggtaacgtggggttctgggaaccagccttgttggcagttggtggagcagaagtttagaatcagctgctgaatgcttgaattgctgtgtttctttctcaggctttctgatcataaggtcctgtccaagtctccacgttctttgatggtattttcctggttgagcctacctggttctctgtggagcattggaccagatcttgccaacttgccatgagaagtgcaggagcagtgaaccattggcgtgagtggccttccagcccctcacacaggggctctacccctgggactctagaatcaccttttggctgctcttctggccctgaagaagagcacgtgcgcacagaatctcgtctcaggaatattgaactttttccttgatttttcccacagtctgcagagcctgatttagggccgcatcaggattaagtaagattaccagcatcttctctccgtctctcctgtgtatcttgtatgaatgtgtcctaataactattgatatcaagttcatccctcaagaaaccaagccgacctttagtaccctgctgaggttgcagttttatgatgtgttttccttgcaagtaaaatcaattgagataaatcttggtagctttttctgcacgatgagctggtgaggccctgctgccatggtgggtccccctctacagggcgcgctcccgtgtcccacgcaaggttttgtttcactaaaattgactgttgatctgctcctcttaaaggtcatgcttaatcacatttcagggagaccgaagaagataccaaattgcccaggtaccagagttgactctgctctccttcggtgctgtttgcttttagcagcacatctctaattaactaggcagttacaccagtgcttaaagggcagaaacccattgtgcatgttttacccggaaaattagtcacagtgagttgtgctgtggtttcggaatggtctgtttttctcctggacattgtaacgccggtggacgagaccccagcatgctgccaatccctgctccccacccccgtaaccagggtgttggttgaaggacagagctcggtcacacagtggcctggcttatctgtgtggttgatgggccaggctgacgggcccggcgggttctgctgttagcctttcatgctaagcctgatatggtagaacagatggaggggaaggggcctccttgacggtttgggaaggtggggacctttaagttaggaggaatcaaaagaacagtttagttattagtggcatctgtgtgacagcttgacattctgtaattgtccatggagaccaggctgctttggaatggtgttcttgcaaatgtgtcctattaaaatttttttcctaataaggaggactggtctgatttgagtagttgtgagttatttcacattacttattaaccatcagcagtaggaatgtttttccttgccaagtgtttgactggagggctagaaacaagagtaattgagattcctgcattcaagaaacatgtttttcattctcgagagaaaatttttgattggaaaatctgtaacatgatttagtatcttgagagataatgttgagagtgcaagatagggaacattttggaggaggcaggaagtagttactgttttcaaagtaatatgcacttattatcccagactgaaaaacagaagccgaaagaagaaaaagtcatctgtaatccctctacttagtttagcaccgttaacactgtaatattcttttcttttcgtcttttttttctaggtgaatgcgtttgtgtttagctttattgtgttcattctttatatataatcaaggctaccctcacccccacttcccgtatgtctcaagaatttttaatgatagtgttacattatcagtgatcatgttataatgatattgtaacattatgtcccatagttctttaggcactctgtctgccacatctaattctttgaatctattcatcaccctccattgtataatcataagggatttgatttagggcataccctgaatggtctagttgttttcgctactttcttcatttaaagcccagattttgcaataaggagttcatgatctgagccacagtcagctccaggtcttgtttttgctgactgtatagattgtctccatcttccactacaaagagtgtaatcaatctgatttcagtattgaccatctggtggtgtccatgtgtagagtcgtctcttgtgttgttggaagaaggtgtttgttatcaccagtgtgttttcttggtaaaactctgttagcctctgccctgcttcattttgtactccaagatcaaacttgcctcttactccaggtatctcttgacctgttctgcgttccagtcgtctatgatgaaaagaacatctattttttggtgttagttctagaaggtcttggaggttttcatcaaaccattcaacttcagcttctttggcattggtggttggggcatagacttggattactgtgatgttgaatggtttgcctcggaaatgaacccagatcgttctgtcatttttgaggtctgtcattttcaagtactggatttcagactcttgttgattatgagggctactccttttcttctaaggcattcttgcccacagtagtagatgcagtgatctgaggaggctgtacaaatagctgagaaaagagatgcgaaaggcaaaggagaaagggaaagatacaccaacttaaggcagagttccagagaacagcagggagcgataagaaagtcttcttaagtgaacagtgcaaagaaatagaggaaaacaatagaatgggaaagactagagatctcttcaagaaaattagagataccaaggggacatttcatgcaaagatgggctcaataaagaacagaagcggtatggacctaacagaagcagaagatattaagaagaggtggcaagaatacacaggagaaccatacaaaaaaggtcttaatcacccagataaccatgatggtgtggtcacttacctagagctagacctcctgtattgtgaagccaattgtaccctaggaagcattactacaaacaaagctagtggagctgatggaatgccaaagtatttaaaatcgtaaaaggtaatgctgtaaaagtgctgtactgaatatgtcagcaaattttgaaaactcagcagtggccgcaagactgaaaaagtcagttttctttcttttaaatatttatttatttggatgccttgggtcttggtggtggcaggcaggatctttgatctttgttgtggcatgtgaaatctttagttgtagcgttcaagctcttagttacagcgtgtgggatatagttccctggcccggaattgaattttggcccccttcattgggagcacagagtcttagccacaggaccaccaggaagacccctgggaaagttcagttttcattccagtcccgagaaaggcaatgccaaaggttgctcaaactaccgtacagttccactgatttcacatgctagcaaggtaatgctcaaaatccttcaagctaggcttcaatagtatgggaaccgagaacttccaggtgtacaagctggatttagaaaaggtagaggaactagagatcagattgccaacatccattggatcatagaaaaagcaagagagttccagaaaaacatctgcttctgaagcctttgactgtgtggatcacaacaaactgtggaaattcttcaagagatgggaataccaggccacctgacctacctcctgagaaacacctgtatgcaggtcaagaagcaacagttagaagcagacacagagcaacggactggttccacatcaggaaagggttacgtcaaggctgtatgttgtcaccctgcttgtttaacttatatacagagtacattatgtgaagtgctgggccggatgaatcacaaactagaatcaagattgctgggaggaatatcaacaacttcagatatgtacatgataacactctaatggcagaaagcgaagaggaaccaaagagcctattgatacgggtggaagaggagagtgaaaaagctggtttaaaactcaacattcaaaaaacctaagatcatggcatccggtcccatcacttcatggcaaatagatggggaaaaagtggaaacagtaacagattttattttcttgggctccaaaattactgcagacaatgactgcggccatgaaattaaaagatgcttgctccttgtaagaaaagctatgatcaccctagccagcatattaaaaaagagagatattactttaccaacaaaggtccatctagtcaaaaggtatggtttttccaatagtcatgtatgtatgtgagagctggactataaagaaagctgagcactgaagaattggtgcttttgaactgtggtgctggagaagactcttgagagtcccttggattgcaaagagatccaaccagtccatcctaaaggaaatcagtcctgcatattcattggaaggactgatgttgaggctgacactccaatactttggccacctaatacgaagagctgactcattggaaaagcccctgatgctgggaatgattgaaggcaggaggagaaggggacaacagaggatgagatcgttggatgacaccactggctcaatggacatgagtttgagcaagctcttggagttgctgatggacagggaagcctggtgtgctgcagtttttggggtcgcgtagagtcagacatgactgggcgactgaactgactgacagagtttctttggaggatgatggaaaagttttaaacctgtggtgatgattgtaaaacttactgaattatgcactttaaatgtgtgaattctatatcttatgaattatatctcagtgaagctgtttacaaaaatgctggtagaaagatggacaaagaatacaaataaggcaatcacagaagaaatacaaatggccactaagcatatggaagatgcttattcatttttactcataattaaaaggactgtaaagtaaaacaatgcattaaatttgttcctaagattgataaaaaataacaacattgtttgtggttagtgtcttatagaaatattgttacctttttgctaagaatatagccatagacttagaattatcctactgaaagaacatctagaaatcacttagtctattccctttattgactcagaaagagtaaggaattcattcagtttataagttaattaatgggatatactggtctatactccacggtttcctgacttttctattagagtcatgcttttctactaaattgagcacagttaaaagctgggacttccatgtgccagaattctggagggaaagatcaggactcctaggaacttttccttctataatggtgcccaaactaagatgatcagatgttcattttacttttcatgtttcagagcgtgtgtgtgctaagtca

SEQ ID NO: 63441 - DNA, 2910 bp, Bovine  19866880370068
atccttttaaaatttaatctggtagatggcttttctttcccctgcttaaaatgttaatcattttcaatagaacaaaccttatattaaaaaaaaaaatgtgaggagggcaggtcctttaaaccattgttatgacaaaacagatgtttaacagcccaggtagtctggcaaggagctgagtttagtgctgctgagtcagaggtctctagttctattttttaaaagcagctagagtcttctggggagaaggcaatggcaccctactctagtactgttgcccggaaaatcccatagatggaggagcctggtgggctgcagtccatggggtcggtaagagtcagacacgactgagtgacttcactttcactttccactttcatgcattggagaaggaaatggcaacccactccagagttcttgcctggagaatcccagggacagagaagcctgataggctgcagtccatgggatcgcacagagtcgcacacgactgaagcgacttggcggcggcagcagcagcagagtcttctgggggaaacttgggaagcagaaagttcagttagttaagttgcgctgatgacctttgtagaccaggcaccctgacacaggatagtgcatttctgtgatgagttcatcttctagtagtgagcacatagttctccagcttaaattctcattcttcttgaattaggagaatatgaaagtatagttcttgacatgtcattcagatgcccccagtgtattatgagttttctgcaactcatgggttagaaatccagcggttgccaagtgcaagatcagtgccgaggtgtcttgtgtgaaagcgtgcatttcttgggttgagccagaaaactgggtgttcaccatcttcccaaggggttcctggggacttgagacaatattttagacaggaaagagacagcctttaaaaagagcaggctggaagagcagcacggatacttgggatttcagaaccaaggaaagagttgacagatttcctcttgtgtctggagaccattgtcactgatgcagatgcagcgctgttgcgggacatctggttagagggcttgtgcttctgtgaaagcaagtggctgtagtgggtggaggtctggagacttgggcgtgggcagggctgcctgattgcaaagcctggctttccctgcacacagtggtgctgaggtctcacaaacgcaagcgtgtgttaacagtcgacctgcgtttgaacccgtggttggttgtgtacaccgtgcagcaccccagctactcggggggtagagagcacatctctgagtgtgaacgtgcaccctctgaagtgtctctgctcttctgctttttaagcagaaagggctttgtgttcgtcagaaattgtcctgaagcaggttattaagagctttaaaagagcgtttggttgccaaaggtttaaacactctacttctctgttccccttgtccctctcactgctatctagacctctgctgatgggcgtggatattccctgtcacctggggagcatgcgctctgtccccagagtcagcccctgttcccccgtcacggaggtgggccgagccctacttggggccagggctttgtaagcttcctgcctggcctttggcaagaaagctctttgttgctgtgtttattttcctcctgtcttggtagaatgcttgatttagcagacagttgtagtgatcacggtttagagagtctagaaggtgttagcttatagaagaggtgtgatggacactgctgggccaggagctttccccatgctgctcacacaacatgaatttaaggcagggtctgttgcctgttcccacatgtcatgcccaccttttggttcaccactcacctagtctgggaatgcaagaagtagcacatcagaacacctaacgagcacgtgtgtcctgacagtccctcccagcagaagtggtcataccggacattgcattggaaacgcaccgtggttccagttggcgtactttatgtatctgcacaaagcacttcatgtgtaccgtgtggcctttcttgatgtagctgtcacagcagtgttgttgatgggcggttaatctgcaggtgaaaaataatagctgtttattttgtccttgccatggcattataagaaagtgccctgtcttctttcagtcttaattctttcaacatgaaaatattctacttaaaatcttgttttgtttctttgtatatgatttgccttgaaattactgtggacagtttatttagttctgttttcatgtattatcaggagcagatttgataagtacatgtgaataacctcctgtaaatgagttttataacaaaattgtactaaactattttctaaagtcagttgtgcagatttatagttttctttgctgtagttttctttctatgccctgaattcctagccaggatttggcaaacaatagccctgttgtctctgttaagatctgaatattgaggaaatggcagaattaaaagcagaaacaagaaagctgacgcatgttaggagttattgaatggagattcaagggacttccaaggtaactcgcttagtctgccattggattgatgttttcatccagtctgcacccacggtgctcctagcttctcacctcttcttggaatcttatccacaaggtagtgagtgaggtacgtgtggccaactgtggtgtcagttacccgttgagatttggtccagaaacacacgcttacctccaggctgagcttgggagagcagagcagatgaacaaggacccacagaaggatctgcgggagccccaatggcggggctggaggcagatggccaggccgggggtaagcgctggtggttacaaaggagagcacgttctccaaaagcagtggcttcaggaaggacagttggacatgctagctccaccaggatggggccccgccagc

SEQ ID NO: 63442 - DNA, 1187 bp, Bovine  19866880370069
aaatgcactatcctgtgtcagggtgcctggtctacaaaggtcatcagcgcaacttaactaactgaactttctgcttcccaagtttcccccagaagactctgctgctgccgccgccgccaagtcgcttcagtcgtgtgcgactctgtgcgatcccatggactgcagcctatcaggcttctctgtccctgggattctccaggcaagaactctggagtgggttgccatttccttctccaatgcattaaagtggaaagtgaaagtgaagtcactcagtcgtgtctgactcttaccgaccccatggactgcagcccaccaggctcctccatccatgggattttccgggcaacagtactagagtagggtgccattgccttctccccagaagactctagctgcttttaaaaaatagaactagagacctctgactcagcagcactaaactcagctccttgccagactacctgggctgttaaacatctgttttgtcataacaatggtttaaaggacctgccctcctcacatttttttttttaatataaggtttgttctattgaaaatgattaacattttaagcaggggaaagaaaacccatctaccagattaaattttaaaaggattttgttatttgctatacaaatatacattccaacttctacaacctctccaggctgacctccttttctacaagaacaagagatcaacgctgcaagcctcctacttcaaagacataattactgatacacaaatgtcctctgaaagcttctgcaactgacaaaaaggaccaagaggcccatgtgttataatacattttgttttccaacaacaaactcctataagaaaaaaagcagtcttatctggacaagcctgtcagtcatcagaggtctgcagcaattgtagtggctgacagcctctgctgttcggccgtactataaaacccatctcttctttgagcagctgtcctcctccaggacactctcatcccagtacttaggtacctaataaaatctaaaggaagaaggaaataaagaaaaaaatttaaattacttaaaatgtatgtaaatagttatatttttgtatagtgtatgtcatggatgtttgaagaaaggtgcccaatttttggtggaatcatatttgttttagttttcgaaaaaatgcagtttaaaatttgtcagaaacagatttagatt

SEQ ID NO: 63443 - DNA, 3372 bp, Bovine  19866880446375
ctggatgtctgatagtccagcctggagggaggggtgcctccttcttaccatcagagtcctggggaccctcacaattcataccttccctcacccaggctcacagccctgactctgacactctccttaattcccagctttgcagttggcaccccatgtcccccatcagaagcagctccaaaaatggaggccaggttcctcgatgtgtgtgtgtgtgtgtgtgcacgcgcgcgtgtgtctgtctggcctcccacccagatagatcaccgcctgcaggcagacatggcacccaccacgactatttttggtccggtctgcccatcacagactcaacaacaaaaaaaagtgcggagtctcaggaggctggcccaacttacgtctggagcccggactcccagtgacccgtgtcctccacccagagagattcctgggccaggaggccagcctgaaatcctcggatctcccagcgggccccttcccccaccccacccaggcaaatgcctcccatggagaaaggagggggacagaaagaaaagacatgtggtgtcagcctctggtcccgtggaggagctgggcgcgggctctttcctgcagctaggagagggctgagccccatcccccacaataagctgaggccagagagtcagggaccccttcccgctgacagaggggtttctgggtccatgagcatcagagagaggaagggtcatggcactgccccaagagtaaggagacccccaccttgccagctcctcactgcagagggggtgggacagggtgggggcgcacagtcggggcaccccgccccagatggcggaaccagggaccttggccacatctccctgtcacccttgggggaggacgagtcaagtcctggcactcccggaaggcaggatctggcaggactcccccggggagaccagagggccaccccagcagcccaagcctgccacacacccctggcttggccctgcccctgcactctgcgcccccaaaggccccagcagtccacagtctaaaagcccagctcagaggctgtgcagctcaaggcggcaatctcctctgccctgctgatctgaggagtctgtttgctcagctaaccctgccctgtccatctcctaggggtcagccgctgggggcaggggcagggccgggggctggcatggctgtgggggcggggcctgagctggctccctgggctctttgggcgacactgagcagtgcctagggaggggggtccaggggcttgccacaagcccttgggcgccctggctggaccccagcgacaggaagtccggactgcctggaggtctccaggcatcacgctcccgcgactctgggtccagcatcctctgctctaaaagccaagcccctgccctccccagagctgatacccccacatcgcagagaggggcagggacttggggcaaggagtggggaagggcagggcagctgggcacccacctgtgggctgtagggtgctgggagccctgggggcccaggcagtggatgttgggggggtaggaatagcggggtccctcctaatggccgcagtggccacaggggctttggggacgggctctttccgggacctgctgatgcctggtgagagatgagaaaagcaagaaagggtgcaggtgggggtcagtggcggggtaccagtgcagacaaacagcttactatcccgccgaggggcccagcgtcacctccgaatccagcttcctctggcccctctctgcccattggcatcccacaggggttgagtttggcccaaaagagccatagcagggggtggggtggcacccctggaagcctgagatttggggtctgccgctggctggctgtttgactctggcaagttctctcctgctgaatctgagagcagatggcaatacccacctgggggtgctggctgcaaggacagaatgcgatagtacgaggatcctgcttagctgatgcccggcactgtgcatgtttgatgatgacttaacgatagtcggttggtcaccccctcccaccctccctcaccttccctgttgaattcctgggatgcccagaccctccttcagacagtctggctgctcagggcctgagctgagctggacacatgggggtctgggtcacctcccctagcctccctgcagccgagatcctggttcatctcacccagactccccacgggtgagcagctgccatggtgatagttgtgggctgtgcagagggaggccaaaccccgtgatcagactggggtggcttctgccaccagtcaaggaaggtgacccccattcttggctggcaggagtggaagaagtggggggttcccagcgggagtgggacaaggggatctttccaaagcagcaccagtcaagaagctggagggaagggcttgtgagacaggaaggagggaaggaggggaaagaagcaaatggatcagaggagggggtggacctggggaggggaggacaggaaagtcccgtctttcctctcctgttttttccaggacgtgcagagaggctcgtgcactgacggccccaggcaccttccccagacgggtggccctggcgtgtacttactgccgacggcggagcctgcggcggcacctgcggaaagagggggggtcacagaagagtaaggagggggtggcagggctggggacaggaaaccaggggggctggggcacctcaccatgcagggactgggtcggattctccacttacaccctcactggtgcctgagagggaagggctgctctgagcccattgtgcagatggggaaactgagtcttggagctgtgacttaccccatcaggggacctgctgataagcctctgctgggggcctcacatgcacccttctcatttgactttagactctcaggtcctccagtgcaaggcaaggaggccggaggtcatcctctggcgggtaatggggtgtcggagaacatgagggtcctaggcacagggacagactggtttactggaggctctgatggaagctgccacagggggaagccgctgtgcctgtgcccatctgggaaacacagggatgcctgtggggtagacgggaaggcgatcacagcggctgtcacgtgctgagggctttctgcatgtgggcccatgctgagtgccgccccaccctggccattcagtgctcagggcttcctggtggctcagatggtaaagaatctgcctgcaatccaggagattcgatcgctggaagatcccctggagaagggaatggcaacccactccaggattcttgcctgggaaaatcccatggacagaggagcctagtggggtagcaaaaagtcggacacaactgagcgactaatactttcactttacaatttgggtttccctgtaaagaatccatcctg

SEQ ID NO: 63444 - DNA, 1312 bp, Bovine  19866880484869
ggcattgttggtgatgctgcttttagtcgtgtccacccccagcctcctgggccctctctcacccgccccctctggatcagccacaccagcagggcgtgggcaggaaggactgggcttcaggttttccacttcctctccatcaggagaatgtgcagggatggattagtaatgtctgctgtggacacagcagagaggagggagctctgtgagccactcacttgctacctggggcttatccacctctctgagacatgtctggccatgactggcaaacgctgggtgggactgaggatccctgggtgagaacctgtcctctggggagagggcaacaggtgactagcctaatggatcaagcagtcgcagtggccctgggtggagattctgttctgaattggatagttgcttgagtttatttcaggcccataccctcaaagattcatacccacactcagaggacagggaggaaacatttgaaaatggaaagattccactgggatctctgtaacagaacataacaaaagtgaggggatcctgctgagtttggaggatagaaaactcggagaagtcccaccaagacgctcacccagatgatgcttctccaccaggtttcaggactgtctcccttttgttgggaagacaaggatcatcagctgtctgatgatccacctgttccttctgatgactgcttcaaggatgctggtttcagcattctggctcctccgagggaggacgaagcaatgttggtttctagacatgacgttcactcctgccagcaagaccatccatcatcgtgtgcaaacggcttgcctcctaaaggccacgttatgagacgatgccaataagcgcattcacatttgccgttgctccatcagggcagccatgtaggagcatctgctgaatccggactttcgtccacatccccatctgctcctctatcctgcttcatcgattgtagattgagtccgtcctgggtaaccaatgaccagtgggttgctgggcatttttttttcttttaattttctgtatcaggtttaattaaaccaaggtgtgcccgaccctgtcaaatcatatcaaaacaggtctccctgctgcaggaggaaaaacatcagcataaattattgattaatcttcattcaaactaatctatcaatgacttcctctggctcggtggacctggggagcccttagatatttcaatgcaaacaacatttgaaagcttcatttcaaagaggtctgagatgcattcaatagcagtcgattgcttcagcagccagtgggggctgcccctgagatgctgaagtgcaatcattca

SEQ ID NO: 63445 - DNA, 1546 bp, Bovine  19866880521703
ccctctgatgctcctgctgtattctgctgctgtctcctgacttggtgggtggtggcagtggaggaggaagagagagagaaacctcaaaaacaagatacaaaaaaactgtgggaatttccctggcggtctagagagtcggaccctgaagaaggctgattgtcaaagaattgatgcttctgaattgcggtgctggagaagactcttgagagtccctgggacagcacggagaccaaaccagtcaatcctaaagggaatcaaccctgacagttcattgggagaactgatgctgatgctcccatactttggccacctgatgcaaagagctgactcattggaaaagactgtgatgttgggaaagactgagagcagaaggagaagggggcagcagaggaggagatggttagatggcagtggacgtgaattgaagcaaactcccggagatagtgaaggacagggaagcccggtgtgcttgcagtccagggggccacagagtcggacaggacttagcaactgaataacaacaaccagtgtttaaggcttgagctttcatgccgtggacccatgttagatccctgcttggggaactaagatcccacaaccccatggtgtggccaggaaaaaaaaaaaaagcatcttttctaggtaatgtttttggatggtgtcgtagaatcgccacacctgtttgctgttctgagatttcccacatgggttactttgctgattgctctttgagtcttgtgtgtgtgcctcatggaggccacgcagcccattgcttctggttctttgcaagaaggggacagtttcagcatttgtgtgctgagaattccagctttctgcatcagtgctccttgtggccctggagctatgccctgttagcactgctttttggcagagaaacaatacttttatcagccagtacgaacagatatttctgttctacaaatgagctcagatttatagactcaaggttcaaagaaaggaggtgagagatcaccagccacagccgaatctacagcgaggaaagagatagcatcaggctggttcatcacgaaagccagtgcacaaggcagccgttcaattctggcagttttttcctctgagaggtattgtcaccctcctgcctttaccttgtccagtgtctcccagctgggtggtggtgggactccagagcccacgcatctgagctgcattcacctctgtcatcgatcaggtgttgtgggagcagatgctgagatggagttcggggtgcagtgtatgtattagggagcaacatctgtctgaggaaggaggacagagcaggattgggcaggggaagatggtaaactgtgatgagccctgacagagcctgggccaacccgggagatctctggagcgcacattgcctctcagagccgtcctgcatcggccagaagcctcggccttctcatccttcctggctcagccccggatgcaggtggctccaggagggccaggactgtccctgggtgagctggcagctgggaaccaagcgctgactgcactcccctagccgggcagcatgctcctc

SEQ ID NO: 63446 - DNA, 1664 bp, Bovine  19866880523657
tgggtgggtggtcggtgaagactgtttagacaaaataagtggtttcatgcctccagggcaaggagaaacttggaactcaggaagcttcagggaagcaaaagctgagaggaggctgggtggggagtgaggccagataaagtggggctcccggttggatctgagagctgcaggggccaaagcaagtaggataaacaagactgagaacagagggtgagacacaaatccagacatcaacagtaggtctaagtgccagcctccccccacgcccacccccggtgctactggggacagagggacccatgcctggctgcaggatgctgctggtggactggaggaatcgtcacgagcccttctctgctgggacagacgtggtcattgcagcctgggaccctaccaggctgcatgtttggagcaccgtgggtgggataagcaacacgatggtttagggttagtgcctgcgatttgtttactttttgcaagttaaacaagccccctagtctgtcattctctgcattttccccacatcatttgagggagcctgttggggcgattctgagggatcccttaggactgaatgccggtttcatgtctgcctccaaaacctttataaactgtcacttaagactttgctctctttgtaggcacccagtgggcataaatctggaggtttaagcgagtctttcagaaactccccttctaaaaggaaagtgtctggtgtttctgaaacctccatctttcctttggcagtagcgtggtcctctggcggcagatcctcccaggatcgcctggcaggatgctcgcgggcctgacttctcctggagagggaatgtgtgcggaggtggagccctggagtctgggtttccagaaagttcctggctggtgacccgtttggccagctgatgctctcctgaggcagctgacagcagttgtacttcatggagcccactgtgtaccaggcagtctctgctggtccttcttaggcatcacctccctaaaatcttggccacaattctaaaaatgtgggattaccatcgttcccattttacagatgggaaagctgagtctcagagtggtttcacaagttgcccacagtcatccagcatgtgggtggaggtgccaggctttgagaggtctgggactctgtagcctgaggttccagccactggactaatcaaaagaacttggtgacatccacagccctcattgttaaatacctgctaagtgccagacttttgagtctatgatctcagctcgatctatgagagataaaaatctaatccatctacatctgtgtgtgcgtgcgtgctaagtcgcttcagtcatgtccaactctttgtggccctatggaccatagcccatcagcctcctctgtccatgggattctctagacaagaatactggaccagggtttccataccctcctccaggagatcttcccaactcggggctaaactcgcctttcttgcatctcctgcatcggcagggtgggggtctttacctctagtgccacctgggaagccccatctatgcctacacctgtctaaaaggtcaacgtcatccacagggtgtgtttttctgttctcaaggagcttatagtgtacttgggcacatttgccacaccagatgcgtgcgcgcacacacacacacacacacacacacacaca

SEQ ID NO: 63447 - DNA, 1065 bp, Bovine  19866880527282
ccacgccgtgcagcttgtgggatcttagttcgcctaccagggatccaacccgagtgcctgcagtgaaagctgtgagttctaactagacctccagggaacttcctgtgaatgggtctgtgtaaatttcagtacctggagccctgatggccgattttgcccataggcaaggtcagccccttgagctgaccagtgcctcccgaggggcgagctgggggctgctgggtccgcaccggaccccgggactccttgcctgactgtccatccgtttacctagctcaccacacttatgtttcctggaaaaggcattgattcgaaatcttcccttatccctagggtttgtgatgagagttagaaccccccgagttttaagatcacatgagttcttggcctatcttttttagcgaacgacaggcaccactgaagaggtttctgtagttagcaagcggaagcgtgttttctttcctttgaaagtcactgcgatgatttctctgtgttacagttcctctctgcatttcgtcctcttcacctgcatagtgaatctgaagacacttctttctgtgggctttagcgcagggccagcgcagagtaagcccgcggtgggtatgggctttctttcagtgctgcacatgcccccttcacccctcaacacttaacttgagccggtggagacgtggctggttaactagagtacccttagcttggtttggatagcaaaagtgcttgccctaaatgcctttaaagtgttccaagaagccacagaggattctagaggccgatgctatccgatctttgtttttcccagtctaaaacagagcagtccgtgctcattttaattgcttggatgagctcagacattgagattttaatgcgttttcacagtagttcagacagcgtcaccacattatcctgctggcagttcatcggaatccttggccaaaacgctgtgcttggggaccttggcttagaaaaccagagtgtggtaatttcctcgcaagatgtcttgtggggaatgctgcctttcccggggagacttcctctgaatcgtgtgtccttctcagtcacgta

SEQ ID NO: 63448 - DNA, 723 bp, Bovine  19866880665703
ctgagagaatgaaggctaccgcgctgctgtggaagaaagtgacagacattctgagagggactcacaggaaggggaggcccccagcctctcccctcacctggctccctcagggtgaacacatgctccatcagcacgtcagggcagagcgtggagggccctggaggaatcacctaacctacttagtattttgggaaaatcatactgggtaaagctgagactcgaaacacaagatgatgtgaatgtggtgtagatatctcagagaagacagaggaattgctctccagtcactcgcctgtgcttggaatgcagccacagggccacctccacgcaggactcagaacaaattgctcccttttcccgcttggtttcatgcccaaccccaaccccaccctcgatcaacctgtgactagaacccatcaatgtgatagcgtttccccaggcgacgacctgccgttgggcagaaagaacaggtcctctgtctgccgtgggacagactgactaagctgagccctgccaggcacacgacacagctctccccgcagagccctggcaagcgccagacgccgctgtcctttggcttcacgtgctcaacgacccttaagatgagagctgtcaactcaggcgtgtggggaggagactcggactcaaaggttgaaggttttgctccatgtggaggcacagctcctgcccagcggggttgaacagtcccgttatgcttctggc

SEQ ID NO: 63449 - DNA, 1481 bp, Bovine  19866880691405
tcaggacctcctaggacctgttttgctttttttttttttttttttcagagttgtggattccaagccagtggcaccaccggcccagtcagggagcaggagggaagccagggcccgtgtgcatccatgcatgtctgtatttgacagagaggaagatggtacagagcttggcagcagtggttagggaaggacaagtaaaatacacaagagacaaaagagttgtttgctaaaggggtctcccgaccctggtcccgcacctgctacccggaggggcacagtccatgtttgttgaatgagtaaattgttggtactccaagcccttcgcaaaaaagatagctaatgttgggacagcatcatactctgtttcagtggagtttggctgccaaatgtgtgtaatctttcactcacctggaatcagaggtgaagccaccagaacttttctttccctcacttcaccgaggcccctttcccggagctctctgccaagtactgcctggccgcagagcacgcgtccctggatattattattctaggggtgggaatggacgtgagccaactgatccacacctttactccttctctgttgggaccagtgatagaaagctaataaaggtgaagtggtgactcggaaaggagcaaagctagtcgactcagaagaggggtgaaggccacagtgtgaacctatgaccttgacctcattagcctcaggcctctgaagcaccagctggtggtgatggtgtgatgtctgtcttactgctgaagtcctcctcctgctgctcagtgctgctgtcttcccatctcatcccctccttctgcagagcatggcttgttacccaaaggaaggatcgctggctcacccttaatatggggaaatcatttagagcacttaatttgtgttgactctttattggtgcactattgcaattaagttagattaatgaaaggtaaattccagtctatacatgaggaaaaaaaaaatctcttgtaaagatcctaattagtatgtgtgtttacttagtctctcatggtttaattgcatcccatcttgctatttacaaacaggcatcattaaagaataatgagtgtgtgacaagagcattaatgctagcagcagatgaggtgactggcggcccggtggggagagggagctgggtgggtgacgtctgccggtttgtgttatttcccgatgaaggagaacgcaaggcgggaggacggaacagacactgcgcagcagcagctcgtcctttgacggcagagccttgggctgcttttcatccgctgctacagtgtcagctggaaaggtgaacacacactctcaggattgtctcaggacctcagccagcagcgtttaggttggagctttcttttctaccccgcgttgcaggatatctgcacctgaactccgtgagggttccctgggatgctgaaaaggccacccaacgcgggcctttcctcctgcagtccagctcttctcctccagcagc

SEQ ID NO: 63450 - DNA, 871 bp, Bovine  19866880697595
atggagactgatgtaccccatggctctgactccgtctttaactagagactcaagtgacaccacctgaacgcctcccttcccctgacttaaccaggcactgtggtcaccacacatcatgatggaatcggaaagggtgccatccacaccagccaccctgatctgaccccttccttcctcccttacgaatcccctctgcaggtccaccaaaccttcccccacaaagggcgcttggcctctcttcgcctggcaaatggtttgctggattggaatgggtggaacaggaggtgtccccctgaagggatgaacgggggagggcagagtgcaagcttgcaaatagcaccttgcttgctcacccagatgctgacttcctacaagggaggcggggcttatctgcaaggctgggcaactgtggctacggtggtggtttggtggttttcccagaggagaggatccagtgatcaccaggccaagaatttccccaccccaaagaacggcgtcacgtgaccccagcatcctcggggcacactttgctctggcgcgtctccaaggcgagacagagacattcctgatcctacaggctgggaaagccagcctggcatccgggtcccaagggtctggcccagacccccacccccacccacttggcctgagcaaaggccacagcagggggccgacttacgtgggagcagaatctttccggggggtctccgcacgtgatgccggagggctccaccttcaccttgacatagtccttcaggcgcatcaccttgggctggcaggcatagaactcccaggtggggccttcgtccgtggtcacccaggatttgcagatgtcgtagtccccggaggccagggccaggcagtgcaggag

SEQ ID NO: 63451 - DNA, 1335 bp, Bovine  19866880718767
tcgcaggcttcagtgtgcagactctcccagccttggactcgttgtccttccgcaaggccacctgagacctgaattgtaaattccagaccggtgaggaaggggagggaggaggaagaccaagataaatgaataaataaaaacctattggctctaaatgcacaatgagaattaatagggctgagctctcaaccaaagattctcgggcaagggcgaaatttcaatgagggctgcgggagacggcgggcggcctcccacctctgactcccagtgcctggccagagggggccagcctgctgagtctgcagggccagagagaaggaggcaaaggcttctcggcctcttgcaagaccccttgaggatggggagcagtcccacggcgctctgaaagagaggttgcccaccaacctgcacagccacgaaaggaagggggagaccttgtccttgtgccttgagcctcaggagagagatggtgaggaaagagggctgggggcacagaccaggcaggtgatgctgaaaatggccctgcagctggctgcccactcacctcccgaggtgcaccttgttagaaatactgggtcctggataacacccccccccagaccctcggagccagaagctgcattttaacaggaaattcaggtaattcagatgcacacagggtacgctctgaggaacactgctctacataatccgtcagcggtgggtgatactttttattgatgatgagcaggcaagaggcctgtgcttcccatgggacctttgcagagtgggggtgtcactactgaaggagaaaggcagacagcaggaggagtggggatcctggagtgaggggtgaagctgggagctcagattcctgaatattggagacctggtgggaggttccagaaaggtgttatgatatccagacaaaagcttcaagcttggaatccaaagacctgagcttgcatcccggctttgctgcttatgggctgagtgatctggggcaagtctctgagactctgtttccccaccggtaacaggacgtggtgatggctgccttgcccatctctccagcttgctgggagaagggaagtggttctctcagtatatcagcaagtgcttagagagtgccagttctcttctagtgtgagcctttgatagtgctgctgatccagtcttgagcatctggacttttccatggtgaaataggtgaatgttaaacatttcatctaaggagacttcagcacacagagacgccagggtcttgacatacaggaaaacccaaagcacacgtgtttctcataagctgctttgccttctctgtgcctcagtttacccagatgaagagccagtggc

SEQ ID NO: 63452 - DNA, 991 bp, Bovine  19866880753155
aattcgcctctgctgccttcccggcctgccgtaagtcttactgccgtgtgtggaaagcctcagcgggttccgggcccccgtcgtccaggtgacagattgggctgcgtaatcagagggggaaggagagcgcgcagaagctgtcagaggcgcgagagcttggctggagccgccagaaatctggcaacatgagttagcgtaactgagtcaacagccgaccgtctccaaatgatctcgccatgaacagggatgaaatacgagcggaaaagataaacttcacctaagaggcataggccagagaaaacccagaaagtctccatttcttggggacagcgaagggacattcttgggacatgtagaagcatcctttgtctcctggccacctggcactgtggaaatttcccaggaggaaaggaaattaagaagtccagagacctaatggtgtgattcaagaaaaaagagggagagagagcagatgaaggagagaagcacgggtgctttaggtctcttctgaaaaataaggcacgtgtggacaaccacacacattccaagagaggctcagcagcgacgtgggtggagccgaaagggcctatccttgccgggcgaggggggggggggcgtggagaaggccacataactgggtaccaccaggacaaccagggagggccacccatcagccctaaaaccagaagtcacatactggggtttctctttcccaactgctcgatttaacagtgatgttcaaaacctctggcttcgggtaaatgcttcactatgagccaaaggaattagcatgaaggtaagcccatctcctctgtctggttcttctgatttcttaatttcattgaggaaagtggactctgaactttcaaatgactccttcctgctagtactttgctccctccttaccttggcttctttagatccagttttctagaaaaagctagaaaattacacagaattacattccaagtatgtaagaactcttcttttt

SEQ ID NO: 63453 - DNA, 1882 bp, Bovine  19866880797299
atgggtgagtggaaggacagtgtggtccaggaaggcttctcggaggaggagagattagggctgagtcttatgggaagaactagggtttcgatgaggacagaggaggcacccaaagcttctacttctgccccatttgcgcccctgttctgtgaggttttcagtcagctgatagcaggaggtctgcacagctctgtccttaagcaggaagcaattttggaaactgagcttcacccagctcttagttaaagccgctcagtctcttgaaacgcccgaggcaggtcccagcctgggacaagaatagttccatgcatgacatcttgttgcttggtgaggcctccttgctgggggcggacgagtgagaggagggggcagccctgcctgcgagggccccgtgggtgagatcctggcctcctactttttcaagggaaggagtttgggtccagacaccccaggagggtggagggcggagcctctggactgcctaggggaagggaaagggcttggaggagacatcgttccagagtgtcagacttagagcttccagaactttccagtccatgcaccccaccttccccaggctcttctgcctctctacatcccctggccctgacttttatgcttcaacgcacgtttaacacaaactgcctcaagttccacgtgtgacgacgaagcagggggtggatggatggacaggcaggcgaccccagctgtggatgagaagttgaggttcgggacggggcgagtgggggctcgtactcatccctttctgggctgtgggactttggataagtccttcatgctctgagcctcggttttctcatctgaaaactggggtgacgcaaaacacaatctcaaaggctggttgtctgggtgagacgagacaaggatggaaagcccctctctgggagcctggcaaaaaagtgaatgttcccaaaaagggattttttttcacccctggtctagaatttagcttgagagacacaaggagtaaaagtagacattgacagaagaggagcctggagcccagtgtgtaagtgtgctgtggagcacacgccaacggccggcagggcggcgggggccggggagcgagtgtcagagcagagagagtgaagggtgggggctgggcggcgccggacccccgcaaggacagccccttagccaggtttccccagctgtgggcgaggctgccactgtgccctggatggagaaatagaccaaggctcccaagtcccactgttggtggagctgggattcagccttctccgcctggccaagggtgtcgggggaggaggggaggaggaaaggagcactgggcaggcagagaccagaggaggcccacggggcacgcaagtcctggggctggaatggagcttggcaggctcaaagaagcaggtgccaagctgcagcccctcccccttaccagccagccatcactaccccagaaagggggtccgggctgtgttcctgacccacggcccagaccccaggctctcctgcctcaggcctggccagggcccactgggcccacgaggaggcctggctccttcctggagggaaccagagtgttggagaaagtgtacaatggcagacgatgcatggttctgttcagctttggtttgcgggttctgattttttttttaatcatcacagcagatttgcttaaatatatgaaaatgtgtttctgattccccaagcacacaccaactgctggcagggcgacaggggccagggagtggtgtgtcagagcagagagagtgaaggatgggggctgggcggcgccggaccccgccagtctcctcgcggcaaggacagccccttagccaggtttccccagctgtgcaacgaggtttggttaggttaaccacttcatccagcgtcgctg

SEQ ID NO: 63454 - DNA, 760 bp, Bovine  19866880800137
ccgaagctgcagtagggctttgcgtcatgccaggcacacggcgaggcttccttgagagtcccattaatcctgttacgtcaacatcatcaccaccaccgtcttcatcaccatcaccatcactatgcctaccgcaacccaaacatcaggttggaaaacaagcacaaaattgggtggaaatgaaaagccagaggccaagacaggggaaacgtccaaagagcaggtaagaagtcctgtctggcagggcgggcctggagcaccggctctcaaagtggctgagactctggtggcccaggagccagaatttagaaatggatgtaaattgaggcaagaaaaagaaactcccaaaagtggttgaaacagggggtgctgtccctggtcccacgtgtggcttctgatggtgtaacttggggcactggccatgtctgccgactgagttgtcctgagcccacgtgccagccacttgctggcaccctcgcccggtgtcaccgcccatcaaaggccacgggtggcaggtgacgatgtctcacactccccggcacacacagccgcgtgaatcagggcttgggggagtcggaacttggaccagaatatcgtggtatttaataacagagtgaaaggatgcggctggggaatcaaaagacgttgccgctaaatgcctggaagagctattttaagtggagctgatgttttaagtaaattccactcagctctcccattaatcccttgaaattggtcatgaaagactgatcggtgacggtca

SEQ ID NO: 63455 - DNA, 1729 bp, Bovine  19866880802520
accccctggtcagtctgcagggtctcgggggagctgcagtctcccaactccgtaagccctctggaagggcgtgctcaggctgaccacagggagtggcccttgtctctgactcaagtggacccaggaccactttcccaagggaccatgctctcctggccccggaacctcgcctcagctcttctctgcctcctggggaaacatctgggggctggtttccagctgagggacaggcgggggcccgcactcatcaccccaccaatgcccactccccacacccttcgctccggccccgtgtcgcccccaccgctgtggaagaggcccgctccaaattcatggctgctcaggggctcatgaattatgcacggccccagatcaatccgtcagcaccctgtcagcgagggatcaaaggccctggcggccagctgacagctctctctgtgcgaggaggagcggagacgtggctttcaaggcccgtggtgggccgtgcgaaaagagcccttcgccggtgccgggggagccctgggcactctgctccccgcccctccccggtgccccggctctgtttctctgccagcgcgaacttgacaaatgtctttaaaggcaggggagggggtaacgtgtgttttgagcgcgttccaagatgctccttgtgaataattgatgccagcgccaggtttgtcatgagaaggtcaccttgggtggggacggttttagccacatcacaggcttcccacggagttgacaagatggcccctctcagcccagggccccgcatccagcccagggctgggggtctggcttctgaacaggagattctgggttgttctgtccaggccccaacagctggatgaatagaggagggcagggtggagtcaaagtgagaaagtggaggcgggtgggtggccgccgggcactcctactcttggcagaagctggagatggacctgggagggcgatatattcatagcaaatgaccacagactgtgcggctcaagacgagagaaacgaggcctctctccgttcaggaggccagtgtccaccgtcagcagaggtggccccttccggaggcctcggggcagaatctgctccacccagcatccagaggctccagcatgctccgcctttcttggctcatggatacatcacttgggcctctgccttcatcttcacgtggcctgatctccccatgtggtttctgtatctgcgtctctcctcgctggacttagggcccaccccaatgcaagatgagctcgagagtcttctcttaatttcatctgcaaagactcttctctgaacaaggttgagctgaggttctgggcagacacatttctggcggccaacattcaccccaattcagcaggagacacaggctcgagcccaacagggacggagccacttgggcctgatggctgctgtgaccgcctcctcttggggcatagctgggcccacagcctcatccgggatggagtcccaggaccctgtaaaggaaacctctgggagctcctgctggcctaaccccccgcggcagcccagcgcacccaggttccagctgctctgttccagctgggacaggatgctgtggtccccgggtagcagatgaagactgggaaactcaggcagaggaagcgactcgcccagagaaccaggccagggaatggacggctgggtcaaggctggcgtctgggtgacttggggaccaccttctctggagttgcactgcccagctgtg

SEQ ID NO: 63456 - DNA, 724 bp, Bovine  19866880824720
ataaccgcagagccatcacttgtgaagcttgacagaaaataatgagaaacactaaatcttttataaggtcaacactcgccttagccgagcagctgtcaaacaagaaaagaatttagcgccggagccacgaaacttccatcggctcattaagcccaacagggcccgggcctggcgtggcggagaagacgcggggcctttccgttttgtgtcagtaatttgcggcggaggaggaagaagaaacagcccgcgccaaaggggcctggggggcggctggggaatcgttaggacgccgggagcggccccggctcctaattggaagcattgggcattatcaacggaggatttgcctcggttccctgacagctcgtgggcccagaatgatcgcccacttgtcagtgtaaaagaccattaaaaacaaaccattttgatttaattggaggcggtgcaccgtggggccaggtgaggctgctccgtagcccggctccccccaagctgctgcccctctctctcggtgatggggctgggggtggagcgggggggggctggaggcgagcgttttccagacttttcttcgcctttcaaaaactgtctgagaaaggactgaatgggagacggaaagagcttcacggtggcggcgagggctgttttcaatggggttgatcagcatgcaccgtgacaagcagagctgccaggaagtgggggggatctccccttgccttttcag

SEQ ID NO: 63457 - DNA, 2470 bp, Bovine  19866880848645
ccatctgctgggtcagcctgactggccctcgtccacttaccttccaggggccaaacgttcccggtccacagtgccctcccagtggataaagattctgggaaatgtttgtctagtctccatgaaaccaggaagatgtcataaaggaaattccctactgcccagtaaggaccctttcccacgcagaagttttggggcccaagtgacctgtgcagccctggatggaggccttggagcccatgaaactctgggggaggagggggcaaggggaccccaccatcggcgtgtgtgtcttctttcaaacatcctccctaatcttgaccatttccccccacatctcacttcagctgaggttgctctctgcctgaacctctttcagcattatttttgcattgttcttctccccaaggaatatcccatttagacttccctcccaattgaatttgatttctccctctgagccaaatcttatttttgttattttccatcgatatctttaccctgctctgaggcctctgcattacttctcgggccttcttggcgagagcaacgcctcccgattaaggaccttatgcaaatttcattagtgaactgttcactccacctttcagatcattattaaagatgttaaataagagcgggacagacagcaattccacacaccttcgccgagaccgccctctgtcatttatctttggcttgtgtgtgtgcagttccattctcaaaatgaggttcttctccatcctaggttgaatttattttgtaaggaaagtttcataacatattatggcagacattttactaaaatcaaatctcacagctatccacagttcccctgcatatattgccccagccgaaggatggtttagctcggtgacctgcttgctctcataagaaacattgctggggacaccatggtctttgggatgcttgctgagtttcagtgaatctctccattccttggtcaaccagctaagaccatgcactaaatacccactggattctgacttccaccgtgctgggctgagataatatggaagaagtgaaccttgtcctctaagaatctcatagtccgcctaagcaaacagaacattcatatacacatgtgcccaccacacagagagctgtggccaggtttgggtgttcatgaatgcagtatgcagtcagtcacaggctacatttaaaaatacttgacaagacttccctggtgctccagtggctatcaatccaccttccatcatgtacacactgctatattcaaaacagataaccaacaaggacctactgcatacatggaactctactccatgttatgtaccagcctggatgggagggggatttggaggagaaacagttcagttcagtcgctcagtcgtgtccgactctttgcgactccatgaaccgcagcacaccaggcctccctgtccatcaccaactcccagagtttacccaaacccatgttggtgattgagtcagtgatgccatccaacgatctcatcctctgtcgtccccttctcctcctgcccttagtctttcccagcatcagggtcttttcaaatgaggagaatggatacacatatatggagagctgagtcccttcactgttcgccagaaattaccacaacattgttaatcagctataccccaatacaaagtaaaagtttaaaaacaaaagaaagaatcctctttccaatgaaggggatgcgacttagatccctggtcagggaactaagatcccacatgctgtggggtatagccaaaaaaaaaaaaaaaagtaaagaaaatctaatagtacttgagtgtaacatgtgttttaaaaccttaattttttatgatgggaaatttaaacatgcatgaaatgcaaattgactatgatctcccaggcgttcatcatccagtttcaacagttacaacattttaccattcttatcatatctccttacctctccttttccttttttggcaggggaagacactttaaagtaaagcccagacatcatatcattagcatcagtaatgacttcgcaatgtacctttaacagatattaaaaaaataaccacaacagcgttatcatatcaaacacacttgaagggaattccttatgacatattacctaatacctggtccttgttcaattgttccccccgattatctaaaaaaagtcttttatacagttggttcctatggaccacatattgtatttgatggacatgcctcttagtctgcatcatatccttttgaaaatgccatttagctgtgaaagaaactaagtcatttatcttgtagaattccaaatgtagtccatcttaaaggacatctgttatgtaaaatatgaacacagagaaagatcacgaggagatcatctaagatgaactaaagataaagtaagaatgccaacacatgtgaaacaaggacccttcgagttggacggaagcccggaggttgttcacactaacccagcctccaccccat

SEQ ID NO: 63458 - DNA, 1427 bp, Bovine  19866880884360
cctgaacttcatgcagtggttccccactgcctacagcacgggccccacacttcctccaccgccccagggaagaggcgactggcaagggtaggaggggaggtggcaggccccggtcctgctctccaccccagggaaaattcctttcgacctcagagacgtgggtggcagcagtggaacagaaacctgccatctaataaaataccatcttttaaaagtaaaagccaaataaagccatcatgttaaaagtatgattatccacctggcaatctgattctgaatcagatcacccagtgttcttcctgtaaataggccccacctcgtgtgaattcccatgtcaactggggaagatgacagctagctggccagatgcacagtgatctgaattagccactcatggcagtcaaaatggtgtgtataaaatagaattctgcccttgactcaagcccctaaactctcatcagcctattaaaagagaagcttggtgagaaagcagatgagtctgacaggtcacggtgaaataaaagcccactctctcacgtggaagtaactctaatatcttaaccctgtttacccagaatcctgttctctctgctcattcccatcaacgccaaattcctaccttcatcaggaaatggaagcccaacgacccagaaataatctgagcaaacctatctcgctgcagacgctttcgtttttatcttcattaactctttggtccctgtcaagcatcctgggagcaggatttatgttttggccactgggtttagaggatcttaacatgtagcacaatctgtacctttaacagggggcagaaaataccgcatgttttgtagacaggtacaaactgttttctttttcgagtgaaagaacaccatgttatctcattcactatattttttaactggaagaattttaaagaaaagtagcatgtcacccagatgaatgtcacttaattttttctcacatgaaatcccacccatttaataatcctatgtcttttccccctcttaagagaggggcttccctggtggctcagtggtgcagaatccgcctgccagtgtaggagacatggcttcggtccccgatctggaagatcccacatgccttggagcaattaagcccatgcaccacggctactgaagccctcgtgctctacagcctgtgctctgtaacgagagaagtcactgcactgagaagccagcgcactgcaactagagagcagccccacccaccacagcaagagaaaagtctgcccagcgatgaagtcccagcacagccacaaacaagcaaagttatttacgcacacaataagtctgtcctcttcaggtaaatggactgagtgaatagtcactcatcctgggtgactggatatttataaaagttcacaaaagtaaaatgctgaagtccaagaaattcacactaggccc

SEQ ID NO: 63459 - DNA, 1821 bp, Bovine  19866880892222
gtaaagggaagtaggtggcaagaaaaaaaaagctatatctgtaatatttcatgtagtgagggctgttaagtaatataaagcaggatgaatggacagagtgacaaggaggtcgtcattctgacaggttagtctgataaagggatctttgagtggtaacctgtatgagcctagggtttgacctgggaagatatctttttaaaatgcattcctgcagaagagaaggcaaaggagaattcatagggggtaagatcacatcttttccaatgagtcaatgactctgatgctgggagggattgggggcaagaggagaaggggacgacggaggatgagatggctggatggcatcactgactcaatggacatgagtctgggtgaactcctggagttggtgatggacagggaggcctggcgtgctgcaattcatggggtcgcaaagagtcggacacaactgagcgactgatctgatctgaagatcacatctaaccagtccatcctaaatgaaatcagtcctgaatattcgttggaaggactgatgctaaagctgaagctcagtactctggccacctgatgtgaagagctcactcactggaaaagaccctgatgctgagaaaggttgaaggcaaaaggagaagagggtggcagaggatgagatggttggatggcatcactgactcaatggacatgaatctgagcaaactctgggagatagtggactggggagcctggagtcctgcggtccatggggtctcaaagagtcagacttgacttagtggctgaagaaccaattgagaacctctgtactaataaggatttggttttcagccaagtccatacctctgaagagaccgtacacagaggctgtagaagaaatagaaggtttgggattcaaatgaaataagttagtggccaaatttgatttcatagaggttcaagacatcttctcctttgtctctttgtcctctcccttatagacaagttcctaaaaaattgtgatctttattactggagagaacccgcccaagtttttagaggagctgggtgtgctttatttggagcagagcagatgaaagccggtggaaagtcatgatggtgaccttcaactcacctttgagtcaaccatggggaagactcctatgtaatctagtggcaataatgagaaccagttgtagggaggaagatttcaacctaatagtgcatggcacttcctgcaattgggaaggcagcgagtccattgactaaaggtattaacctggagtctatgtaggggatcccagcacaggctggtagcatagatcagaacccccttagggctgaaattctataatcacattgtactgtcttctaggtaaaaatcaagaccgttcatgaatgggaaccccgtggaacgacttaaggtcacttacagtgcacttggagtcgttttcctggagttgcatgctgttaagggggctttaattaagctttctcctccgggcacaagcagcctgtttgtggtgagtgcaatatgccatcccagaatatgtcaaacttcatttgcaaaatatcagactgctgtttttttcccagagccaatctgcagagtaatacgttcaataacttttgctctttttgctctcaaaaagataggtctctttttggagtcgatagtgcaataaatgcggaatctggtgcaaattccaatggaaagaaaagatattgttatttaaaggccaaataacggcttaaaattagagttgtgaaggcattgaaaaacaccagacttcccagatggcttggagataattcactttgcactcagtccgttcacacgctaaaaaaaaa

SEQ ID NO: 63460 - DNA, 1277 bp, Bovine  19866880921185
acacacaggtttgatccccggtccaggaagatcccacatgccccagagcaacttagcccatacgccacaactattgagcttgtgcgctagcaccccagagtcacacttgctgagcccacgtgccgcaactactgaaggctcagagcctgtgctctgcaacaagagaagccactgcaatgagaagcctgcacacggaaactagagagcagcccccactcgccacaactagagaaagcccacatgtggccacaaagacccagcagagccaaaaagaaagaaagaaagaaaatgttccttctcagcttcccaagcctcagtttcctcatctgtatgctggggatgatgcccctcatggggcaggatcaatgaggaaacacacataaaggactcagaataccacatggcccatcagaactgctcagcaacgacagttatcattatggaaggaggaagccccgctcccagcctcggtggggatcacagagctacgagggtcagcgcagatagagtagaactacatgcttcccttcctgctcgtgtttcctgtgggtcagcggaggaagagactagaatgtacaaagagtcagtggaccgccttctgctctctctgggtccctccctcccctctctgccccccaccccaccaacgtgcacaaagccttcttccctcctgcggtttctattctcgtcctaagttccttccatctccagttactgggtgatcaatagggacaggatgcttatggaagaagacacgaaggcaagaaaggggaaggggccaagggagggggaaaaccaggcgggtgctggccagcccagggcctcgggtaagaagccagaccccggcggcatctggggaagctagtggattccaacacccacccaattctcaaatggtagctatagctcctgttcccttaatcagtgatgtataggtcaggtgcacaggaccttcatctgatgcaaggaaactcgttccaccatctcccaccaccaccaccctgcttgacttgaacacctccaggaacggggaactcactcttctttttctgtccctggttgactaaggcccagctggatggcttccctggaaccttcaggagctttctgggtggaagcctcggacccagggcagggcctgggggtgagactagggcatgtgaacacctccctttgcctctgccccagacccagagtcagcaggatcggggaggctgtttagccagagtttgcctgatttcggaccccagggtccccggcctgccgggcgcctgtgg

SEQ ID NO: 63461 - DNA, 1072 bp, Bovine  19866880923137
tccaagccacccacccaaactcctataaaataataataagccccttcccaagcacctgtcctagggatctgagacaggttttgaactggaagaccagttctgggtgcaatcactggccaaaactcagcagagtgaaaccaggctgaccacaagggggagcatgtggacctcacaaggaccctggtgccagggagctgggctgaaagggtcatcctgccaggcaaccaagccccccaccaatatgctccccaatgctgactgcaactgtggttaaatagtcttctgcttcttcatcggctgctcaggtcctggggggcatggaccttgtcagttttgtccaccactctatcgtcggagcctggaacatggtaggcactcagtaaatatttgctggagaaatgcggtccagggccttttaaggctttgagacattattcacagtaaggaggaagttgatttgagatgcagagatgagatggtaaaaccagagattcctttatcatttagccaacagtggtcccccagattttggcaccagggacaggttttgtggaagatcatttttccagggactggggtgtaggggatggtttcaggatgattcagacaaattacatttattgtgtactttatttctattattattttatcagatcatcaagcattagatcccagagtttggaaacccctgatttagcagactctgctatcttcccctatggtggatattgtgaatccacgttgcaatgatgcatcctcaaagaccaaatgtgtttcttggccacattaatagaggtagcaggtccagaatgagggaggtgaccttcctattctcttctgccactcaggtcactcttctggcgtcattttaaaacatgagccgtcacagattcaggggaaggcccataaccagcggcgcgtccagacaggagacatcagcccgggacaagggcaaggaggtcactgtgtcagagaacacggccggaaatggtcttccccagctgcgagaggaaagacttagacggttctcaatagcctgaggccctgctatgaggacagtggagggcctttg

SEQ ID NO: 63462 - DNA, 1312 bp, Bovine  19866880946245
taaaaatggggataatcatacgtacctgggagcattgctgtggggattgaatgagaaagtgagtgccaatactcactttgcattttatttatttatttatccactcatgcatttattcatactcattaattcatacactcactcattcattcattcatattcattcattaattcatacatattcattcattcatacactcattcattcattcatatgtacactcattcattcatttgtacactcattcattcattcatacactgtctccctctctttttcttggctgctctgcagggcatgcaggatcttacttccccgaccagggatcaaacccgagcccccttaactattggatcaccattcactgcctttttatgaagcatctactatgtgtcaggcagcagcctaggctctggggagatgacggtggatcagagagaccaggtgccttgctcatgataattttaatggaggaagaacagacaataaaggattaactaaaaacttgtgtttcttgtggcaaacagctggacaggggccaggaagtctgccccgggcggatgactggggacagaagctgtccacagtagcagctgtccttctttcaagacacatttccaagggcacctcctccagccagcctggcctcacccccaccctgacgtctcctgtgctttgcccagcatgtacgcctgtgcctggccatgccccatcctcagctgactccatgtctctcctgcacatcgatggccgggagctcagaagcaaagcctaaccgagatttccagacgggcgtccatcacaatggcctcgctggcacgccagacctcggggtctatctctgctccttctggtcatcatgggacgacagcaggtcaaagaaactgtttggtctaggcaacagtggattggaagaggctgctggagatcttaaagaggtcatgccctgaccacatggcatgacctgcaaacaaagggcagccctctgtttactcaggagccaaccgagccctaggacggtctccccctgaagatgagggaggcgagggtatagctgagatcagagcatcccctggcagagccctctgcccactgcgatgctgggcagcctcttcccgcatgggccctccagtggctcagaaccccagtaactgacaggaggccgcatctcatcaaaggaaaaaaaaggattaaaatcaagattttgctattatttttctctgatacgagtgcagcgaggaatagctcagttgcgtcacatcctagtttttcatttgtgtttttgtttcatgcttcaatatcttcctccag

SEQ ID NO: 63463 - DNA, 1335 bp, Bovine  19866880979072
ccttcctgccagccgaactcagctgatattctgtcaatacaattatggggagagactgtttggtttgcttcgctgacagccttgaatcttctgtctctctggagaggcaggcaagatctgtttggtttgcttcgtatatgtgtatatacgtgtgtaacacatgtatatttgtgtgtgtgcacagataataatgagacaggcaatgtcataggtcaccccttgtaagtttcaagtttctgcactacctggatgggttcagatttgggaggaggaaaccctgagcaggacttaagaggctttatagaggaaaagttctgaaactggaccttgaagggcgaaaaggtagattctggtcctggggtgggggtggagactaggagaaaccaagccttccagggctgtttgattccaccctcctcagatcctgagtgttcgcagatttccaccccaaccccaacagagttctagttcctcagccttggcaccagcgctgggatcatagtaatcgtcatcacgaggaagcatttatttagagccagtgtgttcaaactgggtgcttgacgaaattaggcaaccacactaggaacgtaacatctctaataagtgttgatgctggtgaacgtcaacgcgtaggtagagacagatgcaaagaggatggcagacccacagtcgggggaacaccccagtgcaggtcagggtctttttcatgatcgagtaaagcgtgacagtgttacattccgcttctgcgctgaagacaatgtgcctctgattgttcagatgcttttacattcaatttacagagtaactggggaaaatacagcatgaggaaggggactgaaattccaccaccatcctaatgatagtctcagccagctggtgggaagcttttatttttccagggaaagctgtgggctcattcatccctggaactctttctctctcggtcctttttttcttttctcttcctccttttttttccctctcttcttttaaatcaaaacttctggcttcctggcacccaggcacatctttggtgatcagggtgagcgagcaggggctgtaagcagtgcccggtcctatggctgtttcagaaagcagacatgctctctctcaggctttttaccatcatggtagggggcgcaggttagggcggaggcagctctgcttgagacctgccttcctctttgtccctctaaagaaggagcctttggctttcaaacctcaggaatttgggttccccaggatgaacccagcccctttctaaactctcagatcactggcagtaaggctgtttctctaggaagaattctgagtcctgtatggacaagtcagcag

SEQ ID NO: 63464 - DNA, 1387 bp, Bovine  19866881001378
tacctataagacttgagacatggcccaaaactctgctttaactggcaggtgatgcttctactaagagccgaagtgcaagcgcctcacttgagctccgttagaggcattctaacagtccaacagtgtcgagggggaggctagatgctcaagccactgtgtggtgaccagccctgccgagctccacccacacgggagcagtgggagagtgcacggaggtgttcacgctccacagcccatggcaagctagcataaagaaatgcattatctatctggctatttgctgtctgtgctgtccaatctctaaaatgaaaaaaaaaggggggggggtgcaaaacctactttcatttaaaaatttgaggcctgctgacctggaatataacctgaatttttgcttgtcaggacttactggtgtgggaagcagagcgggtgtggcagggagcagaaatgcagtccattctgcctgaaatccagttttggaggtgcggggcactccaacagggagactttgaggaaaaaatcagatacagtttattgagctcttaacagctaacactattatattaccttcagcaagaaaaactactgtttaatagttccttataggaagggaagccttctaggaatgtagtttttagaaattttatcacaaacctaattttctatcagactgatagctcagagggtgtcctaaggctgagagaaggaaagggagggaaatagagagggcctctcctaggaggaggagcgaggcagagaggggtcaggagcagcggggatagacagacgggcgggcctggtggaagtcggacactgacagcaactcctcgtttcactctgggagctatggcaactcgcgtaacacggttcagcgctgcccagggagcggggactccataaatgcagctccgtattcttcctgacaagacccatgagccttgatttcttctgtttcttagctcacaccatcacaattacaacagaacatattttaatatttaattattaccccttgacattcttttaacctaattaactggtgatggctgctaacagctctagtcccgatgcccaacattaacattctcaaaaacttcctagacgaagaagcagaaaaatgtcacactccaccacgagcttcaccagtgcttctaataacttctgacattgaaaaacaattggtagttttggcagatatgataacaggcagagatggcttgaagtctgggtcgtggacacaggaggatttcagaatgaatatcaagcctaacaagctaccaatttcttatctaggataatgggaacaaattaaccttaagcagggaagatgtgacacaggtgtggatcaggttcccaagatgcagtgctgccttggcttcaaaggtccagt

SEQ ID NO: 63465 - DNA, 876 bp, Bovine  19866881017693
acccgacacgggtggggaatgcggctttggggctctaccccagagccactgaatcagaatttctgggcatcctgccaggaatatgcattgtccacaaactacactggtgactcttgaacctctcaagtttgagaactactgaacccagcagaggaatcaatgccctaaacagttaagcagtttggctgttcaatggtctttcccatttcagagagcttgggatacagcaaaataagacgatgagtctcacggtttaaaacagatgtatcattcaaaaacaaggcacgaatatgctaaagaaactgaaggttggtaaaaatgcacattaaagagactgataaatgagttttatctgctgcaaaccatgtaacatataaagaaagattaatttacaagatattaaggtatgttccaaatatcacggctgaaggttcattttttccttctcttgcattttcatacctagtggatcagtaaaacattgtggattaatattttaaatgccgaaaggagccagttgcttgttctagtctgactcagttaagctcttacaatattttgactgtttgaagaaattaataatgggatgttaggcggtagattaactgaaactaaatatcaacagagctagatttatttttggatgactgagctcatctcttcaaagaacggaagcaggattcattgtatcataagttattaacttacacaacatgaaacagcccccgaacagagccggccacagcaattaaggcttacgtaagaggctgaaagtttagacttcgcattagccacgactgggctgtccaggctccagtcggtggtgaccccaggctcacagagacgccaggagcagttcagatataactgcccgga

SEQ ID NO: 63466 - DNA, 1121 bp, Bovine  19866881034145
cttagcacgtccgccatgttgccgccgccacagccggctcttcaaaaccggcgagcaaaaagacgcgccggctgatgacgcaagcgctcggaggactctgggaaatgtagttttcgcgggacggggccgtccgggaggtttgtgaggccaccctaggagagaggatttcctctttaaaggaatgcgtgggcaggagcgcgatcacctgaatttagggaagtccggctgcgctctcggctttcttcatggtaacaaggaaatacagaaagttccctcacttccccaaacttgcagtcttgggagtcatatggaaatgaattgctcagagcaataaagggtccgtggtgtaaaggattgaataaaattcctccatattcgtaaatcaatgggggagaagggaaatttcttccctacagtagaatgccagctaataaatgcagaatgaatgatggaaagaaaattactacttggcaactgttagattaattattgattcaaataggaactgaagactgccagggggtgaaagggtgaggaatagcagcatggttatatagtctcaacgtagcatccctcaagaaactcgctaattaagaaggaaaaaataataatccagaagtttcagctctggctatatgatcaaaagaaggaaaagtagggtctggaaaagctattcattatttgtacacccaagtttgtagcagcattatccacaagagccaaaaggtggaggcaaccgaagtgtccgtcctgggatgagttcattaacatgtggcatatacacacaagggaacatttattcagtcttaaaaaagaaggacattctgacacccacacatactacagtgtgggtcagggtatcctcactggctcagccgtaaagaatccacctgcgatgcaggagacacaggagactccgatttggtccctgggttgggaagatcccctggaggagggcatggcaacccaatccagtattcttccctggaggctttcatggacagaggagcctggggggctgcagtccatagggtcccaaagaataggacacaactgaagccactgagcacacagggacatataacatgggtgaagcttaaagatgttatgctaggtgaaat

SEQ ID NO: 63467 - DNA, 1543 bp, Bovine  19866881113228
acatgactgagcgactgaacaacattatgtagatgaacctggaaaacactatgccaagcaaaagaagccagaataggcaaatccatagacagcaagcagatgagaggttatcaggagatgaggggagaagggagtggagattgattgcctagtgggtacaaggaggtggtagttgaaaaacattatgaatacactaaatgtgactgaattatatccttcagacagttaattatatgtatttcacaccaataaaaaaaaattccagtacaaaatagtctaaggtaaggtttaatatgcaaaatgaaatgaggcagcacaaactgtaacacagattttttttcatttgaataaattttatgctaaagatttttccttgcttttggtgtggatcatttttaagtttttattcaatttgttacaaattgcttctgttatatgttttttggttttttggccaccaggggtgtgggatcttaactcctccacccgggatcaaacccacactccctgcattggaagctgaagcctcagccggaggaccaccagcaaagtccctggataaattctgccggttgcagtcccgacaagatgcaaatactgtgctgtctgggtaaggatggtttcacgatccatcctacttgtgatttctcattccacgtctggcttcacatctggctggctagcaagcttcctaagaaagatcgggggttcttttccaccttattccctgtattcctagcacctaagttggctcctggcacatagcaaatggcaaataattgtgtgctgagcaaatgaatgaccccagcaacagaatttcactcagcctgggtgaggggtggaggggactctgggtcatctcttctcaacctgggatgcacgcacccctcacctgggacctcgttagagacgcagattctgatttatcggcctgggatgggagctgacattctgtgtttccaacaagtgcccagggatatggatgctgctggtccaccagtcatatttggaggaacaggaatccaggcatgccagaccctaagccttgtcactgaagaaaaagtgcaggtttccaggtcagacacccgggtggtttgtctccccggacctcactgctcgctagtcctcccggcatagaggcgccagagcacttcctggttacccctggggagggtgattaaggcaattggcaactttttcccatgattccacggtaggctgtcattttgaggaaaatacgtgcaactcaattcccaaccctcggtgttgtatgtcttcttatgtgtggtggggggagcggggaagagtctgtggccctcccccagagaaacttgctgctctttctgcctttgtgtttctgagcatgtaaactcagttggaatcacagctaataaacaggtcatcttgtacttccaaaataaaaacatgccgtctttcagcggaatagcaactgtacattaaaaagctgtcaacttcaccacaatttccctgaaccttgcactgcagagagataccttgtcactcagagttgagtgcagcttta

SEQ ID NO: 63468 - DNA, 719 bp, Bovine  19866881114577
aaccattggagcttcagtttcagtccttccaacagttaataaatctttgaaagtttctattccaagatttttacctaagagaagagccattttctacccatgtcttccttataaagacaccactgcgtcctacagaaagcaagcagctacctggatccgggctgtggggatggcaaaggcagactagagaacaaaagtaagtaaaatcaggctactggggaactgacggcggtggtgacactgatgatactgttcatggtaactaacgcatatcagccctcttctgaacccctcgcgtactctaggcttttgatcttcacaacagccctgagtgggagactaccatcaagctcatcttacagatatcaggagtaaaccacccaaggtcacagcaggacttgaacccaggcaggccccggagcacctgtctttaatgacaagctacacagcctctttgatccaaggagatgacaaatgcgttcatgttttagaaacgataaagggctgaaacgaacacaagacacttcagcttttcactgtctcctttctttgcccttttcagatctgcctcaaaacaatcaagataatttgccttctgtttatatccccaaactagccgggaaaaaaaaaaaaaacttaatatgcattatccttcaataagtcaggccatgagtggaatgcacaagccaaataaagacatctcagcagccgtgtgctca

SEQ ID NO: 63469 - DNA, 1585 bp, Bovine  19866881128907
agcactgaccactgtgttgtgacctccagagtatggcacagatgacaaacccggagaggaactggctgggagggtcaggaaggcttctggaggaggtgagctttcagaaggacaggtccagaaggatgggcggactggacgtggacgggaggagggagacccgcccgggcggtgaggaggacgccctgtgtagcaggatcagtgaaaatgcaggagccgtggggagagaggggttaatgagctgggttggaccaggagcctggtggggagctggagataaggccaaaggggaggcctggagccagcatgcattcttgacatttagcagctgcagggaaagccctgatcctggctgggcagcctccttccagaaagaaaggggaagaacctggggacacaggacaaggcaggagccagcacccttcaagtcccaggaagccggagcaaggacggggtgcccaaggcttggatgtaaggaaaaatcctgagagcaacctctctcccgctctggcctttaaattaaaaaaataaaaagtgaaaaaagatgcttaagattgaaagacaagatgcttatagctggaagggaaccagtgtggtcctgggcaagactgaaatttggttctcaaacttggctgtatcctgggaccacctgggaagcttgaataaatccttagcccaagcccaccccagagactctggggtaggtggtgaggctgcagtccagcaggttgcggggatgttaagagcccccaggcgagtccactgactggctcagctgcggaccactccagtggtggggggcccggacggagccaaaagtctgtacagctccctgggccctgcctcctccactcctctggaggcccagctgcccgtctgggattggggcctttaggaaggctgtcccgagggttaggggacatggagctaacggaagagagccccacacctgaacctccattcctgctgtgggaacaccctgacagcggtcctcaggctgactcacctgggggcaccccagacaagccacatcaggccctcgggggagggtccctcccagggagtaaccatcaggcttcccaggagactcccatgtgcagccaaggtagaggccagaggaccctgcaatgggacatttctccatcatggggcggcccctggctccgcgccccgctttccttcccttcctcgccccccatccccagtcccttggggacctcaggtgggaaggggagggctgcctggggcaggcggacgcctcgattccccttctccccacactgcagtcccctccaccctctatttttaggtccattattgtccattcttgggtgtattttttttttttttttttctactccttccccagaaaaaaacagatcagattcctccaggcaaagccatctcgtctcccccggagctggtacgtggggcacgcacgcggccaatagacatgaaataagtgaattatcaagtaagtagattagcagactctgtggtgtctcagaggacagaaggggtgggcaaaatgctccggtccctcctccccagccctccttcctcaggcagccagggcgtgctgggg

SEQ ID NO: 63470 - DNA, 1030 bp, Bovine  19866881158947
caccaacaaagcccgacggttactgcacgtgcccaggaagcggaaccttcataccgcctagcccgagtgcttggacggctgtcattctctgccctcatgctgctcccccagattcagggggtttggagacgattcctcctcccagcttccattccaaatgagaattatgctccatccatcacctccattgcaattattcccaacgcatctcgcctttccattccccatctgatcaccgattacgggctacaacatgagatatcttcttgcctgttgcttcttatttccgtaacatgaatgttgttaaatgcatgatgtccaaacttcccctaggagaagaatatccaattcctctattttccttgactttctcttccaattcacattacacatgaatatacaaacatcccctgagtagctggggcttattattctggagttctggtttctcttggaatacgctatcttcctcttggcttgagatcatgacttctgtgtgcagacatcagtttgctttagctgtgactgtcagcttctgactaacctggcattaacaacagttctctgttcctggcaaccctaagggcacctgtagccaggtaattcaatatatataacttcaaatatttggtattaatatttagtattggtattaacatttagtattgataatctgcttcattttacaaatgtcacaaatttatttttacaaaatcccaaattttcagactaaaagagatgaagtcaagaatcaggtctcatttgcaagatgggatgaaatgtgcagatcttgcttggtttatagaatcacaggctcttgaagcacaaaaaggcctaaaggcctctcccgctgcgcatgcgtggacctcccatcacaggagccctgccaggcgtccctgcagctcctgcctgcacctcctcctactgctctccaccccacgaggcagcccattctgttcccagccaaattccaggggtcaggaagttctttctgacattcaggcaaaatctgtttccggaaaatccaagt

SEQ ID NO: 63471 - DNA, 1014 bp, Bovine  19866881206199
tgttctccggaaggattttatttttatttcctttttgctttgctttttttaaacaaacccttgtatcaaagtgtttttttaagtaaatgaatagatgaatacgtaagtagcaggggacagctccaggagacctgaactaaatgccagagtatggagggaatctggactcggaatcaccttcatgcagaaggccctgcagagtgggaggacggtggggctccatggcctcccctcctccccagctcggcctttcccagtcactcagttaataagggtctgctgtgaggctcccagggaagcggagagagccagtgaacccacagacaggccctcagcagacggggacgcgtctcacccaggcccctgcccgccgccatgtgagggtgcaaacgtgcataccccctcacccagggagtgccttctcacaccagagaggtgaaaggtgcacaaggcgctggcattacagagccacgatatatttttttttttttttgcagtataaaaatgtataaaaagttccgaaagtcaaaagctttctcatcaatataggcgccaaaattcctgtggcagcaaaaactgacatgaactgatgtgagtctgtttacatcttaatttatctcacttagtgtgaacagtcaaacgtcttgctacacaacatttggttacagggtactgcccccaaccctgctggagaacttggtggtatacgaaccatactacctttcaataacccagaacattccaaacccagaacacggacgcggaagctctggaggaggagctgtggacctgggacacgtggtggcgagcgggctgggcagcacttctgacttcctgtcactcaagtctcagcctgaacttcaccttcttggaggtcatctcatcacaccacagggtctctccttaaccacagcagtaaatccaaagaggtatttgatacacactgtttctttctgggtttagtgtatctgtcccctgctctacccctcgcccgccacacccgccaacaacaca

SEQ ID NO: 63472 - DNA, 811 bp, Bovine  19866881219510
attaggcgtatatacctgacgtcaaaacaggctggtcttagtctattttccagttgattttcaacacgaaatggcaaccatcttacagaaaaacctgaaggaacttttcagccaacccaatattttggccacccagtgggggagggcggaagtgcctcctggattaaattgcaaagtcctgggtgctggaaagattacagggacagctgggctggggggggttggaatccccaggttgcagggctgtttctggtgcgcgtgccagctcctgcctcccctacaacgcctgccacctccttccacgacccgggtgcgcccagacttcaagatttctccagcagcgccagaaatgttgcctctgtctcctctagcccgcccccacctcacccagcctcctctttccctcttgtccgcattctcagagcttcggctcaccatgatttgagcagcagtgtcacctcgtgagcaggtgcctaaaaattctgcctctctgaggtgccggattatgtaaaaccaattaagcccctgcctttattcctttggcgagtcagccttcccgcatgctgatctgatttgtgatggagcggggcgggggctggggggtggaatatgtatttagggaagacttgtcaagagcatcagggcctctgaatcattcttcctcttgccccatctccccgtgtgtgacatattccatcactgctctcagtgccctacacggcaccctgagatgattcttcttccaacgcgacagcgaggcagtgttcttaaaatacatccctggtgtggggcctcggggagggccagtcca

SEQ ID NO: 63473 - DNA, 1105 bp, Bovine  19866881278781
gggaaatgggatccggaatccgatcccctggggcagagtggggaccataggacaggggcagggacctcaggaaatggtgatggagtggctcctggtgtcagctctgcccaggaccatggagaccctgagagaatcacttcccacctctgtgccttggcttttccatctgtataatgggagagtgggagatactgatctctgaggtctctttcaaccctaggtttctgggaatcttttattccaatctggttacagagaggcaaagggtatcatccaggcaggggattgtggtccctaacaaatctttttttaaggcttgatggtgataattgctcacctccccggccttgtctctgtgtcccccagccacactcactggctttcattctctcccatttggccacatttgctcagggtttgggctggtccctctcatctagaacatctttgccttcctcttctggatagctccctcatcctctctagaaagaccttcctgccgccagatggacttagaattccccagtccacagtgctactaattgccattaaatgatgccatgtacagtgcgttcagcggccgcctcttgtgccatctcgcagggtccgtgtgggctggccttattcaccagcacgtccgcaggatgtcctgtgtagtgcaggcacctggtccttatttgagcaatgtattgagatgctccccattcaaacaggaccagcgccttcgccaacctgcccatcctgctcccagggctgctggcaggccagtggcgcttgcctcttatttacctgcattgacctgagagtgactcagctccattcagcagagctgtctcctgccaaagccgttacagtttcttagctccaggcagagacagactgcagatggcttaatttagaagcatctcggaaggaattctttgctccacagctcttcatcctttgactctgggggtctgcggggtcatgaccacacgcgcttgaggcctgacttgtggttaggaccctcatctctggcggagctgctattttgggaggagagagtgtgcaggcgggcgggatgggagctgccggtttccagcagggcctttcccttactcatttc

SEQ ID NO: 63474 - DNA, 906 bp, Bovine  19866881405472
agtatggtttcagtgtgtctaccctctgatggcctccttaggagagcactgtcaaaggaagtgaaagagcaagtaggcacaaactggttcgggaacaaatactattatatctcggagtacaagaactggagaacttcactgggaatgttttaattcgtcagagtctacccttatggacagctttcttgaagaaatgtaactagcgcggcggctgcaaccggcgcatttagcacagctgaaaggagctaccccacatccgaggtcaggggcagaagccgggaggaccccatgcccaaggggaggcggccaagaggagttaccctacgtccaaggtcaggggcagtggccgagagtgccaggctgcgacggcgcaggaacggccgagaggaactacccacgtccgaggtcaggggcggcggccagaaggagctaccccacgtccgaggtcaggggcggcggccgggaagacctaccccacgccataggcataagacatccccagaaatagaaaaaggaagtcaataacactgcctgactcctgggaaaaaagagaggaaagagacttttcaatgaatcctttcaaattttgaatcatgtaaaagtatcatctattaaaaagtaaaacaaaaatatcctgaaatattaggtaccattcaatgtgaatggaactaaaaagtgactattgctaacagtcattgctccccttaaaatacttcagcagctttccacttccccttgagataaagactagacctcctggaggccctgcgtggtgtgccttatccctccttccattcccatccatcctctccacagcagccacgctggtattcttgcagcttttctaaaaaactatagtctgactctcttctcaaggtttttacataagctagacattccactttg

SEQ ID NO: 63475 - DNA, 1554 bp, Bovine  19866881407399
tctgggagttggtgatggacagggaggcctggtatgctgcagtccatggggtcacagagagtcggacatgactgagtgactgaactgaactgaaatttcagtcatgcgatcttcatcatatcaaagctgagagttcaggattttagaaattatccagtttgggaaattcactgtacaggtagagaaactgggcccactgggattgagtgacttgctcaaagtccaatagctaaggggaggactaatataggaccaggtcttggaactttgaagcagtgctatgcttccatactagtggttttcaaactgggttccttaaggcaccagaagtccttagaaatatcatgaagataaggtatgcctcaagaataaagataaggaaagggatggtcagagagtagatcctcaggccctcttcaaccaaaaacagctctatttttactccatttatattgagacttgagtagttgtcttttaagaagaggttctctgcctctgccaaagtttcaaaaacctctgtgtgtatactaggcacattaaataatcatgagaggcaacaaacaaacaataaaaatcccaaaacaaaacctcacccacaatcacagtggtacaaatgagatctttagagatactggttagcaaaacccaggttgatacaaacattctgtttcctgtagatggttgcggtggccgggaggaggttaggacaagaactgcctacaacaaaacatagtctagaaatctgcatctgagctcacttctcaaatatagcctggcaattataggctctgggcacaaggaggaaaagaaaagcctgtcctaaaatgtatttctggcatcatatcaggaaccacatgtatttacaaggaaagcacacactccgtggttgataatgatatgcctggaagattggatcctagtcctgattaagttcttcagctacacaaataaaatctctccattgatcgagaccaaaactttcagttaccactctccaaaatgcacgtttcccagcctagtgaggcaacgccctcaatattcaaaaaaagtaaccagatcaggattcagaaagtagaattcaacaagaataaatggattaaaagctggttgtgaaaaagcatttgtctaggtctgcaatatcaatattaaaaagtgatagaattttcataaacacacttcttccactccaggacagtgggtgaagagggaataaagccccagaggagtacattcttttagctccctaactttctccttctgtcctccaccctccaataagttgattagaaagacatacatactggaacttccttggtgatccagtggctaagactccctgctcccaatgtagggggcccagattcaattcctagtcagggaactagatcccacatgccacaattaaagattctgggtgcttctaggacctgttgcaaagaaagaaagaaagacatacaaaatgtgtttatatatcaccttggtcccctcaatgggaaatcttacttccactttgcttgggtcattttatttcactgcagttcagcatttctgtga

SEQ ID NO: 63476 - DNA, 1290 bp, Bovine  19866880037003
atgaaattaaaagacgcttactccttggaaagaaagttatgaccacctagatagcatattaaaaagcagagacattactttgccaacaaagtttcgtctagtcaaggctgtggtttttcctgtggtcatgtatggatgtgagagttggactgtgaagaaggctgagcgctgaagaattgatgcttttgaactgtggtgttggagaagactctgagagtcccttggagtgcaaggagatccaaccagtccattctgaaggagatcagccctgggatttctttggaaggaatgatgctaaagctgaatctccagtactttggccatctcatgcaaagagttgactcattggaaaaaactgtgatgctgggagggattgggggcaggaggagaaggggacgacagaggatgagatggctggatggcatcactgactcaatggacgtgagtctgagtgaactccgggagttggtgatggacagggagacctggcgtgctgcgattcatggggtcgcaaagagttggacgtgactgagcgactgatctgatctgatctgattcacagtctcattgtctagcccagcaccataaccacagtttcaggtgtatctgacactttccccttgagtaaaatctctagcctaatctctagaccacataaactagagattttacccaatagactgtgtgaactccctcatatcaaagcctgatgccgtgctaatttttttaaaataagagaaaacaattataaatcaagttgttttttgtaaatctaattcaagattcccttgtatggagagaaaataggaatgtttatgtttaatggaggctataatagtaactgtcagatgtagactaacagaaactattggacagattctatgtgggaaataaagtactaacatattgctttaagaatttgcaaaaaaaatatagactactacaatacaaaaccaagaaacaaagaaactccaccagaaataattaaatgactgtgggtaatagtgtaaaatattcttatttttctatctaaattgtatttgttcatatgaactattgagataaatacatctatccatgtgtctgcaaagagacataaataggtcagcatgatttggaggcttttcaaagcagagaatgcaaaataattctttttttttttttttttatctcctgtttctcgaagttcttaccagacttaaagagaattgaaccttgagtaatagctctattagagctcttttccaggagccagttcctgtggtctcttctgggtccagctgctgatga

SEQ ID NO: 63477 - DNA, 741 bp, Bovine  19866880187430
ttgaacctgtggtgttggagaagactcttgagagtcccttggactgcaaggagatccaaccagtccatcctaaaggagatcagtcctgggtgttcattggaaggactgatgctgaagctgaaactccaatactttggccacctcatgcgaagagttgactcattggaaaagaccctgatgctgagagggattgggggcaggagaaggggacgacagaggatgagatggctggatggcatcaccgactcaaagcacatgagtttgggtaaactccgggagttggtgatggacagggagcctggcatgctgcgattcatggggtcgcaaagagttggacacgactgagtgactgaactgaactgaagtactttcatgtggaaatcaaaaataacagaacaagagcagactagggagaggacatttttcccagtaaaattttccaaatcaacactttcatccagtttctgacatcagttctttgagtgggcatcatctacctaatgcaaaacatggagaatgtggctttgctttgttgagttgcaaagggaaagagcttttgttcagagctgtagacaagtcagttcagtccacataatctattttctcctttaattctgaaatgcagcccatgctcatttggtagtgaggtgttgtacaagaaatgtttttcttctccttctttaaggtgacttcacatcaggtttcaagtgtgttacttcaacctcaatgcatgggggcagg

SEQ ID NO: 63478 - DNA, 1934 bp, Bovine  19866880343217
tataaacatttatcggagcagtaaggattttggcacagtttatcctcattattcatggattctatatttgtggatttgtctacttgataaaatttatttgtaaccctaacgtccacctgatgggaatagctaactcattgaaaaagaccctgatgctgggaaacattgaaggcagaaagagaagagggcaacagagaatgagatgtgtgaatagcatcaccaattcaatagacatgaatttgagcaaactccaggagatggtgaaggatatggaagcctggcatgcagcagtccataggggtgcaaagagttggacttgacttggtggcaacaacatgacttgaacaacaacagcaacatccacctacaaggacacaagagtcccaatagaggaatcctccagagaatggttttcctagaggttttatttagtacacaatgacaattctgcaagctcaggaagagcattgaaaggtaaagaactaggaccccagttcagtagttttggaagcaaagcatccatgtaaatgtcatgatttgctggcacctaagcaataaggcagaggaagcagagatcaaattgccaacatccgctggatcatcgaaaaagcaagagttccagaaaaacatctatctctgctttactgactatgccaaagtctttgactgtgtggatcacaataaactgtggaaaattctaaaagagatgggaatacgagaccacctgacctgcctcttgagaaacctatatgcaggtcaggaagcaacagttagaactggacatggaacaacagactggttccaaataggaaaaggagtacatcaaggctgtatactgtccccctgcttatttaacttctatggcagagtacatcatgagaaacacaagaagcacaagctgaaatcaagattgccaggagaaatatcaataatttcagatatgcggatgacaccacccttatgtggtgcagaaagtgaagaagaactaaaaagcctcttgaggaaagtgaaagaggagagtgaaaaagttggcttaaagctcaacatatagaaaactaagatcatggcatctggtcccatcgcttcataggaaatagatggggaaacagtggaaacagtgtcagactttgttttttggagctccaaaatcgctgcggatggtgattgcagccatgaaattaaaagacacttactccttggaaagaaagttatgaccaacctagatagcatatttaaaagcagagatgttactttgccaacaaaggtccgtctagtcaaggctatggtttttccagtagtcatgtatcgacatgagagtaggactgtgaagaaggctgagcgccaaagaattgatgcttttgaactgtggtgttggagaagactcttgcaagtcccttggactgaaaggagatccaaccagtccattctgaaggaaatcagacctgggtgttctttggaagaaatgatgctaaaactgaaactccaggactttggccacctcatgcaaagagttgactcattggaaaagactctgatgctgggagggattgggggcaggaggagaaggggacaacagaggatgagatgggtggatggcatcactgactcaatggacatgagtctgggtgaactccgggagttggtgatggacagggaggcctggcgtgctgcagttcatggggtcgcaaagagtcggacacgactgagcaactgaactgaactgaactgaagcaataagagagatggaaagagaaagaagtttgggtgggttcatcaagcagggaggagaaaattgatccaaaatgtgggctgaagttttcaaagtgaaaatgtctttcttttttgtaaatccagatagtcatgttatatatcagctcgtatactacttctctgtgtgtgtggtgagaatattctcttagtaaatttcaagtata

SEQ ID NO: 63479 - DNA, 4248 bp, Bovine  19866880410603
ctaaagcttaaactcccagtactttggccacctcatgtgaagagttgattcattagagaagactctgatgctgagagggattgggggcaggaggaaaaggggacgacagaggatgagatggcttgatggcatcaccgactcgatggacgtgaactccggaagttggtgatggacagggaggcctggcatgctgcagttcatggggtctcaaagagtcagacacgactgagtgactgaactgaacttgaacccatcattttaaataataagtgaccaaacatagtgatagggcttcccaggtggcatgagtggtaaagaacctgcttgccagtgcatgagacattagagacatgggttcaatacctgggtcaggaagattccctggaggagggcatggtgatccactccagcgttcttgcctggagaatccctggagagagcagggtcgcaaagactcggacatgactgaagtgactttgcatgcatgcaaatatagtgaaattaaaatgctatgagtgaatctgaagggtacaaggggtggctcaaaacagccctgcttttctctccccatctcctcttggctcttactgttctcatacagcttcttaagtgagagcccaaaggtctgagctagtgctgaagcgtgtgtgcagtcacaatagagaaggctgccagaagtgctggagaattaatgccccctctcccccgccccagaacaacaaattcttcaaacaatgacaacaaacaacagcaaaagtcttcaacaaatgatggataagagctgaaggataaacaccccagctttctatacttctggttagaacaactcacagagatgaattacatagtccctcagaggtcttcatcaggatggaacttcagttgccaataacagcaatctgctcattaatatacctttcttgactttcttccccatgctgactcacttccctactttcccaccaacgttttcttgaatcatttgccaaaccaattactttcactcaaatccttgtctcggggtctgtttcttggggaaactgatctaaaccaattttgcagaagaataggaggactatcaacccacagaaaaatcaattgggagatatctaccagaaaatatgtaccgcagataaggtgttttaaaagttttaattaatattattcttaatatagaaagaatgtaaattcccacaattaatcatacaaaacataattgtcaatattgagagtagttaaaagagacattagaataggaagagattaatataattttttaagcaaaggtgaaatattagatgtgtttgtagcaggagatttttcttctgggaaaaaaaaggacatgctttagttaaatatctgatttacattttattcttttgtaaaatcagggaaattaatgatttggataattgttgatggggcagaagcttttggcactaatcattgacaaaatgtgtttcttctaagatttgttacaaaagacttttctgtgttacaatcagcaggtcgaacataaaaataatggtaagaatcgggcactattggatagtgtgtagttagaaaactcactgttaatcaccattcatttatgcatttcttgaggatgctgtgcacacaaggatcttctttttagttgttatttagtcgctaagttgcctccgagtctttgcaaccccatggactatagcccatgaggcttcatccgtgggatttcccaagtaagaatactggaatgggttgccatttcctccttcaagggatatttctgaatgacccctgaaatggaaagagggatctgaatgaaaagagttgtctcctcaattttagtgctgctgccagaccaggactgaaagcaatagaggcaaaggactaatggtccctccaggtggtccaagaagtgacctatggacaaaaaccccagagcctgaatgtcctcaggatatgcttttttcaacctgtgccacactgcacttttgctttctccacaaaagtgaaaccatggcttatggattacctcccttccttctaattaaacatatgtaactactcactaatattttaatatttaaaatactcaagctaaaaacaattattaagcaattcaattcctttccctcaatgaatagaaaacacttcattgcatttctagacaagcatgtaagcaataagtttgctagagtacttacaggacaatcataggaaacaaatgcccaaatccaattagtatgccagtaaacacttgtcacacaaggcaacaataataattacaacttattatcctagaggaaatataaaaaccaagaggtaatcaaaatagcccaatgcactgtagagaaaatctaccacattcatttctttgcattgtcaaatatatgatcctgaagtttttttaaaaagtaagagaatccttcaaacaatggatagtcccagtggaaacatttttcaaagtctgttctccaaactttccttatattttcaagttcataaaaaattcccagtaaatagattttaattgcacttaacatcaaattaacccttccccctagatattccatattacctcatgaaatagaaaacaattcatatctagcttgcctctaactggaagccacagtctaagattctatttgaaaaaagcaagaagtcctccaataggttagggtaactaaggtaatttaaatatgggtgaatacaggaaaaaattcccagattcccttactttctttgttgaaacccattcttttggaaaatcattttgtttaggctttggacaacaaaatgcatcgtcaagaaattttatagcaataattataaaagatgtccatttgaacccattgaggtctcactgattttataacacccagcagacctccctgcaggagaacactatatttatgtgagcaatatatgcgacaattgagatcgtaaaattaaatgaccacatagaactgtcatttatatgatgagcgcctacatatgtgatggctggtttattttgcagcgtcaggttgcgttaaatggtccactctcagtgaacggttttaatcacgcatttcttcactctttctgcaatattacacttgaaggactagtaagcagtttgctatgaaatgctaaatggttactggcactgctattctgacagaagagctcactaaaatagaagtacagtacatattgtatgcaattgttttatgagggacattatggttactagaataacatttcacaattaccaactgctgagagaaaagtcattaagatatttggcgagccagtgcaatttttcaacagagctatagtacaagaccttagaacggcttccatagggggagacaggctgtttcacaagagaaaaaaaataagtctcaagtctctgttgtttgatttataccatgttatcttcagagtccagtgaggaagttatagaatgttgtcaggagtgtcgaatgatggggaatacttacataaaatatatgtatattcatatacaataatttatggtatatgtgtgtgatcctggtgtgtgtaaatgattaacctcttgtgataattgttaggacaatgtcaatgtactaaaactcagcttttcctggggaaatactttggagattaacttgtgtattttatacacctaatttcttttttttttttttaactgaaaagatatttatggatgggggaggtgagagagtagagatccacctgtaaacattttacccaaataaggaggataaaaataagtagtttgctgtaagcattttatgtttcctgccaggactattagtggttaaaaaaaagtgatgataattttataaatgttgtgtgtagatatgtatattttatgtatataatgtgtatacttgaaatatgaatatatgtatgcatataatatatataagatagatagctttctgatctctgaactgacaaggattgtcctctgttactgccaatgctacttctattacttctatttttaaagtcgggaaaaaacaccagcattcaccgaaaacaaatatactctggtctgtgcttctacagtaacaaaaatagaccaaattggaattatcgatttggtatgtcagtatgtatgtgtgtgtatggataacagtgaaggcaagtatgtcagtgtgtatggataacagtgacatggataacacactgttgttaacagtgtgttatccactgttatccatggataacagtgacagtgtatggataacacactgacagtgtgtatgg

SEQ ID NO: 63480 - DNA, 2594 bp, Bovine  19866880438151
ttaaaaaaaaaaaaaaagaagaaaattctcatggcatttgattaattatattgcagaaaccatatctacttctattgtgaatatgaactatcatgtagcaaatgttaatcattagtaacgggtctattccacaactcacagtgaaaactatttcagcaccatataaaagacatcatattatccatgcagcttgccaaaaaatgaattgatttggcaataaaacaatttctatttacagtctatttacttccttttatgagactgactcaatattttctgtttttttccttctgttttattgttttgccaagaatttttttttgcaagattttaatccttgctaacagtttgtacttagctatgttgaaagaattaaaaatatttacacatcgtcaaaatttacatacctcaaaaaagtactatcttttgaggttctgaagctacttgttttaataggaattagtttttattcttatcaactattgcctaaaattgaaatcttgaatatattttgacactacatataactattgcttttatttgaaggatactttgatatataaatgaaaagcctatattttctggtctctacatagtaaaaaaaattatatttatacagttatattaattccagaatttataattataatattttaaaatcattgaaaataaataactgaaaagaaaaaaatagagtcaacaccctcatgcaatatacctactgttctatggaagcaaatgaatagctaaaatactagttgccaaatataatcttgaatctgagcttacacataggtgggagggcatgaaactacatttagtttctttaaaaagtacacgctttcattttcagcatccacagtttttattatcaccataggagtagagaggcataatgtttggggtttcttttctttcttgtttcttattcttttttttttaacttcttttaaaatctcatgcctgtgttttcttttcctttgcagttcacccagcatagtgctttctgaaaatacacatgtaattcccattatctataatgaaacttgcatgcatcaagaagagatcagattccactgcaaagtatgtttcttgtgtggtattgtgagcacctggtctacctcatgacaaactccttggatactttgtttatactcagggaaggacattctcatctacaatatagaaattctccagatggccacctgtcttgccacatggcaaaatcatggtactttattttctcatgtagacaaatatttttacaagaactctggagtgtgcttcatgggagaattcagacgtggatcaaaagcaactggtgtacaaacgagcatcaaagaaaatgttgcgtgtacttagtgtctagtactcatcattgactggggataaggaacaacccttttgtcaaatttagaatccaattatatcttatattctaaatttagagccagtttcttgtctttggttttctattttcaataaccaatatcagaaactctgcatttatcacagatgaccagtcaattggaataattgttttctccaatgtatatgccacttacaacatcactggggatttatagttattttttacaatgaggaaactgatgcacactgttttagaacaacttaaatgagtatctgtagccacataaactgacggcagagcctatactaaatttaatggtaaaaactaataattccatttgctgcctgttttgcttaaatactccttggtctcaggggaagaaatcccaacgaggattcccataatagctttgcctttctaaactgtttatgtcagttcagttcagttcagtctctcagttctgcctgacactttgcgaccccatgaaccacagcacatcaggcctccctgtccatcaccaactcctggagttcacccaaacccaagtccatcaagccggtgatgcaatccaaccatctcatcttctgtcacccccttctcctcgtgcccccaatccctcccaacatcagggtcttttcaaatgagtcagctctttggccactttgagtggccaaagtattggagtttctgcttcaacaacagtccttccagtgaacactcagaactgatctcctttctgagtgatcagaaaaggactgatcactgtccctttggttggatctccttgaagagatccaactggttgttggatctccttgaagtccaagggactctcaagagtcttctccaacaccacagttcaaaagcatcaattctttggtgctcaactttctttaaagtccaactctcacatccatacatgactactggaaaaagcatagccttgactagatggacccttgttggcaaagtaatgtctctgcttttgaatatgctatctaggttggtcataagtttccttccaaggagcaaacatcttttaatttcatggctgcagtcaccatcagcagtgattttggagcccagaaaaataaagtgacactgtgttccactgttttcccatctatttcccatgaagtgatgggaccagatgccatgattttagttttctgaatgttgagctttaagccaactttttcactctccactttcactttcacca

SEQ ID NO: 63481 - DNA, 1393 bp, Bovine  19866880446434
aatatcttcagattatctcttcgcataggcaatgaggaacacgggaggttctatccttcaggtaattacaggcccaagattttcacaacaaatttaaatttacagggaggtggtgattgttgggccaagcctcgttttttaggagaaatggaacgatccagatctgtccttggagttgttttcctctgacctctgcccctatcccaacatatatcctgagcctttcctacaagagggaacagttttcttagacatactattggaggacaggaaagagcagctttgtgtcatatcatagaatggcccctagaaggtagcacatttcctgaggaggtaaactttttatggtttaatttttaattgctcactcaacatctccacctcaatgcccacaggagcctcaatgtctctatgccccaactgaaaacgcccaccttctccatctctatggtacctcccttctcccagctactcacttcaaaacttcaatgagtgagagcttcccaggtagcaaagtggtaaagaatctgtctgtcaatgcaggagacacaagaaacatgggttcaatcccagggtcaggaagatcccctggaggaggtcatggcagctcccaccagtattcttgcctgggaaatcccatggacagaggagcctggagggctgcagtccatggggtcacagagtaggatatgacttgactgagtgactgagcatacacacacacacacacacatacacagtggagagaagtgatctggcagacactgccttacccaaatgctttgaatgtcaggatacatgtgtggtggtcggagaataacaggaataaaaagcagaaacttccttttaaagcattaaggaggttgggctgaaaacatccagtctgacatcaactaatcccaggtagctacaaaatgactggtttttttattttgcttgtaatgtgtcctcaggaaatttcaccaaatgaataactaaaacaagcccatatgggcattcttgaacatctctagtctattacaatgaggagagcacctgtttaaaaatagtctgggtgataaatcacagaaggttgcattaatcaaggtagcctagagctgataagtgcaattatgggtttgtcaccccggggaaacatcttgatcagagctcctcaaacccagtataaaccctcaaatttttgcccaaagacgcatgtacctaatttggggacttagcacatcttatccatagggtattgaaggccttctggcaaggccttatccaatatccacagtaatgaaaacttattctggtgagatctattaatggcgttatgatggactacctctacaacaaggggcagcagtcttcacacatcacaggtgaaaagaaacagaaccaaaaaccaagc

SEQ ID NO: 63482 - DNA, 814 bp, Bovine  19866880568010
aggtcttttcctttactttcctaaacatgtttttcaattggtttcagttgatttagctgcctcaagtggagtacagcaaaagcataactgccctgaatatgacagatagctagcagctgttgttgaaaaactgacactgcattggaactgtctcaacagaaaagctgtgctttgcaaaggcaacatgctctgaaatatttgtgtctgtgatatgcttttgcatgaagtctctcctgatggaaaccctgagaaggtgcatttgccatcttcagtttttgaatcatgaaactttccaagaaagcaaagtaaaccaagagatgttatgtaagtttatcaattcaggctcaacattttctacagtaatttcatagatatttttgtttcctatactgtatatcacaacagactctatctatgtacgtttgaattcactttatgatttttggcctgatgaatgtgtcattttcatgtaggtagataatatggcaatatgtaatgttaagtgggtctttgggaagaaaatggaatttataaaaataatctaatccatttagatatttttcagctcatcttggtgatcttttaatccaagctttttcttaaatactgtatttgcaatttaagcactgccacatgctgccacccgctgttacaaagatacattagattgatagaatgatgctgcattctttatgactggagaaaataatgacttcctctgttctctctaatcatgtttttatgggttggtttccaaaatactgcatacttgaccttaaaaggggataaagactgcacatttcatttaacgagt

SEQ ID NO: 63483 - DNA, 1938 bp, Bovine  19866880641329
aagccagatcagacttgctgagagcaggtgcatgttgaatacacacagaacttccaagacttgatgccatgaccatttcacaatggacctgtgaaagagttaccagggtgccagcaataagaagctgactgatatccaagctgactgatatccatgatgaatcaagttttctacctaattattaagatccttcttcacatatttgaagccctatagtaatcatgtatgtagatcataaatattttgcagtcagtgccccatataagaggtctgtctataataccttatctctagacctcttgcaaccaaccttccaaatgtgtacatttcaaatccaagaccatctcatcaatccattagctacagttcatgaatcagatacatctacactcaggccatccttccttccatgcaaccacatggatcacctaaagtcttgtctattctggggattccttttcaccactgtttttcagagccaactgtgagaggagctatagttcagtagctgcccctttctggctcatgccaattctaacagtatgaagcagaagaaagcagaatcctatcctgatacttaagccctgtaactatcctgataatttctaatttttttcctcagatgtataaaaagtgaaacaaacacacacatcactctcacacataagcccataccagctttgtccctgaactagatcctattgtttcagaaacatttcctatcaggcatcaagcattaagagtcaactataaattaacctttctacagaagtagaaaaaggcagcaataacattcctaagatgtacacattttcttaaaaattaaacattgttttagagctatgttggtttccctcccccatttccatcacaagcaaacttactcttactggaaaggataaaactgatgtcaggaaaagtaaacagtcctcactcatgtaaacaacctcatctgtaattcattaactctgctgctctcagcctcttagaaaaagtgtctcatttattagcttccaatcccaagttcatgtttgtcttccagttcaggggtattattgagcagtaaagaaaagagatgttctattactgatgacatctcatacattggagttaccaatctcacccccagtgatgcaggtttttaataaataaactcttttgatctctgtccgactaactatcccactctccacattatttatatgccctgcccactaaagaaagtagaaaaacacatttactgaggcaccccactccaattgaaatagcaacagccactgaagaacagcaatgcctctcacagtgagcaatgctattggtatttgacatgattttacttagtaagcgagactactgatgccagatgatactctagccaggaaaataatgatattaaaaattataataagaaaaattgtttccttttacattttccttcaatcctttacaactattagagaaaaaaaaggtctcagtttggtgatagtctttaacacctaaggtttaactcagagagagcaggcttcatgctcagaacacttggtgggcaaccacatctaacaagaacttattgtcattattctgtttttgttgtctatttatgaaaagtgtacagtccgtttagtagagagagtgaggtttctcttttgataaacttatgttttaaaagcaagttattttaagcaaaagtgttaagcaaataatagtgcaggtgatacgtaaatacaatgaacatttcaaaatgggagtataaaagaaagaaatattgaaaacattgcaaagtaaaaaaaagacataactctttatggatgtcatccagaacgtagaaattactcaatatggcaggtgtttgtgtctggtccgtgtgtgtgtgcacaggagaggatctaaggttctgaatcttcctctatgtcccatttccacatgatgaaaatatca

SEQ ID NO: 63484 - DNA, 903 bp, Bovine  19866880681960
caaaagatacctgaattgagcctgatttactaaaagaaaaaggcatactagtgtgagaaagcaatgatttttttctttttttttttaattcccaagttaaaacagaatgcatttaagcataatatatgtctgtgttttaaaatgcatatggaattctgggtttggggcagggagacatcacttgatttcactataaatttacccatctggatactagaagtgagacatttattgtttactcattcatccaatcagagaagataaatttttcaaattgcagttatatcaacagatacagcagagatcttaattagttaaaaatcttcataagtgtcatttggctgaacgaataaaataacaagagcaacaaaaatatctccagccacacaacaagccatctaaaaattctctggggatctattcctcacttctatagcaaagtaacacatgtaactctaccacaaatctaaaggcaaatagatattcctgttcactttttcttacaagaaagcatctgcttacaattttttttttttttggtgctgttatttttctcttgaatgtttcaattcaaaaacatcaccctaccacctttttggcttgttaaatctctctgtccttagggctacatctctatgcaccagagaaacgatctcattaacaaagtagttctgtgcgtccttaatcctgaggccctagactgcagctggaggcagttctctactcagcccgcagtgccgagtgacacaggcaggcgacatcatctgagtactaacttctactacatccagacagactgcgagaaccatttccaaatcgtgggaagacgtcagagaaccaaaggtaatccttctgtttctatgtccaatttttgcagcaaagatttccaccggaaggaaccat

SEQ ID NO: 63485 - DNA, 1582 bp, Bovine  19866880684968
tatgttctgaaaagtgcaccagtagtagtatataggtatatataatcattagatgacaggtataagatgctttgggatgagcagaattcacattaaattccagcacgtaatacgttaagttttgaatgtagtcttatttatttaaatctgcattctgatggtctgactttcaaagaggtaacaaatatctgtgatccaatgattacctattcaaattaacccagcttctttgaatatgatctaatgattgaatgatcctccaaacactgtaagtccttggggaaatatactgatgtccaagcacattttctcaaggcttggagaggactagatctgccaaggagttgccttgaagcatggacactctgctctacctaaacacaagtcctaggctttaatcacaatggctaggttcacactaaagcaattaaccatatgattgctttcacaggagcccaacctcatcagtatctttccttcaggctaactgacaagactgggtgtagtcaatgtagtcaagtgaatctgattacctaagaggtataaatctctcaatacacaaatacgggtaggactattcaccctgaatctagtttttagaggttgcccttttataatcaaccctatagatttaaatgatcagggtaaaatatttatgaggccagagttggcaagttttacaaggaagattgcgaccaaataacactctgctatctagattgtggggtttttgtttcagtttgtttgttttgatctttttagcaagaagtgagtgagctctcaaaatctaaaatagtaagatttactttgagaatttgaaagaagtaaaaatgcccaagaaatataatttgtaatttaatagcaactttagacaaggtttgaagtgtgtgtgtgtgtgtgtgtacacataaacacatatatatatgtatatgcctgtgcctttttttaggcttgttaaatcttgttacttcactaatcattgctggatttggtggtatatcaagtgtgaacttgaaactttctagcatcctcttcttggtatcctattgggaagttcttgccagcatgataacaggatttttggttactacccactagaattatttcttcaaaagtgttttcctagcttaaaagctgaatataagatctgagcaatgtaagttttccaatgggtttgtcatttctcagcaattttgagattatcataaatattccttaaatgcagttaaaatacactagacaccaagtgacccacctcccacactaaggaattcatgcttctggtaggtaggtgccagaaatctgggaggttatgtggtctgatgggcctcactgggatcatatcccattctagaatgccaatgtacatgaatgctatgaaaaacttgttggaatcatgaaactgacttcccaaaagatttctgaaattgggaattcaacagtttcatcacctccactaaaaaaacggtaatccatggaattttagtcttgatgttgggaccctcttaaataaaaacacaccaataacatgaagatttttttctttagggggttaaggtagtttgtcttgaatcaaacatga

SEQ ID NO: 63486 - DNA, 709 bp, Bovine  19866880709521
ggacttatacattttttaaaggtcaatagaaactgttttgtttaaccctattatcatacttcacacagctgagctatctgctttggcctgagggaagtgtcaaaatgtgaccgtaaaaattgactatctttttaaaaggaagatataacacagtaagttttgaaatgtgattgagattcatgtctgtgatattttgctcttttcattacactaggaaggacttctaaaattctagcctttaggagccttcaataatattcaaaaagatgacagtttctttaaaagccttcaagaaaaacaaaaggaagatcagcgaccataagctaaccctgctgctgctgcgtcgcttcagtcgtgtccgactctgcgaccccacagatggcagccaaccaggcttcccgtccctgggattctccaggcaagaacactggagtgggttgccatttccttctccaatgcatgaaagtgaaaagtgaaagtgaagtcgctcagtcgtgtcagactctagcgaccccatgaactgcagcctaccaggctcctccgtccatgggattttccaggcaaaagtactggagtcgggcaccattgccttctccaaagctaaccctagtggcttgaattgatgtccttattctactcagatcacaaagtggtagaacagcttctaatcacgtatcagtctcttttttgcaggtagaaaattcatgca

SEQ ID NO: 63487 - DNA, 1078 bp, Bovine  19866880790090
tgagtggattcaatcttgaaaaaaattctgatgctgagctgattttgaaaaatgatcttcttccatgttggaaaagtttaaattgccagtttaagcctgttcaaactatttttatcacattcttagtaatttcccatggaagcatttctaaaggctcagcaaaacatttataattttataaaaccttttaaattaatttataacttagctatgagcttcttttggggagactcaaaacagtaggtgaccttatatccataatgtgtatacttaaatgttttattacagcagagtgaattaggatggaattatttaactttccataccaacgtttcatttaactacagtcagcttggtgctttacataaaccgatttaattctattttatacaactgcaaggtcgtttttgtatgttctaactgttttgctttattttcaactgtagaatggctttaggtagggagtataagaaaatactgaccaaattgaataattctcttggcattgtatcccattagacgtttaagaagatcaatgttttctcctaatcttgattagtgagacataacatatacctgatttctcctcctcttagtccacccttttttatctcagctgttaccatgacaaccaattgtgtgctggtataacctgacagcacattgctccagcccagtcatatctcctttactttctctcccagagcttctttacgtacatttacctttcagttctgtttgtcttctaataaatgtttacagggctgtatattttcctctgtgtagcatttcaagcacattcacatgataaactggatagatttctaactagaattcattattttcattagaattaattttagctttgatctcccaatttaacccaaggggttatgtagaggagtcttcttaatatctaaataaatatttgcctttatttgtgcagtccactggagaaggaaatggcaacccactccagtattcttgcctagagaattccgtagacagaggagcctggtgggctgctgtccatggggtagcacagagtcagacacgactgaagtgatttagcatgcat

SEQ ID NO: 63488 - DNA, 888 bp, Bovine  19866880853901
atttttacttatattgaaaacccttcatcaactgctgtttgtttctctttggtaacatcagcaactccgttgaatctcggcagtcttagcaggatatattcctttcccatgttctcctattctatttcctgcagcgtctgatgtaaaacagattttaaagttcatgatagaacagaggtcaacatgaaagactctaggatcctggcctttggtttttgcttctggtctttattattataacaaatagttagttgaactattattttccatgtcatgaaaaaatattagaatgacagccctttctttttaatcatagatcaagattttcaaatacataagaacagatataagagaaaaaactacaacagtatcacaagataaaaaaggaactggaacattcttaagtttctaaataaacagcaagcataccatcaaagtctaagctttgctccttctctcctgttttgatccagaatgtgtcttcaaacagtcttaggccaatgcctctgcctgtgctttagattctacttcctgctgcttcatctgggaacatatactgaacattttctctttttccgttctccctttcaaaacaacacccggccttgtcccatctctacagtacccacagcttctgcatgactctcttctcttctgaacagccacagttctgtaccgggtggccattctctgcactccattctcatcttcctctctctcctttttaaaaatttttttcttaacccattccagtctttctatcagcaccactctgatcacaataaactgtggaaaattctgaaagacatggacataccagaccacctgacctgtctcttgagaaacctgtatgcaggtcaggaagcaacagttagaactggacatgga

SEQ ID NO: 63489 - DNA, 1254 bp, Bovine  19866880873366
ctcccattctacttctcttattccccaggcccacaggcagggtaagctcacagctcctttgagcactgcaagaagctagatgctgtgaatgcaaaccaaatgtcattctcatattagtcctgcttagtcatctctaccttgccaccttattctcctgctgggggtccccactagcctgaagatcatgcaagatgccacagtgcaagcaggcactgctgatagtcagataccaccattactctgttggactcgccttttctgggctccatcaccaatgtcctatagctgtcaagcagtccaagactctgtgggggtctacagtaaaaatggcacatactacagccctggatggatgattagctatactgctctttccctaatgatgtacaagcttttctgtcttacatatatatatttatatatttagggtaggcaagtttgataagagagggaaaagtttttgtttcactgattgatgagttcagtgagagttcagtgagattggctcctgggtggacctcccagggggagttaccatactgcctgtgacagctaaggctcccccactagtcaggctcacaagttgaattctctgagaagctcttaggttgccaacatctacagcccatgtctgtatctcactagatcctttgtacagagtcaaattcacgtattttcctgacatccacaatgttgctcaattccacacgttcaaaccagtgcctcacaaatctgaaacacgatccttcttgcttcccagataatcctaactttgaggtcaagttgcaagtcatccaccagagaagtctgtttttgcctgcatcaaacttgccaactgaggccatacttctgggtcgtctcaaaaataaatctgctcacatcaagccctgtagagaactttctttggaaatttcagatggtgtcagcaaagtcaactgcaaatgtcaacagcaaatgaccctgctacctctcacctctggttctcctttttctgccccctctccctttggccttgacctcccagactgctgactctctacacagaaatttgtcttctggtctctcattctttccttatatagaacaatttagctccttcttaattcacaccttcacgtgctcagcatgggcaaacattcaaaatcaccctcctccgagggtggtgtcatctcactttgccctcagaaaagtgtttgccacactgctctgcaacccttaggtaaatatacagatacacaatgaaaattttttcta

SEQ ID NO: 63490 - DNA, 1302 bp, Bovine  19866880904681
aatactaaatttatacattgctacattactcattactaaaagaatttgcacaacttactatgacaaactctgtagctgacttgtacctgttatttgatgaaatggcaagaatataattactaataaattcaaactactgctcaactttatttcacaaggcacaaccatttacaccaagcaagtgtacacaaacaagactcctatttgcagctggcattaaactttaagagcagttgactttgttatctagatccaatttttaatgctcactgttaagtttctttcttttttcaattttcaaaccaccagaggatgatttccttaagaatgttctcccaggtatgttcagaatattaattaggcccatctatttctgccgggtaataacaatgtcacaggctgaatggacgctgtgacctgtgaaagaactattcatatgctttcgtctgccccagtgcattctttaacaaatgaacatagacctttttcacagtcatcttaaatgtttcaactctgtgtttcatgtttggctcttgcatctccaaccatttcttttctgcctcttttgggggaagacttccttgctactcatttaaatgcttctgcctttatgactattttactaccatacctatggggcttcttactgtatttgcctgtaactgaaggagattttaaagaaattaaatttattcagactaaatcttctgggggatgcaaaggcatcttaaacaattagcaataattaaaaagcatctattcagactggataaaaggtaaatagatttcatttaaatatagtggttagttggtacagttttcccatttgtatgctttaaaaaaaaaaaaaaaaacaactgttagcaaataactttgaaatagcaaaagaaaacattggtttctgtcctttgtataattttttttttttactcatgagtaaaactcttaacaaattgctgtactaaaaattttaattatctttaatttaggtggtatacctaacactgaatatgatatcaagagaatggtgcatgaataaaacctagatttgctttttaaattaatccagaattagtgtggaactgcttaaaggtttacggttttttgactgatttttttttgtaagttttgttcttatatttatctgcctcaatgaaatatttgctttgtgtattctaagggtaatatgtttcattgggttctaagtcatccctaaattatttcaaattaggacttatgtatagtcagataagataaattatatttttattcaagcacatttacaagaatacatatagtata

SEQ ID NO: 63491 - DNA, 1409 bp, Bovine  19866880912624
caagaagatatcagtctaggccccaaatatcttgatctctatttttaataagggaccatgtggattgtccttttttcacaactgtccttatgaaagagtgaggaccagggcacccagtagtgtgttagaggggaagaggtgtgctgatagaggactcaaatttagctgggactaagggtactacagtacctactagtgtaaattattataaacggagatcttcccctgagatatcacactggtaaaacactcttctcttgcccaagaaatcataagtattaagcaaaccattaaatataagtaaagagaggaaatgagcaccctaaaactcctgctcaaatatatggtgtatatgctacctggatcctgccttctctccatcaactggatgttctccagatctcacagaccttgtgaacactgcgtcctaccctgtccatataaaacagaaaaggccttcattcaacaagcccacccaccttacttgaggaataagataactgaattttcactatgataaagaggcagaattagattactgcctttcccccaccaccaccaaaaaaaaaaaaaaaccttagaatgagagaatttagctttattaatttttaattctaagtcattcatataaagaaattttgcataataactctctaaggttttaagcaccctgagatttgcccttcaaacagcatgataggaaaatatttatctatgtgcccaagagttaaatttgataaataaacgacgttaattttgaaactattaaaagccagtttgctgttatgattgttttgcttcaaatatcaaaatgatgatgagccatatatgcccctgggcctatttcttgattcttttcatgtcttacaaagcttttttgaaaaactgaacaatagaagaaataggaatcctggctgaacaccccagttcagttccgttcagttcagtctctcagtcttgtcctactctttgtgaccccatggactacagcacgccaggcttccctgtccatcaccaattcccagagcttcctcaaactcatatccattgactcggtgatgccatccaaccatcacgttctctattgtccccttctcgtcctgccttcaaccattcccaacatcagggtcttctcaaatgagttagttcttcatatcaggtggccaaagtattggagtttcagcttcagcatcagtccagtgaatattcaggactgatttcctttaggatggactggttggatctccttgcagtccaagggactctcaagagtcttctccaacaccacagttcaaagcatcagttctttggtgctgagctttctttatagtccagctctcacatccatacatgaccactggaaaaaccatagccttgactagatggaccttcgtggcaaagtaatgtct

SEQ ID NO: 63492 - DNA, 1061 bp, Bovine  19866880920842
taagtcgcttcaactgtgtgtgtgtgtgtgtgtgtgtgtgtgtgtgtactcgtgcgcactaagtcgcttcaactgtactatgaactgtagcccaccaggctcctctgcccatggggttctccaggcgaaaatactggagagggttgccatgctctcctccaggggatcttcctgacccagggatcaaacccacatctcttgtctcctgcatcggcacgtgagttctttaccacaagtgccacctgggaagcccaagtccccgttgcgtatatattcccaaaacaaacagtaagtaggataatttgagcaagtatctttttttttttcagagacaatgtttgtctgtacttgaaacaagaagggagagccatgtagtctagaatggtttcaatcatctggaaaaaaaaaaaaaaaggagtgtgaattcaggagtgacttcacagaggtgcttccacctgcctcctgactgggtcttcttcatgatggattaagaacaaaataatacaaaaaatttcatgtccgagtatggaagtaactgaaatagatctcattttctttagctagacagcctagtattaagagctctcccctagttgccattcttataaattatcattattttttcaaactgtttgctacccaggtggctgagtttttcgttgcaaaatattagttcagatggtctcacacaaacttatgttaaatgttaaatatcttttgatctccagactttctggtccacatctgcacagaccaacagaggggtgtggtatgcgaagtgcacaaggagagcaggggaaacacctaagtcaaatgacagccctgcactcacacatttggcctccaacagcaggaaaacgccctgctcccaagctgaggggaagctgcatgaggtcactcccggcagacccggagtggacccctggatcctgctcctccacagcaggatctgatcatcctgaccctctcctccaaagggcctcttcccctgaggcacggaggaccaggtccaccctcatatcagctcttcttatcccccagcccactccgcaaacccaagt

SEQ ID NO: 63493 - DNA, 1076 bp, Bovine  19866880957475
tctgatttaccttgaatatgttttactacaatccttgcatataaatcattaataatataattatctgacggtgtatagaagctctactaatattagaacttcaaaatgtattaactctagatacaaattatgcagaaatataaagaatgagattattatcttgttttactttggtaagagacagggttaattttcatgataaatcaaggatttagatgcattaggttttttggtcattgaaataacaaagggaactgtgagttgatctaaggcaaaaatagaatccttatttttctcttttaaaaaataaaacaactgcccagtgagaactggttgcaccaatccactatttgtccaattacactttttttttttccccaaaaaaggcaacttcagctctggattgccaaatgatccaaaagaaaggcactttttgaccatgggcatcaacttttagataaggcataaaaccagagtattggtactttccagaagaattgaggcactagatctggtgtcctggccagattgcaattctggtaattgcattctgctttctataaaggcccctggttagttacatttgataaaaaactcttcacttcctacctgaacagtcacagaatgtgggagtgctgtgggaaattgttgctgggtttgttcattaatgggtgaatgtgaacactgcaacatgctcactcacacacacaaaaatatgattggtgaactgaaatccccatgcgaaaagtgtgcttctgcacagatctacgttttcataaagttagatcccattgtaacaccaatgccatggaaatagagtctttgtcagtacacaaaaattattttagtccttgaagaagacactgattacataattttaaagatgcaattataactaaagccataatacacaaaataaaagaataactcattagaggagaagaaatgaatatgttggctcccatcttgtggctctagggacagcccaattaataaacacattactgagacttacagtaagaaagctttgacacatgtgcagcaatttttctaaagaagatttccagtaacctcta

SEQ ID NO: 63494 - DNA, 711 bp, Bovine  19866880972513
tctaggtgctcaatgaaacacctagctctcattattattattattgagcagtaatatagtgctcaagtgcaatatatgtatttgtatatttctatttacatttcaatcctagtttcccccatgataaattcattttttcagccaataattgattaattcatggattcaataaatgttgtatggttacctattctatgctaggggactagagttatgtaacatacagcttaaaatgcacagtaaacatttcaaccagctgttacagggagtatgaaaggaagccaagtgagaagtagcttgctgccaatccacggaaaggctccaaagaagagaaaatagatccagacaggtcacaaaagtgaagtgaaatgagtgaagaaatggagtcccaggggattttgaacactggcgtagaggatgatttccctgagagcagtgaagaaaataaatcaagagcagatgagatatgaaaaaattgagaagcggcggaggcctggatgctgccacaaactgcctcaaaagtcagggtgcacacctccaggagagctgcatacagatgcttaagccgctagaaccatggtggatccactggatccagaccaaccagaggaagaaagaatctaaatatcaggaagggaagcaagtgataaacagcagaaaatggtatgcggcaaaattcaacaaattttatgtattgcaggctgcatttgg

SEQ ID NO: 63495 - DNA, 701 bp, Bovine  19866880981305
ttatttgatatcacaacttcctcactaactgaatcttcctgacttctgaagtcacttgaatgctaattcagcgcttccatgaggaagaatacctagaaaaatccttctcaagctgggaaagtgatctttgtccattagtctgaaggtttaaaagagagttgcaagggtccatggtgaggaagaggccccactcaggcagtcaaattggccaggttacctaggcagccaatgtaatattccaggcagatataacgtaagcgagcttccctggtggctcagcaataaagaatctggatgcaatgcaggagacacggggtcaatccctgggttgggaagattcccatggagaatgaaatggcaacacactccagtattcttgcctgggaaatcccacagacagaggaacctgagaggttacagtccaccagggtcgcaagagtcagccacgacatagcgaccaaacaacaaaagagagcttcacaatcaccttcatttagtaaaacacagactggttgctaaataataataatgagcttaagaaatttaaccatcatatccatgtaatcacagactctggtccagaaaatacagtaaccctatgcttctaattattattcttgagcatcttgtttcccaatattttagaacaccaagaaaatgaacttccatttgtctctcttcaaatacagagggtttaatgt

SEQ ID NO: 63496 - DNA, 2796 bp, Bovine  19866880981939
ttctacagcatctcttggtatacgttaaccctttacgactgccaattattttggaatggtctttctgtgtgtgacaacattcccacactgagagtctcctccccaaactggatgtagaacccaaatgcgccagttcccttgcatttacagccacaccaaccatacaaggcgagacaagactttttggatatgatcaacactatgtcaagtacaaagtgacggtacagagcttccatgttgttggtacagttggaatgaaagtgtctagtgtagagctactggaaaagcagtgacttctaggccatgggagtggaagtttcagaaaagtcacgttcctggtctttgcttctctgtggtggctgtggcaccagtggaggcttcaccaggccacttacgagccttgttgtgagcattgcagcactgtaagcactgaaagcaattatatgtaagtataaatatgtatttaattttgaatcatggtctctccaacccttctgaagattctctgagacacctaatatcttttaataaattatttttttctgttgaagtctgccagagaggattctggtgcttgcaactcagaaccctgactgatatgcatagctcattatactcataagaacattaaagcttggacatttcctttatcctctatgattatgagatcggaagaaaaataaacaatagaaaaatgaatgttcacaggagtttttgaaacctaagttatgatctaatttaataagctataacatgacttggtagaattggtaaaaagaagcatgagatgactaagaaatagtttcaaaaataattatgcaatcagagacagctgcatgtgacaactgcaagggatttaaagtccaatcccttggactgcaagcatttaaagagctgcgtttaaaatttaaaattgtagttattcaagggtatattgaaaaacttgttcatcctcactgtctgaggtacaattgcgtgaggatcccttgcctaaaggtgaatgagtaaacgagatgggaaaaaagatgcaatgatattaaaatctcaacaagaaggaagtcttgaaaaggcaaatgatacataaaaatgacttcaaagagtatactatagtttacactttgaaaaatcaatattcaataaacatttaaagaaaaaaagtggtaagcaaaagcagcaaacagaagttctctgaagagtgactctgaattatgaaatagtattttatatgccagagtagtaaatgaggaattgtaatttggtgcaaccaattcatccatttctaatttacactcctcactgtgtcattcattgactaatgcttgaaatgtagagatgactaacaagatggctcttgttcattaggacaactcttgacaccaaaacagtattgaaattatccccaaagcaacagactattaccaaattgatttatgtgctatcactaggacacttttaaattcatagctaatcacatgagtataatataaaattcaacagagaattcagaatttagctctgaaagaacatctcagctacacatataattgcaagtgaacatttgaacaattgaaatatatttagcagagagaaccagagttaattgatcattcatccccccaaaaaataaaaatcagtgttcttacatggcttttgggatatcacataaaagggaaagggaaaaaagctgtactttgaagctgagcactcacaaaacctaatattatattcaaattaaataaatcaagatgcaactatctttctaaaatctgttcattgatttgatattgaatttgaggcctgttattcaaagatggaaattttgaacaggtaattcaagatagaaaattcacatgcatgaagtttgaatgtaagtctcctaaaaatgataaaatgaaaaaaaacacattcacctgcttgataaacagagacatcacatatattatgaaaacatgttttccatatggcctattatgtttaatgctaatatccatttatggggaaatgctgggttgtatgagtcacagactggaatcaagatcactggcaggaatatcaacaacctcagatacacatatgataccactctaatggcagaaagtgcagaggaactaaagcacttcttcatgtgggtgaaagaggagagcaaaaaggctggcttaaaactcaacattcaaaaaactaagatcatagcatccagtcccataacttcacggcaaatagaaggagaaaaagtggaagaaataatagattttcttttcttgggctccaaaatcactgcagactgtgactgcagccatgaaataaaaagatgcttgcttcttatgacaaacctagacagtgtattcaaaagtgcagacatcactttgtatagccaaagccatggtttttccagtcatcatgtacagatgtgagtattggaccaaggagaaagctgagcaccaaagaatcaatgctttcaatttgtggtgctggagaagactcatgagaatcccttggactgcaaagagatcaaaccattcaatcctaaaggaaatcaaccctgaatattcattagaaggattgttgctgaggctgaagctccaatactttggccacctgacaggaagagctgactcattggaaaagacccggatgctggaaatattgaaggccaaaggagaagagggtggcagaggatgaaatggttagatggaatcactgactcaatggaatgaatttgagcaaactatagcagacagtgtctttccctgatggctcagatgataaagaatctgccttcagtgtaggagatccagg

SEQ ID NO: 63497 - DNA, 1117 bp, Bovine  19866881030306
actaaagttgaatttttctactttagtctttagtttagttatttccaccttccctcaaatgaagagggagggaagttctaagtctaagcatcaagtctgttctctgcctagagtgtcatttttttccttgtcttgtctggctaactcatcagtcttttaattatcagctgaaggctcctttcctagtgtggccctctgtgatccttcagctttatctattcccctgcatctctagctcttcactcttcttgacatgtattaaaggtattttcctctgaagggggtgagtcctatctttttccccagcctttattatatgatagattggcgctcactatctatttgttggctcaacagatggacaactgccttcacttaggagaacattgaaaactaggatcaggtcaaatatctggctaaaaatttgggattctagagccaagcctgtttttattagagcaataactcaacacgaagtctctcaggcctagtgtcataagacttgaaattcaggtccagctctgctgtgacctttgtgtggggccctgaggaggccattgtcttggtcttattgttgtctccctggggtgaaagcatacatgacagagagttttcataaccataaaacataagcttactcatatcgtagtccgttctgccccagaaagtcttccacagcgacagtatcttctgctttaacacggaagtccactgtactgtgaggtttgacttgtgtgaccgaatctggtttccagaaatccatctgaacaaggaataagacatattgtattggacaccaataattcaatgggtgaatcaccactagtgagcacactaccccagtggattattatgaatcaaattatccatgaaatctcttataaatatcacctttatttgagtggacaaaagttgggaccaagtagttggatgtcaataaaagtgtttacacacacatacatacatagcattaattgtcaacaagcatgaagagggtatgattatctcccataatggtagttacttgcagtattctataactgctcttttctctttattgattttctagaacagttgcttattggtgatagcagtgtttgtggtaatggatatatgt

SEQ ID NO: 63498 - DNA, 1248 bp, Bovine  19866881033314
ttgagttgatgattctgctcaaatcctcttgatgacaaccttcatcttaagtctgtgatgaagaaatcagtgatgtctgatttagaaagtccttttcaaagtccactccctatcttgtaaaactaatttacaaaattcaattggtccttttgatcactttcactaatccagtttaagagcttaaactccccccaagtggcccttaattagtggctaatatgaatgcatgagcatgcacttgagctgtatctggaagctaacaagtgcatctgtaacttgaggttcaataatgaccttccttctctggacccctgattgagacaatgcatatggtagttgtttacaaacttcaaataaatctgtgaggtacattgattggtcttactcctatcctgtaatttctactttattgattccttttcttcttcatctactctacatgggggtggaaaaaaaacaactaccagagtataataaagaaaagagtgctgaacatcatttctataatctttgaagtataatcattttatatttttagaaaagctattttttttttagtttattcaagaacaaattcaaattttagcttatcagagaccaaacatttccttagggaatatttcccaaataaatttcctttccaagctcttttaaattgataatacatttttgcctattgttaaaccattaagatataaataaaagctctctctcatctactttgtctgtttcttctttctgattcattcttatggttgtatcatacattattcattatagtacattttaccaagtgcagcaattggaacacaatttcactctaatattgttaaatgaatcagtcaaagaaagtacaggataggttaatcaaaaatgcttgaatattttgtaagatactaagagttttaatggaaattgtaaatttaaaaggtggattaagatacattaataataagatctatatttattagaatttcacaaaatccccaacactggaaaagcaggaaatctcattcattgctggaaaagatgcaaaatggtacattgccttggaagacagttgggcagtttcttacaaagctaagcatactcaaactattcatttcagcaatcttactccttagtgtttacccaaaagagttgaaaacttatgtctacacaaaaacctgagctcagatatttaaagaagctttgtttatgattttttaaaacttagaagcaatcaagagaccttcaggagagaaaggg

SEQ ID NO: 63499 - DNA, 1794 bp, Bovine  19866881074776
ctttttttaaaggaaattctaaagtatcctatatattgatggaatgattggtggaagagagaaagcatgcagaaggatgtggggatagtcagaacaaagtcccttgagctggcaaaggagagtgggtttgaaacccatgtggaaaatttgctatttgaaagaagcagacagaacacactcatctgaaatatggcaagggaaggttgagggaagatgtagaatttaacacattagttggcttccctcatggctcagatgataaagaatctgcctgcgatgcaggagacctgggtttgatctctgggttgggaagatcccctggagaagggaatggctacccattccaagtattcttgcctggaaaattctatggacagaggagactgtccatctacggaatggacagactatagcccatgggatcacaaagagtcagacatgacttgagtgattaacactgggaattcctttagtagggagataagttcactgtccattttcttccatttttctcaagcatatgaaatatatttatattcgttgtagaagatttgagaagagaagataacttgaaaaggttgatgccttttggtgactcacctggttcaggcatggatctttaatgtgtttgaatggttctcttttctcaaaccccataaggacaaaaaaatttgttatgaatagatcatttatgcaattattctccctccctctctctctctttgcacatattcacatgctttgtatgaacaaatatgaaatagattcagtgaatacagtagcactttgacaatgtgagggaggttatcagccacattaacagaaagagcctcttcttaattggggcccaaacgtaaaaagttctttagcttgggcataacccttcctgtgcaacatcattaacacccaaggcaattatggattcagacactgagtttgaatcatttcacaagacactatgaaaatgcagaataattaaattatccattgctcacactagtggccaataatcaacaaagaacttttgtgtcctctatttgaaaatgggccattttttttatccccaagtgtcctgagggagatcttcagagaaatttgaaaaaaaaaaaaaaatgttaaaaagggtattctgtataattcccatgtcctcttcttgacactatgaagacagtaatagtagcataagtgttcaatcttactgaaaaaccacagatatattctgggtggcctgtttgttctaaatgcatctgtctattctttttcacattcaaggatggattgctcagattttttgcttctccagatccttggctcataaattatatctttcttggccggaaagaacctcatactatagcatgtgtaaaatactccatgtgttaatgaagctataatgattattttctcagagtcatgcaatttttcctgtgttaatgactaaaaatataaagagaaataaatcacatactgattcttgagccaactaaggataaaagtgcagttgagtaatggctggattaaccaagaacctagctgggattagtatggaaaaacatgtattttgtgtcttatactgaatttctagcacaggtttggagtaagagatggaaagttagggttataacatggccctcctgggatgtctggcctgctggcataagttctttcgaaggaggtcaccattaccatcattacccctaccataggttggcctcaggccaaactacagggtgggaacacagccctacccatcagcagaaaattggattaaagacttgcccaccagaataaggt

SEQ ID NO: 63500 - DNA, 1200 bp, Bovine  19866881113557
aggacagcattagtgaaacagtatattcacacccgttccagtagatggtttatgcactttaattcctgttaaaaaaaacttaattaaattgcacaatttattatcttatgttagatgttgagaaaaacagtctggaaagtctatgtgccgtgtgtcagacccagacagctgtctcagacttttggtcctgtgtaaattttgcgaataactgaattgttaacaggctctttgttggatgtttttctgcacttaatagacctcacatcacttggaaaaaaattatgttctaaaaagagaaaagatagtgtgtattttgttaaacaaatcagcatactcaataatgatattttcctttgatgtgtaacagattctgctacatttctgcaactattagcctataaaggtattttgtaatatagtccacctctaactttactttctatgaaagtgactgccaactgtatttatctccgtgctttcaaacctgctacaaatgtacctctacatctttctgtgattgcttttaagagcaaaaccttaattcagactttctacactccttctggtttatggtgatatcaaactcaaagcaaattcactcattgaaatcaatctggggggaaaaactcactggtctataatttaggattatttgttcactggcaaatgattagatagcataatcatttactgagcctcagtctgtgttttctgaaacactttgtatatactatatggtagattagaatagagaaggaaacaaaagtagcagtaaagttatggcaaccaagccattcttcagctcttgagttcatgtctataacttaaaatgcctttcagggcatgagagaaggaaaactcacagaattgtctaagatatttcatattttcagatagactcacacagtcacacaaacgtgtgtgcgtgcacacacacacacacatatacacttatttacaatgaattcatcaggaagcccctccctaatttaggcccaagcttgcaaagaagtcagttgttttttctttttcctgacactattacatcaaaacagtatccaggcattagacagtatttattagcttgtaaggccagagataatgatcccattcaatcagaacacatgaataattcaagtcccaacttcacataatttctggctctacttttaaaaccagtgaaagaaccatttgtatcat

SEQ ID NO: 63501 - DNA, 2049 bp, Bovine  19866881141806
aataaagataactggaatttctatgtctgcaaaactttataaaaatagtattagacatcttggatttaaatattcgtttgttaaatgctcaaaggtggatcagatggtcttttgtcacaacgctgtcacagtaactggagagtggtgtttaggatactttttcagttaaataattacaaagaatgaggctgactgaataggtagaaaaatctagattgcacaaatagttttcagttctgaagcctctctgtaggcgttatagattatttcaaatcttctccaagaatctaagttcctccaaaagtttttacagagaatacagttttattgtttcagaagtggcccagacaaaaatagcaccatgagaagaaacaagcttcctagtaagatcaaaattaattatggtttttctaaaaaaacttaaaagacttttatatactcaattccagtaaacctcagaggacacgctactgaaacaaaagaagttaagaccagaaagaatttccacagatttgagaaaactcaatgaccctttcagtctgttaggcaaacttgtgttctgtaggtatgttttagaattttgtaagtaaccatgtgatcatagatgataggaggaggagcgaagaagaggagcaaaattgtacagaatgaacaaaaaaattaagagaaactcatacagattacaaagatgatcaggaggtcagttttctaaaatgtaggcactgttatcaacctcagagcaatggtcctcaactgtggccctttcgccccccaccccagaagttactaggcaatggccaaagacctggtagctcagacagtaaagaatccgcctgcaatgcaggagacctggtttgatccctgcgttgcgaaggtcctctggaggaaggcatgacaacccactccagtattcttgcctggagaataccacgggacaggggagcttggtgggctacagtatatggggttgcaaagagtcagacacaactgaagcaacttagcatgcacatcatcacagaaaatacaaatcattaacaaggtacaactttctacatatttccttaatatgtcaatagttctagaaaaagtcctgggattgatttttatgggatcagcatggggctcagagggtaaaccgtctgcctacaatgtgggagacccaagttcgatccctggatcgggaagatcccctggagaaggaaatggcaccccactccatgtactcttgcctggaaaatcccatggactgagaaagcctggtaggctacagtccatggcgtcgcaaagagttggacacgactgagcgatttcactttcactttcagttcagttcagttcagtcgctcagaggggctggcttatttcatttgtcaggtctgccaagcacataagaacaaaaaagactacaaatataactttaggaaaaaattacctttatttacattgcaagagatgactgtttatcaggcaatacatccatataattggcttggttatgactacagatgtccttaatgtataaatttgggatccatctacacctcggctcctcactataaaattcttatcatttattttaaaaaggaataaaattcacaaactggaagaacctcaaattcacttgttcctaacctttcttataaataaaaaagctaaagcacagagtgaccaattcatcaaagtcgtgtacatcatggcatgatagacactaaatccagcttcctccatgcctcagagtgagttaaatggcatttagcatgaacccaaatgactgtaatatgagtgaaaactgtaatccccattagaaaggtacaaattgattgctctgagaattcaaatacagtaatcatcttctggatagcggcaggccacacatttcatctagaatgctcaaacttaccgctttggacgcttagtctatttttttatattattttatgtaaatttttgaaaactttattaaattctttcctgtcttttaaaaaatagcaactgctgaacataatttggcctttttcataactgcggcatcataatgaaccaccatca

SEQ ID NO: 63502 - DNA, 904 bp, Bovine  19866881206357
aattggacatgactgagcacacatgcacacaaaagtgggttgccattgccttctccaatgcattaaagtaaaaagtgaaagtgaagtcgctcagtcgtgtccgactcttagcgatcccaaggactgcaccctaccaggttcctgcgtccatgggattctccatcaaagtaataataactgatacttaggtacatttcattaaaattagtttgtgcatctagaataaaagtatttcaactgaggtaaggaaatatatgctgtctttataaaggagtttcccatgattgtgaggtatcacgtttctgatacaagtgatccacttttcctgtgttgtttttactaccatagtgatctaaatagctaacagtgaaagatgagggtaaaactgaaataaatatttaaaaaagcaatttctgtggttaaagaaaatagtaggttaaaaactgatcaaatggaagtataattgaaacaagtaaaaatgataaaacagatttaggaggctttaaatacaagagttctgaaggattctagattttgtatctatagtatagtgtatattgacttcctagattccatgacatctgctttctaagagaattttttcatcctccccatttactgtcccatgagttcattcacattgatttaacacaccatcatctaaaggatgtgataagttggtgtttatatctgtcaagggaccgaggagatgaaagtaggcatcaccaaaaggtataattttaggttgttggataccccttgcatttttcttaattatttctgacattttatctatttcaccatgagcttccttggagaatacagatgaaaaaaaaaatgttcttcatgacccaaaagaagaaatacatcttctcttaataaatcccacgtgaaatcatatagg

SEQ ID NO: 63503 - DNA, 950 bp, Bovine  19866881208681
actttgatagattatcccaaatataattacttggtcttttagttctgtctttattatcataggaaacttcagagtatttttttttcttcagattgcaaactcatttataaaggagcttctaatggacaaattaattagattggtttgggcttgaataaaagcttaaggaggtattaatattctaatcaatttttagaaatgtggtggaccagtgttcttgcctagagaatctcagggacagagcagcctggtgggctgcagtctatggggtcgcacagagtcggacacgactgacatgacttagcagcagcagcagcagagactgtcatacggagtgaagtaagtcagaaagagaaaagtgaataccatatattaagtcatgtatgtggaatctagaaaaatggtatgatggccttatttgcaaagcagaagtagagacacagacataaagaacagatgtatggataccaaggggaagggtgaggtgggaagaattgggagactggcattgacatatatacattattgatactatgtagaaaatagataactaatgagaacctaccatatagggaactcagtgctctgtggttacctaaatgggaagaaaatccataaaagagaggatacatgtatatgtaaagctgattcactttgctttacagtagaaactaacaaaatattgtgaaggaactatattccagtaaaaattaagaaaaaaatacaaaactgttcttgaaaagtcaaaaaatattctaaacgaaagtcttggggaaatattcttagaatttaaaaaaaaagataaaaagaaaatctttcttaggtttgtttttaagaaccagggaagctgtcaaagactgcaaggtaattcctactaaacaaccagtagataaatgtggtgtggccaccatgagccaaccttgtgtttgcagcagactagagttcccacc

SEQ ID NO: 63504 - DNA, 703 bp, Bovine  19866881212176
agcaccaagctgagctccttgtgttatatagcagtttcccactagctatctattttatccatggtgttgtatatatgtcagtgctactgggaatagagatgcagacatagatagttatttttaatgcaaaaattgcctgaggtgtgtcacctcagagaagactagaaaaattactgtgacatgaatgaaggcatgatattcaaactgcccatctacacacaggcagccccttccaataaccatctcatcgtgtgtcatcttgtaaatgactactgattcaaattgtgtatggatgatgtatctggtggttattgtatattaaacatataaattaaatctagtgtcagcccatgaagctattagtttttctaggagacaagtttttcctttctcctgtatgctagcattagagttcatgagcctttggagtttggaaaatataatttttagagttttatggtcaaataagtttcagagttactgttctgaataaattgaatgagaataattcactggtagataattacagtgaatcagtcttggaataggtatcgggagtttgatcatttatatcatattaaagaaattagctaatcaaatattatttttattagaaatgagaccatacatctctttttcttctatgtgaaacaccacttaaagattttgataaaagtgaaagagctaattaccttcatgttta

SEQ ID NO: 63505 - DNA, 824 bp, Bovine  19866881228772
tgtaagtgtaatcatagcagaaatgtaaaaaagtatgaaagcacttttaaagtttgttagggatttcagtttgacatagttgtgtgttagttgctcagtcgtgtccaactgtttgtgatcctatggactgtagccctccagtctcctctgtccatggaattctccaggcaagaatacggcagtgggttgctttgccctcctccaggggattttcatgactcagggtttgaaccagcatctcctgcattacaggcagactctttaccctctgaaccaccagtaattcagctctatttataccttgattgcacccttcttgggttttggggatttggttttgcttacataaatacagtgttctctgatggatttctcacatagtctaaataaatattaaaaaggtaaagttaagaatcaatgtaatatgcaaaatcacctgtcatgactatctggaatatggtaggtatttgtcaaatcaattgaaagatggcatgctagtaattagggagacatgtttctatgtattctgaatatgtagcaacttggtagagttctcgtatgttttcattttgagagtttcaatgaaggagctgtcatttaatttactcgactttgttttaattgatttttcagagaattccttatggtggcaatggttccccagggtgccaattttgaagcatgctatgcttaattttttaaaaatcaacctgcttaggcaaatgcattcatcaatctaggaagaaaactattgagatatttccttttagactgatatctaaactatgtgagattttcttctgctcatttaaactaggcatttt

SEQ ID NO: 63506 - DNA, 1797 bp, Bovine  19866881300892
actcttgcctggagaatcccagggacgggggagcctggtgggctgccctctatggggtcgcacagagtcagacatgactgaagcgacttagcagcagcagcaggacaaaataagagcacctgcatttttatgtcactgataccattctggcaattcaatcagaactctattttttaaaatttctataaatctttagaggtaacagaggatggggataaagtagagaataaatagtccaaattctctttgcctaatttagaatttgcagaaattcagagggagagaaaaactaggttttagtttctcttttttcctctcagtggaagggaaaaaaataaggcaaagacaagaacaactaggttaactgaaagaatgaacaacacaagcacactgaacaggaacacttagctggctacttaagagaacactttgaattcagatacttggggagcatctttccaagtgcaaccggctagttaaaatgtaaggaaagccttggattgatggggcaagagtttgcttttccaattacaaacaattttcacctgctcattaaagtagagttactatgcaattcttggattcaattcagttcagttaaaaaagtatgtattgagcgtctgtgtgccaaactggaaccccgtgttcagggcttagttcaatgacctatatgtcttgaacaaaaataaaactgctactaccgaaaatcctgtaattcatatgttcacactcatcttgactggatttcacgtcaatgaatctaaattgatgttatgttattttggagctttgaggaagtgaggttcaggagacagaaagcaatggactattgacatttctgatggggagaagagcgcccctctctcatctgccttctgggcctctgtggcagtcttagcttgttagcacatggtttgacttcacacaaagacaaattttacctcagtgtagccataagcaaaacctgataatcaataaaaaacaatccaagtgttaacgtggcattgtgccaaaatccatttatttcatattatattaaattttgagtttaggcttatcaaaatcccagtgatacagtacccactaagaagatttaataggtagagctgtcagagaaacctcaagaaaaagtatcttgagtgttcagttgcctgtgtatttatttaaaagaacacattttagataggtctttgctatatgtcttcatatcagctgagtccataagattaaaatacaaataaatatgtaagtggttaaccattttccaggaaaataactaatatctggtaatttcctctttcaaagctcagaacgctgcaagtctgcacaactagaataactttgtaaaatcactattgttatcatgtctcttcagaaccattgtgtgtaattgctatggaaatgtaaaaataccccctgctttttttttttccctcctctccactagcacacgacaacccattcagtcttttgcaagttcgctgtaaatgatgccagtaagagcatccaatgagaccctcagacattagtgtattagcattatctgttacactactggaccaaaataacaaataatatgcctggaggtgctgctgtttgtgactgctagtttccctgcatggcatatgcctagagagtctcagatgagagatgactgcacaaaactgtgattgtgagatgacttagcagaacccgtcatgatgtcctaatggcctcccgctgggggaaacaggagtaattgtttgtcaggggagggaacacatgctgtaagaaagcatcttctgcaaaccaagcagc

SEQ ID NO: 63507 - DNA, 2556 bp, Bovine  19866881321723
actggggatggattaaagtctgatgctgtaaagaacaatattgcataggaacctggaatgttaggtcaatgaatcaaggcaaattggaagtggtcaaacaggagatggcaagagtgaacatcgacattttaggaatcagtgaactaaaatggactggaatgggtgaatttaactcagatgatcattatatctgctactgtgtgcaagaatcccttggaagaaatggagtagccatcatagtcaacagaagagtccaaaatgtattacttggatgcaatctcaaaaacaacaaaatgatttctgttcatttccaaggcaaaccattcaatatcacagtaatccaagtctatgccctgaccagtaatgctgaagaagctgaagttgaacagttctatgaagacctacaagaccttctagaactaacacccaaaaaagatgtccttttcattataggggactggaatgcaaaagtaggaagtcaagaaacacctggagtaacaggcaatattgaccttggagtatatatgatagactatgaaaaatctgcccctcatccacttttgtagctcactcgttcatcacttcccttttgaaatgttcacttcaggaacactcaactgcttacaatgccctaatggacacttgtaattcactttcacaaactatttactctggcccaaattttcttcttatcctattctttctgcaaaacccatattcatttcccaaactcttgcacagtcacagatttctctggaatcccaccataaaagccaaataccccttcattactttatatgtattcctattactagacatatatttttacatatgtacctcttcttctctttgtgcattctgaatctaaccaagacttattcaactttgtattcctagtgcccaatttagcatataggaagtctccttagatggattgttaataaataagtgtatgattaatgaataaatcaatgtttatttatctctttaaaactatgtatttagcaatgatataaataagatctgtatagtaaagtgtttaatatctaatatactccactctggaggacttatttactgcttttagaactaaaaacataaataataagataagctagattactttattgttgttaaactggagctgttcaactctatagttcttccctagagaaaagaaatattttctgtgtcttatatagtggaaggactttattagaaaaagaacttagttacccaccttggaggttcattaggttgtgtctgtttggaggtcacatttgccttcacctcatccctgtttcctggaaatgaaacagaatgtgctgataatgaatcaataatatgttgatgctgtgcacagggattaatcaaaagccctcattctctttcaggacaatttcaagctgccagtaatcagcagaggcaagcaagctggagagcaagcctagcacatacttgacagtgacaatcaagctgtacacactaatctctgtggtgaaattcagacagtgccttccagccccaaggcaagaaatgcacagaatctaaggttaaataccaatcccctcattctttctttgggtcaactagtgcacattcaaatcatttaaactgagttgcttctttttaatggagacactaacttgccttttcctttacttgagaggaatatctaattaaaataaaaatttccccctccatttggatataagtgcttcattcttgcaactgaccatttttatcacttcttgcctcctcattatataaagagtaaatatcaacttcatagagcaaagtaaaccattaccgctctgattaaagtgaccctaacaatttggtgttgattgcctccttcagggagaattcgttgataaataataacataaggacacaaaagatgctgttttagctgctcttctgaaaaacaatgctttgaagtaagaccatatgaaaactgatgaaaaagtttgttcctgtttttattttcccattgaaaattatatgaagataaaacagtcattctgttacaactgtttcattttacatgtgaagatatgtgaaactagacatgttaaaaggaatgtcccactgcaccctagttatttgtttctaggatgttaattcagttcaaccacctgtgttcacagaacctacttgtactccctgacttgactgattgccaccttattcccttatttcatatctggacaggaagcactctcactcaatactaaatgtcctcttggcctgaatcatggattacacaaacctctgacatcagtcagagaagacttctgggcttgacctctcagatcctatattctagcagccagcttccctttaccagatgtgcagaacatccctatgtgttatcttatatgtccattttttttttttaccaatttttgccctactctgtgccccagtaggttgacaaatatgggttacatcaatgtgcaactttatcttctggtttctggttgggtttaaccaatttggagcacccacaggagaggagataggaggacagcaaagtcaagctattcattcccg

SEQ ID NO: 63508 - DNA, 1968 bp, Bovine  19866881383588
tatttaggatttagacaatcagtaatttaattcactgcattataaatgaaactgagtttttaaaatgatctgtaaacctaaccactctgctaaacatatgagtctgtgggaaaatatgttttatttccaagtgtgactgatttttaaatggaccttggaaatataacctattagcaaagcatgaaatactcatattttatgcatatatgtctacacatgcatacacatatatatgttactatataagttattggagatggcaatgggcaccctactccagtactcttgcctggaaaatcccatggacagaggagcctggtgggcttgtagtccatggggtcgccgggagtcagacacagctgagtaacttcactttcacttttcactttcatgcattggagaaggaaatggcaacccactcccggtgttcttgcctggagaatcctagggacgggggagcctggtgggcatgccgtctatggggtcacacagagtcggacacgactgaagcgacttagcagcagcagcatataagttatttatatgttaatatgttactatattttttgaaggtttttctctttttgttttaggaatgtcattccatataaaaacaatagaaatataatagtataaagaagaaagttacaattgaatattcaagtggaaaatctgcacacattatcatttaccataattttaaacggtaaattaactgattgcaaaaaaaaccccaaatgttcttcctaaatccctctgctgtcttaactcttggagtactataggcagaagtcctacctagtgttatttataagtatcaaattaaaactgaatatgtacagaaaatccattattttaaaggtcaacgtaatatctttaactattcccaccttgacaaaaggacaaaatgaagattcagtaaagatactgaagtatccaattctgagactattcagtcagttgccaataaagaaatctggtgctagattggtcccaggaccaacaaaaaagatatagttaaatccaaaccaaccatctgataaggggcaacttaatgtctaaaatacttgtggaaaaccagtcaaaatatacttgccagcttaattcagaggatagtagggattaagcaattaacttggttataagttttatatatatatactttttatatactaatatatatatacacacacatatatgtacaacacataactcacatgtaccaggcagtgtagtggtaaggaatcctattgccatgcaggagacccaggagatgtagtttctatcccagggtcaggaagatcccctggaaaaataaattgcaatatacttcagtatttctgcctggaaagttcaatggacagaggagccgggtagactacagtcaatggggtcgtgaagaataggacatgactgagcacacgcacacacacacacacaatcataactcaaacataatatactatgatcacatcacaatgaccagttttatgtaagacatataaagtataatgtgaagtcaagtgggccttaggaagcatcactacgaaccaacctagtggaggtgatggaattccagttgagctatttcaaatcctgaaacatgatgctgtgaaagtgctgtactcaatatgccagcacatttggaaaattcagctgtggccacgggactggaaaaggtcagttttcattccaatcccaaagaaaagcaatgcagaagaatgctcaaactactgcacaattgcactcatctcacacgctagcaaagtaatgctcaaaattctccaagccaggcttcaaccatacatgaactgtgaacttccagatgttcaagctggttttagaaaaggcagaggaactagagatcgaattgttaacatctgctggattatcgaataagcaagagagttccagaagaacatctatttctgctttactaactatgccaaagcctttgactgtgtggat

SEQ ID NO: 63509 - DNA, 838 bp, Bovine  19866881420748
tatgaattataatctgaattattacatcaaaataattctgattttttcttcaaaaatttgtatagaataaaaattgacctgagcatactatgtatataaattctttatgaatttttcatatgtcttctcttctagattgtaaccaggtatatgattagatatgttgtaatctgtaagaaatgctcatgttgtattttcctcctgattggaagaaaactcatgagagaaactgttccctgttcctgcacaatttgcagtctcaagaagattggatagttcaaagcaaagcctcattctgttttgaaatttcttccattatttatttattctgaagtcatattattgcattctcctttccctctttcttctgaggagctaagagaggagagttttatggaagaaagtgtcctcagaagaaaatttcacacttatttattcagttaaatgatatcttttattgatgcatcctaatttttgtgcttcctgatttttatatgaagcaaagaaaagaaaactttctaagtggatgcaatagtacctcaaggtttcacagacttagtttatgtttgccttagtaaaaatttgccacaaatttgcatgataactgctgagtctattctttcctttaatctagacctgtatttacccaacactttatataactgtttatattttgtcatgagaaccatgccagtctgtggtaaatatatataatatatatatattatacacacacacacacacacacacaagcacatgggcttcccaggtggttcagtgtgtaaagtatctgcctgagatgcaggagatacaggcagacatggggttccatccccag

SEQ ID NO: 63510 - DNA, 1254 bp, Bovine  19866881810776
ctggcctcactaggtctctgaacatgcctggggtcttctcactggttttctcatcaggaagccagttagtttcaaggggtgctaatccctgtcatgtttagccctctatcttcccagaaaactttcctccaacacatgccactatatgctcctggacctaatagcctcctcctctgagccctgtaaaatcccaaatccacctttaaacagtatctctagttcccaagaagctcccttcactgccaaccctaagtcaaatttgctattggactctacagcgccagcttcctttgtgagtagacaatggaggatgtcttacttccatttatggatacacttcttttttaattaaaaaactttttctttttttttttactggagtatagttgctttacacgttgtgttaacttctgcagtacagtaaagtgaatcaggtatacatatatcctctctgttgtagatttcactcccatttaggtcaccacagagcactgaatagggttccctgcacttaagtaggtgctcagtagttgtctattttgtatagtcattatggatatacttctattggtctcaattttatggaaaatggaacacattacaggtttttgcactattatttttgcttgtaggaatacagtggtggcttttttttttttacttttctgatacataagccaatatttaatcatttcactaggcaagatgaaaaaaaatgatgagaatatgagaaagagaaaaatatcatcgttttaagtttctaggccaaatgtctaccaaaaaaattagtacactatcaagtactatatgcatagataaagtcttttctcatatgttatctcatttagaaagttaaaatctgaggagggatggcagttcttaattattgctacttttttaaagaggaaattgtgactccaagtgacaagtgatgtgcctaggcttactcagtgagaaacaactccctgttagcagctgcctgatgcttattcaatgcctctctccacagctacaggatttcccagttaataactttaattgtgatcatttctctgtcatatgaatatgggacttttaaaaatgcatgtaattctatcatattattaattcattatttgtattctaagaatatggcctgatactgactctctaatcttacacttaaataaaaaaaatgaccctttaagaatggtttttctgagcagcagagctttctggggctgtcaagctcagaggctcgtttcccatttaatg

SEQ ID NO: 63511 - DNA, 834 bp, Bovine  19866882081667
cctctgtagagctctgcactctgcacccccaatcgacctgcccacctgaagccctgggaagagaatcaatcgagtaaccatgtgctaggtgttatgcaatctgctaaggatacaaaacaaacagccaagaatccttctcccccaccaccaccccaccaaaagctccactagaggacagacagatgcaaaaacacatgatgggagcacagagtgataggaactccgatggagacgtgagccctcacgaagaagaggggcagctttgcaaagaaggtgacatttagactaaatttggaagaacaacagcaattccccttgtaaacaaaaaagacaagaggattcctacaagaggagaaggacacccaaagtcatggaggtaaggagaggcagggaacagaatgaaagcagttcagggccacttggcttggaaagaaggtggggatgcagggcaagtgatacatggccagacttcatgagagaaggtgagagagccattcaaggatgcggtgatgaggggatggtcagaaggtgagtgaggaggttgatatcaagatgagagagcaactgaggacaaggaaagccaagtctgagacacaaactaaatgttcctttaatgggcaccagtgacaagagcaaaataacagctgttttaagttaacatcaatcttaggtattgtttcagcatcggaggcagagcaacggtttgcaaaagttgtctctgatggcttagattgcacttggttattgctttgaggaaaggaaaccaaacattttttatgtggccctaatgacaatccctggtggctcagacagtaaagcttctgcctacaaatg

SEQ ID NO: 63512 - DNA, 862 bp, Bovine  19866880353656
ccagaattctgatgaattgatgttcttaatgataatccagcagagtcattcaaagttatagcttgtctgcaatttctctgcaaatccttagaaaaaggaataccacaactttggcatttggtctgattttctttttctttcccacattttggacaaaattcacactgtttagaaaccttaaaatgcaaaagaaagaaaagaaaaaaaaaagactttggcattttatttcaacatcatggaacaacaacaacaataatctcaaaatgattctcctatttctcatcaccatcgctatggctaccacaaaatcctgaatgtcacttgggatttagcatcacaatgctggaaggaatttttgaaaccatctagtccagcagtcttcaaatcagactatgtatattcctcaagggctacataaagattttctaaggcatacagggcataaataatcttaaggtaatcaatatttagatgttcaagtcacacatataacccttctaaaaactgctctgattatgcttatgtcaaagtatcacctgccacaactgttcttctcatactttaaaaaaaaaaaaaagaatcctaaatccatcttccatttgaaatattaaaatggcatatggccctagggtataaaaatcaccaaacaaaacagaaagataatgttacatgctggaaaaatgaattgattctaagttctggttaagacaatcttttacaagataatttatttctaaattatcagtgctacaaaaatagttcaaggaaggcccaatctaggcctcttacaattatgataccattaaagaagtttttttgacagtagagtatcatacgattttgaagcctataatgtagaagg

SEQ ID NO: 63513 - DNA, 759 bp, Bovine  19866880364990
agagtatgtgaataaaagtcaccaggtggtttacaagatgtacagtgagcgcttactgtttacagagagtaggctttaaatgccactgtcctatttctgaactgcagctgtcatcagcaaggagtccatcatcactgctatcatcctataaaagacagcctctgttagtactgaaactataaaatctaactactaacaaaacagcactactgagggtaaaaatccttgtggcaaatatgtaaaaaacatatctctaattaggtgattagactttagaaaatgctgtatgtcactcaatcccgaaggaactgcataggaatccaaagaaaaacttctaatgatataaaatattggaactccttactaagcattaagtttcacctggttatcctgatcttctgagaagtcgatgagttcatcttcaagcattttactaccttccgctgattcatcactgtagtttagccttattttgcttaaaccatctgtatcaataagaaatattacataattcttaaaaagaatatgcacataacttaaaagtatatgatcttaaaattaatgctagcaattatatagtaattacaaatataaaatttgtattagcatatagtatcacaaatacaaaataagttacttttttaaaaacctgaactgtcatactatttgcagagctgtttctactactcagaccctaaaattcattaaatattaaaaactagctatcatcttattattaaaatttatggatatttaaat

SEQ ID NO: 63514 - DNA, 1678 bp, Bovine  19866880447904
ttttggcgggctgaaaggattgtgtcatgggctgccctgaatgagttgcccagtgaccttggcagtatgagtgtctgacaagggtggggaacgagggaggtgaaattaaaagtcacaaataagccttgtcttgttcatagctgtgtcagtgaagtgtattgcctaagaaatgcctcttgaaaatctcatgtaatgtttattaattgcaaattaaaatgtgttttcgttaggtggttgtaatctgaagaataaatctactcagtcattggaatattgtgctgaattactgggtctggatcaagatgatcttcgtgtaagtttaactacaagagtcatgctgacaacagcagggggcaccaaaggaacagtgataaagtaagttccctgctcactgctccttgcaagtcctgccttgtgagggaaaagccagatcctgtctctgttccttgctgagtaaggcaaaggagtgtatcaaaccatttcaataaatttaaaaagtaaggataaaaaaagcccttttagctacacagaaaatcctgtaacttactttcagaaatgttagcaaggtatgtttagcctggttctctgctaagctaattcccaattattgtcatgatgaagaaaatctgtgcctgcagtagcatggtccttcagagacatttctggaggccacggaaaggctggtagaagccctgggtgtggtcctctgctccatttcccctgtgtgctaaagcagttctatgttttatggatggagtgtccacataagagtccctttaggaaagggttcttctgcaagaaatataagttgggaaaccactgtttagaagagattgaagtattagtctgacctgaatgacttttaagatttctttcgaagtttgataattctttctggtgttcccaaggtgcctcatgctttacgacagcatttggcacagtgtctggaggttcttttgtgtggcactctcttcattggcccgtgtatgtatctacagtgtctgatgctgttatgccgtgtagttaattaatacttagatgaaagagtacagttggacaatttggattttaagatcaactttttttccttaagcagtgttaacaaattactgaactttaaagttgtctggaattaaacacagtttcttttgcatttaagaaagtcacctggaagattattcctctgaataaatttcttgtgtattcagcatgtaccgtgaggtataaaattaaggttaaaaagatgttttgagcctaatattcttttactcaataataggtctttaattatagataattctcctgtagtattttacttggccctatttatttgtttccattcacaactgacattttgtagctgtttattttctccttcgcgttgactgtgcgtgctcagctcttgggaacctgtgttgtttccataacgtattactaggaagaatttctgttgactcggtcttcttttacagggtacccctgaaagtggaacaggcaaacaatgcccgggatgccctggcaaagaccgtctatagccatctttttgatcatgtggtcaacagagtgaaccagtgttttccttttgaaacatcatcctattttattggagtcctggatattgctgggtttggtaaatatagttttgtttgtgagtttgtatctgtttgatatttttaca

SEQ ID NO: 63515 - DNA, 1208 bp, Bovine  19866880682091
attaaataaaagtggaaagtttcttcattgggaaaatgattccctcactcatttctccagtttttggatcaaattaaaaatgaagactattagaagatttgcagttacaagtcattatgctcctgagatagccattaaacaaaaattaaaagtgaactcataggtgtttttctaagcaattgtattctccaaattacactgtttgaagctctttataaaatcacgatgcaaaagcaatcaacagaaggaaaagcaaatatttatatttatgttaaaagcattagaattataagtatcaattttaaatataccatatgaaggaagtaaacaatctttaaatgcttttcaaagatctgtagtcaatttattccctgtcattcactagctcatttcccagctacatgcttcagatttttctgaaaaatgtaaagaagtgttttggtaacttataatctaatgtgatttcaaggggaaaaaatggaagaaatatatattgcatgctgattcccagaaataccactgacttgtgtgacattggacaactcacttcacctctttgtgcctcatttgtaaaataatggtattgtgcttaattagaagttgttaactggcaccccttttgccagatctagtctttggactagatctgggctatttcttagcccagcatgttttaaaaattggtaaaaattacacattcaaatccaaattcctgatttctctataaaattataaggtcagcaacagtgagcttatatctcatgtggaagcaaaggctgtcactgaatagcagctgtcctttgtagataaggcattgggtctttgagttattaatacttagctgcctgtttagcaactaagtttctgatgaaatagatgacctcaagtttctttcagctctaatattcccacactgaaggtgagtcatatagcaaaagggcttcccagttggcaacagtggtaaagaatccatttgccaatgcaggagacgtaaaagtcgcaggttcgattcctggggtcaggaagatcccctggaggagggcctggcaacccactccagtattcttgcctggagaatcccattgacagaggagcctgtccagagggctacggtccaaagggtcacaaagagtcagacatgactgaagcgatttagcatgcatgaatatagcaaaaagtccattcaacctctctaagcttcagctcta

SEQ ID NO: 63516 - DNA, 2498 bp, Bovine  19866880753939
taaattgagatttattagctataaactcattgttattaatccctaattggcacttaacttttatttttcaggctctttttaaagctttgggcttaaatgaagttgactacaagtttgggttaactaaagtattttttagacctggcaaggtaaatgcatttttattttaaactgtaacataattagtatggacagttggagtcagtgaatattttaagtgttcagtgatttatattattcttaaattagataatcacttagagcatgcatatatatatgggacacacacacacaaaaattttcccactggtgagaagtttccaatgtatagcactctatagagtttttggttttttccctctagctttggaggtattggaatcagaggattgtttagttgaatttttacttaaaataagggttaaccaggaatacttctattttaaacaagttgaaaggttttctaaaacattgattcggtcttcagtaattaaaagtttcacagtacttttgagtgttcattgtgagaacgagatctgttagagcatgatagatgtattgcatgtagaaaattagactggagtctgtgctgacgtctgtcaaatcatagaagggatggctgtgtgcatacttttgtactaatacagttttcttaggctacccatagttttagtatttatagattcttgcgctggtcttgtactatgatacaaaattgagttatggaagatttcatgactaaatacatatgaggcagaaatacttacttcccattcacagtctgttcatagtattttcaccactcttgacttctttaatattgattgaatattgctttctcataattttaaacacaagtattattatgtaatagacaactatacttgtttgacttagcaaaatcattcataaatgttgctttctcataattttaaacacaattattattatgtaatagacaactatacttgtttgacttagcaaaattattcgtaaatatctctagtgccttgaaggctaaattaatcagataaataaatctgacttcacattttgaggcatgagatgaaatctgtgtaatgcattaccaatgtatgccctttcctatgaatatttttactgcagaaaacctgtatcatctcttatcataaatggaagcaagttaaaagaaaatgaatatataagtattcatagttggcttagctgtagtcatgcatatttatcagaaactcaacatttcttatttcggatctataataactattttagggatttatggcttgatagagaaagcacttggttttatctgcctccagaaaaattaatcagtcagaaggacacagtgcaggcacagggcaaattttcaaagatctttaatctctgttacctttaattttgattataagaagctgttattttgataggtgtgtgacatcctcaatatattgtagtgggatattcggtaaaggatagaaatcaatatgtagtttggtggtaaattgtggaaataatgcattttgtgatttaataacctaatagatgttttatttgtgttgtctgtctcttagtagcagtttcttctttctgatcaaaagaaggatggggttgggagagacatggtagttttggtggtacccaattttatagagctgacctttgcttgtacagttatctgggaatatggatttgccagttcagagatatgctagactttttttcattcttctcgccataaaacctttttacctatcatctataatggtcatttaagattttttttttcctactttttattattgagtcttctaactagcaatgagtaactcaccctccccgtaacctctacaaaacgagtcctggaggaaggaagagaaaggcagcaaaattcagtcacgtgtgtctgggtttgctgtgaaactccactgagacgtgtctgtgtaacgggcttgtgaccccatacagaaagctagattttgatttgtgttattttgtatctcgctgtgtgtttaagcacatctgtcttttgatattattagtcaattatttgatttcccagtttgcagaatttgatcagattatgaagtctgaccctgaccacttagcacagctggtgaagagggtcaaccactggctaatctgcagtcgctggaagaaggtccagtggtgctcgctgtccgtcatcaaatgtaggtgttttcttccactctcagacctggaattatgttggaaacgcgttggcttgtggaatgttattaatttgtctcagtggtgagagctaggccacagggactgtgtcacttactcacactatgtccctggttcctcacgtaacaccttacatgtagtatgtgataaattagtacttttcgacttcctcagcttcttgagtgtacgatacttagcttctttaatcacatgtattataattaatttcatcttggtctaaaaattctatctcactatcttgactccttccctctctcccctactctctctcc

SEQ ID NO: 63517 - DNA, 1404 bp, Bovine  19866880760885
actctttaaagacaagatgctgcatctccaccaaagtattagaagtttcattctctgacaccaagtttcaagagaatacatgattagctgcatttgctttgtaaactaatggcacaatcagagtcgtgaaatataatacatactgaaatgatgtgctgtttcatttttctgagcatatgatatacaacctttaattagtttttcttaacagggggaacatttactggaagagttgatatattctggtcaacaatgtgttcaaaactggccttgggtaaattatttctctaaagttgacaaaatagactcaactggttttttaaatgtgcatttgtatcttctttgaaattatccttggtttagaatattcaaacaatcatgttcaactagaggaacaaacttcttatgcaagtccaacccaactacagacacaagttatcaactaaccacgtcatcaatgtgcagccataacttttgtcacagtcagtgtgatattgatcactctaagcaattctgataaaactgcagggcaagtcctggaagcaaagacaatgcaacagatgaaaagaggatgtccttcacactatggtgaacacattcatactcaaatatgtgcaacttaagaaagaatttttctaatacactcaatttgagttttaaaaatcaggatctatcttatctgtatacaagcaattactcaaaaaccacacacacaaaataacattctcctgcatagtttatattcaacaactgcaaaagcagtgatttgaaaccaggcatatcttgtgcctcgtcagaagcgcttggggtgactgtaatgtaacgaggtcagaactagcacaaggtgtaccagtgtaatcagagacggcgggtaagggagaagcggcagggcgaaagtacagcaacacaaacacacacaggacttccctctcatttaccgcacgagctgctcagcgagtttcattacatgaaagtgcttttgcttctagggaaaatatcccctccattggttagccatcctcactgcgaaaggactgggaagttgtcctttgtcagatttctgttacctgccagaaaatgatcacttggcagaaatactttgatggctattaaagcatcataacgatctttgtgtttaaaaagcgatcgggtaattctgagaaagagatgactttctgattctttaaaaaacaattcagtgattgtcctcagtttcaaatgtgttatcaggtagtggaacagtgagactcaaaggaaacagacaacacagagtcagagagagctctcttcttgtggaagcagaaatgtcttaagagagttaagtagctgtgcatttcagtcttacctgactggcaggcagctcgtctaaaccaaaggtacgtcctttacggaggtagcttatcc

SEQ ID NO: 63518 - DNA, 1012 bp, Bovine  19866880763455
agaagatggaacattgcacagatcaccccatcctatgctgacgatgacttcatgcattctaattgcctctactatgtcaattgtattcaggtgtcctttaaatgccttatattttaaatgtttcaaacatttcttaacataaaagaacaacctaaaatctgttgtaatgtagggagtcatgggttatgtttgttttaaacttctcctgacttcagtcttttcttagaatccctgagcatcccttccttgggatagatcagggtattcagagtgtagggagtcaaaactaagaacaaatagcacaactattgtactttataaaccaagccaagagaaaagtaagaatggttcctattgaaacatacactatcatagttcatgcaactgaaaccatgattgtcaaagatgtctgcctgatgttcaaagattctcttcactctgacgctgtgtgaagagcctatgtattctatggcaatcaaccaaatttcattaacttagttgctacacttatgcaaaaaagctggcaagtacagtcaagaggagaactttgtgattcgctaattaaggtgcattagaagttggctctatctaaaatgccacgctaccacaatgcagaagtttcagtctcactgtgtgggcaggaagtatgtaagacgatgagtcaccacctttcggaataattttctcaaatacacaatggcccctagccccgtctcttctccacccttcagtcatcctatctcagcacaccctaaccctaaccctaaccctaacccacccagctccaaagcggacctaaaggtgtccagtgacctcacatattaacatcctcagcatttgtttttctaaaatgctgcatcttctcaaagatgtctgccattaaccccaaggaatcaagagatccaactccccccacttgtaatcccttacattctttttcatctttaaaatgaggataataatgtctgttccacccactgtgtgtctgtaaaatcgtaatgcctgttttact

SEQ ID NO: 63519 - DNA, 1512 bp, Bovine  19866880768630
aaatctctgtctattttatgtaaacctctgtcctacaaattgtgtgagttgcaaaaatgcataagacttgctttctgctatccactgattatctagtaggatagataggcatgaaactgactagcacaaagtagactagaaagaaacaaagtgaactgttagactgagtaggagtgtaccaaggattaaggagactaacctattatttattttttaaaatcctctataatctcccttacataatgacaccatgatttgtgggaatctgttttctcttcctccctttccctctgggttcaggttttgctatgtgtgagttttgtcccctccctcacatgggcaccttctcccttaggctttctaatcagttttccatgctttccagggcataattgtccttctctcctaatttccttcttttcagaacctctttctgttatttcttctgcttcattcagccttagagcatccttcgacattaatatatgtgaaagctacacaaatcaagacactttcattaatgttgtagagaaagttactcacaaaggataatttgttaccagtaattagccttcaacctcaagatttattaccaatattcagtcaaaactgttcactctaatcattcactaagaaatatccaccttggaggagggacctgctgtttcttccattattattgtataacagagtcgagtttgaaatacaaactaccattcaaagtggaggtccaaccagatgctttggaacagaaagatggtctgactttactctctttgtttatgcatatgtatatgtattgttctggaatttgatcccttgaatgagtatctgttgtagtaagaggttaggagaacatgatatgagtacaattattgtaaagggtattcagtgtactaagaaaagatcagaatcttggttacataaaatcctcagctaaatgccagaaattttgcttaagtgctttgagggaatagcctaactttaaaaggagagttacaaatgcagatttaaaatatgtatgtagaatggattagacactatttatttaaatattcttaaaagattctatataatggtagtgtataattacttgtttttactcattggttattgaaagagaataagtaaaagaataataaaaatcataattacttttattgagtacttctgacctaccaggaactaaactaaatgttttctatatgtataggatcatagtaactattattattcccattttttgaatattattatgctattttaaaaaattctttcttaacaacacatggtcagacttcttgtcatctaaactttgagcttgtctgaaactcaggtatctagattttagaaaacaaggtgaaagcttatgaaataatttttttctttcatgggttctctaatacttgatagtttttatttatttacagaattcactctgaaatttttaaaatttacccacaaagggacctccccggcagtccatggttaggactccacacttccattata

SEQ ID NO: 63520 - DNA, 1075 bp, Bovine  19866880804550
taatgattttgcaaaagcttaccaaaagagtataatattttagttaatattttggaaaaatctttcctagcaacaaatgaattgcacaaaaattgtcttcattttaatttttttgctatgaaaaatttcaaacacagagtagagaaaataatatgactatcacttatcactgagactcaacacatgtaacagtctgtattttttttaaaaaaggacatttttctataaaatttcaatatagtaacaaaaagacttaaactgtttttaaaagtcaaaagtcatttgggttaaaactacataccttaattttggccattaaagcatcaatagaaatttcaaggtccttgacctgtttattcatctctgcttttccatctttcaatgcacttactacttcattaaatttatcgagccgttttttcagtgtgcccaccttgaccaggccatcaatgctgcaaagataatactttatcagtttaattctaccatttaatcatagaaatagatttttcattttaattaaatgctaaaaatatgactaaatagaatacttctgttttcatgttatgcaatattgttcttttttttaaggtctcttgttgagggtaaaagaaatcatcaaatatggatgtgaatgacattaatatctgtcagtaagatttaagacttctatacttacactgaagaatttgagaattaaaattctttaaattttaaaaatttaaagaaaaactttaaagactaattgctttgaaaatgtgttatagatgaacagttattcagacttccacgtttaaaatttctaataataaaagaatcaaataagaaataaaggctaaatttacagtgacacagtataattcctacagaaaatcttgaaaattatggtcaaaacattaatgagatgtttttaaaaacaatgtcaatttgacatttagtaataaactcaagtcactaaaataatcagtataaaacagctcctttcaatctcttatactgtttacatttctctaatctaacccatatggcagaaagtgaagaactaaaaagcctcttgatgaaagtgaaagagcag

SEQ ID NO: 63521 - DNA, 1491 bp, Bovine  19866880901640
tttattaagactctgaccaggaagtaggaagagggggaattaaaagaaatcactgagaatttgtgcactttcaaaaaactctggtgaaaagaaacttcaactttagttataaataatctataatccatagggtttttatgactccacaatttaaattttaagtgtctgaattgattctatgcgtgtacctgattgatactaataaggcacagcagaaagcacataaaatatttaaaatacaaaaaagcatatacccataaagcaagcttcttccatccttgaactgaatacttgtggatacaacagaatacatattaatataacagaatgtaactaagaaatttacttttcatttcatggttttgatttactgggctgacaaatatattaaaaatttaaaaaaaaaaaaaagactttgagggacaaagaaagcctcactacatttctgtcacttcccccgaaatacgctactttggcatactgataatcttgagttaaaagcacttgagaaacagcagctgtaacaagtgcactctgaccctttttattcctgaaagcaagagataaaactcccacttgaaaggtccctccctctaccagggggaaagagacatgcttatcaccaggggacggaatggaggacaagagcaatctgtgcagaaaaaccctgtcttgtcagactaacgccagccctccctgccacttgtccacaattcaccacccttagcccaaaagcccctgccttatcaattcttctcaaatttgttgtttctttgtctaaaagacataaaagcctcctggtctggttacttctttaattcttcattcccttgcgaaggctgctatgttcatgtaaaaatgtgacagaagttgtatgcgttcctactgtgactctgtcttatgtcaatttaattttcaggcccagagatccaaaaaggtagaggaaaatttttcctcccctacaacttcaaatatatacaaataattgagctcatttttaaaattgtttcttttttagaacatgtactgcattgttaagtacaaataggtacttgttaataaaaggaaaaactagaaacactctgtcttttctttcctgagggtatctttaattggcctcctctaacatggcacattatatattatgcatttaggttcctgggttgtttacagtaacagaatagttttctctgtgaacagacctcatgagagatctaccttgtttttctaaggttcccagaaggatggcagtcatatggcattagttaaccatgtatcagtagaatataaattattcatgaacactggcagagtctaaagtaaacagaaatgatatcaacaaatttaagttagaagtcctacttaacaggaatatttattaaactaagaagagcgaagctctcccacaaaacaagccctacagtctccatgaaaaatgaagactccaggtcactttccccccaagacttccattttgttatgcagtctagt

SEQ ID NO: 63522 - DNA, 784 bp, Bovine  19866880927930
cagagagatcttgaaaacggaaagttaagctctctccaagactcagacaatgtacctttgtaggtcaaagaaaaagtgagagtggggtggggagggaagaggcacaattgtaactcattccaagccagaaatttcactcatcccttcctttcctataaataaaattaagtttggggaaaaagatctggaaaaatatttgaacaaaaatttcgtcccaagccctatacctccttttcctcccagccagaggccacccaggggcttgactggtgttctctattggagaagcctgaaggaatacacttggaaggcttaagtgtatctgctttagtaggtaacatttccgggccacacagaaatggaactagtgtgctggctgtgcctccaagttgaccaactttgcaagtaattagtggtgaggcttagagcttgagtcttgaagtcccttgggtcttctgttcctctcatgctaaaagaagagggcagattagatgttctgaaaggtgattctagatcggaatttttccagcttgactgctgccattttggactagacagttctttgttgtggtgggctgtcctatgtactgtaggatgtttcgcagccctgacctttacccatgccagtagcatactccttaatgtgttttttttttccactaattttttggggtccacacagtgctgcatgtgggatcttagttacctgaccaggatggaacctgtacctcctgcagtggaagcatggaatcataaccactggacctccagggaagaccccatt

SEQ ID NO: 63523 - DNA, 803 bp, Bovine  19866880939407
ggctatttctttctttatttaagctttcttccttttattcacagtactagagcatccaaagaaacctcatgtcacaccatattcttcaccctctggtcttaaaaaaatgaaaagtcatcttgggtggggctttattttttgtggctgttttcgggatgaggtttgaattacccacccaggatgctgtgacgaaagcgctctttcatttctaatatgattcctctggaagcaagagtcatcctctcaatgcaattataacatgtgaatgttaatttaacagaataggccttctcaagtcttactttaatacacattgggagaaaaattttgtaatttaagaatgacttgtttttttagaactctgactctcacatttactgtttttgataggatgtttaaaaaaaacgggttgaatttggcttttagtatgaaatgtaaaaccatgaaggccaaacatacaaacatttatttcttgataaccacaagtggcctatgattaagacagaacctgataatttaaggaaaattaacttgtctaaagtgagaacagagaataattcatgaatgtactcatttttctttctccttccccattagtctacattggtctttagctctgacatgtaaaccagtgggaaaacattaactctggtcaatggactgaatggatttatttaagaagaaatatttaaagaactaaaagcatcaaattatctccacaacacatatattgggtcacagagacaaaatataaaatacatcataaatcttacttcttccagaaacctcatctcaagccccat

SEQ ID NO: 63524 - DNA, 1789 bp, Bovine  19866880994050
ctctaaagagaattaaattttctcctgccttctaatagttgcttatacatttctatttctcaaacaactgcaattactcctatggttgaagttccgaaccatccatatccgaaccatccatatcaaataaatctctaaggaaaagctgctcaatgattttagaataatatatataaattctatatatgaatatatatgcaacagtataagacaaggctactgctacggtttacagagtaaacttaaaatccaggttgcttgtactaccaccattcaaagtcatatccaaattagaaaactgttatgccctgaagaatctagaagttaattattcggaacccaccacacatgttcttaacgttatatttgagggaaggtttaaaggataaatcacaagtagagaactaatctataatgcacgttaagtatattaatggtactataaaacaattcacaacttataacaatgattctacaggaaaaacacattcagaaatagctcccaatgtcacagggccacgtgccacattcacagccttagccaccgggctaaggcctccccagactcaggtgttggctctgttttgtttggagcctctaagagatcagacaaagggctgcaggacaaagcgttcctgcagtgagaaggggaagcccggcgctgaaagggctgcagggagcccttaaacctagtttctctccatcttgtttcatcccccaaatgaccaccagccgctaccttcttccccgctttaccactactcaggagaaagaggaaattagtttcattaaggcagttgttttctcttagaggaaggaggcttcttctcctctcaagagactgcagtaaacatctaccacccagcaaacacagggcatccagccccaggacatggacaaaggaaaccgcccccgtacttgagaagattacagtcgagtaggaggggaaaatgtaaaccactgtctccaataaagtgttacagaggttaagaatgtatataccactcctcaaagcaaagagtaatcaatgcaggggaggaggaggaagagacagagcatctgtgggaaaactccagaaaggaggtgacttcagtcagtcctgagagatggattagtgtttgctgagcgcagggctctggagagcggcattccaggcaaaagtagtactgtgagcagagacacacagcaccacccggatccctgaggaccgagggggaaggctgcaagaggaagagaaacgcacacaagaccaggggtatggcaagagtgtgagagggagactgctggccgacaaaagacgagactagcaatgtagactgggaaaaggaaaggttgacccttaaatgccgcgtgttcagggctttagtctgaaggccagccagctgcagatgtggaacatgaagtcaacggagaggttcaagacggcgttcttaacagaataaaagatatcaaaatatcagaatccaccacacatgaaaaagatgtttcatctgaatacacacacatgtgtgttgttgacatgtaatatctatttgttatcagtacacatatatacacacacgaataatacacctacctaatgcaatttaaaatctatttcttactatgtgccacaactgaaaaactttaaaaggcactgctatcatctaaaacatgttccccatgagagctaaccccctcttccacgcttctgttgtatcagaaaacagatctgtttaacttgtccattgctttctgtactttcttaattttcaagtgcgagatcatactccacaaatcatccacacaa

SEQ ID NO: 63525 - DNA, 1365 bp, Bovine  19866881134945
atttcaagattatgtaaatgagctattgtctctttaaaattggggctccatggggaaggatcaacacagcacatatctgtgctctaaaggtatccaggtcctgagttctggttccctcttcatggggtgagtgataacataagattcagaaagtctcaactttctcaacttggatagaaagagcagtatcctttctgactcaaaaaattttctaagattgaagatttgaatgtgtatgtaacagttgcctcccccaaaggaattattatttatgcctcttgctgcctttattcggcaaaaactagtttaaattgtgctctctctgaattattttagtttggtaaattatctctttagatctactgtcaacattttaaaaattataatataaatgttgatgattttgtaaagataacattacagaatcaagagtaaaggaaaagtgaaggtatatgccactttctcacaaattccactccccagggctaattctatgaataatttgaagtgggtcttttcaggattgtttttctctataaatatggaaatgtagatgtcagcacagacgtactctctctatctatcactctctctctaggattatcgagaatttactatatgccagaaaatgtgcaaagtgttttggaaacattatcttgtttaaacttcaaaataactttaacaaataggtatattgttatcaccattttgtagatgagggatacaaattggtactaagcttggtaatttgcccaaagtgggtagtgtcaggataaaaatctaggcagcctaactccagagctggcaattataactttatgaattctccctatgtacctattaatacagagcctctcatatatgtaccattttattttttcaaatagaatggaaagctcaagaacaataaaattcttttgatgctaattttcatttcactgaaactaacagttatgtcttgcttatttgtttttcaataaattgattgtctcttctacttacacatgtccagctctcaaccgagtctttttcagttttattaatttttcctgcctgaatctataacccaaagtttaaattaaataacagttatgccccgcccctccaattctgaaggagagaccagataattgtgttggattagaattccactgtgttgaatttgtttgaaataaagatctctactctgattatgcctgtagtaattaaataaaatctttaccaaacatctctctgatttgttaccttctctggatgacaactgcagggcctggttactgcttctctcccaccgacatgggcacagagcacagatgaagcaggtaattgtctttcttccctctctccttcctcccttccttgttt

SEQ ID NO: 63526 - DNA, 1516 bp, Bovine  19866881298152
gaagcaacattgggaagagtgagcacgtccatgggaagacgggccagagagggctggaaagatgaagctgggctattagcacctaaattttctgtccggtgtgggttttactaacgtacagtcttgggtgcggtcctggaagtggaagtgaaggcaattggaatgaatgaggtcaaggatggtgaagttagggtattggctatgagtgttgaaacctccgaggatgatggtgggatttggagtggagagctagtctgtatcatgtagtaagtatgagggttggggagcagaaggtcagcagataattgctgccagactattttctgtaaagtgcttctctgatcgtgtcatgcaggtgcttaggaatttacaagagatctctagaccctatcagattgaaatctaaattgatcagactggtctgtaaaaatctatttattaacaggcttccccttaaccgtgaaagcttatcttttatattccttaacttgaccctgcctatcaaaccccctgccctgatctagacactcacatgtacaatctcaaatactattaccatcccagtgtttttcccctggcttctctatatttctccaccttaagactacttacagaacagatactgaaaatctttacgaaaactgaggaggacatgtattgtccttgttctatcctacacttccctcatgtactagtcaatattcctgtttttcctttttaaattaaagatttaaattttttatagcagttttgggatcacagtaaaattgagaggaaggtacagtgattttcatacacgccctctgccccaccccacaggcataccctcccgtattatcaacatcccccagtacggttgggcatgttacacttgataaatctacatggacacatcataaccacccaaggcctgtagtttaccttagggctcacctttggtgtgtgcgttggtttggaaaatgtatgatgatatgtgggtctcccaggtgatgctagtggtgaagaacctgcctgccaatgcaggagtacagagatgtgggtttggtccccgggttgggaagatcccctggaggagggcacggcaacccactccggtatccttgcctggagaatcctatggacagaggagcctggcagtctatagtccatggggtcacaaagagtcaaacacaacagaaacgacttagcatgcatgatgttacgtatctaccattattagcaccttacagaatattttctctgctctaaaaatcctctgggctccacctattcatctctcccccaaccttacacaaatttcttttagttcccattacatacacatttcccatgtgttttatgtacttacttatatctgttgcctgaaacagcttgagagaaggggttgtgtcttctgcttctttcctgagcctcattgcacctagaaaagggctggacatcattgtttatctactgttaactaatgatcgttctcagaatatcctaatatttgtacgtcctgtgaggcagtcataag

SEQ ID NO: 63527 - DNA, 1129 bp, Bovine  19866881681827
aaatgaaacatgattactgcttcattttgcttactgcttttccaccaaaaattccaaggcagttataagtcaaactaatgctgcactttaatatactgttctgaaatcattttttcaattggtatttattgaacagtatttttttaatgttttttctttaaaacagaggcattacatggctgttttagactcaaattccaaattactgaaccacatataccaaaaaaaaaaatctgattccagatgaggttcaaaaaactcttccaaaaaacaaaagcccacgagatctttagttcaggcttcacagtaaataaattattcccattccctgtatttacacaactgagataacagactttcaagagactccttcaccaaagtttatgtgtgagagaccaatgcatctatgactgtgggctcctccattcacagaaaccttcacatcaaaaggctacatttcttctcaaccaggatagagagtaccctgtaatataatcactcatacatttttggaaggaacagtttccttttctatgatgagaactacttttcaaatggatgcttacagttatcttccacatcttttttactgtcctcttctgcaggaaacacttggtttatgagtgccaaaaatgtctaaaaaaaaacaaaacaagagcttattaaactagaagcttataaatggtaaagaagtcaaaggagcttaattgtctgcatacattgcaataacagcaataatatgctcttcattaagatgtaataccagatcctcctgttcaacaggtctttaacacaaaagcaggataactttagtcaaatatattatccattattattatgaatgcaaaatcaataatagaaatcaataaaaaaaatcctgtgctctaacaccaagagtggcacaaaacaagaagtatgttaatactaacatactgcatagtacattacacaggcatgcttttcaataacttttcaaaaaataaaaattttaatgtttatatatacagcaattttattgttttaaaaaaggaaaaagtaacagccaatcaatcaaatataccaacagactataatttaattaatgttattgtctgagtaaaacacattagacacaaattcctataggaat

SEQ ID NO: 63528 - DNA, 699 bp, Bovine  19866881752301
ttgagggtatagaattccttccccctaccccatgagatatggcctcacatactttgctactctttgaagcacagttgttccccaatagttcattcttaacatttcaaagaagcttcagatgttttccttaggtttgttaatcacagaggcattataaaacctttccagacaaactccacctggcctcttcttatttggtccttccgtaactctgattactcagcatttctgtacttctctgcttatgttcggaaacttgcacattggtagagagaacttttctttactcagggttatccaaagtcaactaaaataacgatatacatgaaatgcaatggttgccaccgcctggcactagaacccattaaaatgtgaaacatcacaagatttggggaccttttaataatccccgctcaattttggaaaaccatttaatgccactctaaaacattaaaacttgcagtttaggtttgaggtacttaaatgagtaaacaaagccctaagtgcaaacctgatataaaatactttttgttgtttgtccactccaaatgcaatagtttgcatctactaaccccaaactcccagtcagtccctctcctttgccccttctcacttggcagccatgagtctgctctctgtgtctgcgaatctgtatagcacagggaactgtattcaatctccagggataaaccataatgg

SEQ ID NO: 63529 - DNA, 1491 bp, Bovine  19866881892007
taataatcttcccttccagtctggcagtgaatgcaatttaacctaaaaatatcagagaaagacaaaggtaatattttgtctcctcagtgactctgcaaagaacagttatgttctaagaaaagtcttagagcacgaaaaacttaaaacacacaaacctcaaacttttcctaaatgcactaatatattcaaatagtataagtctgacaccaagtggtaaaaaatggtataaacactttaactaaaaaaatataactggtattgttgttacaggatatttgatagaccaaaaaatttttatagtcagtcttatgtacatgtctaatattcaccgtcaacaccatcttccatctaatcatatttttaaaagatacattaaaatttctctctacatagagatgctgtaagaattaagttaattttttaaaattttcgtgtctaccctacaataagcactaacttaatattaactcttataatttcatgtcagctaggtgttatggatactaagcaacctgtccttttcctcagggtgcaggtgtgaggaagggaaacaaagggaaaccaaatgaaaccgtgttaacaggactgtaacaggcatgttaagcatgttctgggaaatgtatacgaaaggcagagaccaattccttctggagtgttttctctaagaactgctccttcctcagatacagagccttacattagaaatctgtggccctgctttctgtccatgaattactgacccagagttggacatctgtctcaggctgggaccatcatatgttttcttctaggaatttgcatttgagaatttgatactttcattaatctgagatgtccgcttgagccgaggatgtaagctgttatctggtaaggtggtcatgtgaacagagaaacaggaaaagactgcctgagtttaaaaaaaaaaaaaaagcaaaagtatagaaggaggcagagatgagagaattcacgtgtcaccagagaaacagaagatcttcttttgaggaacaagctgtgaagaatcctaatggctttccaacacacggttcaagatctaaaaatgacctgaactgtaccctgaccttgtgttttgagagacatccttatattcttataataaatttgccttccttgctaaatcttgccttagtgagtctgttattttccactaaaataatcttaactgagataccagataagctcaaacattaactttctatccaatatgttcttcagtaattcaaattttattcttttaaatatttgggtaccagttacatgatgtaattttatactaatttttcaccaatgaagtgactgtatttttataggatataaaggctatcaatcttgattttttgtgaggaaaatatttatgtaaacttacagaggaaaaagatcatttgaacttaaaattttacaaatggttgtggtcatttcacaacatacgttagtatcagattatcatactgtgtaccttaaatgttcagttca

SEQ ID NO: 63530 - DNA, 936 bp, Bovine  19866882034689
atttgatgtggcttgctacataaataggattatgaaaatgaaagaaaattgtaaagaaaatttaagggcaaacctagaaaaatttattaacaatctgtgctgttagaatgaacagtcttctgagaaacgtttgaacatttcctgagctggaacatttccaactagacttaaccaagtaactagatctacagagggaatcatctggcattgatagaggataaactagttgatctgattggtcttttgcatcttaaacttcacatgaaactagaacagtgttttcttttgcctttagtcttgggtactgtgggtactgtcatttatgtctaaaagatccaggctgattttctggaagccgcacttgcaggaagctttttgccaagctacactgtcaaaagtacactatctgtaattctgtgctttccctttactatatgtcatatttataattctataaaataattaaaaagttgaagttatataaataaaactattgtgctagctcaccctgtgtactgggtaggttcttaaaaaagaatgtaagtaaaatcaggaacagataggagttggatacttaacaagtaaaggaatgatgccaagacctaacttgtacagaaaagaagtttttcttggtggtagggatggagaatattgtgaccaatgttgaatagtaacatggaaagataaacctggaaggttcgagcaggagtgagactgttaaggaaaattcaaagtcaagtcttataggagctaataaagatggaagctagagtgagcctttaattgctgtagacttttccctctttcattctctttggacttgttcaaaggctctaaaaatccttattagttccatacaaattagtcaaaattgttataaatatcttccgattcctaggatagtattcatctgacagtacatgctgacataaaaga

SEQ ID NO: 63531 - DNA, 942 bp, Bovine  19866880359655
aaactacaataagggaaatgtaacacttactcaaggttacccaataagtcactctctgtcattaggacttaagggttttcagcttcgctgtctgatttcagtccattaggccacaaagtcatcaaaacaaaccagaaaagagcaccatcaaaaagcaaaagtaataaaatcaaaggatcctggaggagtattgtactaaaagccatctgctatctaagtccacattctcaaccctcttgaaatgttatttgtaaagatttaaaaggcttgactggaagccttcatgtctttttaaagatacagtatatctattgctgactcatgcatgctgaattgagttgtaatatagatttttgaatatacatcagagaaatgccaatactttttgcattgccaaagcccttaggctttgctgttgagaaagatttgtgattagctaagcaaatgattcttgctatagcagtaatggtgagacgaatttatgtgtgcgtgtgtatgtgtatttgtgtatatattataagtgtgtttggagaatggagatagttgcaacatttaaatgataaatactagaatgcatgagcttcccaggtggctcagtgggtaaggaatccacctgcaatgtaggagacatgggttcaatccatgtgtctcatggacagaggaacctggtgggctacagtccatagggtcacaaagagttggacacgactgaagtgactgagcatgcacaatgcactgtatgcatatttttttagttctttttttaatatccaatattctcaccagcctactagaatttctgtgccataatcaggtgaaaaaaaaagatccataactgctgtcttagtgtttccacttgactttgtaccttgtctccctgccttgctctgtcaaatgcctttattcttctcactccttttttcatttaggctggcaggcaca

SEQ ID NO: 63532 - DNA, 2909 bp, Bovine  19866880370283
ttgacattatttgtttgtgtgtaatgagtggtttcttttcttaactaatccttcaaacctgaaacaaaagttaaaccttcagcaaaacaaggagtaactagtcaatctcataatatagcttagttaaagtatctaatagagaatcatcaagatccttgcttctcctttgtggctgattaggagtatccagtggtaatatttggcaaacctctggagccagatcactccatggactatcagtactttctctttacatctaatcaggttagagagccaattccagagacctcagaagcaattcataaaactcatccttaaatttctgttcctctagtagcactcttggtaccaaaatctgtattacattagtctccagaaactatgagatataggatacatgcatatacatgtgtacatacatctcacatattagtgaaagagagagaaagaatgaaaggttataaagaactgcctcatgtaattttggaagccaaagaggcccaagatctgtggttgacaggttcaggactcaagaaaagccaccattccagcctgagtccaaagactaggggaaaaaatcaatgttctaactcaagtggtaagacaggagaaccctgttactcagtctctttgttctatgcaggtattttggtcttcaactctttagatgagggccacccacattaagaggggcaatcttcactcagtttattgattcaaatgttaacctcatctaaaaacatcctgatgaacccaccagtaggtttgactaaatatctggacactgtatggcctgattaaattgacacatacaattagccaatacatcatgttaatatatatgcatcataagattaaagctgcctggagtgtttagccaacatgcagactatacaaacatcctctagtcatccttggttaggtctactgtaataaatgttcaagctaataactggttatgggagtgagggattttagtagtatctgattaattgtagccttattaaattagttaattcagttgcccaggatggtcactcaaaccttgagtaatctttgcaagagtgagacagaaactcttgctattttatgttcctgagatttagggaatatttgtttcagtggcaaaatgtagcccattttgacggatgtagtctcaatctgtaaaacgtggggttttaactagatatctttaaagtcacttacagaacttacattctatgattttaggtttcctgatttcaaataggaaaactcaatcatttgaaagcaaaacaactctaccaaagcactcagtgtattaaatgaaattctgtggccagaattgtggttttcaaattatctacccagtaatctgtttccattacattgcctcatgctctcttaaactcagcaattgtttaaaggaagcattaaaatatataccttatttaggaatgatttttatctaggaattaactgattattatggcaccttttggaatgtaccatttgaaaatgccagagtagctcatcagtagtcagtttcacgcaaaaaattcaacctaaactcatgttatttactgactttgtacctagccattagcaagggagtatgggaaatgcagaagtatatgatgtgatccaagtaatttcattaattttatcttaaccagcatggaatataatcacacataaatgacacatttaatttgtttagtatgaaattatttatgccttgatttcttgtggagaacaacagtcctctagggtaggactaactatgatgtaatgtgaaattatgaaaggcatttctgaaagctagcaaatcagagtctagcatctaatgagtgctactgctgctaagtcgcttcagttgtgtccgactctgtgtggccccatagacgacagcccaccaggctcccccatccctgggattctccaggcaagaacactggagtgggttgccatttccttctccaatgcaggaaagtgaaaagtgaaagtgaaatcgctcagccgcgtctgactcctagtgacccccatggactgcagcctaccaggctcctccgtctatgggattttccaggcaagagtactggagtggggtgccattgccctctccgtctaatgagtgaaactaccttcaaatctgtcacattgagaaattgtgtgactacaccttgagatacagcaagtgccccgaacattcttggatttcctcttcagggtacttgaggcatttttgtgaccattttgtccattgaatgtgctatgctattgattattaaaaatggtcattcaaagcctttgcatgtgaactaacatatatgatagatctggacaatattatatttattcaaacagcaagttgaatttcttattttatttcttttgtggtgtgtaaaagtagccttgaaggcagttatcaaaaaggggtaccttagaaacatcaaaatcaaagttagatttcactgatacatgtagttttcaaatagacaatactgaggccaatcatccaatgattgatttgtttgtgaacgcatatgagtatacacattactatgttgtgtgcaagtatgtgtgtatttctgagaatgagaggttcattattttatgccttataacaagtgttatatctatttttaaagaattctgatgtaccttgaggatacacacacacacacacacacatatatgtttatatgtatatatgtgaagcaacatacaagggaacctgagccactgtactgcaggcactgaaccgatatgatgtgacatgttaaacaaggagatttcttcctctggagactttaaagaaaatgatagatggatgtccatggaattttgggggctgtggtatcaccggaagtaaaaaaaaattatcaatattaataaagcaatttctacatctctaaactctctaaagg

SEQ ID NO: 63533 - DNA, 1752 bp, Bovine  19866880602937
agagagctgatctaattagtttatgcagcccataagcagaggctccaaacatctttcttgtttgtatactccattatttaatcttacgtggttctctcttgtaaaaatctgtcttcagtgtagctgattttaactgacagtttgctcagagtttcctggactgaaacttagaatagggctgtatttaaatgtacctatctcctttatgtcagatcaaagcaagtatgccatttgttcctagctttcaagggccttcatttaattcagaatattttaaaggaaatactcagtccagggggttttatttccaaagatgacacacaatcaatatttgtggaaaaaaatcccatgatttcatttctgcttcactgtaatgtttttgttacctttgtgatccatgccacaaaagagtattatagggcaataagtcacagtacggtaggaatgatcattatcttgatatttgcaaaaacaggctctctttaagagggttactgataatctaactttgtcagtggagcactattttgtaacaataataagagtgcttggtaatattaattgagaacttacagtataccaggggcaattctaggctcttcacatatattaaattatttaataaatagtccaatgaactaatattcataaatccctcaaatttgtatgtgtgtttctgctttttgtaacttattttaattctccatcttctgttatggctttgaccttcattacatgcctgaaggatagacaagtaatgtgacaagaactttactacaaataaagagtatcttcataaatggattgaattactgtgcaaatcattatttattaatcaccaaagtgcattcctgactacattcaagtataggaagggctgtcagttcagttcagttcagttcaattgctcagttcagtcgtgtccgactctttgtgaccccatggactgcagcatgccaggcttccctgtccatcaccaactcccgaagcttgcttaaactcatgtccatcaagtcagtgatgccatccaaccatctcatccaatcccatgaacagtgtgaaaagtaagggctgtacttccagaagtatctaggagtcaagaagtctagaagtcaaggtggccacaggaattgctttggtcaatgacatataaacagaaatgatatgtgtcttcctggtggatgcatttaggagccagcacacactgtgtcatcttttcttctttgacattatattagggttctccagagaaacagaatatatatgactgatatctgttctctcttgcgtgcacgtacgtgtgagagagaaccaggagagtccatggcataaattctagtctaaaaatagcatactctacccaagaagagctgatatttcaatctgagtcccaaggctagagaaaaaaaaaaatgtcccagatcaagcagtcaggagttttctcatactcagtctttttgttctattcagtccatcaactgattggatgagaatcacccacattaaggaggccaatctgttttactcagttgactgattaaaatattaatcccaaccaaaaacatcctcatagacaaacccagaataatggttatgggaacaagaagcaaacatgtttttatgcgtcagcaggagcaatagcagtgccagttgaattttcattccttgattcttgatgtctcgatttctgtgaattctggctatcatggaaacagcaccatatgttgaatattgattcagagcaaatactgt

SEQ ID NO: 63534 - DNA, 2068 bp, Bovine  19866880931843
cacattttatgggagtgaagataatattgctcattaaagacagagcaggcatatggcaaggtactttattaaatacatattaacggtagcaaaatggaatgaggggttgcatttttctcttgaaaattgttttaaagtaatgtggtagtttcattggtgtcaactctgaatctcatgctcccattgatatataactcagtttagagatgcaatagtagtagaaaatatgaacaaagtaatacaggaaaggtggaagagaaatttgagtaaggagacagggttaaaatggaaaaactgtaaaatgtataatgtcattctcaaaaatgaaataaaaattgtaatataattaattgcaaaactcctttgtagcattaaaatctactataagagcaacttagaatcatgatttgcagcaataattatttccatctagtaatttctaatattattatgtattatataattgttataatttcttatattgctatatgacataataaatataataaatgtgtgtgagtatgtgtgtccagttgctcagtcatgtctgactctttgtgaccccatggactgtagcccaccagggtcctctgtccatgagattttccagggaagaaaactggagcaggttgccatttctttctctgggagaccttatcgacccagggatcgaacccatgtctcttatgtctcctgcattggcaagtggattctttatccctgcaccacttcggaactccaatataatgaatatattataatatgtaataaaatatattaattattataattagaaataataattctaaattattttcatctaaaatttcagctaataatttccatcatgctttagaaaaaggttcactaaaccatctatgatatatatggacacattctaagttcactgggttggctaaaggaatgatcatttaacagcatactgttcacattatctgtgcctttgtctatgtgcagacaaacactctggaaagtcatacattaatgcatgtgggtgtgggcaatagttccttcacaggacagctggatgcatcccataaagacgttcagccaaatgtttattctaaagccttctggtgtgaagcacagggaggcctgcagcacagttagttggaagcagcccctaatgcagaaaggagagctcagtgtactgataacaggttctcactcctgctcgttctttgagcaagagggtaaaaggctacatacgtcatgtcatttgccaatctaccaattatcccttggaaaagggaggcaaaagcacaatctgatagtagcagtgtaaattatcaacaagcttaaataatattcattttgcctctgcattcttgtctttttaaaacctgatctctacacatagaactggaagggttaaacacacacacactcatcccacgtattttgaataataaaatagagttgtgcatattttcttacaacaataatagttcttgacgaaaggcaatttcccctcaggtgacgtttggcaaaatctggaagtatttttaattttcacaacttgagtggtaatactggcatctaatgggatgtgtaccaaggatgctactaaacatcctaaaatacacaagacagtcacccacagacaaaagaattatctggtccaaaataccaatagtgctgaggctgaaaaatcctctgctagatatagtcaaacgtgttgagttcagttcaggtcagttgctcggtcgtgtccgactctttgcgaccccatggactgcaccacgccaggcctccctgtccatcaccaactcttggagcctactcaaactcatgtccatcatgtcagtgatgccatcaactatctcatcctctgtcatccccttctcctcccaccttccatctttcccagcatcagggtttttccaatgagtcagttcttcacatcaggtggccaaaatattggagtgtcagcttcagcatcagtccttccaatgaatattcagtactgatttcctctaggattgatcggttggatctcctttcagtccaagagactctcaagagtcttctccatcaccaaagttca

SEQ ID NO: 63535 - DNA, 1677 bp, Bovine  19866881170324
catcatcccagagtaatacatctgaatttgatacattgattggttcattgaaattgagctcttcagtagatgatatttaaatatcaatcaccttatgaatatttaaattcaagaaatgtcaaattaaaggtttgctcatcttatttacttttaagagttcttcagaaatatcagataaaatgagatcatacttggtggcagtttaaaactcttaaaaggctgatctttgcatagtaatactccaaaatattcaaggggaacctattcaaatataatgtaacctttgggtttattaaaagaaagttgcttcaatctcagaaaaacctgttatatttacctttaacaacattttccaattaactcttgatttaatatactggatttaattctaagctgatgcattggaatgaaaaatcaattgtattaagcagttttatttgtgtgatttaagtatctatcaatatagtggtaatttttgttacattctgttcctgactgattacatttaacttttagagaatcccaaaggtactttttcatatattttccacttcttttcagacaaatatttaataatttgaattttgaaacactaaatgaaatctgtaatctaaataatgtccatatacaatttagcttaacagataaaattttatttcataaatatattcttcttaaaaagaaatctagcatgttctttggaaaagcaatttatttgtctttaaatgttatttagttcactaacatgtcatatatatatatatatatatgaagttatttacagagtttatccattgactataagaatatcaatgttcactgaatagtgtatatgtatcccttctactttctgagcatagattgagggatggatacatataagataacaaaataattgccataaaggatcttattgtaagttcatatctgtagcatatttatatatatatcagacacacatttatttgtagtatatcaggtatgatacatacatacctgataaatgccatgtatatatacatatgtatcgcttcccaagtggctcaatggctaaaggatctgcctgcagtgcagaagaggcgggctcaatccctgagttgggaacatcccctggaggagggcatggcaactcatcccagtattcttgcctggagaatcccatggactgaggagcctggcaaggatacataccacagggttgcagagtcagatgcgactgaagccactgagcacccttgaacatctctctctctctctctttttctatctctgcatttgaaaggggtcagaagcagtctgaccaaactcagagaaaaatttagggtcacagtgttttcaagaggcagtttgattttctttatgaagtatgggtggagagttaacttctttaggggcagtttagcagtctaggacagttcatctatccaaattcacatctacatgttctctacctactatttccctttccttctcccacagtctggaattagcttcagcttttgactctgtttctctgtttgactctggtttctaatcttgcatatcatctccttgacattcacagataatttgacttattttgccataggtctttgatcctagacttcataaaggatattcatgtcatccgtcttgcttgattttttctgcctctcacctttacaaatcaaaatccat

SEQ ID NO: 63536 - DNA, 1194 bp, Bovine  19866881732867
aatgttctctattgtcgcgttgcattaaacagccacgacgtggcccagactgagtgggctgtgtaaatggttaggtgttctgttttcatcttttgtttgtgttattttcctggctgataaatggtgctgtaagccttaaatagctactttgcattcctatggggatattgtgtgcatctttatgcatccattttggtttacttatattgtgattccacctctttatattaaaaatttatattttttgttagatgtttcaagtatgtggcttttaagcatcagtacttcttgtgttcattgtataaggaatgaccttcattacagaatgcaactatggggaatattggtgagcaaaggaccagcttgaccagaacaagctgcatcaggtttaggactctggtctagacttaggattcctggtctagctcccagttttcaagagaatccatttgaccttcaatcttgcggaggcaacagaagccttaacacaccaacatagtaagataagaaaaaaaagaaaataaaagtcatctttttttaaatttcaaaaaaaaaaaaaaaatcatgtgaagaattcatcccctttaaaaagcaacaggattctttccatgcattatctttcccttcatttgcagcgtttcgcattttatatttgagtaagaagaaaagagaacagtgagcattaaatagcaaagatagaagccttagagcttggatgttgtagcagatgacaatacaggcattactaaagataaaatgagtttggggctgatattaatatagtgatgagtttggttacagtgtgtgatattatcataaattaaaacatggagattgtccaaggcaagctttttggcacacttttatttcctagatttgataacatggttcacctagctctcagctgataaaaatatggaggcatgatcggatattctgatttatctctttgtgttgttgttgctctcttcttatcccttccactccagtgctcctgtcctttggtatatttcatagcctgacatgcagctgtaatggttctattagctgccacagatgtgctgagcttgctttttgaagcgagcatgtcgtcaccggcacttttttgcagttccttattagtatgtgccctttcccgactctgcaggagccatcacctagaattaaacattttatgctagacctgtccttact

SEQ ID NO: 63537 - DNA, 720 bp, Bovine  19866881977905
catctttgcttaaaaaaaaaaataaaaaaggagagagagagaggtaggcctatgaggctttaatttaaattaatgggaagtatttatttttcctaaaaatattttaaaatatatattaaacaaatattgaaataaataagaaaaaataaacttttaaggagataaaactcctgttcctgtgtatttttttgtatgacacaaagcagatgctacttcagtggataaagaactttgttagaaattctatgcagagattttctattgagctgttctaatagtgatttcactgtttttcagtgaatcacaactatgatacttctgtgtcctgtaacatttatgtatattctacatattgctttaaaactgcatgaagatctggttattgagactattttaattaagctctttatatatacagtcctttgcaatgtaaacattttatagaaaacttaaaagtttattttctttctctttcttgtgttgttgtttttctgtacgactgtggttgatgataacttccacagtacagaccattctaggaaacaacacatactatctcttttttactggctattttgctgaagttagttaaaatttagatttcttcaactattcctaggtattacatcttgctaagaagttaaaagttatcctaaactgtaatatgcttaaggacattccattcaatattttatgagtcaatctaatatattaagagta

SEQ ID NO: 63538 - DNA, 986 bp, Bovine  19866881259656
gatgattcacgtcctgggaggattggaactggacctgagtaattctgttgcattactcagaatggtgtgcaattgaaaacttacaaactgtttatttctggtatttttttccatataatgttttcagactgtggttgatcaagggtaactggaactgtggaaagcaaagccagggatgaacagggactattgtaattttttagcacttgcgatctgtcagcactgttcttcatgtgttaactatttatgtactattcagagctattgatttaaaagcactaactttatccactcatttagaatttctcccctcagcaagtgtttcaggcagagtatttcaaagaattagaggataaataaaattccacaaagcaaatctgtgtattaggctgaccagagaaagagtacatgacacagtcagcctggtgattattgaggatcgtgtgtagctagttaagaggactgaaactgaaaaacacaccctgctgttatcatgatgcccaagcggtcactgtgacgcagatccaatctatgataatgaagctgaactcaaacttgctcttctgttcagaggagccatttctcatttattcttccctctgccctccggaaaaagagagctcaggagaatttctgtgtcaagaaatgaaaaatgcgctgaaatttcctgtggattgaaagatatttctttatctaacccatggttaacatctagatggtcaatctggacttctggagaatgtgaaagtgttagtcgctcagttgtatccgactctttgcaaccccatggactacatatagctcatcaagttccttggtccatggaattttctaggcaagaataccggactgggttgccattcctttctccagaggatcttcccaacccagggatcaaaggcatttgaaggcagattctggcattgaaggcagattcttttatttttttaagagcacaaaatacatattcacataacacatttcat

SEQ ID NO: 63539 - DNA, 1206 bp, Bovine  19866881286074
cattaaaggtggaatttgttctaatgaggtttcaagatttggggcttactttgggccctgttcatcctagtcagtcgtagagatgaccttccttctcagagattctgcagttccagacctaggcatcccctgagaaagccaggtgccatccactgcctgggaagcaacgctcccttggagttggagaggctgaatgtggggcttttcacttttgcatcaactgtagctttggaacatgagccgcaggaggtttactaggttctgtgataacatcgtggacctgaattcgagcaaactctggaagatagtggaggacggaggagcctggtgggccatagtccatggggttacagagttggacacaacttagtgatcgaacaacacaaatacctcactctctcgtaatcttgaatgtgggtatctcagataatatggtcataaaatattctatgatcaaatcccttgagcaccttgctctccttccttccattgtggtcctttacagactaaatgaccactttcatctttccctacttgagatagatgaggcatcacggttagtagaaaggcaatagatctggttgtcagctaggttttctagtctcgtctctaccagttgtgtcagttcagctgctctgagcctgtttttaggattgggtcttcaagtcccatctagcctttgaaggcctatggatttgatgagaatagaattacctgctcagcctacccaaatgggttgttgtgggaattaaaggagatcatatttatgaaaccactttgtaaatcctctacaaaagattaaggaatgtgatactattaattccttctgaagaatcaaaatagcttgcaatttatttctaatcttcaagactgtgtatatatcttttgtatttggtctttaatgatgtgcaccataatgcaagacaaatgaacagactaatctctttccccctagatgttactccaagtcattctaaagcaagaggttggagggaggaacttttttttttttttttttttttaaacagaggtcaaattaatcgcaggtacacagggttctggacttttttcctactcctttcaaagttctgagaagcaggtgagtttactgtttcactccagagattgcttaaacagagctggggactcaacatagtatctcacccatgtggagagaaaagtgctgtagttcaggacaacccataa

SEQ ID NO: 63540 - DNA, 2341 bp, Bovine  19866881408336
cttcttggaggaaagaatcattagctatgttaactgtatgttattatttgatcagtataggagtgcctcggtataaaactagttcagtatcgaacacatacgtgtatgaaaaactaaaaacataacacatcctagctgagagtcatttttcttttaataattgagcctttaggaacatttgcacagaaggcattgtctctgtaccataagtcattgaatcgaaggaaagctttttgtcagctcagcagagccctggcatgtaggaaagccaaaactctgtctcggagtcggagagcaaaccatcagggtctccagagaaccttgttgtacataaaccatcatttcattttctaaagcaactcttttggatgatttctgatctgagcatgaggaggggaccctgttcacacaccccatgaaaaggaagcaggaggaacaagtgtggctccctcaactctcccctgcaggttattccctgtctcagcccccttggcttctccttagccaagatcacaatttgaaactattttacttatgtgtcagcttgtttgtgatttattagtgataatcatccttcatccaccaaactctaggaaggtagggctcacaccactttagttctttatgtccaatgcctagcacagttcccagtccataagaggagttaatcttttttaattaaaaaacgaaagttttgccaaagcaaatcaatactgaaacagcgaggctgcacccccaatctcacatcacctgtgtctcagtccttctgctggccaagactcacacttgttgtcagggtttctgaaaaatgagacagacgctatctccactccctaatgagatgcttgtttgtaaccctgaaatatcactgcagtgaaagctgagaagccagaaagtttccaacaggaatgacacctcaaaaagatagcattaccaaatgcacttcttacacatttacagcgagtagcacttcttttgtggtttgggaagagcaaggaaagagcagccttaggtatcattctaaaactcacagcattcctttccctaaagagcctgtgtcatccaccttgcagatggtgagccaggctagatttccaaagtaaaccctgaagttgtgcactgaagcaaggtacccccatttgctcatggctcaagcagctggaccagcacccagcacagagggcatccagggacacttgactgttgatgagcaaaaagaaagcatttccctaatacttgactacgtaattaacttgtaaatgcctagaagtgaaaataatatcgggaaaagctacaatttaatacatccagtaaaaagtttttaatacaaagtatttgtggcaagaaaaacattgagtcaaaaaattgggggagcagatccaaaaaaaataaactcatggatttttaaaaatcttgtaagaataaatggtatataaggacttaccaaagattatatgaatgtatacattatcatgggcttccctggtggctcagtgataaagaaattgcctgcaatgcaggtgacaaaggagacccaggtttgatccccaagtttggaagatcccctggaggagggcatgacaacccactccagtattattgcctggagaatcccatggacagaagagtctggcgggctacagtccatagggtcgcagagtcggacatgactgaagcaacttagcacacatgcatatgttatctatcatatattcctttggagtcttgatttttctttatataaaatactgagagtaatttctcacactggaccagactagctgtgttttcttttctagtttctaaatggaattgaatgcttcaggaattcatttttgtttttctgctctaccttggccctggatctctggttctctttgggtcaagttacttctgtagccaaagggaagctcgtcatgttctataaagcaaagggataagtattgcagatagaatggctggatgcaataatttattggatgtaaaagtatatgagtcttttgataatgcatttaagtgacatcctaccagtgtgctgaaaggaaaaatatactactagatgaacaaaagcatcactaagaaagaaaagaaaagaaaaatggcgagtggtagacctgactctcttgttcccaggtagaaaaatggacaaaacagtccagaaaaatacctgattggctaggccactgaactggggagtaaccaacagaatcccactagtattctgtggtcatcccatcgactgtggagatggtcctcctctctgtgacttagaaagcagataagtgccctgacaagaagttaaaacctcttaaacatagtcacatcctccagtacatggatt

SEQ ID NO: 63541 - DNA, 2456 bp, Bovine  19866880538229
ccccaggtcattaggtgcccaatatgctactggagatcagtggagaaataactccagaaagagtgaagggatgaagccaaagcaaaaagaataccccactgtggatgtgactggtgatagaagcaaggtccaatgctgtaaagagactcattggaaaagactctgatgctggagggattgggggcaggaggagaaggggacgacagaggatgagatggctggatggcatcactgactcgagggacgtgagtctcagtgaactccgggagttgctgatggagagggaggcctggcgtgctgcgattcatggggtctcaaagagtcagacacgactgagcgactgatctgatctgatcggtgttccaggacattctactaggaaagaacagacaaagcttaatgatatacagcaatcagtgtaagcaaatgaaatgtcatgtaatagcattagataagacagaagtcagttcctgcttagtttgaaatagtctgattttttcctatgaagacagttttccctcctaataattatgtaaatgagtttgcatttagtgagcacatgccaactgctctgtgagacagtaagaaaatgtggcaggtagaaggaagaggtgagaataaagcttataaaataaataaatatgtgtgtgtgtgagtgtgtgtatatacatacatatatatatgtatacacacacttcataagcaataggtaattgaagcttcagcatcagtccttccaatagaatattctgggttgatttcctttagaattgactggtttgatcttcttgctgtccaaggcactctcaagagtcttctccaggaccacaatttgaaagtaccataagcaacttaaaaaaaaaaaaaaaaaaaaagaaacttctccccatgcttacctatgatcttgaaataaaagctaaaaataggaacaacagtatcctaccagttttttggagcaaattgctgagataatgaataaccctgatgtaaaagtaccttcactctccagaaacagaacaggaatatcagagatctacttaacacgaaaatatactcagttccacacagttagaaaaacattcacatccataagtggaatttcagtgtttggtacagttagtgggtgaaaaagaaaagggagtttttctacacaattattaatgataatacaacttgaaactggatttgtatcattacccagaagcccgcagtcaagcaggaatgccaacgccacagatattccctgatgggacccaagtcacagggcagcacctggcctgtctcccgaggtggtcaacacaaacagtggatttacctcgtttcctttgggtccttcctgtaatctgaacacggcacagaaaggcccgccattaattgagaagggaagggaggaagagagccccttgtttcctcaggccagcagtgcctcaggcacaactcgaaaaacaagaaaataaatatttttcaaagcgccaactttctgtctcagaaaaacgtgttgctgtctaataatttaaaaactataaccacaggcacagatggtggggatgggctataacagcttcctagtctctcctttgacctcttccattctcacatctaatgcaaaatggctttttcaccatgtctcatctaactggctcatgtttagaagacttttcctcaggacagaaaaagggtccagaggcttccctgacagcaccagggtcaacggtgtccctcccagggaaccaaaaccagcttgaaagaatagactggcctccaaggaaggcgccagggtgttcagtaaatgacagcatctgcatcctgagttttccctacgaagggcacattcctggacctggacagaagagaaacttgaacaaaatgcacctgctctcaggaacaagacacaagaacaaataagagtttcaacaaccagcccatgaataggagcaaaggacaggccggctgcaagtgtttcactccaagagacagtgatgagggagagaactcagacactccagtgggggctttgccatccaggaggcttgttgacatgggatcagaccttcccccagatggtccacgggacagacatagagttctaggacactgtaccactgatcgcaaggtctttttggtgaggtccttataggggctgctgtgcacaccattttggagaaggcgatggcaccccactccagtactcttgcctggaaaaccccatggatggaggagcctggtgggctgcagtccatggggtcgtgaagagttggacatgactgaatgacttcactttcgcttttcactttcatgcattggagaaggaaatggcaacccactgcagtgttcttgcctggagaatcccagggacggtggagcctggtgggctgccatctatggggtcgcacagagttggacacgactgaagcgacttagcagcagcagcagcagcagcagtgcacaccatttaa

SEQ ID NO: 63542 - DNA, 1296 bp, Bovine  19866880685441
tgttcttgctggtatattaaaaagatgacttttgtacattaatattatatcttgtaaccttgatataattgcttcttagttccactagtgcttttgtcaattctttttgtgattttctacgtagacaatcatgtcatctgtgaagagacagctttatttcctctttctcgatgtgtatgaattttatttcatcttcctcagtttgtatgaattttattccctttttagtcttatttcattagcagggacttccagtacagtattgagtaggagtggtggagattactggcttggtctcagttttaaggataaaagcttctagtttctcaccattaagtataatgttagctgtgggaagtttgtagaggttcttatcaagttgaagaatttctctatattcctagcttgctgatagttttctttatcatgaatgggtgttggattttgtcaagtgctttttctgaagattagattttttttgttgttctctgtttctatctacaattactcctccaagtttcttggggaaaaagaactattcattgaaaagtattctggaagtccagtaagtctctcttcttgtcaccagaagctaaagataaccagatcactctttattcaccaaagctattgtcagcagcacacaggctctctcctatgtcttcagaacacagtgggtaaaccatccaacttcatagtctcctaatccacccacttcttcacattctaaaacttgtcaccaccctaaactcctcaaatcccaaatgactgactgtaagccactcacttcctatacctcctctctgagtttatatgttggataacatctactgttccctcatcatcaatctccagtttgatctgccttcatctcagtgcatcagatctttcgtatttcggctgcactcttttcagcttagatttcatgggtcataatttcaattacactcttgccaagaacttaatatcctttgcccttcttatttcttcacttccatctggcaagaccccaactggatgaatacaattcaactgccttattcttcctgcacctgagcaaatatagcaagagaaaaaaacaagagggtagatgatgacactgtaaatttataatcagaaaaatcaaatttattctcaggaccatttagcaatttgagtatatcttttgttccattctttctagtcttctccacagtatttcaaaacttctccactttcctagatgtaggacaccttccttaatttcccccattgtcttcgtatatttctgattcacttcacaaagcaaagagaaaa

SEQ ID NO: 63543 - DNA, 1118 bp, Bovine  19866880713501
aagcccccagcagaggagttttgactggagctgggatgcttagaggttgataaccagataggttgggaagatgtagccaggacccagcaagtagaagaaggtgctgcagaagagaactgagagaagaaaggaacatgagattcagttctctgtaatattgttggacttaatatacacacacacacacaaaatataatacatacatacacacaaaattttctttttttaatttaatttttttaactccaaaaacattttgttttggggtatagctgtttaacaatgtcgtgatagtttcaggtgaacagtgaagggactcagccatatacatacgtgtatcccttctcccccaaagcccctcccatccaggctgccacataacattgagcagggatccctgagctgtaaggtaggtcttggttggtgatccattacatgcaacatttttctctgagaatatcaaattgaccctgcaaatcagccatggactctcaactagagtttggcaaaaaaggaagaaagaaagaaaggagagagtgagggaaggaaggaaggaagtcttgctgtgtccattccaagagatcacctcagcctttcttctaatttttttttcctttaattttcatgaacatgagaacaagtttccttattttaaaatgtaacaaaacctagatttgcataattgaaacatttctgaaagtgtaatttagaatttggcaggacgtagatttcagggaggggcgaaactttatcgttggaatttttatatcttaaagaccgcatggtgaagtattgcctgtcatttcaaaaactgttttcttaaggagaatttttagctaaacacattgctttttttttttctttttttaaagacatgggtagcattaaacatcattattacattactgagtttgaaagataaaagaattaaataattagaactgccattatcatagtcaaattatattttctgaagtttaaaaattcaacctgtatgttctcagtatattctagttgatcataagtgggtggtgtttttggcagaacttcagtacttcgtttatagaacttctgtacttcgtttataggtaaacatcacattctgtcaatcctcacca

SEQ ID NO: 63544 - DNA, 1912 bp, Bovine  19866880726129
aagaggagcaccccagtgatcaccactgcctactcggtgcatagaagtcttttggaggaatttaagggaatgagttgactttgaccttcatagaacatctaacattttcctttacaattccaaactgaattttttttgcttcttcctttgtctgtatttcagatgtgttctgcttgatgtcaaatctctaaaagctaattaaatgatagatttttttttcattgagtacaccatatatctttcaaggttaagcaagaataaaacactttgcctggatttgccatcgtgaaattgttgggcggggggaggtgggtagtagaaggaaggatatttttaaagtgatgcactccagtagaggaaaaaaaaaatcctgtcagttaaaacgactagatacagccagtcttataaatgttttataatcattgtaaaaactcaaagtgaattaatgatattttcaaaatttcctgggagaatgacttcttttctcactgaattatcttggcaacattcccaccttttgagctcactggagggtgaagagaatagcattcttcttgtcctgattttatggaaaacaaagcaatctgctgtgtttctgaggatgctgttattaccatttaaaataaatgatgatttaaaagaatctgttccttggtacctattcaggccattctaatttcattgacactattatgtacagacagttgaaagaattatggctattaagcagagtttaatattatagaaagtgaatacataatgactgtatttctgttacttcctgtttttattatgaagagttctatagtcaaccaaatttgaaattaggaaccatttctggactgacagtcaagtctagaaatggttgtaatcttaaatctcttgattttatgggaatggtatcaagaatgaatgctgaggaagaatttaagtgttaacccagcttcctcctcttttattcctttttgacctcttccaattctgtgaaagcaccttgctttctgctccaaagcgccctttgtagacatgtatgtatcactgaacgtaccaggatatgtggtaattagatgtgtatatttctgcatcctcactggcctatgaacttctttaagaagagtatcatgtacaattagtcaccagtacattctcaagagccttacacacagccttaatttagacagagactcatattttgtgttggggaggaagaacaggaagaagagaggaaggataggattattttctgggcaccgtgaatgatgaaaatattcctattaaattacatgagacctaaaagttttaaagtgtgttaaagtagaagcctttaaaacccatggcaaaaccaatggatattttagcagattaattaataatcacttctatattaaagatctgaaaatggaactagattctacctgttcctaaagtatttccctaagacaaatctgagccctttgaaaatgtttaatatttatgcaaaaatactataacaatttgaatgagaaaactaactcaaaacagagacaaccgataaacagaaaacctgtgggaagttactcaacgtttaattaagaaatgaagttagggttaatttctcatccattaaaaaaagctcacaattaaagtgaaaccaatcaactttgctaactagagtccaagctggttttagaaaagtcagaggaaccagagatcaaattgccaacatccactggatcatggaaaaagcaagagagttccagaaaaacatctatttatgctttattgactatgccaaagcctttgactgtgtggatcacaataaactgtggaaaattctgaaagagatgggaataccagaccacctgatctgccttttgagaaatctatatgcaggtcaggaagcaacagttagaactggacatggaacaacaga

SEQ ID NO: 63545 - DNA, 3712 bp, Bovine  19866880757747
atatatacatatatacacatgggtatgcatattttatatctgaatatctatatctatatatatatttaaaaatctgattaaaatattgggttctcccaaaagttcatttgggtttttcctaaaacctgaacaaacgttttggccaacccagtattcttgaaaaagcaaaattattaagaatcttctgttggcccctaggtgaatctttcctggggactatttcaatattaacactttctcacaaggagataatatacacatcaaaacgctaaactgataagtcataattgcttacatttctcctggtcatttgtccatttattctttacaatgctgtatagtttaatgatgtgaagcccagctaatcaactctcagaccactcagtacattgctcattctggtatctctcaaggattacatatcagcatcctttcaggaaaaggatatggttatctatctatggtagagttacctctaataatagccctagtattttagtgattcctacttcataaggtgtaacaattatgctattttaaaatcccgaactgcaaaacagttttcctgagatattgtaatatgaggaaaagatgcttgtctgagctatcttgaaggagaagggccagagacaatgagagccttctgacttgcaggctgtcatgatgatttctctaactctgttcagatatccattcatgttacagagagaatgtcaactcagtaatccaaacttcccattgttgctgaagtatactgcagcccctacagcgggaccgcaaggagagagtgtaagtctgacttaaggtcacgtcctcttctcccgctgaaaagtatttctttatacagaggataaagaatgtgctcacatatgtgtgtctcaatttcagttatctcgtggttcctccagctgcctcgtaagaacggaggacatctgtgtgcctggctgtgctacaggcccctgtacaatggatgatgaatattaaacaggttacatcgcttccgcgcagacattcagtgctgtggagccaagactccaaatctatgttttcccacagacgacttctttagaacaattctttagagcccagaaagctgcgtttttagtggaaatatgacttcattttttggcaaggtggaacttttctctttcatagattgagactggcttctcttaagcatgatctgtcctagacagttactgtagcaatcgtattagaaatcaacagtgttcatcttcattgtcatcatcattatcatcacttatctttacagttattttactgccagggaattacatgtaagtgttaattaactcagttaatcttctcaactctaagaggtgagtattattattacaccttgagttgacacaagaagagataaaggcaggggaatttaaataagttgcatgtggtcacagaattagtaatgctggcatcagaacttgggctctggagtaagtctgcttggattcaaactctggctcctgcacaataaacagtgtgactggaggaaggttaacttccctgaagctaaatttcatctgtaaaagtgggggagagaaatggatgatggagattaagatgcgatggggaacagggagagaatgagctgtaggaagaggaaagactgggccaatggggtggcactggcttgcattactagtcatcattttttacatttaggctgttacttctagatgcctaatgcaggtgacacaggagatgcggttcgatccttgggtcaggaagatcccctggagaaggaaatggcaactcactccaatattcctccctgaaaaatcccatggacagaggagcctggcaggctacagcctagagggtcacaaagagtcagacatgattgagtgactaagcacgcgcatgcacacacacacacacatacacatgtctaagtatccgggctctgaatccataatcaaattacacaaataaaagggttggcaaatgtcagtttctgatgcaaagtagatttgaaggtaaaaatctacacagatcctagaagacatagctgttcgtctgaagggaaaatggaattaagagttcgcactttggtaaggagagaatgaaggtattaacatgtcctgtcatcactaataaagcacattttcccagaaagaagatgaattcgttttaatcctccaacttcacactttcaaatcaggaaagtcaccttcaggcagtgctatctgaggataatgaagggcaacagaaaagaaagaagcaaatctaaaaatttctgatgagtgtttcaatgcataactcaaagtgacctttatcttaatgttagccagaaacaaactaaataagcaaagaggttttttacatacttagcaaactaaggaaacaacagaaattctagcaactgcctgtgaattattttctttcaacatcagttgcttaataagaaatagaaaaaagagagagaaaaactctgttgacactgggagaaagtgatatttagacactaacaatcattctattttggagctccttagagaagtcaatgaaagtcagattattggggggggagattttcttagttcacaatgtaaactctgataatttaaacaccgcatacaactaacctagtaagacttcctggagataaaatagagacaaaaagaatgaaataaaaatgttttcaaccagaaggtatacgacagtggtgaactcattgaagaacaaataagttctttctaacttactttcaagctgctatccttatttataggaatattttgaagaaaataagtgaaattcaccttttccttacaaccaatacttataaagcttgaaatacttactcatcaagagatacgctaaggacaccaaagcagaaacaaacagatgggacgtaatcaaacttaaaagcttttgcacaaacaaagccatcaacaaaatgaaaagacagcctactaaggaaaaaaatctgtttataatatgaatatataaacagctcagacatcaataaagtaaacccaattaaaaactggacagaagatctgaacagagatttttccaaagaagatattcaaatggccaacagatacatgaaaagctgttcaacattgctaatcatcaggaaaacgcaaaccaaaacttcactgagatattatttcatacctgtcagaagggctatcgtcaaaaagaccacagataacaaatgctggcaaggatgtggaggaaagggaacccttgtgccttgttggtgtgaacgtgcagctactgtggagaacattgtggaagcttctcaggaagactaaaaatagaaattccagaaattccagaactaaataccagaaattgcacttatctgtatgtctgaagaaaacgctaactaaaaaagagacatgcaccccaaagttcaaagcaacatcatttacaatagccaagatatggaaacaacctaagtgtctatgaatggataaagcagctgtggtatataatatacacaatgaaatactactcagtcatagaaaagaacaaaaccttcccatttgcaacaacatggatggagttggagggcattatgctaagtgaaataagtcagacagagaaaaacaaatactatatgattatcacttatatttggaataaaaaatacaacaaactagggaatataacaaaaaagaacagactcagcgataacaaactagtggttaccagtgaggaaaggggaaggtgaggg

SEQ ID NO: 63546 - DNA, 948 bp, Bovine  19866880820611
attaggcacaagcatcctatttgattaaggaagtgctctccctctgggcaaaatccatctgcatctaggctcctgggcactaactattcagcattttattgtatcagctaaactttgacaaagacaaaatctttttaccctctaactcataaaacctcctaatttatgcctcagcctcacttttttagagtgcccactgggataattatagtggttgtttcacttctgtctgctttatttagataataagccctaaaggccagggatgcctttccagtttctatctatatcaccaaatacaatatatgagaacaacgtttgtgaaataataatattaggctttaatagcttttggtaacaagttctgaacaatgcaggcaccatattaaagtcaagttctgtttacttccttcttgagatttctacatagatcccaacataagaaattataggccattagtgtatcattcagaaatttttatccttgaacatttttagctgtgcattactggtacttaattctatttttgtatcatacatatggttttctctagatccaatgccaagaatttcattaaaatttttttctaagggatagctcagtaatgagtgttcttggtaccaacactttgtcaggcacttttaaaagtggtttacatataaaaaattgaaaaatatttaaaaacctgttcagtatcctacaactaagaggatgcagtctgggatttgcagacagattgactccagagtccgcggtctttaccaccacatttcacgtagtttcaactccaattttgaagaaaaaggagttgaacataatgggtcatcataattactaatctaacctcatactgcatttcatgatatactaaattctacatcaacatacagaattttttattatgtctagcgtttattaaaatataaatgcttttaaagtataataaa

SEQ ID NO: 63547 - DNA, 805 bp, Bovine  19866880833589
atatataattattatatggataatacaattataatataccccattatatggattaaaaagaaggaaggataacaatccattctatttgaatactttgtaccctacataacagtccccaaacaatcctgcttgatcctcatgagtaaatattcctttgaagtatgtgttttccttattttatgtctaggagtgcttagttttgtacaaatcctttctaagtttagaccccaggtcacttaactacctaccaagttttattgctggcacagcctcctgtcattaaaccagagagagatgtcttacattctaattttattagataatttttcaaactttaattatataagaaaaaacaccagtggaaacattagaatctccttagtatactgaatatttggagtttaagtacgtaatattttattccataataaatatgcctaactcattagaaaagaccctgatgctgggaaagattgaaggcaaaaggagaagggggcagcagaggatgagatagttagcattactgactcgatggacctgaatttgagcaaactccgggagatagtgaaggacagaggaccctgactgactacagtccgtggagtcttagagagtcagacgcaacttagtgaccaaataacaaaaatatgcttggaattttcaaagttaaaattccaaagataatgacctttcagttggatgaatattagaacatcattccccagatgatgttcactttgtgcttttgtgctgtctggaagatgatacttcattcctaggacaggagtctttgtaagaagagggg

SEQ ID NO: 63548 - DNA, 1989 bp, Bovine  19866880864751
atatatgagtcctactgattctaagtatatgaaaccaacattttctctttgtcggtttgaattcaatttataaatgttgatatagagacatttggaaaacatagttttcatttctaatacacttacaccataatatatcaatatagagaaatcggtagattctaaagcaaggaaaaccttctagaagagtatgaaaacaaatgaaaaacactgaatcatatctgatcatagaaaatatcaaatagctacataaaaccatcccaagcataaagaacacttggcatatataatggcattatttcaataagagtatgtggtccaaggcaataaccagctgttaatatcactgagctctcctatgcaacttaattagttttcagtacatctagcaattactgttggcacgcattcgagttccatatcttgttgtcttctatctcaagaggtttcaacccgattacatttttcctggtttaaaaccataactcctttattggcatccaagtatcaagagctgaattctgtgtctttcaccctctgcttttccctcatgtagacttatgctgttagaaatggttacttgaatttcagtagacactcaactgatgtatccctaccacaatctcagtcgataggaactctacagtccccatctgaggactctgatcttcatcatcacttatgaaggaatactcaccaacttaggaagtcttcgttttagccaagatagtatcaacgggaaactttccaagtcagaagagtaaatggtcttttgtcttcaaagtgtaatcaagcaggatcccacaggtcctctccagggaaggtcctattccccatcctctctgaagtacccaggtaacaaaatgtgatgcatatttcctgagttgttttgcagatgctattaataaaactcccaccaaatggaagaaattaacacaaccccctctgaagtctgaccaaactaggaactatttgcaatagctcatcatctttccacttcaccatcaaccgatcggagaattgtgcatgagctgatcacgtatcctggatgcccctttcttgccgcacctttaaaaatgttttgtggaaacccacagaggagttcaggctttttgagcactagctgtccctaactctttgcatagcaccctgcaataaacgctgcactttccttcagcacaacctgatgttagtggattggctttacttcaggtgaggcaacccaagttttggttcagtaacaaagggagagtttcacaacatagttagggtttatctgacagaagattcagagcacttggccagtaattcttagttagcaacatttctctcctttagtcctccgtggacatgaaataaattttctttaacagattcctcaagtgcttactggacacaaagaactttcctggattttttaggtgtctggagcctggcatgtgcttccgggcactgacaagatcatcccacaaccatccagagtacttaaaatactatttcttcaataagttaacttagattcttactgcttaggtcatttacagtgaacgtaacttttgtttgtttgtttgtttctggctgtgccacttggcttaacccctggagaaggaaatggcaacccactccagtatccttgcctggaaaatctcacggactgaagacagaggagcctgatgggctgcagtccattggctcacaaagagtcaggcacgactgagtgactaacacttacttaacggatcttagtcacccaactagggattgaacccaggcccttggcagtgaaatcaccaagtcctaaccactggaccaccagggaattcccaaagtgagtataagtttgatagagctttctaattccataaatttttactccatgtagtgagttattgggaggaactattcccttcctaacactgtatgtgtgtgtgtgtgtgtgtgtgtgtgtgtacatgtgctcagtcatgtctgattctttgcaaccccaag

SEQ ID NO: 63549 - DNA, 1526 bp, Bovine  19866881168634
ctctcagaccaagtaacagatttatttatttaaaagacctgtctttagggggaaagtgggagagggatctattaggggtatgagattaacaggtactgctgctgctgctaagtcgcttcagtcgtgtccgactctgtgtgaccccatagacggcagcccaccaggctcccccgtccctgggattctccaggcaagaacactggagtgggttgcccatttccctctccaatgcatgaaagtgaaaagtggaagtgaagctgcgcagtcgtgtacgactcttcgcgaccccatggactacagcctaccaggctcctctatccatgggattttccaagcaagagtactggagtggggtgccattgccttctccgattaacaggtacacaaactatataaacaacagagaggaaacaaagacctaccgtagggtataaggagctgctcaatgccttgtaataacctctaatggaaaaggatgtgaaaaagaatatacatgcacacacacacatatgtaaaactggagtactctgctgtatacctgacactaacagaatactgtaaatcaactatagttcgattttaaaagttttttaaaatttaaaagacctgtcttgttcagaaaagatttaaagatgatgaaatatatatcttattgataaagaagttgagaccagagataaagaatgttggaacagggtcagacatctcatatttgcatcctctctccagtggttccacgagctactccctgtgtgaccatggacaattccacacctcagtttccttatctgtaaaatgaggataataacattactacatcaatgattaactgtaagaattaaataaaaatacacatcaagcacatagtaaactatcatctccctcagacaaaataagatttcaatgaattttctaggtgttttaaaattgctatgttttccccttccatatgcactatctcttcaattagagctgaaatcacataaaaccaataaagtatgtttgggtaatttccagaacatcgagtagcagcgatcagaagggaaatatattataatgagaagggaaagatactaggttcaatgagaagtatacaaagtgtatttggttaggaagatcatttgtgattatgagatgattaacattactgcagattatagaactatcattgtagattttgagttactggaaatagaatgccttaatgtagtagatttggaaaactgtagttcatttggtgttacacctgaagtgcaggggaagtaggaagggaaagttttagagtttgtataatcttgtaaaagtaataacaaggtgagccacagacacagtcagagactaattagccaaatggagcagagagatggctttaccaggctcgcgataccatatggagcaaagccacatgcagaggaagcaaagacagagcaacaagcagatgggttaggtccaccttgggtgaaggttggtggtggagttaggagggagttatgcaattgatgaaggacagaaccccaagggacatc

SEQ ID NO: 63550 - DNA, 899 bp, Bovine  19866881209626
atcctttctcttcatcatggcatttttcccttgtgtccttgcgctatcaagaaggccttgcattcaagaccaccaatagtccagttgtattcatagctctctctgcttttcaaggaggatacattttcagtggtttatataatttcagtacttaagttctctcaagagagattgttaatacaatccaacttactttttcaaagctttaacataaaagacatgattgtaaaacgtaaaccttgtcagtcaagatgtgcatgcctcacactcactcattcactcacactcttcccctgagaattacaagctgaacaagtcagaggaaatttagcaaaacatactgaagtgaaatgaattcttttgaagtagcagaacttgtgtacaaatgtatgatttttatttgctaggattgtgtttgaggaggtgttgccacagggctggccagagggcagagcacccaatgctttgcttgagtaatgtggagagtcaggagttcagcttgcattagcgtctgcacgcttgtgcgttgccctgagttgtcagcgttctgtgctttcctgcagtccgtgttcctgcatgtgaacataaggtgagtgactgggtggcgcagtagaatctaatctttcattcttctgccaaagaaaccaaattagaatgattgatcttgagtttccttaggatttgttgaaaatttctagataaaaagtttacagcatttgaccttaaacttcatggtctttgtattttctttggcaacaaaaattgtttatatttagtttatttggggaaaagcttaatttatatcacctcaactgagatttaagcagtaacatctctcagccttggtttttaaatctggggcatatggaagtgatgtatataaaaggctcagactttag

SEQ ID NO: 63551 - DNA, 1306 bp, Bovine  19866881288747
tccccatctatgtcaccatgacccatacaccctcttgcttaagctggaaacctaggagtcgtctgtgaaatcacttcttcccaccacttttggaaaatttaaatgaatttgtcgaatgaagttctatattacccatctaatgcccagctggtcgggtgattacagtcagagtgtggtgatgagacattatactcgtgttttctcacgtgtttgggtttctggccacactgttccatccccatgtacggggtttatgtttttgcattttgttactggtggtgtattgttggtgttctgtgtaacacatgcagggaacatccactatagaacagctgagagattctctcctctccatgaaggcattggatttgttgaaagttactgcgtatggcctttggcacacacagctctcagcagtattgccctctttaattatgtcccccaggaaaaaataatcacttccctggtgaggcagctttcctaatcaaagacttcctgggtcttaagtaataagaaactcaaaagtttcgaatggaaacttatagtggggcttaattgggcatgtattttaatctcctaggaagatgaagaaactctaaatgttacatacaagaaaatatttcatgagggatacatggatggtttcatatattttgttctgtttttatttaagagaagttactggcaaaataatgtgtgcattagtattaaaaagtttgagtaatgtatcttccttgacctgtaaattactgcttctttcccaatcattttattgtcattatttttcacttgaacctttttctaggtttgagaaattttgcttggttatcatatgaaggaaggtgcctcaggcaagtagactgaagacctgagtcccagtaggattttaacaataagaggaaccgtgccccctaacctcccaacccagggagacagttaacgaaaaaaagataattatagattgaactccaagggaaggccctcttgtaggggtcagaagaagaaattagctgggaagttaaaattagctagacagtggttaaagcaattaaaagtggattttattcaggactattgcagtagggccagacagacctcagtaacgaattggtttcaattccaaataaattatggacaagtaggaacttatataaattatggacaagtatgggtttctgttgtggctcagctggtaaatagtgcacctgccatgtgggagacctgggtttgatccctgggctagaaagatcctctggagaagggaaaggctacccactctagtattctgtcctggagaattcacagt

SEQ ID NO: 63552 - DNA, 932 bp, Bovine  19866881348930
acagactaaatgctgtccttggggattttcaaaacgtcaacaaatactaaaaaaagatgtgagctgtgatcaattctattatactctgctttacaaagaaatgattctatcatacaatggagaacatgtgtccttcagatagtacttaatagatcttttaatagaaaaggccaattttggtaataattgatttatgcagaaattaaatacactactgtggatgactaggttgctaaatagacaccaccacgccatcatctccaccacgaccatcaccacacactgactgagtaggtggtatgctgacacatatacgtatctatctcccagagcttgaaacagcctcatcagtatgattttcatcttcgcggtgaaatgtctcagagacatgacaaataaacacaacgacccacaattagattttagttatcttataggcgtctaaagtaatcaatgtactcaaacagcaccagcaattcctggctctaaatcatttctcatgaaaaagcacagaggaataaaatatagtaagctttatctcaaaagacattaacttgcagaggatttataaaatattgatagagtaaagaagcccacagggttaaaccctctgctaagattgatgaaattgtccaccaaaactttattgatctattcctattaaggaggaagttctgaatttctgctgagaaaggactgaggttaaccagtatcaaagggacacttcaacctcaaaaaattaattaatgaaaagagcagaaaaatattccatagttgcatggatcctatggtaaacaaatcatctttgccccaaatgtaatttatctgggtacaaattggctataaacataaattttcagaggacaagaaagaaaaaagtaaggcataccttgaacttaccggaatcagatataatcaagagcacagcaaca

SEQ ID NO: 63553 - DNA, 1658 bp, Bovine  19866880449539
ccctgaatccccagtacaaccaagttaaagtccaattccttagccttgctctccccctgtaccacggacggcacccctgcctgggtcctcagctcctcataccacctactacccagcagcctcctgcctgcagcatcctctctgggctctgcttgtcttcccagacttcagtgccagttttggaagctccccaggtgccctccccctctgagctcccacagcctttaagttcccacccagtcagtctgccctcttcttccccaggtatggaagttctatacccccctccatcatatcgccctcctccatcccccccacccccccagccaggctgtgagcttcctgagaacctgctggtctcctcctctccatctgctcctggcaggggacctagaacagaggcaggcaggcaggggctgctgagtagtgggggggatgaaggaggggaccccagtgcaagcactgtgggaagtcccgcaggtggtgagcagctctgagtaggtgtctggaagctggtgacgcaggtggggagctttgctgtcagggcctgcagtgcaaaccaccgcccccaccattttcttcaccaagcacccaagcagaggtgggagaagagacttcacagaggatgaaagatgggcggaggggactccaggtggctgacacagagaagttggagagggacaggacaaggggtggggtgatgaagatggatctggagaggggaagatgtgggcagagaaagggagggaatgggcagtgctatcccaactttgccattttctgctctgtgaccttgggcaagtcactcagcctttctgggccttccgtctgaaagatggaagcttgacttacaggctggtgagaatcacatgcaaggcaaagtaccttgtcactccattcattcattccttcatttatccatccattttcccgagttctttaggcacaacagatgtattgtacatggtgggcttcttcccctatcccagacttagggttggctcaaatcccaactcagaaaggatggagctgggaggctgaagttaataatactgattctatcatcagggcctgaaaagctccatagactgagagatggagagggggtccaaggtcaccccctgtccctcactatacacctggcttgtgctatagatgggacagtggctgaaaagtcagagatcagaaaagttccacttctttggattagcccttaaaagcttcctggaggaggggatttcccagccatctgcttggtccgaggatggacttatcattgaggccacagactggagtgtgtatgtgttggtggggacaggtgtgtgtcaggcatagggagggcgctctggtagagacaagaggctaggggaggtcacagctggttcccctctctctcccctccaggtgcactgtggtcagctgagtgacaatgaggagtggagcctgcaagctgtggagaagcatgtaagtgggggtagggctggggtaggatgggggatgggggctgctgaagaccctcatcacagctgatgggaagatgatctggccagggagatggacagagctgggttccagggtcgcacttttgggctgtgtgaccttgagcaagtcacttaagctctctgagccacagttttacatctgagaatcaggataag

SEQ ID NO: 63554 - DNA, 1424 bp, Bovine  19866880462246
agacagagcaatctgaccctgttcttgccttggaagagtctcggggctaggggtggagacaaaccccagtattttatctgatcatggaccgagggactctccggggaaaagagggagcccactggagtgtgggggtggagggcgatggcaccgcaggcagagggaacagctcaaaccaaggctagagtcccaaggtggcgagggcgataaaggtggggggtgtggcttgctgaccgctccgcccgccccagaccctggtggccctgaaaagggtgcaggccttgcagcagcgcgagtccagcgtggccccggaagcgacccagaatcctccggaggaggcagcgggagaccagaagggtggggtcgcatacacagaccaagaccgaaagatcctgcagctttgcggtgaggacctggccgctgcggggaggggcggggcgcgaacctgtgaaggcggagccacgggtgggaaggtccgtgggtgggcggggcctgcggctggggcgcggccggggactggctgggacagcaactgaagaagagatcctgaactgggtgggaggtggaattggagggtgcacgcccttgggggaaatctgtgggccctctgtctgactcctgccccgccatcgcaggggagctctacgacctggatgcatcttccctgcagctcaaagtcctccaatatgtgagtccctgtgcccctaccactgtgttcctcccggaacggaagtcctcttgagcttccatctcagtacagattcagatgtcctctcttctccacttacctgcgagcctcagaaaggcaaagggtggggagtggggatctcccagatgcgaggtcagcccctcgctgtgtccctccctctcagctgcaacaggagacccaggcatcccgctgctgcctgctgctggtatccgaggacaatcttcagctctcctgcaaggtgagggcccagagccactgtggggcagggagagggacctgggtctctgagaggaaaaaccttgtctgtcctttaaccagcccacgtcgttctgcccatcaggtcattggagataaagtactggaggaagagatcagctttccggtgagtcctgtgtctgtcccctgtgttggagtctgcagaagcagttaaagtggaccaggtattcctgggatctgcccattgagactggaatctactagaatctcttggaatctgatggaattatctggaccttcagatctacttagaaacgttatgagagatcacaacctctcatgatcaggatcccttaagagaaatcactcacaatctacagaaaggtttacttggggccaggtcacttctgttaagtatctctgggcttggctctcttagaatccattaggatcagtgagaatcctggattctgcttttttctctccagttagggaagac

SEQ ID NO: 63555 - DNA, 639 bp, Bovine  19866880495889
agcctggaccagacttgtagcaccccgccccctgccccacacccccccaccccaccaaggccccgggtggtcccctcaagcgcttgaaatggaggctcagaggaggtggggactggctccgaggcagacagcaggtcaaggctgatgctgggccagatgctgtggccccagggctggatgaggcgcctctggctggcccctcccccaccaccctgcctggcccttggctgtaaacacagagagaacaagttccgtttcccgggaaatatttatctcaggccgtgtggggagcgtgcgctggcctccgcctgtccttcctgcgggctggcctggggcaggaggtgagggggcttggtggccttggggggcaatctgtggggctcccgaaggctgagccaggaagggtgtgccctgtggctcccaccagagctggagtctgaatgccggcacgcgcggggagaggaggcagctgataggagagaagccgccgcataaccttgcctctgtcatgttcctattttcatccctgtcacccgtctccgccggttcctgcctccaagcctctgctcctgtctgctgcccccacctgggatgccgtttcttccacttgcttgtatgtcccagctctcagctggcttc

SEQ ID NO: 63556 - DNA, 921 bp, Bovine  19866880521494
ggagtgagtgaatcggaggcagagttgaaagtggacctatgtcacatattcaaccctggctctctccctgtcctcgggtgagaaggccgaagatgcccattcggggcctggtgcccagtggggtcagcatgggctcactgctgggacacagagcccagccctgaggatgtgcctgcagctgggtgctaggcgagggagagaggggggacctggagagtcattattaatttatttctggccgtggcattccccgtggggcgggggctcccccgggagctgggacagatggtgttcctgggagccagcagtgtctcggcagccgctgctacccgccaggaaagactggatttgtcatcctcccaggaagctgagaggggagagggctttggagaaactgagcccatcttgagagatgggagcggggctgcaagagcaggagccgggcccaggcttctcgtttctttctctgtgcacagccccctttccctaggccctgctccctgcaagttcaagttctgcctccttcctcaccctccccacgaggcttccccagatcatccctatttgttcctgctgcctttccttcgccggggtcccactgccccctctctcagcccaaagatatgggctatgagcccccctgggtctcatttctttccccccagtcccacacccatcacggagatggcaggtgtctgcctggcttctgagcagcgcctgctgtgtttctgggttcacttagcaccccgttccgggtgcccgggcccatgctcagccctgctggaaagaggttgctgcccctggggatcccctaacacagaaaggctaggactggagagagtaggaaccctagggtgtggctcaaactattgggacacctggaggtaaagagggatggggagcctcctgtgaaggtggagc

SEQ ID NO: 63557 - DNA, 1704 bp, Bovine  19866880523387
caggcagtggaggtgtcctgagagctcagttggtgttgagactgcccagcagactcagggttcctgggagaagtctcaggagccacactgggtccatgggggcatcctaatggacctaactcctggcttctgcttaagccagagcacttcttcctcttatctgtggggctccatgcagattaaattagttctagcaccaaaataaaaacaaaggcactgggttagaaaattagttatcaaaatgcagtaaagaagtagttagcaaagtttatcaaaggcctgcacaggccagatactgtgttggccactgagtctctcacacagctacttctgcatatacattcgctgtgtgccagagacctgcccagtgcttcatatgcatcatctcacttaattctcaccagcatcccacaatgagtaccattgccatgctagagatgaggaactgaaattcagggagttgaattaactccccaaggtgagcttactgttaagtagatttgttgtttagtcactaagtcgtgtccaatcttttttgaccccatggactgtagccccccaggctcctctgtccatgggatttcccaggcaagaacactggagagggttgccattcccttctccagaggatcttccctacccagggatcaaacccatgtctcctgcattggcaggtggattctttaccactaagccacctgggaagcccaagtagattaggtgaggtttaaattcaggtctttctggggcaaagctggcttctttgtgccacacgatgtgcctcactatgagccagaaaggtatcaaacttcatatggggactgctgtaagaagtcagtaagacactacacagaaagttcggattaccatgcccggcacacagcagccatctcacagacggcagtcacctcattcacttggcagcacaaattgaatccttctgtgatccaggccctgtgctaggtgctggagttacagggatgaatagagcatggtctttgtcactacttcctcatgtgtggagtaaagagatagaaacaggcagttaaacaagtgctctggaggtgccagggcaacaggctctttagacaatttggtatttaagctaagatcacttagagatgggtgggaatagagaagacttatgtgctgagggagcagtgtggacaaaaggcccagaggtgggaatacccatccctgaggggaagtgacctaacagacagacctcacaaactctcggaggccaggttccttctgcatcctgcctgactgcaagcgggccaggccactggctggtgctataccggcctgtatgtgtgcatctctccatcagagcctttcagcccagtggacccaagtgctgagaggggctaggtggatagggaggaggaggaggcagatatatggctggagtcggcagagccaggtgatgtatgtggtgcctgagggagctgcacagtgacgtgctggattccaaccggcaagcgttgctccgctgggattggtgccgaattattgctccatatgaaaccccaggactgatgggagctttcagttacagactgatagcaacagccaaaattggattgtttgctatttattttttttaacttctgtcaaggtcactaccataacaggaaaacactgcccaagtagcaggtattcttcatccactctgcccgcaagagcaatctgcagccacca

SEQ ID NO: 63558 - DNA, 678 bp, Bovine  19866880551332
acagaggagcagagaagagagaactaggtcagtacagctaagtctctcagccagtctgaggcagtgccacctcgacatgataaagtcccagtttggttgatttctaccacctttatgactctcacaaaggtggtcggtgctggcagataaaagccttaaagatctgcttgaagggaaaatgaaaattggcacctcccacgatcaatatctgcggctgctactgaaatgcccagtctgccttctttgaaagcatctttttctgctttttcagtcagttcttttgcacaatcacaactagagactcaaagcatccagcctgagcctgggatctggcagagggaggcagcattgagttacagtaaaacataaactctgcaggaagccagacgaggttctaaatgctatctgtgtgacctcagacaaatcactctgcctctctgggcttcagttgtctcagcggcaaaattaatacatatcatgtggatggctgtgagtagtagagctcactctctgtacaaagtagactatttcaaccttaacccaacagctgcatgctggggcactaggggagtgggcaggaaaatagcagagcctgcaatgagagggcagaacaccccaccttccctaatttctatcagaacttccaaaggaacagcccaaagaagtccttgctgggga

SEQ ID NO: 63559 - DNA, 661 bp, Bovine  19866880632153
actggcctctgctgaagagtcccgtttaatttacaatactcagaaattgcatcgcatgttttagctaaacttggaagacgactctgggattcccaccttaactctaatgcccgggccctgctaggtgtttcccttcttgccacgcccccatgtccaaactccatttcccaatacgccccaggatgctgtaagtctgcagtcattatgacgcaagttctacagccttctgggcagtgtagtttatttctccccccgctacgtcaaggtctgcggttagggactaccactcccgtgaggtagtgcgtaattccactccgcggcgtcttcgaacgcgccgcggcagccatgttggaagtggtcagcacaggggccggcaccagagggttatcgaagcagctgtcacgatgctggggtccctggtgtcgaagagaacagcgccggcgccgcggctccttcttcagctgcttaggtccccatcgctccggagccacgaaagtgccaccggccagagtgtgaccaccgggggtcgcggggagcctcagtggctgagggcggccgtcggggggcgccatggaacgtcgccggccctactcaccggaggaggggcagccactggagggcgccagagaggacgtaccgagaccccctgccttcagctgcc

SEQ ID NO: 63560 - DNA, 1087 bp, Bovine  19866880640844
aaatatgagacaagggatcaggtacttgatgggtgttagagcctgagctcgctgtgattcacagtatttcacttgatgctcacagtaatcttagacacaggactgattagctttatttgaggcaatagctgaaacttggaggggtaaagcaacatgcctagggccagcagaacctgcgccaaggaatggctgactccagagcctggatcacccagcccactatctccaaggggagagggtggtaggcacttccgtctcctgggtgaagcatgcactgaaggatgccatcgtcagctttcaggacacccttcacaagttgaaatctgcctctcgtttagatgctccaactgaaaaaagacttgcatcgtccatcttttatcaagccctttctcctttctacaccagcaagtcagcagatactttccttctacttccactgtttatgaagacatattaagacagcttggataaggagattataatttgtaattaaatattaacctttctgacagtattaaaattaaaccactcagaattcttcatccctaatcaggtggttcctgcccgtaactacatcttctctaatagtctcactagtttatggccctttccagagtgctaattgtttcaatcgctgccaacctgatgaattggcctaaaaaagccgtttcagttggaacatattagcatgccgtgtgctgcttcttgcctgcctgcctgcctgtcgagtgggtctgccctggctttgggtgaggcagctcatagctactggcacagtcagcagaagggaccatggacatagctcaggaggacacagcctcagctaccttgttttctgtggctgccaggccctcagagaggtggtgaagggggagccaggccacaacaggacaggagttggccaggactctgttgctggcagagttctaggcagttccttattgcctcagctagggaggctttccacagaaattaggcaagggtacccagggttgtgggcaacctgcaacgcctccagactgggaagctaggaggaagagaaatgtctggttttaagttgaaatgtttctacagtctccaaggactg

SEQ ID NO: 63561 - DNA, 1472 bp, Bovine  19866880667081
gtctggggggtgggcctgccctagggagtagctgggaaggggctagctagcccatgggtgtctatgaggtgcaggaccccaggtcccttctaagtctcctttcccttcccctcacagagtggatcagcattgataaggacgaggcaggagcaaagagcaaagccccctctgtgtcccgaggcagccaggatccccgggtgagctggggctctgtggggagtcacttgaagtggtgcctggggactcgtggccagctcctgctttatctccctcccctgtgcaccctgcaggtcagggagccgcaagccagcctccacagaggcctcctgccccctgtccaagttatttgaagaaccagagaagccaccaccaactgggaggcccccagccccgccccgagctgctccccgggaggagcccttgactcccaggtgagagaaggaaacttgtcattccaatcccttatccatcttgatccatcactgtgcgtggctctcagggttggcctggggatcatctgttgcttgggtctctgtggggccctacacccgtggccactggccagccaggcctcctgaaggtgtggttctctgagtcaaagggagcacagtcagcctctcctctcacttctgtcttaaaaaatagacttagaaatggtttctgcaacagctcccttagatacttaagttgagccttctgtttggagaaggcctgtgtctcagcagatttccctggggcgttctgtggaacactgtcctacaagatgccccattggaaaacgctttgttgtcaaatgagtttgggaaatggttgttactagattcttttcttagatattcccagtgcacaatagtatcagcaaaagctctgagcttgtggacaggaaggaaatcctttttcagctgtgttgaatatagtttcccaaacttaatgggccaggaaacttttccatgcaataactattaatatcctggggaactacagttgacccttgaacatggcacgggttaagggtgtataactcatagtcatccctctggatccccagttcctgtgacactgaagttccgcatggattcagcaaatgtggctcatatattgtgcaataccatagtacgagaaaaaaactgcatagagttggacccctgtagttcaagcccatgttgtttaagggtacaggtcaagtatagtgttccatggatcatactttgggaaagtgaggcttgcttttaacttatatccagttgtcatttgaacataaagactcctggtgcattttcagtcatcttcagacactatcaggcaccttggttttatcttcagccttgaataaaactaacctgaatctgtgaacaagattcctcagtagactgggctcaggtgcctccagggctttccacatctggctggtacctctcattgaaggcttttattgccctgccttctggcctctgttttcacccattttacag

SEQ ID NO: 63562 - DNA, 1976 bp, Bovine  19866880791969
ccacttaccgctatgagcggggttcccgggacacgtatgcctggcacaagcagaagccaactggggtgagtgagaatgggttaggcccaaggagaccccccaggactgtggtgaatcaagagtgtgtgtggggtcaagcctctgcacttaccattccagcctctatggccccttgaggccttgtgggtgatcctgggtgttggaggtggatgttggacccagtgtggtaggggcatgggcctcagctgagcaacccccagctgacccctgaccacactgctgaccctgccccaggtccggaccaacgtgccttcatggtgtgaccggattctctggaaatcctatcccgagacccacatcatctgcaattcctatggtcagagcctcccggacagggtgatgggcgatcccgggtggtccctgacctgactctgccttggctttgggagtcaggagcagagagtaaggagctttcccctgagcccccattcctactcccctcccccaggttgcacagatgacatcgtcaccagcgaccactcccccgtgtttgggacgtttgaggttggagttacctctcagttcatctccaagaaaggtggctattctggctgtgctgtgggtgcggcatccatctgggtgggtgcaggtgctagcctggggggtgtgcatagctttgaatatatctgagtgtgtgtgtgggtgggtgtgtaggggcgggtacatacatgcatgtgcaggaatgtgtctgaatatgtgatgtgtaaagctgtctgtgttcctgagtcaccgtgagaggtatatgcctgtgagcaggtgtgtgcgtatggaggtaattgtgtacatgtttctgcctgcctggggctcctcatgtacccgtgtgcctagtggcatggtggattgttggtgggcctatcctgcaggcactctggttcccagccccttctcagatggtctctgattcttgggttgtctgtctgtcccagcctcaggtccaagctttggggtctccctgggctgcttgggatggaggaggcccctcctggccttccctcctgctctgccagggctccagattccctgccccagtgctcagtgtctgtgtcctgttccttctgccaccctctcagccctcctgtctgcattcctccctttgcccctcagggctctcaaagacctcagaccaggcctacatcgaatttgagagcattgaggccattgtgaagacggccagccgcaccaagttcttcatcgagttctactctacctgtctggagggtctgaggcggggcccagggctgggtgtgggtcattggggatgggaggcctgaggtgcccagagtgggcagccccctagttagggggaagggaagctgagaggtggcactcagttgggtgtcccctcccccaccagaatataagaagagctttgaaaatgatgcccagagcagtgacaacatcaacttcctcaaggtgcagtggtcctcacgccagctgcccacggtgaggcttgggggtgagggcacagagggaagtgcagccagatgccacctggagcctgcctgggagggtgggaagagcccacagtgtgggcttgtgcgtggagtgggcatgagtgaggacgacggcatgtgctttacttgcggggggagggcggtttggagaccaagttgcagttcactcattcgttccatagatacttctcaaggcttcactaaacgtcagatgctgtgttggcaattgttgatgcagaaaatcagttagttacagggctcttgagtgctctgaaaggcccatggaaatctttccttcaggtggacgggagtgagcatggacaagcttgaggatgggatgagccacagtcatggcaggaagtggggtggggggtgctttattcctcactgggcctctctgctcccagctcaaccccattctggctgatatcgagtacctgcaagaccagcacctcttgctca

SEQ ID NO: 63563 - DNA, 924 bp, Bovine  19866880811675
tgcagaatgatgagctgtccctagggaagggtgtttctgtatcccagatctgtggacgtagaggagtcgctgctttagttgagttagagatgagagtgcctgggcgccagagccccagctctccagagccacctgccaccaggcacccgcatttcatcaaggctttaatcggctccaggcagtcctcagatgagcctggctggtatccggcatgagctcatcaccaagagtggcagctggaggccaaggctcccttgggtgagggagaggtcagcgtttgttgggccaggtctgttctgtgttctcctccacctgcactgggcctggaaacatctgagtaggattccagtttcccatggcagggtcggctgccctttgtcagcccactcgtgcccatccagtgagtgtgctcttgggtagaatgcagagagaaagggcagcacgggttttaagaaggagaaccttagtccatagaggtcaggacctgcaaaatagcagcggaggtccatcccagggtaagatgggtcagaaccaaagttcccttcccaaaacgagttcacatctagctttcatatactctgctgtgttacacagaggcctagcagcgtcccacggagaacacagcagaaatgctctctgtaggctgatcccacagtcttctgcctgaacatcattttggaaatgaaaaattcttttaagtgcagccaaagaaaggagtctgccacttcaggaatccttcagaaactcccttagtaatgaaccctatgcagcactaatgtgacctacactaacttggccttgcagtggatggaaccttgagtaagtcccttcctcctcactgggcttcgttttccccacctataaagttagttggattgcagtctcaaagctccttttaattttcgtatttgtaattcgaagaat

SEQ ID NO: 63564 - DNA, 1137 bp, Bovine  19866880845983
ttgtgtgtcactgagtgtgtgggacatgccatgtgacggcagcgatcgtgtcctccctgttgtcaccctgagccaatgagtctgacacacagagtggatgctgcatgggatgagaggggtcacgggtgtgttgtgagtgatgggggtgtgtgattgtgtgggatcagccccagcctcggctgctgaccatcagacagaggacagacatcacagagtgggcaagcaggagcactcagcggggacagaaatggtgtctgggcccaagtatgagctggcgtgaggcctcctcctttcactgagctccccaggaaggcttcctggaggcagggtgggagcgcagtactgggatgctgcaggtacccagtaagagcaagggctatggtatctggctctgacatgtagcaggtcatttcatctcttaggcctcaattctctcaagaataaaatggggccggtgggaggattatgtgaaatggtgcttttaaaagaacacagtgcctggcactgagtgaatgctcagtggtcccctggggagaccatctcttgcatcccagtgtgtccaggcacctggtgtgatgtgagcaccagtgggtgtgcagaggggctgaagggaatgaatgctgtgtttgatgttcacagccctccactttccctctcccatcccttctgtcctctgctcagcgtcgtcaggacctccccatcccatattgctcccacaccctcctctccgtggctcctgccatccttacccgctgtcagcctccaacccaggctcctgcagcctcattcaattaggccgatgcaatttgctcaagaaaaaatgccataatgtggttatcacaccagtgggggatctggccagggttgcggggaggcagcggggctggtgggtagaagacccacactcacagctgagggctcaggtctggaagggcctttctcttggaaccccacccactcccttgggctccatttcggagcccacagagtccagagcttggatctccccagctccaggtacagagatcttgagacagaagcttgcaatgattaggttcattgtgtccatggagggtctctggttctctctctgtctcagtctccccatcggacaaggagagttgtcattggtggggg

SEQ ID NO: 63565 - DNA, 1785 bp, Bovine  19866880959347
tgagtgggcagctgtggggaccttggatctggctctggctggcttggtacctggtgtgctatttggtccaggggtatccattcctgtatctcatcagcgaacctgtgagattttgagaagcaaacccctttccattttcccagggctggatggggctgagtggaaaggcgggctggactcggtctgcccatgtgctggctaacacagcctctgcatgggagcagaaggaaggcctcacctggaacaggtggatgtcagcccctcccctgacagtaagccctccctcccctgctcaagataaggagaggtagagcggggagacctgggctctgggaccagatgtatcttgagaccatttatggctcctctggccttgtgctctgtggccttgtgcaagtcatttacaacctcttgaacttgtttctacatctgttataaaaggttactaccttgcctggctattgtgatgattagcaataaagtctgtaacatctttagcacaagcctactgcatagactgctgaataaaaggaagctgttctcatctagagctcactcggtcagttgagagggagactgttctcgtttgtgatgagccgggagctgttcagaagaagaacactccataagccagggcaccaccattccatcatcactgcaatggtcacagacagcagtaacattactaacattttaaagaactggtgaagatgatggaaggaaggagcaggagccgtctgagtgagattcttggagcttactggatccagcctccctgtttttcacatgaggttcctagagatggagctgagctggaactaaaaattcaggtctcactctctcctggcacttctgccccattctctctttaaaagggacctgggcagccacaacatttcaacttttgggccctgcttgtttttcctagagtgcccagtctgggccctggtccagagaaggggtgaagccacatctgctaactgagaagcaggaacttgatgaacgactgactccggatccacaggtcctgctgctcatagccccctcatacctacaggtgtcccccagccaaacccagccccatgactcacctcatcaaacagctgcagcatgatggtgagcacatctgggtgggctttgtctacctcatcaaagagcaccacggcgttggggcactgcttcagcttcttggtcagctggccaccctcctcatggccaatgtagcctggtggggacccgatgaacttggctacctggcggaaggagagaattaagttaggcaggcctttccatcctttcagtttccaatacggggcatgcacggtaagctggctttgtatactgttaagactgcctgtttcaacaaggtgaggttatctcttggggtggaaggaatcttgctgtgataggagagcagttggatctcttctatgtttattcttcagagcaaatcctatgcaaaacagatggaccccactgtgtacatatgtccccaaaggacaaattccaaggctgctgtaattatctcaggcttgaatgacaagtcacatcaaaatacccaggcagagtcatgttgacaggctttccaaaccagacttccccaaggactctcactcacctcatgccgctcctggaactcagacatgtctagcctgatgaaaccctgtgtggaaacaagcacgagtccatttgaaggtaggaaggcagagggaagggcggaggaggagagcatctcaaatatcttctgggctttcaagccacaccaagccaagatcttctatcatg

SEQ ID NO: 63566 - DNA, 1423 bp, Bovine  19866880982254
aaaatgcccagtctgaagtagctgggcccctggatagcttagtgtgacctgtaaggtggagagatgaaaagaggtggctgtgggtctgggttaggcacccctaaaactgagcttcctcatggcagaggtgggcacagggctcagggcctgggagtacaggaccctgactgcattcttggggacaacaggagagctgggaaaattggattttctctcatgccattccttaagagacagcatgaatataaagcacagattggagccagatggcctaggtttgacttttggctctgctacttattaactctgtgactgtgggcaaattacttagtctctctgtgcctcagttttccttatctgttaaatatgactaataatgggtcctgccttctagtactgttgagaagacaaactatgaggctcagagtgagtgctcagcaaatcttaaagcccaagaggtgctggctgtgccaggccagggttggcccttgactctggagtctgagatatcctctcctgaagaacaaatagctctggcctgcggctgtaacagatgtctcctggataccttgtcctacctgcactgtctggagcccaggattgagttgataatagatgctcaggatttaccaagagatttgtgtactggtttcagactcagtccttataatagcccttacattggttaccctcttaacagagtaagaagctgaggccaaaaaaagagaatggaggccttccctttttggtcagaacctttgcacgtcttagcccgtgtaatattttctacagcattaataagtaggacaagttgcccccagtctgaagatgcagtaacaaacactgacttggcttggattacttggtgacaaaggagtttcccatccctccctgtgcccctagacatgactcctagtaaagatgcaagaagggggacccagaggactaaggtagcatccagggaaggcctactggaggaggtggcatccgactggcccctgaaagttaagcaggcccagagggcattagggttggggtggttgagtgaaggcccgaaagtgagaatgagtcagtcacccagctgaatagagaaggcagtataaatttaaggaatggtggtgagggggtcaaagccgaaacaagttggctgtaagttatagagggtctgccatgtcatactgagggtttgggctttactgtgctgccagcagggagtcactgaaggtgtgtgagcagggaaagaggcatgtccacagctggaccacagaaatagaggtgggagaactcttgtctccccctgagctggtggcacagccggggctctgcccagcctgtgtgcctggtgcctggactgtgtccaggactaggttcagtgactcaaccttgaggaaatcactccccagggagaaaggacccagatgaa

SEQ ID NO: 63567 - DNA, 960 bp, Bovine  19866881010107
tagtatcagaaatgctgtctgcggagcaatgggaaatggaaggggcacatgggagactgcacagaaagagtgacgggtagggttggggctggtttttggaggagctggtagaaagaggtgcctgggaggaagaagaagggcaaagagaagatggaggaagctgggaggggagaaataacccttcacaatgggtataaagagaagaatggtccagaatgggaaagttgcggatcgatgaggatggagagagatgaggaagaggagagggggacacctggaggagaatgggatgtgaaatggggctgaggaaatgaggcctggggagaagaaggatgcagggtgaagatggccaaatttttaaatgtcagagagtccgtggcagggctgaaggtagacctaggcaggagagtctcagttatccagctgcagtccatgagactggttattggagagacagggtgttggcgagacctcacagacagcgcaggctaggaaggatagaacaggatcagaagtcaggtcgattgagggtcgcaggggtgggtagactggtgggaggtggaaggaacgctgcggagggcagcgacaggtcaagagtcttgacagagaatcagatttttggttccctagctgcagctgttgggtcccaggtctccccgcgccctgtccgccttcatccctgccggctctatccagcggtggtgaagcgatctgagattgagagggccaagcccaggggccaggtcagggggtaggggaccgtaagcgatccctcaggcgcagaacccagcgggccgggctcggctcctcacatccccaccctcgttgattcccccctcccgcacacatctgtagtgccctacaagttctttccggagccgtcgggcctgcacgagaagcgcaagcagcggcgcatccgcaccacgttcaccagcgcgcagctgaaggagctggaacgcg

SEQ ID NO: 63568 - DNA, 853 bp, Bovine  19866881029362
ctctggctgggccttcaagggcgggtgtggcgctcagttcgcagcttcaaaatgccaccgcggtcacttgctgagctgcagggtgtccagaaggaggcgcttgtgagccgggtcctgcaccccagcttcctccaggtcttcttcagtgatgtcgctgtaagggtaagagatgctgggagaagggccaggtggtcccgagagcccctagctccgcccccaaggccagtcccaccccatccacttccagccccgcccccacctgagaaactccaggtcgtcccagccattgtgcaccagtccctcctcatagcgttccaagccgatggccctcagccaggctcccatgcctgcctcacccagcccgccagcccgcccgacctgcgggcacggagcctgagggaacagagcaggttagaggcagcactgagggggcctgcacacacaggacttgcaggcagccatattctgccgcctgctctggggtggggagagaggcatagcaaggggctgattcctgtgaccttcagctccccagtgcccagcccagggcaggggacaccactgagtgctgagtggtgaagtaaagagatgcccccaccgcaggcaggcacactctgcaggcacacagccacccccggcccacacacctcttctgccaggtcctcctggatgctctcccggatgcgaggcggagggaagctgagaggccggccgtagtccgagggcagcccacggggcggctgtagctccagggggcctggcaggagcatggctcggccaggcccggcaggagcatagtccacctcactcagtgtcttggccatctgcagcactgagcaggagcgatcatccc

SEQ ID NO: 63569 - DNA, 1841 bp, Bovine  19866881039929
tgattgcaatggaatgggtaatatatactgtaattgggagatgcctgaagtgctagggaagctcttgggaggaataactacctcaaacttagcaagaatcactggaggaagtgacttttaatcagaggcctaaaagtgaattgaagttagtcaattgatggcgtgagagagagggaaatgttccaggcagtggaatagtatttgcaaaagctcagaggctagaaagagcattaggaacgggatggtgagatgagacctcagaggggagcagggactctcttcatagacattccttattagctgggctgtgacactgccagtatgctgatgtttgtccctgaaccaaatagcccagctgtgccccttgagttcttgtgctttttatggtaagcatcccatgtataactctgtctcacacttatgatttgtccgttcagtggtctgattcttgcatcagatgttaacttcttagagtcaagaagggtatcttgttcattagtatatctccagaagcttccaccatgcatggtgttcattaagaatacaatttgaatggatgatatcttttctttgtaaaatgggttatacccttcctgctttcttgaaccaactatcccttttcctcatgttcatcactgtatctagcagttaatgtcctgtgtggcaattcagtggtgccctactggctcttgaggtactgtactctctggcttcctctttcaggtttttgttgtactgttattttccctccccgcctggtgagctctggactgtgatccacatacttgattctgaaaacttcttcccagccttctagtttgcttcgtctaatctgcagtaggctggaaacaaaatcccttgccatgatttgataagactgttctcaactaagagtttgagttaatctttgagttaggtcctaaagttaggtcctgcatgagaaacatgcagataccattgtacattggacatatatattagctaatcagaggccttcttcctgtttaccctactccaggaaaggtcagataacactccaggggtgggggtcatcagttgggagagcctctggtgcagaagagctgatggaccactgattcaccagaccataaggaagtatggtctgttctccagttacatactccaacaacttcattttgaccaaacatttgaaatactaccacctaagccatcttacctgggtgttatctacaaacctcaggccgatctctgttagggcaggttccatagagagtatgctggcaccttcacttgagcagggaaagaagagagagtgtaagccaaggctaggaccagaacatctgggctctgattccttcatttgcaaaatgagggtgaaagcatgatgtgatggggaaatagcgtgaggactcagattagacctgggctctaatcctcatgcaaccacttattaactgtataacctctgtactttagctttctcatctataaaacgagaattataatgcctgtttccctggtggctcagtcagtaaagaatctgcctgcaatgcaggagaccaaggttcaatccctggattgggaagatcccctggagaagaaaatggcaacccactccagtattcttctctggagaatcccatggacagaggagcctggcgggctacatccatggggtcataaggaatcaaacatgattgagcggataagcaacaagcactatataaagtagttaggggaattacatagattgtgtgaaatgaccatgtcagccaaagagcagagaaggtcagttgttgttcttcagttgttcatttgtgtccagctctttgcgacaccctggactgcagcacgccagg

SEQ ID NO: 63570 - DNA, 1586 bp, Bovine  19866881144094
ttagacctgatcctgtccttcctttccagtttcagctctcaattcttccccaccacaacaatcctgaacaattgcgcccagagtcaaccatgctggctcattccttcatgccacattcagatacacggctggctttgtcctgctccacctctatcctcaactacctggccaacttgaaagcaatcactctaggctcagatcaaatgttgctttctctgggagggcccaggtggaaagcaccaccaaaatcctaagagatctttgttagaccttccagtttcattctcccttgttttgttcattgaaatatctttctaaccattgagttggatgaatctcctaaataagactccaaaacacatgtgctgggaggtgggattcagacaaatccaagcagacagctaccctgaatgggatgggggaggctccatggtgggggagaattacagacccataattacaaggttatggattatgtgctgagatgtttattccctgttttatgccccctttgaggccagcctttgtggctgattcatccttgtggcttctacctctttcttccccagcacttagcacatgcctgatacaaaacaggtggtaaattttactggatgaatgagtaattttacccagctccctgctttgcagaggagaaaaaaagagactcattgaagatcaagaatctgctcaagtcacccagtaagacaatggcagattgcggatcttccttcactgtcttggaggtgcttcctggagcagaaggctagggaacactgacctttggcaggccccatgtggctcaggtactcgcagtggctgctccagtgatccagagtggtgaggatgtgaccagggtccccaggcagggcgtgggtgagcacgtagctgaaggcccgctcctccatccgcagccctgacaggcaatctcggaggctccggagcaagactgtgcgaaccaggagtcggaagtaatgccggtacctcaccaacaatgtcactaccaggggcaggaaggccagcgcgatggcaggggacatggtccctacctgggccctggggtggaggaagggagggaaaccacacatgtcatttgcctgtcatttgtgcagcccttaccagtggcaattatccccgtattttatacaccatggctcagaaaggctaagttcgttgtccagagtcacacagaagaactaggatttgaatccaagctggtctgattccaagcccacacactttcaaggactccatgccacctaagttcagcacccaatcccaaaccatctcttcccacttctggaccctgatacaccttcatcttgttcccttcatcagttttgtatcatctctgtagtctcccttttcaggacccctttcaccagttcctgcctgagttctcctcccaccttacccagcgcctgctcggtctctgacccattgctactgctaagtcacttcagtcatgtccgactctgtgcgaccccatagacggcagcccacgaggctcccccgtccctgggcttctccaggcaagaacactggagtgggttgccatttccttctccaatgcatgaaagtgaaaa

SEQ ID NO: 63571 - DNA, 842 bp, Bovine  19866881172002
cggtcccagagcagagtgatgttgtgcctttgcttagcctgggacaagtcagacagcagcatgtctgcatgtggcccagggctttctagatgttccgcccccacccatgggcagtccctgctcttactcttttggcccagaaattcaactccttgttgacgagctggatgagctccgagtggcagaaggggaggaagtagacgatctcattgattcgtcccagaaactcatctctccggaagtgagcctgcagggccaggttagggatgtgagcttagtgacccagagtgggtaatggaattagtggaccctactggggaagatatggatgggagggcttccacatcttcacgatggctaaggtgatcccctccaactcgaggctccagcgggaaggacaaggaactcttacttttaggatggggcgaatcacgttttccttgaagttctttgagatggtgatcttgtcactgatctggacgtcccctatggagacagaaacataaactgcctgctccctacacctgggacctttgggagctgtgctgcaccttggctccatgacaagagcctgctcttgcccctgacagtctgtgtgatcctggtcaacatcttgcgccctctgggcttcggccttctcatcacctgcacaatcagaggactggactgcatacttcccaggcccttccagtgttcatgtgcagtaggaattgcatgaaggagcggaggggagaggagaagagtcaggactgagacttgagtcctgagttgtaagaagggggctggagagttcaatcctagacagaaggctgatagaagcagtgtccaccctgacacactcc

SEQ ID NO: 63572 - DNA, 1363 bp, Bovine  19866881210710
tagcattatataggaccgggagacttggtttggtctcaggtcagttcaggggttgtggtgattggcacaggccggcagaaacaggactgctgacgctaaggaagccacgttcacaaaggtgtggcttggtgagggcgggagcagctccatgttcaggggaaggtactctgggagcaccgagttaggttctgggaatcccacgaaaagaggaaaggagagtgaatgcctgagagtagaaggggcctaccctcaggaagggacctttggatggcaggacccagagcctgcagccgggactcctgagataatatgaggaatggccatcgagaggatgagcttgctttcccttggggcccaaggccttgtctggcctcacagggcctctgggagcagacagtctgaccagagaggatctggtctcggggatcagaagggccatactcaggctcctgatttgtatcagtgtcccctctagaccccactgttttttccaccttctctggcttccagcctccaatatcctttctctaccaggtgctggactatttcctgcagctgcaaggctgtgactaaatacctacgttgtgcctctgtccatcttttcagggcctctaggactgcttggttccactttagctcatcctagaccaccaccagcctagctcccaaaagcaagcaggatcttggtcctggagcgaacgcttctatacagttgggcacttgggattttcctaatagaaatatttttggtgcttaaaggtcagagctgggctaagaggagagcccaatacaggtgggttggactaagggcctcggggctgatgtctcccctgtggtctctcctaggaccgagaggagcggaagctgctgctggaccctagcagcccacccaccaaagccctcaatggagccgagcccaactatcacagcctgccctctgctcgcaccgatgagcaggcgctgctctcctccatcctcgccaagacagccaggtgggcatcacaggactgggcctgggacagcgctcctccatccatgttaaagactgggatggggggccagacccaggatgcaggggacaggtcagtgggaagaggcactcctgggcccagtcgtgctcccgtgggcaggcaaggacacgattgtcagataggcttcgagttgtcacctggcagggagtctgttcagccctctcagaagcacttctcacgtgctgtctctcctttccccgaagcaacatcattgatgtgtctgctgcagactcccagggcatggagcagcacgagtacatggaccgggctcggcagtacaggtgagctcccggccgcttggagcctgaggccgctgggccctccctctgcct

SEQ ID NO: 63573 - DNA, 1705 bp, Bovine  19866881239334
tgtctctctgcctctcctattagaaaactatttgagaatatgcttaaatgaaacaaatgaattgttcagcctaggcttcctgaaggcaaagcttgaagtaagggtttatagataaactgggagtgcaatccaagggggcagaagtgagtgacagataaaatgcaaaaagggaaacaggaaaaccaaggcaggattgcattatttatttttttaattgaagtatagttgatttacaatattatcttattaatactttctggtgtacagcaaagcttttcagatatatgtatgtgtgtgtgtgtgtatatatatatattatatatataattcttttccattatgatttattacaggatattgaatattgttccctgtactatacagtagaaccttgctgtttatctacttaatatatagtagtttgcgtctgctaatcccaaatttctaatttatcctctgcacccctttggtaaccagtttgttttctatgtctgtgggtctgttttatacatacattcgtctgtgtcatgttttagatcccacccataagtgatatcatgtgatatttgcctttctctaacttacttcacttacatgacagtctctaggtccatccatgttgctacaaatgacagtggtccattctttcttatggcccagtagtattccctattgtgcgtgagtgtgtgtgcgtcattgaggtggcagccataagtgcctagttactgtatcccatgtagagaaacctgatgaaatacaaataaattgtcgaaagaagagggaaagagaaagaggaagaaaggaaagaaagaaaggcaattatctactgaatcttctcttcaattggtcaaaaattcttccatggagcataaccttccttgctcttctgcttatcacattgagtcagcatatgggttcacacagcatgatatcaagccatgtattagacaggaattcagatcatgagctggaggtgaggtgctgtcagctttcaactacacaaagtcaatcagagtccacagcagaggctacagaaagagatgagaactagaatattggaaagagtatataaaatttcattgaacacttccaatatagccctttgagtcttctcatactttctgttaacagcagtccatcacagggtctttgcagctgccatctctgcaaagacaagctgcaagaggattacagaaagagctacagttcctggtgctgtagttggtccctgagccataattgataaccatcacctccctttaagatccaataatacagtgttataacattgttttatataatctgatgatagcttttagagatgttaaagaagagaattataatggctacccactccagtactcttgcttggaaactcccatggacagaggagcctggtaggctgcagtccatggggtcgcaaagagtaggacacgggacatgactgagcgacctccctttcacttttcactttcatgcattggagaaggaaatggcaacccattccagtgttcttgcctggagaatcccagggatgggggagcctggtgggctaccgtctgtggggtcgcacagagtcggacacgactgaagcgacttagcagcagcagcagtcttttttattaagctacatgtttaccatttctgatatgggcatacttcattttatttgtgctttgttttattgcactccacagattatgag

SEQ ID NO: 63574 - DNA, 1127 bp, Bovine  19866881263582
cggctgaagtgtggaaacgcatgaacatcaaaccgaagaaggtccggataaagcacaatgcactctgaggttcccaggaccccagcagtcctaaaggcctgagggtggtccatttggtttgacaataaatgatttgaactgttcggcagatcaccttgtcccatgcaaagacgccccccaaatcaggtaaccagcatcatgttctggtcttacatcactgaaacaaggaggaaatggaaagaaaggcccactggcctcagctgatggcatagccctgggaaatgtatctaacctgtctgggacctttggcgttctttagttcagatatcctgaggttagagttgcttcgcagagcatcaaggttctgtagagatgccccagaggcctctgtgacaggaggccaggaagatgagctgtgacctctggacgccccacttcaatcagatcagagtagttcctcactcatgttttatgtgttatgattctgctaaagattccacttgataaaaacaatcctctacgtgttatgattctgcttaagattccacttgataaaaacaatcctctgcttgaaactgtgtgtctgctgaatccgttatcaggtgctcttggtctgtgtgcagacctccaccccctcactgggcttcctgggaattccactgagcctgaggcaatgcccacaaggatgatggctgcctcagagttcagcctgttcagctttgatagtgttcccatcgctggagaagggacaagcagtcttatccaatctgaggttagcacgggtcgagtctaagctaagacctgggaatctcctggattccatttagtgcccgtagaagataccccctccccctcgtccatcatgccgctcacagattggagtagccacaagtaaggagggtggtgggcaggacagaggggcgggaaccaacacacagatggatacatgtcctttatcgaggatgacaaaccaaaacaaaaccaaaaaaccccaaacatgtaaaaacccagggtgctagaaatacaaactcaactcgttcaaattcaagctcatccagaccctggtcacaagccctcgtgaggtgcatgtgagcaccaagtcagggacgggggacaggagtgagcca

SEQ ID NO: 63575 - DNA, 1228 bp, Bovine  19866881269179
cttcccggaagccttccctgatacctgtagtacctccttctcttggttactcaccttggtgaagcatttgcagcaaagtgcaaggtatagggcagaactgtgtcctcatgttgatcaccgtctctggagccctcctttccacagtggctagcacatcagggtactatcgcaggtcttcccatatctgtttgttgaatgattcgtgaaggcaagactgaactctttgtgttggggagtcctgccttgtgtccaggaaaggaatcccatcccggactcccactccccactctttggaaagggatcaccctcccttcttcatcccctcactccccaaggacaggaaactccctccctctgggccagccttctgcctgggagaaagtccttcctcatctgaggaattttcaaggggccatatcccttccacaaggacaaagtagaagcaaaggggcaactgatgcgtgtgtgtagggaccagcagggacgcgaggccctggttccatctgtctccgtttccatgatccatccctgtcttgtctacactttggtcatggagccattaagttcctttttccctctaaaccgatttaagttgggcttctgacacagccaagagttcggaccaatataatccgtaaatgcttgacacctttacagggaatcaaacaaatggctgtagtgattggaagttttgtggtaacatgcctgttgctggctcagctgggcagaagctgcccttctcctgactcaggactctgcagttgaaggctcctgtctctgtgaggagctgtttgtgctgaggctggccctgacactgaggtgaagtccaagaaaatgtttgaaccctgtctgttgttgggttcaggtgtttcagatggtgtaggtggggcaactttggaggccaggctgcgtgtgtgtgagatatgctgagaactcagcataaaaggagacaggtagaatgaactgggctctgcaagggcctcaaaacagagaggctagtggttgtcatcggatgtggacgctgtttctaactgagaccctcctcccacaaatgtgtgcactcttggggaaataaaaatgctctgacatggaacattgtctcgctgagcatgtcttcacttccgtagctgatgatgggttctgggtcactgggttccagctctggcgctgccactttcaagcggatgacagggggagttactcagcctctctgtgcctacctttctca

SEQ ID NO: 63576 - DNA, 1711 bp, Bovine  19866881309172
gaaatttgcctagaggtactgagcactaccctcatggggtactgacagaggctggctggctggctgcccatcagggattctgtaaagggtcattagattatattgcttccaggttcctgtcagccatgtgatttccaaggttctggaaactttaggcttatcttcagagcaagtaatgtactttgaagtaggatttgagccaggctttggatagtggagagaggagaaaaaaagaaaagatattctaagcagggatcacgcttgagcaaaggcacagaggggacacatgaaggggagcttggagatcacagctacttctctaccacttcatcccctgattctgaccacattctatgcggtgccttgagccccactctaggagagtcccacttgtagctggctgctgggtgtgggccccaatcctcaggtggaggaggcagtaaattagtggtaacagtaaacaagtcacccagtcagggatgcccctggctgcttgtaagtaactgttataaaccttgggtgtctggggctgtcaaaaatgcacgcgagcactctgagcgcctctcatatacacaattaaaacaataaaacatggcagaaacgtagccagagcaggctgtaaatcagcttctcttctcagctccaagtggcggctaaataaagatgagttgtgcagaagctgggttggcacagggcccttcctgggataggggcctgctttgccccgctggacctgccaaggccaaccctaaccccacccccagcccgggtggctctcttcccatagctccaagggctgcaggtcctggcctgctccagctgacctccccatctctgtgtcttcagatgggggacaggacgatgcaagctggcacatcacaaaccagtggacaagtgccctggagttcaggagatggctaggagtccccactggcggtaatggaactgctctctataatatttttccctctccccagaacattgctaagggagtagtcttaccttagctcatctattcaatataagttaacacccagcacccactgcatgcccagccctacccaggcacagcagagagaatctgtgcccttggagacaaattgaaatgggaataataatggttccaaggacataacggagaaggcagtggcaccccactccaggactcctgcctggaaaatcccatggacggaggagcctggtaggctgcagtccatggggtcactaagagtcggacacgactgaagtgacttagcagtaaggacataagaatcacctgtctcagagtccaaagagtggcttggccatcacctgtgtgaccttgggcaattctctatatctctgagccctgattttctcatctatagagaataagattttttacaccctagatgtagtgtgtcaaaaacagattcctgccccattcccagatcctgagattttaattcagtgtgtctggggttggacctgaaattttgcatttctaacaggctcgcactctttgagtaggtgatctaggctatttatgcttgaactgctttaaaaaaattcatctggaccttctccctggaagagactctttttttcacttgaagtttcattcttagagagtctgtgtgcttaagcatggtattatgggtgtacagaacacttaatagctgtgacacctagggcaattttctgtacctcttagaggctctgtctccttata

SEQ ID NO: 63577 - DNA, 689 bp, Bovine  19866881336456
acccctggtaagtgctgggatattgatttgtgcaaagtaatacagtgaatttatcagtgtgatccccagctgcagggcttctagcaaggctggcgcacagttaccatcttacaaatgggggagatgaagcaccgaccccacagcccaggcccccatggcctctctggtcttctcgggtcactggagccaaagcagggccaacatgcagaccacaagccagagcactgacatcaagtgtgaggttcttcttccagaatcccaagctgttcttgatcatggggaaggggaggatgcctgttctagtgggagctcagaacctctgtgcccaccatcctcagaaaggcagccagctgtctgttcagatctagactctgctcccctcctccacctggtcacctcccatgttcctgtctcagtaaaggccccaccattccctggtctcctgagtagaagtgtagatatttccttggctcttccttccccttaaagcccttcaggttctatcattttacctcttaaatagatctcacacctagcctctccccccattcctaataccactgaggacctccagctcaggacctcagtgtcttctgtctgaacctagtggtggtctccttgttggtctctctgcctccttttcttcccctataaccacttctccctagctggagtcagctttgtacagt

SEQ ID NO: 63578 - DNA, 757 bp, Bovine  19866881357750
acctgccccagtgcagccagtgtgcaccttggtctgggaatgaacacttcgaggggcagcactgctcacggatatggtgacagcatctaggatgactggtgcttttggagcaagaactcactgtttacaggagcagagacttagaaaacgtccccaagtaacatgctactcactttgtcctttggaaagctctccaaagagagacatttgtagctaagaattagaacgttcactatggggcttctctctgccatgccttaaaatcaatcaatacccccagctattgtccagtggtttacattccccacttcccatcagcccctaaatggacaagaaactcattctaaaaagagtccctctccccagccttgcagatcgaacacctttaaaatgaagaagcacgggccttttatgaaacaccccacccttaccccccaggccaaggctggccatttgagccgttccaggggcatggttcctgcctgttgacttggaacagatgcccttagcccccatctttacacttcacccacctgcctttttacccagaatccatttacaccccctgccctagcctcccagcctcaagggccaaaaccattaacccactgatttctccctttccgacctgaacaagtggccatccctcagggcctgcaggcttgccaacttctgacctccctccccccttgacctctcttggtctgcttgtgtgtgtgaccagccaaccgagagggcagggatcctgttcccttgt

SEQ ID NO: 63579 - DNA, 1306 bp, Bovine  19866881359164
gaatgattgttgaaatttgaaagagggtggttgtattaagcctcattggaaggtggcttttcgagcagaggaggaaaggtgtgctgcatcacagcatgcagtaatatatgttgacatctctcaccttttaaacccctgggagtgcccacctcaatcctacccccaccccatcacaggggcaagtcctgtccaaatcctctgggtgtccacgtgcttctctgggcctcagtgtcctcctttgtatcaggtggaggagaacatcatctacccatatcgtgggacctctgggaatacgaaaccatgcacagaacacacatgacacctgggaggcgctcagtaagtgtttattccacgttgttgccaacatgggatcctattctgagcaggccacctctgaaattacatcaactgcaccccatcctgccttcatcttctcccacaatggtaactcaggatgtgagtgtataatggaagggcttgacccctcaacccctcccccaccaccctgacttcctcttccttgtctgaacaagccccctcccaacccagagccacactccatcctcacttggttgtgcagcttgtcctcagggccgggttctgccttgtggtgcttggcatccatgcagacgttgagcaggtctgtccgggtccgggcactgcacacagaggtcatccaacccagaaaaagcagaagtggtgtcagtttccagggcatgtctttcctttcctgcagagtcagctgtggaggagaccaaagtctgaagggagagagcccctcgcagggtccccgctttgcctcctgccccagtctccccaactccacggtgaaggatggggtcagatcctgttccttcagtgttggggtcctgaggctccttgaggctggagtagagaagattggcaagggcaccggctccctcactgtaagcttggggagctcaaaaggggatctgggattagattccctgggggaatcttcccaagttggaggagactccttgtgcccctaccttctctctggagtgacccaagaaaaataactaaataattcaggtccatgctccactctccagaagaggacacagcctcatcctgtgtccagcaagtgctctgccttcacacccttgatcaccctggtttccatgccagcttagaaaccctgttaccctggcatggcagtgacccagctctgctgagttctccggttcagcatgaggatcaagggaggtaccaaacaggatggtgatggttaaataatacagaaatgacgatggggggttgtttttaaacagctttgctttct

SEQ ID NO: 63580 - DNA, 1544 bp, Bovine  19866881407988
tctgtagatttgtagaaaatagttctgtaatatctctaacctccctgaggttataatagttaatacaaattaactatttgtattggtttcaagagatccctgagtgcatatttaagactaaaataaagggattcaatgtctgggctggggttaaggcctcaagccacacctccattaatttaaatgtgctagctttttatgaaaagccctccaggatgaaagaaaaataaaaccttccaaactgcagaacaccatttttacaaagaggctgtaaattgcactctgtaatttatgttaatacatgtaaataaattaattagtcttcaaaagaatgagtcttttaacagtttttaagttagaaaaatgacttccaattgaaaaaaatgaaactactcaactgagtattaagacctttaggtaaaaggtaaattttatattcttaaagaattaaaacagagtatgtgtaaataaccttggaaaatgaactaggttattattacaacttcaaacactattcctgttttcaaacctaagccttttcttcaaaatgtttttggatgggaaccaggaaaatctaactttggtttaaaggcttcatggttcctgctgagttacaaaataaatatgcagatcaggaccagtgatatgcaaattcacaccaggccaaaaatgggtagtcacaaaggttttaagaactgcttcagtactaagatttctaataaggtaggttctgagaattccattactcggtaaaataaatataaggaggcccttgatcccctctgccaagcggcctgtccacagccacagcccaggtcctcccacagctgggaatcatgggatttccttttgctgctttcacagatgacaccaccacccagctgatattttactgaaaacaaagagattcagcatagtcttcatttgaattctcctgttgggaacccccaagctccctcatttcctttccagagtttcccattttctaaagtaatttgtcccttgttcagttatctggagcacattaccagtaaatgactatgtgtacataaatcactgacaatgttctttaacttcttagttttagtctcttcaagggtgttttccccttatttatgttgatgactcatcttttttctccccctccagtcaagggaaacaatctaccagcctgcctgagagtttcagatccatgttgaaaaacttgtgttggatgctctgggtgttgagaaaagacagagtaaatgtacacaccacgccccctggtggctgcacatgtctagggtttaaacccatagtggcaggttactgtattaaatgttaattaactagttctgttgccagcagaacctgcaagagctcctaagtgactggataagggctggatctctttcacttttcctcattcaactgaacaccctggtgaggcaggaggtaggtgaaccccaagctgagcaactggagtttgttccctgtggacagatactctaagataaagataatagcaagaggataatagcagagactgagagctatatattttt

SEQ ID NO: 63581 - DNA, 1112 bp, Bovine  19866881569665
cacgtaggctgtttcttgcctagcctagtgctatacttacactgttccttttgcctagaatgcctttgccttctatttgctaaacactcctaatattttaagactctgatcaggcgtcatttcctctgggacattttctctggtccacccagtagatgagggccatatgctgggctcctgtctcagcactatgagtggagacagactaaggacctgcatagttactggagagcatggtgtctgtccatgaatcctccaggcaagaacactggagtgggtagccattcccttctccagaggatcttcccgaccaggaattgaacctgggtctcctgcacggcaggtggactcttcatcataagagccaccaaggaagccctcctgtctcagcacagatcatgctgcgttaccagtcttccccagactccttaattgagggcaggaagtgtgtctggtcagttgtccctgatgccaggtaaaccacccagcatgtggcaggtgctcagtaagctttcatcaaacaaacaaatgaatcctggagagaaagggcaggaagtctgaagttcaagactgataccaccatatttccttcatttaaaaaatgtttgtgccgatggaaacaactgagttaagcactcagcagagccctagctccctgctgggagaagggaagtaggcaggggtatagtctttcacccagatttgttcgaaaagaaatgtgatctctgcggcaagaataggaggcctcactactcccagccctgacagctcctcactcggctctgtccgatcctggacagatgtgccttcagactgccctgggccctaggtttcggttgagtggttcctgagtccaggagccaggcgtggggtgggctgagcccaggagcagggccacctgctcacgctgccgacaggtgggatggggcctcaggacccggctcccactcctgaagagccacagctggacctgcaaacgatgtttaagtgccttgggggaagaaggaaacagctgccacacaaagagaaaggagaggacgacgggaaggaaaagagatccagtctccttctgatatagccagctggagtttgaaaataagactctggactgt

SEQ ID NO: 63582 - DNA, 1955 bp, Bovine  19866880340789
cccttctcctacctccaggatgaagtgtatcttactatcacccttcactggcagaccagctaccctgtggagaatgtttggaggcagattcagggaccattcccttaccacagttctgttcctggagtactttctcacagtctttgcctccagaagtgtcccatgagagtgagagcaagtgggaagacttcgaggaggctgaggacgcagatgagggccccctcaggtgggtagcactctgggtggaatacggctgggttaaattcttctagagggagtccgcgtctctactttggctgggtgatggtccatgggcattatagcattccccttgcttcccccctggggtcacacctcttcgtggtacgtatcatattccatgttccaaggcgacagccctatgccctgacacttcacgctattccgatggcacattcaggactttcccagggtcatcagtaagtaagtgatggagtcagaatccagccccaggcctcccacttcagggccccttcatggacctctgctgcccgcagcacgcggccaggccctctgtccctcctcagcgctgtctctcggtgggttactttgtgcgcttatgccttcccgtgggctaagtgtatttcagagaagagtcttggtgacatgtgatgtggcccctctcaagagcccctgtggttttaacacagtgagctctttcttgatcaagaaagccaaactgttcacacgaactgctactagaagctgggatgaccaggctggagtcagatcagactgatgaagacacgggaggagtaagtgtcacaaaaactgtcaggctgcaagtagagagggttaacctctcgaattctgttcacgtgcctacaacacaggtagttccagtatttgaaaaatgctgaacgttcaagaaagcgttcgcatcaacacattttcatgacacactgaaacttaccaaggcactggctgtgaagatttaggtataattgaaacacagcctttcactttcatttatattgtgtcccagctacattttcatcacaaatgactgaactggactctcaaaggacagtggcaggcaagctgataaggtgggtggatatttgaaattcaaatatgacaaatgggctggctcttatctgaaataggaagcaacacgttaatagagaggatgacatggaggctctgaagaccctgcatgccatttatgggaaagttggacactctggcaactttaggagtgatgtattatgctatgctatgctaagtcacttcagtcgtgtccgactctgtgtgaccccatgggttgcagcctaacaggctcctccgtccatgggattttccaggcaagagtactggagtggggtgccattgccttctctgaggagtgatgcattatgggttcacaaaagtgtaaagcaagcagagagcagcttatacatggagggcagtcttcctagagggggctcctcagggctggagagttaaagaaaatagggtgagcaatgctttggggatccatggggaaacagttaaggaccgaaagtgtcagtacttacggaatgtcctaggagatctgcagtgccctgaagggaggaggcagagatcagagtcgtgagagcgcggctccaagctaggctccaccactcactgactagatgacctgcagcaagagactttaaaccatctagtgaaatgaagtgaagtgaaagtcgctcagtcacgtccagctctttgcaaccccatggactgtagagtccatggaattctctaggccagaatactggagtgggtagtctttcccttctccaggggatcttcccaacccaggaatcgatcccaggtctcctgcattgcagacgaactctttaccagctgagccacaagggaagcccctttaaagcatctaagatgcagctagctgactgccacgtggagataatgaaatccaccgcgtg

SEQ ID NO: 63583 - DNA, 2197 bp, Bovine  19866880450252
ggaggcagccggatcccaccaccttggcattctcctcatctcctcaataggagttccaagccatttcttatctggagaaaggtgaggtggaatgtatttagggatcttcctttctgttctttgatgtttcatttcacattgttcttttctaagatcaaaacatatatattcaatcacaaaccactcactgtttaaattcacttagatacacaagtaaaaacacttacccagaagttattgtttaaaatgtgccaaacttgctctttctccttggtatttagaaaaaacaaaacaacaaaaaaccttataaggcttacagtaaaaccccagagcttattttcactagtctgtggaaggaatttccaaacacatgtaaatcaccttctgaaaaagcggccttgtaaaacaggtacactgccaaacgggtcatggttcagagtatcagctactccttaggactctagacaagaattttcaatgaagtgaacttactatggcatgcttgccataagagatcacaaaaattatggagtgggctttaagataatttttatacttacatttttttgtaatcatacaagctgggatttaaatcccagctttactccccacaagttacataatttcagtgaattgtctaaccaatttcagttttctcatttgtgaagtggtgcaataccacctgcctgctgtcagagcgttagagaaaatgcatatacagtagcctaagataacagtagttactatcgtatttatggtcgagtaattcccataaatctcagaaggaagttcatgaaactaaaatctgattatttacttcttttctgtttctgtgatttttagaatttaacatttgagtctaagtttaaattatgcattattaattaataagaaagacaattatttcttgccttcagtgcaaaccataactttgtgaaactccccctcacaaaattatataacacattaccctattgaagacactcttgatggtaaaaattaccttttgtcctctgctttgggcactctcatgaaatgatctgtgattttagaatcctttctcccatgttgcttagaatttctgcactctacattcaggctagaagtacttccaggtcgtttggcattcacatcattcattccagctcgactctctcctccttcaaattggaaatgtaatcgaatctcacctcccttagcagaggaccgcttcctcaactcagtgtcagcttctcttggttggaaccttgaaggtttatttgctgtttgagcagaactgctatcttcctgttcatcaaaacctggacttgtctcttcatctgcttctgaatcctgacaactatttttggaattatctacatccattggtgactcaggttcactttctttctcaaatggaggagaatttcctagactactttcttgtctattcaatctgttggcatttttcagtccagtaccaacatcctcagagccagtgtccgacaaggggctctcggacaccacgtctgtctcctcctgctgacaccctgcacaggcttctgcaggatggcaagccttgccacacttctggtggcttctggcttctctgccctgttcatcttccatcgtctgctttgcattcgcaagctttacatgtgtcaaaaactgctgattatctctactctcctcactatttgtgtcactgtgatcatcctttggggacgactgatcgacattagcattactgaactgctctggtaccagagttaccgctggaggttcactttccaaaagccgttctgagtgtggcccttcattctgccacttacacatagccgcagtctgatgctgcttcaaatactgtgtacctttttcaactggtgacttatcaaaacctagctgagaaacattttctaatttttccatgttatgttgataaaagttatctttttgtacagaactcatcatggattcttctcttgtattgttgttttctttactgtgcaaactgtaaaacagaaagaatgatacaacagaacttatgacacaatagaaagaatttacaacacaaaaaagtcacttacccaaacacattcctacaatatcatagcaataatgaaacctgtgattacctgagcatacagcatgccctttcatgactccacacctgtgcacagttgcctataaagcccttttcccaactgtgtgcctggca

SEQ ID NO: 63584 - DNA, 1005 bp, Bovine  19866881025033
cggagggagttctctgggcccgcccctgggctgggcccgcctgcagcgcggggagggtggctcgtccgggccgctgtttgagtcccagaagagcctcaccctgtcccgcgcggaaactggggtctcagagctctttttctccacccacatccatagacttcccctactgtccttttataaatacttgggaatataaaagtttttactccaccatagtggctcaaaaaaaaagatggccttttagaaagattggtttaatcagatactcatttcttctcccttcctaggtttttgaacatgaatccttcactcctcctgacagccctttgcttgggaatagcctcagctgctccaaaatttgaccacagtttagatacacaatggaaattgtggaaggcagcacacaggaaaccatacgacttggttggtaacatctgaaactgtccatctgaaaccctgcagagaatggtccatgctgttgggagtttatggcagatagtagtctcttgaggctggctcttgtcagggcagtaacttcatggcacctgtcactgagtacactgtgggcatttgtcctgtcatgtgggcgctggagaacagctcccaagagtacagagccatctctggccatggtctctcttcctctttatatacaaatccacttggtgacggtatgtgctgtcgcttcagtcgtgtccaactctgtgaccaggctcctctgtccatgggattttccaggcaagaatattagagtgggttgccataccctccttcaggggatcatcccaacgcagggattgaatctgtgtttcttgcatctcctgccttggcacgggagttctttaccacttagcaccacctggtgaagcccttggtgagttggttttaaatagaataaaagaatataggctacctgtttgcttctagaatgaagaaggaggagaaaagcggtgggaagaagaatataaaagattagctgcatatcaggaatacagccaagggaaa

SEQ ID NO: 63585 - DNA, 779 bp, Bovine  19866881826601
aggcagactatattttgttttaaatcaccttatccagtgatgaagattatagactaaaaatacttaggataactgaattaatttttgtccggtacttaagtttttctagaatttgtatttaataagtccctttgcttctatataataaagcaataattctgaaatagggctaaaatttgttttgaatgactcgctttttcccccacatttccatcttgacgaggttcttacctacattaacatcttggattaactgagggaggcttaatacacatggaataaacaaagctactgcttgttagcaccacaggaatgctgacctttccttccagtacaattcagcaaggagttattcagcaacattcaaggctgagattctccccacttccttggaatgtcttatagatgaaatgtgaaaccttggtgattaaaagaataccataaaggtttctatttatttttctccctaccaatgccatgtatccccaggagatcagggaatattgtattgccgtgctctaaagctcctggtgtagcgtataaattacattatgctgaatggcaacaacaacaaaacctctctaaggagtgttatcatttctctcttttcatcaagttataattcagaaactaagtaagctgaacaagtagctttaaagtaaagtgagttggaaaaaggctaaaaataaagaaacactcatgtgcttgtttttcatgtactggaacaggtttctcacctataatagagagccgttaattaagaacttttttaagtagta

SEQ ID NO: 63586 - DNA, 1621 bp, Bovine  19866880845695
aacatgaggaaaatgttagcgtcgacttactagctagtttcttgctgttcagcacaacttctgttcttctgcctgttggacattttcttttaatacacttacttttcagttttcattttctctgaatatatctttctgtaatcatccatggtcatctcatacagttttagtttttaatattaaattgaaactcagagaatatcatacgcttggaacctgctgttcccggaacaatcacagccacgatttttatcaatttatgtggtttggaactgaaaagcttatgaagtgtcttttattaactgcagttttttaaacctttcaagagatgaaacgaataaagaggaagaggaagatgatgaagaagtagaggaggaggaggaggaggaggaagaggatgaagaggatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgaggtaacttgagttttagctagtgattactacctaaaaaatcttgtacagtaattttctattttaaaatttaacgaattatagatttattagtattccaattgaggtcatagtataccatataaaaaacatggagttttggcttgtaaatacctctctcagtgacttcctacttactgttttcaatacttcaaagatatccttagtgtctagaaaacttaagtctgtgtagttgattttaatattatgcatgtagattaataggggcaacattgttggtaaaatgatagaaaactttctttaaaagttaaaagggatttgagcttcttgaggtctacaagccaattacgaggcttctggctcttgcattctcatctacctttccatggtaacctcttccttgttttcttcctaaatcatcacatttctttcctttagtaggcaggattttaaagctgcaatttctcaggaagctttagctatttcaggaaggccttatatcttgattagcagctcttgcattacatcttgttcatcttgttcagaagcctcagaaattaatttttatgtttgaaacaatgattgaaatatgagcaagtctgcttgactgaaatagggcgcatggtccaactctacttacctagggaactgaaaaagcaggactgagttttcttcttatacaagttttctttggtaatatctgaattttatccaaagtgggcaagctagttttggaatctgagcatctagatatctttaagaaaaaccttatttattttggaatgtctgatactatatttgcagtagcctatgataagagttgtagcttttgaaaaggttgccatagaagttttcaacggtggtgtcatggtgtgcctagtattttcaaggaggaaaacagttctcgtgatttatgtttacattgtattctttggtttggaatgtgattaagaaaacatcatctccagagtgtctgtttcttaaaaaaaaaaatacactctctgtttcctaaaagtacaatttgtgtgtctttttgcagcagtagg

SEQ ID NO: 63587 - DNA, 1229 bp, Bovine  19866880963514
ttcttgcctttcttagagtgattttctgcaacaaaatctgggacctgcgtcttaaggtcatttgtctgaccttcatttcctcttccattactcaacttgaaaaggtcttcattatggttctctgattgccatttaaaatttgtgcaaagataaataaggttatccttcccaggattcctgggactccattgttgcagtgatatatcactacctttgttttcttttaagaactgttaatccacataccagttaattggcctctagttattccaaaattgattatttttgacaccttcctttcatttatttatagtctgcttttaatcctaatgtattcagatatgtttgaaagattatcatcctgtagcttaattttttaaaagcaagttattgatccttttgataatgtataacttgagtgaatttttcccttataatttatattgtatgcagaagttttctttgattctacctaaagaatagaatgctgaaattatagaaatctttgtgctcctccaaaagttttttccagtaacgtggccaaagtgtatgtacagcactctttgtaggaaagcactctaggctgttatccttcagaaaaaggataaagcagaataaggcttgtaatgatacttgttaggtattatttgtgggtagtttctacccagtaacattgttaagatttacccaataaactagtgatttgtaccagatatttacaggtctgcagatcgatcttgaataatatttttattgagatataattcacaaagaaaattcacccttttaaagtatttagttttcttttttttttttttttcagtgcattcacaaaattttacaaccagcaccactacctgagtccaaaagttctttttattgttcactgctttattttgatatgagagcttgattctagtttccttcttgataaaaactgggaaaaaatgttttactggttaggttcatacattttgtatgatctctatattttaatctcttaagaggctacacatttttcctgataactaatacagattttgaatttgcaatacaaaatttgaagctgagttagttgtttgaaagagtagggatcactgaagtccaaattgcattttaaagatcgagcctctaaagtttctggctcagttttctatctgtacctcatcatatggtattctttggcacatgtcttaagttgccaaattcttacttgatttataattaat

SEQ ID NO: 63588 - DNA, 827 bp, Bovine  19866880234447
tgaaactcatgtgcatcaagttgatgacgccatccaaccatctcatcctctgttgtccccttctcctcctgccctccatccttcccagcatcagggtcttttccaatgagtcagcttttcgcatcaggtacccaaagtattggagcttcagcctcaccatcagtccttccagtgaacacccaggactgatctccttgaggatggactgagtggatctccttgcagtccaagggactctcaagagtcttctccaacaccacagttcaaaagcatcaattcttcggcactcagctttctttatagtccaactctcacatccatacatgaccactggaaaaaccatagccttgactagacggacttttgttgacaaagtaatgtctctgctttttaatatgctgtctaggttgttcataactttccttccaaggagtaagcgtcttttaatttcattgctggaattgaaattttgatagttgtgtgctgtaaatcagacacttcatattcataggccaaaagactagaattagttgacaaaagataagtaaaactctaaagaaaattttaaaacgattataccaaaatttttaaagtagtaaaatttaagacctcttagaataatttagttgtttgttcataatttttgttgtaattgaacactgaagtttttagaatagtaaaaatagaataatgggtttctgtgcaatttgcctttttgtcggtgaatataaagaatgcccctttgttcccctcctttatcttttacctcatccagttcctgggaagttgcagtactcagtacagaagggacaggtccaagactttaa

SEQ ID NO: 63589 - DNA, 1312 bp, Bovine  19866880452138
gaaaatataagtatataaatgcagaaaaagtaggtgcctttctcaaacccactttataagtaaatggaaggccaaacctagctcctggcatctcttctccttaatagtggtttcaaaacttataatggatgtgtcttcctacgatgatgaccttgagtttttgaaagttgatgaaactcgggtttgaatctcagcttttctttttactagctatgtggctacaagcaaacaatttaaactctttacaatattattttctgacatgtaaactggggtgataactgggtatttaggcttatgaaagattaaatgagataatatttgcacaacactcaacactaatcagaacctgaatattaactctagtaattgtcataagaaaacttgtgttcttttttataaataattctctacataagaaatattcagcatgtgataccaacagagatggttctaagaattaaaaaaaaaaaaactttactatttgtaaaaatgaaataaatttcttttcctggggtgcacaaaaaatgaaacacttatcaagttgcacttcaaatagtatagacttttccatcctctcaagaaagcatattttcacagaggcaacatatgccttttgtcattctaaaaaacccaggtgggatagtttcagtgaaggatcaggaaaaaaaagaaaaaaaaaaatatatatatatacatattttttaatgataaaaatagtttctgtaagatctaactattttatctttgtatctagactaactcccttatatagaaccccaatcaagaaaaacataaagctatatatcactatagaacttgctaaatggatttttttaattgatttttgaatggtttattgatttatcaaaattacttgatattttggcatcaggtagataggcacagcttcagagaaggcaagataaaaattacatttcatcaaagatagattatgggtaggaagatattagggtaaatgtttcaaatatttgttagtggctgctttttaaagttttctttatgcttatattcttaatattaatatgtacatattggcaaagtcaggagaataaatgaagtaattgcaagtcaaacaactcaatgtagcataaatatgaccataatgaaagtttttcactgtttctaataatgaaaaataaatcaaataatcatttggtttctagaaggtaaactaagggcaaaagttctcaaaattagctttagagattttaattgtgacttaatggggttcttggaaggagcaatcaggataaaatacacacatgattttctcaaattaaatgagggg

SEQ ID NO: 63590 - DNA, 1482 bp, Bovine  19866880506767
gaaaggctacccactccagaattctggccgggagaattccatggactctacagaccatgggatctcaaagagtcagacacaactgagttactttcacttttcactttcatacctccattaaaataaaaagtaactaagaatggtaaggcaaagagaaaataaggattggaaagtaaaagagcaggaaaagtcaatagaggcaacatatgcctttatgtatgataaccttagatttgggcttccgaagtggcacagcagtgaagaatctacttgccagtgcaggagatgcagagacacgggtttgctccctgggttggcaagatcccctggagtaggaaatggcaacctactcctgtgtttttgcctgaaaaattccatagacagagaagcctggtgggctacaatccatgaggttgcagagttggacgtgactgagcacctccaccacttaaatttatgtttagtctttttagcagccccataaagagaaaagctgctataagattcccaatgctaagcaaatgtttgacctgatggggagactagagagaagcctgactgaatggtgaagttggtcaattacttgtccttccatctcttctctacttctggtccatgccctctcgaccctgtcttctctgctgttgagttgatacagttcgtctgctccatagatgtcttctttcttttctcttttgctctaacaacaataagacatctccacccccttacctctaccctgcaacggttagttttactttttcctgagccaagttacctagtgtattgtatgcacacttccaaaggctcattctggcaaattcttagtaggaagaaaggcaccaaaatcttggaaggacttgagggagtggagaaaaaggttcaagttcaaaatgaggaaggtgttccccatttctactgccaaccctgggaaacattgccttaaagcaactgacagaatataactaaattaaatgaattaactcttcctagcaaggaaactgataaactcagaagacagacgatggccctactgtatataactaagatatactatactattatttaacatgtgggttctgattcagggaatagtttacaattaatttttcaatatacctattttactgtagaccacagagtgaatttcagtgttagaaattatccccttattcatatattgtactactaagataataagctagacttcttggattatttggggatgtcttcttggatttaccattttgtttaatttttactggattttgttcaagagacaagggaagcaggataggagatgaacattagtcaagaaccatctttgtgtcagatatgaagacattttaatattgcttcattttaggtctctcattcagctggcaagacttggcaaggcttgctggaagtttatggccagcatctgttctgatctataggttcccaagcccaaccatttacacattactaaatattacagtt

SEQ ID NO: 63591 - DNA, 2265 bp, Bovine  19866880554859
tatttttatcttgatataataaagtatgtgtaatatgataaatattacaagagtgataaatattacaatttcactagtcagtgattgcaaatcaccttggtgtactagaagcagtcaatactaatgatggtcttctaatggatgcaggcaattgttgatacagtggacaatcttctgagacctgaagctttggaatcatggaaacacatgaattcttctgaacaagcacatactgcaacgatgttgctggatacattggaagaaggagcgtttgtcctggctgacaacctcgtagaaccaaccagggtgtcaatgcccacagaaaatattggtgagtgaatctattgtcaagtttaatttttatttagaagatagatgtttaagagaattatgattccattgtgaatcttttgagttatttccaagtgctaagcttttcttttgtcaagttatgtttgtcccttaataagaaatataactgatcacattcataaaattaatgcaaaagccaaagtctatgtcttatgaaagttggtttgatgtactttttcccaactaaaaaatcattaaaggaaagaagggtttagagtacttaaatgccagaatatggattgcttaagtagtgataatgcttgctatggaactagggcaaatgcttttccatttatatgatatgttcctaatgaatttaaattactttctggaatgtgttctcccagtcaaatattttaggcacacagatatgtgagccaaatgttgatattaaacacaactgctttcaggtgaaaatgtggtcagtgatgtacatcccccatacagcagaatgttcatgctttacagattgcaaaatagctgcagatagttttgggggatcatttagaatttaaatgctggcagtgagaggcaagaattcacttttgatgatatttgaaagaagttccataagttcagtgaaattatactaatgaattagtataattctatactgattatactataatatataatgtatatatactaaatatataatgattatactataatcaatatagaattgacttgtcagtcagtatcggcttgactgatttagaattgttattcagtgtggttgggctcagatgaagtttatagtatcccttagtaaagtaaagaaatttccaaagcgtaaatgtgaaaaaaaaccaaaagggaacacagactactctgtcattgaaaaaatgtattggagcagcagatattgaatgaagttctgctatctaggatgccatatcttattgccttaacgtacctgctgaaacatgggactttatatttaaaaatgcagaaaagcaagttgtatgggaaaaatagagataaatctaattatgatacatggatttagatacaaaattttaaataagtgagtttttagaaagaggatattattaaaattgtatttttatttatgaggttttgaagtgataaataacttaattttaagtcaaaataatatggcttgctttgggagagcagcacaaggaaagtgatagtctaccattgcttagtacaaatagaaaataaaggttctcttttctgtctagagctgttatttctgagtttaatttatttagtagtctaatgaatttcctaagatacacattaaacaattcttctcagatgttttcagggatttgcctataaggttaaaggagtgtagacttgattatctcagaagataaatcataaaaagtatttgaagtgttgtgttgggacctccatttgttttttaaatcttttgaagactattttaaaagcaatgccccccccgcaaaaaaaaaaaccctaaaatttcccacttaagctgcttccaagagtgcaagaagttttgataggccaggttaattttttaattaaagaaagaacgttatgcatagatatctcatagtgtatatagtacatgttttaccgacttctgaaaaataatgccccgagagggaagtttgagggaaaatcagttcagttcagttgcacagtcgtgtctgactctttgcgaccccataaactgcagcatgccaggcctccctgtccatcaccaactcccagaatctacccagtccatcgagtcggtgatgccatccaaccatctcatcttctatcgtccccttctcctcctgccctcaatccttcccagcatcagggtcttttcaaatgagtcagttcttcacatcaggtggccatagtatggagtttcagcttcaacataagtccttccaataacacccagga

SEQ ID NO: 63592 - DNA, 2486 bp, Bovine  19866880562985
cccctttcaaagagggggagttgtggtatccatggtgatgccctctccaaatggtccgttaggtgtatagttgcaaagatagtggtcttcatagttgggaagttttagttttaattgtaaggaaattaaaccattcagaagagatgtgtttatgcaacctcttaatggttagggccatgccttaattgtgtgatatactctaattgagtaataagatgactttttaatgaaaatatcaggacacttttcttatcctgagctacacttgttcttttctatccatgaacatcaagataactttggaaatttctggcttgaaggaaggagtagttaaatatgacccagattgggggcccaaatccatgccactcagaatcataagatgggtattgatgtattgggaaaaattaagcagcatattatttaagatttcctgaggaatattttatccaattgagctgaactctgagatgaatcaacacctacagaaggtgtaataaaccagcaggatctagccaaaggagtagctgacttgatggcttgatgaaaatctctaccagtgcctaacactatggagaaattttggagctaaaacagctagtattgttctacattgggtgggctgaaatgatctggcatttatataaaccctccatcatcaagtgatatggccactctcgtaagaggatgatgctggacaaggaagttctttgcaactgaagccactactaaaggtgctgtcaattgcagcttgcccttgaaggtggatttgtgcaacaagtacaccttaaaggaggatctggagagggtgtcaccatggctaccacaactcccgtttcttttgaaataaggccgtgttgggcaggaaaaaatgtgcatggaagggttgcatacaataattcactaagcacgatttatcatcatttccatgagtaccttagatttaatgtcaattcctacatagattttcttcttcataaaagaagactctccaagcttcaccagcaccccaccactgcccccacctccaaattgtagtagttaaatgccttgatcatagaatatgtcaataaatgttcctggagttgattttttcaaatctgagagttgtccattgagaaaacttctaatcaaaagaacctcatggcagttttaagtgtgaatgcacaacactagtaaatctaagggttcaaatttcacttaaagttttcacagttttaaagaaagctgtttcatgtcccagaatctaacatgaaggtgattttaatatgctgtagttataacttgtctggtagaagtgctactcctaaaagaacattcattatatataatttaatttataaaatattatatctttcaaaaaattattacaacgttttgacatttaagatcaaagatgatttaacaatatttcccaagaaaaacaccatcaagtacaaacattacaaaggatctctgagtgttattaagagtctaaatcatgttgtataccttaattttgtacagtttacgtatttttgtacatataagaaagggccattcactttaatagagttttctgagcatttttgtgctcgtgtggtagttgctgtttaggataccagttggaaaacagctctgcagacatactctttagatgaaaaacactatcttcctgaccagtggaaccaaatacttgtttagtgtagagatgcaggtaaagagtatctcttttcaggccctcccatccctgccccggggttaagatccatcacagagctctgctgtatccttgatgaccagaggtgaatccatgctgtttaagcctaggatcaacatctgggagaacagactgagttgatctcatccaggacaacccattctcctctttattaagtccttatttagctgaactataaatattattaaacatttgcttatgaactgccagagcaccatgctgttcaacagatgaagctggtgtgttttaattttatgcactctgaatgtgcttagtttagtttccattctgcactccacattttcctaagttccagttattggaaagaatttttacctacaatccaaggcacagattgtcttaatttttattttctgttgttggtggggtgggggttggtttgggggcatgtgtgagaagagaaggattatgggagtggaatgggttatgacacattttcatttgcagctgctacaactcccttgccttaatccagcccagatctcagcggaaacctaaaaccattccagtgaccctagaattgcaccagcacctcaaatggccaaataaggtaagtcgtttgttatctgagccataaatatttacattcactagtgacaaatgtataaaaagtgtggagtgactgtgtaatttcagctgccctcctcaagcctgtcaatagtttctgttatctcctgaaagccccaatgactgatgtgtgctagtttaataagaatgtgctcaccagcttgttaccctcccctaa

SEQ ID NO: 63593 - DNA, 1716 bp, Bovine  19866880619743
tagtattaagaagtattcacataataaataattaaaatacactaatagtaaccccttaaaacatcctttactttttacacaaaggtttgaacactctagtagttcactattaaaagcataggacagattttcagcttcatttatattcagaggcaggcaaatcaccaaaactcatttacatcctttcattttccttaaagcatgttaacagcaggtgtctatccatcccacctttgaaataggtaggtggctgaaaatgcctctacttttcagtcaagaccctgaattaaaaataaacttgagctctaacttcatcattttctctacaagatgcggtaatacagaataaatatagtacttagtttgttcttattttaatccatactccacatactgttttcacaccacaaacttgcttattttaaccctgcatgttctctgaaaacttgagcattcaagctaataaagctgacaaatgatctagtaagaaactataaatgttccttatattctcattttatttttgcacaccatagactcgtcagcattcctttacactaatgaatgctaaaatattttttaaaccatcacaatgggaaagtcattattatattagctgtatactagccttacattgtacaaaatatatctatgtagatacacgtataaaaatatcttcgcatcttctgttggcaattttccagaaataaaaatacttaatatttaatataatttccagagacatatacctccttcaacctaacttgacataagtattccaagaaccagactgaaacacaaaactcagtcagaatgaatacttaatacaatgtgaataaattaagtctttgtgagagtctttgtcaacagaaaagaatacagaaaatattcaaatcatcagcatcacaagcattttcaaaataaaaatactaaatactaacctaacatgttttataagttgataaaaatcttttccgggagacgaggtgatttgaaaattttcagactaaatcagccttttaaaaaacactgtctccatatccatgaaaacctaaaattcagcagggtgtgatctgacttacgtttttctttacccctgtggccacctgcatttcctctgaagttacaaaaaagataggaaggaaacaaaccaatctacattctaatcttaaaaacagatgttacatatctaaacaattctaactcctctgggtatcagtgtccagggacaaattaatatttaaagttaatgggaaataaagtaagatctattgaaatgtaacttgaaaagtatagttttatgtatttttcaatctccatcaacaacatactcatttgttatcattcacctgatcagacaataaaaataatgccttctaaaaagattaagaagattatcatttactaatgctctaactagttaaggggttacaaagttttttgaaaggtagttttacataaatgccaaccaatataaacataaaaattttcatgagtagaaaaaggaaaaacaacacctccccaaatttaagtatgtttttggttgttttacctctgctaaaaaggaaagggcaacccactccagtatttttgcctgagaaattccagggacagaggagtctggtgggctacaatccatggggtctcaaaagagcccaacatggtttagcaactaaaccaccaccagcaccacaacaacaacaacaaaaaacagca

SEQ ID NO: 63594 - DNA, 1650 bp, Bovine  19866880676597
attaaaatgaggtggatgaaactggagccctattatacagagtgaggtaagccagaaagaaaaacaccaatacagtatactaacgcatatatatggaatttagaaaatggtaatgataaccctgtatgcgagacagcaaaagagacacagatatatagaacagtctatggactctgtgggagagggagagggtgggatgattgggagaatggtattgaaacatgtttaatatcatgtaagaaagaattgccagtccaggttcaatgcaggatatgggatgcttggggctggtgcactgggatgacccagagggatggtacggggagggacgtgggagaggggttcaggatggggaacatgtgtatacccgtggcggatttatgttgatgtatggcaaaaccaatacaatattgtaaagtaattagcctccaattaaaataaataaatttaaattaaaaaaaaatctactgctatttttagattttaatgtcttacaaaaaatacagctaaatacaagattatctgtaaatctgtatctgaagttgcacattttatagccagagttttagaattatttttatttacaaaaagtagtctaatacttaaaatagtacactcatacataacactacatattttgttagaaataatagtttattaaatatacttgatgtcattattatgaaaaagaacactggaagatcttgctactgctcttatctttgaccctttagctcttccattttagcaccttcattactgtcaagatgccattagaatgtctgccacttatttacatcactacatcctggacaagaaaaaaatcttctgggttcaatcagtaatactttccttttgtattcaactaaaacgcagaatagcatcacacaaaggacaagatgacaaaagataaactttagaatgtaaaatgtcacgttttagacatgaattgggcatttttaaaatgtggtttaaactgttttagtttttaatcgtcagacttctttaatatctgtaaccaatagcactaataggacttgtttttataattactattactacctttcttaggttgggtaacacgggaagcaaaatttgagccacagtctctgagatgcttataatgtccttagaactatcagtgaagccttaactgaagcaggattaggtagtctgagaagtacaatttggctgcaaataaaggcttagcaaattcctcgggggtgggagctctgagcttgggacagctcttcaggaatgtgttaaaatgcagcaaaaatgaggaggccaacctttggcactctggcattcagtggaattcctctagggagaaggatttatatccctttagcccatggcagttcctgggcagggactcactttgagcccctcctcaggtaactcccttggcagctgagggggaaaatggcctggtctgaagtgggaatctggggggcataccataatatccactgcaatgctataactgtaaagagtttaatggactgtttgcaaaaacagttcttttactaccacttctcattttcatggtttttattggattttatcttcttgtacacactaatatgtcaatcctgtttactaagcgatattcaatgggtttcctatggagcaatgaaccttaacagg

SEQ ID NO: 63595 - DNA, 1133 bp, Bovine  19866880790844
aggattagagtttgaaataatgcaaaagaacatgcaactaaaaggagttttagagggcaaaattgagtaaactagatttctgttgttcctattttaaattccccttaaagataacacccttggtttagatgtgattttgacaaacaggaaaattataccataaatattttttttctgcctcccaagatgtttcatgagatgtcatttattcagtctaatataaatctctgcatataaaagaaattcatctctagtctaattgacagctaataaatttcttcttttacagacctcactttgattacagtacagcagctaatgttcacacaacttcctatgtaatcaaaatgaaagcacagaaacaaattcataagacttttggtgatgtggctttaaaaaatctactatctaggcaaaagtaatgtcaaaaaaatacaatttttgttcaagtgttttaaattgactcaggaaatttttttttgctttttattaaaatgactacattctgtatgtgctcattttttttttttaatcaagaggcaagaaagcactgctgttctttacccaaaatgaattctttcagtaagaaatctttcacaacttttagtacattctttcctcatcaaacttgtttttcagttaaatgcactttttattacttttattttacagtaatttattttcctcatgcaacttataaagcttataaaaagtatatagaaatgttttgtgtaaaagggagacgaaaaagcaaaagtgagcagtatcttaataatatgaactgaactgatacattaatgctggaggacagggaaatacatagtgttaatggtcaacaaagggataactctcggaaaacaaaatgctatgcaattattctgcaagtcatgaatcttttttattaattatgtggtttaactttgtgcctcataaaaaacataatgttgttatccttatgttattctaatttaaaaagatgcatctgaattctcacagaaaacactatctatacacttcttgagctatttttcccttatggaagaaccatttgaagaatcttttctctgagggtagagcatttttgaactgaggacaccagactaatagtctgagcatctcctatattccaactc

SEQ ID NO: 63596 - DNA, 946 bp, Bovine  19866880915891
caaacgctgaattcaaggcctttccttttctatatagagacagtaattaactagtaagcagcagtatatttctaccaagctttagataacaataacatgtctccatggcatgttttagtagctgtgtgtgtagaaactttgtactaactgatttactgtcacaagatctgtttgtgaaccagcaatcattaatgtcttagaggtaaacacaaatttttaatccctttgaaaataaagatcaaatattacatttaataagacaaatatttacatttaagcattaatatttataaaagaaatattataaataaaacagtaaaagcagtgccaaatatgtattatcagctaaaatgggttacttaactttctcctccttctattttcatatatcggtcatttttagtaactattataaaataaaatcctgaagtaaatgggcagttttatgtctctaattctatacgctgcttctattgctttctattaattattttgacttccttaactgtattttattatcaccatttgttttctaatataattctcatgtgctttcaaatatatttcttgaattcaaattgctatgtattctggaatgctcaattagatcactcaattttgaagctttctctactcacttcaactattaaatggtataaaagtaaaattacctgtgtactttttaatgctatcagtctacactgaaatgaaaattatcttatcagcaggaaaacttccaaaattcaatgtacacattcattcttttctcttttatttatttaaactcaatattgactcacaaaccatgtttctctagagcttgtcacacttaactagcaataaagataataacactgactatacagtagtatatgaaagaatgcacacataatgtttagctctggtcaataactgtttactcagaaagcatttaattaaattttag

SEQ ID NO: 63597 - DNA, 1503 bp, Bovine  19866881115608
tgggtgtcacaaagagccagacacgacagtacacacatacttatgtcttagacatggatgctgagtcagaaaattctagaagagaggagttaataagctgagaatgccagatattacggtatatggtgttggaaatattcaattattgctatggtaaaagaaacaaatatgttgtttttcatggtttcactggaaaccatggtgaaagggaaaagatggctggatttaaaaagaaaatctaaatgacaattatagtaatgtgtgttgaatacttactaacatgcccagccagcacggtggtcagcacgtcccagaaaagaggtcatttaatggtctccaaaaagctaatgaggcagaaactgtatcatccctactctaaagttaaggaaactgaaactcaaagagagcaaacaagttatccagatagatatagaaataacagagctaggatttgaattcatgactgcctgactccaacacgcttgctctctattgtctcaataatatgtgtgtattaatttgagtaagatccaaaatctgcctgttctaaattgaattgtcttctgatatctacaaagagcagcacttttgaatctagaacagaaagctgccttttcattttggcttaactatgggctgtaaaattttaattaccttttgtttagaaagtgctatagaacctgaacttgtaatcagtgctggaagtaggcacaccaaggggttgttgatttccctagtgaatttgagtatcatttatggaaatgtaattacagtggaatcctattataacgatcaatttgggcaacccccatttgatcattacatccaaatgatcaccacacacagaccataaaacagtgagcctctcaaaccagacaggctaaacagtaaaatatccatcttgcaaaaacagtattattatcactaagtacctcagaaccagcacagggtcagtagaattatttgctctaattagctcttctaaagcctatacattctttagctaaattgtaatggctcatatgaaaggtttggaattcaactaagtcaactagtatttattttgtacctgctgtgtactctgaatgaggctagtcactgaggagaatataaaataaataggacttctttctgaagcttactatccactttcagaaacaagttgcataaactccttgggcaactctgcctaaaatgagagcctaaaaggaccccatattataataacagtcagtttcagacgtgaaaactttggcaccagtgaaaaacaggttaggagtatattcttttgtcacaaaaaatgattgcaaaagaaaatgcaataggaaatgaaaataaataggtccttcctgcagaggcagcacctgaagtcagagacagcaaagggggttcatctcacattccaacttcaatgaattggtacttaagcagggagagcaatgggattttctctctctcatatcaatatcaataaacagttaaatggctgactgcatagctggg

SEQ ID NO: 63598 - DNA, 1227 bp, Bovine  19866881127909
tgtctttgtaataagcttcaaaatgttaccagttttctgttctagcccctactttcaatatattgatataacttaatataatttagataaataccaagttgagaaaaatttttaaataagaacttttgtgttcaggaagtaaataatgctcacctgggtttaagtcacacatgaaagttgaaaatgggttagtattttattttcagaagatattgctctttacatcagaattgaaagatacatcaaatctaacattaaaatgtagtgtctgaatgaatagtactgtaatgataaacaatgagcagaaactgagttaatatcaatctctggcttgaaattatgaaaatcttgtgtgtcatgtataattttgcatctgtttttggaggggggacactaaactgaattcgtgctgttatatttgaatgttttcatacatttaaaaagtgtggatcagtggctcattagtccacataataaaaaaatttccaatcaaaatagagaccactttactgacacagttggttaacttagcagggggctagcaaactagtgactttttcatgagatactgcagttttatttctagtgtcacctattaggtcaggattcatatctgctgttaagagaatttcattttttggcacatgaggccagggggtgttacttttgaagcagttccctcctacaggtaaaaagaacctgggaggaacccatactgctagctgcgagagcacacacagttactgcgcaccgcactgttaacaacattgttcaggcgtcacgtggttttgtcttagaaaaagttttatgtgacgtgatagacctgttttgccagccagcagataatgctctatgaacacctatagagaaaacctatcaaagttaggtatgagagcacaggaaagaagatataaaattaaccttttagccattgagtttctttgggtcccttatgtgattgttacctttttagatcttacagaaatgagcactttttgtgtcagctcctgaatctttgctgataaactcagataaggcttttaggtggtttctttcctccttcctcatttattgcgtgactaaatttgagccagttgtttagggttcagacatatgcaaggcacggtcccttctcttgaggagttcgtggtcttgtgcgggggtctaaacctcaaataactcctggaggtctgcagtaggcaggaaagtgcttgcggggggacccat

SEQ ID NO: 63599 - DNA, 1685 bp, Bovine  19866881222265
gccgcaggtatatcaaggggtttctgaggatgggactggttgtctgcattatttagaatccctcttattaagatgttctgggtcagaagctctaagaagctgaaattcatttcagcaatcctgtagttgacctagaaaagggatagtaactggggacccaggtcttttaactaaggtgttattacctcttgtggtgtttccctgtgctcaggtcactcatccactgttgcacttggaatccttggggtcattctgttggcctttctcatcgcaaccctcttgtggattcagaggcgaagacagagacagcggcttgcaggtctgagccaaattatcgtgtctctaacatttctatggcataaaaaatttcttggaataatacaacaacaacaaaaattagattcaagtatcaaatggccacaaagaggaaacctagaagagatttaagcagtttccccaaaagaagaaacaaaaattcagagaagaaaaggggtactgcttgtattgatgattattataatgtagctatgggcttccctggtggctcagtggtaaagaatccacctgccaatgcaggagatgagggttcaggccctgggtcaggaagatcccctggagagggaaacgcaatccactccaatattcttgcctggaaaattcaatggacagaggagcctagcaggctatagtccatggagttgcaagagtcaggtacaacctagcaactaaaaacaacagcaaatagtctatctacatctttaattgaatgttacagaatcgatcatttagaatgagtatgcttttgtgatgcatgatgaatcctttattgtccaaacatttgtttgctcttactctatgctgctaagtcactttagtcatgtccgactctgtacgaccccatagacggcagcccaacaggctcccccgtccctgggattctccaggcaagaacactggagtgggttgccatttccttctctgcatgaaagtgaaaagtgcaagtgaagtcgctcagtcgtgtccgacttctagcgaccccatggtctgcagcctaccaggctcctccatccatgggattttccaagcaagagttctggagcggggtgccatccccttctccgcaaaactgtatagaggtgcggattaatcatctaccatacatccatcactcggttaggtttgggaacctgtgagccacaaatattatgttccaacaagtaggatgtgacaggcaggcatgaaaataaaaggcagtcatggttctgagtattacaggtgatcagaagtcaggtcccaaacggtcacacgattgaaaatgattagagagtattccctctggtaaagtttcagggcaccagatgcgactgaatctagcaaaggcaactttttctacaatagctaagagaaagttagaaggacctaagtaatagaaaatagccaagactgatttggaagcttccaatcacatgtaacaaagcacagtctttttcctggggattgtggtcaggtgggggataagcttatgaaggcagtctctacttgacataatttattgagggacccacaaactcactgacatgactctacatgatggcaagctggataagttatatggctttccaaaggagatgcatagtggatgagaaatggaaatgagattttatgatttaggaaacaaatcatag

SEQ ID NO: 63600 - DNA, 1525 bp, Bovine  19866881222274
tttatggccggccccagactttgtaacttatgtggcagtaaagtggttaagtaaagttttcaatccaatcttggagccctttgaggctaagataactatgaattactaagacttaaagttttcttctggaacaaaaagctatttttgaaatattctgatgtgattatatttatcatcagggccttttgtttttggatcatggtaagaagtgacatgatcctttagctcatattttttagatacaatttccccggcagaacactttggtcattagctcactatattttctcattttctcaatccctacacttactctgttaatcttaggcattatgtttggcatggatcactgaaccgatttacttctccaggtctctttgaaggcaggcttaccatcctccaaactgtttaggagagtatgatcttcctaaaacacatttttggtcttggaactcccctgtttggaatccattaaatattttccatttcctttagcatcaaatccaagttcctcactttggatctggactttgctctttttcactttattcctattctgaattttaggtgccagacacagtgaagagttgcttacgctaactcttgcctataaggcttgggacatgcttgacttttgacataggagtctgctctctttatcctaactgtttagtctggcttaatttttacttatcttttggatattgccttttgcctcatttcccttggacatcttttctgggtctctataaaatgaaatatctgttcttatatctgttcacatatcatccaggtttactcctattttaggacttactattttgcactgaaatttcctttgtagactcctccatagacttgacagtcttcttgtaagttaggactgcatcttgtccactagggaaactcttgcaccaagatcagtgtacagacacgtgacaggtgcctcgggtatggatatgtttgcttaggtgagttcagttctgccagaggccttctctgagaggcttgcagttcccgggcttatgctaggctgttcagattgactcaggaaagcattggtaaaaaacataattttacgcctgaacttaggtctgtggaaaatcttgctcaaaacggacacacgggcctgttctatagtatatagcactctgcgtgtcagtaaaaacaaataaaaataattaaaccagttaacgcaaaagagagacatatatacaggtacctcttgaaaaatattggaaagtgtatattggccctcagtccagaagaaaattggaattaggaagtaaagttagaatcataaattagaaaagactgtatacctcgtatttgcctgtttgcattttcattgcagaattcttcctctgtaggcttttcttctgcttttcagaccacatggcggacactgagtctataacaccctgttaaaaacacaggaccaaactgagctagaattccttctgcataatttctatggaaaatacaattgctgtaacttgggaacaaatcaatataaataaagtca

SEQ ID NO: 63601 - DNA, 1011 bp, Bovine  19866881256154
gtggggtatgccaaaaatcttaaaggagagaggaattaaaacgaaaccatttttttggcaacaccttgccccaagaatttgaaatggtttttaacctggcttttttttttcttcattgacaaggatccatcttatctctgtatacctgggcaaaggaacgtggcaaaaaaggagaatgtgtaaacagaaatctaaaacagattctaaaaaagatattatggagagataaagaaaatttttggaaagcaattgaatttctttttctttgtattgaattaatgaaaatacatttagttttcaaaagaagatattctctgggttaaatttatgaattattcttaaataaaaagaaaatgtggttgtaactgtagtttaaatacgattttttatctttgactgtgagtcagtcctaagaagccactttgggattgcttgctttgcatttagtagatgcaccaggtaaacgtcttgggcagctttggtttgggtgaattgccagtttcacactggtgctgtgtaagcaaggtaatgcttccttttccttgaaatacactgtgagagtacctctgggtgaaatatgaaaagtttgtgtatcctgactgctctagctgtgttcttaaccaagatgttgggcaagagtaatcatgctgaaccacagattttcaggagcagttatttatcaagtaattggtaaggaggaggaacaatgctagataatagtatttttatacaattatgttctgcatctttaccacacaattgcctacatgtttcaaatatttttgccaacctttgttattacctgtagagggagcttgcatatgagataaaataatcaaggcagtataaattgatcatttcccttttgaaaatgatattttattaacattatttttgtttgagaaaaattattctaaggaaaataaagcattttgagattaggcaaattctagtgaaatttacagtaataaatgccaggtttttatgattttctgtatttacagattacag

SEQ ID NO: 63602 - DNA, 844 bp, Bovine  19866881327448
tccggagaggcagagagggcaattctactgcatgctttattaaactgtcttctccatttctccccaggctggactgcacagaagaaattcattagctccatttaaatgcacacccccagagcctaccttcagcttccagcagagcacaacacatttcacattggataaaccactatgactctagagaataaatttttttaaaacttaaatcagccttcatggaatactttatattgttatgattttttttccccttataagtgaagaactactctgtagacaaagactgggaaaagtcattataaaaaacaattcatagtagagaattttgttgtaatgagatcaacaagacactaatgctctaggtcattggcctgggcttagaagtaattttattattgcaaagattttttcaatattgtttcttgttaaaatagaatttaactctgcaaataaactttcatccatttacaactcacaagtgaagaccagtaacccatgcttgaaactttagaatcatttttaactcctcatgtgtgaccccccaccacatccaataaatgtccaagtcttttctctactgttttttctgttgtacctcttggatattccaacatatcctttcagagtattgtacctgagctgtctctaaaatgttgacaatcctttgcctcagatcttctcttgctgtaagctacagaggttaaattctccattctcatgactttaattaccatttatactatccattcaaagtatcagttcctgactatctcttaaattttgatagtcttttgcctcagatgttttcttattgcaaaattcagaggattaaattctccgt

SEQ ID NO: 63603 - DNA, 1240 bp, Bovine  19866881414129
acctggacagtttgtttagggaaaagtatacactggttttctgataatcaaaagctcaactctatgataaaacagtcttctctaagattaagtgggtgttaaaaatcctcaaggatattctatgtcatttcaaacatctttcatttcatgaaagtcttccttacaaaattctgttacagctgggttgaggaacatttacagtgcatcaacttgttaaccgttaaatattcatacttgcactgccaagcaatattatattttaataccaattgcattttcaggaagaaaagagcttgaactcaatgaaacagattgcattcttgaaacttccaaacttccatcaaactcctctcagctgttttatttttcttcagcatacattctcacttttctgctttcattggcaccgtttgtatattagtcgatgtatgttgaggcaatgataattaaatttcacttgaagttaagagacggagtgattaaatttgaacttaaatctttctgaaataggtagctctcttgtatttcacagagggaaaattctacttgaatattgggaagaatataattatcttgttcaagatactaggtctttcaagaaacaatatggtattatcttgagtagaaagaggataatcagaaattcaaaggaggttttctgtagttattttacattttcaggaagaaattgtactttcctcttacccagacatttgccacaaaagataagagaaatgccaaggaaggctctgcttgcttccccaactgtaaaagaaaaaagggagaacatgtgatgtctctgtgtggcaggtggaaagataaggaagcaatctatgcagcaaaagctactccagtgatggccatgattcactttcttcggaagctgcaagcaacagaaaaggctcacagcagagttccccagtggcacgggccctctgggggtctagtcacgtgcagttaggttagactgtggggagaggaagatctacccagaattgggcctggtagataaggattgtaaaatttttacaacctggattgtaaaattcagctttgcctatcaggaatctagttcacctcctaaatagaagggctagtgagtttcctattgcactgggactttaattcagcagtttcccttatcctacatcctgcattgattaaggaatctgaatgcaaaagtcaaagctgcattacaagctcaggctgtacttcagtgccggattgacaatcatcccta

SEQ ID NO: 63604 - DNA, 1638 bp, Bovine  19866881469626
ttattgaagatacttttgtcaagagtcaaagtatggatcttattttctacaacatgtggattagggaaaaggggattaaaatatttcagtaacttactgtccaagagcatacagttattaaactagtacagccatgattcagatctaaacttattttttttgcagagtccatgttcttactaagtcatgctaatcttagaggaataggaaagaaatgttaccattgcatgtatttgccttctttctagagaagaacatggaacatactagactttctcttttgcttgaaagtcattcctgagcttgttgcgttattgagtattttctccttcttcaggccttagatctaattaatgtcaaccccgagagaggcttttcatagtcattttatgggaagcaacttccaagttacatcatcctatttattttctttcttaatagttctagtacctgtaaatagtttatttgtgtgttttgtttcctcaaattctgttttacagattagtacttgacacacgttgggtgttggcataaattaatagctgtttgtttagtgaatgaatacaactctttatgtatttggcttccttgtaaatatctagacataaacttaacaagtactatttcctcaaaaattttcttaaagaaataattaaaactgcacttaggttttaatttccagttgttacagtggcagtcaaaagttattttaaagaaataagttatatataaatttccatgaaaatcattgggaattcttaattgaaactggtttactgatactagtcatttctgtaattcttacattcatttcccacacaagacccacttttgcaagcatatcttaatgattgaattattaagtagattgtacctgacgcaaaaacatggtaatctctcactgatttggaggatttatatgattttagtttttgcatgaaataggttctgaggactgtgtatagtatgcattggaataatacatatgttaacattaaccaagggtgaagttaaagtacagaattgttagtggcaacaaaatgctttcagtgctagaatacaaaatgctatctgtggctataaatatacaaagttatttaagaactgaattatgcttccaggaagaagaatttgagattattttatataaaatagtgattacattttaaactttgagaagcagaaaaatattccactaatttaagtagtttttcttaagtaaatttaagtgggaactttctctcttttagactctcttatctattgtttgaaaggatagatgagagaaaataaacctagtaaaatatttctagtgatctagtagtagccaattgtttctgctttaacaattacagtatttactgtcagaattctaatttgtcttggcaataaataactattattattagtgtttgatgattactaaaagcacagtgttttaaaatgtctactttctaaaaataacaaaaaatagcctggatgtaatagtgttttgttttaatagtggacagggtagcattgttgctgagcccttgggaagaggggaactctcttttggggtctctaaaaacaaaccaaacttcttccctgggggttctgacttccctttactactgtgcatgtgggccagtgccatgt

SEQ ID NO: 63605 - DNA, 1575 bp, Bovine  19866881581431
ttatattgttgagaagttgagaatatgagagtatgtgaaagtatcaaattttgcttgccatacacagatactctagcaattcactttaattctcgaagctagctgcattcttcattgacgcacaagccaagtgatccaccactaagagttaaatgaggtgacgttcaggcgtagccctaggaggaacccggggccacaagtgcattcaaagtgtcgatgatcaatgcatcagatagtcttatgtgagtatttgatatatttccagatatcaataaattaaaactggacccattctatagttgagtgtctctatgtacaaattccttctgctagatatgcttgtagattcaaaattaaaatcacagggttcctgaactccaagatctcatagcctagtgagaaacaagagtaagtacatgcatgactaatgaaaggtaatgtatgttctgtggtgttcactgagctggtataaactaaaggctacaagagctatttggaggtagaagcaattaattcaaactgggggatcagaacatctcttcttaatactggttgaatttaagatataaaataaaattaaggaaaactctatcattgcatatttaatctgcttgggagggctttaattactcagaaaagagaaagagaatagtacagtagaaccttgattaaatggtacactctgaatttggataatgggattttctcattaattctctttaagacaaaaaaagaaaagaaaaaaaaaaaaaaactggtgccttgttgttgctattcctacttttaacaatgcctattcaagcagttctcactgaattaatatggagtaggcataggagcaaatatgagtgattcataatatataatccctgacttcactgagtttattattttgtgcatgaaaatagacataacataaaatataacattaacactgatatattgacataaataacaataatataaagaagtatgtaactagctagaaataagagttctagagggattaggtgatgaaaaaaatattttgaactagaataaattaacaggatttagtcagaatatattgatttgtatcagagagacgatataaaaaaagaatatcagaacttatcgataagttgatggtgtgcagaatggattgaatctgaagatatagaagcaaggagacaaatctggcaacttttaatgttaatcgtacctgaaaatgttgcttgatatgtcttagacaactgaattctggatttctatttttttaattaaaaaaaaaaatttactttatttttggctgtgctgtttcatttgctgtgcaggattttctctagttgtggcaagcagggcctactctctagttacagtacataggcttctcattgcaaaggcttctcttgctgcagagcaagggctctagggcgcatcagagtcattagttgcagcacgtgggctcagtagttgtggctcccagactctagagcataggctcaatagttgcatctcacaggtttactctgctgcaagtgggatattcctgggtcaggggatcaaactcaggtctcctgcaatagcaggcatatt

SEQ ID NO: 63606 - DNA, 719 bp, Bovine  19866881699013
ctaaggctttctttttttctctgacatgccccaaggtgttttaggacagtggttggatatgtcagagagaaaataggttttatgttatttggcttgaatttccattaggtacctatttgtctggacaaacaggcaggagtgcccatctttaaataatgagctcagagttacctggggaattacttaccaatgagtgttaccttcaggacgagaaaaaatagctgataaaatcattcctgagggttataaaacacccaggtgggtagtgtgtgcagcttcagcctggataaatcatgcctctctaatgtatttggaatttttgaaagagttaacgaaatagtgaagcttagagaagtagtgggtattaaatatttagacattcaaaagggttttgctcaagaacctacccagagacatttaggatccatttcagccttatgaagggcccaagatgtgagagctaaaatcttttcctataaaaattcagttaaaacaacaacaaaaaaaggttaacagtgaaaatgaaaggtaggaataaatgatgcagttagcctgaagggaggttaataagaaagtgccccagggaatgatactggaaccagaatttttatatatgttaacaccaatcaatctggaaacccttctaaataatgaggtttcaaaatatgtgggtagcagtgaactgttaaattagtcaggagtagggaacaatttgagga

SEQ ID NO: 63607 - DNA, 576 bp, Bovine  19866880352355
gctgttgatgtgtgggccatcggctgtctggtaactgaaatgctcatgggggagcccctctttcctggagattctgatattgatcagttatatcatattatggtgtgtttaggtaagattatgcatctgtattttaaattttagtaattttttcctatgtgtttctttttgtattgattttgcaagttgttggtacactaaagatgatgtgtgtgttttgaatgaatatagggagcaaataggaaaacatctctccctctctctctctctctatatatatatatcagttcagttcagttcagtcgctcagtcgtgtccgactctttgtgaccccatgcatcgcagcatgccaggcctccctgtccatcaccaactcccggagttcactcagactcacgtccattgagtcagtgatgccatccagccatctcatcctctgtcgtcccctcctcctcctgcccccaatccctcccagcatcagggattccaatgagtcaactctttgcatgaggtggccaaagtactggagtttcagcttcagcatcagtccttccaaagaaatccaagggctgatct

SEQ ID NO: 63608 - DNA, 1111 bp, Bovine  19866880703403
agttgatgactatctggatagcgaattattctacggttgtcagattcattctgttcaatatctcctctgcctgagaagaggaacagagcagatattaaagcttacaatgtcatataataaaaattagttcaaagcaatgaaagttaaaaaccctaacacttgatattcttgttttagtttaataagataataagctcctttgagttgtggaactgcctattattagtaggttagttagaaaacaacatgacactgaagtgttaaccgagggtactgactagactgctaaagtcccttcttcgagatctactggtctgatcatgtgaaagccaagtatcagaagtataagtatttctccttaaccaaactcttgcaatcacccaggcaccaaactgcttttagatagtgagatgtgtttgtactaaatatttgtttagtactttacagttcacaaattaatcttgtataaaagactgttgtataaaattatagccaaatcagtaaatttaacagcaataatgtcatttatataaccttttatacaccttagggtgctcatatatacatatataaaatcttatatgatcctcccactaacacaaggaacagaatgaggcatataaagaaaaggcatcacacagaaaaaatttgtgtagtaactgaatggtttaagagaatgtcacaatttaagggtcttacacaaaataacaaactcagtgacaaggctgggatgaatcccagctcccataactcctggtttaataacacacttttattaaaaaagtatattttctaaatatgatgtatactatctcccacctcctcccaaaagcaatctaaacatattcatagaattcaaatagaggttctacatatattagctaacaatggaaacaagtcaaaaatcatggcaacttacttaatacctaagacaatcaaaataagaagaatcagggtgtgcttattgtttatctgtgaagagataagagtgctaagtaagagagtaggttattggcagctcggttttgaattcttagaaccagtgacaataaccaaagaaaatgtgtctcaaaattctcttattattttcaaaatacatgtctctatggca

SEQ ID NO: 63609 - DNA, 774 bp, Bovine  19866880722220
taaaaaatatgaaaaagataagcaattggcaatgtaacaaggatacaatccaatgtgttcacagattggttacctgtgagactggtgctttaacatggggtggaattccagaggaagaaacagtgccactaggaggcaggtttttactggtcactgaagcccaggagaaagcctgcaggaaatgcaacaaacctagactactaatcatggaaaaccaccaacattcctatagggaaacttccaaatatatattttcttttcatttctgaactattgctctatattggaggactcctaaaaagaaaggcacacacacacatgccagtctatgtgccaggtttcaaaatctcattatgcaagattatgactgtctgaactactaaataaatccacaagcaagttcctatatactctaagtagatgagcaagtggcaagcaaaaccactaacaactacacatgctagaaaaataagaacctaatagaatcaatttatttccccttttgggggggaagataagggtgttgtgatggcgctaaggggagagaggaaggacaggaaagaagagagtactagctggaaactttaacagacattcacaaatagaacaagcaatctcctcctctcactacccaaatatacctactttacagaaagatagaagatgttttaggtaggtttaaacgaaacactatgggtatcactcatctttccaagacagtttggtgtagtaaggaaattgttcccatttaaaccagaaatagcacacatatca

SEQ ID NO: 63610 - DNA, 852 bp, Bovine  19866880804456
taggtctagtgttttgagaaactatattcgataaaatgttccaggataaattttttaaaggaatgctgcatttaaaatagaagccctttgttatcatcagctttatagagttcatgaactcttgccctttgggtaacctataaataattcttgatgttttatgatttataattgtaatcacttgaattatcttttaggagcgaatataagaattccttatgtaaatttgtctttttgtacatgttcctcttattatttatactgctttgtctggtttttctgttgtagataacctagaaaaggcatgcttatttatatttttatacctcaggcagaaataccataaactcagtgtaaaaagtcacaaatttttataatttataaaatttataattaaagttgataattttagtttataatttggaaactatatactgttagactttgaaatgctagcatttgtgataggttatttgttagacaagtttcagtatgatgccttgcttaaaagcatgtgcttttggaaaacaggaaatttcttagagaaagcatggagaatacatgaagcagtatattatgttggctaacttattagccattccattacataattgtaatggaaatagattatgttaggtttatggattgatctgaaaagagactgttgtttgactttgtaatcccccccacccactttaagattgaaacagttcagatcatctgaagataagtctggctcttgcttttttttttgtaaaatcttctcagtgatagaatttgttttaaaacaaatttctggctctttctgtaatcaaaaccagtaactttttatttcattaaaacaaatcaaat

SEQ ID NO: 63611 - DNA, 1041 bp, Bovine  19866881149176
taaataatccaattaaaatttacctgtgtaaatattctggagctttattcagcaaagtataatattgcctcacaaactcccgccctacaagcagcggactgggcttctccataaccatttctttgctgcacaatgtcaaatactagggaaacaaacataggaataataattcttaaaagtcatctttgttaaataccatgaagcaaattttcttagacattcaaatgaaaacaaaatatcacttattaaaaaataacagtaaaataataaattcccaataactacttataacctccaacatttgccatttcctctttatctctatgtctctatttcttgatctccctatgtctcaatacaaggggaagtggcatgtccagtgctgtctcagactaggtggcaccataataaagtctttttactcatagtatatttttcctttggggaacattatctcctacattcttagactctaatggtttgtttttggaaactaggcagagggcacaactcagggcttgggagatcatacttatagacagcactagcttttgtcttctttatgtaatactctagccttctagggattaattgcactgtttcaaaatgataacaattaccattaaaaatcagcaatactctaaatactcagataatggtgtttcacattttgtgtgtgtcttttcaacctttcttgctattaattatctaactacatgtcaggcactgttcataggaagtgggatacctcagtgaacaggactctagccctcggagtttataatctatcatggaatacagacaagcaaatagggaacagaatggcttaggtgtgacctaaacgtacctctaagccccaactctcaaagataaacaagtaaaaaataaaaatagaaacatactctttcatcatttaaagtaaataatttatgtctatagccctccaaacagtaaaagtcataacactaggaattaagagaaatgggaagaaaaaagagaaaatatgagtatcactagtttaaatacatatatacacacgtt

SEQ ID NO: 63612 - DNA, 1302 bp, Bovine  19866881219941
aaagcatattatttgtataacagctttttctcctcaacccctatattttctaataagccctttccagctcaggtcaaatttctttaacttggcatcattattctagaaagcctcattactctttggatttctaggttccaaagaaatgaggtcattctgtcaacccaaccgataaagggtatttcttcttctgtgtccgtcctacttcccaaaaagataaggtctgctacattattttgtaggtattggatcttttctccagctttagccataatttaccagttctaacctttcaagagttgaccgctcagcctgcgcttttccctttctcttttggtggctacttcctcacagtttttattcacttcttctcccttggggtagcaagctctggtctttttaatcctgtatttagtttccatgtccgtctttggcatatcacaaaaatcaagctaaaataaaactcccggcaagtaggagaatgcttgcacaataaatatttcttgaatgaccaagattattttttactatcataaaaagcaaaaagggtgctgaaaatatactattagagtttattagaaagtgaaagtgaaatcactcagtcctgtccgactctttgcgaccccatggactgtagcctatcaggttcctccgtccatgggattttccaggcaagagtgctggagtggattgccatttccttctccaggggatcttcgcgacccaggaatcgaacccaggtctcctgcattgcaggcagatgctttaccatctgagccaccagggaagtttattaattccacacttaaaaccaggagaagattaactagaattagactaatcattctaaaccatttggtttgaatcaaattgttttcttactcctcttaatttgctaaaaggaatcttgttgagtaaacaatattttacgcttggaacaacaatgtcatctggatccagtaaataatatcctggtcactatgtttgtttttatttgttttatattctagtcacttgtttgaaggtttctgggctcaaatacaaatactgatataatttgggagaagaatttcatccaattatcttctacccactggaatattctagagtagaaaggtcccgaatatgtcactgtagcataacacttattttgagcagaaggcatttgagttcttgaaatctcttgtctgggtaagagcagagcctccccaaagaactcaaagaacccaactgtcagaagtcaaccaaagaacattcttatcaccagagatcatggagaagtcaccacaccacaccaacaca

SEQ ID NO: 63613 - DNA, 1071 bp, Bovine  19866880494757
tgggaagtgccctgtttatattacttttcctgatctcctgttggccaaagtcagtcacatgaccaagcctgcagccaacatgggaggagcccacacaagagtttgtataactggtggtgggattccgtgtgggcttaaagacaacgatccatcacatgtaatatctagctgtggactataataaacgccttcatgtctcaacatattcgagtccaatagctgcttcataacacacatttccacatgagctctgtgatgactgcctctcagatgcctcgtgactatggagacacagaatcacttggctcctagggtgaagaatgttatgtaacttattaactcactgagtttggcttagctactggagaaaaccctaaggcacgaatttcctcccaaacaaccctcatcccctcttgcaaacttgatgtgccaggctttaacaatgcttgtgctgactccttgctaccaaggccagggcttttcccgaccctccgcttggttccctattccctcctgcagctctcatctctcctcctccagacagacatgctctcttatctttcctgaagttcctaaaaccatcctgtaatcagccacctctccccatccctctctctaacctccagctctgccctttgtaattctgagcattcttattatagataaaggttatgaagtggaatgcttcaccatccttcatgcccaagtgtggttggctttatgtgctattcaggaaggcccgggtactttagtgatgaacggagcagaggacagttatgagcaactgcggaatagttaaagtgactgatggagaaatatgggtggtgtttcagcctccggtcaggtcacagaggagagaggaaggagtaattaagatggttgggtaatgcttctcgcagaggaggcctctgtcggctgtaagcaagtcagcagggatgggggtcaggaaagggaatggggtgattcagagatggctcattaacatagaaatgaaggaaggggtgagacactgaacatgcacaggaggaggcagccgggtcaagtgctgctactgaaaaaggttaccgcctg

SEQ ID NO: 63614 - DNA, 2140 bp, Bovine  19866880568338
aaacaacgactggtcttgggaaagtcacttccttactgtgcctctgtttacctgtctctgaaaaggggagtggacacagaggctcggaactcttgagtctctacagcttctccttaatttctttgccactctgcaggtgtctttctcagatgtctcttcctgggtttgcctctccatccctgcctctgggctcaagcttgggcgcagcagcctcacgcagaatcctagctgcaaacccaacttggcatcttttttatttttttctgccttgaccgtccgaccacatttgttaatcacacaatttagtgccttgtaagcatggccactgcttcatttccccacaaactcctgaaaatagcagccagggaagatttgtttctagtcatgaaccaaatatgaaggtcgcatgattttgtgattttttttcttactgaagaaatatgggaggcttaagcaggccaaccttccaattaatcctacgaacagctgccttcgaggtgggtgagcctgaatattattcactttcctagtcatttatcaaggaagggaaactgtccgctggcctccgatagctttaattcattgaaggctaaaatacagcacagtgagaaggtcctcgactcacaggcatgatgcagattgttacctgtgcccaactttgctctctagtggaaaggacttgactgattggactgtcaatgtgggtgcactgacccgtacactcaaacacacgcacacacacacacatacacacacacacagtgcaggagtcggcatcttcctgctggtcatagagctttggggtactcaggaccaccccccactcagtggccagcccagttgcccttgtcatctcttccgtttgtccttggtcacacctgcctcacttgcctaattcttagctccatgcagccgtaggcttttctagtaaaaaatgtgcttggttggtggcttaccttagaacaggggaaggagggcagactcaaagtgggaggaagccacagtatcaagagaaaaccagcaaaacggccatagttactaatggatttggggtcaagaagggggaggtgaggagactgaaggggcagagacatgggtcaggtcctgtttccagcgcttgacacctgtaacttcagtctgcttgataacacagagggaggcactattaaccctgtgttatctggtgacccttgcagtatggttgctgtgggtactgcctagcagggacttggttccaagtgggtactccgtacatgtctgctgaagagatgggtgggtagatggctaaaaggaggtgaccttgctgatctgcatactagtttaaaattgtatctctgttgcgatgtggtgttttcaagatcctgggagcacttcgctccgctgtctgagtgggcaagagatttctctgggtccaggttcccagaattccactgggccctgcctgatcagagtggacccaaagaagtcctttacctcagtaagaaatagattccatagagacaagttggcgaattattttccagaatggtgaaggtgatgaacttagatggtgacatattaatattaagggagctcaagttaaagtgaagtgaagttgctcagtcgtgtctgactctttgcaaccccatggactgtagcctacagtctgtctatccctctgtccatgggattctctgggcaagaatactggagtgggttgccatttccttctccaggggatcttccccacccagggattgaacccaggtctcccaccttgcaggcagatgctttaccctctgtgccaccagggaagccctaggcagctcaaaatcaagcaaaaaaagggagaaataatgcttcaaagggctgggcagacccaacagaatggtcagggagccacttaagagagctatgatgaggctgattcacagattctctccctggaaggcaactttgaaatttttgtgacagttctcagagagggaaatagagagaggtcttgtgtgcctggaacagacacatttagggtcacttttctgacggcatggtgtcactggcttcaggacaggcatggtgtcctaagtagagtgtctctgtcctaggccctcttcctcagtaattctagcccaggccctcaattcttacacacctcatgagg

SEQ ID NO: 63615 - DNA, 599 bp, Bovine  19866880763326
tctgcccccgcaaaggaggaatgaggtctcaggggccttcagattcatttagatttgacgagatatgcaatagggagcaagcttcgaggagcaattttgtgcaggcgaaccttgatttgataaggaataggagatgatcaattgcattttctttgctatccctttctctccccagttcattctgattttatgatcctgtaattaatcagataattaaacaaatgtaaatagccatttcataatgcagcaccatgctttggtgctacctttatgttgaattctcattaacagcctgagttatttctcatttacatgcaagaaagtacaggaacctggtgctcacagagagctgcaaaaagtagtttaattttttacagaggtagaggaatgaaaccataccttaaaactgtgtgtgtgtgtggcaatattcttttgttaaaaacaccttcctgtgcttaagactgacccttttgcatccattttatgagtttttgttaaggatcatggcctgctattttattaaaattatcttattcctgggttttcctggtgactcagatggtaaagaatctgcctgcaatgcaggaggcctaagttca

SEQ ID NO: 63616 - DNA, 1669 bp, Bovine  19866880789916
tgctgtgcctcttgattgtgacggtaagggttacacaaacctgcacgtgtgtgtgtgtggtgtgtgtgtgtgttagttgctcagtcatgtctgaatctttgtgaccccgtggactgtagcccacacaggctcctctgtccttggaattctccaggccagaatcccagagtgggtagccattcccttctccaggggatcttcccaacccagggattgaacccaggtctcctgcatggcacgtggattctttactgtctgagccaccagggaatccataggtattaaaattcatggaactgtaaaaaatgctactagtctaatcaggtgcctttcctgggtttatagaaagcacagtaactctgtgaggcaggtattatccatttttcccaaataaggatgcagacttaaggctcttgaggagagagcccaagtcatacaaacaagaaatgagagcagaggtgagctgcagggcacgggtggaggtgctagagccagctgcgtgtgtgcgtgctgctctgtttcagttcctggatttgaccccagtatattttattctgaaaagcaaacaaacaaaacccaaaaacaagctcatccaattctagaagtcatcgaatcatagaattcaaagatgagcgggacgtgttggggcttcgttgttgttactcatttagaatatgcctggtccatggggcttaagggactcttccaaagtcccatcttcagaaaacactagtgtcagtcctgactctgtcttccgaagttaaacccgaaaggcattatggggtttttctctcttcatggcaaagattgaaatacatgtaagaagagacacacatagtagctgtaatcagcgagtattcttttcccttcgctctctctcctcttcatctgtttagtttaaaaattcctacaattggttacaaattctcacatcacctctgccttcttatcagctttgtgcagttgggagataaagacccacattatcttcaaatcaagcaggcagttgctatgatgaatctttccttcctaatttaagctgaaaccacaaagtgggccccacgttataaccagtgatgggaaaggggaaaaccagaggggaaaagggccgtgtcgctgggctgattaactctacaggagagcctccaactcacccaggcccgccccttctgacctactttctccggccatcgaaaaaagagagaggttacacagagatgtttcaaagcgaggtcggatagcatcttgtctgttcccaccagataagcattcccaagcctgccttcgtcactcactgcttcggaggccaaggtgctgccgtaatcaattgaaacagtagcctactattagtgctgcctccgtccccagcatagtgcagggtttcttggtctggattgaaaggctgacattcttggtaatgaataggacattttaaatcactagtctatgtcccataggcattctgcccagggacaattgatgagggcaagaagaatgataataagggaacccaagacttcattcctaccagaatgctgctggtggttatggagaaaacaatctgacgtgtgttcttattaatcctctgcctgtgcatttgggactaggatggagatgctaaaattcgagccaggcttctctggttccctttggaaactgctggatctaa

SEQ ID NO: 63617 - DNA, 1961 bp, Bovine  19866880986840
aactgaacattggaacaacagacttgttccaaatcgggagaggaatacatcaaggctgtataccgtcaccctgcttatttaacttacatgtagattacatcatgcaaaatgctgggctggatgaagctcaagctggaatcaagattgccaggagaaatatcagtaacctcagatatgcagatgacaccacccttatggcagaaagtgaagaaatgaagagcctcttgatgaaagtgaaagaggacagtgaaaaaattggcttaaaactcaacattcataaaactaatatcatggcatctggtcccatcatgtcatggcaaatagatggggaaacaatggaaaaagtgacagactttattttggggggctccaaaattactgcagatggtgactgcagccatgaaatgaaaagaagcttgctccttggaagaaaagctatgaccaactctagacagcatattaaaaagcagagacattactttgccaacaaaggtccatctaatcatagctatggttttcccagtagtcatgtatggatgtgagggttggactgtaaagaaagctgagtgccaaagaattgatgcttttgaacttttggtgttggagaagactcttgagagtcccttggactgcaaggagaccagaccagttcatcctaaaggaaatcagtcctgaatattcattggaaggactgatgttgaagctgaaactccaatactttggccacctgatgagaagagctgactcattgaaaaaaaccctgatgctgggaaagattgaaggcaggaggagaaggggatgacacaggatgagatggttagatggcatcactgacttgacggacatgagtttgagcaagctctgggagttggtgatggatggagaagcctggtgtgctgcagtccacggggtcacaaagagtcggactcgactgagtgactgaactgaactgaatgtgtcccaggtcctgaggtaaggggtgaaggttcaaatgcagtgttaataattatcatgatatagttgccatttttagaggaccactgtgtatcaggaacgtgccagacagtaagattaagaagtgaggaacgacaacagcgataataattcctgcttgtgtttacacctcatataatgtagagaggatgaccttccagtcaggaattgaatgcattttctatctcttccctggtggttcaaaggtaaaaatctgcctgtcaatgcaggagacataggtttgatctctgggttgggaagattccctggagaaggaaatggcaacaactctggtattcttgcctgggaaatcccatggatagaaaagcctggtgggctataatccatggggtcaccaaagagttggacatgacttgatgattaatagcaacgacaacaacaagcaacagcaacagcaacaacctttatttgcttgtcacttttccaggaaaaaaatcattaaaataaatatttatttcaaaagataagtactcctcaactgctataaatctaccatctctctctggggacgtcctccagccgagagcttgttgactgaaagtcagggctccccatgccaatcccggcctctgccatgtgtccacgaggcagaggcagatggttttccggtcaggtggaactgagatatattttctcaacacagtctggcagacaagcccgtctccctcaatgcatatcgcatctcctaaagaaaccatgcatattgcatgagcctccaaatgtagaaacagatactcagaaaatacaagtctcaaaataaaaccgaaacatttcaaaacaacagcagttgcaatgccaccaaatgatttagttttttttttttttttcatcaagcatcaagatcttgaaaaaaaaaaaattcccacagtccccaagcagaacctgaacatctcagatgccatggtgagggtttgagatgagttcttagtttaagtgtgggaaagcag

SEQ ID NO: 63618 - DNA, 1392 bp, Bovine  19866880993093
agtcccctgccccacctcccccctgcaacttccccaccaccacacccttctccactcccagccaggaacagcatccttattctgctgtttaagaactctcttccggactgtctgggctctttggactggagtgactgctccaatttctccccatagatgtggcttgctgtcatgagctggttattcagcccttggaatactgaacaaatgttttccatcagttattgcagtgaaatcctggccattgggaaggtaataaaatctctgacccaaggaaagaatgtttcacacatacctagcaaccagagagaactcataaaaagttcattacaaagcagccctgtccattcttgcgcatctccccatgaccattgctacaaaacttctctctagagcacatgtccctacagcttcatagggacaaaagttcccaaactgtgtgattaaaatacatttgggttaaagattctctcctcttttaaactatcatttgtccttccattttcctacctctcacttaaccctctattgaactttcttcctccccttttatttcctcttcattctaatcaagttgcaaagaagaaaagttaaaaagaaaccagttaggtcaagcagagcccaaagcagaaggagctgaactagccagtggaccgagatcacgtgatatttgagaagctgtgagttgaataactcgaatatttaaggagtatttgaagctttgaaatgtgatgtgctggacatggtaaaaataaactgaggtcagaaatgagggaagaaaaaaatcatttatgaggtgcataccccccttttaagtcttctcttacaacttggaagaaaacacagcaaagtgtacatcttttcccaatttactgtgaaacttaaaggagactgcttccccttagcaggaatgatatcaaggatgttcatcatgtataacattcatcctgaatgagagatagcctgttgaccaggtttagaaaagtctcttcaaaggaaatgccttgacagagaaatactgtggcggtattttaaattgatgtccaacaggaggagtttcagagaggaaggtttccaggaggaaataatacttgaaaatgtcattataaaaatgtaatgattaattttgtttctcctctacatggctttctaatttttgcctttttttgagaaaatgggtgaattgctgcagaccgcacaagagaaagggtcgcatctgatgatggttctagaatgagtgtatagttctagtcattattcaacccaaggtaaatatcttggatgtctgtatcaagagtatataaccaaggaatatatgacaatgagcagaaaggcactggcatctactcatttaaatctctgtaaacatcccttttctttaataaaatgatg

SEQ ID NO: 63619 - DNA, 1640 bp, Bovine  19866881100804
aatccattgcctgatggtttagtctcttggtcatgtccaactcttgcaaacctatggactgtagcctgccaggctcctttctccatgggattctccaggcaagaatactggagtgggttgccatttccttctccggggtaacttcctgacccagggatcaaacccaggtatcctgcactgcaggcagatttttttacctgactgaaccaccaaaaaaaaaaaaagcctcaagaaacttaaaaagatgagttatcaaactttcagaatttagaaagctggagttctgagatgtgagagcaatagtgatatgcatgccactgctcataaaggaggaactaaggcaaatccatcaaaaggcacgtaactcctggtccatccatgtccacactcaaccctgtgctgacgtgattaaccatggctcagagatgctaagagatgcacacaaggcctcaccaataataatgtgtgacacagccacaactggaactcacactcagatttccctaggctggaaaaatcgctctacctacaggatggtctctgtccctcggcactcacctctgcctcttgctggagtggccctgccacgacactccgtgtaattccttcagattttcaggaaaatgccatcctttcgggggaagcccactcctctccactcccccactgtgactcagagtccatggctccctgctctgtgtccttccccaagactgtgaccttcccaggggccaagaccaagcctgatcgcataggctttcctcctaacctagtgcctggaatataataaaattttaatatccatttttcatatcctctgtgaatgagggaagaaaggaaagaggaaggagggaaagaagaaagtagggaggaaggaaggctcgctctccactcctgagagaagagccagcaaaactaacagcgatgaagttaactgctcggaaaattaggtttaagaggtcacaacgaaatgacacccccctaggtaactatagcttttcaaagtaccttgaaaatcaagaagtgatccatagacagtcaaaaatagttattatttattcattcagtatttactgagttattatttattcattcagtattttcctttgcaccagggaaaattacataccatattccatttaatcaaccctcaaagccaaatttgtaattatacttatatattaattatatatttatatataaattatatattttatataattaaatatattaattatattgattatattgattaggaaactgaggctcagagaagttaagtatattacccaatgtcacacagctagccagcccagaaccaggatttgaattcaggcctctctgatttgaacagtgtgcttattccattgcattgctccattcccctcctctccccttttacttctggtatcttcccctttccttccatcttctgcttattcaaaagttaacctcggcacaatgcatttaagtacagaacacaacagaatcctcgttcttaaaaggtaaaaagcacagcaacttaattgaaacaagacaatccaaacactggcttcacttaaagtttataaattccatttcattgacttgtattttcacaaatgactgccctgtcaaagttattttatttctacaaaagt

SEQ ID NO: 63620 - DNA, 2649 bp, Bovine  19866880452784
tgtttttctccctgtggattttttaatgccttcgaagagagctgggccaaaagaatacttagagcatgttttacatacatatgttgtctctcctgtgtgacgtcttttgtgtttctctaaggaactcaaataatggaaggctttaccacactgcttacattcatagggcttctctgccctgtgaattctttcacgttttttaatactttcaggacctttaaaggcttttccacattgtttacattgatatggtttctctacattgtgactccatttatgcttttgaagatcacaggaaaaaaatgaatcctttctcacatttctgacatttgaaaggtaaatcaccagtgtgtgttaccatgtgtctttgaaaagttactttccacatgaaggcgttcccacattctttacattcataaggtttctctccagtgtgagttcttttgtgttcttggaaagagtttcaatatggaaaaacttttccacattgtaaacattcatagggtttctctccagtgtgactcctttcatgtattttaagagaattgaaattaatgaatgctctctcacactccttacatttataagggccatctccagtgtgtgttatcatgtgtttctggaggctttccttaaatctgaagactttcccacattgtatgcactcatatggttttttccactgtggattgcttcatgtatttgaagagcactggcacaagtcaatacttgagaatatattttacatacatattgtgtctctcctgtgtgaactcttttgtgtgcctttaaggaactcaagttattgaaggttttcccacactggttacattcatagggtttccctcccctatgaattctttcatgtactggaacactctcaggacttttaaaggcttttccacagtgcttaccttgactgggtttctctctattgtgtttcctttcatgacttctaagccaactgggagtaaggaatgctttctcacacttctgacatttgtaaggtaaatctccgtgtgtattaacatgtgattctggtaagttattctccacaagaaggctttcccacatttcttacattcatagggtttctcccctgtgtgagttcttttgtgttgttgcaaagagtttcgatatgaaaaaacttttccacattgtaaacattcacagcatttctctccagtgtgattcctttcatgtgatatgagagcactgggagaaaagaatgctttcccacattctttgaatttacataccttctcagcgtacttttcgatgttctcttgatttgtcttcaatgtgacatttcatgtatctagtaagggatgaaccactcatgatggtattttcatatgcactgcattcccatggttttaaatcaggagtttcccccctcattttgagagttttaataagattgaagttttctccaaaggaactaatgtctttactttcagagagtttctctatcattggcgttctgtaaataataagaacaacattctaaatacctttattattttacatttttgtatttattatgatttataggaatagtgaggctttctatcttgtgtgaattgtaacaagttgaatatacaaaatgctttcaacagaatttcaacctttctgttaaaaagtgatattgagggcttccctggtggcttagtggtaaagaatccacctgccaatgctggagacacagggtcaatcctgggtcttggaagattccatacgctgtggataaactaagctcttgtaccacaactatttagcctaaactctacggcctgagaccaaacgtaccaaagcccacactctacaataagaaatacataaatattaaaattatttaaaaaaaacccttatattcaaatgtagagtttatgaatatgaactataaacaaattacattggaaacatggaacatttcttccatatttaagaaaatattttggagagacattttcaagaataaataaatttgaagatggggctatttcttttctttgattcctataaaattttcattatacaccaaaatttggacagagacatgctgggtatcatgaatatggctcaccttaattttttcccatggtttttctcctgttcatcaatgtcatgatgatctggccgttttgccactgaaatgcagaaccagaaaaaaaatatgacccaaagtactagaaattaaagaaaaattcattggattttaggtccatgatgaattctgaccctgcccagtttgtatttttctttcttttttttttttttcctgccatgttgtgcagcttgtgggatattacttcctgaaccagggattgaacccaggccagagaggtcaaagagtcaagtcctaacttttggactgcaggagaactgccctttcttcccgcatagtttctctaccaatgtattgtctttccacactccacatctttgaacactacagacaggtaagaaacacctctaatagatcaatatagggaattttgtcattcttacctactgatgccagattcctgatgttttccaacatcatgtctctgtggagtttcttctgtgaggaatccagtaaaagccactcctctcaggtgaaattcacagccacatcctcaaaggccaagagtcctaaaacatcca

SEQ ID NO: 63621 - DNA, 1263 bp, Bovine  19866880405664
attttgtagaaaaggtacaaacttgaacttaaattaggctacctgtgctgctttgaccaagttatttaagttttgggggctttggtttccttatctgaattctacctgttttggaactgtctttgagtatacactaaacagtaacagatgtaaaatgccaagcaccaaatcatgtaaagtccactgcgttccatttactaaggctgggaattgtgtaattcgcttcccaaagacagccatcacaaagtgttgaaaaatgccttgtgcttaaagagttaacctgcaaataactagagcatgttattcgccaatcttgcagatataatactgcccacttagacctggaagtgaaggcaatgtcattcattgcaacaaccaagataaccgagaaagagcattgtctgaagagatcaacacctataggaaccaatataacaacattagaattactaacttttctttggctcatagaccaaaaaaaggaagtcaattgctccaggaaagttgactttcactgttaaatcgtttgtgtcttcttaaatgatttacatgctggtggaacacagaagtccctgaactctctctcccgtgcttcctccactttcttctctgcatgcccttcacagcacagcttcgtaaaatctctcctagtatccctggttaccagtattatatataacaaagccacacagactaaacctgacatggaaaaatcaaccttgcctaaaactaaatataagcacaatttaattaacttgcattccacagtcatagctgccaacttactgagactagaagacttgggtacacagtacccaagagctcagagggagggggaaaacatgaaagttttctccaaaatcttcatatgttcctttgtaaacagtaaacaggaataatgtctcctgtacacaagatacagtgatccagtcaatggtggagagtggggagtagtggaatgagccaaggcagaagagaatagagtttgagagaggctgaaatttcaggagagacaaacagaactagaaatgaatgacaatctgacaacaaggtcagacctaagtcaattaaagaaaggtctactttacccctaaaggaggaaagatgttgctgcagataatggaaagtcaaaaactacgtgcctgtcactttaaactctcaatactgcaaaccgagtagtggatgtagtctcctctaaaaatactccactgaccaaccttctgtgcttaaggtaatactgggggaatggtgcaacacatgcaa

SEQ ID NO: 63622 - DNA, 1670 bp, Bovine  19866880353168
aaccttgtgaatacactgagtccactccatatataattttagcttgctgaatggaaggtataacgttctacacacatataaaaatgtgctactgtgctttccatagtaaataaaggatgcaaatcagcctcaccattaagtcagagcattatcagaaagaagcctgtcgaagaaatccatatcctaattctgaaaatatcaagaaagtttgattctcttccagattagtccactaactgctgagcacaagcaggtgtagagatgagaacacctgctcgggaggcaggcctgcgttcaatcctggtgctaccacttgccagctgtatagcggaggtataaacctccttaagcctcgtctggataatgttttgctgtgaggatgaaataagataatttatgtaagatgcctgcttcctggtgccagtgagtagtcaatgaatgcttgctctcagtgtctcagtgtggatgcttactctgtggtcttagggacgcaactgacccctcccttgggcatcagctgctagatgtttaagtagcagaaagttggactctgatccctaagatcattctccattctaaagatttttaggtagtaggaagagacagctggatgtctgtgaattctggctttcaggttctagaatttatgttggcctctgacttatgcaatgaaagctcctgaggggctgaataaaaaatgttaaccgtggcacatgcattattgacaccattaaccagtcaggcagattaatgataatctgagctagagtaatttgcctgacaaggccatcgcaaatctgaggcgaatgttaaatccactacgttttaaaaagctgttgtgttaaggggctaaataaacctatacgggcaaataagcatcccagctaatcgctcagacacatggctcatgtttgttctagttgagagccagaaaacagaaaatgaaccaagatagtagaatcaaatttcaaaatcaactttttgtttctcaatttaaaaagtttctgttgaattgcagtcagcattttcatcgtctcagtaacacagtttgctttattggttgaggaaaaatctattaagaatatcacatctgcctctctgccacttttatcttatcagttccgatcagtaaacatctgcagaagtcaggaaactagacacttggatacagaattataaataagatcctgtctcaattgctggggagagaaatacacatatagtcgaacaaacacaaaaccagatgcaaggtgccaaatacttaccataatcacataatcaaagtgaaaggggcagataaaggagaaattgatgacttctgacctataagaccctggagagtttcacatggtgactgacatttcaattggaacttcaatttaacaactattccgtggggttttactctaagctaggcattgctctgggtgctgagaatagcttaatgaataaaactgataaaaacatccttgcccacataatgcatatattctggtggtaagaaacccttttcaggaaaccataattaaaaggtaataactcagtggtgaaaaataagaatgaataaggacacggggaaggttagcagtcaggtaaaacttccaagagaggataccatctctgcaaagacttaatgacagacagacatgacccatgtccaatgtttgagg

SEQ ID NO: 63623 - DNA, 1529 bp, Bovine  19866880455211
tttttttaagtcttttccagacaacaaactttctcccttataagggtatgaaatctgtagggtatggataagtttagcaccctaacctgagaattgggtataatttaataaaagagctgctttaaacagaagaggcaacacctgggaaatgagtacaaagtccctgggctaaatagttcattggcacctctagcagaggtcaagtgagggccgggttatgcaacctgaagggagcattttgttgctacctgacaagagattttggtagagagagataaccaaccggctgtgccttagaagctagggaacagggtgacaagaaaacatcctgtccttattcccattcttctctctcctgtgtgttcctcaccttgctttaaccttagaagtctgagagaaagaccgtctgttgagaccatccataaaggtcagcttcctggagcacagagcagacatggtcagatccactctgaagaggtaaagaaggaatactcagctcagtggccatcttctctctttacatgaagagttctcttaacctttgaaattgtaatgtcttccaaagccaaaaacacagtaatgtaggccatgaattggaaggcttttctgtgaaagcagttgaagtgaatgagctatgagtgaacacttgtgcagagagcatcaaatgtgtctgttaatgactgctgttgtatcttgttctattaagtgtctggtgagctgcgaagtcaagggagggtgacagacgcagggaaactgaaatggtctcccccttacagcgttcttggagaggaagggctgagccaacaactgctattctgaaaaaaacgtgcatggatctgcctctaaggaaggatttccatagagaaaaggagaaaaagtaatatgctgcagtttttcccagtactgggcttgactaattttgaagttcaattgattgctttaatcagaccatgttcttgtaggtgttaccgtaatcgaggggaataaagcactttgccattaattctacttgaagcctggcctgataaggaaaataaacttgtatgacttgatgaatattgcaggattctggaaaaccataattactgttttgggaaaagcaagcagttggatagtggctacatttgtttttttctggactttccttaaaagccctgtttttaagtaaaacatacctatacataaatgaatggaatagatgtctttgggctgaaatttccaaatttggtttcagcagttaagctgcagttaaaatattgggaaaggtacattgttttcaactgtttcctagttatagaaatagaaatattttctttttatatgcaccttaatgtttcagcatataaattcatctaaatggcttttcagctcaaaatctctatttattgaaagcatacatttgaaaatatccttttggtaaaataaacacaattaaatgttaaggatctatcctgagtatacatttataataatgggcttttaaaaaagattaatctaaaattagatattcttagtcaaaataggttaag

SEQ ID NO: 63624 - DNA, 1127 bp, Bovine  19866880466248
tgcctggaaaattccatgggcaaaggagcctggtgggctgtagtccatggagtcacaaagagtccaacatgattgaagtgactgagcacaagcaagaacaaaatgctgcagactggctgccttgcaaaaagaaatataatttttacagttctggaggttggaaatctgaaatcagagttccaacacagtcttaagttttgctaagaagattcttccaggtttcagactatgggcattctgtgtcctcacatggtcaaagtgaactagggagttctagacatggggtaggaggggggtctctttaataagggcgctaacaccattcgtgagggctccaccatcatgacctaagtacctcccaaataccttacttcataatggcatcatactgagcattagggttttgacatatgaatttgggggatgcaaacgttcagaccacagcaattccctgcaatgccctgcatgttccagctcctgctttcctttccagtctcaaccctcacaggatttcctctcgctcttggttctccaggcccacaaccttctttcatgttccctgaatatacaaggattcctcccatcccgttgtcttgttcctgagcctggaaagcatttgcctccaaaccctttaaactcatgcctgtttctcccagtgaatgctctgtttcctcacagcagaattgttggctgttgttgttctgctcacttttgcatcaccagtaactggtctatagagtgaatgtcagtttgataggacgttcctatttatttatgttctaaataggtaatgtgctcccttattgaattaaaatccaacaatgtttcattctcattgatgggctcatatttggaagtgcctgggtgagtaaattggttaaagttaggcagtccataaactgccacaaatggaaaccccattagcaaattgccctgtctgtgctgatagcagcgacaagtttggggtgcatttcacagagttaaatgcttttagtgcaaattgagttaccagtttctcaaagcctctagcatatgccattaattaaaacattaattcaccctctggatttaagtgagataaaattaggcttgaaataatagaaatgccataataacagcatttttgt

SEQ ID NO: 63625 - DNA, 2346 bp, Bovine  19866880476624
attgacagtaacagttagtagatgtatggggaaaataaaacatgccgtcattatcaggaagacagggaaataagaactaaaatacacctgttgaccccagccagatatactgaattataacattactggtatagatttgggttttaataaacaattctgtatatgactgctttacattgacctagactgtaatagagctgcatgtctggaaaattctgctgaaagactgtaaacaaagggaaaagataaatagcaacctatctagttgtgggcagacgcatgtggtgaggctgggcttcctccagcatcttgcttagtgagaactacaaagagggtaggtagtcacaggagaacatttagagatggaaactgagatgggtataagcctgaagcctgtggcaggatggcattagtgatttcacaggcacctggccttcagggagaatcactgggcatttagggtcaaggctcagaaggatacagtttttccctccggatagatgtcaccccaaaatgtaaacaattcagtaagaattcagagagagtggaaaggccatggcactaggagtatatagacctgagttagaaatgaacttgactacttaagagacactcttaagcaattttggtcacttttctcagttctatccttgtctgttttaaaatctggaaatgtgaatgatattatcttcatttaaaatatatgttgaaattggtatagccactatggagaacatgacggttccttaaaaactaagagtagagttactgtatgatccagcaatcctctccggggcatatattcagcaagagccccactgcaaaaagacatgtgcaccccggcgtccatggcagcactgtttatgataaccaagacatggcagcaacctacgtttcccatcagcagacaaatggataaggaagatgcattgtgtctacccccccccccccacacacacacacaaacatacagtggaatattattcagccattaaaagaatgaaataatgccatttgaagcaatgtgaagggaccctagcggttatcatactaagtgacgtaaatcagaggaatacaattaacatatgatatcacttagacacagaatctaaaaaaaatgataaaagtggacttacttacaaaaccaaaacagactcacagatatggattaaaaacttatggtatcaaaggggaaagaaagggaggaggatttaaattaggaatttgggataacgtacacatactattatttaaattaaaaacacttgctccttggaagaaagggttacgaccaacctagacatcatattaaaaaagcagagacattactttgccaacaaaggtctgtctagtcaaggttatggtttttccagtagtcatgtatagatgtgagagttggactataaagaaagctgagcgccaaagaattgatgcttttaaactgtggtgttagagaagactcttgagagtcccttggactgcaaggagatccaaccagtccattctaaaggagatcagtcctgaatattcattggaaggactgatgctgaagctgaaactccaatactttggccacttgatgagaagaattgactcattggaaaagaccatgatgctgggaaagactgaagacaggagaaggtggcaacagaggatgagctggttggatggcatcaccaactagatggacatgcgtttgagcaagctacgggagttggtaatggatagggcatgctgcagtccatgaggtcgaaaagagtcggatacaactgagtgactgaactgaactgaatgagtcttgttttcagcctcagacttctgaacacttgactgctatggaaattatgaaactgaagcctattttgattctacaaagtaaaattgattaaaaaaaaaaaaaagccagactaaagaatggtatgaacagatccttgcatttgtacaaggtacaatagcatagaaagagctcctattattccaatttctgctcagctaaaacacaatattgaagttgtctgcgaatacatagtaaagaaatttccagtgcccccaagagacttcacttaagaaccccaacttactgttattagatcctttgatgtcaacaaatctggatgtgaagttgatgaccttaaggagaatgtagctggtggtagtgttctaaaaggagtattaaatgtgggtcaggagatggaagtcagacccagtgttgtttccaaagatactgaaggaaaattcatgttttcatcactttttgcagagcataacgatcttcagtatgctgctctgtgtgtgtgctgagccgcttccgttgtgcctgactcgttgcaaccctgtgactgtagc

SEQ ID NO: 63626 - DNA, 830 bp, Bovine  19866880489927
caactcttgctgtccgactcacaattgacccagcgtcccctaaagacgcctcgcattggtaaagtccctcgtccggcttatggtgcctggagtgaagtatgttttgtatcaacagagacccatttggaagttgctgcttccgttcgtccattcccaaggcgaggtggatgccgtctttcttccacttgatgacggggactccccggtcagactccgcggagcagttcaggaggacgttccctccgcgcatagtgacggcatccgagggctccgacaggaagcgcagggatgtgaaagacttgatctggaaagctggaacgtcaaagcacagagaaatacgttcacttcttgtaaaagatctcacgaggcaagccctggccttcacaaaacttttcccaaacaatctgggtctttgaaaaacgtgcaagaaaaagtgaaacttaaaaacaaagggggacttgcttcttgatccagtgactaaaccttcactttccaatgcagggggcgcaagttcactctctctcggggaactaagatcccacatgccttgcggccaaaaaaccgaaacgtaaaacaaaagcaatattgtaacaaattcaataaagacttaaaaaagtaaataaaagcaaggatgttgtattaaagaaggggaaaagtgtccaactgagataaccacagctaaagaaactattggtcccaaaagtaataataagaaaaattaagaatttacagaaatctaggcaaggctatcatcacataccaatccatacttgaaaatttagaagagatcaataaaatttccaaattcaaactaggtatcttaaagcagt

SEQ ID NO: 63627 - DNA, 3335 bp, Bovine  19866880518749
agtttcccagatggtgctggtgataaagaatctgcctgccaatgcaagagatgcaggttcgatccctgggttgggaagatcccctggaagagggcatggcaaccctctcccagtatccttgtctggagattcctatgtacagaggagtctggcgagctacagtgcatagcatcgcaaagagttggatacaactgaagtgacttaggatgcatgtcagttatttcttaaataattgaaaaaaattggaaacaaacaaatatgataaaagataattaattaaaagttacctttttatgctgaaagccagcatgccaaagaaatatctattatattattacattttctgtcatcaacacaaagcagacatatttaacttgactttttttccattatactccttttggaattttgtattggtttcatatatatgggctctattcacaatataataaaacactttaaccattgtatctaagggataaaaattaaaaagcattttattgcatgaactgcatgcatactatctactaccaagtttaagtatttcctttcaggaactagtgttcttattaaaagaaattttgatatggcaagacagaaaatctcaaacaaaattaattttttttaaggacacagagtagcaacatgaaaaaaaatgtcttgcatcatgattactagaagaaaactctacatgcttacaagtataaaaatcactgctcaatctaaggatagttgtatgtttatacagtaaaataaaaggcctgagattatagtgactacttcataatgaccttcatataagttctttctgttttagagcacagcatttttttttttttttttttttggaggatgaatgatttcaagagcctctattatttagcaattgaaaataattcagatgttccatagttgatatataaacatgtacatttaaggtattatatgtgttattgtcgctaagtcatgtccaactctttgccactccgtgaactgcagcccactaggctcctctgtccatggaatttcccaggcaggactactggagtgagttgccatttccttctcaggggatctttttaacccagggatcaaacttatgtctactgcttggcagacagattccttaccatctgagccaccagggaagccttttaagaaggatacttggtttttaaatcccttaccaccttatgcccatatatctgtctgaaaccttaacaaaacatgatggcaaacaactgacaaattagaaagatgtatctgagttgacatttttacccatttacttggacaaactaaagaagagacttagaataactagatagcccatttctcagttctcctaggaaaaaatactctaataaacagtagacatttggatgctggtgattgagctgttcaaaagctagatttggtagcagctaatctgaaagtttgccaagaacatgcaaataagcattcagcctaagcctacatgacagctctttcacgacagagtagaagttggaaggaaggcaagaggaaaatgagccagtcttcgcctatccaggtttttaggacttcatgtctaaatcagatttaactccaaatgagcaattgaaaggaaactggtcattcattttgtgcgagcatgaaatgtaactagataatgtttcacaaatgattcatctttatctatagacaagtgccaaactaatttcatgcttacaatgtatgccaactagagatctcacagagggtttaagataacttaagacatccaaatgtattaagcagcagagagatgagttatctcaggatttataggctcatattgatcaccatcctgtggattatttaatgaacttcatatcccatttggtactatttactctaagtgccctgaactcatccatgagatatttaagagtaagaacaaattcaagatatgttatatgtcacaatagtccataagggttatttctaatatcatgatatgaatatttaagtttatctaccctaagtatatcgtattcaattaatagacaattagatttttatgctgtctggtgctgtgcttagtcgctcagtcgtatcccattctttgcaaccccatggactatagcccaccagactcctctgtccatgaggattcaccaggcaagtatactgcagtgggttgccatgtactcctccagggaatcttcccaacccagggatcgaacccacgtctcccgcactgcaggcagattctttatcatctgagccatgaaggaagcccatggtcttacagtaaactaagttttggatgtcttaagtatgttttaaatgattcagacattgatgttgcctatctttatcaacaattaatattgcataggcacgaatcttgtatgtatgtcacatgacagatagtctaaggtaaataaattactcatcataagagatttgaagccacagtgaatcacatctacactaaagataaaatgctctctgatttaagattttctgtttccaaagctacttcaaaatataaggcctctgttcatcagaatgtaatgtctgacagacagaaaggctcccttattgtcctgaagctgaggaaactctcagtggtctatgagagttgcaaattgtgcattagtcagtcgttaagagcatcactggagaaggcaatggcaacccaccccagtactcttgcctggaaaatcccaatggacggaggagcctcgtacgctgcagtccatggggtcgctaggagtcggacacgactgagcgacttcactttcacttttcactttcatgcattggaaaaggaaatggcaacccactccagtgttgttgcctggagaatcccagggatgggggagctggtgggctgccgtctatggggttgcacagagtcggacacgactgaaggacttagcagcagcagcagcaggctctttaatgtaacaaaagtagtcagtacctcaatagttagtcagtagtcagtagtagcaacagttcttcataaatgcaacaaaggaaagcctgtagcatttcataaagctaaatctttaggattatgaaaaagcctgtagcatttcataagaaaaacctaattctaatcttgatactgtgactgttgaaatgaaaattttctagattaaacaccagatgcattccttttacatcactgttttcattttcaagtgtctttgtcattatttggtagctttactgatgatttagtttaaaaatgtgaaaatcatatttccttttcattcaaaatatcgatgggaacaaagttttgagaaaagaactgccgaggaccagccccggctgatccagggtattcgaaggggagacgg

SEQ ID NO: 63628 - DNA, 984 bp, Bovine  19866880544613
ctcctgcattgtaggcggattcttttccagctgagctcccaggtagctcagctggtaaagaatttacctgccgatgcaaggaggttcaggagatgcaggttcgatctctgggtcaggaagatcccctaaaggaggaaatggcaaccaactccagtattcttgcctggagaatcccatggacagaggagcctggtgagctacagtccatgaggtcacaaagagtcagacatgactgagcatgcacacacacacacacacacgtttcagacaacagatgcttgaattaaattaactctgcataggacatacttacagtaaaacattatttgttatttgttcaaatttcaaacttaactgggcatcctgttaattttaccccccatgaaactaacttccttgaggccatagcataagtggggaaatagtacatggattcatactatcccttctctgttctgacataggtgcagagaagagtgaattcttagaaaggtaccgtgattgaatcagaaaaagtgattttagcgtcaggacacttgctgacctagtccaacatcaccaaatatccacgtagaaaggttgttgaactcgatttgttcttaacacagtgatccttcttttttttccttcttccctttacaagtctgggagcaaaattcagatatataaatacagaatgtgaagttcaagaagcaactaagccggcagaaatctcttagtgatcccacacagaggctccccatcagacattctgagcacatggcctcttccctaaagcggtggaggctttgccaagagatctgagggcttccacagggcaaggagtgtgtgccccgggcaactgactgagtgtcctctggctaaatctaacggtaaagaaaaatgataagggccaagtgagagtgaagaggatctctctcagccctttgctgcttcaggagctaaatctctaaaccacagcctgatttttctgtgtgatactgg

SEQ ID NO: 63629 - DNA, 993 bp, Bovine  19866880554612
tatgtgagtgttctagcatcgagcatttgttaaacatccactgatcgcagttaaccttactatttataatcataagctaaactgcagctcattggaaatgagccctcttgctagaattactcatttgcaaattagtcaaccacattcctctctgacataaaaaaggctgagaaaacagtgggtgattgctcaggaaatttatgagaccaacatgagtatctttcacattccacaaaagaaatacaacaaatcctttgctgacaaagctgtagtcattacagagtttatattccagtttacagagggagagcctctctcaagcagatggattgttttatcataggaactttcttgcaggaaaatcacttaggagaaaaacttcaaatagatctggatagaatcctgtctccaacagctagaagctgtttgaccttggcaaagataattgatccttttgagtatcaatttggtttaccttttgtaaaaacttctttttattttgtttacatctgtgtgagtacagttgctttacggagttacgttagtttttgctgtacagcaaagtggatcagccacacatatacatgcatgttctctttttggcatttccttcccatttcggtcaccacattataaaatcgattctcattagtatctgttttatacataatagtgtataaatgtccatctcagtctcccaattcatcccatcctccttttccctccttggcgtccatgtgtttgttctctacatctgtgtgtctgttcttccccggagatgggctcatctgtgctgttttcctacattccacatatatgtgttcatatatggtacttttctctttaggtctcacttcactctatgtcagtctctaggtccattcacatcttttttatcattcagcaaagagtcttgaagtgcttactgtctatcaggaactgtcgtaggcactgagaacgaaagtcactcagtagtgtctgagtctttgcgac

SEQ ID NO: 63630 - DNA, 1001 bp, Bovine  19866880595919
aagatgcaacattctacacatctcaacagggccaataaaactctctactgacatgtcttacttccttaggtcaagaatttaatgaggagatggtgggggagaaatatctgagaagctgttctgccttcattgacggaggaaagacatttacccagtatttagatggctctgtacctgtgtgcagtcattctatgcccttgtttcaattaaattaagggctgcatcatataaccacaataatagcaaagagattttacagttaggatttttgctttgaaacctttggaccactgaactggtttatggagcagatatgtgaccttaaaatatatagcctctccccagatttgctcaattcagaactgtagcaaagaggctttctctcttacatggagggctcaagcccgtagctgtctagacaagtctctccagactgattttcgaggcccattgcacctttggaaggaatccaggtttctcttccaccctctccttcctctcaaaataattctctggcttgaccatgcccaagattaagtttcctttctgtctttcctttaagaatttttattaacagcaaagcatgacaggttcacagtaaatgtcaaattagtctaccaggccataatgataaagcaacagtcccctgacacagccctactcaaataaaagttatagctttcaggggtgaccacactcaactcttattgatctttctgttattctaaataatcttcttattaaagtaggaaagttaagaaataagaaaatatccactttttggcttccgaaatgttgtcctcgcctatatatgctgttctttgctgcccttgagggtcatccaatctgtgtaccccattccatcacattagcatgagggagcagagctatacttgggtgtttcattcacaatgtttctagaagcccttagaaatcagtggagggaatatcagtggagggtaatcctgcaagcaggccaggccaggaggcatatattccag

SEQ ID NO: 63631 - DNA, 776 bp, Bovine  19866880607925
ccattgagttgtatgctgtgacaggcatactttccaaatccgtgtttcatgccaataaaatatttatgcaaagaaaagtgctcaccaagtcttagctgacttgatttaatttgactgggttgctggtcacaagtatgaaaattgactccattcttcagttgccgcagggattagggcagagataattgaataaaattatgtcactgagtaatatttctattatttctttcttgcaaaaattgaattaggtttaaggaagctggggcaagattttgtcagcatttaaaccacagtgttgccactttttgaagctgcttcttggaagctatagaggcacattgaagcttcagcaatcaactaatccgtgttaggcctcacatctgctgtgggttacaggacacatagacagattcccttaaagattctgcctccgtgaaacattgtgggagagtcagtttcttaacagagacgagggaatcatctggaagggatgctctgcagagggcattggtgttagggggagattgaacacaataacttatcataacttctttaaaatcctttgattctatttctggagctgctctatggatgtgtaaatgatggccaaatatgaattcttatccctgtgtcagcttcttgttcagtaattttatgaaaagaagtcacacaggttgcagaataaagctattgctcttaggacactgtgttagttttctaacgctgccataacaaatgatcctaaattgagtgacttaaaatgacacaaatttatt

SEQ ID NO: 63632 - DNA, 1903 bp, Bovine  19866880635326
aattgactttaggagatggaattgcattgagcttgagtattctggcaacaatagaaagaatttctccaagtcctacttggtgcttgtggagattcaaactcaaagggagagcaaaaggtaaaacaagaaaaaaaatcacaaaagctctatgaaaaagaatacccacttttaaaaattagtggctgggtgtacttggttaaacgttcatttaatatctgagtaaggaaagtggtgctcaggagagaacaaacatggagactcctgaatatctcatagcattcagatttaagtagggaaagactgttgacttgagctcaaaaagtagctatgaaagacgattttagtgctagctgataaaaatttaggatttcaaccctacatgtgtatagagtcaccacattggcagtgtagaacagttgaaagtgtatcaggaaatgttctcatgctgatattgtgagtagaaccagctagctctattctctgtctctccataggtcatttattatttcaggcttcagttttccaactgcaaaaagaagttgcaagtgtctatcagaatcacctagttcagttcagttcagtcgctcagtagtgtccgactctttgtgaccccatgaactgcaacacagcaggcctccctgttcatcaccaactcctggagtttactcaaactcatgtccagttgagtcagtgatgccatccaaccatctcatcctctgtcatccccttctcttcctgtcctcaatctttcccaggatcagggtcttttccaatgagtcagttcttcgaatcacatggcaaaagtattggagtttcagcttcagcatcagtcctttcaatgaatatccaagactgatttcctttaggatggactggttggatctccttgcagtccaagggactctcaggactcttctccaacactacagttcagaagcatcaattcttcagtgctcagccttctttatagtccaactctcacatccgtatgtgactaatggaaaaaccatagctttgactagacaaacctttgttggcaaagtaatgtctctgcttttgaatatgttctctaggttggtcatagcttttcttccaaggagcaagtgtcttttaatttcatggctgcagtcaccatctgcagtgattttggagctcaaaaaaataaagtctgtcactgtttccattgtttctccatctatttgccatgaagtgatgggaccagatgccatgatcttagttttttgaatgctgaaatttaagccaactttttcactctctactttcactttcatcaagaggctctttagttctttgctttctgccataagggtggtgtcatcaagggaacatttcatgcaaagatgggcacagtaaaggacagaaatggtatggacctaacagaagcagaagataataagaagaggtggcaagattacatagaactataccaaaaaaaaaaaaaaaaatgacccagataagcatgatggtgtgatcactcacctagagccagtcatcctggaatgtgaagtcaagtgggcctgaggaatcatcactacaaacaaagctcctggacgtgatggaattcccgttgagctatttcaaatcctaaaagatgatgttgtgaaagtgctgcactcaatacgccagaaaatttgaaaaactcaacagcgaccacaggactgcaaaagatcagttttcattccaatcccaaagaaaggcaatgtcaaagcatgctcaaactaccacacaattgcactcttctcactagtaatgctcaaaattctccaagccagacttcaacagtatgtgaactgtgaacttccagttagttggtcaagctggatttagaaaaggcagaggaccagagatcaaattgccaacatctgctgaatgatcaaaaaag

SEQ ID NO: 63633 - DNA, 4500 bp, Bovine  19866880636196
cagcacatcaatccttgctctacgtgggaccctccttagcatggggccttgtgcagcttccttgtcacgtgccagcaaaggtggtcccgcttccaggtttctcttctaaagaatgttttgttgctctttgggtttaaatcactagataatgctgatttccacttcatagtgttaatggtcacatatgatttgagacatcaattttcccattgactctctctttatagatcatacatatatatagataatcaatgactttttttttcttttttttaattaattttattttatttttaaactttacataattgtattagttttgccaaatatcaaaatgaatccatcacaggtatacatgtgctccccatcctgataatcaatgacttttataaatatttggtatttttaatcaataaactgaataaaaacaaattaggtctatatatatatatatatatatatatatacatacatatatacatatatgtttaaatggtatatgccatattgtgtacacagactgatagttgaaaaacccataaaaattctctaaaaagatcttgttcagttttttcatggtagaacttaaactttaaaagcatgttcattttcagaagatccaatttctatggattgtctgaatcctttgcttcctaatccgactattatccccggaattgtttttgtgtacttttctgggctgactggctatgattacattacattgctgataaaaattctacagtcagcctcatttctaagactgagcaatgttctttatcttctatcaataccatttttcctaagtatccagcttgaaaatcaatttccagaatttgtttttaaaggccaacctttccaagtcaagagagaagaaagtcttccacttggaaactgactaatagtaatacctcatttcattaaaaaaaaataataaagtactcatgatacaatgtgtttggtataattaataataaaaaaatcagtctgtgattatttgtattacacacatatggcattagcttttataaagcgcaagcaatggtataattcaactgacaagtatagttaatgaatatccactgtgtttctaacactgttcacagtgactgagacacattaagaaagcatagctatgtaatgagtaatagcacttaaagttccaagaagcttcttaaggaagcaaatgttttaaatatgtaacaataataaaataggtaaggaaacttgcaagaatttgttcaatgaaatgtaagaactctgaatcgtagatttgcttatgagccccttacctgtgatggcctctggcatacgctcagcctctgtgtgtggtaccaaattgaatcttggagataagagttttgggtgagttaggaaagaatagctttattgctttgccagtcaaagggggacacagtgggctcctaccctcaaaaactacgtgtccccacccaggggagtttgctgaggagttttatgttcaagagtatagttgcttgccttcctttttatctcttctcttgatataatctttatgagctggttcctttagtctggtctcaagtggtctttgggcttcccaggtggcgctactggaaaagaactcgcctgccaatgcaggagatgccagttctatctctgagtcaggaagatcccctgcagcaggagggcatggcagtccactccagtattcttgcctggagaatcccatggacagaggagcctggcgggctacaatccatggggtggcaaagagctggacatgactgaagagacttagcacacacacatgcatgagtggtcttctccagttgaagaatgctgccatcttccatttgctgggttgtaattccataaagaacttagaggcattgttgcatgtagcccttgaggcagacccaggcccctgccccaaagctgcagtgttgtttcttagcccttccttccttgtctttgcatccctttccttcctggattagcaactgttcgaatctgctttttggaactccaggaaggtcatggaggctgcgatctgttccctacagggaacggggttgggggtggaatggaaaggatgggaaggcttctgtgtccatcatgtccaggagtcccacaggatcctgcttgctttcacatactatctaggcagtttttatgcctaaatcatcttgtcctcctcctcaaataagtgctttattacaaagacagccaccttgatcctttatatatcatccattcttcctccttcagaaagtagtctgagaatttttatagaaaaccacactgggcactggtctcagtaagcatttacttaaaatttaagcataaatgatactaaggcataaaataaaattaaaaactcgaatgaataaaatctgttgcttgttggtattatcatagcatgcaagttatgttttctccagaaaatgaaagtggaaaattatcctgtttttgacacatgaaggtgtcttaatttcttcactaagggtagtgatagtggccttagaatgctaaccacatgttggcctttaatgacaacaattgttttattaaatcacctctctttttacactatatggagtaagaattatttccttcgcagaccattgtttattggagggtgacctgattgtgtttcattgaggacttttcttgaataattaatctcttactgagcagctaggtagacaggagtagttcaggctagatacacagtacttttagaatagctttttacatgtgcaaaacagccacctccttcagttcatttagattaagagtcttgtggcgctcacttgctgcctttattacagatattaggatgaataaataatgttatcataactaataggtaggacatgtgtattttatcttctgtgttaacacaaaaatgccactttggcaatttaaaactatttctagggtaaggagcacttcatcttccccaagcctgttcaatgaaacaccgatttctgagtaagatccagcatcttagagatcccgtacttcgttgcccccttccctcctctcctgtgctgtttcttctctccctccctttcctcccctgtctttctcctcctctttctcttctctctcagcttcttataagctcatctttctatgtttttagagaaagttcaaaggctgagtttattacttggttagaatttcagaatctagaggcagaggcaggggggatgttttcatttttctctccctgacaaaatgatcttatcttttgaaaatgggtcccgtctgggtatgcaattgcttgctcattttatcacggtttttccaaatgtgatgtagtaattgtacactaaaatgacatagcttttatacaaattgaatttcaagtttttcatattatttgaaaatataaactctattatgaaaaccatattctcaaggaatcaaccctgatagaaaatatgtctgaaatatgaatcagccagcaagtgtttctgaaagtgcatacatactgcagtaatcatttaaagagatcaccagcccaagatccagtttatgaaataatcacccagaatacaaaggcttgatttataggcaggtttgtgtctcctgattctatcttccttgggctaactccttgctccttccctctgcctttatagtatgtaatttctccactgtattatcagccggatttaagtccctgcctgcttaagacttgtctaatcttttcatgccacatgtggaggatttttgaattattatttggggtcctttaagatgccgttaaggcagtttaatcttgaaggatattaaaatggaccacatactgtctggaggctcgagttagagtggggagcctatttgctagaccacaacccaattatccacaaaacccttttatagttaagtgttgtaagtaatattcttagtccattatattctttacactgaaaaggcgagtgaaagcaaccaccaaattgagtgactttaagatatattatctagaggaatagatatatttgccttttttgtccatccctggacatctttttttttctttctttctttatttttattctataaagactcttcttgtatagttgttacggaacttgaaaagtctctgaatattatgtctccaaatattactgcctatttcttaggagaattgtcttaatctttctttcttaagatttttttttttgtcatgtggatcattttaaaagtctttatggaatttgttacaattcactgcttctgtttcatgttttgatattttggtcatgaagcctgtgggatcttagcctgaacctcagatcaaacccgcactccctgcattggaaggtaaaatcttaacccccagaccaccaggagcatcccaagtttcttaatcctcgaaacctcattgtcctcaatcataagttggagatattatttactcctcttctttattctgaaagctcagcctctttggacacgggtgccaaaccaaacctggagataaagagttttggtaagtagaaacga

SEQ ID NO: 63634 - DNA, 821 bp, Bovine  19866880703815
ctgtaatttccccatgcttttagctgtggccatgctaaactgttagttgctgatgtcagcaccaactggaaaggtttcctgaacatatttatctgtgtcaaagcactgaacccaccactattaagcaaaagggcatagagttgtgagtcattgaatgtgatggagcaaggttctcgcctatgatcccagctctcatgcgtcattctgccgttattcttcatggtcaaagccagtggagttaatagtgtctaagtggttgcagtcctttctaccatgattcacatgtcatttttcacagtcattttgcagactgacagggaagtgggatagcttttgtttcacagtccccttcacaaagacccattgcatttttaatcactgggtttcaatttatttacagctataggccagtgtgatgaacccctagtcatgtctttccagttatgaccaggaagtattccaataaacattggccttttatccctatcagagacatttctattaaagagtaaccagcatttagatgctaatgattgaatgaagcaatcattctctttacatccaaatttaaaaatccagaagcgtgacagtatatcatgcactgtagaaatagaaatgtatatactatatttcaataaaattaattctgaatgcttccagtgcctgacacgacttctcactatcagataaaaataaacagtttccaaaaaagagtacaagtgtgaacatctgtgtcatctttaaaacagtgatagattggagaccatgcatcccaggttgctttcaacgattctagtttataagtgtggtcctgacataaa

SEQ ID NO: 63635 - DNA, 1390 bp, Bovine  19866880705384
atgaaaggaaatccgaatatggactttattaataataaagtatcaatagcagttcatatgctgcgataaatgtacacactaatgtaagatgttaaggtgggtaactagttgcaagttacatgggggatactctgtgcttactttattattattatataaatctaaagctattctaaaacaaaaaaggttatttttaaaaagtggataataaaaataacctagaatagaagacacgtatgtagaagttaagggcaaagacttctgtgtttttgtgactaaaatttttctcctttccaattcaggaataatcctgctgtgtatagtatgaaacaaggtcaaagaaaagagtgttatgaaattgttgaacggagagagaaggtggtcagtggtaaaagtaccagaactgcacaccagtgatggaggtcacgacagaacaggcataatggagacttagcagacatgttctcttagttgaaatgtcagctctgttggggacgatctatgtaggagagctcagaacagaaaaaaaataaaagtgggaagatggcatcatccttctgaaatattagttagtagcaatgtacttcagctggtcaatgaaatggataggagaggatacagaaaaggaagaagaacagggaaaatctgattgaagttctaccatccattatactattgatatgattatctttgaggaaatgcctaaactttggctcataaagttgtactatcaaaaatacaggctttaacaggtgataagttctcccttttccaagacaatgatctagttcaagagggaggaagatgttctagctacatttttaatagtagaactactaatgtttataggctcactttcaataatgaatgagctattcacattcataaagtaatgaattagaagagtttctgaaagatcatagagtctcccgtcacatcaccaaccctcatatctccactacacactcacactgtgtcatggtaggaatcgttgctcagtcgtgtccggctctttgagaccccacagacccctccaggctcctctgtccatggcattttccaggcaagaatactggagtgaattgccattcccttctccagaggatcttcctgacccaggaatcaaactgtggtctcctgcattgcaggagaactcttaaccgtttgagctacatggaagacctagtgcatattaatattcctaacagaagagctactgaaagagattcagcacgctgctttgctgacctagcctggcactcagctatcctggtaggtggtgtattctattccaaatgcttaagcgttcacatacagtctttatcttcatcttactatactaagttatgtactttggagccttgggaattttggttttgatgtgtagggt

SEQ ID NO: 63636 - DNA, 2744 bp, Bovine  19866880705740
tgggtcaaatctggtccaggttctatttttgttgggcatcactgaactaacaatgctttttgtacttttgaagagttgtaagcaaatatagatgaatatgtggcagagactagttggactgcaaagctgtatggactgtcttggtctcttacagaaaagttggccaaaccctggtacacactaaaaattgtggcagtttgcgttccaagttttcaaaactattcctctctcctactttgatctggactttctcttcctttcatgtctgttgtttgacctactcataaattttaaatatattttcaatagtttgtcctcaaggtgaaccctgtcccagaaaggagagtttgtaggttagtttcaagggtttatatttaccattctcaaactggtctattgtactttctgttaatagcattacctggtagttattttagaattactctgttttcaggattgatgtttccctccaatttctctcccacagatactaataacgtgtgggttctaagggccttgggggtttgtccacatccattggtgttttaggatgtgaacatacagaccccatcacctcattttgtcataaaagtctgaatgcctttgtttctccatctagtttttctgtctctttttacctggagattcaagaagatcaaaaactatatttccaccactgctgcccttttcccagaatcaagctcactcatttttcaactgtttgcttaattgactatattcaatttgatttcaggaaaatgtttatcctgagtatttcagcacattaaataaacccacacgtacattttttttttctctgttttcctccagagtcaagttcccattatgtcatctccctaaaagcttttaacaatgcaggagaaggagttcctctttatgaaagtgctaccacccgatctatcacaggtaagctgaaatagttcatctttttttcacaaggcatttgagttgtgaaaacaacaaaccaaaatgaaacaaaacaaataatgaagaaaaaaatgtatgaagtcatgtccgaggcttatgtgtatatatacatgcacaatttattatttggggggttatcaaaattgtgagaggaattcagtctgtaaattagtacttggacataaagaatgtagatcccttattctctttatttgtttccagtagcttcatattttggtgtcttgacaccattgttcattcctttgggcaacttatttccaaatcagttcaatgtaggcaggagggtctctgcagaaggccaccaggtgcctgaatggacactagcttcattgcagagggtccttcaaggtggtattaacaagcatcaactgccctcatggggctggtttggactaggctgagtcatacaggagcttctttctgagctgggccaaagggtcaccccaacagtgcccaaggcctgtaggcactgaaagacttggttgcttcaagggcttatcacttctggaatttgttatgtgagttggaccttagaggaggcaaaggaggaaaacagggctcaaggaaatgagaaagagaaaagggtgggttagaaagtgagatcccgggtcatttatggagactatttgtgaataaggctggacctactcagaaacagaataagtaccataagtacccctgtgaggcttgctcatgacccagcacatgactcaagtcacgtgaccactcctaatagccttatgtctgaaatgtgaaagcaaaacccaggatcctactctatctttttaatgtatactttgatcctttcaaaacccacaatcctcaaagttcattcaacttatcagctgttttcaccttaatgacaacaaaggatctgatgcaaaggagcaggatttagtaggagcaccatggaaaatcactggggtgcctgagtatgagtcctggcagctaggaataaatgaacctccaggaaatgatgtggtcctgtgacttctgctaccacctaaatttatgtgaactttgtacagtttgttttccaaatcttgaagtttcattcagaaactgtcttgagaatatacagttgtaaaccagattttgcagttgtcatgtgatggttttcacagcataccatccctttattgatgtccaccaaatttccttttaaccctttgatattatcccagagtctccttgaatctttggctgttggatttaacatctgtgctcggtctgaagtggtatgcaaaagcttgggtgcatgtcagtatattaatttatccatggagacagtatatatcttgcattgcattatcagagggactctgactcccaaaaaaagggtaaataagaaatattacccagagaacatttactgtcaaaagtgttgtgtctaagtatagagatatgaggcaaatagaggccaggatagaaaccatgagataacatggtgaagggtgtctgggatttttacttcctcttattctcttattctgccaaaattcctttgagtgatagcaaccactttggctgagccagcgcttcccataatgtttattcattaagtccgctctttcctgccttgggtaaaagacagttaaaaaagtcctcactatgaatttgagctcatgatcaggccaaacaaaattgtaccatgatccgtctttaagaactcataattttttaccaaaactaaagaccacaaggaaggaacacaaagatgacctccaaaatccattttttgagcagaaactagttaaaatagagatagagttcag

SEQ ID NO: 63637 - DNA, 1321 bp, Bovine  19866880725092
aagagggcacaagcaaaaaggataaaaggcaaataaaattctaaaaaaaaaatattaagagctaagtttctgattttatgacactctcacacaatttgttgagtggcattgttctttaatttagttgtgagaacgtaattagaatacacttattaagtaaatccagtttatttttaaatcctcaaaacctgtttgcaaagtcagttttactttagaagaaataagcatgagggtgattagttcaactcaaaggctgaggacaaagatacaaactctccttcctgccccttaattcactatatacaaggaccaaactatgtaacatcatacctttagaatttttagacctaaatttaagtataattttaaatacttatatttattgttaataataagttatgctattaataacacatattatatattctctttatatgtattatcttattactaaaagaatgagacattgtttggaattttccccagttttcagcatagaggtatatatgaacttcacaatcgcaagacactggtcaaaagatgcttacttggtatcacacacagcttctgttcaatttcacctttcctaaaccatagggcttaataggtttcctggcagcagacgctaaacactttaaagaggcatttaatgtgaagcatttgtttacctgtggattcattattaatgaaaagccaagcgatgcacagttcaaatcaggcagacattaagtggatcagtcacctgcattattaaaatgtaccccaggggaatagggattattctccacattcaattattcctaaggaaaagagccccccgccccgcacctataccactctcaaaaagaaagcttgctcttcccgttgacctttctaaatgctcacaagtcttggtctgccaaggcttcaagcccccggggagttggaggtggtgcagaggcagccactatggagcgggcccagtcccccttccctcccctttaaaagaaagccccatgggtaatcatacagctcaaagcccttgactgcaggtcccttaactacaggaggtttggaagctctgacaccgtgtgtccccagagtctctgtctacattgccaggaggcagaattctgtcagggaacacgctttggctgtcaacagctcagacctcaggaatcaggtaaagacaggccccagctgccctgaaatctcgattagacagagttggaaaagtagagtggtgaaaaatgagacaggcaatgaaatgcttaagaccagcgattctgcctcttcctctcctcgattgcataatgcacggattcccacagggatctttccg

SEQ ID NO: 63638 - DNA, 1772 bp, Bovine  19866880781583
ataaagtgtagtgaatcatggggagtgattgttaaagatgactgaaggaaaacagaggagttttttaaatgggtaaaatacaaagagcagagaaggcatgccaattaggaaagaagagaaagaaggcctacgttaaaaatgcagaacttaaaccaggggcagacctagaagatgaaagttttaggactctaaacctatttctgctggcaacagaaagggtaatgatttacgtaatttcttacaaatgttaaacatttgtaagtacagggaaaggcttcatggatattcatttggtacaagttttccctccttaattttcactctctaatactatgggggatgtattatgtacaaaaactagaaacattcagaggtccgtgggcgtggggcctagggaaattgtaagcacctgtattatttataaggacatggatactgagattgagttgaaggcacgggtagggaggaaagaaatggaagagagttggacaaacacagttagtctccaagaacatgctttatttgaacatcattagagtctctcgggaacatccccttgaacaacagatgttctcttactaatattaaactttacatgtatatcctattcctgattaaagtcctagatagcaggaatgatgtgttttcatttttttgctgttactttttgaaaatttccttagtgtccagcataaagtcagtaaagactggatagagttcaagaatctgtacgcatacaatgcgagctgcagagaaggtgtacagctgcagcctaggattgagaatcattgccagaagtgccctagctaaaaatcttttttatcactcaatacttactaagagctctctgaaagtgtacagaggtcccgttgtaaatcttctgaaagtataccgatttcctttgtaaacgggatgcatagggaagccaacagatacatcttgttctgctcagtactcgttttatcatcactactataattaacaagcagtatttattcagtacctcccatttgccaggcagtggaattttttttttttttgtaattataccaagtgtttgcaaaaaattatagacaattttatcttccacgttaaaaacacttgagttcagagggctcaacaacctatctaagggcatgcagcaagtgaattcattagtttaagtgactttccatctcctgtgaaactggattaaagtgaggcatttttgtaggcaaggcttaaccatggatgctaagaaaggaaaaccagtttctagctacaaactttcttatttttatcgcgtctaatccagccaaccaaacaccaaaggcacaatccaaaaaagaaacaattgattagctgggcttaaattaaaaaacaaaacaaacttctgctttatgaaagacagtatgaagagaatgaaaagacagttcacagactgagataaaatgtagcaaaggacaactactgataaaagattgttatccaaaacacacaaagagctctagaaactcatcaataagaaaatgaacaactcaatataacatcagacacatcatagaagatatagaaatggcaagtaaacacacaaaaagacattcaacatcatatgtcactgcttgcatgctaagttgcttcagtcacgtccaactctttgagaccctatggactctagcctgccagactcttctctgtccattggattctccaggcaagaatactggagtgggttgccatgccctccttctgggtatcttcgcaacccagggatcaagcccccatcttttatg

SEQ ID NO: 63639 - DNA, 1379 bp, Bovine  19866880831773
ttttttagattctgtacactgaagtaattctttttctaatctttgtaataccaaaaaaaaaaaaaatcattacttgccaaactggatactgcactttatacttgtggatatgtaataatccttgaaaattgtattggggaaatatggatgtttggaaacaagtaacacatgtagtcagtacactagacaaagttgtgttcatttatttttgcagcttacatcttgttttacaccttggacaagaacattccaattgatgactggattatggaaacaatcagtggtgatcggcttactcatcaaatcatggatctcaacctggacactgtgtattactttcgaatccaagcacgaaatgccaaaggagtggggcctctctcagatcccatcctcttcaggactctgaaaggttggaatcatttcctgtcatttccttttctttcttttttttccccccctatggagcggttataaaataattttgaagtctgtttagggaattgacttaaaccatctctgttggcaccataactacagtggacattcaaaagaagttaaaatgcaaattaaaaccaaaatgcgatatcacctcaagcctgttaggatgagtgtcatccaaaagacaagagacgacaaacgctgccttgactgtgcaggagagagagcctagtgcaccgtctgggtgtgtaaattggtgcagccgctgcggaaaacagtatggaggtgcctcaaaaaattacaagtaaaaataccatatgatctagcaattccacttctgggaatatattcaaagaagacaataacattaactctctaagatacctgcatcctgatgttcatagaagtactatgcacaacagccaagacacggaaccagcataatgtccattgatgggtataacagaatatacatataatggaatattactcagccacacaaaaaagcatggaaatcctaccatctgtgacagtatggatggaccttgaaggtgttaacttcttcataagttaaagaaatcagagagaaagccaaatgctgtatggtttcactaatatatgggacctaaacaaacagataaacaccaaattcaggaaaagagatcagattggtggttatcaaaggtaggaggtgatgagggaaggatttggaggaaagtaattaaaaggtacaaactttcagttataagagatgtaggtactaggggaggtaataaacacatgataactatagttaacactgccgtctgatatcagggaaagttgttaagagagtagattccaatagttatcgtgaaaaaaattttttcctttttattgtattcatacaagataatggggtattaactaaagctattatgataatcatttcacaatatgtg

SEQ ID NO: 63640 - DNA, 2969 bp, Bovine  19866880837747
attgtatttatctagtccaagactattcacagcctgagcagtttacatcacgttgatttagaggaaaaaaaaaaagaacagggaaaattaaagtgtcagtttgcttttcattctgtcactaagataatatttggatagcattaatgcattgtttaaaatgataagtacgatcctaagcatttcaaaaaatcacattaagtgactcaaaggcaggtcaagggtaattagttcaacgccttaccacaaaatgacagcattcccttcataccaacactaacagatggcttacttttaagattacttggtgaaagagtacttccagcattgattacattccaattttgagactttatctgcctttttcattcctgcattttggcctcaagagacctcagctatctccctacagataaggctaagctctatggtaatttcactgctttacaaacatggatttcagacaccatggagaaagtgtgtgtgtgtgtgtgcacgtgagcacatgtgtgtgagggtttacaaaatctcacgacatagacaatacatttataaatgactgacttcctgcatagtaaactaaaatgatcttttaagaattctgcctgatatttaaaaaacaagaaggaatgtttgtaaaatgtgtaattcatagtggcaaactggattaaaagatttagaactcagaaaattcattttagttaggaagaaacagcattgaattttaaaatgtagtatatgaaggacggagaaggcaatggcaccccactccagtacctcttgcttggaaaatcccatggatggaggagcctgttaggctgcaatccatggggtcgctaagagtgggacacgactgagcgacttcactttcacttttcactttcatgcattggagaaggaaatggcagcccactccagtgttcttgcctggagaatcccagggacgggggagcctggtgggctgctgtctatggggtcgcacagagtcggaaacgactgaagtgacttagcatagcatatgaaggacaactgataaaagcatgcatttgattaaaagacagtaaaatccactacaatagcttgcatgaacaggctcctctggtagctcagatggtaaagaatctggttgtaatgcaagagaccagggttcgatccctgggttggggagatgccctggagaaggaaatggcaacccactccagtattcttgcctggagcattccatggactaaagactattttggtgggctcaagtccctagcatcgcaaagagtcagaaagactttcacttccttacctgaaaatagatctaggatttttttgttgactgctaagaattccaattttacttacttttatttttttgtaaatggaataatatttaaaactaagtccataaatttctgctttattgactatgccaaagcctttgattgtgtggatcacaataaactatggaaaattcttcaaaagatggtaataccagaccacctgacctgcctcttgagaaacctgtatgcaggccaggaagcaacagttagaactggacatggaacaacagactggttccaaaccgggaaaggagtacgtcaaggctgtatattgtcaccctgcttatttaacttatatgcagagtacatcatgagaaactttgggctggaggaagcacaagctggaatcaagattgctgggtgaaatatcaataacctcagatgacagctgataacaccatccttatggcagaaaaagaagaagaactaaagagcatcttgataaaagtgaaagaggagagtgaaaaagttggcttaaagctcaacattcataaaactaagatcattgcaatcggtcccatcacttcatgacaaatagatggggaaatggtggaaacagtggctgactttatttgggggggctccaaaatcactgcagatagtgactgcagccatgaaattaaaagacgcttactccttggaagaaaagttatgaccaacctagatagcatattaaaaagcagagacattactttgtcaacacaggtccatttagtcaaggctatggttcttccagtagtcatgtatggatgtgaaagttggactgtgaagaaagctgagcgccgaagaattgatgcttttgaactgtggtgttggagaagactcttgagagtcccttggaatgcaaagagattcaaccagtccatcctaaaggagaccagtcctgggtgttcattggaaggactgatgctgaagctgaaactccaatactttggccacctgatgcaaagagctgactcatttgaaaagaccgtgatgctgggaaatattgagggcaggagtagaagggacgacagaggatgagatggttggatggcatcactggactcattggacataagtttgggtaggctccaggagttggtgatggacagggaggtctggcgtgctgcggttcatggggtcacaaagagttggacacgactgagcaactgaactgatatatacgtgtatatatatatgtgtgtgtgtgtgtgtgtatatatatatgcctttgtatgttgttatacccactaacatgcctgtaaaataagtgcaatctgcaacctgaacattctttctgtttttatgggcataaagctgatacaagatttctgagggttcaggatggggagcacatgtatacctgtgatggattcattttgatatttggcaaaactaatacaattatgtaaagtttaaaaataaaattaaattaaaaaaaaagatttctgcattgttgaaagaaaaataaatccaccaagttgcaagtcaagtcacaagttaaaaaggagccagtttttatttgcttttgctttttaaataaacatgaacttcaggtagagcagaaacataagctgagggtactttgaggatagacctgtgcctaattacttcttattatatatcctaaaacataagaatccgaataaatgccaattt

SEQ ID NO: 63641 - DNA, 1401 bp, Bovine  19866880849578
ggaatgattaatggaaaatttaaccctgggtggacatttctgtgtattgcatcatttcagttactgcctgtatgaagtgttggccatattctcttaagcagagggatgatataaggacccagagataaacctgaatacaggatcattaaatcaaatactgctcatgtagacaatctgctactgttagtgaaacaacattcagattcttagtatttgtcaacagttgaaaagtattcttgttgaaaagcatagtctacaccacgatgccttagagacatgatgatggtagggaggttacgttgacaataatgtctcaagcaggaaacaattatacaagctgtgagctctgaaccaatactcacaacaccaacagtcaccagttctgagcatttccaaacgcttgcttttggaagactacaacatcctataaaaatcaaatgcataaactattctttttttttcccctgtggcattctactaattatctttgtgcaaaaaaaatggaatcttaatacatcagtctacaaatcatggtaataaattcctatctacctgagaattgatggatttgatttatttccattttcctctgtgtaaaaccatctctgtttctctacacaaatcagcttttagcaaaagaatggaaggaggacaaaatactgcaagtaaaactccaccttattcttaaaatgaaaattttctggcttcaaaatgaacaaaagtattgccctaaaaaaagttgacctaactttgtttttctgtgtgaaaagcagctcattgtagaggaaaagcacacacaagttatgggtcttctctgtcgagctacagaactttaatccagagctcatgaaagggtgcaagagcagcttgaaaattatgctgagcttaattacacttaatgtgaattattcagaagtgcagacagagactaaaaatttatttcatacaaagaagcttgacattttaattggtccttcagaatggagacaaaacaatttcctctcaagaaaatttacatcctccctatcagagccgaaacctcagccaagcagaacttcattaactagattaattatcgcactagtgtctgcttcatcaggtgtatggcccaggtagaaagaagaaaatgaaataatgaccgacatttctaaaagacagcattgacccaaggagggaaaaatgacggatgaaaaccaccaaccttggtcattagccattgtgtcagggtgttccactgtggaggaaagagaaataatattattagattttggcagtttccatcaagaaaggtgacatttctagccaacggttttattagtgagttctcatatcaaggccaatgccctactgaaataaaattgataaggagttggttactgtgattatttccattaaattaaa

SEQ ID NO: 63642 - DNA, 1184 bp, Bovine  19866880849854
tcttagctgcattcattcttactgaggcaagaattatctgaaattattgtgtaaaattccatcaaagtttcattgaacaatttatgagtttagttttgagctgatgctatgaatttgactgcaaatttaagaattcaacagggattctcagactttgacaatcctaggatgtgttgtcaaaaaataatacaaagcaagaatgctgatgaatctttcgatcatcagaatcagggctaaaagtgaaagattcctagaggaaaatacgacctgcaggtctatgatcttccagatctagtgccttcaaaagccagaccaccttcagaagaggaataagaaaaataaatagtacatatttcattacaaagttctttctgcctgtcaagacactctctgtacacattctcttccaccaactcattcaacgtctacaacaacacaagtcttattacaaaatgaacaggtttcatcctttaactcaaatagatacgcttaaatactctctttttggcctagcataccttgagaaaatccgagtattactacaaagtgaaaggggttaaaaaggaaagcacatcactgatgagtattattcatttcagttttaagcatttctcattgatagttctatgagtgatgtttttcattttctattattattattttttaattttagcaatgaatcccattaccaaggtattctcctgttaatgattctcttgtagtgactcagttactgttgccaaggaaacagccccgttgcaagagttaagcagactttttcatatggtgagaggatgatgggaacggatgagggagttgaggaaggtcaggcgtttaccactgaatacaaatccgtcatgcctaatagatgaagctctttagtttctgtgctgttcaggctactcccagcagccagggagaaaacacaaaagacactcaagcatgaatgccaacgagcctgcgctggcaacggtggtgcattcacatgtgccatcgcagctggaccaggcttggtgactaggcttggctatacacgaaaagataagttaaataggttgtcaataattatagaaggtcagaatctaaatcctgagggaatcttaataagatcagacagatgggatttggttgctctatcctgttcacgtgcccgagcttccttctctaggtcagagttcaaaatg

SEQ ID NO: 63643 - DNA, 1432 bp, Bovine  19866880856953
tgccattgactgtcatggctgacacctgaaaactgtactgacttcctttctccagtcctgtgaaagaattttccacagaaggaaaaaaaaataagttactgaataacaagtatttttcatgggttttaaaagttttagcaaaatttcaacaatactaaacatgctttacattttgtgtgattgttgtggtaattactgttattttggccaaaagggttggaagattacagcaagaaatcaaattatttttcatatattctcatttatttttcccagtttacaaaaatgtttccttgaaaatagcctcagggcagatgcagaatacaaaatatgaacgatgaagaaataatcaaaaatagtaaggatcatttttcctcacagtccagaagaagcctgcctataaatcaagaacagtcaatctaaaaatttatgctccatcattcattcaaggtcagtgattcctttgggcaaagaaagagaactccaaagccactgtacttcagctgaaaatactaggttttcatctctcgaaaacatctcaaggcatatttgttttgcattaggttccacactacagcatgaagaaaacctgtctctgtgataacttggacacggattgcagtactcagtgatgacctatgagctgattttccggcacacagagagtacaggaaataagggaagccttgtgcatcatggccgagtgtgacatgtataaatttgtaatgtgaataactttccttttatctgagtttcaacatagctcatcaatgtgacacatgtttataaaacaaataacgcctctcagaagatcatatgacttttctgagacactgaggactcggtgtaaaccaacaagctcttaaaccttaaggagttgaacagcactgataacaattaaaatatcatctctcttttttccccattcatttgaaatggcacaaacatttggagccaaggacaaatcataaataaaatagcctcttagagaaatgatgcttctattaaatacaaaattatgtatttgtttatttttgtacagaaggatgaataattcttggtactgagaagaattctaacttgctactaatagatggcttttaagccatggttagaatgaatttggtacagttgaaggcagtcatcttcagtaactaggacttttagagaaggcaatttgataaactcacccacatacaatactggccacttaagatacgtctaattttataaaatacattggaaggcatgggttgagaatagtgttggtcctgttgtttctcttactgtgagtggcttcagtttacatccatagagtcaccacgatgcctgactcatggaaggcacaaacagaaacaactgttggaaggtttattagagcaagtcttagcactaaggagatactaggttataatacaatacccaacaccat

SEQ ID NO: 63644 - DNA, 2095 bp, Bovine  19866880870698
ctgtatgctggaagaataaactagatgatctatttacttttcatttgcactgtctatatttctatagtaatggaaataataagttacagactgagagcatgatttttttgatcccagcttttaatgatacacacaggaagcaaaagtattcaagttagctttttagtagagattttatttggtaatttgactctaaggagactttgattttttaaaaatatgttatcatttaattatatcaaactaaagggtagcatctggttttgattcatttaaccttaatgggaaagaacaagtcattacttaaagagtgtcttatagcctattatttcttgtatttttagaaaccatttattcctcttcaaattgtgctgtaattattcattaataattcttcttgatgtctctggagtcattccattacccacagtcattacgcatcatttcgtcaatgtttgctatgatgttgaggtatctatggctcattgagtcactacatccattggtgtatatccttttagtgaagaatacccaatttattctgaatcaagtttcactgacgtattttccagaaacttaagaagctgcttttatatccaagaagaagagtacagatataatccctatatactaactcctggatatctctcatgtaaatcttggcattgattggataattctatttttgttattgggctaatgacccagaggatatttgttattcagctcgtggaccccaaattgtaagagaaaacagcactgcatggaatcactgtcattaactgctttatccatgtaatggtacatgcttatttgctcagtcctgtccgactctgcaaactcatggactgtagcccaccaggctcctctctccatgggattttccaggcaagaatactagagtgggatgccctttcctcctccaggggatcttcctgacccagagaccagacccacgtttcctgtgtctcctgcatcacaagtggattcttgactgctgagcccatggaagcccatggaagcccatttaatggtagtttgtcatagaccaactccatcatggttggtcacaacagctttttgtaggaagacctagaatattaaaagaggagtatttcctctgagtaacagaattctgcattttaaataaccactatctgttaaaataggaagactggcatcagtggaggatgaaatgtttagcatggtcaggataatgtatatttttttgagtttaggcttggtttaaacttttacatctggtattacttagtttgagtatcttctccccagaggttaaaataatctaataatgaattaagcacattctaaatatttatattttccccatttcatagaaaagacaaagtataaaattcctccaggcagctctactgtatgaaggcagtttataaaacagttgtgttagtctatattattcacatcacaaaagattcttctgttgtgaaaggatggagctcagggtttctttaaatctgagctcccattatgcatttaaaacatcatttaaattatccaaaccttcaggaataaatttgctctgtaaagtgacatatacttaccttatttgtgaactttggtgtaataagttattcaggaggtgattgacacaagtcttgcaagaagtcagaagtgtgaaagtccggaacttggaattcttgaaactgttgtacagcattatgtctgtttccttaagaacatttatgactattgttttgaaataatcatgttgatgtaatattttcaaaagtataaagtttacttttaatagttatatagaaacagtagacatatttctaatgaaaaatatactgattcattaagcaaatgtttattaaatgcatgttatttgagctgctaacaacctcaggtacttcagtctcccatttgatagatgtaaacactgagaacaagagcagtgatatggattgctcaaagtcaagtaataaaaatgcagaaataggagtaatggtctgagttcctaactgcttgcctttcgatcaccctctacaagcttcttatgttaattcactttattattgaaagagattgctttaaaaatattggtctgtct

SEQ ID NO: 63645 - DNA, 827 bp, Bovine  19866880966686
ccactctagtattctggcctggagaattccatggactgtataagtgcatggggttgcaaagaatcggacatgactaagtgactttctttttttttttcttttaatttaattttattttttactaagtgactttcaccttcaatttacatttcctttagtttcttacttggaaaaattcagttacttaacaaaaaatatttaaatgctctagctctgagctttttttttccttagcaactgagcctgtctgctgttttcattgattgtgtcttattaccaaaggaaactgcatggaaaagcactgcttcttaaagcctgccacgctgatttgtatctttagatgtatctgaggtgtgttctctggatggtctccgtggctggagaagagggttatagggcagctgggtcaaagcactatatggttggaatgaggtgagtgatagtaaagtcccatgaaggttggaaggagcggtgttgcatgtcagtctttatccctcgaggaagctccgatgaagggaaatgattgaaatggcatgtttggggtccctaggcatggagaaaggataaacaatgcctaggaattcaatgacatcaactcaatggaaagcctggaaacaaagggagctggggttggatagaagcctagctttcccgcagttggtgaaaggtgctagggagagacgttgatggcagagatgattacaaatgcctcatgaagccctggagccactgctccaagatgaaaagggtaccatgattagtaaggaaatccagggaaggaaaaaagacctgaaatgaagcaaattcttacaggaggggacatgtgg

SEQ ID NO: 63646 - DNA, 734 bp, Bovine  19866881019701
tggtagagggcatgcttaatactatttcctattcttttttttgctatccaggaaatgatggtaaatattaatatgtaatttgcctttagcttgtgctcttatatgcaagtcagcaaaggcatttgaaaactctaccttcctaattaaaatgctgccaacatcttataccataagaagagggtatattttcaaattatatacacaaatgacaccttgactgataaaactctaacaccgcccccccaaactttgcaaattaggctgcattaacaagaacactttagaatcttgagtttttgaacctcacgtacattaaaaatttcatacatctccttatgcagtgacagaattatagaggtttcctatctctccttttacttgctggattcatccttcaaaggattgtaatagaataatggtttactgtcagaacactcaagccagttgcaaataaatttagagcttgctaatcatttactttcccttatgtgtcactcttttaaaaacaacactcttggaattcaaataaagaaaaacaaagctatagttcatgtttattcttgaagttggaagcccttaattaaattgaggaaactgaagaggcttcctaaattattttctgatgacaggtagaatcaaagctaatatgcagtgatatgatagtattttacttttatgatatgttcgattttatggttcaccttcttacagcaggagaatcttcaacttctgaa

SEQ ID NO: 63647 - DNA, 3298 bp, Bovine  19866881049522
tcttccttccatttccctcacatttctgaattggtggaacttttgagaatgacttgccaagaatctaccactttatgcacttctctcaaagatggtcttaaaaaagaatattctgtcaataaatccaggtggtaagagaaagcaatgaaactcaaaggctctaggttgttgccgtttatgaaaatctgataggcgatgttaattttagaatgttgtgagagatttaagcagtcacgactcttcctaatacatagtgggtagtcttacataggtggggatttccttttcaccagcattcctgagctgaatagttttgtcagtgtggtcagctctcaactggtccatctgtgtgataaaacatttttcatgttataattccaggccattcaaaaacatcagctaagatattttaaaaatttgaactgattcaaggaaatctcctcgttaaccctaattcaaacatgacagagggtgaaaggaatgtccctctgacaggtagcaatgaaaaaccacagggaatgctcagaatttctaaaaccgggagctgccggttacttatacaagatagaaatattaattccatagaaatatgtacccaggaaaaaggcaccatagccctcaatccatattgtttctcacacaccctgagattagtcacccatcaatcttttcacctctgtccaagtttgaacatgaaacgcaggccaaaccatcgtcttttccaccccagattcttttgacaactgagtcatttgtgtcaaggcacactgacacgaggcaatggcagaatcctagtctctcatttaaatctgatggtaaagagacgttatagtaacattagaggtggtcgtttttgttgtgaaagggaacattctccttctattttatataggagttaaaatactccagaattatactgcacttcttatacttccttccattgccaagcatattcttctacattggccaaatgtttttgtatactagagtgaggatccatttaaaagttcctatataaaaaaaggattcacttataaaaattcctgtataaaatgaaaccagaaaagaaacctttatttttttttttttcagccaagaacttttcctttctttcctgcctttgactatcccatcaagcctcacagcaactcttcaaagttttattggcctcaatagttgttataaaataattgtccttttccatcagagatactttctaagtttagctttatttaacttacctttatggaaagtggaagaatgactgaggaaaaaaagatgatgattcccaggttcaattttctaacaagatattgaaccatgcagaggatggtaatgaactcattctacacaagatgccctaaattaagtcatcagagggagggttcaagagaatcatgttccctgagctatattgattgatgatgatttcacacaattgtcttaaacagcaattcttgtctcttgagaattagtggcttaggaaagtggtattgagtgtcttttaaaacaagataaaatcaatctcagtctatagaggcagagccactagattaagaaattaaccagagaaacacagagttagaaggaatctttgaggtcacttattaaaatatcctgtcatgtgcttaaattctatttatctccctaaaaagagttcatccagaacctgattgagcacttctacaaatgcagcaatctgttctatttatagatggactaattggaaatgctcatttaaagtgagctgcaattggtcttcagttcaacacattgcatttaatactgtttataaaataaatatttaggtagagagcctcctgtgcaacaagactataaaggaaggaaatctgttactacttactaattctgcagcttctgtcaaacaggcagggaactgctgtagccctgtctgggggcagagatgctgtctagcaccactgtttgggtgccccaggactccccttggcctgtcccatttaagctccagtcgccccaccaacttggcttgtggcccagcattcctcaaggactcccctcccaacctgtacccgctaagccagcctcaggtacagcatttcccagggactgttctggaccaggcttctccagtccagctgcacaatgtgacttcaggcatggcactccctagagaccatcctgggtctggggaccagccccagccagcttgccaaagcctctaagtacaagcaatctacaaagaagatcctctcgcacaacgccattcctttcgatcaggagaggtagctattttgccaaattcacaaaagcaaaacacagaattcaaacaaaaggaggaaacaaatatgctcaaaataaaatgacaaaataaaactctggtagtgtgtgtatggtgggggaggggttctcatgaagtagaagtggagataagtaattatctgataaaaagttcaaagaaatggtcataggatgctcagaggatttgaaagaagaatggactctgagaataaaaaagactctgagaataaaaagaaagaattaagcaggactgagtacaataaccaaaaaattaaaaaaaaaaataacaacagattagagggagttaacagtagattagatgacagagaagaataaattagaaatctagaagatagaatagtggaaatgacccaatcagaacagtaaaaagaataaacactttttttttttaacatgaaggacagtataagagagtctggggacaacattaatgatttaacattggcattatgggagtaccataaggagaaaagaataaaagggataggatggctgaaaaacattccctaacctggaaaaggaaagataaccaggtacagaatgcacagagagtcccaaacaaggtaaactcaaagaggtcaacatgtaattatacttaaaataacccaactcaaagataaagagagaatcttaaaggcagcaagagaaaaacaattaatcacatacaagggaaaccccataaaattatcagctgatttttcagtagaaactttgtgggtcataagggagtagcaagatacacttacagtgctgagaaaggaaaaatgacaacacagaatactacaatatatctggcaagatattcaaaattgaaggagagagagtttcctagacaagtgaaaactaaggaagttcatcactgttaaactggtcttacaaataaatgttaaaggatcttctttaaacggaaaaaaaagaccacaattagaaataaataaatgacaaatttcattggtaaaggtaaatgtatagcaaaggcagtgaattaccgcttaaa

SEQ ID NO: 63648 - DNA, 615 bp, Bovine  19866881068975
tgactcttttgtgtacttgtcagctctcattgccattgtctcctggtgaaataaactccaggtttattaataatttcatgcttctattatccccactaaaaccctaagtttgaggatattggcacttgcagtcaacagaaaatttgcctcagacatgctagaattaaccattttaattaatatgactaatccaatagaacctaatttatatacataccattcagagtgcttctatcaatcaaattcgtatcaactggccaataacttccatctccatggcgacctgttcattgggaaaatgtatcagaatgttagtggacctataacatggaaacacaagtgaaacaaaacaaacaacagtatttaaaagtgtacaaacagtggaataagatgacttcatctacctcagagacagcctgaaaaaagtgataccattatactttgcaagaaaatgctattttctatgtgtgagaaaaatctgtcatgaaaatactcttctaaacaagctaaattcagttcctcactgaagagctgacccgtcacttcctctttgttttccctccagtatccttgttaacaggccaccagcaggtacaacatcagttgctagtccaa

SEQ ID NO: 63649 - DNA, 1643 bp, Bovine  19866881196308
aaaagaaaaatgctctaaactgaattcatcctgttcagttaatctgaaaaatagagtgatttcctcctaatccaataaaccttctatttatgataatcaagttatttttcttctcaaaccactttcatagatcttgttggtcctgagtcctaatccaatttactaatggcagagtctaaaaagttgctctttgaaagaatttcaggtttccttatttctaaaaatacaaaacataaattaagatttcaaaaagaacactcagagtggattaatttgcaaatttggttggcattcaattattttgtattttctttcctcagattcaccaaatgtcttttgttgataagataaaaataattgaaagcgcggttgatgtaaattatataggagagctgagctgggactgaagcaaaaatatcttttaaaaagaaaatctgtctactcagatcttagataaaaataatgaaaaactatacagaaatatgttctcttgttgtaatttaccatatcaattccttttatgtttagtaagattgtaattttgctggcagtgctaaaagtgtttacttcttttctaatgttaaaaaaaaggaaattcactaactatacaacttaatatatgaaaataaatttatctggtcacccttaaatgaaaacattagttttccttagtggttttagttaagttatcaacacctccccaatacaatgtgatttcattttccaacattaatttctgtaagacaagttgtttgcccattattattacttttagtcaaaccaatgttgttaagtataagcattctcttcaatcactttatgacagctttctttaaaatcatttagctcatccatatagttaatccaacacactaaaaaaaattcacccacacaacctaatttggtatcttcatcacatactcaataccatcataagtgaattttaaaagtaattatgtaaatacaaataaaacagaaaagcaatgttatgtaacattattcataggttaccatttttatttataacacctcaaagaaaactagagatgatgacgattttttaattttcacgtgtatctgtatggtatgaactgatcctttgtgggaagaaggtcaacagtttcctccccccacccccgacccctcaaagtgaaagtgaaagtcactcagtcatgtccaactccttgcaactccatggactatacagtccatagaattctctaggccagaatactggagtgggtagcctttcccttctccaggggatcttcccagcccagggatccaactcaggtctcccacactgtgggcggattcttcaccacctgagttatcagggaaactttttcctccaaatgaagacctaactctgagttcagtgacttgcacatttttcaattcattagctatttatgtgtcccctcctctatacctctccttgtgctgccacttcagtttagggcctcctgctgttttgtctttatagctgcccattatcttccatttcagatgttaaatcagcatgcctctgggcagcaactgtctgagtcagggcccattcacctaggtgcttgcgcactgggttggctcttcttgctttagactcttctgtccacatgccatgcacctggtttgttaggtct

SEQ ID NO: 63650 - DNA, 632 bp, Bovine  19866881262612
ctctgtcctgggattccccaggcaagattactggagtggttgccatgtccttctctaggggattttcccatcccagggatcgaattcatgtctcctgcactggcaggtggattctttaccactgagccacctgggaagtagttgtatgtcattatttaggtttcttatcttttaagggttcccttatgaggctaacattctatgattctataaagatagatctaaagtagttcacaggtatgaaagagctttgtaaatgttatgtgttaccatttctagtctctgtcaatgtacatataaaactttcaacccttgtacatgatgaaattcaaatgcaataatttatcatctaacattgaaggaaaatatttttatatgacttagtttattatgtgttctgcactcttataacagggtagcccatttgtttaaaaaaatgatgactgctgataatttttttatttgcaaattggggtcctgccttaataaataaatatctgaggctttcaaaagcagtcatggtaattttctacacacagtaattttttttaagaaaattatatagagactgtttctaattatgtttaacatttatgagagatgttatcctcatctcctgaaagttcacattt

SEQ ID NO: 63651 - DNA, 1104 bp, Bovine  19866881303070
caaaagcagagatatcactttaccaacaaagctatgtatagtcaaagctatggttttttcagcagtcatgtacagatgtgagagttggaccataaagatggcttagcactgaagatttgatgcttgtaaactgtgatgctggagaagactcatgagacccttggactgcaaaggagatcaaaccagtcagttctaaaggaaatgaaccctgaatattcattggaaggactgatgctgaagctgaagctcctatgctttggctacctgatgtgaagagccaacacattggaaaagaccccgatgctgggaaagactgaaggaaagagaagggggaggcggaggctgagatggttagagagcatcacgattcaatggacatgagcttgatttaactctgtgagatattaaaggacagaggagcctgttgtgctgcagaccgtggggttgcaaacagtcagacatgacttaggagaaatatatgagaaaaaagcttaagggaaaaaaaaaaatctgttagaataaagatatgtgatgctgcagtgcctctggagggaattcagtatcctcttgtgcttaaattctgtgaaagtcaaatcaaacgtggaaatcacatcagaggctgataccaggaggaacttgggcaagaagtgatgcaccatttgagggtctgtggaacatgatgttaagccttgattaagtggtacgttttaccatgctctgtgttctaatatgaaagatgctgatggtcctcctcttgaattctagagtctcaagttcctgaccagccaagctctcttcatgtgaggccccagaccaactgcatcatcatgagttggacccctcccttgaaccccagcattgtggtgcgaggctacatcattgggtatggtgtcgggagcccttacgctgagactgtacgtgtggacagtaaacagcgttactattccattgagaggttgggtaagtagctgtgaattttcttctcctaaggaaaagaaatgatttatatttaattattttctcttttggaaaattgctctttggaattggatgacagtttattacagatatccataactctttttctatccatcagtctactca

SEQ ID NO: 63652 - DNA, 1221 bp, Bovine  19866881366539
aattaaagtatctctaaagtatatatagcactttatttgactaataaatattttagctaataaagattttctgcagtcataagctgaaatgtataatttagaagaccctggaaataaacacctcttataaggtttcagaactgctccagagtattgatatcaagtagatatttgtgccacatttaatttaagcttcccgatgaatgaatgaatgtgaatgtgaagttactcagtcgtgtctgactctttgcgaccccatggactgtggcctaccagactttgtccatgggattttccaggcaatagaactggagtggattgccatgtccttctccaagggatcttcccaacccagagatggaacccgggtctccctcattgtagacagacgctttaccgtctgagccaccagggaagatagtgtgtatgaatgaagagaaattatgaatggagtaggaagttttacttgccattaataaaatcattctctgtggcatgtcggaactaaagcattggtcaaattggtgttggataacacagtgccatttgaagcctctgagagtgatctctagttagttagtaacaagtggagcttggggtgttattaagcagaattacaacagcagtgcaccgctgcacaaagaaattcgtggcatttcctctaaacagcatctttaaaagtctggctcctaaaactaatgttgtgaagcttcagttcttttgaattgagactccagggaataagagagagtgataattattagctagcaattgatgctaaatttgtttattcactggttttccactactttctatagtatgtaaatgagatctttacttagaaaaagctttcccactcagagacagttgacagctgttcaagcccaggggagaaagaaaacacagctttctcctcggccttttcttctccttcagcaaggcttccaaagcctcgtggagttttcccagaatcccctgcacaggagctttcacattctgattgactagtcatcatatcagggcttaccgctttgcagctccctggctgccaattgaatagtatgaactgggcccagaaaatccgcttgctcagcaccactggggttgtgggctgtttagcaagcgatgtctaattccttatgactctcaccagtaaagatgacatcagagtgatatgattagcatgttttcagaaagaatcctggacacctcgtcaaagtt

SEQ ID NO: 63653 - DNA, 1121 bp, Bovine  19866881448456
gggaaaagagagattccttgctgaattccttgttgatgagctattgatttgatgctcagccttacagctatacttttggcaaattcaaacattttaaaatatgtttttcctatgataaaacagcataattctttgaaaataatttaaaaactatgctttattaaataaaaataaaatgtggaattctgttcccgggtttctttgtgcaaaattatctacagatctgccttcgtgtaaatacattacatctatttactttgtataaaagttagtttgttttcatttcctccattcaagctgtatgtccacattaccagttataagggaaactcagacattcgaaagcattagcctgaccaatgacaagtctgtgcagtgtggatgttaataattcctttctgaatcaacaaattatcacatgctttcgggtactgaatatatgttcagccaaaaattagacacgtgagggggtgaaaaaaaggatacaaatgatttttctgtcccaaagaagttgagaatacatgagagaatagtatttctttaagaagctaatcattattttggacttctggagcctaaagttggcaagaaggtactcatttcctgagtcttctgtctctataagcagggtgtgaatgttgactttttaggagatcaggttttgcaacagtgatctttgaaacgtttgagcagtggtgcagcgtgggcactggccatcagaatgggcgtggtcatcttcagcccttgtggcctcaccagcaccctgattcccactgtccccagccatagccctgatgtctgtgcagagcacagatttagtacttgataaatatgtgcttaattaagctctacaaaacagataagtctttagcacctcttggtaaccaaagaagagtttataatctaagagttgctttttttttctggttgaaactccattaagctattatagtaatggattatacactgtcgattacaagtagataaatgttttcaaataggccgttactttaaaaatcaatagtgaactcagttcagccagcattcaaaatatctgcggttatattatcaaaatgttgatattttagattaacgaccaacagaaaatttatttttaaatt

SEQ ID NO: 63654 - DNA, 1401 bp, Bovine  19866881648288
ctagaatactggagtgggttgccatttccttctccaatgaggaaagggcagtggcctctaaagagaccagatgggctgctaaactttctacaatacacccgtcagctcccttgacaaaaaagtatccagtcatccagctcaaaatgtcagtagttgcgacactgagaaaccgtgtggaggtgcagcctttggggaatgccacagcaccctttgcttacctctttttctttttacttattaatcttccacggttctaagaaaaaaacccagcaggaacagggcttgtacagacccaaatacatgtatgctaccatgattgatatttacaaaaactcttcacacgtatgtaaaatactgaaaatgtttgtgaatgctgtgttccaaacccagtacccttgtgtaagaatttttacataagtaaacactctcactgctcagcaacaatcacccagaacacacgctggccataagcacgaaggatagccttggtggtattcagaccgtctaaagcagatgaacacgtatgtgtggggagagaccaggaggaccaagaacagtctagaagggttaggaaatggctgtgtgagaggctttggaagacaccttcgcttgttcagacaaactctcacactttctcgagggaaatcagataatataacgagtcttcacagcccaggaatcaggcatttttagacctcattggttttccagagcagtctgcttaatctttatcccctgttgcaaacaaaccagtagacgggcaataccgcccaacaaaagaataaaatttgtccatctatcattaagataattgttattgattagtctccttgtaattttctgctttttgttttcagaagttggttataaatcacacccacaacaggcaccgagcctgtgtttgtgtctattatgtggtcctgataaggctgggcagcgttttttgccttcctgatggaagttattgagattgattgaagcgctttgctggttctatcctagacactatgtaattaatgtttcattatgttaatacatgcaaatgtaagagtgtgtgtttgattgggaggtgagagaacaaaacaggattaaagagttcacgccaaagtacaaattaatttattgcattgctaactgccctctgaggaatgagggagtaggcttcaaaatgaaagaaaaaaatgcaaataaagaaagagctgttgcatgtctatgtcattgagaggtagttcccttgacaatgataaaaaggatattcagtcatgtgacagagttcttacccacgctgtggttttcagcagttcacatctccctctctagttaaagggtttaggatgagaaaagtcacagattattttttctttacatatgcaagcatttatacctatacagaatgtgcga

SEQ ID NO: 63655 - DNA, 1101 bp, Bovine  19866881845364
acttgtcatcttttagccatcgaatgaatcttggttcactggcaacaatagtcagtggtttcgctgtcaaattatagtttctaaaaaagatagccattcctgtgtttggaaagctccaccccagagctcagctctttccccacatgcctccagcaaatggaatagcccctgactcacctctcccctaccctgtaactcacagcactaggaattccatgtctgttggaaagtgcaatcacaaaccaataaggcattaggtgacgtcaaactgggaatacggtggagagaagagaatgctttaatgctagcacagcttccctctttcaaaagcaactatctgtgacaagggagactgaacacagaaggcacacagatcagccctgcccatagctgctggatggagctgggacccttggctaggagtggcatccatggagatgaaactgcagtacatgggggattcctttgttcagaggagtcactctccccagcattaaacatctcattaagcgtcttccttaatttttgtgatgtccagaagctttcagagataatctgagcagtcagtgaactgatgtgtctgccagggcatgaatagcaaagatcgttgcgtgtttgccctgggtctatcagcagcaataaattttaatcggttaggcatttttcaagcaagctactgtttgccaaacactatttttggcaggcatctgtaacaaagcctaatgcattatgcatattatttccacagtatttcattgtattagcacatgtagtatttgtatggaatttttgtaaattcattaccaaagtattatcatattaatgactctggtttaaaaaagtatttgaaaaaatattaatattcatagaaagttacatacatcctatggtggggaaatgggactcagctattatcatttgaatttcagaaagaaatattagcatgtgtatggaaaaaataactcaaaaatacatagcaaacatgaaaaaaatcttaaaaacctgaattcttttgatgtttctttgaaggctgaatgttcattttcagcactgtaatgataataattattatagattaaattatagtgaaggattagtttt

SEQ ID NO: 63656 - DNA, 1036 bp, Bovine  19866880455228
tacatagttggtcaaaagctggatgaccacatgaaaatggatattttagggggagttcttgaagctgaactaggtgacctctatgatactctacaggtgatcctgtacaacccatgcccccaaccctatcctgtgtgaaaattgtatctttagactaaacaaagagtatgaacaaagcccagcccatctccctcattctctccaaactctctccaacccagaaagatcgtactattcaccctccaacactctcactctttctttctcttttctttagtcaaagaaaccttaccgctcccttcatattccatgctgtaatatggcatctcacaagagtagcgagtgatggaaccaaatagagtactttctggatcttcaactctaccatgctgaatgggttcaggagcgccacagtccacggctacatgaggaagacaggagagagatggtcaggatagacacttcttcccaggaagagtccctgggccagtccatcctcccagctctgatcctcactccttccctgcctcccccatccataagcacatctggggtgaatcccccacatcagcttctgtggccatgatcatctccccagcctactgagtcctgccacttcaaatggcccttagaacacggcaagaactaacctgcttcccagtggttggtgaggcctctgtagaaatggacccatagaatgctattaactctactaatctcatagcccctttctttctaagaaagctgctagtctggcaggcctggggtcagatcaggactaggattctacgactgatttcccttcaaaacccaatccactatctcacaagcctaagaagaaaccatgcatttgtatctcagtgccttaatctttccatttcctttgggagaggggaaattattcccttctttattcttaagggaaagaaggtttattcagtagacagactgtgggccatctcagaaggtgagaggcaccagggttgtgagttttcataagactgagtaatttcataggctaatgagtagaattatt

SEQ ID NO: 63657 - DNA, 1091 bp, Bovine  19866880456146
tatctctgctgttatgcattggtgtgtaattgtggcacatgggcttcagttcataagaaggaccatagtaaagagctgggactccttggcctgaccctatattttattctccttttctctttttcttccttagtcaattgcagtggaaatgtattcaccacaatgactggggaggttgaaagtcctaattaccccagtccatacccagagagctcaaggtgtgactatcagatccagttggaggaggggttccgagtggtggtgaccatgaggagagaagactttgatgtggaaccagctgactccgagggccactgtcccgacagtttgctcgtgcgtgatggatgatcagttttcttccaactcactcagagagagttctccctgaagatgcattatctagctttctgtcccttctttttttctttctctccttcttattttattttacttttatcccttccgtgttacctttttcttttcgttctttctctcttctgatttccccattttgattctcttcagtttgtggcaggagaccagcattttggtccttactgtgggaacggctttcctgggccactaacaattgaaacccagagcagtgctctgaatatcatcttccaaactgatggatcagaacaaagaaagggatggaaatttcgttaccatggagatcgtgagtaacctagaagctgccctctggttggtgggaccagagtccttgcccaaggtaaaatcaaaacagtgaattgttgtagggatggatatcctgagaacacagcagctcctcagcaccatgtaaacctgttagtggttgtgagaaaccctcaacttttaggaatccttcaactggattttcaaatgcagatggcctggaggtggttagttagtaatgtcattattctattttatttcatttcatttcactgtcagacttgcgagattttagttccttgattagggatcaaacctgtaccctcaacagtgagaacgctgattcctaagcacaggatcgccggggaattccctgccatattattttaaccacctccatgttggaatgctgggtttcaggactgaggatagtc

SEQ ID NO: 63658 - DNA, 2328 bp, Bovine  19866880612451
cattgcaggcagacgctttatcctctgagccaccagggaagccataacagctctatgctgctgctgcttctgctaagtcacttcagtcgtgtccgactctgtgtgaccccatagacggcagcccaccaggctcccccatccctgggattctccaggcaagaatactggagtgggttgcctcgatcccatggactacagcctaccaggctcttccgtccatgggattttccaggcaagagtactggagtggggtgccattgccttctccgtaacagctctatgctgctgctaagtcgcttcaatcgtgtccgactttgtgctactccatagatggcagcccaccaggctcccccatccctgggattctccaggcaagaacactggagtgggttgccattttcttctccgatgcatgagagtgaaaagtgaaagtgaagttgctcagtcctgtccgactcctagcgaccccatggactgcagcccaccgggctcctccgtccatgggattttcagttatacccaaattaattaatttaaagcagcctatttagccttaaatgctgctgtaggtggaaggcaaaagtgggtaaaatagaaaggaaggggcaagaaaagaagaaatgaccagaaaagtggaaagaagggagtggctatagttgtcttggcatttggtagagcccctgttcctcaggaacaagttgtaggattgcaaaccccagtatgatgcatttgaactgtggtgttgggagaagactcttgagagtccctggacagcaaggagatcaaaccagtcaaccgtaaagaaaatcaaccttgaatactcattggaagaactgatgctgaagctgaagctccaatactttggccacctgatgcgaacagccaactcattgggaaagaacctgatcctgggaaagattgaatgcaaaaggagaagagggcaacagaggatgaaatggttcgatggcatcacctagtcaatgggcatgaacttgggaaacttcgggaaatggtgagaggcaggaaagcctggtgagctgcagtccatgtggtcacaaagagtcagacattgttgttggtgactgaacaaaagcaacaggaagaaataaagaatagacaatcagcaatgaacaacgttataacttagattaaaaatacactagagggaaacaatagtagattctcatggaataatctcctcttaaaccatactcttatatcttcagaggttcctaaggggatgaaggcaaccctagatgccagatgtaggatcaaaacatcgattctacttctttctccaggagaatggccaggtctccaggtgcagctagaaaaagaaagaactgttgtttcctgtgaagggaaataaaaaacctgtatttaagagtttaagacaaattaatgacctgcatctcagggccccaaatgatgtaggttacattaccacatgtattgcttcatacttaaccctaaatgttgaggcaagaatgcagttgttggctttccacatttctcatttatccgatcatatgagaaataaggagagtttatagtggcacaattaaatgttttcgaatccatgacattatcttccctcactccactgtaatataaataccatgaaaagaagaatctttgttctgtcctctattctatctctataactctgaataatacctgaaatccagtgagtttgtcaatatttgctgaataaactgatgtagttctcccattggaacattaatatgtgtaggttcttctggagactttccttttacccttgtttggttcaatatgtgcattttctgtccaaggaaggatttgtggtctgaatatggcttttattaatcttctactcaactgccttgacaactgattttttaatactgaaaaaatatctcgaggaatgctttccactaaaggacttggagttttaaacttcatgtagatttggcaacaaaataaaacacacacacacgatttggggtatgtgtcttacataaatagaactggtaatttgtcatccctataaaacacagatggggatcaaatttgtatcaggataaatgataaagtgtgctatgctgtataacaatcccacagaactcagtcatcaatagaaaaccaaaaattcctttatttttttgctcttactacttgtccatcatggttctcctgtgaattggctgatgcaacagctgttatttgaaaggttgctagcagatgtggtatagggagaaattatgtgctctaccctagaaatgatagaaattgttctcactcattcctattcactggccagaacttgtcactggctagattacattt

SEQ ID NO: 63659 - DNA, 2742 bp, Bovine  19866880808804
taatacataaagcaaaagattttacagtacagacttctagaatctctataagacatttgctccagaaaccaatcaagctccttccacaaaggccctccatcttgttctcggttacctatgaaagccatagcttggtcttttgggtaaaaaatgataagttcctaatcagtcttggtccattcattttggcttttggttggaagagactctaacttaaacaagaaagaaatttatcaaagggatgtgggggaggtcacaaaattgggttggaagctggagttttcacaaggacaggaagcaggacagatgcataagcaccaagagccaatagacggattttgctccaaccattttctatctttttgttcttctcagaaaactcaatcagggacagaagttgtgattggcccaacttggttcacaggcccacatgctgatcagggaaggacgggcaccctgatgggttgtctcaacaaggcggtgtttgatagaatagtggctcccccacagacaaactggttctgttactgggctccaccagcacaaatgctgagggaaagacaccaaatatgtcccatctatttgatgaccactcattcacgccttctcccctctttcccatgtgcctatgcatacctagacaggagagagaccagccaacccagccctgtggtgggtgaatggcaaaggggatgaggtgaaatggagctttggagaactgggctccttgtcccgaaaggctgccaatgtgctcaccaagccctgtggtttagagagaggagaccgagtggccgtgattcttccccgaatcccagagtggtggcttataaacgtggcttgtatgagaacaggtcagtgccaatatttaacatttctaaatcatgcagaaacagaaaaagactgaaagtagaggtttttctgaattgttagtcctgactgaagttatgcttacaaagaacagaaaaactgggttgaaattagaagcagtcatgatgcaataataaaacactacctcaagaggtaagtattattgatgcgatgcccattttgtgagaaaggaaactgatgttcagaaaggttaaatttgcccagagtcacacagctagaaagctatgcaattggagcttaaacacaaaactctataaaagcaaatgtgggtaccaatacctctttgcagtgctggttatgatgtgttcatccagatgctccagaacttccttctctgaatacatttggattctccctgacatagcagtacaaaaggaagaaaaaaggactataacaaaatgacttttaagactaaggttgtagattccagctggaaaacctttgcctcttcccagaaaattaatgtattaaatgacacattttctcccacagtagtaatttataatgtaccccagtaaaatttctacagaactctttccctttctaggacagagttcagcagaaaccacggccagtgagttggccatctatttttgtaaataaagctttaaagttataatggaatacagccatgctcactcatttacgtattgtctatagctctttttgcactacaacagcagaattgctgattgaaatagagatggtacgactcacaaagcctaaaatgtttacaatctggccttttactgaaaaagtttgcacacacaacataaatgtttataagtcaatcaaaaataaacaagaataccgaaggatatactactatacagaacacaaaaacgcttgttgcaatatcattaataataggaaaaaatggaaacaactatataggaactattaaataacttaaaaactagctgagaataaagtttagtgagggtgtggttattgctaattgaaattatgatgcttcaatttgctggaatgtcattaaaagaataattacaaggatttcataatagtgttgaaaaatgctctcattgccaatattacataaaatagcaatatataaaattctttttacattcactataaaaaggaatttgcaaatgtgaaaccaattgtgggttggaaagagattaaaggttttatttgtcataaaaatatactaatattacttaacataatgtatgccatttgtgaaatgctgagattaaaaacaaacccacaagcagaatggtcaaaaatatacaattaattaaatgttaaacaagcgcctgagggattatgttttcaagttcagaataattaaatctcagtaaacagagatactagtactatgcaccacatagctaaatactttgcttttgctgtaaagcgtaaaaatctgaaatccactagaagagaacttactcctgacccccaagctatccattgaatacatccacatcacaaatcccccaagagtactaataacttctgagccactaagaacaaatggtttgcaaaatcttatatttttatattgagtgaatgatgagatattttcttgattaacttatcacatcaaatatttattcatcttctcaagaggggatgacatgtaagagcttttaagatacattcagtaattgaagtttccttcctaggaattcaactccatatcttcctatttagcctacttcagggaactcaccaagaaataaggagtctggtatatgacacaggtcttggagtctggggaagtgtatctttaatcttgggtctgccacttactttacagcccctgggctagttgtcgtctgtctgctgggattaattttaagtgagataccaggcatatattatata

SEQ ID NO: 63660 - DNA, 600 bp, Bovine  19866880967918
atttttctttgtatgaatctgtgtaaatgattaaaaaataaagctgtaaaatatttgtatgaagaataaatgaaactgacatggctttgagtcctgcttttgggtgtgcatttggtgtgctgggaagggagttgctgtttggaagttggtgttcaacagtttttctctctttatctttcaaattctcagtggaacatcgattacccagcatctacccagtaattattcagcacctagtacacgggaggtacacgaatgagatggtcagggtccctgtgttcgtggtgctgatggtttagcaggagagtcaggtgtttagcaattttttacttgtgttacttcaatacagaaaaatatggggtacaatataattgcttggtattttttattacaaattatcacatggaaagacttcagtagtctttttcaatacttagggcattgagatgccagcatttcaatgctggctgtgctgggttttatcagaaactagagacatatcaagatgggtctctatcctagggaaaaattttaaaatatgcatatttatatttggaggtaaatgtctacggccatgttagagtttgaaatgtctaaaag

SEQ ID NO: 63661 - DNA, 2777 bp, Bovine  19866881018169
agtctcttttatgtctcctgcattggcaggtgggctctttaccactagcgctccctgggaagctctgatatatatacatctatggatgggcttccctaatagctcagttgaaaaagaatccgcctgcaatgcaggagaccccagtttcatttctgggtcaggaagatccactggagaagggatcggctacccactccagtattcttgggcttcccttgtggctcagctggtaaagaatctgcctgccatgcaggagacctggatttgatccctgggttgggaagatccctggagaagggaaaggttacccactccagtattctggcctgggaaattccatggactataaagtccatagggtcgcaaagagttggacacaactgagcaactctcactccacttatggatgggcaaaggaagatgtaaaacagattcttcttgtttttggtggcacggcatggcttacaagatcttagttcccaaaccagggattgaacctgtgccctctgcaatgaaaagcatgtagttgtaaccactgcactgctagggaagtcccacgacagattcctaagagaggtagaggagggtcaggaaaaggctggggaatggcaatgggcacaggcagggagggtggggggagggccacaggggatcacacccaccgcagagtttccgcagtgcacgctctgagtagttgtcacggtcacagcccttggccacatggctggtctgcagctctatggtggcctgaatgttccagagaggttcatcacaggtctccaggcggataccagggaacagagccaagctcccggcgcctggtgcatattcaatccttttgttccagcctgcaggggtgagagggagcaggcagtggagcagagccggttaaggcagcccctcctacccattctgctgatggtcttgggttcctatgaaaatggccagccaggggagacagctacaagtctgccccccaaatgttgtcgttcagttgcttagtcgtgtccacgccccccaaatgttgtcgttcagttgcttagtcgtgtccacgcccatggactgtagcacaccaggcgtccctgtccttcaccatcccccggagtttgcccaagttcatatccattgaatcgatgatgccacctaaccatcttatcctctgtcatcccctcctcctcctgccctcaatctttcccagcatcagggccttttctaataagtcaactcttcgcatcaggtggccccccatatatccctcccgagctcctagcctggcccctgtggttgtcagaagggaggaagagagaaaccaaggtgaaggatggatcatgggccccaaagcatagttcctcaccttgccagctgggtttacaggtgggcttcacctggatctccacctcagcatcgtccgccgcccgcttcttcccgcagtcataagccgtcactgtgaacttgtagagcttctcaccactgtactgtagcttctccgtgttctcaatgttccctggggtaggggacagagaggatcaggggcactagaggaggtccgggggaggactcaggagctaactttagggcaggtgaattaggcagcaggaagcaggcaggaaagaatctggggaaagaagttccatgtctgggaagcaggatgaggaatgaggaggtgaggggcagaacaagtggagggcgcagccccggagcatcacgaaggatgtgggcgcccagggctgagcagctggggtggcagaggctggactcaccgtcattgtcgatgaggaagggggtattgggtgtgaggatctcgtaatagcagatctggctgtactggggggagcagtcgccatcaatggcctccacccgaaggatgcggtcatacagcttcccctcggtcactgccgcgcgatacagccgctccacaaacaccggggcaaactcgttcacgtcgttgacccgcacatgtacggtggccctgcgggtgccagagcaaaaagagaagaaggaagggtcagccacagatgggagtccacaccagaagccaaggagatggaaccagtgtgacccagagcctggtcacgttcatccgtcccccattcaggggtaccaggtaccacaaagggagaggaacctcaggagaaagggtgactgatgtacagggtgaaaatgaccctgggggccatcagtggctggttttgatgacttctgtacagaatattaaaggataggatggcaagatgcataagacaggattctgaatccggcaggttgttttttcatgaaatcaggtccaatcaaggcagatgcagagtaaaagccaaaataaaaccaaccatattcagggaagtggcttccccagtggctaagcggtaaaaaatttgcctgcaatgcaggagaagcaggagacacagattcgatccctaggtctgaaagatcccctggagaagggcatggcaacccactccagtattcttgcctggagaaccccatggacagaggagcctggggggctacagtccataaggtcgcagagtcggacacaactgagcaactgagcacacacacatattcagggaagtggttttgtaccaaagtctcaagtcatctgatgtgtgcagtgagctgtggccactccccactccggcccccatggggcaagcagaggagctggggctggggctaaacccttcatgctgagccttgcccccagcccagatccaggcacccaaagcccagaggcaaaggtcctatctccaaatggaaattagtcatcacgtaaagca

SEQ ID NO: 63662 - DNA, 769 bp, Bovine  19866881081338
acacacacacacacacacacacacacaccatcccagaaggaaaaaatgaaagaaacagcttaaaagttggaaggttgctgactctctgcagggttcctcctccagcagaggaacaggctgtgaaattatgacggggacggatcatagtatgaatcggctgcaggtacagaaagtgagatgctggtgatggccgagtcagaggggatgactagtccagcaggcaggagaccagaggggcggtggtctcctccagcggagagctttcccagcctccctgccccacttcagggagacgaggtcataaggtcaagctgcccttgctcctccaccaaccactgggcccctctaccatgagcgcctccgtggagaagcttggggttgaggcagggggacttaccagcccagcaggccccaatcatgagcgcgggctcccttcgaggcgggtggatgagaccattgtcgtggatgagggcggggtcgaaggagatgccatctgcatagagtgtgaccgtggggaactcgagattcaaagcatagtggtgccactcgtcatcgcagacctgggaacggggaagggcaggaagccctcggttactgcatccccaggaaggagccccaggcactgccccatcccctggggggcaggagacagtccttcatattccctggtctatcaacagggcttgcagtgaattgctgcagacccagctcaaggaatccttgcccagaatggaccaggctcaacctcatacctaaactacctaaaatt

SEQ ID NO: 63663 - DNA, 1032 bp, Bovine  19866881185186
taagtaaattaatataatttgagtgagtgctaagtcgcttctgtccaaatctttgcaacattatggactgtagaccacccaggctactctgtccacaagcattctccaggcaagaatactggagggggttgccattcacttctcccagggggtcttctcgaaccagggattgaacctgtgactctgtgtctcctgctttggcacgtgggttctttaccattagtgccacttgtgaagctcttcaaattatataatttaggtaaagatttaattaatataggtaaagatttaattaatataagtaaagttcttaacacaatacccagctcatagtggttctcaataaattactggggtgttttttatctatttttttcattaccatcatcaccatcaagatacacgtttgattacatgtttgactttcacaaaagcaattcatggagtgatccaagccaagtcaatacttcataagagttacaaagggaatcctcactccctgtattgctcaatatttgccctgcttccagtctcatggctggatcaatgaggcacaaagaggtgagccttaccctcagcaacatagtacgcagcaaacccggtgaaacgctcctcgttggagaagtccgaccggaagatcacctgcaatttactgtatgggatgtggaactctttcaccactggggagtttgaattcttgttggtcctccgtccacagagtttcccttcttcatggcctcccgacattatctaagagaagagtcaaaagaacccaggaaagggtaatattttggcatggagggtagagagatagaccacttcccaccttaggactatgtgacccggcttactgtgtgctcacgctctcagtccaccaccccagccccatcctttcgcacccatcacagtgtacctgcactgaatcataggagcagttctcagacaactctatatccaggtgggtgaagtaaaggtggatcccgtaccctgcagggacttctatgtcccaagacttctcgacctcgttggggt

SEQ ID NO: 63664 - DNA, 1069 bp, Bovine  19866881367536
aactttgctggcggatttaagcatttctggttcttgatctctttcacaattataatgaagaatggcctcatctatgttcttatttcgtagttttattctggtttgtccttaactgtacttagaaagggccttgccctgtgtcttgtatcttgttttcattctggtgtgttgttttgtggtggtgacccctgctctcctcaaaggagcgttttgttccctagtcacagtcacatgcttactaggaatccagtttacctaacacctctctgctgcgtggacggccccgggacagaactcagcacaatagcatcctaacccctcaaatgagaacacctccactagaacaggacgtgactctgaagccttttctgcctgcaggattttggaatttagctttcatttattatcagatacagattaatactaataacttttaagaatgaaactggagaataaattaagtttttcaaagtgcttgaatactatcctgtcagtacgcacaggactctgcgagctgggtgagagttgcaattgaatagcagagcctcaaatcacatttcctttatatattatctcactattgcaagataacaagaaatgccctttgaatagctaaagagagcttatctcataccctaagcagatcctgttaagaaatgtgctctgtccagtgctgaggagtcaaggatgtggaaatatcagccgataaagacttcctaaaaataaagtttaattgcagtgtggatcagagtttgccaggctttccagctgctgggagcagggtagcagcgtgggctgacttcactgtggttgcggacagtctccttcatgacatgaagtgtttgccagcatttctccgatccctttgtggaggccctccacttcctctccacctcttgcctgtcttggttgtcatctctcattcccactgctccatagcagctccctctgagattccaccttctgagaccgggtctcacctggctcctcttccttgtaggggtaccactttgaggaagagaaccccctgcgggaccacccccagccttttgaggaggggctgcggcgg

SEQ ID NO: 63665 - DNA, 1035 bp, Bovine  19866881398751
ccagtttgcccaaatatattaaatatattagtgtctcctatgaaataatagtccataagactaactctttttttaaatcttaagttccccaaccagggatagaacccagaccagaccctggtagtgaaagcatcaagttctaaccactggacttccagggaattcccatagaactaaatcttaaaatgatgagattttctacttggaaaagaatttttcaaatgaaacattgaaatgctttgaattttaaatcctttgattagaagtaaatactacattgacaagaaggaaaagactagacacatatggacgagtgtatataaactaacaaattcttaataattttctaaggaaaaaaaaatatcctttaaagggcttttgaatgaaaataaagaaatgttactttggttttatgatctcagggttcccgcactgttcccaaaaaaaagttcaaaagaaatacaaatggacaataagctaatgggcaatcagcccataaaaggctgaagagaaaataaaaatgaatacagaagatttcaggtctaaattcccttcaaatgtattgttgcaaattgaaagatattttaaaatcttcttgtcctaagatcttaaaatcaaaaaatagaagttacaatagcaaaaataaataagaattaaattttaatccaaattaactcaaattgaagtaaattggtatatgaactttggacatacaagatttctgtatatttttgttctgatttttcccacattataaaataaaaatgcaaatatggcattaacccttatgtaagactttgaatttttctttctagaagcctagattaaatgaaacatcctaaattacttatacttgctgtagagataaagtaagttattacctttgtcattattaagagcatataaaagtatgtaggtgggccacatggatgtttaaataagtttattctattaatgtttaaatttaataattcaaataatgtcttttaaaatgattttcttaatcttagtcattagtataaattccatagacta

SEQ ID NO: 63666 - DNA, 1243 bp, Bovine  19866880368317
atgggacatcctgaggcaggacatgtgcaatgagtggttttgatgctaatgagcccagtagaatgggaattacctgctttctaatcttcctcaacaaacatttctcgaacctctacctgggccaagcacttcatgggaatgtatttggcaaattgatgaaaaatcagaaccattaaggccttctgaagtcagaaagaggacagaaaaggtaaaagagacaaagggttgaggaaaggactggagcttagaattaggtaaatgaggagagctaagtctggactgagtggccactgtgagaaacgactgctcagtcagattcccacgtgtgtccatggaatcaccagctggatctgtgatcctgtgacttctggaagcagaggtgtctgtggcgttagggagaggacaagtctgttccggaggcaggctgcctgaggtgccatctcagatctagcaccacagctatgggattcggctaattctttaatctctccatcctcaatcctctatcctcccccttctctagcctccatccctccatctgtacaatgaagtttataacaggacctcgtgggattgttgctagaagttggtaatccatggagggcactctgcacagggccttgcactctgtcatgatgcttgaataggtttgctcctgctctgcgacagcgtacatactgtgtgtgggcagagaggcaacttgagaaatggaaagggcacctgcccttgggatgtggtccttgcaaacacccctcccctctctgagctccctgggggatgaggatggacaaatcagccaacgcagcaagcagcttgaggaataaagctgggatacattctctgtggagtcattcatctcaccacagacattcacagagacacacaatttctcttctcttaagtttatagcttatggagtatcttagcttctgatggactacaggtaccttctggtgagacttcagcaattttctcaatttttgtttaataagagtaattcactctacgtgccaaggtctgcataaatagtttctgacagatgaaacagtttataaatcctcaagagctttttattatccttgaaaaaacctttacacttagtatctgcgtgccctgagggcttgaaggactttctaaagaacaaatgcaggcatttatttatttatttattttttacagaacaaacatattgtcctgcacagctaaggcttcttccaattccaaaccttggaaatcctgttcg

SEQ ID NO: 63667 - DNA, 1617 bp, Bovine  19866880372866
caagagtactggagtggggtgcattgccttctccaaacatatacattaccatatgtaaaatagatagccaatgggcatttgctgtgtgacacaaggaacgcaaagcaggtgctctgtgataacctcgtggtggggtaggggtaggggggaggaggtggtggggtggggagggagggcgggagtgaggtttaagagggaggggacatatgtatacctatggctgattcatgctgatgtatggcagaaaccataacaatactgtaaaataattaccctccaattaaaaattaaattaaattaaaaaaaaaaaactaccacctcttcaaactcagtgcttgaactgtgtcacagtatacagtatgtgaagaaagagaatactaaataaatcagaggaataaagcagatagttggaagcatgtttaagtgacttgagagagcaaatggttttcaagcactttaaacactttaaacacatcaattcctcaacatgcataggctatgctaattgtaaatctttcattaaaaaccagtctctagaggctctctccaggcaacatcttgcaagcctagttctgattactatttcttctttaaagtaaaaagacagtgcttccataagcatattctataatttgtatttcagttggtatcataccatattctttgaataactaaatcagttttcaggtgctttgtaatatatggttttattcaaatgtattagtcccctgatctcagttttcacttataggtaagtagctagcttataactgcttttagaattttttttctattggatgatcaagaacatgatcatctgtgaatgttctcataaatctgacattatctataatgtgtaattgagccacattgttcttcagcatatagttaggtaatttaaatagatcaaaggtatataagatgtcactttaaagcattttgccaagtcaaagaagaattgagttggtcagaggttgtcaaatagattttgaaatatttctgtctttgctttttttttgtcatcagtttgtttttttttaatataggacagaaattaacggagtttattgttttccttcttggagtccttacatacttgtaagaattagttgagatcttaagaacttttagaaaaatattttatttatttatcgggctgtgttgcatcttatttgcagcaagcaagctctttgttgcagcacacaggcttctctagttgtgggctctagagcacatgggcttcattgccctgaggcataaggaatcttagttccccaaccaaggactgaacccttattcactgcattggaagccagattcttaactactggaccaccaggcaaggccctacaaaaaaaaaaattttttttttcctccaaaatttttaaatccaaataaagaagtgttattttaagggagctaatttcacgtggttcctttaaatttatttatgggataaattaaatctataaaaacagtagaaaaatatgtattggaaaagataaaggattccaataaaatttactaagaaaagaactaaactatgtagcccaatgctgttgtgtgtgcagtaaatgtcagcaaatatttccagaagaatgaatgacccagcttcca

SEQ ID NO: 63668 - DNA, 1825 bp, Bovine  19866880434901
cttcctgtgactcaccctgggccacatggtctattctgccagtggccggacagcaatgttagactctcacaccctcacccggttgggctgactctcagagtatgtgacgagaaggtggcctttctgaacaagttaagtgccttttcgtctcagggccaacacggacctactttctgaccttactttccattgatgtcttggtttttggtcaccagtggcaactgtctcaaaaacataggctttcacatgcctctggcagcagtgttattcttctactttactccttcccttaagtgaaatatgcatactctatgtaagaattggattcctggggtgcgtttgatgaatcacccattttattcagccgtgggtgaatctgcctaccttttcctatatgtgaattcagcctttccctctttgagctttcggaaaattattagtcctcattaagatggatgtgaagtgagtggtatccctctccctttttaaatcactatgcatacatgctcaatcacttagttgtgcccaactctttgcaaccccatcgactatggcctaccaggcttctctgaccatgggatttcccaggcaagaatactggagtgggctgctatttcctcctccaggggatcttcctgcctcagggatggaacccacgtctcctgtggagtctttaccactgagccacctgggaagccccataattaatgtggatcacagcctggttcttttaaaaccactcccctccaggtatcttgagttgagtggagaagagcaaggaaagtgaacgatgatgtgggtggtgggggtaatgtagaaagtgtttcagaaagggacacatgttacgattctcagttcagggtggcgcgtaggctttgagggcaccagcgtgggctgcagcctcgtcctgacctttgctggctgtagcactgtaactttgccttgctgagatacccacctcatttttaagattgtttcgaggattcagtgaaatagtaatatacggaaagcacttatcttggcacacagtaagttgctcttaaaaatggtagcttttgttattatttcaatgaatgctgcaataatatttatatgaccaatggtgaagaaagaactccagggaaaagaccaggcatcatgtcaagacttttaaaaaaaatacaatagagcagttgtgtttatagaagagtcatctggctggcagcagcccataattttgatgaattaggaatctccacttgaaagataataaaatatgttaagcaataactgaagctgtttagcaaattaggattcagaattatgcaatagttgagcttctatagcctgaccactctgaaacataagtaaagatctccatctgtgactgtgtaactgcactcaaactcaccccctttagatatattcctattgtttggatctttaacctgcatttaaactgaaaccagaagggaaaaaatgaaattgcatagacttgataaactaatgataatggttaacattgagcacttcccaggggatatgcattatcttgtttaatactcacaataattctctgaagaagggaaaattattatttttttttatagatgaggaaactgaggtgtgagttgtttaacttgcccaacgtcatccactgaattaggagcactgtctttggaatacctgcctttagccccagtacttggggcaactttacccttcccccagcggacgtttaacaatacctggagatgtttttgattgtcataacaggaggtataaccagcatttggtgggcagagactagggaggatttaaacatcctgcaatgcctaggaaaata

SEQ ID NO: 63669 - DNA, 996 bp, Bovine  19866880444080
tggcctctcttcataaaatatccatcacggctacaagagaactctatagtaaaataatattccagggcattttccctttgtaagacagagagagctggcttccataggaatacagaaggaactctgtaaaccatctgcagcaacagaaaagtccagctttgaacccctgtgtctgtgtgtgtcgtcatctcgccctcatagaccctcagtcactgcacaatgttctgccctttcagatggcagagttacaagaatgtatagtttaaactctgcattttgcaaaagatgagcattatttttgagtctgggaaacttcaaaataatttgattgccttctgtgttttgtctcattaggcaaaggcaaaaaagctttgcttttctgtaccaatatacagcttgtgttttaattaaaacaagaactaggctcatgaccaggggggaaaatcatgaaacagaaaccctataatacgtaaaagggctacggttggagagtaagaagaggagttttaaacttgggcatctcttctgtaaacatctttttcaaatgtattatgcatttcccttccctcttcctgccactaaaccaggaaagaagcataaaggctgtcagaaaaggttgtttacagaatttcaacaacacaggcaggtttatgggagacaacatttcttgttgggcttcccggtgcaatgataaagaattcgcctgtcaatgcaagaggcacaagagatgtaggtttgatccctgggttgtgaagattctctggaagaggaaatggcaacccactccattattcttgcttggaaaattccatggacagaggggtctggtgggctacagcctatggggtcgcagagttggacatgactgagagagtatgcatgcacacacatttttttgttataccagtgaattagcaagttgaacacatctttggggggattttttcccctaatgttagcatttgaattatatccacttagcccttaaagcagatg

SEQ ID NO: 63670 - DNA, 2048 bp, Bovine  19866880455388
tgggtggcagttgtcagtaccagcattgcccttggttaaatatgtgaagagaggacattttctatgaagttctcttctatctgccttcctctcttattcttcatcctctcccacaaggtcccagagcttgctcctggggaactcactttcatatttgacctccattaacaaattctgaaaatattttcattctcctttctccatcactgtctgtatctttcccatttcttcaaatccccattaggtaactggttaatctgaaaagttagttctagaacagtgccactcaaagtgtgaagctcctacaagcagcatcatcataacatgggaatttattaaaatgtataatatctgcccatcccccagctaatgaattctgggagagagaaacagtaatcggtgtttttggtgtggtttatatgatccttatacaaacttataactgagagacactgttgcagggtataaataagagatcatggatcatcgtcactttcagatgtcatgtattctgctttttaaagaagccctggaagtcttattctaaaagcatgactatgtgaaaactgggcagaagacatcctattgtgtaccgctaaccatcctacatagtagccctgggttcccgaggctgtgagaaccatactgatgacagagaggctagtttcaaatagggacctcggaatgtacactcagaagccatcagaacatcttgcttgaagttcccgacaggtagattagaatatcgtggcactcagccacagccccagtgttcggaagagagagaaaaagagctcctgaaacagcctcccttgtgatgctaatggcccacctccaacgacacatcatttattgaattgaaaggaggtctgatatgggcaaggtgtgatgacctggcaatttattttacttctccgtgtcacagacctgtttctgtgggcccagcagggtcaaagagcttaaaacgttatctagaataagacaaacgtgttattttcctcttgctttattcttctattttttttcccttaatgattaattaagagacattcctcttcttgagaaatttgagatgaggctgtaccaaccattatggtcattcataatagctaatgtctacaagattaagcttgcttgggaatccatgggccagaatttctagcgaaagaatttttactaagcctatgtaccgccacctccttcccaaatcttttctgtaccgtatcatcctctcaggcataaattttccaccagagaaggatttagccttctctgtaaagtcttttaggatgatgtgtcttctggctggcagtgtttgaaagtcaagcaaacaagccttccagggctcacattgagttaagaaaacattttctgcatgacatttagggccaaattagggaccaaagtcctcattcttttactcaagactaggtttatgtctccacaggcaatgtgaaatggggtgtggagaaatgatctcatgaaataaattaatttagacaggatgcctattttgttcataccccacagagagagagtgtgtgtgtgtgcgtgcctgtgggcttaacagcaggttagggaaacagtaacaacgaagagatgaagggaaagagctctaagtagtggtaagatcaggcttttcctctaggcattactgtttaccaatcatatgacctggggcgagacttctagagcctctgttttctcgacttttagatgattttatgaaacccatttgactacttcccagggttgtaaggaacaggataattaacaagtgtattccatatagatatatcaaagttgttactgtcattaactatcccttctaatatttgcacccagttccgtagagacacattttctgggggacgtgttcacacaccatgactttgaacttttatcctctcccacccagacactggagccacacacttaccaacactagatgaacttgctgtccgagtaatgatcctaaccatagttgcccccagaacaagatatcagaataggaaatgaatctagcttctcacaggaaggccaaggca

SEQ ID NO: 63671 - DNA, 1918 bp, Bovine  19866880459910
gatgttttcttttcttccttctttatactctttttggctggcaataacataaaatgtgaatattctctgaattaggagatgttatcactttatattggaaaagctcattgcagttttattatttaaggtaatcttatatagtttacactagcaaaactttttatatatacagttttgcataaattaatcgtaactttttaggtattttttaaattgtgttttttattacagaaattgaaattagccatgaatagttaatatttttaagtaatttataaactaattatattgataagctgtataagggaatttagatggtccctttaagaatcagactttagtaaatgttatttattattagctagatttttttaatgcttcatgaaatatatatatgacagattataagaatatgttttattatcatccacagctgataaaatactgggaggcattcctacctgaggccaaagccattgcctagcaagaagattattcctgttaagaagatcttggatgcttgttccagttatgcagaattccatagtgaaatcattaaaaaccatctaaataaaccactatatattttatgaattacatgtggttttttataaatatatattctgacattttattacaagctgcatgtcctgaccgtctttgaattaagtggactgtggcatgacattctgcaatactttgctgaattgaacactattgtgtcttaaatacttgcactaaaaagtgcactgcgaggccagaaaattttacaatattttttctttacagtatgttctgtagtgtgttcaccctctttatgaagtgaattatcaatgcattgattaatgttcacttatacattcctgtacagaaattatgattttgtgattacagtaataaaattatattccttgtgaagtattagtaacaaattatttgggtatgtaaacatattagaagtcttttgaaagcattttaatacaaagaaactttttcttttagatgtatttaggtgatgctatgatcattaattttttaattgaccaaaaaagctgaactctttcattactaagtcactaaatgaaggttaattaagttttgtttttgcaaaatcatcataaaccaaagaacatttatctcttggttcatctttgagagatgctttttgtcttgagtaaaggagtaaatagttgtcttgttttttatcctttcctattataagtgcccaatttaacaattaaaaaaatatttatctgtttctgttacaggtcctatggattttgctcatcttctattaccttcaaagtctaagactttgcatatatttaatttattccttaccttgccttttttttgttgttttaagctaaaagatcatctgtggtcatcgttgacagagaaaagtgctgtgctaaaatacccagtgatttgatgaatagccaatgatggtacaaagcaaatttgaagtaaagtgaaatttgtctttggcaaccatctcacctatttctgtatcatgtttacatggcagttatataatccttgatgttgatgaaaatttaagttgtgactagcatcagacttttcttaaagatgctcctcagttgtgtctcccttctggaagggtaagatgtatgtgtaactgagtcttttctaacagcttactgaacacagttaacgtagcagagtctcctcaggcgatgtttgtgcacttcttttagttgaaatttttagcctcttgtaggtattgttcatatttataatcctagaacctagaagaatacctgacacttataggttaataataaagacttgatgaattgaacagaaaaaaaaaaaatcccggacgatgcaaaataatgtttgccgtcttaagaacaaggagaaactgaatcggaaacagtacagtcttctgttgttg

SEQ ID NO: 63672 - DNA, 1224 bp, Bovine  19866880482351
caaagcttgattttccttacctgcaaaataaggtgatattttgcagataataagtttggatttcctctaccctgtcttccaaagaattctgtgatgataaaataaattaataatgtaaaaatgcctcataaaatgtaatataaatgaaaattttactgcctaggagtaagaactcagcttctgtatagagttacaattgtaactgagtaagctttagaaaaatattgtaatacagcacttctgagtaacttctcacaatatatagtttatacatggagtacagtttttcatttgaaagtactgttttattttgtaattcctagttgtttgcaaaagttttatataaaaatgaactaacaagttaaaattccctacatttaatttattcacagaagcatgttaaataagaacttttctctctcttcatagatattttatcttcaaactaaaatatatattcaatattatatactttaagtcaaaatcttaactaggatttttatcaagtctattttgagcacttcatatggtcctagtagtatgataagcattatgtcacttaatgttcacatcggaaaaaaacaattattctccccatttttctccccatctttcagataagaaaactgatacttaactaagtcattgtcaaccgatagtaagagacaaacctgggatttggagttcagtctgtttcaccctaatctcacccttagaacccccatgtttgtgatacaccaaagagaaaaagaatgctgaagaactggagggtggttcttttgcattcatttgcgttattttcacatttcattaaaggattactttagaaagactacaggaaagaaatcaaaagaactggaaaagataattgattcatggacaagggctaattgcttcctacttggtctttagttaagaaatgaaggaaattttactgagagtcagaattgttaaagatatgaattattaaagggagttgcaatatctacttttctgaaggactctacacagattaaatctcatcttcggtagactctgtgaaattcagttaggaaactagaatcaaaggagtgactaaaactagttcagtgagccaccacatgaatatgatagcttatgaatgtttataaaggaaaaattcaatgtaaaatttttctttaagaaataaaacctaaaaataccttagaagccaataatggtacttactaaaaggataaaaaagaa

SEQ ID NO: 63673 - DNA, 2090 bp, Bovine  19866880537346
accttcccagagctcctctgcaggccagaagagaagcgggagcattgacttccgttgacatttacccacgctaggcactggggtaaaaaaacgaagatttgaagatccttggttcctgccctcaaggagcttcagaggtagaaatgtgtatatgaaatgggtttaaactatataaagtgatttttctttcatgccagtcaatggctttgagagtatgaggtggagatcaagcccattaaaaatggccgtggaggggcaatctcagcttcattgagttcctactgtgtgcaagaccctgtgagcaaaggattattagaaacatataaaactgaggaactgaagttcatctgaaactttaatatgcctgtttctatgaatttcaagtgtgaaattacacaattatctaacttaaagtcggtggccacaaatggttaatttagggaacatagaacaaactgtggaaaattcttcaagagatgggaatgccagaccaccttacctgcttcctgagaaacctgtatgcaggtcaagaagtaacagaactggacatggaacaacagactggttccagattgggaaaggaatatgtcaaggctgtatattttcaccctgcttatttaacttatatgcagagtatatcatgagaaatgccaggctggatgaagcacaagctggaatcaagattgcagggagaaatgtcaataagttcagatatgcagatgacaccatacttatggcagaaagtgaagaggaactaaagagcctcttgatgaaagtgaaacaggagagggaaaaatctggcttaaaactcaactttcaaaaaatgaaaatcatgacatccaatcccatcacttcatggtgaatagatggggaaacaatgaaaacagcaagagactttattttggggggctccaaaatcactgcagatggtgactgtagccccgaaattaaaagacgcttgctctgtggaagaaaagctatgaccaaccaagacagcatattaaaaagcagagacattactttggcaacaaaggtccatctagtcaaggctgtggtttttccagtggtcatgtatggatgtgagagttgggccataaggaaagctgagcaccgaagaattgatgcttttaaactgtagtgttggagaagactcttgagaatcccttggacaccaaagagatccaaccagtccatcctaaaggaaatcagtcctgaatattcattggaaggactgatgctgaagctgaaggtccaatactttggccacctgatgtgaagaactgactcattggaaaaaaaccctgatgctgggaaaggttgatggcaggaggagaaggggatgacagaggacaaaatagttggctagcatccccagctcaatggacatgggtttgaacaagctccaggggatggtgaagaacagggaagcctggcatactgcagtctgtggggttgcatagagttggacatgactgagcaactgaacaagaaccataagttgggtttgagtatgatgattgggaaggggtgagaagtggagagcaagtgaatatggttcttacatcttagagtgaaaaaggagattgattaaacactgattgtattccagaaattaggggaaatctatttacttgagagagctaaaattgaatgctgtgaaaccctgatgattcttgctgcacgctgcattgatctgagtgctgaatgtatctaccttgacaggttcaggccacctttcaaaaaaattctttgaaaaaaatcaattatttaattgatctatatatttatgtttgctcctattcactgttatttactatttcacctaggctgccaacttttaaacaatcttggtacaaatgtttggtcctaaacattagcagatagatgtgttttatataacagttatggagtccattaacatgaagcactaaagcacaaaaagaaacgaaagagatttataagcatgtgaaatgccctcaccagagacagtggaaataaatccaaagtcagaggaacatttatgaagttactgcaagcagatttatctacttcaaaacatgtttttgtgggactgaaacatacctaatcta

SEQ ID NO: 63674 - DNA, 1542 bp, Bovine  19866880544934
ttttctttaaaaattagaaatttgggaaagcttagattattaatactttcaagtaactttaaaagacttctagcactactgtttcacagaaatacccaattctgagcccaagtgctggtaacaacagtagtctagagggcaactttttcttggctgcaactagagatattattagcatcttcagaagcaaacgtcatctcccccaccaaaaaaagttggcaaagtaaagtggtggcatttgtctcctcgttaaaacatcagattgacaaagtccatgtactactccgtttcaaaaagtcccagctcttttaaacactggcattcttatcattttgtgcattcactgctgactgctggctaacggtgtctgtgtggagttctccttgagtatctttccccatcaactgataagccagtcgctcctaggatttctggtcaagagcagtgctcaagaaagaaagctgatagtacatatttgaaattgttgcagtccacattccttctcttgttctgtttatttgtttctttctttctatttgaaggtaggtctagaggctacttactgcgctttcagatggagatggcccgggcacagagtggcagtttaatacactttccttgggaaggaaagacaccgaccctgtaaatctaagctgtatttgctgtcgtagggctaatccatgggccataaaattagagtcaaatataaaataaacggcaaaccactgtgttcacatcaatctatacaaataagctaatgtattattttaggagtgaaaacaatactcttaatagctccttaaatacatgttaaagttccagtacttgcgaatttatttttacaataaaaatgttaggattaaggaaaatagaaaaaaatgatcaaaagccctgttctctcgaaagacgtaacttcagggctttgttgtttttccttagccttttggttgttttgctcatctaactttttattttatttttcactgcatttgattaatagaatattctctgggatgtctttttaatatttagcctgcagtaggtctttgttgctgcgtctgggccttttctagttgcagggtgggggtttctcattgcagtgaattgacaggtgggttctttaccattggatcaccagagaagtcctgaggtggcttttatgacgatgtgtaagtcatgactttaaaatgtttttggaagacagaagatgctttacagaaatgaaaaagtgtcaagtattctttcctgccacaacaaagacattgttcaaaagaaaagattttcagatcttgcaaccactgcagtcattttctttattttttttcttttctttttttaaaatttatttttaattggaggatgattgctttacaatgttgtgttgatttctgccatacaacaatgtgaatcagccaaaagtatacataagtccccaccccccaccccatcccatccctccaggtgtcgcagagcaccaggtcaaacagcaaccccaccccatctgttttacatatggtggtgtccgtatctcagtgccactcc

SEQ ID NO: 63675 - DNA, 1212 bp, Bovine  19866880578570
aggaggagaccaaggctcagaaaagtcaaatccgcccaaagtcaaacaaactgaaaagtgatgggatcaggatttggcctaaagagtaagactctggaatctccctgagatagaagcttctaaatccttctagtgactaagatctggggaatttttatgttttttttttcttttgtgccacttatgtgactttaaaatacgaggctgtgaattcctacaaggaaacttgactcctattatacacaccctcatcctttcatagctaacacttccttgcagatgcctggcttgtcaggaagccatctccctcatccatcccagtccagttcctctgaccagcacctctgcagcatatggtcgctgtgctgggcacagtgcaagtgctgatggggagtatctcaaccactcctcgtaagacctctgcttcctgcagctctccgcttcatggtaccgacgaggaaacaggcgcagagagtttcagtgatgcacaggatacctcctggtaaactgtggagctgaccttcaacctgaggcatgtgccattcattatgggtgttccacagccgccccagctgaaactcccatccgagtcttcaaaaggaaggaataagcatttttatcaatggagtttcagcttctcagaaaaacaaggatggccgcagcctttgcagaagtccgaagatagtaagagtggtcaccagagggagacagagcttgagacatcccagtctcttctacttcagcaccttaccactcagcgaagcgcagaactgggaggaaaacagctccgtttgtttggaaccctttgtttgggtttaatttcttgtgtgatcaggtcctctccttttttcccccttccctctgctccatttccttgcctgtttctaagtggtaaggaacagctttatcagagtatacaatacaaaatcagtctctttcctctgcccagagcctcagtacctgatatctgagaaaacgctgctttctgagtgaaaaggcaccaatatacagttttcatagctactgcgtcagattctggggccctggacagaaatacaaaagcaatactagatcatttttttgagcaaagaaattaaacactgccaaggcaaaggaaagtttgatgtgcaacttttttttattggccataaaactttaagttggatttttaaatacccaataattctatataaataatggatatgtgaaatt

SEQ ID NO: 63676 - DNA, 1536 bp, Bovine  19866880580681
gatgaaaaatgaagcttgaaagaatgttcattaccagtcggtatgtgttgaccagactgatttttcaactgccaaaatgtgtatactggcttctgtctcatctacagacctctagaaccaaaagtaattgatcaaattagctcaactataatcccctactagttctgttatgattgcagcttattagccttagtacactgtttatttaaacacatggatgacatcatgaaaaccaccccctttcatcaaagcatgatgcagactatgaaaaacaatttggtttcaaaccaccctaagatatggtcatttttcttttcttctctatattgaaagataaagtataaaacctcagtttacagtcgtttgatttttatgccagctggctctcccccagtaaaatggaagcattttcatgtcatttagaatgaagcaaactaaaatactaaacaatcatgcttcacccctgcaaaaggagaaatgatgagaggaattgttattttgatactccctttatctttatattctcaagttatttttatattcccatgttcacttttccatgctgtgtaatggtttcatgtacttctgtctgtcagataatgcccactaaagtattaatgctagaattagccacaggactagtaagctgttttccttggactaggaaagatattctttcttgggtgatcttatggttgctggataagttctgacgtgctttggttagaaaagttggtgcatgtatgtacattctcaccttcaaagcatgctaagttccttgttttctatggtgtttgtgctgtcatagttccaatattattccacaacaccaccttcttcctttgcatcaatttttagcatgtaacaagcctaatctttgaatacttgtaggagacaaatagattagtcattcagaattgaactactgctttactggtggcaccaatatgagccaacactccaaaagggacacgaaatacaaataattaatgcaatcaatggcagacttactctgttgacacttgcaatttttgtcaccttggataataaatctatcctttagattttgagaatttattaaagtaactaattttgcatgtgttattaagactttttatgtagtatgaagggtgaaaaatctataaagtcatggttattgtctacaagatcaataatttagttcagcatttccaaaactgtattctttgaatcactagctttaagctataccctgtgaaaaaagaattccatgtatgaaaaagtgttaattctctcttggaaaatcatattaaaggccctgagatatcctgaagtgaagagatatgttaaatctgtttaatctagagtttaccgcatttatttgatcataaatcactgtttttgtgtagtacctctacacatttcatgaaatgtatttgggaaattctggcccagtacacttgaggaaggggattgtatatactataataagattttagattttaatctataatattatagattattatattatattataatattatattaataata

SEQ ID NO: 63677 - DNA, 1689 bp, Bovine  19866880672011
tgagatgctacccaaagtatactggcatacataccaattacaatctaatctcttaatggttttaaaatcagaatggctaagtcactagaccaatacctatagtttcttctcttatacaggtcttaggaaacctaatgatgtcattatgaaatgtagctgagtttaagataaaagataaagcataaaaagtgtctgcagataacaaaagaaacagatggatatttttattgcttcatctctgtttctccttaaaaacaaaaacactgacactgaccatggatcaatcactatgtttagtatactctgcactaggtacactaacacaaaaaagatttttccagttgagcctcgtgggcaaatattactgcacagccctgacgtggcaaactgtttgatcagcagggcacactgtaaacaagaaaaccatctttcctaggcagagatacagagttctgctttagagtttcagcacactcattaacatagaattctgagacttagagactcttcaatacaatggataatccaagtgttctatttatgaccctctactattagaggaataaccacaattttagattagcagctacttttgtcatctttcagattaaaacataaatgccatgaagaaacttctaaggatctcctaggaaaaagtcaaggaaagaaaagaaaaaggagtattacaattttggttaactgtcatactctaagttgttaggtagctcagaacaggggaggggggtggctgggtaaatgattgtcttcacattttaattttctgacacgaattcataaaatacatgaattcatctgcagtgaaaacttttcacacattaaacaggaaattatatggacctctgtcatagaggactgtatttttaaatatacttatattaaaaaaatacaggatggtttcaatattcagccactataaaagctgagggaggatacattatcaagtttacattatcaagttttaactcaaagaaagccagtttaggtaaattaagctctcaaacacacaaagacttactattgcaattatttgtgccattaattctaaggcagatgctgctttttaatagccaaacattaatttgtatttaaattttaatcttaaagcaggtaattgttttgaagagggtccaattttttaaaggtagaaagagactacaccaaatcctgcccccatatcaaaaataaattcctgaagcatcaatttattcacttaaaattgaatcaaaatggaacccatggtaaatactaaaacatttttaaaacagatttcaaatatatatagattatgaataaagtaattcttaagttcagagtttaattttgctttgtgaaaaattgtaagtaagaaagaatataatcattgctatttctcaaagtctgaatgccacaaccattagtttgtgtccaagtactgctcgaaataatcaaattattcatgtgacttatttccaaacacttaaaaccagaaaggatcacattcgtgcttctcacaacagtctttatttttcacaaagcaaagtaactaaaatttcctatcctcctaagtcgttaacaagaaaagccatcaatagtacttcacagaaaatgttagttttaagagaatattttgataggatatatgctacaattgacaattacttaaaaaaaaaataaagctatttacaatta

SEQ ID NO: 63678 - DNA, 951 bp, Bovine  19866880765466
cagtcagaaagatggaatctgaacacagctctctgactggaagcgctaagcctgagattctcagcttctcaccctcccctgtgcctgtgcatctcctggggatcttgtgaggatgcagagtgactcccctaggtctggcgtggggcccaagagtacatttctaacaaactcccaggcctgctgctgctccatgggccatatgcagagtagcaagggggttaaagaaacagttgcatttactagactgattccatccttacagctgtgacttctaaaagctgagactgctgccagccatacatgtctaaagagttaaccgctttaaagagaaaaacaagcatgtttgacctctatgaaactgtgcagggaatttttttttctttataattcagaaaacacaagcttgtaacctaaaaccaattttaaatgaaataaaatgcactgccaatgttttgtgtgtgcactcctgttgttttcagccagaagagtttctttggggtcctacacccaaaccagatgcattctgtgtttctaccaggaagccatcagaatctattaaaattactgtacgctgatagcagcggggacatgacaaatcgcaggccaagagtcagataccgcagaatgtatttcggggctttgggggcaggcccatttgcaaccaaatgatattgtgcgaggctggcatgctcagtgcatgacaaacggatgcaatttcagccctgtctgcgggtcaggggagatttctctgatgctgcttggggttggtttacagaattgtgcagagttcccagatttgaatcgcttggggcttcagagggcttcccttgacaagctacaaataattacactctactctttccattgtactcgattattttgcccccttatctccaggatttgagcttttgcgaacaagcaaggtggcttctattcgaccacagcgcaaca

SEQ ID NO: 63679 - DNA, 2674 bp, Bovine  19866880823450
ataaatatatatccatgatgcctagctcttcttttagacctttagtgtgttctccccacctccccagtgaccccacccctgccgtgtgtgtgtgtgtgtgagagagagagagagagagagcgcgggtgggggatattaaagaatataacttcagaccttcatgttcccataggtattgcttttagagaacatccaatgtaatcacatggatgacgcagttctgtattatttctgttttacagattgcctctccaactgacatgccatccaatcacctatatctattatatctacccattcaatgttcatctaatgaatgaaaacttactttatgtactagtttcctcttccagggattttctgctcttttgataacctgttttaatgttttttgtgcattcttaaaggcaatggaacttctttatagaggcaattaatacatgtaatttatgaactttgctggacagtctagttaaaaatgtaattgaaaaggatgccacaggtgcattactgctatcaataaaatctctatagttttgttacaactgtaagttctaaaggaggcaattttgtctgtgattataagtcatcaaatctaacaagccatcaattgtaagattcattccagtttttgagatgctaaaatgtgaaggaaaaaaaaaaggccagcaatagttccatattgtcacttattgtaaaattaatgtagaatctagagacagtaaaatgtgaaaaaataatacatctaagaattgactgaacaggtttaggacttccctggtggctcagagagtaaagaatctgcctgccaatgcagaagacccaggttctatccctgggttgggaagacaccctggagaagggaatggcaacccactccagtattcttgcctaagaattccatggacagaggagcctggtgggctacagtccatggggtcacatagagtcagacaccactgagtgattaacacacacacagaggttttaggctgaaaaaaattttttgccaaacttatcttatactttacttataggtaaataaacaatatttatagcaataaaaatcataaattggaaggtatccaataaccattatagctgacatttacctactgtctactacaggcttcctgtgacttttctcatttggatctcagagcaaccctgttaagaaagttgtattatctccattctaaagatgaggaaactgaggtccagggagacattttcttatcttttcttttaaaataaagaaatatatatatatatatatatatatatatatatatatatatataggctcctgggctagtaagggtagggctaggatttaaactcagactgaggagctaacgtcctgtgtcttctgtgtatgaatatccaccacggctcatgacccatgacccctgactccataaaggacgtgctcctttggcaccccttgggtcacagcaatcacattaactgtctgtcagtctgtgggttgtggacctcctgtgctagttatgctttttcaaaggccttggagagcagattcttgcttgtgccgatcaaaggttcttctgtgcactttcatctgcaatcgtagaactttcagtgttgtttacttatttctgccccatgacaacaaaataataaagtcaacagaatatttctccttttaaaagtaaactgtggaaaaactctaacacagcctgtggaagcaaccccctcaccagcaggcccgtcaccattcatgaccattcggaggaattctgagccttttgtgaaaaagtgacttttatttttttaatctgatcaggtcaaacatttaaaatggagaatgaacatcacataggcaagtgtgttctttctcagtaaatgcttaatgctatgatgcctgctgtttccatagcagaacttcttgaccaaaagtcacattaaaggtttagaaacaaaatgagaagtttgatgttgaaacagtgaccaacacgccaaacaggccggaacccccaagcatgtgagggcgagagcttcactgggaccctgaaggagaccatctgagctttcatatttgaataaaacagtccaagttacacaggcggtagctttgacttgagatcattctgtcttgattgtttcaccagcagcatctctccctcaggacagcaaagcaggcccatctgaacacgcgcccctctctttccctgagtgtccctcacgcgttcaccttcatgctccccgtggctggttctgctaagtactatcagacaatgaagtaattgccccctctgagactttgtgtgtcaagaggaggaagatcaattcctgttacccaaagatctatcactccaggagaccactaaaaactgctggctaccccgtggttctggagtccttacagttaattttttaccagaaaaaggatgccaactgtgagtcaaatgaagcccattcttttaagaatctataggaggggcagagggtaaccaaaataaaccaggagagaaattttcctctgtactatcctttccaaaaggtatttactgaagaaacaaaagcagaacacactcaagtgcctgctccatgtagaaaaacctgcatgtgctgaagccattagaaaactgttcagtaacagtcttccttgtgaaaatattaggcttgcgaggttccaagctcagcatctccacgg

SEQ ID NO: 63680 - DNA, 808 bp, Bovine  19866880826389
ttggcaaggtgaaatctaaaatccaagcatataaaagctatttttaagtgggaatgaagaaagcatgtgatagggatttgactgaggaatggttaaaaaaagaaggtattattatgttcatatagattaaaggaatgtaatcccattgaaatttttcttttaaggtggtgccagaaaggaatttatttttctttgtagtaatactaggacttgaaataacttacctactaatgagttacttcgtgggaaagaaaaagctcatttgtgtttgcattgctaaacatgaaggcaaagaagccaagatgtggtagaccagttctcttcgtctatcagcaatggcagtcgtttatttctgttttccctgaatgatgcatggatacctggatgaggctgagtttctgccataccaggcagagatgatccttgaatccagcaaaccacatggctcccagatattgcttctggcttagtgaccttcactacactaccagctcattttggacagggattgtttagtgcgattgccccttgctcctaaaagcaaatacattacaaactggtgtcagatgccttgtttcgtttcagggcattggagagtgagtgtgttttctccaactctgttgatagcacaaatgcccactccttcaatgttttaattttatgacaacttcaaccctgtggcactagtggtaaagaacctgcttgccaatgcagtgagatgtaagagacgtgggtttgatccctgagtcaggaagatctcctggagaggggaatggcaacccactccagcattttgcctagagaatcc

SEQ ID NO: 63681 - DNA, 3708 bp, Bovine  19866880850325
ttgaagtactgtttctttagaaacttttagctattctaaagttaattttaaaaagagataaatgaaaatgctaagaaaatttggaaggatttaaaaatgtaagaatacttatcctgctgctactgctaagtcacttcagtcatgtccgactctgtgcaaccccacagacggcagcccaccaggctcccccatccctgggattctccaggcaagagtactggagtgggttgccatttccttctccaatgcatgaaagtgaaaagtgaaagtgaagtcactcagtcgtgtccgactcttagtgaccccatggactgcagcccaccaggctcctccacccatgggattttccaggcaagagtactggagtggggtgccattgccttctccaatacttatcctactagatattaaatttataaattataatgtctgacacaaaactgcctcaggaggcagaaacagtctgaactgaaacataataaagcagccagaagtagacccaaggatatatggtagtcagttatatgagaaagatggcaggcatttcaactggtgagatgatgaatagaatttctggtaaatagcattgggattaccagctagacatttggggaaaagaaagctgaattcctatggtaaaataacctctagatggatcaaagagttaaatgtacacaaaaagataagaaaagaaaagagagaaaccagaaactacgagaataaaataggggacaatatttctaatcagtataagtaatacaagttccataattaaattttgataaatttggttacatagtaatgtaacatttctctgccatgaaataagcttttaagttaaatcaaaatacaagctggtatatatatgaaaaagattaatacacttaatatataaagagttccagcataccaataaggcagtcaaacaccccaacagaaacatgggtaaaaaaataataggtagttcacaagtggagaaatgcaaggattaacaaacatgtggaacatagtcactctcactagtagagcagtggaaaagaaattacatatattatttttcactcatgaaattagcagatgtttatgtgactgtagggaacactgaattgtccaagtcatattgatgtaaatgtaattctacagatttttgtaaagcggtgtgggagtgtgtataaagtcttaaattagatacctttggcctaatagctccagtccagaaatttatcccaaagagatcttgtgtaggctaaactaatatatttgaggttctttttcatgtatataaataatctataaatatctttcagtatgaaactgatgattaattataatataaattataagatatcccatatccaataaaatagcaatatagatctgaatttctttggtcagaaagatgttcatgattttttggggggttaagaaaagcaggttaaaatagtaggtaaggaatgaattgaacatgcaattgtaaataataagatccatctatgtagctgtgcacatagaaatatacagacatgtattagttatatttccctggaatacaactgacagaatctcaatctaatttaagcaaaagaggaatctgggggcttagatagttgaaaagtgcagagttttgttctgcttttagacacatcttttccagggcttcaaacgaggtcatcatgaacagccagttttcccctgtttccaagtttctgccctactttctctgtggctttgtcttcagaacagtatctcccctcatggtgacaaggaggctgccacagcttttgcctcttctcctgtccgtatcagccctggcgaggaagagagaaagtcttttcctaattactcagttgaaactctgggttcaccagacttggctggttaatttgggatttgtgctttgttattgttcagctggacacgattgaagcaacttagcagcagcagcagcattgttcagtcactaagtcgtttgtgtctgactctttgtgacccccatggactgcagcatgcgaggctcctctgtccttcactgtctccccggaggttactcaaactcatgttcattgagttggtgatactgtccaaccatcctctgctgcctcctttccttttgccttcaatctttcccagcatcagaatctttttgcatcaggtagccgaagtattggaacttcaggttcagtacctgtcctttcaatgagtgttaaggactgatttcctttaagattgactggtttgatcttgcagtccaagggactctcaaaagtcttctccagaaccacagtttaaaagcatcagttcttcagtgctcaggcttctttatggtccagctttcacatccatacctgactactggaaaaaccatagctttgactgtacggatctttgtcggcaaagtgatgtctctgctttttaacatgctgtctaggttggtcataactttccttccaaggagcaaacgtcttttagtttcatggctgcagtcactatccacagtgagtttggagcccaagaaaataaaatctgtgctcatacccaaaccaacactctgatctagagaacagcagttctgactggcttaggcctgtatgctgtgtcagactttccactgtatctccaccatatccaaaggtaatctaggataatacctatagtgtgtggcctgagaatcagctgaggcagggggagagaggagggatctcagtttaggaaaattgatggggtaattatctgacaatgggtaagtggatgctgggccactgaaagaacaaaagacatttctcccttcatgatgatgtttttggacaccactgttgtatgtattatttgagaatttgcaatcttttaattagcaaaacttattcgagactattagtatgccttcttttagataatctatttgcaatataaataaaatacatagatatttgtttctctcactcatgatatttttgcttgtattttgtatttatgccatgtctttaacttatttttctttcctataaatctctcagtattgcttctttctgttgtcataccatagctgttattcaagcttccaaagtcacaggagaaacaatccatgcaaaaagggaaggtatttaccctaggaagtatttcagagaaagaagaaaagtaaagaaataggtggtagctcctgaatgtttgaagagggttctaggggactgactcgttttgaagttttgtttgcagaacaaacttgatttttactttgtttgcaagtttctatacggtgctggaggaaaaggtgactttctaaagcctccctgaaaagcctttcaatttgaatgtgctcagttgctaagttgtgtctgactctttgggaccccttgtagcctgccaggttcctctgtgcatggaatttcctaggcaagagtactcaagcgggttgccatttcctcctccagggaatcttcccagcgcagggatagaacccaaatctcctgtgccccctacactggcaagaggattcttttaccactgagccacctgggaagccgttggtgaatggttaattcagatcagtgcttcaaaaagtttgtgtacacataagtcacctcagatcagaacagatcagtcgctcagtcgtgtccgactgtttgcgactctatgaatcgcagcaccccaggccttccctgtccatcaccaactccccggagttcactcagactcacgtccatcgagtca

SEQ ID NO: 63682 - DNA, 766 bp, Bovine  19866880858042
cacacacacacaaacctacccctttgatgatcacaaaggcaaactctcataatcaccagattgcagtactgaacttcttgggagacacgacatctaagaacccacaacttcacagagtttaattactgcattgccccatggagcttaccctcaactctgatgagcagatttcatgttagccttataaacaaagtgtctaaactattaccgctcagaattttaaaattgcagtatgttttcttatggaaccagccccaaaatgaagaactcctcccctcaaaaacaaaaaacaaaaaaaaagtttatgaactgatgtggtaatgtcaaatgccaaataccatgaaaaatatccagtatgaattttctttcccatgtgaaggtctagtttgctcacctgaataaactggcttccgatatacattacatcatcagtatgagatcagaattttcttccttagatatacttaatgtagaaacacgtgaagcctgtgtttctttaaataactgtagttacaatgattttaaagtatgtatggccatttgagtattattgagtagaaaagtcttaaagcattggttctaaactgtgaattgttccacatcagaaaaatcactccacaccaagatgccttgtaattactctcagaaaccaaactggtaactcttcatccagatacttaggctttctcttgaaatctgtgattaccttggggtccaaagaggaatgaaaggtagttaaaaacaatactaaaggcaacataggaga

SEQ ID NO: 63683 - DNA, 1223 bp, Bovine  19866880889576
gggttcctgcctgcagtagtagatagaatggtcatctgagttaaattcacccattccagtctattttagttcgctgattcctagaatgtcgacattcactcttgccatctcttgcttgaccacttccaaatttgccttgattcatggacctgacattccagtatctctgccttgtcctcgtgttattaccatggagaggctgaattcattactccatgcccaggatccaaggatacgcccacataaacatttgaatagggttgtcctcagattttgagctttgctccccatcctcaaagtccatacattcccccatggtgtagtattggaagtgggctggatctgccttaatcacaggggaagagtctgacctgagttactattctggcaaaggcaaacaggcacaaatgaaatacagtgaaggacccttggctacctgctagggaccctcctggggagcctggaggagctgtgcttatagagagccaggctggggacattggaagcaagcgggaaagtgtgctcaaaggcagccctcgtaccagttaacttttctcattttgtttgtctaaataaaatgatttctggttataaagcagctaacctttttgcttttctcttgtgcttcgttattgtccaggactttataagtagctgacgttactcaaaatgtgcaaagaagaataatggaagcccctgaataccttgatttggatgaaattgacttcagtgatgacatctctgtaagtattgctccttgcaggcagtgctttcaagaaattctgccttaatctatatgggttcctttctctgttgtagtctgtacattctaagctcttcctaccacatttagaaattgacaacagaaatcctgctgtggcagacaaagtgtggtttgggggccttcctgaccaggaagtaaatgaatcccatttcgttttgtgtgagcttggatgagaaagcatgtaacctcgctggacttccccttcctaatctgtttctttcttgtcacaattattcattaggtaaatgtaattaacccgattggtgtagatgcccataatgtacataattagtccctttcatatacctggctgtgccacagcctgcatggactaacattcacaaggacacagactgaaggatggccaagttattagtctttgaacaatatctttcagtaactggagctttcaaaacatgggttggacacttgttgggaa

SEQ ID NO: 63684 - DNA, 1407 bp, Bovine  19866880976570
gctggtcccagccccagctacatctgcacttaattaaaagatggtgacctcttccccacatcccccatctccacagatgttaacttcattatataggatccatgcatagtgcccttctgattaaacttcctcagtggactcaactaagcatttcccatgaagaccacccagaaacctcagaaggtcttcagtctgtgtgtgtgtgtattttaattctcagtgctatgcaagggacaagacatcggcctaccgaaccctacaaaatttgggccttggttactttaaaaattcctttctccatagcacttcacagcaacaaagatattctacgtttctcctgttaatgagatccaggtttaaaatttcagaaggaaccttttcagagcaagaaccccaacttaggggcatccagtcactagaaccataatgcagttatgtttattcataaagttaagtctattcataaagaaggaaaatgaaatgcaagaatcaagtaaaaattaacttaaaattcaatgcttatacaacatatatgcatcataagatatataaaattattatttattgaatctgaagcagtccaaatgattatactggctaactgtaaaaaataaaatcctggtcatgtattttaaattataatgtgcttatttttattaaatccaagttcagaaaaatagattattatggatacttgtcaattcttccaattaaaatgtaccaacttaataaccaaaagaggaaataaagtctcttaaaataaatatctcttttttttctgaagaggagtaaagttgcatgttaaggtgattaagaaggaagagtgggttaaatgtctgtagtaaccaaatatttacacatctgtacatacagaaagaatatgatttagcaagcactgattgtttcatccaatggttttctctagccaaatttactaaagataattagaggaaggcaaatgaacagaatctgcttctagtttaggtgaggtatcgtgattaaaagtgcaaaaatgaacattgtatactatactaatgcacttccaatgtatgtcatagtatgtcaagaaaaaacacaagatgaaaacacaagattactgttaagtacctttaaaggaattcagctaggcagtgtaatcctcagtttttacaatatgctgctttttaacatagtatcttacacacagtaaatacttaatacactgttgagttcacttccagactatgatcattgttgggttctacactaaaaactgtggtattgtctgaaatcacaaatgttgagatgactatttttcttcaacttataataacttcaggttcaaatatcttcttcttgcactgtttccctcagaagtcttttttttgaggaaaagtcagtctttagtcctctttcagaaattatctg

SEQ ID NO: 63685 - DNA, 1886 bp, Bovine  19866881023737
atcaaattggaggtgtacatgtgatcccattaaagaggcctgagtttttccctcaaacattcgtttcttgtcaggtctaatcattggtgattaccttgagcattggatgtttgctctgggtgagtctgaaggcatctgaacttgaaattggcctccttctcaaccacagaagaaatctgtaacagcgcctattgtggaagtggctacaagtcacatgacctggagaaaaatggaataaaccacccctaggaaaattatttttaaaagtttcggttaattcacttaacttggtaagcaagaaaaactatttaacaaagaacaaattttccacttcactggtgagggaaaatgctagcttttaaagttttaaaatatcctgaaattaaattactatccctaagtctagctatctgatagtataaggaatgtataagagaacagactccagagacagacttcctggagtttgaatcccaactccgtaatgtaattgctgtgtgactctgggtaagataattaacttctctgctccgtgcctcagttcgcccatccatataatacaaacatcctaatggtacttagttcacaaggattttaggattgagttaacacaagtaaagggcttacagctgtacctggcacattaagcactactgaagtgtttgctattaagtcttctttcttactctacatcttcaacttaaaaaaaaaaaaaagaaaatcttgtatctccaaagtaccttcagatacatcacctaattttgatactaacagtagcctagcaacactggcagaaaattttcttttttattttatagataatgagtcacaggctcaaggtgggatagagggtaaagggttgcatgctaactcagatggaggtcttggactctgaggctgggggcctgtccactgaatctgctgcctttgtcactgatcacagggttcaactctaaatctggggatggcttttaaggaggcacattctgataagccttgtgatcaaagcctctgttaaccccatagaaacttgagtgtgcttgaaattaaaaaaaaaaaaaaaattaatggaggtaagcgaaaactttcatttgcacttcaaactatcttccgtgacgattctgacccagacaatgaaacattactttcactcacacagaaaaacaaagagataaacaaacctagatagacgaattattttccccacctcatctaaacaaactgtcgatagtaaacaaacgatccagaagaaaagtaaataagttttgtacagttgtttcagttcaaaaggcctagaattctcatagctgtataggtaggaagatctatttattttcaaacacaatgcacctaattcaaggattatcttaagtctcccatcatctgcagttcttaggattctagttactatcagaggtcccgctttggcaaggttaatggtgatgccttagagtaattagttggaaaaataacaaacatcatttcatagtttaatgctatggtatcattcccatcaatatccttttttattttcattttttgcccatcacagagagaaaagcaaagaggcttaatttgattttcagaaggaaaaacaatcctgaatgtacttttattttggtcgagggtggggggcggtgcaaggagaaaaggtcagccagctggttttcatctatatgccataattctctgtttagtttacactattaaactccaaagctttgctttaatcttaactgttacagtatgccttactgcagattctatcatgtcgcatccctgataggatttcaaactttggcaaagcaccatcccccaagttggtccttgccatctgggtagtaaacgtatccaacattttttcattggcgcctgcatcattatgt

SEQ ID NO: 63686 - DNA, 1818 bp, Bovine  19866881042168
taatcacgcataaatgccaaacacaagatggtgcacgataggtgccttctatccccaaatgtttaattaatgaatgcatccttattgagtgaatttatggtgggatcatcaggtattttaaagccagtaagccttttgacatctctaaatgacacttgatatttagacactgtctactccagccgtgagtaaagtcattgcatgctcagacaccctgcccagaaatatacttcttcccttcttaaccactttcctcccccaagagctcaggcactccttcagaactcatctcttggggctatcggattaaactgagcaggaaaactggtagaaaggttaatgcaattgattccacaacttggaatggtttgaattcaaaggtttagttgctaattttagtcccagggttaggatattgaaaaagtagactgtgtctctgtttaaatcatcttccttaatgatgatgtaaagtaaaatagtttttaaatgtcctggagacaggcaatatatttttaaaactttttggtttgtgtgtatgcccacttagactgggtatagatgaacatagccacataaagttgccagtttagggggagaaaagacccatacaattttgggcttattacaaaatgtaaaaaatatgatatagacctcccactgagtagctctgaattaaaaccaacttttacttaaacgtggcatttgtccttatgtaactctttctgggcctctcctcaccacccctcatccagaaaaaaagttttaaaataataagaataatttgatttaaaatgccaatctgttttaatgctttagcctaagttcttcatttgggttcaacatactattttgccatcctggcatatagtacagcattcacttaggaactataatccttattcagagaaactctttggtacacacagctccagctatatgtaagatactttattttctgaagtaaatgaaaatatctctgcaggaattaaactctcagaatagatctaccttggggtttcaacagcctttctgattgctagcccagcaccttgtattaagcaagatgtgcttcataagccaataaacaagaacaaaacttgccttcatgtttatcaactcagaccctttcagtcttgtcttcatcatgcatttcaccacttaaggcaaagtcaaggactttcagtttgtttatatttatctattgcctgccaaacaatcctttgctctcaaatgccccaaccccccacaaaccaggataagaaaaggagtttaagttattcttatttgatgcctttatttggttctttcatacttctgaggcttacttttcatccataaaattaaaaatagaagtgaaagtcatccttgtttttataattaaaccctcatttcatcaaactggatttcattggcaggacttaaaggcataaccttccgcttattatcaccatcctttataattcctgcagtcattacttctgtggcagatgactgtggtttgggctttttttgttgttgttgttgttttaatatatgtctctttactgttctttggaaagtggccattgttaatatggaggttcttccatatatccaagtttatgtttgccagatgctctagagtaaatgattattcaaaacatatttgaatcctttttgttttcatccatagcttaagtttggcactgaaagactaatgaacttaaaacataattttctccttatacatttaaaactgagtcacatgcatatgtaagactctttttttcttgtctatgcaaaatgctagagacatgaactccacaagtcctatagggt

SEQ ID NO: 63687 - DNA, 1240 bp, Bovine  19866881073828
cccattccttctggtttctctgtacctctgcttatacctttgtaaaggtctctttgtaagtgatcctcaagttatctgacttgaacgtgccagctatttcttgcaaggaccctgataaaggagacaaattactctgaaagtttatagcttaagtaaaaaaagatgggataaagagacatgttttctagccaagccaaaagctattcatatactaacatctgattatacagttttggaaaagagttgactcttttaatatattcttcattggggattatacattttctggaccaaaatcataatcagatccaaaaggtttctaatactttatatatagttaataaaatttaacagtaacaggaaaaaagataaaagggaacaaccctttcagtttccaaagcagagagaaaaaacagggcattgctcctaaatcactctgttgccatgcaaacttcttagccataccacgctgaaacatcccttagaagagtcagtctcccaattctgattctttggctaattaaagcagacgtggggcactgcaatggctcactttccaaaattcagtgtgagaagagtgggaatgttgattacatgtgaacagagggattgaaacaatacatttcctgtaggcatctatgtacacataaggattctttctctctctctctcactctctctctctcacccccacacacacagccagaaaggtaaacccacagagaaaaaggtgtgattgtcagaattcattctgctgcttggagactagacaggaccaaaggctattactttcgttctgagtcaaagcagggtgacatgctgacatgttcaatattttctgccagttggtcaccatttgggtaggtgggaaaatatacttcattcctattctctcccttatcccctgccatgagttaatttttaatataatgccataagaaatattacaattcaaaaaataagaaaggaaccaagctacatcattgcttaatcaacataggataggtttccactgtcaaagtcgaatggagcattatcctccagtggttttgttttgttgtttgtacaggaataaggctgattacattttcctcttttgaattttaatgagaagggggactgtgaactaaaatatattggctacagccactgaaagctacaaggtggcacaaaataagagtgggtcattcatactaacaattttttcagttttgaaacagtgccttttgtcaggcaaggt

SEQ ID NO: 63688 - DNA, 969 bp, Bovine  19866881074985
ggaggctgctctgcctggaatcccatgtgagctgcttgatgcctggcttctgggcctgggaagaccaggagtttccatagagtttcttttcctcctcatcgttagaagcaggggaaatgctcatcactacgtttttgccttaagacaatttgacttagtatagaaaataatcaaaggatattccaaaaagcatcttatattttaacaagatctagtcaaaatcaaagcaaatcaaaaaagcacatcagtaaatatgcataatatgcaatgaatgtgcattgcatcataagtatgaagcaatctgatttaattcaggaagtatttggtgacaggccatcgaggaccagaaagaaagtttcctgcatattttctgtgtgacagaacttgacatcattttacacttcggtcagtttcagatgacaattgttaagctccctctgaacctataagccagtcaactatcatgttaagtaaagaacgatctcaaatctaaaaggaactcaagtgtaattatataagatgcccacattggtacaaagctggggacttgctctttgctgaaatatttggacaactttcccttcgttgttcctgcgacatttccttcaaggttgtgacatcagcaccgtgagaaggaccctgtgcccgagcaggtcttttcctcctggatcattacccatgtctttccttctttttttttctgctaagtagcatgaaatccaagcttggagggtcccatgcccaggcacttgtctgggattgtaattcaggattagttcaatcccagtccagcctgaagtccagctctgacctgccagagctgtcagtctgtcctgatgagttcttatggtctatgaaaatgatttgtgaagagatttgtttctaaaattaaagatgatgaacataaaaccaaggctcttcctttattaaaaaatgggtttctatcaagcctttttttacttccttaat

SEQ ID NO: 63689 - DNA, 2009 bp, Bovine  19866881075358
agacctggatttcggcaaatgatatttagttagctaaatgtgaatgcgatattgctaaggcttatctgaagagtcagaacacaaatgagacaagaattaaaccaggcttgctggctagaatgcctttaaaatttgttttcagagtcataaaaattgtttggaaaagccagtgatctaataactgtggaaaaaccaaagctcataataaatattgtttatctccagtctcagctcttggtctgtgacagatgtacacacactttgtgagtgtctcagccttgaggatctgctccttaagagtcagacctccataacgtgccaggagcacttcctgcgctatattgtatccttcttcttttaaaaactatgaacactctgagggcagtctagatcaggttttaatctctaagagcccaactcctggcacacagtagatgatcaaaatctgctggctgaacaaatgaacgataaagtggaggaaccgaaggagagcctgtgtgaagacagtgctgtgatccatcatccgagaatgctcttgctggaccttcagctccttccaaagaaccaccgtctacagtgggaaacgaaataggtccccagcttggatgggagcttcactctaacgctgctgccatgacttccaggactgccatcataatctaggacatctgtctctatcccatctccttaattcactttttctatctatccctctctgctggagtgggttttccaacatagcatttcatgacagggtgagtggatagagcagagagatagaggctgcccatccaaccattcgtcttcagtttcctcatctgctaaataggattaataatactacccattaataaggctgtttgaatattgttattgctttataaatgctgagaaatacaaatgtttattaaataaataaaatcattgagatgtctcaaaagttgttactcattatgccttgaaagtgaaagttgctccgttgtgtccaactctgcgaccccatggactgtagcccatcaggatgctctgcccatggaattttccaggcaagaatactgaagtgggtagccattcccttctccagggaatcttcctgactcagggaccgaacccgggtctcctgcattgtaggcagattctttatcatctgagccacctgggaagcccaatattatgccttactgggtgattaatgaaacaagattttatagacattatagctcacaatttttgatgattgcaaactactttactactggcatttgaatcttgtgatggtacactatccctgggtttggtgatgaaggacttgcaaaatcctgccttgaaacaccattcacacagaaatgtgatcataagacagcataccactggcacaaagtctgggctataagatgggctacagaaatttggcctttattttatactagaatgttcacctgggtcaaattttcaatgatctttgtcattgtcattggattagtatgatcgtcaaattgagtgacagcgatttatgactcctgcgtgctctactttcctggggttcatcataatatttgtgcataaccacacagaggaggattttagtacaggaccgcttcagtgttaaccaaacatgccatcaccttgaacctgaatctcatcaaaccgccatcaaagatctgttctgtctggctttgcactgcacttcacatattttccaactgttgcttactcactcaagacttcccacccgagaagagactcacactcctttcgaagtggtaatttttgtgatcacacattctggatgtgtgatcacatccagaaatggaatttgcacaagagatacagagtcacaggcaacttgaaacatgcttacagatattgccaaaatatgttcatatgcaatttcagttttacactgcaaaattagcatcgactgaaccatctgcttgcaggaataaaattttttgagtcacccttggtgatgttaaatacaggggcttccattggagacacttagaatt

SEQ ID NO: 63690 - DNA, 1247 bp, Bovine  19866881101707
tattatttatattacatgaacggggcttcccaggtggtgctagcgataaagaacctgcttgcctgccagtgcagaagacattagagacgtgggtttgattctgcagtcgggaagattccctggaaaaaggcatggcaacccactccagtattattgcctggagaatcccatggacagaggaacctggtgggctacagtctgtggggttacaaagaattggacatgactgaagggaattagcacacacacatgcaaacctactatatatacacatacacacacacgtatatatcgtttaaaataaatttaaataaattatttactaataactaataaatcatgaataatacaatgtgataaactgtgtggtcatgagtacaagaataaaacactcaagagaagggaagaccccctgtggccagatccatttttaatctccagttcacaggaaaggaaactgaagcgtggagacccagcaggaagaggtggcacagaacctcagaccttttgctttcaacagatctttttgaaagagaaagggaagggggaaagcaaagctgactgacttgtgaagcagaggtgttaagaaacctgggtgccaaccccaaggctcccccggaactgcggtgatgagctgctgacggcagaaagcccctttctgagaggcaggaatagggcccaaagcaggggggcccaggaagcccacctattatcctcctcctccaaggattgcatcctcccttaaggaaggtaaccgtcctgtgtacatttcaaggaggaaagaaaaaaaaaaaaaaacaaaactgtttcctttggaaactaaacactggctctgccaatccaacttcactgaggtcatttgagaactgaggagttcaaaggttctctacagcttcgatttactttggcataagatttaacagaaaaagaactaaaggagaatttatatggcccaggctgttttccaaatcgcaaactgctaaagttatttagaatttactttaacttgcaatcacatgtaaagtggctcagatgtaaatgctttccgtgtggcttaaggcaatctaggtttcctcaaatgcacatgtgcgattctaatagtaaagatctggattcgaaatctcagagtatttacttttgggttcctcatgattagaggctgctgttaactttatgcaatgtcgggtgggagtagaagaaataaaacacgctgccttcatttgggcctttaagttctcacagtagcg

SEQ ID NO: 63691 - DNA, 1513 bp, Bovine  19866881104253
atccatacatgaccacaggacataaagggccaccacaattaggatggaagaaggaatcttagtagctacagtatgtatcataagccaatgatttatgagatgtttttacagcatttttcacgaagtatcagctgcttttgactaagctgttgttttttcctcagatagtggattttgaagttcattcctatcctggatgtgactgaagcttggaattgagaaaaggggatgtggacgacctcttgtgaagagtcccaagccacagccatcagcatgactgcatttcatgagcacctcaactgtggcaaagatacttttagttcatgagtctggaggactcctcacagggaagcagacccataaacacggtggcacattcatactaatcagcttcaaggattttgaaacttatctagtagactacagagaagtgacttggtaacagttcactctcaattcttagtgaaaacacatcatgttgaaaaggacacgaccccatctaagtttggaaaactagtgctttgacctgaatttttattatattaagaaacaaagggacagaaaagggcttcatgagggggaaaaaaatgggccatgacttcttcctgcaaccacagaattccacaaaatgcatgcaaacaaacccatgaaagctctgactaggccatttatttctgcacccagaacaccagttcctgcttcgtaaactctaaatctgcttgggctctcctttcttcacctcctgtttctagacagttcctgttgcacatcctgataatctgacaaaaaagacctcctgatgaggagcaaaaaagaaccattttcagatttagattaccaaggaaaagaaagagattatcaaagatctaaataatgcaaccaatagcaaaacatccttagtaaatcatactaacccagctaaattagatagcactgtccatatacaattacactgttaggctcccatgacagtctttaaatgtgacatgttatttgacatgtttgcaattagggcttaggaaaaaaaaaatcaatttttttctattccacttaaaataaaaaatgtactgtttccctgaaatgtacctttttaaaaaaattcaagacagactaaaaagtaataccagaacaaacatatcacagctgcattatgaagatagacatttaaagtccaattttattagattttatgaaagggtagcacctaaaagtaattaccggtgcattgtatttactttcacatcatcatccttactcactccgcccctggactgtgaacaggcagtgaggtccacagtaactgctggtcctggctgagcttctgagaagctctgcgagaattgcctgtgttcgcgaccacccagcggggctgctgctgctgctaagtcacttcagtcatgtccaactctgtgcaaccccatagacggaagcccaccaggctcccccatccctgggattctccaggcaagaacactggagtggcaagctcctcctttcactaaggccccgagaa

SEQ ID NO: 63692 - DNA, 1041 bp, Bovine  19866881120015
tagagtattgaataaactctaccagggcacatgttatgcatcatttagcacctgaaatccttggaaggaaattcgcaaaacttcagcactttcaagtattatggattcagtagacaaaccatgtagctcttttgggttgagttcagagctctaagtaagggtggagggaagttgaaagagaattaagtcattgactaaaatgttcaacagtgacaatcccccatccccctaagggtattataggaattttatttcagttcctgtctcaaagtcgtatatctatcatgggattggccacccaagaaaccagtagaaagcttcatcagatggtgtgggggtagatatacagctttgactctaactggaagatggattctcattccatatgattcacagaggtacctagggaggctttataatgagggctcttttttctgtaccgagaaaatactcggtgtgatttaaaagagcaaatgtgtgaaagggcatggacagataatttaacagatagcctttcacagccctgagtaatttaaatcatctcaccaggattagcaatttgaagacaatttttattctaccaagctagccacaaaataaagtaggtaccttataaagaagcttcttgagatcaaagacttatttgacaaaatgcctccacagagcctccttctagtgctgtgcacacagtaaacaatacaggctcactggatacatattgaggattttactgccattattagaagcgatggatacaaagttcagccagctgttttttcttggttaatgaaattgttacatgatccaagacattcaaggaaaatatgattttgcttagtgaataatacttattaagcactttcatttataaaaataccactttcttcccatggttctttcaacagtgaaagtacacatttcctattgagcgtgtggggtgggttcaggcttcaggcactggcccctctggcagcggccacgaagcagtgggacacgctaccctgcccggacaagccattaaagccgcctgcctcaaagaga

SEQ ID NO: 63693 - DNA, 2269 bp, Bovine  19866881145613
ttctaatatttctggaacttgatgaatgtgaattgacaaagtacagtatatagctttatatcagcattactgaaaatacggcaacggtgtatataatcattactcatttcttttatggggcatttattacttgacctttgaaacctcaactcaaaaccttggcattccaatgtactccaaaccagaaggagagggaagagttttcttatgaaaaatagcaatgaaacaacttaattctaatggagagagaaaatattgaaataaaaaaaagtgtagtattacatatttgagaaaaaaaagtgggaaaactgaacacaaataactctggtcacactagccaatatttactttaaggaagaagctttcattttaaaatgtgtatcttcctccatagatttataccctagccattttttgatggtccttgtcatagcacatggtcagcaggaggagagtggtgtctttatccagtagtgcatgcttgctttgtgtaaatttgactaatgggttaagtaattctcactaaattggcattttctctgaatgataggagtttgttttataaatgacgttgttaattattatgaacatgttttatagccctcattcttacatattaagagttttaggcagttttaatgaaagagttctactagttctccttgataggatgagtgggatgtgatgaaagcaatagtcacatggtggcctatgattcaggaacatttcctccttgtcacacagacctgctatgtgactgtgggcaactcatctcccctttctcagcccaaagtatcagatctgtaaaatggaataaatgttccagtctaccttctaggtcagttataaggatcactgaaggttgggaaagtattttataaatcaaaataccaccagatgcatatgacctggtcattagctgctgttctttctttgtgtttaggtggtggcagatgcttcactcctttgagagtattgctttgtggtctctattctcaaggctggatttagctggagttgagagtttacaagtaaaaaggttaggagaccacactggtgtggtccttgctgtcctcctctctggattgggaagcagtgcccagaagccatggctgacagtgctccctgttgatctgattccccaggctgccatccacaaatgtcccctgcccctcatccaggtacatttgactgcacagatagctcatgtacctggaccttgttcaaggttcatgtgcatatgagatactgtgagttggggcctcttctagctagaaatgtcagtgtcttcagaagtcaagcagttctacatggtaggtattgttcagtaagagggctgaagccacagcaaattaaaacacttcctagcgggcgacagtcccatgggttgcaaagagtcagacatgactgagtgactgagcatgaacaacctgttagttacagaagctccaggagtgctcttaaaggtgtggtaggtacctgtgtttgtgttaactttagcaaatggaaaatgtaggactggaaaaatgcttccttactgttttttctagagaatattcacatttatccagcattttcagtattttattttttgatagactcatcagaggaacaaaaaccataaatgactggcttattgctacaccccatctatgttatttccaactttttttttttctctctctctttgaacaaaagttgatttcctgatgtgtacaaagctttgtgtaagatactgatgggtaaaagcttaaaatattaaaaatgcattcctgccctcagtgagcttgcaatcttctggtcttatagtcttagcaataatgagtttccaaacgctgcacatattatcctgtggtcacggtccatgagcaggttagtagatgaagcctgggctgacgtgtcccatctaatgtgatggcctcagaataagctaatgctttttggactcttactgtctgcccagcactgatttaagtccttcacctacactagctcatttgattttcatatgagccctatgactgggactgtcagtagcatcattttttcaaagaaggtctcaccttcctgaagagttaagtaactgcccagagtcacttggccagcagacatgaagctgtgattgtaactcacacacattggagctgacacccacaggcgtgctcttaacctctgccctccaccccctctccagttcctattgactaggatgacttctattgcatattttcattagtaatactttagaaattcccctctaacaattata

SEQ ID NO: 63694 - DNA, 853 bp, Bovine  19866881174364
accattatggagcaccatcactgagtcagacactgtgctaagaactgggtttaaagttggactcagtactgtcagaatgagccagtaacgtcttcaagaattcctctcccccaggtaccccagacactgctgtcgcctcatttcctagctctgtggacaaagctaggggttgagagtggagactactgctcttctgaaaggtgatgctctccagtcttggcaggagaaaaaaaaactggtgaggaaataaatagtctaaccgtccagatttatttttttgtaacttcgagcagcaccaaattcccaatgaattctcaatagatgtctgttgtcaagggggctgtgaaagatgatcaaaacacacagccctgctccaaaaggcctgccagtcgcgtccaaacacactaagacatgcgggcctctgctgcgtcctaagcacagcaaacatcgcacgctggtcctgacagaaccatttaccccgtacacttaagacaccgaatccggtcctcaggctcccaaagttgcccaagtagaatgtgccctttctctgtcacagcattttaaaacagaagagagcaagcacaactccagaagtcagtcacttctttctttgcagataagccttaaaagttctcttggacttttttttaactgtttcacctaaaacgcaattatatacgttctgcttcacaaatcactgtgttaagataatttcgagacagaacgtttgaaaaggccgcagagttgaagggcattctgttagcaagtttagattatatgaaccaattcactatttgaatgggtaaaaaaaaagacattcaagagatggctttaaaaaaatttaagaaggtgt

SEQ ID NO: 63695 - DNA, 668 bp, Bovine  19866881183167
ttgtgtttataattatttgtgcttttgtgttttagaagcttttactctggatctcggtctcagggcctccttgtaaaatgcttttctttgaatagttaatctgaggtctttatctttaacattctgcatctcatattttatgttagttatttctctggcttaatgacactctggccggtgttgactcactctaaagaaaggggctgtttacttaacagtggcatgcagtctgttttccccaaacacaatctttgaccagagaatgggttgagtagtagtccttcttcacataagctgcctggaagctgtccgttcagccttatctggtgggtgacttgaagtgtgggctcattatgcttgcatggcaaattcttaagtcacagtcctttttcttagctttaaactatacggaaaatttactagctggccttaattttgttattggggtcgatataacttcaccgtgattcctgtactcatttgctcggtaaatattcaaagattgcatttgttcccccagggtaaacatctttccttgctcctcaaatgtcacagggaaagacctctggtcctgccatggcttctccatggaaaagactctgtctcctgtgacagcgatgtttttaaaatgtagcttccaccttgaagggtgattcagtatggacata

SEQ ID NO: 63696 - DNA, 1111 bp, Bovine  19866881237337
actgatgatgttattttcttattttgcatctgttattgtgttctactctctgagtttaccctcattttctaattggatttaagtagctgctgcttgtttcacagatgcaatgccttcctgtatctctctgagaatattagtgatagtcttttaaagtttcttttttcctccttgtttctgtttcctcaaaattaattttccatttttctctctcgtgtattagctgctttcctcagatacttgttaatttttggatgtcttctcaagattagcagtgggaactgaagctgattggaagctctgtcaaacttaaaaatgtttttccaggtttcttcaggtataattgacaaaaactgtatgttacacacccaatctagctggctatcaggtcctgcctcatatgaaggccgccagcagttgatgggtagggctgtgtcccagtggggctgactacttaagactggtgttgacctactcctgggtgtgttaagcccctggtgttggtaggctagagggaggattccaagatggtgcttgccagcatcagtgcccctgtggtagaaatgagctccccggaatggctactgccagtatctgtgttctcaggtggagtaccagttggtcctccaagatcaggaggagtgtctaagcctcctttcagatcgttacctctgtgctgggacttggagcatgtgaggacttgcatgtgccctttaaggagggtctgtgtttcccacagccctatggctcctgtacgcaagccccattggccttcgtagccagatgttctgagtacctgtcttcccagtgtaggacctccaggctgggaagcctggcgtggggcttgcacccctcactcctaggggagaacctctccagttgtgatgatccttccatttgtgttgttgcctactccaggaagctgggtcttgactgaagcaacactgccccctctacaaggtctcattgtgggtctgtctttatacttttagcggtggaaggtcttttccactagtcttcagatcattctcatcaatagttgcttgtaaatagtcttagttttttgtgtgtttgtgggaggagctgagctcaagttcttcctactctgcca

SEQ ID NO: 63697 - DNA, 1124 bp, Bovine  19866881238300
ttttaccagttaggaagtaggcactaagttggcaaaggagacgaattctgggaatgaggaaagtgaaagtgaaagttgctcagtcatgtctgactctttgtgaccccatggactatacagtccatggaattctccaggccagaatactggagtgtgtggcctttcccttctccaggagatcttcccaacccagggattgaacccaggtctactgcattgcaggtggattctttaccagctgagccaccagggaagcccaagaatactggagtgggtagcctatcccttcctgtagcctatcaggaagatctccagcagatcttcctgacccagaagtcgaaacagggtctcccgtgtcacaggcagattctttaccagctgagctaccaggaaagccccgaaatgaggaaccagcctgcaaagaattctccctagtttgtttcagcttctcactcttgttcatgtgtaactaggcccagtcttcctcattaatctgagagggataggatcaacaaaggcaaagagaaggaacaggattctatgagttatgccatgtttgtgacagtctgtctcttgctgggaatgaaatgtcaaaggacacctcctttgttcttaggtgactgcttagaagtctgaaaggaagggttgttggctataattgatagtgattttcctagtgaagattcaaatatagcatttctgtagtaacagagatctgagacctttggcagtgagcaaggggttctgtttgggaagagcattttctctgggcttagctaattagttgcagaaatggtctcatgccagccaacactatacctgggttctggcacattctcagaactggtccagttctttttaagatattaccagtttcttggattctgttttaaccaagttttgtttagttaagcaagataaatttcctagacaacaggtgatatatattcctacattttcttagaatgtagagaatgagattaattttaaggagaatattcctagccaatgacaggaatatccaagtattacagcaaagaaacattgcagatattcagctgagaaagatttttaaaattatactcattaataagatttttgtgtttaatattgtaatacgaagt

SEQ ID NO: 63698 - DNA, 719 bp, Bovine  19866881266004
aggccctgtttcctcattttaaaatgtggcagaatgggtgctaagggatggcgaaagtgaaatgaagagggaaggaagatttcttagaacaaaatacatgataacagattaaaccaaaccacagatatccttgcctatcggtgaccagttcagttatgtgtcttgtatttttgttacaggaagacaatgggaaggctaaaaagacaaggaattccttaaaagggtgtgtcctgatatcacatgaccaagaaacctacaaagactgctgctggtgtgtgctctaagctgttcagatttacactggtcatcaaggtagactcagtctctccaatgtcgctgggagctaaaggcctataagcgagggctgtcagttcttcccgatgttggatcattgcgtggaataggacccaatcttattgagcaccgttgctgaaaggctagctgaagtgacactcactctcctagcactcaatcaaaggtcagtgaaactgtgcacacactcctttctctctcagtagatcaatgctgaaagaagaatattatcaagggccagaggggatgagaaggtaactcttcttgataaaattagctgttccagggcagtctgttttaaccacaaccctctgcatggctcctcctctcaaggtttccttgtctgggctattttcacctatttttgcagaaacgcttccccacactcaggagggcatcctaggctt

SEQ ID NO: 63699 - DNA, 853 bp, Bovine  19866881295552
tactggagggagaaggaaagctggggtttgtttagttgagaggtcagggcgaagagataaaaggagagtgagtgttttctgaccttcccctaatctcttccccacccagttggaaaacgcaggtcctgtttgggaagctcccgagcccagtaacccaaccagtgggattttcctgacaccaagacacactcgctgtgatggcctcactgtcaatggccctcgagcgacttagatttcagacccggtcctcggtgggagggaggcggctcggcgtcagtgtgtgggcttttgtgtcgttctcttttgctgtctttttgtgtgcaggcccaagccccatcccggaacacacatgatttagctattttacatcatccgttatctagtgctctgaaactgagcatagagccatatattagattgaggttaggagaggtggcgactgtttatttaaggtgataaaatggtccatcagcagtaatctccatcgatatgtgccaccaggagatgaaggatgaggggacaagccacaattaattgccctatagttttgtaggagagagtggagccggcccagacccgcttcgatctcctcttgcgcctcctattcatcatcttcgcattgtatatggcggcctcgcaggggcaggggccggtgaggtttatctctgcgcaatattctctcgccctcacacactggctctcccatttaatttattaatacagtcatcgggagacaaaaaaaaaaaaaaaaaaatcacatttcctctttctttccctcccccttttgtctctccctcttggtcccagggccaagccggcagccaggccgagcaggggaagcctgacgcggctc

SEQ ID NO: 63700 - DNA, 1045 bp, Bovine  19866881345690
cctttattaggaatctgaggctaagagcagatatgacctgacaaaccttttacagtctgttcatgatttaacccaggtcttatagctttggattcctagagacagactttgccattttcagaggctggcctagggagtgtcgtgtgtaggttcctagggacatgttcggattcccgcagacagacttggccattctcacaggctgccccagagagtaaagtcctgtgcaggtactgcccgctccactttacttcctgcttctgcaggcctttcagcctcagacatgggggccactcttctcggcaatggcagctcctcccctcctatgttctgatgaggaggctcccccagattctgcccacaaatcttccccatcttgggccctttctttctacatgcagcaggaaagacccccaccattgtcctcattccagcagactgtttcttcacggcctggttctccaattctctcagctttctctgctaccacatttctttcagctttgaatccagtatttgtccccattcccgctcaaggccctgcccaccccctgctctgtggagccccgtaaccctggtgggactcatgattcagtcaggcacgactgaaaccaagcaggcaagttcctcagctctactgaagctagcaattccttttcagttactgagaggatttgaggagagaacatatgcacagggtccagctcagtgccaggcttaatcaatccgagctccctttccccaccagagtggcctggagctcttactcacatttcccagcacttagcacactaatataattagcaacattagtatatctaaaaggcaattaccatttaattgctctggccccagccagcctgaagttgctctccagtcacttccaatttggagctagggtgttttcagtcttacccaggccaatcacaaaatcactgccttggagagaattaaaacaacctacaggcagccattgattacgagataaaggatttggtaatttcctccatttcgttctatataaaaatgcacatatcaatttgtt

SEQ ID NO: 63701 - DNA, 1207 bp, Bovine  19866881352039
gtgcaaacttatgctgtggctctggaaatagttacggcacagaggccttgtaatgacccatgaaccaaaattggaaacaaacaactattttgctgaatgtgtcctctctgacctaaacccaatattaaactttttacagaactataaatcaaatccattaaaaacaaaaaacccagtgaaccagtctgaactgaatccaaacctacatattttctaaaacaactgaactgtaacaaaactaaaacatcaaaatattctccaacctgaatcgatatttcatttggttcaagtctctgaaccacattttctgtttcaagacaggattattgttgttaaccatccctttaaagaggaaatacagaagggaagttaatgccatagttagcactgagtataaataagaaaagtatgttgcaaaatgtatgaaaaatatgcattttataaataaaaaattatttaaagcaaagcaagaaaaaaactgtcaaaagaggaaaatacaataatcaaatctgtgaacaactgagaaaatacaggggaaccagtgcagatcaccgtgaggaagctgtaaatttcatgtagaatgaactgattccatgggatgggagaggaaacaagcaagcaaatatacattaagtactgctaacatctgcttatagtttagattgcaggggaattattcactttaattataattttccttactttttggtcatttttgttgattatgaatggcaaggagaagtaagtagtaaacagaaaaaagttgggaagtaacttctggtctgtatgaataagaaatgataaaattcaaaaatgtattatttgaacctttaagttatcttagaataaacatttggatgatttttggaagaaatttatgtttaagagaacaattctctaatatccaaattttgcaaaattttttttgtggtgtagaaacacgaatatgtctctaaaaataatggaaacttaactgcaaattatatttagctatgctctggcatacataagtacgcatacagaagtatgcatacaaactatgcataaaagtatgcataaacactaatctaaaaaagtctagctttttctgaatagcatattattagggaaatgatcacagggcatagaatctgcagattcatgactttttccaacaatcaattaagacaagtgtcttaattcctaaaggaatactaccatattcaaa

SEQ ID NO: 63702 - DNA, 1072 bp, Bovine  19866881378312
ggtgtggctttagatctgggatgcccactggcttttctgcccctcccccactctaggcctccctatgagactctgggaactggggaggcttcacctcatctccactcacctttgggatttgccaaaatatctcaggggactggtgccttctctgtgctctggaaccaccccatccccctgaaacatactctgaatggccgcaggaccagagccaaatgctttggcacctttcaagggatcaggagaggttactatgactcagtcaaggctgttgagcacaatggttttaggaaagcagcctggggagggttgagacttcttgatttcccatgcctttgtgcaactcaaactgtttcctctgagagacagccagactgaaggtgactgaaagcaagtgacttgggctgaatctgtgaactcctgtttgcgtgtggacacatctgctggggaggaaatcactgcaagtcagtgagttcactgggctcactcaggccatggtgaacattcatgtgatgatgtggaagtaactttttcatgtgcagtgagtgaaaaaggccttctcctagcatccttattcctgaattctcaagaaatgactgttacaagaactagagagatatcacaaacctagcagaaaaaaaaaaaaaaagaaattcctgccagccctgcagagttcttcaggactctgcaggattttttcaaaactagcagcaagcctgaatttatatatgcaaggcaaagggcttcggctttgtaagtggtaaatcaaggtatactttacctgtactgaactactgttagattctgttctccgcagtgccttgcacatcggatatacctcatccagctcgacttactaggttccccaccatcaataaagtgctgtagtgtcccatcttggtcatatatctagagaagaggtcagaaggtcaagtagttagaacgaatcatcagcaatcatttcccctgcttcccttggtgtctttatgtgttggctgcacccatttattgcccataggtttgctagtgctcaggaatgcttgggaaactcaactagaaaacaggagaaaaa

SEQ ID NO: 63703 - DNA, 1001 bp, Bovine  19866881378932
tgactgttgataatatcaaatgtctggtttcttggtagagagagattaggatatgcagctctgcattcagaagttcttgagggaggcagtggggaggcagggaaagagtttatgccagaggcctgggctctgccagctacaaggcaggagatttggggaaaggcactttattcctgtggctcagtttgctcaactataaaatgaagggagttgggtaaaatcatttttaagatcatttatagctttaaacttacatgaataaatgtgtcaaggggatatagactttgcccaggtatccacaaataaacatgtgctgtgcttagttgctcagtcgtgtccgactctttgtgaccccatggaccatagcccaccgggctcctatccatggggattctccaggcaagaatactggagtgggttgccatgccctccttcaggggatcttcccaacccaaggatcgaacccaggtctcccgcatttcaggcggatttatcatccgggccaccagggaagtccaaaaatacaggagtgggtagcctatcccttcttcccgaccccagactcaagctagggtctcctgtattgcaggcagattctttaccagctgagccaccagggaagcccacaaataaacatcaattcttgaacaggctattgagagccataattcccaccatgtaacatcattccatgtaacagaataattaaaaaagtcaattcctcaagtctaaacccgagttagttggtcccttggccacaatacggagatgaggactcaagagcaattcctttgactacgagtagggggcgagcgagtgctgtcccaagccagaagaatgggtgtcccaggctggcccttctggcatcattagggttatttgttaggccaataagtgtttgcaaagtaacttaatgtccaataggtaaacaacaactcttacccataactctctgtctttggtagagagggcaaatgtcgcacatttaggaaatcaagaaa

SEQ ID NO: 63704 - DNA, 974 bp, Bovine  19866881401689
tgtgagacttttttttttaattgaagtatagttgattcacaatgttgtattagttttttgtgtatagcaatagcggaccaagacctttgacctaattttttattagacccttaaaggaaaaggaggaagaatatcagacaagtccaggtgttactgaatttattagtagaagctgaccttagaagaagtagaaagttgtggtgagttaagaagtaaaaagagacatgaatgcagatgcccctcttgagatgttcagatgaaaggagagaagagatgggatggaatccaaagctgggatggggttttttgattattgtttatttggctgctcggggtcttagttgcggcatggggcatcttccatcttagttgcagttgtgaactcttagttgcagtatatgggatctagttccccgaccagggattgaacctgggtcccttgcattgggaccacagcgtcttagccactggaccactaggaaagtccctgggatgggttatatttgtcgggttggtgagacttgaggatgtgtgtggtcaggtgcaaaaagacaagactgatgggtttaatccttagacaatagagtagagatatagaccaagggacttagggctggagtcaagctgggagagggttggggggagttttccacaactgcctgccaaggaactgagcttaggctgcagagacagtgcatttggaattccagcctttggcaaagagccatgtagcaccttccacttacaagcagaaagcacctctatgactgtcttacgattttaggaaataagtactcacaaaagctggcagttataccagactttgtagccttcagactgggttcatgatttcatttgacctatgctaaccttgttacacacaccatacacacacctcatatgcatacaaacatatgggtatgcttgtttatacacacacttatatacatacacatagaactatatatatttca

SEQ ID NO: 63705 - DNA, 1584 bp, Bovine  19866881463348
atggagatctgttagagctccattgtgggacctgctcttcaggcaaccttggaagtatttccaattggagtcccagaatctccaaggaagctcccagatgacaccagatgacatcagcctggggaatattggcctgagtctcagaaaaagaagctgcaaccaacaaggcagatccatttgtgagcagggaaaagaaagagggcaaatatccaaagtcttccttctcctaaaaacctgaaaacagcccttggtttctctgaacttgtctgcttctgacattagcggtgtttcttctttacaccccatctaaaccaattcatatggctttaatcccataccaggccaggacaggaagttcagccctttccttcctcaaccctgagggggcccttcccttgctctggcgatggtccaccctcctttatcatttattacttccctcctgactctctgtctggcccacatgagaggccgtgcctgtttctgctggccctgcccgctctctgtgagtactgtggccagagatggaaatgaggttttcctgcacttggaagaaacagcacacatgagaagcagttgaggttccagcgggggtcaaattgggtagaaaaaattacaccaggaaaagcactgctaatttagcataggatggtacagttttatgcttagttcttttaaatttttattatgaaaatattcaatagataacacttgcagggaaaagtataatgaagtcttctatcctccacacccaggtaaacttagttgaaaacctgctaagattgaatcctaatggtctatgtttcaactactgttcttttggatatgtgatggggagaggtgctgggaacacaagattccagagtacctctgatgccttttaattctacttccggaaatatgagattaaacccacatggctataaacaactacagtgaaaaagtgaaaactggcctagacatcatgcaggctaggtttcatcattgattcacattgatcagctatagaccaatgtttttcaggtgatacttaactgagtgtgtgttcagcaaagtaatggccccaaagatgttggcccctagtcctccaaacttatgaatatattacatgttacctttgcagatgtagttaaggttacgcacctcgtcatggggagagtatctcggatcatccggatgggcccaatattatcatgtcattaatagtaggataagaaagaaagacgataagagagatgacagcataagaagtatccaaaaccctgtggcttgttctgagatgtggcaagctatgtgcagcgaccagagagaagcttctccaagttaagggtagtcccagcaggcagccagcaaagaaactggaacctctgtcctataaccgcaggaactggagtctgccaacaacctgaatctggaaccttcagcaagaaacacagccccaccaacaatgtgtttttatctggtgagtccagggttgaacgtctgacctacaaaagtgtaagaaaataaaggtgtgcggcttaatacattaagcttgtaatctattatggcagcaacagacaactaatagaaacatctacaggg

SEQ ID NO: 63706 - DNA, 817 bp, Bovine  19866881509950
tagtaaaaactttactagttttccttagaatgttcgacttcagcagagccctaaaggttaacctgaacgaaacaaattcaaaggactcataccattgcaaaactacagttactgtgtgagagagggtttacctgtgtgtccacacagccacagagaagagatgataagggtacgtcacaatcatgtggaacatgagtgggtaaatgtacatctgtgtgtgataagataaccctctatcagaaccattcctgacatttgggttttcatatctgcctttttcctctaaagtgcatctcacacttcgctctgctcagtgccactgccaatgaccactgcttccctttgcacttaggattctagaacaggatgtcatttgattaaccaataaccatttattcactttttaacttagtagaacaggaaaaactcctcaggtctaaaaaaaaaatctctttgggcatatactcatgaattaaaaaaaaaacatcttagatcatagaaaaccacgtgagctgtcacagagttcagtgtctgaaactgatatggaaaagcaggatttcccagacctcagcttgctcgttgatgatttttgctttatctttacaatatctataccattacctacctgatgtcccattttaaaatgactttaattctatttattcatattatttagcctcagtgtaaacaatactatttataaaactgtgggggtttgtttgtatattactgctgttactactttaatactactaatcctgtaacaactgtaatactaccttaatactactaatatggtagtattgaaaacattttt

SEQ ID NO: 63707 - DNA, 1363 bp, Bovine  19866881719585
aaacataagctgctatcaatcatgtgctcagggcattatgtgaggtttttactcagaaagatgtcattaaaagttgcagaaattaattggtgccattgaatgtaatggcctttcctgccatagtttctcaaatgtaaagaaaaattatggataacgtaaactccttgtgggattcttatagatgtctgctttgttctgttattgtttattgcaaatgttattactgtgatctatggccctatcacgctttgtctacactgcgctgctcttctgcagcccacaacaacggagggcttcactcataagtgtgggctgtgtttatttggaaattcttcgctttcatatattcccaaagtgtctcaaggtgttcatttcgtgtgtttaaatttttatacaaaaacagatttgttctgattgattaaatattgacttacaccatttttagaacaactctgaaccttatttaagttcagggtttgtgttccgcttccccagaaggtttgaaatcagtgtaataatggcgattactttgtgtgaatcaatggattgagatccgtaatctttctcaataacaacattggtttaattagtagtggtttaaaattttgacccttaattaaagaacaattttatgtctctgtaaaaacatgtttaaggaaaatgaacttttttgcatattagatactatcttaatactatataatcactaaacattaacctattgcttctagatatcttgaagtcatttgtggatgcctattcttttctgattctatgatacaaaattctagaaattcatgaaaagggacagtatgccccttggaaaatgtaatgaattaagcttacaattctattttactccatcttttgattgtattttgtgaaattttagagcatttctgggttacactgtttaagacatatcttcagaattttatagttgagatcatgtcaaatattaaaaagtctattgtaaacagctaaattcaaggccaagatggttcattcattcacatatagggaaactaatgaaaacaaatgttagcatatataaaaataataaaactaaactctaaaaaaaataatattttgtttgggattgtttgatgatatttaaagcctagtaagttccatagcatgtttggggaaaggctattaaataatgaatagctttatgttttattactaaaaatatgaataaaaatagatataaaataatagtgaccactaaaagaaggtagagtcatcatatagttttcaaaccaacaaaagaaacagtaggagaaattttttaattttttaacggtccaataaaatgcagaaaaaagaggggaaggggaagcaagttaaaaaataaacaaat

SEQ ID NO: 63708 - DNA, 1365 bp, Bovine  19866881748169
tctatgtgtgtatgaaatgatgattaaaattccttaaaaaaaaatcttagctaagaaattccctggttgtccagtggttagaactccctgcttcactgcaggaggcatggattcccaccctggtgagggaactaatatcccacatgccaagtggcatggcccaataataataaataaataagtaaacataaaagaagggaaagcattttaaagcctttaaaaacaaaaatatcttaacctaaacaaaatttcagtggagttcagataaaaccatatatacatagacctcatcttgagagataatttctgagcacttgacaatggagagatatgtaagtagacataatgaggatacaacacacagtactatttcagagtttatctgcaactcttgctttcaatttgcccatgttatttataggccttttttcacatctactgtagctcatgaatgaacttctaagggtcacatttacttgataaagcatctagaagctctttcaaactgttatacttaaaatatcaaatgcaattgtccacattcccatttgggatcccagtagcatcttcttcttcttcctaaaagacttcgcagagctttacctgtagactcacagacaaaacaggttttcataataataaacttacagtttaaatgctggtaaattcccacagtagctgttttttgaaaactttttgttattttcctctactttaaaataagattgtgtaacctgttttatttatcattgagataggaagcttgtaaaaattatatgtgttcaaggttttgaaccccagagaaaggcaccattcaaagttatgaggattataacaacgaatgcaattccattcctcatatatgtagttgaaatgtataaacattcaaaataaaagatacagaaaatgaaatatgggttaacagtggctaatttttttgcagctgatatcataatggcaaatgtttttattcctttagtctgaaactttggaagtagttttcataacattatgaaaaaatgtcaaaatacaaagaaattgttaaagttctggaaaaatccttaagatactgatggaaccctattattgcaactgtggctattttcacccagtgattagaaagtgccattatgagaggaattactggttgtaaaaccaccacaaaatacattgacctaatggcagtttctcaaagctaaggcaaaatgttccatgagcttctctttattgattgttgttcccatgcgtacctctgggaacaaaacagcaaagaaatgttttgatcggagaaagagtgaccttttctatggaagggttttaatgctgtgatatgctgaaataactaactgaaaggataacaaaggg

SEQ ID NO: 63709 - DNA, 915 bp, Bovine  19866881927410
ctggaagggagcaggcatgagaatgaaataggaagggaagatggaaagatagatgttagaagacgctgctcagtctctgaatccagccatgcctgaagccaatctccacccccagcttttcagttacccaacctattacattccctcgtttgcttaagccaggatgaattgatttcttgtgacttacaacccaaagcctttgtctaatacagcaatattggaaaagttttatgtataaagatgaagattacagcattatttatgctagcaaaatactggaagcaacttgaatgtccctaaatggttgtaaagcaatagcatgcattcattaagactaatgctacactttttagggaaaaaaggagaaattctgtatgcagcacgatctcaattatgtaaatacattcttataaaacaaaatcaacaaaatgtagagtgacataaaacaaaggccaatggtaggatttttaaaactcttttctgtttgtaatttttaaacttttttgccttctaacttttctctacatttctttataaactacttagaaaaaaaatattaaaaaaattttagaggtaacataggaggaaattagaatcaaatgtcatctttacataaaaagggccttaagtcttcaaatgtcagaaagcacataagccattgctactgccccgcacaaagaacatgtacttttcactgtatttgccatctagttttttcatgactatgagcataatgtgatttctctactgaataaactgttagggtgtctattacagcagatgaccaatgagttaacatcttccccctggtagaagccatttatcctgagggtcaggctgtatactgaaaatgttagcaaactgatgactccatataaactactactttatgaaagcctatgctttctgcaagag

SEQ ID NO: 63710 - DNA, 653 bp, Bovine  19866881940253
atgtagttgttggtctacattcattagcttagcccatgttctaagcaaaaaggtctcatgttaccatgaggttatagcaagaagtttccatgcccttttgatttgaataaaggggatcctaattagggttttatagctctcatattcctcccttctctcattcctcaaaattcaccaaatcagatacaaataaaacatgataattaggcaattgacaaaaagtagagctttacacacactctggtttgggatgaggaggccatatctataaaagataatatgtaccatggttacacaaacatcttccctttttggattggattactacaaacctaaacaggttcagcaacagttgttctgaaacaactaaacacatttgaaacgaggaatataaagctgagagtgaaatctgagcttttaaaatgtgcatagtcatacagaataaatagtccagtgtgagtactgtgaatggcaggactaaaatggtaagaactggagtcttgaaaattctcgaacacagatgggccagtggttttgttttcaagctgaacaaaatagtctctttttttggagttcagaatgcatttcttccctttgaatagctgtctctaaaaaaaaattattggagtgtagttgatttacaatgttgtgtt

SEQ ID NO: 63711 - DNA, 690 bp, Bovine  19866880456132
tgttgtctatccttctaaatgcatagtttgcatttaccaccccaactcccagtccatccctccccgaccccctccccgccttggcaaccacaaacctgctctccatcagtctgcttctgtctcatagataggttcgtttgtgccacactttggatttcacatgtaagtgatatcttacggcgttcgtccttctcttcctgacctacttcacttagcgtgataatctctagttacatcaactaccctgttcactgctgacctcccacacttttcagctgaaggtggcatcagctacaagctgcaggaaacaagagaacaagtttctgctttgatagatgatgcgtgtcattatgccagatgaatatggaatgccttcaactgtgaaggaagcaggaatctgcaagatcaaactaaacccaaaataaaatcgttgtgcaggaaacaatttaagaggtcggtgcgggttctcccctcaggtatgcaaacatggcacagttgatccagctggcatcagtcagcctgcctgattgttctttaaaaagcccttgttttgggttccattgtaacctgcgcagtgatgccatatcccttgtaccagcaacagactagaggaaaagccaatcttctgcactaaattgttaggggcagggcatgcgtgaaccctggctttgaagcttcattaaggctctg

SEQ ID NO: 63712 - DNA, 1296 bp, Bovine  19866880845307
cactctttcttacacccatgatatataatttttcagaacacaggaagaacaagatgtcattcacacatctgaacatttagattgccatactattaatctgggttttggaaagttgagaacaaaggaggactccctgttttgtctggtggtggtgaacaattgatccatactcagtctgaaagcctcatctactctctgtactcatttatcagctgtcatggcatctagcttgctgctgagaaaccctgggtgacgtctaccatgtgaactctttcaggtctggggtcaccgcaggcagcaatggggacctgacacctcaactctacaaacccacatttctcttagaattgactgtggaaggttttcacagaatgtttctttcatgtcgcatgcctcacattaaatattgttaaaaaactaaaaaccgattctgggggtacaatttacaagtcttcatataagaaggaaacgactgaaaaaatacccacccaagcacctacaactcatctagcgaacaaggctactaatacgtaggcggtgcccggagaactccgtgacttgtggaaaagcggggaggtgcggtccaccctctggaaggaagtgagacgtgctgatgcagagagtgctgtcagtggtgcttggcttcctaagtcaaattcggcagctgcgtttcagagtcagtgtcgttacttatttcgacctaaaacagaaaatatgaatggctttaaaagacttcaaaattgaaaatgaaatttcctttctatttacccgggctttataaaaggcaaaatgtgacttgtgctgtctgggttcctggctgtagagtcagcaaccaaaacaccagggttccctgcttttcggatcagggtgggtgagcaggtgtaaacatcagagggtggaacttggcttcctgggaaggaagtgccagccacaagaagataagggggtgaagtaagggtgttgtctttggtgaccttggggtaaagacgacagggtggtgttgtctccaaacggccagatacgcccctaacctaacctataggcttctgctagttgactgctcaagaatcataaacacataggtggctttcacaccacctatggcccttacatacatcccactctgtgatggttaattaaaaaaaatactttaatttatttatttttcactgtgctggctcttccttgctgcgagcaggcttttctctagttgcggtgcacagacctctcactgtggtggcttcttttgttgcagagcacgggctttagggtacatgggtttcagtagttgtggtg

SEQ ID NO: 63713 - DNA, 934 bp, Bovine  19866880853293
atttcccagacattcttccctggaatacggtggtgaagagtactccatagaggacatctgtcaggagtggacaaattttataatgaagtcggaaaattatctcagcagcatttcacagacggttaaaggagaagttgttacttgatgtgaaaggtttcctgattaaaaattcatgactgagatcctatctggttatatgaatgaaaggaagggaatctttaaattaatgcttttctgatttttttttttttaatgtaaaaatcttttaacttgagcaacgtgggtatttgggaaacttctttactttttaagtatcttttctttaccttagaagtaattaaatgttagtataccttaaaagcatagaagaggttccttttttggcatttgaaagaaagttatctctgaagtaccgtcatgtgtacatttgtgtttacggttttatttttaaaaacttttctggttatataggtttaattataaatgaatacatagtccactgaagagaaatattagcacaaatcaactgactataaaaatctattcacacttttttaggtgtgtcagatgagactataattcagattgaagtctgagtacagttttacatagttatttccacgggccaccaagctagttcacctcagggaaattctatttagcatatctgcacaatagaaacttttgaatgaagtccatatgcaataaactattatacgctgcatcaggtctctaggaaattattcatgttgatacaattaactccatagaaattcagagatggaataatatttggttgccatatacatggactctatttttaactaaacagtaacatgattacacaaggggaaggaaatgtttacattgtaaaatcagtcagttacatctggaacttttcagactatgcataaatatttaggttttactatat

SEQ ID NO: 63714 - DNA, 1383 bp, Bovine  19866881014087
ttccaacacagtcactcatcagtttgctggaggtgctgccttcttgtaattctcccccacagaggcataaaaatacaagtaatgtatatgtgtatctgtgtacttggagtatccaccaatttacagcatcttatgtgttagtcgcgcagttgtgtccgactcttttgagactttatggactgtagcccaccaggctcctctgtccacggaattctccaggccaagaatactggattggggagccactcccttctctgggggatcttcctgaccagggaatgaacccgtgtctcctgcactgcaagcagattctttactgtctgaaccaccagggaagccccagaagcatcttaagtcattacgaatacttttaggccagtcgatatttttgcccctgccatgtcttaggcaatagctttcctgcaccttaataacagatgaggtgaggcagcaaatataatggctactaaagaggtgggttattttaactacaacaaccctcaaaacatacaacaggattcaaggccagaattattacgtttattttacagggagaggggaaattctgaccaagaagtgtaatgtgctcaagatcacttggcaagtcagtggccataggtagtattagaacacaggtctcctagggatcctagtctactgtatccatgggtaaaactgtaaactgtagaaagaaagaaaatttcttcgaataaacatttatacaaataaatactttgtatgtgtgactaaatgtatccaactgaggtgatactgatggatgaaaataattttaataacctaaaatatttgtaatcaatacacaattttgtttatagaaaatttgtatctctaatatcaaagatgtcataaggacacacctaagttaaatgactatgtcacaaaccatacttatagtaatgctttacaatgctggagatactctattttgttttgtcagacaagtacttcatagaacttgcacacttaccttaaagcaggtaacacaaaacacttagcatttcaaatagccttgcaaagtgccacctccccacagatctaggataaaataatttatgctaggcaataatgaccacagatttcacatatgtctaagtctatatactttctaatgggcagaccagcatgaaagaaattaatggatcattctctttaaatttagaaaccaatttttttaaaactcacataaatcagtatcaaattgtgagctttatgcttacaacacagaaaataattctaaaattaaaatcagtctaaaaattaaaattgctgtttatatatatatctttaatcaaaatgaagcaatggattatctaatacactgccattactagcatcaaaaatgtcaaaaaattgtacaactca

SEQ ID NO: 63715 - DNA, 743 bp, Bovine  19866881028767
cattgcaagcagattccttaccagctgaggtaccaaggaagcccaataaatatactatcccttctctttaacacacaactaaatttatatttaatatttggaagcattatcctgaagacagtaccttggacagcaaggagatcaaaccagtcaatcctaaaggaaatcaacccgatgctgaagttggaactccaatattttatccacctgatgtgaagagctgactcgttggaaaagactgatgctgggaaagattgaaggcaggaggagaaggggatgacagaggatgggatggttggacggcatcaccgactcaatggacatgagtttgagcaaactccaggagacagtgaagacaggaaagcctggtgtgcttgcagttcatgaggtcacacgagtgagcgatggaacgaaaacaatcctgaatagactacacacttactgtgagaacagcagcaatcttcttggctacagagggggtaatttgaaaggcatgagcaaactgccagccttccaaatcaaagacagccttgattccatttcgctgtgtctctacctcctggacaataagctccgacgtgatgagactcacacgaaatgcatcataagctgtgaaaacttttgggtcccagtgtgctaaaaaaaaaaaaatgtaaaaacttatatctcagtactgtgtgaagaataaaggatcagaaagatttacagaaggaaatggattcttttttagatttcaagatcaa

SEQ ID NO: 63716 - DNA, 1420 bp, Bovine  19866881055657
tgatattgattctgttgacctagtattcataatgtgtttgatgcctgaatcagagaaaactttttatattatgcagctcaagtcagttcctatatattagattatatcagcttgattaaattttcttctatgtatctcaactggcagtcatttccatgggcaaaatgaagacctttgaattatcttcttatttgattaggacatgctgtatttttttaacctctatctctctcttttctaaatcaagatttagtcacgttaattagaactggtagaccctacagccaaattttaaatcaagccaacggtctcattttttgaaatagccatggacgtttgtatggggaaatcttcctttattaccactcactatggtagaaaggagcagagcaattactattgcagagtaatttaatactgttttattaacacagcctttcatcttggtaaggagttctgggattcatgaggatgtccattttctgtgaaatactatcccatttaaatagattaatccactatctatcgttataaaagcataaaaaaataaagatgaactaaaattcgagtagagaataaaatgtaagaatcaattaacttgcatccttttaaaaaatattatactattatctttaataattagatacatttttcctgtttcttacctgagctattgttcttttttatgccaggtacttgacatgttagactagagaagaattaaatctggaattaaaacttgattaatggtccaaaatactttagagtttaaatcatttggatgaagtaaattgtagaaatggatgtttgtttttatgtagtgaatggctcttttatcagacattatttggtgtttaggttatagtttactttctctgcccagcaggtttcctggagaaacggcattgtaggcattttagagaacttacaatgaaagaacattcttttgcagtgctttctttgtaaaagtagcatacaaacataaacttttctcataatacttccttcttttaattgcaactattacttctcccagggagaagtgaaaaattaaatcacagagaaaccaaagaactgtcttttaagagtagatagtctttaattcaaatgaatattcattttattcttcatatctgagtactcctttattcctccagatcaaaggatttgtgttatgttgttttctgtatgtattttgcctgtgttgccatttgtatggaataaacttgttccatggcattaaagacatttaaaaaaagccacatccatttatctttctgattttcaaataaaacttggctcaggatccatttaactaaccataatgttttcagtgctcagaatcacattcttctcctcagcctctgatttcccacagtagaaggaggtagatctcagctttagtttgggggtgtgtgtg

SEQ ID NO: 63717 - DNA, 1609 bp, Bovine  19866881057554
actatattatcaggcttttaaaatgaatcagttcattactcatgaaattaatgtatcccctttgtgacatgtacactgggatctatttatgaattgtctattttattccattgatttattattttaagtctattttcatgtcaataccataatgattttattacagtggcttattacagtacatctccccattgccattagatttttaaatagttttcttggttattctggatatttgttcttccataggaaattcaagataatcctaatgaaataaaatttcttttgagatactaattagaattatattgatattcacagtattacttttgggagaactgacatttttattactgtcttcctatgcagtatgttatatctttgcatttgttccagttttgttttctgtcttttagtgatatttgtactgttcatttctgtgctgctcttgtactgttactactttacagtttttgtcacttttgtgaatggaatatttttccatttataagtgcttttttttggccatgctgtgcagcatgtggggtctttattccctaaccagggactgaacccacgcctcctgcaatggccatgcagagtcttaaccactggactgccagggaagtccctgaatgtgctattatttctgcagagaaaagctactgattagaagtatttattttgaacccagcagatacattctttaagtgagtttatagatcatatttaccattcctttaacaactctatgttgaacacttttctaagctctaggataaagcagttgaacacaagaactctgccctagagggctcatattctaatgtgtattacagtaactaaagcagggcatatggtctcagtcattgaaacaaaggagcactatgataggctggaggagcagactcagagtgtttactctcagcgtgacttggtggtgtcttgcaggatatggcaaagtgaccatcaactgagattggagtcttgatcacagtctttttctgaattctctctgccatgtttggagatttccacaatttccccctccaagcacctcttttccccactacatcttatcttttatgcatcatgtgctttcagagtgtcgctgctctgagacaaatcttttaacttaggaagttgggatgcaccaaaaatccttgtgttgccatttcaaacttgagaagaaaggtaagaagaagcagtactgttatttgtctaagcttttctagaaaccaattagctaattactatgtcatctcagttcctccatccatgtatttgcagacttttcatggattttcatcacaaaacagtgtcgagtgctttgttgagatgtaaatagattgttattactagatactttcatgtattcattcagtaatgtcaaaatacatgatgtggtctgatgtagcttaggctcttataaatacgtactgataacaaggctacatatccttctttcccagatagacaaaattaatttccttgttgtatcttcaataacttttgagatatcaagaaacaagccgttttaatgattaacaattgactctatctcttctggagttgactcacatcattttctatagctctgaaataattc

SEQ ID NO: 63718 - DNA, 1089 bp, Bovine  19866881073777
tcccagatgaggggggtagagagagagcaagaaagagccccgagaatggaagtcaccaccctttaccaaccagcctcagaaatggcatcccgttattcctgccacatcctatctgttaggagcgagcccctgaaatccagcccacactcaggaggagaggatcatgcaggacaggaacacagaaggcggaggtccttgggccacctgtctgcctgccacaccaaaccatccctccctccttgcaaataaatcataatcaggggtgaaactcacctgaaattgtgattctcttttttttttcatgaaatggcctaaaaatgtttaagtgactattttgctttcaaaatatcaggcagcaattgtcaggcagaacccaccactgccaatttttctcactgtactataatttagggtgcactgccacaactgctattttctgtgacattcccaaggatattttaaacaatgataaaaaagacagttatatcaatttcttgagttttattattattattaacaataataacaaccagacgagcaaaaaggagtaatgtgtctctttctccatttatcttattcctgccctctgttacgatctccttggctgccattgttgctttcaaaaagctagttcaattactgaaatactattcattaaattagaaatgatgggtttgccaaagaaattagctatgatttagaaatcaaaagcataggcaaagattctgctcaccatcaacgaatttccagaagtcttaacatcttttcacagccattgtgaaccacagaacaaagttgatgcttttgaaatctaacccagcagttaaagacacaaaagcgacaacatctgtaaatagcttggttttcgcaactatctaataaaaaagctcatgtgcaagtatctttctgccgattgttcaagccccacagtccttatgattttccatagctttcaactgaacagaaagaggaggtctgagcgcactccccgggaatctaccccttgggatgcccaaaaggtcatcatgcagggtcaggaaattgtttgcaaagtgtcatttcaaaaaaaaaagaaaaggaataggaaca

SEQ ID NO: 63719 - DNA, 1186 bp, Bovine  19866881177579
aaattgtcttacagatgcccatatgtgcaaaaaagttgttcttcactatttttattgaagcagttttggtaataggaaaagactggaaacaacgcaagtgcttggaaactggctaaatgaattatggtagagctatgcagtggtcattacagaaaagaatgagggacttcttttctataatgaaggtggcccagtggataagagtccacctgccaatgtaggggacacaggtccaatccctggtctgggaggattccacaggcctcagagcagctaagcccgtgcattgcaattcctgagccggagctctgcaacaagagaagccaccacaatgagaaacccgcacactgccagctaaagagtagtcccgctggccgaaaccagagaaaaccagagtgcagcaataaagacccagcacagcaaaaaaataagtaaataaagtatttaaaagggagagagaaaagaatgaggaactctgtatgctggagtagttctaagacacagccggaggcagagtcacttgtggtggtgtgtgccgtgttctagatcctgtatttgtctcagcctagaagatgcagagaaaccagttacacaggttgtcttggggagacagggctggggggctggggtcatagaccaaagaagaagactttgtagcctctccttgtacaatctgctcaggaaaattcaagttggtaataaataaacaaaatgttttcatcttcagtcagcagtgccatgggatactgggagaagagatcccattcttactttgagtaaaagcctccaagagcaggcggcatctgtgaagccagggcgactcaggtctcacagggggaggagccgaggtgccagggtctacacttcctccgtcccacatgcagagtcccttcctaaggtgccaacctagaagaatccaggttttcttttaccaagaaaggtggcattttccttcacaggtcattggactctgttttcatagtttctttagtttggctgaaactcaggaaagtaaacagcaaaaacaagtgaaccatgaagttaagcctacatcattggggtgtgaactaagatcattaaatctgtcatgtgagatctaaatattaatgtagaaattccatgatgctataaaattgtgccaaaagtagactaacccacaatataacagagtaaacagctgctgctg

SEQ ID NO: 63720 - DNA, 991 bp, Bovine  19866880413321
ccctattgaggatgtaaaaattgatatgacactatcattcacctgtggtttttaagtctcaacgagatccaaaatcatttattataagatgaaggtacttccttaaggatcttttacaaaggaattactccaaactggttataaggatgttaaatatagtatttttacaataataatgataatatttaaagctgtacaagttcaaccacagaaaacataagtgaatcaatactagagatcctataaatcagttattttcattctttataagtattcagagtagttgactacatgaataaaaattccttgtacagaattaaatggaatcagattcttgctcactgataaaagaggaaagaaagaagacaggtagacagacaaacgagaatcaaaccaggagtccacaaattacagcccaagagaaaaaatctgactcttggcttccctttagcatagcccacaaggtgaaagtggctttcacacttttaaatgattgaaaactatcaaaagaaaaaactatttcatgacattaagattatgtgaaactgaaggaaacacaaggaagttgtccataaataaagtgtcattggaacacagccacacccatttgtttacctaaactgtgcttttgtgatgcagcagcagaatggaatacttagaacacaagccatatggcccacaaagcctaaaatattttacgttcttgtcttttgctgagaaagtatgctgactcctgaggtagacagataagtaggtagataacacaagctgtaatcctccaccatctagacttcaaaaagttccactagaaatccaaagcatagtaattaaaatcaccacagtactttgtgatgtgttttatcatcacttaaaaaacaaaacatatttatcatgagccagtattattgctacaataatactatttatatgctttcccttagaaaaatggacaggccagtgtccaaggtgccagggacctggcagtgtccga

SEQ ID NO: 63721 - DNA, 1481 bp, Bovine  19866880493815
cggaggaagcctggtgggctatagtccatggggtcgcaaagagtcggatacaactgagcgacttcacttttcacttttcattctactaatagcatggggagtcagcggcagagaaagtgatagtaaaataagttaccttcttctgtgtcaccttttgaaaaaatgtgtgcaaacatttattgaggtccagccctatgcaaggcacctggttaagtcctgaggatacagaaatgagtaggaaccaatatacttgccagaagccctctgtctagcacagaggttctcaagtgagatgactttgttccacaggggtcatctagcgatgcctggggacagttttggttgtcacaacatgtaggaagggaaccaccggcatttagtgcatagatggcagagatgttgctaaacatccataatgcacaggctagcaaagaattatccagtccaaaaggccaataaaaaggtgctgaggttgggaaaccctgaccgagccctttcctggagtcttcctgcctctatcaaactcataatgtcctctcacctcaacatttacatttagtaagttataaaaatcaatgagtacaccaataatctccatgaaactacatatttaagttaacggaatggtgccatttccatactcagacttcaaagccaatgactccatatatgatattatcaatgaactctggggactggtaagtgtggggatttcacatgtggaacacacacttcaggctctattcagtataacatcttccactctcttttaaacctttaaactttaggattttgtcaggcaaggaaatgaaaacaaggtatttttaactacctgctcaattgcttggaaaattacctcttaaaacatctgaacacccacttctcattttttccaaagccctagagtagccaagtgatattaatcactggaattccttgatgaggaaatgccatttttcaaagtattttaggacaatttgttttgtttttcaagctctgtattctgggacagatacagctatagatacagatgtccatctgcaacacaaataatcatgaatttgctgcaaacccaacagcagcacctggagaagagaatggcaacccactctaatattcttgcctgaagaatctctggacagaggagcttggcagggtacagtccatggggttgcaaagagttggacacaactgagtgaatgagcatgcatgcatttacagcagtatattctctgaattcaatactcaattttgatagacctatatgagctttcaaagggcaacaaactcactgcagcaatggaaatctaaatatttataagctcttcaactacaaatgcaatatatattaggcaaaataaaaaatcctgatattgtgtagtgctatatacaatgagattgtacaattcctttagtcttccatctgttcaaataaccatagcacagctggaggcaataaaagctactcaattgtcttctca

SEQ ID NO: 63722 - DNA, 2931 bp, Bovine  19866880705409
ctacattttctaagacttccttaaaaatcactgcagatggtgactgcagccatgaaattaaaagacgcttactccttggaaggaaggttatgatcaaccctagatagcatactaaaaagcagagacattactttgccaacaaaggtccgtctagtcaaggctatggtttttcctgtggtcatgtatggatgtgagagttggactgtgaagaaagctgagtgccaaagaattgatgcttttgaactgcagtgttggagaagactcttgagagtccctgggactacaaggagatccaaccagtccattctaaaggagatcagtcctgggtgttctttggaaggaatgatgctaaagctgaaactccagtactttggccacctcatgcgaagagttgactcattggaaaagaccctgatgctgggaaggattggggacaggaagagaaggggacgacagaggatgagatggctggatggcatcatcgactcaatggacatgagtttgagtgaactccgggagttggtgatggacagggaggcctggcatgctgcaattcatgaggtcgcaaagagtcggacaggactgagtgactgaactgaaggaaacctttctttagaatcatgccaaagagtgaaacagtgtagctgttagaacattcaagttcttgttgttagagggtactcaccagaaaatgggcataatatgtataatgttaaatactatgtttccttaactagtttatgggattcccgggtggctcagtggtagagaatccacctgccaatgaaggagacattggattggatccatgggtcaggaaaattccctggagaaggaaatggcaacccacttcagtattcttgcctgggaaattccatggacagaggaacctggctgcctacaatccatgggttgcaaaagagttgcacacaacttattgactaaaaaacagcaacaactcgtgtataaaaatcatgtcagtaacagctgaagactgcaaaagaatcatgccagtttatctgaaattacagtgagaaagaagtaatattcacaattcttaatgtttacttattgagtcacacttttaaacaccttcatagtttaaatatgatgatgaaaatctaagccaaataagccatggttaataaatacttgttttacattgatcttttcatgaatgcagttacaaaacaacgctgaactttttgaagatacatatgcaaaattgggtacatctgcaaaatacacatggacagccttttgtttataggattatgtggacatttatagagtatttttttcctctgggtactttggagctggctcctcagaataccaaagaatgtgtgtgtacatgtgtgcccatgtgtgattgttttgcaacactacaatgatttttagggattagaattatgtagggctacatatgctccaataaataacactcaaaatgttttaccttctgtgattttctatttatttcttaatttttaactgtcatcttttgagaatggcaaaattattacggcaaattctaactccagaggaaattccccagctcagccagttgccagtggagctataatatcagtaatgaagagaaagttttcttagaagttaaaagtctggaagaaaaggttaattatgtagagctgcctgacaagcaaccatctatcataaaaggaaagagctttatataatcaagtgtccgaaagttatcatgaaaaaaaatagacttcaaaccatttcacagagtatctcagagttttctacttcctcttaatcaaaacagattttaaagaaaaactcattaataatttagtcatgagtctttcattttggacattaaagtatctgaagaaacagaaaccaacacacagaacatgcattgataaaatacattgattgtaatttgtaaagataagcatgacaaaattaaacccgtagtaaatgcctcacctattagaaactcagaattttcttgttctatatagcaagatggttagacagcatcaccaactcaatggacatgaatctgagcaaatcccagggatagtgaaggacaggggaatctggtgtgctgcactccatggggtcagaaagagtcggacacgacttagcaactgaacaacacatagcaagataaaaagaaccaagaaaatcccatactgagaagtttagatttagcaatagtacaagaatgaatcacttaactgtgaagttgtagtgattaaaaaaaataaaacaatatttaataaaatttaacatgaattatttctctcttatactatactctgtgatcaaattctcttacaacaaacttcaagggaaaattttatttcattatcttagaatatttttttgaacactacttgaaatagataattagctgggagcctgaaattattttagttaaatcaagattactgtaataagatttagcctgtatttcattaaaaagccaactgatcagatgcatctggggaagccataaccttgatttgtctacaactctatttcatttgccattcattttttatggtaactcattgtgaacaaattgaagaaaaacgtaccccacttggacattatgatatttgtttgtagctttgtcctggttttagtttcctacttaatgactaaatggcaccacagtgggtaatgcactggagtaaaagtggtgaatcattaaagacttcgtaaattttaaaaacaggggcaggccttctgggccccatatgcttctagaaaacccaatgttgtgctgtattaattgaaccgtgaagcttttattagtgctctttaaaaagtgcttgcagtgaagcttttattaatgcttgccctcaaattgtttagtactacttagcatttccataagatttttttatttcaaagaactttttgatcattaattatatctactctacattt

SEQ ID NO: 63723 - DNA, 2043 bp, Bovine  19866880715280
ttgcatacaaatggtgtttttggtctggctggcattgcagatcttttccttgaaatgaggtgacataatttgattttttacaatctggggggaaaagaagtatttgttcatcttgagacgttagagaaaaaaagattgtcactgaataaaatgcatgacttgacacaattcagaaaatgggttggtgccagctagagaaagctaggaggaattctacctggttgaaaagtacaactggtctggtagtaaaggaaaatctcttcaggtggctcagtgggaaagaatttgcctgccaatgcaggagacataagagatgcaggttcaatccctgggtcgggaatatcccctggaggaggaaatggcaacccaatccagtattcttgcttgggaaatcccatggacagggagtctgggggtctagtccatggggtcacaagcagtccaacacaactgagcgattgaacatgcacactaaggaaaatctctaggatcagtcatgtggggctttgtaatggacagggaggcttcacagaggaaaggattccagttcaccttcaccttagcaaacactttcccttctgaattccagtgaactacatgttttggtcatagatgttaaaatttgaaggcttctccagagactctcttgacaagtaagatattctttagtatgtaaacttttacagataaaatacctcaggtcctgagagatattaagcaactttcccaggaactcacatatcaccaccctaatatttgattcttttcttcctcctggtgctgtctgtctctagatgctatgctgacttttccagggaatatcaagaataggatctgattttaatagatagaaggcatccttctataaatatcagatttactttgacttatctataccttagtgaagaaacacaatgaaatcaaggatgttttaaaagtaagttgagtaaaccactataaaaatatattgagtaatatataaagtattttctgtgctaagtagaagaaatcagattataaagccatacattaattatatgtgaaggttttattttttttccaaaataaaactaacataccataagaacaaattgattctttttttagtttgaaaataccttaagtaataaatgcaggtatagatcttaataagtacatattttcaagttcttgaactgcatacacctcaaaactattccaagtaaacgtctgttgttgttgtttagtcactaagtcatgtctgactctttgtgtaggctatattaaagctaggcaaagctttttcttatctatacttgccaaaaaaactcctgaatatttaggaaaacaagcataatttcatatatttaagtgacaaaaaattacttttaggagaaacacagtcattttactaatcgttacaaggttaaaagtttagttgatcagttgtgtccgactattgtgaccccatggactgtagcccaccaggctgctctgtccatgggattctccacgcaaggatactggagtgggttgccatttctttctccaatggttacaaaacagcagttaaaaactctgaaatcatggattctagttaatataataaagaactgcttgcaaaattcttttcatgccatggtgagaaaaatactgtcaagtaaagaattcagcacagttaaataatttaatttggtcttttagagcaagttaagaagttcaaacatttttgtcctttagttaaaaacacttttccctgcaatatagttttttaaaagtgaactgtttattgcatatgcatccaaaggccatatcatactcattttgtataaaattgcttaaagaaatattctctcacactaaatgttcagttgaaactttctagattctcaacataagtatcagaataatttaaggtcacatcatgagctattatctaagtgtatagatataatgtctatatactcaaatggagcaagttaatttaagaatggtagctgaaattgtgttttatgatagaacatgaaattatctttaaatttacagggaatataattataggaa

SEQ ID NO: 63724 - DNA, 1110 bp, Bovine  19866880888366
aaaagaggagctgtactgtgaatggtacgaactcattttttcaggacagtaataatggcactggttctcctgtccaaccctgaaagatgtgtcataacaggaccgtaactcttttaagtatcccttattgtcaatctcattgactaatcaccagcagactcttgaatttggcaaacttggaatttactctaaaaaatgccactaactcatggaaattaagggaactgtcattctttctgctgactcacttttattcccttgttctctggtgcatgaggtagaaaggtgctctattttggtagatacgattttgtccctcagtgaaatcctgagtggcagctaagtgtgacatttgctcttcttttcactttgtttcttctttgaaccatctcactgtcaaaatggtgttatagaaggaggattggactagaggtaaaccctgactgctgctcctgctccacctgtgactagcagtgtgatctcaagcagtcctatagcatctttagacgaacttaccaattgtccaattcctggcatatttatccaagtcatggttgggaggaggagagtaaatagttaattagcattgactataaaaatatttatcttcagctgaaccatatgcaatggccttttttgtagatcaggcagtttcatatggtttaaactatatttgacccttgaacaattcagggttgaggggcacagttgaaaatccacctgcaaattcacagtaggccccttatatctacagttccacatcctaggattcaaccaggttaggatcgtatggtactataggatatatttactggaaaaaatccacatataagtggccctgtgcagttcagacccatgttgttcaagagtcaactgtaaaagattctactatccacacttcaaggcctagggatatatacacaagtcagatctggtttgcatctacattgtgaacatgatgaaaattgttattcatatctacaactatttttttttctgtttcttccatttcgtgttattctctttcctcccaggttaaattcaggccttcagaaccatcttgatctcctcattttatctatcccttatccatccattcgtttcattcat

SEQ ID NO: 63725 - DNA, 724 bp, Bovine  19866881084357
cagacatgaagcccccagtgaagatgccatctgggagtgaatacattaggccaataatagtgtattgtgaattactgtgaataatacagacttgacacatcagcattagtaactagcaggcctctgaggaaagggaatgtagaactgacaacatttaaattggtctaagagaggaaagagcagagtgaaattccttaggcctaggccctaacaggtaggaaagaaggtttatgaaaagagaaaagccaaaaggtagaaaaatgtctttaaataattttactcattatctagatcaacctcttattttgaagaggtaaaaatttaggaccaaagaaacacaaaaaggggaatgccagcctcaaaacaacattgatgatgtcacaattttacccagcactgatgccacttctacttcttccaataaatcacactcctttttaaccagggtcaaaaacttgtttgatgtaatataaaaattccaaatcaaacgatgtcatatttattatagtcacaagaatccaacttagctttgaatgctgatctgctacaatagtgcatattgcaaggacagaaacagaaagcatatggaatagaaataagttgataaaggattttaaaacaaaagtaagcaaaaagcaaaagaaaaagttcattttttttttttaaatcccaccattacctatgggcattccccaagcatagaatctcttttgtccctactttt

SEQ ID NO: 63726 - DNA, 1771 bp, Bovine  19866881100222
cacatatagcacaccagggatttcttagggtgttgtttaaggactcccctaaaaatacagattaagatacttggaacttacctagaaatttcaatatcagaatctgtgtaacaagagtccataaacggcattttaaacaaattcccacaatgatgcttaagtgagctaaagggtgagaacaactggaggaatgacatatgtataaacaattaagaaacaacaaaacagagagaataacgtggtctaaactggctttggagtctgacagaccataatgaaaattccaccttcccaatttcttgctatatttttatgggtaaattactctaccactcttactttcctcaccaagaagatggtggctctaataactacttgtaggatcactagggacaaatgacaatacatttaaaatacttagcacaatgctcaataaatgggaaatatcattatgaaagtcagggcctctgtgttacaaactgcccctagaatcgtgaaacatcacagccctaataagtataattttttaaagggaacaggacagcatatgcactacaagaattcaggaaagggagttttcactgtaatcagaggtagaaggaaaggtaccctgaaacagctggtatgcagctttaggatgttggattttaaatcaaacatgcatggttggcaaaaatgtccttctttcccaagggtcctcaagccttaactcaatgaactggaaagttttaagaaacaattttaaagttacctcgctgtgtctttcaactatcctgtgatggaaacaatccacatttgaattcccgtatcataaaatatattcagtgttaaaattatcctcaaaattatttcaagttctatactagtaacaggatgttagtcgtgtgttttatgtagcaccttgtattcctgacaagacagtaggactttgtacagactgctgtgttgttgatatacaaaatgacagtgctggccgcctcctcagggagggagaccctttgggtttctatactcttattactgatgggttgtagctattttatcattgcttggaagaacctatgaacgatgtccactgaggttcaggaaggtcaagaagatgaagactaacctgctccagggagcgaactggctcatgataaaatcaagcctcttgatcccattagtaaaacacactaatcaattaagctaacacactcagagccaaacctattaaaccttataattcctgggaagaataaagagcaattactccttcccttcaaaaaaaaaaacaaagagaattacaaaacctgcaaaaaataagataacagttaccaaatatataaatacagtctcagaactcaaaacaaacacagcactcaatccacaagacacttattccctctgagtgagaaggccttctctgaaactgagtatctgaataaaaacaaaggagctaaaacaaaccattttatcacaggcaacttctattaatgtcacagaggggaagaaatacaatcttttctttcatattctacctctggaggaaaaaataagcatatgtacatacgtatatatctgcacatattaaactgagacagatcaacacatataaatagctcaatgcaacatctgtagtagtctttaaaactgtattaaagtccttgctgtttatcaggctggtaaatcatatcagctcctagatatttaaattgccagttgctgggcaaccagagctctgtcaactgtcactccttcttaagttcctctgcaacactcctttaagaaa

SEQ ID NO: 63727 - DNA, 2647 bp, Bovine  19866881126666
ttgatggcatgaagatggtatgtgatgccatagaaatagatatgatcacctaagatggtaagaagtgagaaaagctgagggctcagaacttaaccatgggaaactccaaaatttaaaagacagaggaaaaatagacagtaaaggagatgaatacatagtagttagacaaaacagaaaaccagaggcatagaatattcaggaggaatgaattgttacccatatgagtgaaaattgttcagttgtgttcgaatctttgcgaccccatgggactgtagccttccaggctcctctgtccgtggaattctccaggcaagaatactaaagtagatagccattcccttctctctgggttggggatcttcccaacccagggattgaacccaggtcttgcccattgcaggcagattctttactatccaagacaccagggaagcccccatatccagtgctaattaaaagctaataaattatcaaaaaatatcatggaatttagtaatgtggagctgattgatatacaatacattgaatatttaatttctttaagatgtaattgcattttgacatgttggctaatcaattttactattgactaattcaataagtacataagatttaagagtcatgttattaaaagtcatgttattctcctaagtggcagtaaataaatttattcttaattatatttaactatttatgccagtctgaatttatctcccctatagtgtaaattgcttgaagtctgcacttgattcatatttgtattttcagtgtcaaggcggctaggtattgttgctaagggcatctctcatgggtgtcattcacagaggtggttctcaactatggacaattttatactgagggaatatctggcaatgtctgagacatttttgaatgttacatttggggcaaaatatgctgctagcttctggtgggaagaggccaaggatgctgctaaatatcctccaacctacagggcgcctcacaaaacaaagaattatttggccaaaaatgtcaatagtgtagaggctgagaaacctgacatatcgactatgatgtaatagtcaatgcccaccctgaggggttggcaatcatagtttttaaggtttttttttgcaaacaagtggggatctcgtactgtgtttttcatggtataccaataagttggtatagtaagtgatctttgagtttcatactgatcctgagacttcatagaaagaaatgaatcaataaaagtaaagcacatttgtatgaagtgcctctgcagaattaatttctaacagaatttatctatatggttagaagtagaagacagtgctccacccaatggatgttaagactttttacatcagagtcggaacctttaagtagaagttagttcctatgtgaaagtatatattacggaagttttaatgttaaaaagtaatcttgaaagttattagatatattttttaaaaaacctaaaaggtcccatctctttctttaaaatgaaacattttggctttcagtatattatagttcatatatctaaaattgtgttgaagtatgtataaatataataaactactaggtacacataaccaatttagaaaattgaatatgaccattcatatcaatgaatcctcctctgtgactccccaccccctttacccacctgaaaataaacacaattatgaagttttgtttattgtttctctaatttgaattaaagtttgatatatatatgcacctaaaaatatatgaaattagagttttttaaatgcttgtgtctataaaattaaaccattatcttacagcagacacaaaaatcaactcaaaatggattaaagacttaaagcataatacctaaagccacaaagcccctaggaaataatatagagagaaagctttatattattagcctttagcaatggtttcttggatatgacaccagaagcacaggcaacaaaagcaaaaatagacaagtggatctacatcaaactgaacagcttctgcacagcaaagaaaaccgccaacagagtaaaaagacaacttatggaatgggagaaaatatttgcaagctctgataaggagttaatagtcaacaaatataaggacctcctacaactcaatagcaaaaaaccaagtgatctgattttaaaggacttagatatttctccaaagaagaaatacaaaggctagtgggtatatggaaagatgctcactgttgctaattaccaagaaaacacaaatcaaaacaatgatacatcacctcacaactgttagatagacgttaaaaatgaaacaaaataacaagggttgatggtgttgtggagagattggaatccttatgcactattggtgggaatgtaaaatggttcagttcagttcagtagctcagtcgtgtccgactctttgtgaccccatgaatcgcagcacgccaggcctccctgtccatcaccaactccaggacttcacccaaattcatgtccatcgagtcggtgatgccatccagccatctcatcctctgtcgtccccttctccaactgcccccaatccctcccagcatcagagtcttttccaatgagtcaactcttcgcacaaggtggccaaagtactggagtttcagctttagcatcattccttccagtgaacacccagaactgatctc

SEQ ID NO: 63728 - DNA, 905 bp, Bovine  19866881617408
atataaaagtattggatttgatctgtttttccaccagttttaaatcccagtgattcagcaatattaactgaaagcacactcaccagagcatgaaaaaaaggctctgataaagtgctatagcaacaaatgttcctaaaagttctttaggttctgtttgcttacagaacaataaatgttccctgtttggaaataatccccaaatgttccctcttgttttaactgcctgaattcttaacactacgcagtacacactacttgtaatctatgactgaatggagccctttcctttctcagggagaatggaaggatgttattttcgggaacagtgaggctacctttaccatttttttctaactggcaaaatactgcaataaagtattgctcaactcagtctgaaacaattttcccatctgtcaaaatattttaaatagtatcaagctggtattactttgtcaaaacatttcatcagaaacagtatctaaatttaaacaagcagttcctcgaactatataagtaaggtgaataaactgtcaccgacacaatatatttttttggaaaatctgcaaagtctcattagaaaaaccttgaaggaaatgggtgtttaaaccgaggataaatgtccagtgggtagaggaaaattaatactgcattaagggctgaacatctcattgtcctagaaatgacacacttccattctccccaaactgttcgggtaaacagtatgaataaaaggaaaataatggctagcaatctttcatatcgacaatatatgtaatatattctggctttatacactctctacttctttctgtgataatatagcacaagaaaaagattaagagaacatctctccaggtcagacctaacatgctttctccacaaagcagtatatcttcaatcatcta

SEQ ID NO: 63729 - DNA, 702 bp, Bovine  19866880449309
cctgtgggcatacaccgggttgcccatacacctgtgggcatacccctactggctaggggtcctgaggaaggggccccgggggccagggttccaggcagctcctctccaggtctgcatgaagccttggttctttggggacctgctctgtgtgtgagcaatcgtactctttagatctctgagtgtggctaaagccatgtggggctggcaggcaaatgaggcagtggaggataataaagggaggaccgctctgccctgcaccgtccccttggccccagccctctcccctccccttaggaggggcctcaggccccaggagcagcttctttacactgtgactgtgtgcatgaggggtgttaatgattcatacaaatctgcaagttaaatgctctgtcaaaaatagaaatgcaattgtctacaataaaattaaaaacaccaagttcctaaatccaaaggctgctattgacagagtttcctgtctgaaggaacaaacctctcactgtgttgggaggggaaaaaaattatctgtgttggtttcctccccgccgccctcttcaatcagcagcctccatcagtctccagtctctctagagaggactttacaggtacaggtctgcctgtggcctgttctccccctaccgcatcctgatctgacctcactgcctgctgctgggtctctggggacccagcctgtgagtgatggga

SEQ ID NO: 63730 - DNA, 3342 bp, Bovine  19866880488899
cggcaaccgaggctctctctcctctcagaaaagactccaagggcttttcttgtaacaggagagagggttgcagaagagagctgagggcccagggtgggcatttctgggggaggcagccatggtacccacagaggatgccccgccttctgtgggtctcagccgcaccaaaccagaggcctaagctagagtcatccctgccttcggaactggtgagtgttgacttctggactggctgttattctctggactggtggcaaaccgagctgggatccatttgttttgaggaagatgagaatttattcccctttatcttcctcatcacagaaagagtatttgaggttcaaactctgggttttaaactgtgttgttcctgggacccctgagccagggaaagggtcagggtggggcgagaggcgacaaagaaaaagggatggtgtgttcatagttgcaatttaccaatggcaattagcttcctatgatgactaacctttcaaccttctgccagcctgcactgggggaacaattgacatttagaatctgcaagccaagtgccgtggtgcgggaggtgatgttttttaatggggactcagggcccatggatgtgctctctggccctgtgctatgtgcatactttacggggtggaggtcgagctgcattttaacaggtttgctggcttcctgggaaagtgagtgcagccgtgactgtggggattgtcacccgtgtggttcccagatgcagttggttttgcatccttacaccttccctctgctcttgcggagtaggcagaaaggatggcaccggcttgggtgggccagaggcttcagtctctcaccatccaaggaactgaaagatcaaggtcatttttcctgcctgcctctggctaagaacccaccctcttcccagggtagactgtgctttccagtgattactgtgttcagcctcctgcccctagatggtgattggctttctctagcctagccagggacctctctgggtctttaattcatccacccatgcaaccatgtgctcattcaagccactaacatttaccaggggcttattatgtgccggccactgttctaggcaatgagtatgcagcagaaaaatagacaggtccccccatcctcagagagcctacacgctagtggaggagacaaaggagaggtcaaacaaataagtgcaacatgtggaatatcaattgtgagatgtgctttgcaaaacaacacagcagggaaggaggagaggagtattgtggtggggagcttacttttaacacagtggtcaggaaaagcctcccagagatatttcagcaaagacttgaagtaatgaggggggagccacctaataagaacagccagtgcaaaggtcctgaggttcccaagagagacctgcaacgtgcaggggggtcaggccggtgatgagcaggcaaggaggggagaggcaggcagggatcatgaagggccacagagacctccagcagggctttggctcttcctctgagttccttggggagccattcatgccaggaggatggcatgagccgactggtgctttaaaaggtccactctggcagcagatggagagtagattttagggggtcagagagacagggtggagcactgctaggaggctgtggcagcaatccaggtgagaggtccttatgtctcctcagagaaagtgagcccacagactccctcaactcacggtcatccagacgttctccactgtgcgctcagctgggatttccagtagacatgtgtggatgtgggagctggaccagaaagaaggctgagtgcccaaaaattgatgctttcaaattgtggtgctggagaagactcttgagagtcccttggacagcaaggagatccagccaatcaatcccaaaggaaattaagcctgaatactaattggaaggactgatactgaagctgaagctccaatcctgtggccacctgatgagaacagctgattcactggaaaagaccctgatgctgggagagattgacagcaaaaggagaagtgggcagcagaggatgagatggttcgataacatcgccaactcaatgcacatgaacttgggcaaactctgggagatagtgagggacagggaggcctggtatgctgacttccatggggtcacgaagagtttggatgtgacttagcaactgaatgaaaacaaatgaggctggtgtcctgggtcttaaagcttatctttgggcaagaagatacctggcttaagagatacttggccccacccagagcatttgctgggcactctccccagaggaatcactgagggtctccagttccaaggagcagagctcaggcatctttcccagacaggcatgagccctaagggacaatatctatggcaaacctatgcttccctgcactcacggagagccttcagctgcaccatctcatgcacatctcatgatcaccctgcagatgattattattgtttcattattattgttcaccctttgcagatgaagataggtcttcaaaggtctcagctagaggattctgagtttctcagcagaaagtgaggaccaggaggagaggctgggagatgaggctagggtggggagtgggccagaccctggagggtcctgagtctcattgtcttccccatcctgaagaagccccttctccctaaaggggctggggtggaaatcaaaaagataggcaggtctccttctggccatggaaccccagactttcgggaggtccatgaccccttatcccacagaggagcctgggtttaactctatccaggaggaaaatggcagagttataacatgggttggcttctccatagccagctctttctccaagggttcttcatgcctggcccagcaagtgagagtctggcctgccctccgcagggttgctgggtcccagagatgttgaatgaaggttatcagggcagtcactctgcctctagggactggagctcctgggccatggctctgtggctctgctctcgtgggcagggcttagaactcaggcagagggaggaagctacagggatgggatcatttgtcattgcgggcacctgcctgctgagtcactcactgggactccagggacagcaagggtgctgtgcagtctgctggaacttcctcggaaacttgagcccacatttataatagatttataagaactgtgtggacatgtttgcttttttttctcgcccctcataagtgatgccattatggtagccataattcttatttactccatcagcaggctgctggtgctggcacaaaaatagatttggagaattatctcatacatgcatcataaggaagcaacaaaggcacccaggtgagatttat

SEQ ID NO: 63731 - DNA, 1947 bp, Bovine  19866880497443
tatggatgtgagtccaacactcatgttggactacaaagaaagctgaatgctgaaaaattgatgcttttgaactgtggtgttggagaagactcttgagagtcccttggactgcaaggagatccaaccagcccatcctaaaggaaatcagtcctgggtgttcattggaaggactgatgctgaagctgaaactccaatactttggccacctgatgcaaagaactgacttatttgaaaagaccctgatgctgggaaagattgaaggtgggaggagaaagggacaacagaggatgaggtggttggatggcatcgctgactcaatggacatgagtttgagcaagctctgggagttggtgatggacagggaagcctggtgtgcttgcagtccatgggttcacaaagagttggacatgactgagcaactgaactgaattgaacaagtcactgtgttgatatcaacagcaagtgtgtaatctagagacctggggtatggatgggaggcctgatttcttaaggcccaggaagatgacaggagccaagacagaaccaagatgaaagggtgagatcaagagcagacaggcctgattcctctgggctacactggatatcagacttcactgcctgaagatatgggccccatgatagaggacagagacatgagacaaaagctgtccctgccctccagtctcagctgggcacactttccactccacgtgagtgggaatggacatgaagacaaaggacttgatttccagccccagctgtgcagtgactcagtgggccatcttgggcaagaccctgcctctccatggggctcggtttcttcatttacaaattgacagggcaggagaggaggatttgcaaggttctttctacaaaagggacagtgagatggacattaatatctacctactgatacagcagcagaattctacatggattctaaagaaagcccagacctgctggctggcagatgccacgttgactctttcttacagatccctctgtgccagggcagcccataatcagtcaccttccttgaggaagctaacaatagttaggatgccacacccccggcccagaacccctctggagcaggaactaggatgccaccctgcccagaactcctcggggaagctctgttgcctggtggccgtggcagctgagccttgcaggggggagggaggaaagataattgagcagcaggtgcttctgggcctggtttagggcacaacagagatgacagcgcatctgccctacgtgtgttttcttatttgctcccagcaggaaatcaatgatgtcagaaaccgagggataactctgcagccccaatcaatagaccctgattaattcagtcatggccgttgggtaaatttgctgcatcataattagaattattaattaaaaataggaaatcaattgacacaaattaagcaaagtaagaatcagcttggcttctttgacattgtttgggcaggagttgaggacactgcacgctcagctctaatttgggggcccacatcctatgtgacccccgccaggacaaatccagcctccaggccccacagctcacaaggaagcagagtgagcctccaaactccagagctggaggtaccccagaagcatcttattcaataatctcattattaacattgaaaaaaaaaagaatttggggagaaaaaagtatttctgctcattacttttctttctccattcatatgcatatatcattttatcataaaaatgtattcatatggtatgtggtcacatgctctttttcctctcaacagcatggcacaatcacttattcatttgccacataattatcatttgaatggctgcataatattccatagatgtaccataatttgcctaaccagttctctattgttggccattgagttgtttaataataatagcagctacattcatgggcgggggggggggggt

SEQ ID NO: 63732 - DNA, 1030 bp, Bovine  19866880787976
acactgatgccctcctggtacttccgtaactgtgtgtctcttttgtcctgaattcttctaggatgagctgtccctttcccttctctggacctctccctcccgctaacagagattttcagttttaattggatattcttccctgactccacggccccagttcatcctctgctgagccagttgaatttctttctctgttcctggggacatttttcatctgtcctttctccaaccaatgttatctcagtgctaagcgggatcataattctgccccgtgtcatgggaattctcggcaatctattgcttctgacagcgacagagtctttcaggctcagatacctgagcacatgctcacagatttaggcggggttttttatgtccccacactacacacctgtgatacacgtgttacatagcgccatacgcaaaattgcagccatttacatgccctggaggagggcatggcgatccactccagtattcttgcctggtgattcccatcgacagaggagcctggcaggctacagtccacagtgtctcaaagagttggacacgactgaagtgacttagtatgcagcacgcatatgacatgtccaaaagatgtaaccttgccacatcacacacacagcacatatataatccaaaacagcctggaacgctcaccccttatggactcataccatgccatcaatacacatgatacacgtcccacacatactgcatgcaagcctcagaccacacatgcattacacacaccactcacacgtcacacacacatgcacgcatgcatgtacatccctcaggaaggctttggggtttctgttttgtcaggatcctgctcagggaaagatgcttcattcttgccgcagaggccacgtcccccaccaagacgcacaagggcttcagcaaggagtgttcattactgctaacgagcattacatgcctaattaattcccaggcttggtttgaggatctgacctggggcctatttccattcagggaaaaataaaggagagttaagagggcttctgtg

SEQ ID NO: 63733 - DNA, 911 bp, Bovine  19866880799072
tgggactggctttgcatgctgctgcctctcacacctctgcttctctatgcagctgcgaggagctttgcccgcctgggagccatggggctcactgtgagctgcgctgcccctgccagaacgggggtacctgccaccacatcactggcgagtgtgcctgccctccaggctggacggtaggtggacctgcagaatcggggtggggctctgtaagaggtctgagcatccctcgttcacatgcaccctggagagctaaattcctctcccatcctgaatagcctccatcctctttatggtcatggggatcattagacactgccggggggccatggacacagctttgactgccggggctcatatctaaatgctgtgtgatctgaagcaagttccctaacctttctaaacctgtggtcccttgtgtgcgaaggagttgaattcttctgataagttgtctctgtcttttagcatactcatttgagctgccatggctctgagatgtggtgaaaaggccctggtgtaaggatggaggtggtgcaggggaagggagagagcaggcatggcccccctgcctttatagaacttcagattcccagcctccaacccctatactcacagatgcacacagatattctgattctgtgggccccgggatctgtatcttaacgtgggctccaggtgattctgaggtagcctccaccagtctaggtctcttgtctggggaaagagggatgggatttatcaaatcacaggcctgaatccagacttcacatagtgttagccctgaaaaaaaaagccctcgatcattctagtctctgcttccctaaatcagggataaaatcaggggcttccctggtggaccagtggttaaaactccacacttccacttcagggagggagggtctgatccctggtcg

SEQ ID NO: 63734 - DNA, 3382 bp, Bovine  19866880802604
ttgggccctgcagcatgtggaatcttcctggaccgggattgaacccatatcccctgcactggcaggcggattcgtagccactggaccatgggggacgtctgtaatgtggaccagtctttactgaatgttacaatattgcttccattttatgttttggttttttggccacaagacacgtgggatcttagttctcagaccagggattgaacctgcgccccctgcactggaaggccaagtcttaaccactggaccatcagagaagtccccggttgtgcagtttaaatgagctgatgtgcatagagtatgtagcaaagtgtctgacgcagagcaagagcttaatcagtaatagtaccgagttgtttttattagtagtctgttattattatttctactgctgctgctgctactctgccactctggtctttctgttttggagtttcagctcctcagcatggctctgaacatcctctgcgatacggtatgaccttgcatattaccttccccagcatgactctctccctcgcaggaagtagactggtctcctacctttgggctgttgctcacgccctgcctgcaagcccttctccccactttgtctggtcaagccttattcctccttcaaagccaatgctctcatccaactttcaccatgaaccacctgctccaatcactcacatcagggcccctccacatgcatttctgtggtgtttattattattatgaaatattgtaaacatacaaaaagtaaggagacaaacactcatgtacccaccacttagctcaaaaggaaaaaaaaaaaaaaatcatagaaacaacagaagtctcctggtttactccctgattgcacttctcttgttcttcccagaggtaactggcctcctgcatatgatgtttatcactgccaagagggtcttgagtttttaccacacctagacccctaatcggtgttagctgtagcgctgcgtgttttgaaggttgagatatatgtacggaagctgtagcaggcgctgtgtactcgatgccatcgccctcagcccatctgctctcagcactgctgtgggaccgctcccggcgctccgccagcctcccacttcagcccgtggcatctctgcttggggctttctcccgagtcccagaaggcagctcagagtgtgcaggcacagcaggaggtgccaggagctagcatccctggggctacctgcccagttccatcagagaccggctcccccgtgcgtgcttccgggcttccccagagggtctgcagctgccccgcagtgacctgctcataatccctctgggctggttttcccctcccctatcccctcctcctgctcctcctgggagagctcccaaagtaaatcccagcacacaggcttcactctgggaaagccaagctaaggcagtacggcttctgctctcaacacggctttggggaaacactcatgttgtgacatatggctctatttcatccatcttcactgccacagagtactctatggaatgagcaggtctgaatacatacccctctccgggtgatggatgcttacgtggcctctggtgtctcgttatgaccaacagcactgcagccatccttcccgccgtttcctgaccaccctggtgctttccatcaggctctctgaccccaggtcccattgcgcttcccattcccattgaactcttagaagtccacgtctccctacctaaaggaaagccctaaaaggcagaggagggaatggtgggagggaaacggattcactcaaggtggagtgggcggacttcagtaccaactggatccagcttggttaccaccatctagtttcaaatcatcactcattcatccacatgtgccaggcacattgaatgggttaacaagctttcatcaatttccccttcatcttcctctctaattccttcctgcatttcatccttctccctctttcttgcctccccaggagtcaaggggacttcctgcagaagtacagaagccaaggctacctggaccccctccctgagcacctccagcaataacggaagctggtgttaaaacaacacgctgtctgttcacctgtgtgcagaaagcctgcaaacagcagttccaagttcttgctactcctcaggcctaggtcacactaggcaggtgacggagcgatagtcccaggggcgtcaagccctccgatcaaaacccacatgccctaggaaggcttccttgactctgccaggcaccaaatcctatagcgtttagtgttactatctcatgcctgctgtgtcagtggctcagtaagcctttattaagcatctactatagtcaggggatgaatgaagcgccatctgtcagttttcacatctgggctttgctgctttctttgtggctgccttggggcaggtggtgtaacctctccatgcctccttttcctcaaggataagaacggtccagatctcatagagttgttgcgaagtcaaagtaagttctcacgtgtaaggaccacaaacagtgcctggcatatagcgctccttgaaggatagctatgatagcctgaaaattctccaccctgtgactgactggggagggggaggggagggcctcaaactcaggaaagagctcccccaccagaacagtgggtaaatgccccagttccctccgggtctctcccaccatcctgggagctctctgaagacagggccctaattcccttatgagactagattttctcaaaggtggagaagaagcaaacttatctcacttagctgatcaaggtccccagggtagaaacaaagtcctcaccagcctgactgctgccttcagtgtgtgactgaggggcccctccccgcgttcaggccttcctggaaggggtgggcatcagaggcctggggggatgtcctcaacctgacatcctcgtgaccacaccaaacctggagttttgagcaatttgcaggaaaggtaaaaacaactggttgcaccactcaaaattttctttttattatcagttaatggcagcacttaccagagcaattttatatgtaataaaacttttttattgtctcagtcttggcttagagaggcagaaaaggagacaagcccagaaccagggaaagaaaagactggagtaaacaccacaattaaaactggcatcttcctaatagggacaaggatgatagattgaggcatgcacctggtttttcttcaaagacggggtaaaaggaagaggtagaaagttaatactctgggatggaggagagaaccagattcaggggaaagctggtctcttctggttttgctgtttggccatgggggtgtcactttctcgcgtctgagcctcagttttctcctctgtaaaatggggagatgtttaagggactgactcccctacccccacaagacctt

SEQ ID NO: 63735 - DNA, 1474 bp, Bovine  19866880824757
tgcagtggtagccagaccaccctggctggcaggtgcaagctccagtcacggggtggcagctgaatagatgagagaaggatgagaggacagtctggtcaggaatgcggccatgtcccaccctctgcccaccccaggcttggtctgcccatggtgcaggatcgaagagcctctgatgataaactgcttaatgttttcattttattttttatcatgtatttggctcactttgtcttagttgcagtaatgtgggatctagatccctgaccaaggatcaaacccgggccccctgcgttgggagtgtggtgtcttagccacttaaccaccagggaagtccctttttctttaaaaaaagttttttagcttaatgttttgtttatttgtcagaacatggcaaggttacatggtcttatgagcccaagaaactgaggctcataattgttagaaaatttgcctaaagttacattgcaaggaattgcaaaatcaggattagatgtaggtctcctgactcccaaacagtgctctttataatacaaatacagagaccaaagcaggaggcagcctttccaggtccttcccttgtgtactatgaggtttggagcttcacccactctgcacccaaaggagatgcccagtgtgtgggcaggtactagagggctgcactgagatgcagtggctctgtataccgtaggtacttaatgagcgtttgctgagttaaagtggaacctctgggcagatgtagcctcccctctctggcaaagtctatattggagaggacaccctccattcatgcattgctagggctctttaagactgagtaaggtcatctccatccctggtctggctagaacccttggctggaggcaagggctgcctggcatgacctctagagaggtgggcaacctgtggctggcagagtctgatccaatagccaatatgcattcatgttagaggagatgctgagtgtggtgaccaccttcttcttagagcttctgtggggagtgcaattgactgatggcctcacctactgtgtctgaaatccagataatctacctaaagtcacattgcaaggaattgcaaaatcaggattggacacaggtctcctgactctcaaacaagtgctctttacgatacaaatccacagagaccaaagcaggaggctttgttttctccgtggtcacacttcccctgggctcctctcagctagagcacagcaggaatatattaaggtcgacgcattcctgggaagtctgggactcctctgatgggcaattcggctgaaagactccccatcttgtgaaactttcttcgaactgtgcttcactttaagactttgcatctagtcttcctcctttgtttccttcacacaggtcagatctgccttgcagctgatgcttttctagcctccccagccccttccctcttttccctcacagctgtgttcctagtaagacctcttgcattttggcatctgctt

SEQ ID NO: 63736 - DNA, 1194 bp, Bovine  19866880886165
ctggggcgagctgaggagagttttctttggtcaagggttgggaggtctttgtttctctaagaaagatgctcagggctttccttgcaagctgtcttggtggggctcttgcacaagccaggggggcaacaaggcaaggctgctgaggaccccacactgtgtcttttggggagctgagtggaagcttcgcttgcaaagaccacaaaacttttaccattactgggctgatgaaggtgatagacagactgggaaactgagacagagagggggaaattatactcatcaggacactggctcaggcacaggtagttctaaggccaggatccaggggtcccagacccaccaaaacctgcagctcaactgccttaggagtaggagtcctagagtcattactctgcttttcttagctcccaagagaaggctctagaatgggaccaaggctcatgagaagagaggagtgacctgtgtgcacacagaggaagacagctgttctctgtgtccctgagaacaagccaagtgcagcgagagagaggttgagtgagatcggaggttctccaccttgggcaatcctacctctccctacccatccaggttgtcagaactcggggccggggtcgtgcttctggcatctagtggacagagaccagggatgctgctaaacatcctgcaatgcacgggacagccgtccatggcaaagaattatccagccccaaacatccacagtggcaaggctgagaaatttcgagttagaccaaataaaaacttggtgggtgctgggggctcagtcactggggcagtgagccaggaaaaagtggtgaaacattagagcttgggcagaaccaccctagaggaatgggctgttgaagatgaattcagtgattctttttcctgaaggtccgctctgtgccaggcatcgtgcagtgctgaggctgcagaggtggacaagcccatgctgacaccgctcccgaaaggaggtggtcaagtagacccggaggaacctggcctgggggcttggctgccaggtgccctaggagcccccatgcctaagaagtgctactgctcccaacccctgaaatgtgacacgtgttaaagagagtaaagcaaataatcatcaatattgaatgggctgagattagcgacggagaagagggagtccttccaaattaataatgcattgaggactccttcagaggaggg

SEQ ID NO: 63737 - DNA, 877 bp, Bovine  19866880926555
ttgatggaaactattctgctattgcctcccaactcaggaggctgtagcatttgactgagtgataagaaattgccaggcactttctaattacaattatcatcatcgtggctgtctctcttaattactttcttataattagctgttgctttttcctcagcatttgtgtactttgcagatttgctgacatttgagagccccaaaatagggccatttggggaggagggcagaaaggtggggaaaacgtgaggggaacagattcttttcaggcaacctgataaatgtgggggcctttgcaataaggaaattggggaaaccaaaagatgggtcattttctcacctgatggggaaagagaacaggggtggggatgtagggattgggctttgtggagggtctcctagtgttaaaccttgcaggaaatactctttttttaaaactcattctgttgccctccccatcagctgtttgtttgtttgtttttaaagccatcttctagtttgatagccaaaaattagtgtttccttttttggggaggaaataactcttgaaaagtcaccaagctgccatttctgaggcttgggtttcattttaggaagcaaaattaaccctgttgaatccttttcagagttaattaaataactcaggtcaggagtagcttgttttccctgcagccagagatgtgttctgagcatctttacaaagtgggttgtgctccttgaccagatggcttggttttcacactggtcctattcttcctccctctcttctgacctcccgcagccttgtgtacagaggagtgtgtgcacggccgctgcgtttccccggacacctgccactgtgagcccggctggggagggcctgactgctccagcggtgagt

SEQ ID NO: 63738 - DNA, 1237 bp, Bovine  19866881048642
ccaacttgagaagctggggcatctgggaaactcctctgatgcccagaatctcctggagaaaacccatcaggcctgcgaaaccaggcactggttgctatcccactcttcttgagacacagcctctttccttctcacagattctcaggccacagaagagcctgcagaccaccctggccagctctcctctacttcagatttgccttgagaacagcattactgattttttttttttttctttattttaatgtgtgtcctctactcgcaaagagattgtgtggttaaagacagagaccttctttacttttatttccccaagtctaaatataataaagactcataaatataaatgatattagagctggattggagttcatcttgttcaacccttctcatctccctgacagtgagactgaggctcagagaggcatctgacctgccgaaggcttcctggtcctgcgcccatccttccacgacacctttgttgttgactgactaattgattgattgatgacaccattgaggaacaccagtagcaggctagaaaggggggaggtaaccccgagttgtccctacagggccctacaccagtttcctgaggaatgatgggaatttctcagaggagccagtaccactgcctctgactgcaccttaattcttaaagatatctccaggggtaaggggactggggccagccagcctttcagcaccaccatttcttctgatctgatgtcccactttccccaaacattttcctggggatgtagaaggctttaattagtgaaatgaaaagacacacttcagatcccaggcatcaatcaatactttttcactgtaagtgacagaaacccggcctaagatggcttaggcagaaaagaggatttattgcttcttggaaccagaaagaacaggggtagatgttgctctaggcacaactgcatcatgatagccataatctgtctccacctttggctgttttcctttgtgttgacttcattctcaagtgttctcttcccaaaggaatgacagagatggcaaccaacagttccaggtctgcagtctcccagcataacatctccaatggggagaaagcatccctttactcaatcattccagctaagtcccagaatggagttgcattggcctgatagggtcacatgcctatcccaggaccaatcactgtgaccagagaatggagtattctgattggccaggccttgggtcatgtgccctcctgctg

SEQ ID NO: 63739 - DNA, 1226 bp, Bovine  19866881248579
agacttcccagcaattgagagagttcagtggggcacaaactagaccagagctgctcacatgaaccatctggggatcttaataaacacaggttctgattcaatagctgggaagggggcagggaatgtgggcccgaaaccctgcatttctagcaaactcatatgtgatgccaatgctgctggtctgggaccacatactgggtaggaagggcctggatcaccatgctttccagaagtctctgacccagtgtcatgaaatcacacactcttgcagctgatacagccttctggtcataaagtccatctgcctctggaaatttggggattccttcttttcttagaaaaaatgttacacatatgtagagggggttgtgtttttgtttgttttggctgcaccaggtcttggtggcggcacgcgggatctttaattgcagaatgtgaactcttagttgtggcatgtgggatccagttccctgactagggatcaaacctgggctccctacatagggattatagtcttagccactggaccaccacagaagtccctagggattcctttagaaaccccttctcagagacccccaaatcagatggaggctgttctgtatttaaaacctaggcagtaagaccacgtaaggctcctcaccactgtaatttaataactagcaattgaacagcaaattggtcccctccaattacctgatctttgaatcacagagcttgctttgggggcaagatatttactatgaaaactgagttgagacaggaatgttaccaaacattataaatagcactgggtttattttccacatgctccatactctgaaacgagaaggatattcacagagcatcagaatctaagaggctgcctctttcctctctgctcaccgcagcacagatacacactgccgaataagacatccttatgcgcaattaggttgtggatcacgtctgaatatctccttgtacatgacatttacggagaaaaacacttgcaaattaaatgtttgattaacattacatctttttctgttgaaaatgggtaagcataattgaaagctgcgttagtcaaagaatatgaactttataggggctttattctgggtctgagactctcaatatttttattttatccttagagccaatggcccagagtatttatataccatgtttcatgaaataatcgaaggttcagaagttggcaccccatcagaggacaattagcagag

SEQ ID NO: 63740 - DNA, 1620 bp, Bovine  19866881321528
gcacgcaatcaaaatgcctttgaacctgggctgagagctctgaggtcctctcctgtttcaggtcaggggctggcaggaggctagggaacccttgatgcctaattggcagctaattgaagagacggggagggggctgaaagcaagttgttcaggactgggtgagtgatgctctttcaactcaatgtaaaagcaggtctattatgggttttcttgctggtatccaggcggtggggagacaggcttctgttgcttaatgagctcatggctcaagctgtctccagttggggagcaggtggaggctttcaaggcaaagttaacattgtagttagttctagttggctacctgtcatcactcaagatcaagagagggaacgatcttattaaaatgagcaaacagaaggcaagctcctcagcagagctctctgggtgggggtggggtctggacactcacaaagctgagaagagtcccagacaaatttttccctctcggtttgatacagaccacagagaacttagaaggtgctactatgggcatcagggggattcccaggtggtgctagtgataaagaacctgcctgccaatgcaagacatgtaagagatgcaagtttgaacccttggttgagaagatcctctggaggagggcatgacaacccactccagtattcttgcctggagaatcctatggacagaagagcctggcgggctatggtccatagggttacaaagggtcagacctgactgaagtgatttaacagcaacaagggatccaggcatggatctgagcttggcgctgggcattaaggtacaggcattgagggcatggctgtggaggctaacagacctgaattcttaagggtgaccctgggcaagttactaaatctgtgcatcagtttcccaaatctgtaaaatgaaaataataatatcacctacctactagggtagttgtagtgatgaaatgcaattacacagggcttagcacagtggcaagtacatggtaaatggacagtggcttgtagcagttatgattatgaaggaccaaggttgagtagagactctttgcaggcctcagagttgagtcccatagatgattcataggtagtgaagaagaggatgcaattacaaagtattagaacgacagccaccttagcaaacagctagtcccatcctctccctttgcaggtgaagaatgggaggtctagaaaaggaaagtgatttttcaaggtgacacgatgaactgaggcagtgctgagtctagaacaggtctccagagggccaaagctgcttctactgcatcatcagagctgaaccacagtcacaagccagaaacagacagcatttgcttgctgtctcctctttgcttgcatttttcctgccatgtgagagtgggttatggcagtttctcttgccatgttcttttcatgtctcatgaagacaaactttcaggctctgagagtggctgaatggagggtggggaggagaagctggcctggggtaagccatcagggcctgagagttttctgttatctgccaaagaacctaatggcaccagcagaacaagcagctatgggggttatagattgtttgacaagtgccccaaaccagtgcccgacttaagtatc

SEQ ID NO: 63741 - DNA, 1135 bp, Bovine  19866881327331
aaggtccagagcccctgtcatggccccagccccaggtataggaccctgtggactctgtggattgcagcttcacacccactcatctaggctaatcctatctctctgccatgggagacaccgaaggcctgggtgggtggtaccttccaaggcgcatgacagcctgagaggggctctcccaccagacagacctcactgtgtgaagcaagtcagagtgaaaggcacgctgggaaatggcggatgaggctgtgggatgagttcacacctcatgggagacaggcttgtaccccatgaccttccaatgtcctttcccgctcggcctgtaagttcaccttcctcagaccccacatctgggggtcccactcccaccccacagagcttcaccaaattccttttgatccccaacctctcccccagctcctcagcccagggtttgctctggagctttgaaaggggggtgaaggcaggccccgctggggagggtgccagcctgggcagcaggacccctggctggtctgtgtgtctttgccgcctttgaaaggcccttccaaaaaggtaattcctttgtgcgcagacatgatttatgagactttctgggcaaattgcagagataaatggtctttggggctgggaagcttcaaaggcagtgatgcaggcagatcagagggagccaggcagctgggagctggggcctcattaaaagcctctggtacggggaagggggcaggaggctctgagcagagccgaggaacctcaggccggcccctggcccatttggggcagccccagcttaccgccctgtacctcactgactccactgctgaagtgcaggaggcgcgagtgctgggaccaccgaggtgcatttatccagaggtgggtgcagcccggggcagaggctttgaggacagaggagagtggcgcatgaattctagagtgggttctgggagagaagggggagatagggcagggagtctcagctccagggacctcaccagcctggggtctcaccccccagcccatcactgatgacctggacatcccccttccactctggtctcaatatcctctgtgtataaggacagcgcaggtgtaaatgagttctgctgtgcttcccttgtgtccgatgctctcttgttca

SEQ ID NO: 63742 - DNA, 1591 bp, Bovine  19866881339109
tgggtagccattccttctccggggatcttcctgactcagggatcgaatccaggtctcctgcattgcaagtgaattctttaccatctgagtcaccagggaagccacgtagggcaagggtcattacgtatttgatgagtacacagggaatcccaaaatagaatgacttgcccagggtcgtccatcaaaacacgtcctcttttccttcctcttttccctccccagcgccatgagagcacagcataatttccaggagggctgcagacaagagagcaggattcccatgtgcaatcattcagatggagctcttcccatgggcagcctggctaaggcgccaagaggttctggactctagccttcattctgttctccaagcccagtcccctgtatgggacaacatctgctccaacaggagccctctgaggttagctttcccccaggagcagaccctgagacaaggattcaaaagcaagcagtttatctaggaggtgatcccaggaagcactgggaggggcatgggaaaatgagacagggaagtaaaggcagacattcagggtgtgcttttgagcagctcactgctgtgggcgcctggggttccatccccctgaggaccatgaatcttttaagaacaggcctcagagttggcccctctgccctaggggtaaggaagctgagatattcttccactaactccccatctgttattgggtgagggatgcccccctagggtaatcattctcgagcactttccacctgccctgcccatgagctgctctgactacaaagaagcccccagcagcgcctcttgggtgaatagcaggagggggtaccaaggggtttcaggggggcactgactccatctgctaggagggcttttcactaacttgtaggaaggtgagcctgagggttgcctctcccttccctcacccaccctctacctactacccgagagaagtactcacctgtgtctggtacacttgaaccagttgaggatgtctgtgcagcgcgtgtagtagatttgatcaaaggggtgtgcgtatgattcttggacggtcacggcatagctgagaaccagacaggagatggaagctgtggtcagttcttgggaggtggagctgatattcagaatggggtctcccttcccaggggagccaggccccacagccaagtgtcaagggctccaacctcccctgcctgactctattctcctcctgccctgggtactcttgggtttcaaaccttcttgaccccaggtaagatgcaggacacaccccttactgtcttttgaagctcatcttttcagctcatcttctgaagttcgaattcatttgttcatttaatggagaatgaataaagtttgcatttattctacttggttctggaaggcccaaagccagcaagttttaaaatactttctgcttgttcatatctttatggttttcaaagtgcatgtatggaagctgatctttgctgcaacattatgaaataagtggtcacattttatagatgaagaaacaaaggcttagaggtggcttgcccaggtcacatagctggtaccagtaactgctcatatttgaatgtcctatgttaagtg

SEQ ID NO: 63743 - DNA, 1754 bp, Bovine  19866881472238
atattgatttaatagaatttagatgttataattataatttacagagttttagattatactaagaaggaaacagaagttgagatgaggctatcctttatttgaatgtattagaactgaggtggaagaatagcttttagagaaggcacagtagagcagtgctggcaagctcctgcctgcctgtgcaatgctgtctggaaagtagtgaatcctacagggaagaaagcagaaccgtagagcccttgatgtcaggttgaggagagtatgtaacaataccattcatctttaaccacctttgtgataaaagggaatgaggagttaatggagttatcaaaaaaaaaaaaaatatatatatatatatagtcttccatttcagattctcctggtgatcacacagcacaaggctctatttgccacaaggttagaaccaagtattgaaatactagcagtaataaaaatggtcatcagttgcaaatgagaatcttaagggtggagttcaggtaacatatagggcaattggacaagggtagggctaaatggattggattacagagtgattgaagtggggccagcaattagaagtggatttaaaatgtatagtgtgacccacgtggtgttggctttatgagaatgatattttcataaattgacttcatgtttctataacccagaacataggagttttgagcaagaaccttagagatcatctagtgagcattttattttccaaaaagtgaacatttacctacttgtgatttgtccaaggtcataaacatacaatagtgagaggagtttgaagactagaatctagatccccaagttctttgctttctctattacaaaaatatgaaatcagttctgagaactcagtattctaaactctccatgaagtaagctggatatataggaaaattattgtttaggaaaaaactgaaaaactgaaaaaactgaaaaaactgtagaccaaagcccaggcctcacaattcctgggccagtaatcttctactaaaccacattgcttcagagattaaaagaaaaaaagtgaaaacttaaaaaaatgccacatgtctaggcatagaattcactctttcaatctgcaggtattttactgttgttatatgctgggcagtcctctaggtgccataaaaaagatcacaagattaaaagatttattttgtaagaatagatttctattttgcaagactaaaatttgaaggttacctaattatcagggaaatgcacatgccttttggtagttgataagctagcaggaagtatgtcttggtataatacagtattgaaaacattttcactttcaccaaaggatgggtttcaaagtatctacagtattacctgctaccgtatttttgtgtgtgtatatatatatatgtatatatatatatatataaaatctgacaatgccaaggttattgaggctgtaggaaaactggaactcaatgctctactagggggaatgtcaaatggcccaacccctttggaaagcagtttgacaatacttactaaaatttaaaatgcatataccctacaatccagcagttccatttctgggtatatactctaaagcaattttttcaaactgtaattcatgatccattagtgaattgtgaaatcaatttaagggttataataaacatttatttttttacaaatgaaatagaacagaaataccagggtaaggattattttgtgaatttttgtgcaccacctagattctctctttccaggactaaatgatt

SEQ ID NO: 63744 - DNA, 756 bp, Bovine  19866880520179
acggcgtgtgggagcttaggtccccaaccggggatggaaccctgcactggaaggcagactcttagcagctggaccacaaaggaagtccctagttctgtcatttccttcgcttctcagcccctacctgccccccttagggtcaaatatcagccctgcaacttgacagctgtcactgggagcctcagtttccactcccctttgtatctgtcaaaaggaggcattagtaatcagtgaagggatggaaagtcctgtgcggttgagaagtattgctatgccttgacctctcccctccacccagtccccatcctgcccttaactccaactctctcctgactcccccactccctccacacaccacgacctctatcctggcatcaggcagtcataaactggaagtgaaagtcgggggagactccatgcttgcccggcttcttcggaataccattggagccctgaacacctcctctgagatggtggtggactcaaacaacatgcgtgagtgatgctgaaagtttggatcagaggaattgatggctggggcccggggagaggagacaggcggggtgtttccaagacaaagagttaggggactgggccttggctatggtgaaatgggggtcggtgtgtttgcattagagaatcagagtaggaaacatcaggtcaagcttgaaggattggaggatgacaggtttgggtcagaggagtccagagggtcccccaaggtcccagcctctggagcaatgtcattcagtagaa

SEQ ID NO: 63745 - DNA, 1626 bp, Bovine  19866880561711
tgaagtctcaaaacctgactatgcccatatgtttgaggaagctggatttggcaaagaagagccctggagggcaagggttctatggaagtcggtcctggagagcctccctcacttcgtgatggagagtgagaagatgcagccggtaatagcaacaaccgtcatcacatgtactctcccgtaaatcgtaaatcgtcttatttgattctcactgtgaggctgagaagtgagtagggcagataagactatcactactgtgttctcctactctacagatgagaaagctgaatctcataaatgttaaatgactcccaaaggcagactgaacaagtaaaacctgtctggatccaggtaccctgatttcaaatcacaagtctggctcattatgctccttctgtctcccagcctctctccacacgttttccaggaattctcaggccaccttatcaggtcactctttgctcaagaaactccaggggccccactgcctgccaagcaaaggcaggactcctggccttggccttctgagccttccacaatctggtccctttctagcctctgctccaacttacctctccctgaactttacatgttctgtgccagtttctccttagacttcaagccctggcacttggttggcatttcctttggattctgaatccttgcacattctgcttcctcaactgggaatgaatgcccttcacatttctacctgcccatcaaaatccagttaactccatgatttggtcatggaatcacattatgttcattttgagtgagtttcttaggagatctggatcaagatgatgggctagaagcacatggcgctcacctcctcccatagtatcagtatgttcatcagacattcatccagcctgtactgcatgtcatgggagttggggaggtctaggagctggagcgaaaatttaagcaaacatggtctctcacttttatgagcttttttagggctgattaaataagagtggctgctccttgtgtttttaaatgatattgggccccgtaccaagaaactgtaagtgaattaattcaattcaaacaataactatgtaaggcagatctctttttagcggaaaaaactgatggcttggagaggtgatcattttcacacaatgacaactaacacgtatatacaacttgctatgtacctgcactgtgaactcatttaatccttactacaaacagatggagtagttaagtccattttacagaagggaaaaaccaaggctcagcatttaagtcagtggtcaagatcacacagttgtcgcagtaataatgggaggggccaggattcaaacctcagctctctagggatttccctggtggcccagtggctaagactccaaatgcaggaggcctgggttccacccctggtcagggaactagatcccacctgctgcaactaagagttcacattccgcaactaaagatgctgcatgcctcaactaagactgggcacagccagataagtaaatatcttttttaaaaaatgatatttttatattaaaaaaaaaacaagctctctggcaccagagcctcatagccaaccaccactctattactgatctctagtgagcaggcctcatagatttgtccaacctccccattctg

SEQ ID NO: 63746 - DNA, 701 bp, Bovine  19866880638985
ctatgcctagtctgtagcctgaagggcagggcccacaagtacggaatgtatatgaacttgatgtgtgtctatgctgatttctacaactggagtttttttatacagtgttctttgtctcaaaataaaggaatgtgtttgtttttttggacatgattttctgcccctccttcctaatttatgaccattgagtcctgctacttgccaggctctgcactgtatcagtagcaagagggtttgaagtttttttcctctctccagaaataatgcgtttcaccagcccataagggtgggtgttttcctcctctgaggtttgtccaggacaggagtgctccctacagcagttccaggctgcaccccactctggaagttccttctgtccaaccgctgccccactcccaccctctcagcgctgggcttcggcatacttactcttcaggtactcacgctgttgggtgagtcaaggcagccgcttggaacgccagctgaggcatgcggcccgcctcacagccccaccagcaaagacgtgtgggaggctgggagggaaagttcccagcagcaagctggttggactggcgagaggcgggcgggggggggctcagtgatacatttggccagtggattcgccaagtcacagaaagttggcagtattggctgcagggggagggcatttcacacagactcggtgattcctggcagttcca

SEQ ID NO: 63747 - DNA, 681 bp, Bovine  19866880742624
tccgttcctctcccctcagttaaggcaccacctccacgccagacaccagcaaacccagagactgaggaggagccataccggcgccggaaccagatcctaactgtgctggcggggctggcagccatggccggctatgccttgctcagcggcattgtctccatccagcgggcaccatctgcccgggccccaggcacccaggccctgggcatggctgaggaggatgaagaggaatgatttatcctcatgctctcaggactgatttttctactgtcatgcattccagaggctcctgtgtttccccattgttggtatggtggaaatggggtgccccctccccagaaataaaactgctcacatggactgagatcagacattgtgtcttttaagagctgccatttctcctagctggtacggggggccctctggtgctcgagtctaccctctggtgctcggcttcgttcactgcctgtgccttggtgctgacatctgcacaggcctggttctgcatctccaagaaagacaaacagttcccagttttgggtccggccttcctcgtctcttcctctccttaacctctctctccatccaccccaccccctacccctgtgtttgtacagacagtgagctcaccctgggccggggcccagtttccacaggcaaccagcgcatagcacacgctca

SEQ ID NO: 63748 - DNA, 1303 bp, Bovine  19866880756875
taccgcctgccgggcacccccccttcaactcccccttccagtccctccgccccccgctcctgctctccgcctagccttttcccctcccagccgcctgcctgccaggggtagtgagccggctgagcggcatggagacacaggaacttcggggggccctggctcttctcctcctttgcactttcgtatctgccagtcaggacctgcagggtaagcctgtaccaatcctcttagccccttctctgcctcctccccatttgtccccagccgactagcagggaacatgtgggccaaaggagaggagagaattctgaaattgaatcggagggaagagttgatgaaattatggccccgtgggggaggagttgacactggaaggtggtggatgagtgggagctggccagggtcagcatgaggccagggcagaggactcaggggctggatgctagctagggttgcctggctgggttggtgtctgagcatccccaggcaccccagggtctgggagagcagctcaaaggtgggcttcttccatccctgggttcctggctgcctaagaacaggatgggggtggggagcaagaggtctgggctctcctggaggtctggtggtgggatgggcctgtgggtgtgggagaggtagttggagcagatgacacaggcacagattctttactggctggaagggaaaccacagattggccaggacacaggaggcagaggagctgggtcctacgttcctgtgggagaaagccagacagtaggagggtcacagccttcagtgggcagctgttctcatctagaccgagtgcgccgaacccccagcatgggaggaggggcactaagagtgtgggatgagccaaacccagcggtgcaaagagaaactgccttcccgtttctgtgctgtgggcaccaggtgcttctactggagatcagcagtgactcctttgcgccacctggtgggagcatctcaagtttgtggggttctgtttctgtattttcaagtgagcctcaggcctgctggttcccagagtgccagtaagggaggcccaatgccttgtcctctgatagcaacaagggttggatttcaaggggtagtgaacactatggggtggggataacggatgccccacccctgaaggctcagaggagagggcgggccttagcatttaacagaggtctgaccttgatcatccctgcctggccagtgatcgacctgctgacagtgggcgagtcccggcagatgatagctgtggtggagaagatccggacagccctgctcaccactggggacatctatctcttgt

SEQ ID NO: 63749 - DNA, 1243 bp, Bovine  19866880790176
tccttggatatattcttacaggcgcagacctgcctattccctcaaaccttccccggaaactggccagaaagtaaatgagtttcttgctttcagaagccctttctcctagctccaattccaagagtaaaaagtactgtatccaaaagtatcatctgttttcagacagtgagtacacatggttcctcaacaatctttactgtctaagcacctggaagttcagcacagtgttggaggagattagaggtgaggcttacaagaaagggttcaaatactcaacctcaaattttcacttactctcagggaagatctttgcttggaatcctttgccaaagacaagattctccagattattgaaggcctgggttgagggagttaaggcgtcggtcgtgccatgggggctgagacgtgcgggttaacgggaagggtacaagcctacctgaccctccacccttcctaccctcaaacaactctgcccagtcccccgctgagaggatacagtgagagagaagacgaaaaggccggaaccaagcaggccgccctggatggtgagccactcggtggaggccagctggcgactatacatctgcatcccagcgaagagcagcagggacaggagggaggaaagcgccagcgacgtgcctgtacccaccactggggcgggggagaggagagacggagagtcaggcccagccctccctgcaggagccgcaggcagattcagcaggtccgggagttcgagagcccgatcacttccaagcactccggggactgcagccaccttccccaactccccacacctcgcggcgaccccccaggaattcctcaccccgaaccctcccgccccgtggaaatgcccatcgcctggaacccaggacacgtcagctctgtggggagaggaccaggaaagctagtccacccaactccgaccccaactcgtcctcccgggttggtggggtagaggggatcccgttggtcccgttacccatcatgccctgcccttgggtccaatccgtgcttctgcccaggaggagagccgaaccggggacgattggctgtgcgcatgcgtcaaggcctaacgtggccttgtttctcccttaacgccttcctctttctccccctcagcgcctgagtgcagcgccctcttcctgcagggaggaaatattgcgtctaaggagcatccttggccaccacccggttcccggctcttccccgcacccagagcatctgcgcctctcagtgcaag

SEQ ID NO: 63750 - DNA, 1009 bp, Bovine  19866880851319
tgaactccctccctgccctgtgccctctaggctggttccctccctttacagggatcaaagggcagagagcagccccaccccactccctggcaggctgcgggcactagggcgatcaggaattgcagggactctggtgcccaagcaaatgctcgggcaaggggttgccgggaggccagcacctggcggcaggaagacactggcccccatcctggggagtggaaccttcgataacttcatcaagctgtccgtagcccccttggactctttgtataggccctaacccgtgtactgcctcttgaggagatggcttgagaacagggtctcgggccttatctgtagtacctaggggcctgggcccgcctagctggcaccaaggcacaggggtgaccctcccccaccccaggcccacagttggcatgggtgctgggagccaggggggtaggagggagaggagggcaggactgccagcatcctggtgggtaggtgccaaccgggccgggagctggtgaggggcagcaggccagcggcattgagccagcagctgttggggggaaaggggaggggatattttagggggcatttcttgtggtcccccctcccagcccagcaggacctgggatggcctagtggctgggggacctagggcccgcctcgttacaggaataagagacccccagagttgtttaagtggaactttgtggcccaccctcctctgggctcagagccctcctgagttgcccctcaggcccaggcgggtcccacccaaccggccagggtggcagcagcttacgcaaggggtggggctaggcgcttcccagcagatgccccctcccggctccttcctctttcggtgcccacagctccccccatctgtccaccccacctcaggccagctctatccccctgatccccctggccactgggggctggcacaagtgctgccccctggcctggttggcaggggctggcacccgggcaaggaactgtggtatgtgagtgggtttggggt

SEQ ID NO: 63751 - DNA, 1084 bp, Bovine  19866880907664
cgaggcctggagatgggctctcatctcagattctccaccgtttgtaggccttgggagccctctcccctccccaggtgctgctactccacttacctcccaggctcccagctcctcccaacgcctcccattccagatccttgctagtcaaggaaggttccccaggtccttgactttacccctcatcgctactcaggccactgtgccacctgcactatcccaactccaaagccccaaggtccttgtctccccaactcctcaactttccaatttttccagatcccaatcttcagtcttccagtaccctattccctcatcccctgaccctcaaaatttcccaactcctcaaggcccgggcccccagtttcctgacattctagctcagccgcccagagcactacctacttgggtgtttgggaatgtgtgtgggatgtgccccaggggccagggggtaggagctcttctgccatttggtgcccagagaccagggcaatgcttgggaacagttctgcccaaatgccagtactacttgccctgttgtgaaactgtaagtccaaggtccctgctctcagctcaggtcatctaggccctgtgggggagagggaccccgagaccctgcccgtgtagggtcctgaccagcaagtccttgaacactgcccgcagcgggggctgtggagatacgccaagctgtgcgggtgttgttgatctgcagctccaccgtgcagccgagcgatgctatcaccgcgttgaggttgtgccgcaggttggccactggtcctgagggaagatgccctggtagattacctccctctagagccaattaactttctccagcccatcccgagctcccactctgcgggcggtgaccaccttctagaactgtacattgatggggcccagaagctggtgagaggtcatctcattcaacccctgattttttttttttccttttgtaaatgaaagaggctcagagactcagaggaactctcttaggggacacacaagtcagaatagctgggattagaccccccactctttgttcttcaccaagccggctctcagggatagcccacccagagtcactgct

SEQ ID NO: 63752 - DNA, 1474 bp, Bovine  19866880918746
gcatgtcagtaggcaggagcaagacgatgtaaataactggtgtgtactgatcccagggagtgattcagggagagcatgtgttggtggctgccaaggggaagcgaagagtcaattctgctcattttggctgtgtcctgtgcattgtcataagcccgcaggacagctttcccttgcagctttgtgtgtgagctaggggagcagggcctgatctctgtaagctgggaactagtaccagctcagtgctttccccaagatcttcagggacagggagctggctagatcaggtcttctatttaggttcccagccttacatggagggcctcataaagaccccacccaagctagactcctccctttctacaagttgggaggaaccgggcctttccacccaacgccctccccacccaggcaccagtgagtcaggaaacctggctttcagtctttctatccaggacaacctcctttcctccctgggtcccaaactgttcccatgctgactttttctgattcccctgtagacatttagaactttcggtctcaaggcctatttattatacatatagttcagtgattctcaaatagagagactgggggcaggccattcctggtattgggagggtatggtaagatcagccatctgggccagtaggctccccgagccagacttggaggagcgccaggtcctgctgcagtctgactggggtcctagccagcaggccaagctcctgtgcaccagaggtgcgctggaggtgggggctgggtacggaggcccagagatgaggcaggtctgacagatggcacaaactggaaccaggatagcacttcacttggtgtttgtggcccatccttggtcaagcacagccggctccgggagtcttgatggacgctggcctgggtgctataaaaagaagaatgggaagctgagaggcaggctctaccacagaagttgcaaccgtgcctcctgtctgcctgctctaccctgcccacctgaacgatgccggccatggtgcccgtggagtggaggcaggtctctgccaccattaatccagcagctccttgatacaccagcagcagaggaggatgtaggctatttccttcagggtccgctgcaggccctcccaccctgtgcccatcttcatgatgggaaccctaagtccagtgtctctcaggactcctccgagggagaagggcagggtctgggctaggggctgtgtccggggctgcatgtgggctgcagatgaggaagggtgtggtagatgcgtcctgtgccttttatcttcattgtccccacccccttcagacatcatgactgtgggcacaagggccccagggtatagcacaggaaggttatgggcccgagaatgggatgagtcagcccctgtgcccagggatgatgggatggggttagtaggagggctggccactccatctttcatcctccatggccaggccagatcagcttccctttttccag

SEQ ID NO: 63753 - DNA, 1871 bp, Bovine  19866881211125
ttccctgcctgcctggcagggtcttctatgggggagaaggtggcaggtgccctccagaccattgagactgccctggctcggtacagcctcacccagctatgcgtgggcttcaacgggggcaaggactgcactgccctcctgcacatcttccatgccgcagtgcagaggtgagctcaccccctggaggcagaccccagagatagagctgccccaattggctagttccccatcataagaagcaggaaggaaggggggtgtctgggtggggcttggcagggcagtagccacagtgaccagttctgatcctccccatatttattgagcatctgacacctacctggccctgggtatggatgtgccagccaccttccccgaccacagggaagtcacagtcctgtcgggaggtaaggcctacatactagaaacgggtgtgggctccaggttttagagatcagagtgggcttgccagaggaaatgggttcttcccttcagatgagaaggccgaaaagggagaaggagagggtgtctatcccagtggccaaagggaacagagcaagctctctggggagtgtttccttgcccatcctggcaagccaatggatcctgcctcctccccaggaagtgccctgatgctcaggagcccctccagatcctgtatatccgtagcatctcccctttccctgagctggagcagtttctacaggacaccatcaagaggtactaggggccttggagatttgggattccagagggacttggcagggcccattcctgactcccggcgctcttcctcaggtacaatctgcaggtgctggaggctgaaggagacatgaagcaggccctaagtgagctgcaggcacggcacccccagctggaggctgtgctgatgggcacccgccgcactgacccctactcctgcagcctctgccccttcagccccaccgacccaggctggcctgcattcatgcgcatcaacccactcctggtatggggaaggggggtttcttgccttcagtctcctgtcccccgtcagtcactgtaccctggcttcctggggcgggcttgggcttggatgaaatgagccccatcagccaagggaggcagtggtatttattcattcagccttttgatcaggttatattgagcactaattcaacagcaagcattgtggaccgaacagtgtcttagacctgtgctgtccaatatggtagccgtgagccatttatttacacttgaattgtaattaattgaaataaaatacaaattgctttaaaaagttgaattgtatactttaaaaagatgaatatcatggcttatgaattatatctcaattttttaattaaatacgattcaaacttcagttccttagttgtatgttgtactagccctatgtcaaatgactaccatgttagacagcatagatacagaccatttccatcattgcagaaagttctactggacagcacaggcttacacaaatagccttaaacagcctctccctttcctcctggaaattacatgccagcggagggtggattgagaatggggaggggacgggatggtttctctcattgattggcatacacagagcaagatgtactggagagtttagtagcaggccctccctccaaggctaggggagcaaaagaactgggataggccctttcccaggtggatgaaggtagatgtaggagggggagtatttgtgactccgctctgatgctggcctcccaggactggacctacagagacatctgggactttctgcgccaactgtttgtcccctactgtatcctgtatgaccgagggtaagctgttgggggaacaggatgggtatgtggaagacatgagggtgctgggactgggaacac

SEQ ID NO: 63754 - DNA, 1192 bp, Bovine  19866881341553
tcattaagatatttacaccctgagtgaagccttgcacgctgtgttgatttatgggctacataattacataagatacgctgatgactgtttgcatgggaaacactttggattttttattttgttaatcagttttcccactttgagcccagcatttcaatcagagctccaggcttgattagaacctcccaggggtggtaaaaagactgcttggtaacagtagttttgacggctgtacattccttcagataaaaagtacctttggggggcttttcaaattacccattagttaaaagtatttttatcagtgatatcctcttcaaataatgctactaataatttcaacccttttcagatgagcaaaactctaataaatatttcttaacttaaaaaattgctggtttggttttgtcaattgaaattcactactcagaaaatacacccatacaacaaaaagtataccttctgtattcaaatgagctttatctgaaatcctaagtttttcttgggaagttaaagggaccatcttgaatgcagttattgtactgaaagaagagtccaaacaatgcaagtagaattcaataatacacccatgttaacttgagtttggctaaagcatggttgatgattactttcattccctgcagcagcctcaccctagtaattttatttggaatatcttgacactgccccttccattttatgggactcatctttcttttgcacctggattactggcctatactgcttttaaattttttactaagtataataaacatagggcttcccaggtggcactgtggtaaagaatctgcctgccaatgcaggagatgcaagagaagcaggtttgatccctgggttgggaagattccctagagtagaaaatggcaacctgctccagtattcttgccttggaaatttcatggaaagagaagccaggtggactagaggccatggggttgcagagactctgacacgactgagggactgaacacagcacacgtgacaaacatgtggagaatgcataaatcttaagtttgaaacctgagagatttccataaactgtgtttattttcataaacagacctgtgtaaccagacctagaaataccagcatcaaagaatccctgcatcacatgttcctttaaatcaccccccgacccacaggtaaccgccatctgacatcagcagcatag

SEQ ID NO: 63755 - DNA, 1960 bp, Bovine  19866880488854
catgggcctgaaagcacatcattgagttatagaactttatatacatacatttcaatttccccatacttttcttacataaataaaataaaggtcagtagaaaatagctggctttggcaattgtacatttcatttgctaaactggaatagaaattatagcaccctggtctttccattaaaagcttattcaggagtctcacagttctgcttttggtgcagtggtagaagatatttaagtaattcagttttaattttaaagcagtattaggtcagcataaaacagaggctgtatttatgccacaatgattgggtcaagagcagtagaattcagtatctcatcagaacacacagtcatttaatttcagagctttggataaatatccttagtgaatgccagctagtttatttgtctgagtgtttttcttccaagtgtgttaactattacagtattcgtgagtcaccggggccagaattagttgtaatcatacctccatttcctaagccgtcagttataatatctcagtgataatgctgagaggttgtccacaggaacaaagagcagagtctagagaatccgtgtcgttctctttgttgacccagtccattatctcctggcttgaatgcattaactcagcctccttttttctccatattttgtttgtttcctttgagcacaaaaaagttctggtaaagtcccgaaggggaaaaacactgctcaataatttcctcaaagttgtgattgtatcaggatacatactatataccatggatatgaatacgaacaagacttgtcttcaaagaacttactggtttgtaggccaggaaattattttagttaaataaagaatgtgggtcaactgtcagagcctttgtgggaaaaggtgagaatgcataagatgaattcacaagatttgccctaagagcataaaggtcaagaaaggccctccccctactccctcaagtccaaagaaagcgttcagattaatgacttgttagctaaaggaaactctaaatattaccactcgacaatgtagaacaacattccttgggaggaattctgaagacggttactctttgactgcttacttggtcttttctaggctttggggtgtaggatctgcattagtttctgaggcctgtcattacaaagtaccataagctgagcagtttaaaacaacaggaataaattgtctcacagttctgaaggctagaagtctgaaatcaagggccatgctccctctgaaggtggtatggaaggaactgttcttttatagcttgtagtagcctcagaagtcccttggcttatagatatgtcactctaatggttcctctccatatggtattgccatatgatcacagcatgttccctttgtcatgcttgtctctgggatcacatgcctgatcacagcatgttccctttgtcatgcctgtctccgggctcacatttccccttcttgcaaggacactaattgctctgatttaggaaagatagtgagggacagggacacctagcgtgctgcagtccatgggactgcaaagagctacttagtgactgaacaacaacaaaggaaggaccacatcctgagagtcaagactccacaatatcttttattattattatttgcatgtgtgtgtggtgtggggatggagacacaagtcaacacaagtcaacacaagtaattaagttaaaatgaaatcattacagtgcatcctaatccacatgattagtgtcctttatacaattcaacccataatggggtctgcagtgaatactgttgctactctgcccaggttctctttagccaaagtggcaccaactcctcacttgctgtgaatgttgcctcatgatggctcaaacagcccttttcctggtaatcaccgctggacacatgggaaccaccttgactcgtaggctacagccatgcccacacctttagcaggtcttctgcctcaatttggaat

SEQ ID NO: 63756 - DNA, 2013 bp, Bovine  19866880578288
aaaattttgtcaatatgtaatctgtatatctcaaagcagaccttaaatattctaaaggtaattttcctaaacaggcattttagaatgcttgcaattagagttacaagtgttgattgtctgcaatagcaattttcttgtcttagtggaaataagctgttcattattttaaaaaaagtatgtcaaccattatttatgtttagaatgctgccttttctccaaaagctgataaaatattcaactttctactgacagtgtagtacaatgtgaaggatgacaccagccttcaaagactgacaataaaaatccacattgagttttgataggttggttttaatatgaaagtaaaagtgttagttgattagttgtgtccaattatttgtgacccatggactgtagcctgccagacttctctgtccatgggatttcctagacaaaagtactggagtggattgccattccctttgccaagggatcttcccaacccatggatcaaacccagggttcccacattgcaggtagattctttaccatatgaaccaccagggttttaacataattacccttaaaattcttaaagagaggggactaccagaccacctgacctgcctcctgggaaatctgtatgcaggtcaagaagcaacatttggaactggacagggaacaatggactggttccaaatcgggaaaagagtacgtcaagtctgtatattgtcacccttcttatttaatttatatgcagagtacatcatgcaaaatgctgggctgaatgaagcacaagctggaattaagattgctgggagaaatatcattaacctcagatatgcagattataccacccttgtggcagaaaacgaagaggaactgaagagcctcttgatgaaagtgaaagaggagagttaaaacagctggcttaaaactcaacatttaaaagacaaagatcaaggcttttggtcccatcacttcttggcaaatagatggagagactatggaaacagtgacagactttattttcttgggctccaaaattactgactgcagccatgaaattaaaagacacttgctccttggaaggaagctatgaccaacctagacagcatattaaaaggcagagacattacttttgccaacaaaggtctgtctagtcaaagctatggtttttccagtagttatgtatggatggatgtggagagttggaccataaagaaagctgagcaccagagaattgatgcttttgaactggtagtgttggagaagactcttggagagtcccttggactgcaagggagatcaaacccagtcattcctacaggaaatcaaccctgagtattcactggaaggactgatgctgaagctcccgtactttggccactgatgcgaagagttgactcactggaaaagaccctgatgctgggaaagattcaggacaggagaagaaggaggtgacagagattaagatggatggatggcatcaccaactcaatggacatgagtttgagcaaactccaggagatagtgaaggacagggaacctggcatgctgcaatccatggggtagcaaagagtcagacatgactttgtgaccaaacaacaactacaacaaaaatccttctttatcttccagtttcaccatgcttacaaacagagtcaataaacatattcaagaataaaaaggaatatcagaaattatgatttttttaaaagtaggatattcagaacttgaaaattaagaggacaatgaaacaagaaatgtaaccaaaaataggctatccccactgtaaagtcagaaaagtctaactagttttgcaaacatcaagagaaactatgtcataaatgtaagctgctgtctttaataaacaacataaggtttaagcagctcagagctttaaagaacatctgaacatttctattatatgtgtgtattactctaggtcctctgagaagccaatgctaagtcgggattaaacgtgcaaggattgtatgagggaaatatttgtggagagaaaatggggcaggg

SEQ ID NO: 63757 - DNA, 1219 bp, Bovine  19866880813002
cccaaagagttggacatgactgaccaacacatgcatacatattctatatcttggataatatccatcaacagactgacctgtgtttgtttttcctccactggatatgaacaccttgacaacaggggatatgtctttatcatcactgatctctcttgtggcagctggcacaatgcctgacacagagtgggtgttctgtagctgcgggttgccctggactccgctgaatcctgtcgctttagttctcctcataaatatcctcatttaacctagtcatgtatagcatagtgaattttctaactacttttattcattttaacttacaccaaggtcttgaatcctttgtggaattttgttgattggaaacaaagcatgttcctttcagtacttcatttatattccatttagcatgcaattttaattttattaccttcttaacatcttttatcttttattcaaaagggaacagcaaacgtgcctacatacatcagcggatcccagcaacaactgaaatgtttttctgaaacaagagaaatgagaagctttgatccctttctgccacttagggaagaaggaattcttctcagttccccaagagaggattcctattattagggttttttgttttactttttttttttttcaaattaattttatggttagcaaagaaatacatgtgtattgctttaaaattattcaaatgctaccggaagacttaaaatgaaaatccgtggttgttccttgccctactccacacatcaccccacccctcaatctccagggataactactcttttggctattttctggtatttacattcagctttctaaataatatgcttatatctctagttcttttatttattttaaacagctatttgttttcagtatgctatctatagtactttaaaatatttcagcatagaaagagacgtgtgtgtgtgtgtgtgtgtgtgtgtgtgtgttatttgggcttaattataccctgtgtgtggtcactaactctaatcataccttagacacagctagaattctaatcaggaaacctaccctccagaggccatcactacaaatgcttctgtcttgttttttttcccttatcccacagttttttataattagcataatgaatgttaaaaaaaaatgattttccataagcaaattagggcttgtaaaggaaattgaaagagagctcatcacaaaattaccagtattcaagata

SEQ ID NO: 63758 - DNA, 1457 bp, Bovine  19866880819953
tgttttccttcattgaaatttggggttgtttgttactgcagcataatctagactattgtctttaaaacaaagatacctgtacttaaaagtactcattgtagtgaaaataggaaaataaaacataatgaataagtaaggcacctgatatgatagaaggtaataaacactatggaattttaagacatagagtaggtaaggagccaaggattaattcatatttaaagtgaaaagaaagagaggatgcaggttatagaactaattaggaaggtcagctaattaatgatctctgagtacttataaaactttcttatatataggaagcactcaaaaacttattcatttttacattatgtggctctaatataataaatttgttgactatagtactaacttttgatcttttcatcacataacttttcttaaaaattaagacaaagcctcacttcatagttcagaagttaggtttacattgccaagtttctgaaccttacttatttacttcagcacatacaaatcttattaatagtagatcttaaggcatcagtgttaccttatctgtgctatgggaataattattttcaataccatggagaaaatccaggttcagtatgcttgataattcacactatacatttatctgcttggcaggaacagcccgtaaggaaatagcatgttaatgttgctataatgtacctttcttcgaccctgctgtcagggtcaatactgcatgtgaaagcaaaaacagtgaaagagaaagaaacaatggcctaagttaagtttgcttttcttcattataccaaagcttgaatcagaggggttttataatcaatctgcaatcatcttcaaggtaatattttaaaggtaaacacgtttctgggtattaaaggaataatatccattaaaataatagaggttaaaaagtcacttttagatatttaaaatagaatttttaattaaaaaattaggatttcaaactaaagttctattttcctcattttgccaatcatctttgtgaagctgttaaaccattctacttctccaaatcaaaatgtaagaaacttttcttttctatcaaaaacactaaaaagtctttgattcagagacagaaaacatctccaaagagacaaataaaatttttaacttgtatttctaggaacttataacattgttatttattaacagggcatagttatgaaaggaatagcaaaagataaaaatgtgtatttattcattataaatacctccccataaaatttgaggaggtattattattattaaatattataaaatacctccccattataaatacctccccatagttcagttcagtcactcagtcgtgtccgactctttgcaaccccatgaattgcagcacgccaggcctccctgtccatcactaactcctggagttcactcagactcacatccaagtcagtgatgccatccagccatctcat

SEQ ID NO: 63759 - DNA, 970 bp, Bovine  19866881004993
acattttaatatattacttgaaattatcctgccaataaaatacttagttctgtaaattttggctcacaaaataatgttcaaaattacactgaagaaagagtctgtagagtcactagatgaggcgaaaaggtaaagacttacttcctggacactaccagctcactgagttctcacttcccctaacctcttctagtatgtgtctgtatcatctaggatttgttgacatggtgctttctatctctagctggctattttaatgtgtatatcttgcttccttagtcccttgatgttttatgttttctcttcacaatgttatgggcttcccaggtagctcagtggtaaaaaaaaatctgcctgccagtggaggagatgccagagatgcaagtttgaggcaagtttgatcccatccctgtgtttggaggattccctggaggaggaaatggcaactcactccagtattcttgcctagggaactccatggacagaagagcctggtgggctacagtccacagagtcacaaagagtcaagacatgactgagcatgcatgcactgcacttcataatgctaaggtttactctctgtgcttagtaggcagacaggaaatcttttttgattggctggttgtttccctcagtaaaacttaacagaccacagacctgaggtcttggtatttatcagtaaaaccatttccttttcctgttccattgtgcagtgaggggtatatatactgtattcaattattcaatcatcttgctgaaaactgggagagtctatttctaactgaacataataaaaaagtaaaatcattgccattaataaataacataacatatgtgtctgttttccaaaagtaagcagagtttgaatgagtattcatgttgttcaagattaggtaaatcaccacagacaaggaaatttagtgccataactcataggatcagatcaaaacaacagtcattttctccgcca

SEQ ID NO: 63760 - DNA, 1901 bp, Bovine  19866881138226
tcccgaaggtcacagggaaggattgatttagaatctgctctagattttaaaagtgattttttgttttgttttgtttaaattctaagggcaacataaagttaatttagcttatatggaaaatcaagggaatgccaatgggattatactactaagactctgaccttccatttcttcttctattgtaaacagtctggtgagcaggaactgatctttaactgtatgagcatacttctggtgaaccctccaaaaggtcataaacaaatgacaaatacacttgtccataatcccctaataacacaattaatgtcaagaaaaacaataaaacatatggtttgtaaaataaaatggatggctaggtttaaatattacattgactatgcaatgcattaagatgtgtttatacacattgttctttagagctagattgtttttctaatatttaacaagaatttctgcaaaaagattctaattcctgacatgtctgcagaataatatcctcaaacatgagaaagacttggagaatttgaataattgccatgaaaacaacagatttttatatcccccctttcaaatattttatttgagaggaaaaaaaaattttaaaggccactgtttcaataagtcagttctcttttatttcatactcaagtgtgtgtcatatgcttttggaaaagaatattcagtgatgacacaatgaatgttataaaccagatagaaagctaagcatgtagctaggcaaagtgaatgaaattttgtaggtgttagatcttatctgtccatagatactttatagaactctctctaaaataactctttcacagcacatggttgagttccttgcacctggagagtgctacagcacccaagggagagcagactgattgaggacactgaaggcaaaaataagaaaagaggagataacctctcattcctttcatatgaaggctgaatagtacagctatatcttttgtgcaaaatagaaaagccaaagagtagcttgaagcatcactggagtttcaatagggtaaattcaattcaagaagaaatcgaggaggagagttttaatttctttccttgtacctgtctggagtttaagagagtaataagcaaaatatctattaactgttttaatgaaacacaagaacttttgacatttttgagttcatatttctgtggtgcttcagtttttatggtataaatatttataacctagttcaatgatcaaaagagatgaaaaattcattgtttaaagagaattcaggagtcagagttatgctgcgaatatacttttacacatttattcattcaactaacatttgttaagaacattacgtgctgtgcaagtgataccaagagcaccaagtaagatgtctaccttaatgaatatttctagggattaaggtgatgatactaagggaggtcctttgtctctcagagaaatgaatcagcacatggggttcaggttttaatataagagaaacaggttaaggaggagtgaatcctttctcatgttaaaaaacacccctgggttggttatgaaggtagtgtcaggggaagtgtaatctcctcggttctgtctggtctcagcaaaaatttgaagcgagggacactaaagccctcagcgagtcacagctcttggacagtgttatagctcccttagttttatttagaaaataaaggaaaacacatcctctaggcgtgggggcatgatgacccaaaggactcaaagataagagagagagggagagggagagaaggagagaacgtgcgcgtgcgcaagagagagagagacaccccgggccctaggctcctctttttgtgtgttttttcctccctctgagcctgccctatgtaaactgggcgggagtgctgtttgttccacctgaggtcctcactccggt

SEQ ID NO: 63761 - DNA, 3192 bp, Bovine  19866881202844
aaaagtagctttctttctgcatacagtatctgctgtcaaggctgcactttctactgctctggttgtccagctatctctaatgttgctacagtaattataataatcagattttcagtgttccctcattcagtgtcataagtaataaattccctactaactacttccttttcagaaaacactgctgtttcctctgattctcaaaagaggtattactactattaggttgttactgatttctaaaacagtaagaaggaattctcttggtttagatgttcatgtcttttttaatgtgactgatgaaatttaagaagctcttctacaacaggatatcaggttataatgaccatctatggacagggaggcctggcgtgctgcaattcatggggtcgcaaagagtcggacacgactgagcgagaactgaactgaactgaactgacgagcctttggatttacagtatctgcaagcacatggcaatccaataacacaggcaaaatagcactttgttatggccacagaagaatgttgaattattgcagattattatgattgtagtacatctttcagttgggtattttcatgcaaccactccctcaacaaaattataaagttcatgaataatgagagcccatctttttcttttcacagaattctttgtatttgtttgtcttgcatctctatgtgaaacaactttttaaataaactatgaaaacctaggagagaggatgaaatggtagaaagggatcaacaatttttaaattaaattcatactggtaggtctttggaagaaaggaaaaacagaatttgtatttactggaatcagaccacagtgagctgactgtttgaaactaagttttgaattattaatgctgaaaaatgttttctataaatgtgggcagtaggaaaaagtggaaacaagcttagtagtccttagtctaaatatataatatcttggttatttaagaccttgtctgtgtacataaagaaaacaaccacaaaattaagcactataagtcaaaatagctatagttagttcctgtgaattggtataaagatacatactacattaatgtcattctccaagttatatattgtacacatggctcagacagtaaagactctgcctgcaatgcagcagacccagggttcagtccctgggttcgggaaaatctcctggagaatgaattggcaacccactccagtattcttgcctagagaagtctctagacagaggagcctggtgggctacagtccatagggtcacaaagagctggacacgactgagtgacgaacacttcactttcacacatacatacgtaaaatttgacattttgaattgtgtcagatttgatgcagaaatttaaaaccaacatgaatgaaacctgtctagactttcacatggactcaaagttccgggtgagtttataaactacccttctcatcagtcctctgaaagacagaagaccctgagatctccttttcacatgcagtcctcagtcccaagatggaccagaaacaatccattcccaaggcaagtgtggcttcacgtcctggtttctactcacagagtctttccacccagacttagtggtgtacatatgaacaaaagaatgtcaatgagctgtcctttataggactaaagtcaactcttggctaaggatgaagactgaagtacttacatgaaaactagctttctaaggactatgaagtcgtgctacttacacaatgatatatccttttccattgaacataaagtcaaaccttatattaagataaaacattttctggcctcaaccatactgataataaactatggtacaaaatgagcctctcaatctgttagcatgacattttacttttcttggaggagattaggtttgagtttgtattttatgtgattctatctccttctctgccagtgaagcaactgaagctgtctatgtccaaattctatggtgactcgaaaatccacagttttagctgtgctcttagacatcagttcctttattggaaaagtagccacattcaaacatttctgctgaaataaaggtagttatctgacttgttggtgaataaacagtctgccctgaaactgtcctgtgacagtttgacacagtgaacaagagtaagattctatttaagtagcaggactcacaggaaattagggagtaggagaacatggcttagcaaaagttcttattttgacaatagccatcatttgtcctttgaatctaggtcctaataatggtgataaatacatctttgcttaaagttacctatttgacagacaggaaaaaatggaaaaaaaccaacaaattctttcctattaggtggttttaagttagtatattaggctgcagactggcaatacaaaaagcatcctattaaatcacatcataaatgatccatgtagaacagtttatttttcattagcaaggtgaggaggtgtggggccaaataaatcaaaatgaacaaggcaataaccgttcctcccacaatatcaccataaatgtggaagtgataaaggaaacaatttaaagaatgttttattgatgaactcatttttatgttagaaaaacttcatgcctctgggaaagagttagcctattattttatgtgaaaagtaaaatttaaaatacaaagttagattcataaagcaggtccaggaagtactagtaattaacttaaaatatcagaagtgcaaaaaaaaaaaaaaaaaaaggaaactcttaaaaataacttctgacatgaacccaatggttgcaaacattaacatccagaaagtaacattgtctctacaatcttttagattcataatagcatagatttcacagaaatgtaacataattataaattcttgaaaatacacattactgaaaattggcaataacatcctcatagtcagtgagaatcccatagttcaaacatctcttctttaactttgaataggttatatcaccactttagctgttgttggccatacatagattttcgtaatgctgaaaagcaactagatatgagttagtgacgaccttccaatatatattttttctaaatcttatatgaaataaggaggacttaggagaagcttttctctgtttttaggcaaagggatcaaatgtcaaaactccataacaaacagcaaccaactctgcctcttattggattctttctacttaaaaatggaggaggaa

SEQ ID NO: 63762 - DNA, 897 bp, Bovine  19866881221959
atgaaatgtgtttttagtatatcacttagaaatattttttcagcttcaaaattcattgtcaacttcaggaaaactgttctttagtttctttcatgtataagctgttaagatttcctatgcactaattttaataccctttaaactttagtgatacttactatctaggttgtcttcagttcactcaagttaggatgtcaggaattggcacagcagataaagaaagattcctgcaagccttttttactctggggctgctaatgaaagcttaatggtcacagtgataactacaaacacacatgtgaaccccactaaaccactgaaagatacccccaattagccaaatccagaaatgcctatggccaatccaaaggtacctgacaatattgtttaataaaattctataaactatagaaagtctgaaaagtcagagcaatcataacccactgaggtttaaatatcttacttttgcaagttttgctgtgtaaacacatggctcagtgccctccagaggctgtggaagaggcccaggcaagtggagccctgaagctcttcacttcatggaaaatccacttctgtcagagtgtgttttttaaagacaaacaggctacgaggaatgctaaaaccatgcagcataagaaacggttgcgggaactagggatttttagcctggagcatggaagacctagagggacatgattactgccctcaaatatttgaaggactgtcatgtagacgtctgtccaggcagtcactctgagtagctctggaggacaaaactaagaacaatgaaaagaagttacaagcgaggaggtttcaaccaactacaagaactttctaaacgattaaagtttctcaaaatggagtgaattgccttatgttgtaatgagctccctgtta

SEQ ID NO: 63763 - DNA, 4065 bp, Bovine  19866881332267
tttttatctatttttagtttctcttagatgttcttgtgtgtttgttcttcttaatgggcttcagtgtgaacttttctaactctgtaataaagcctgttggtatttttattgagattttgtgtaatttataagttaacttagggataactgtctgctttaggatactgagttatcatatgcaaggacaggggtgtctttccatttgttcaagtctactctagagtctttcagaagaatttcaaagttttattaatatatgtttttctagatttcttgcttatccctaggtatttaatcttttttattactattataaatagggttttgggttttccctctcataatgttctctataactgggtattggttcaaacattgttatccttgctttccaagtattatttcgcttaattctcacaacaaacacatgaggttcttttcagtaacatagcctctgatagatggcaaggcaagggttctaaggcagaccatctgatttcagtgtgctacactgcctagttcccactaataattcccttgagttttatctaaaattatggacaccaatctaacatattttcataattcagagagaatccaaaaaagcagagagtcaaactggcaatttttgaactgggaattctgaccatgtctaacagcttatctccaaaggacaggggataatataagagggagtagcatgaggtgttttttctccacaagggtctcttggggcctgaattcctctcagattctatctccaaccctgaaataaaggaaactggaaaaggccacaactctctcggcatgaaaaacacagcacacattctggttgaataaattctcccaggtattcccaacgttagcggaataaatgctaggaaagaagtgggagcccctgataacaaaatgaggagtgagaggctcagagcagctcttaggagaagaggtgtcactggaaagatatcatgtctcaaggccccagagatggtaagcaatagccctaaccttgagagatacagcaaaatctcaggaattaaggcagttgctacaaaaatgatggacatgagcacagtaaccatgacagtcaagaaatgacagtcatctttgtaatggaggaaaagtctaagagaagcagagcacactcacctcctcccacctctagtgaaaacctggagaaactcagtagtgactacaggcatgacagttcctatctgaggtggcaaagagggtgctctactgagcaaacttacaggatctacactagccgaggcttttgtagacaacactgttttgtcctttggagaatcccatggacagaggagcctggcgggctacagtccatggggtcacagaattggacacgactgaagcaacttagcaagcacacacctttgtacttcctcgggctgctaacctagaaaaatctgttaaagagatttttggtggaatagatttctctaaaaatgaattttctcagcatgagaatgattaatgagtgaaggcctattatttccaggtaatcaatatcaaaatgcactctctgaagtcatttatttttcctcattatgcatcacagttcagtcccctaatgctgtaaggttaatatacttaggataatatttatgctgctcatcccaaggttccacgttaagcataaaggctgcttctaatgcttgcatctattttttgacttcaaaagaaaccatttctcttgatagaagttgattttcaaaagacaatttcctactgaaagacatcatcagtggagtttctggtgatgaattaagggccttttgatatgacagattccctgctcagaagaccataagaaatagccacaattatggtgctccagactgtcacccttccagtcatccaaacaccactgcaatgttcagatgaaaaagaaaattatagtactattcattataaatagcaacataaagtgaattcaatttgtctaggaaaggaagtgactattggtggcatctgtcctatttactcaatagccagcattagtcacttaggggtttggtttccactactaaaaagaattgttaataacaggccagagaagaaacaaaagttatgtggaagaagagataagaagtcagagttcctcatatggcactttattgtagagaagggagtttttacttatatttattcagttggtgagaggtaagagagttaacagggaacaaattgtatattttcatttcgtgtttgtttttcagtagtttgaggcttctgggacttcagatttccatagcagtaactcagctcaatattatagcatgtatcaccttggaaaagcaattgcagaatgcttgtttgtattctctttgtgctctgagtgggctggaatcattctcttcaaacatcatttacaactcaatgtaatgagcacatgtagtcagcaaggcttttaaaagttaatgagaaatagaaaactttgagggggttatttctcactgtgctcagtgtcgacaactaggtctttcatttaaaaagagcatttctggctttgccatagattgcatctgcaggacaatggactgggagcatagacatctatcttgccttgaacctaattaagaaagagaaagcaaagaggggaagaaaaggaagacagagaagcagcatggaaagaggaagacaaagaatagcacagttttatttgagcatctgcgggacagggaaaatggtcttatcccaggtgtaaaattactgaggaaacagccctggcattcccaggaaagttggaggagaagtcaaaaggaaaaaatcacagaggagaaaagtgaaaggtctcttttccctggatcatgattatttttttaacttcagaagaggcaagggagatgggaggcctttttgagataattaaatgagagaccagaattaaatttaaactatagcagagcatgttcaaggagaggtagaggccctccatttactaattattattaaaggcagagaagtagtaccaactcttgaaaagaacaatgaattcaaaccctaaaactcctcttggctccactgtccatggtttacatggccttgacaatttaatgaggctctctgaatatctcagaatctctagctttgggctagagatcatttctacttccggcacatttaaattttaaatttatttccattagagatactgaaatttggagttcttttttaagtaatgtgaaaagagcagagagaaatttgtgactgttaagcacttttgtttttaattatgcttagaaaactccttaagttttctacaatcacctttgtattttccactttctttgtcctgaaatgtattcattctaatagtgtaacaatatcattctcccttatctcaatttctatccattatttcagagatctatattatttggagaaggacagggatttggagaattagactaaatactgtaccaaggcaactaacagcattctatctgtcataatcaacaaattaatcactttgctatttcaacacatttgtaagacattgtttactactctataaagtgtctgtgcttctagtataatttcaatatttattcactaagtgagtcataaaatcccatgatttacatactcgaatactttttccattctatctctcaaccatcagagagtataggatattttatagctaccttttgagtttaattctggagcctaggcatgtatcaaacaagatccagtgtaacaaaatagaacttggatataaatgttacaaaaaaaaaaaaaaaaaaaaaacactaaaaacggctgcatattttgaaaaggtttttccaaaaataaaacgaagtgtgcacatctggggggttctaccttgaaccctcaaactaatttcttggttatcctaagacaatggagatcccaagtagcttctgggttgagtaactcgtttgcagtttctaccatatttgaaaagaccctgatgctgggaaagattgaaggcaggaggaaaaggggatgacagaggatgagatagttggatggcatcaccgacttaatggacatgagtttcggtagactccgggagtt

SEQ ID NO: 63764 - DNA, 415 bp, Bovine  19866881924222
aattgtattttcctcctctcttattttatggaaatcggctcttctgaaaggtgtgcttagtcaaggagtaaataacttccttcagaaaccacataaatcttatctacatcacttgcatccttcagtgctctgggaagcaatataagttctgaccctcaggtctgtatgtattttgtactatctctggaattttccctccctctctcattttctcagttccacgttgaagacctctgatctctgtttggtattgccataatgaaatcttgctcggaactctttttcagaagatttttataaacattgaaaaaaaaagaggattagaagtaattttaatagataaaaatgttgtgttcagaaaaatttataaaataaacttttttttttctaaaagtacaattcttttaaaatacaa

SEQ ID NO: 63765 - DNA, 943 bp, Bovine  19866880233635
ggagcccccccaaaataaagtcagccactgtttccactgtttccccatctatttgccatgaagtgatgggaccagatgccatgatcttcgttttctgaatgttgagctctaagccaacattttcactctcctctttcattttcatcaagaggttttttagttcctcttcactttctgccataagggtgttgtcatctgcatatctgaggttattgatatttctcctggcaattgtgattctagcttatgcttcctccagcccagcatttctcatgatgtactctacatataagctaaaaagttatccataccacttgcacgcacacacacacacacaaatctgttaaagacatcagagaactattgaaggaactatgacatgaaatgaaaatatttacagagatagagagcttcaaatatgagcttacatgtagtcattttcctttgaaggcatttattgattctatcacatgaagaaaacttgagaatccatatttcatgtggatagagagccactgatgagccacagagaaataagcagtcttatgagactgggtagataaaattggaaacttgagggcttaagatcacagtgagaaggaagagatagaactgggcctgatatacagctcgttttccccccaggatatttgctgagttctgaagctacaaagaacaggagaacatgaaactaagcagaacatctataaaaaacagaattttttgctgtattgctttactacaaaaaggagtgttgagtatagaataccatccaggaggagtgagtggggatcatggtgaacatcagttcagttgctcagttgtgtccaactctttgtgacaccatggactgcagcacgccaggcctccctgtccatcagcaactcccggagtttacttaaactcatgtccatgagtcagtatgccatccaactatctcatc

SEQ ID NO: 63766 - DNA, 1523 bp, Bovine  19866880373014
ttgtttctgctgactgtatagagcttttccatctttggctgcaaagaatataatcaatctgatttcagtattgaccatctggtgatgtccatgtgtagagtcttttcttgtgttgttggaagagggtgtttgctatgacccgtgtgttctcttggcaacactctgttagcttttgacctgtgtcgttttgtaaatcaacttagataaaactttgtcttgctctgtgtaataatatgtgtgatatattagctttgtcttttctaatatatattaaatttaaaacatagctattaaaattaaaaatttagaaatctcttgtctaccttaaaatttctcatattttgcctttagtacaagtcctgtgttttgggaactctacgctaaacatgaagagagaaatgttttcacagattttgagggacccaatcagcatggaccaggggaagaaacttaatattatgtgtttgcaatttaaatcctgcatgctttcagaaggatttaaaggtgacttaagacatgaaagcaaaaagaatattaagataaaaaaaatatagatatcagaaacttaccaaaagagaaagcaaatatactgtcccttcaggttaaaatagctactatgttgagtattaaatttagttctgtgccttctgggaaggtcagtgttatatccaacttgctcacgggtctatgacctctgttgacccttgttatctaagggagatatacccatatggtgaagtagagtattctttttctatgttaagaaattttgaagtttcctagaatttctatcgaaaattcacatacccagccatcagtttcaaacctgacagctttcactaacagatagagtgggagagctggatctgtcaaggtgagtggtgtgcgcaggagtcagttggtgaggcttgatgagggacttgcctggaagaggtgagtgtgcatctgaggtttgatgttatgaatctgtgggaagccagcactgtgatttctgtgccaactattccagctgcttttgctatttaacaaatcacttttaaacttagtagaattaaagtaaaaattattgtatattaaagtctgtgaatgaactgggggcacatctgggcagttgtcacttggggtctctcatgcacttaagagcagctgtcagcttggtgcagggtcatttgaaactcaactgggccagatgttcaagatggcacactcattggctacctattaataccggccatcagcctgaatttttggtggcctggagcatctagacatgcttttgtcatgtggctctagcttctcacagtgtagagaattagttctgagagaaaatgtctcaacagcaaactctccaaaaagcaggaagcataagctcccaggctacttaagagttatgctcaaaactggcatactaccacttcttctgtgccctattgaagagaaaaatcacagggttcattcagattcagagaagttgggagatgtaaactcttaatgggaaaatggaaaggtcataatatagaaga

SEQ ID NO: 63767 - DNA, 3783 bp, Bovine  19866880488958
cacccctatttttctgtcaaactactagatccaatgcatttttctctggcctccctggaagtggaattgtcttggtctttcccctgcagagcccataacataaacacaagagcattaaaatggaaacaggatcttggttctcactgtttcaccaggcttcttagcactgacctctgaccctcattaagatcccatggaaagtctgggcatctggggtgtgtatctcactgtgggaatttttttgttgttatgattgttgctttcctcctcctggattattttggcttaacctggggctatgatgtaaaataagccactttcaagagcttttcctgacctggtttggggatggggtttagaggatgggatttgactatgctgcttttgactcaaagaatccattttcaagtcttcttttaaaattcatgtgagaaaataaaatatagcatttcttacattctcttgcattaatgacagttaagttcttatttttgaatacccatgtggaatttttgaagatatcgaggcttcatgattttttctattcacttgttatgttttttaaagtaggtctctggatcagatattgtcccccacattttttgatttatattgtatcacatcatattgtcattaaagaaaatatctttcttcatattttgtgggaaagatctcggagaagttagtttttttttttttttttaatggaattctttgtttcctggattagtttgagaggctaaagcccagaaatataattggaagggaattttaactattttggttgagtgtctaatttatgtacacatttagtggttattagtagaggatttagaaaattttcaataaattcagaaaagcagtcatccactatgagatagaataaatcctttcttctttggttggatatctctttgcatatctctgggtcatagacttccattcaacaagggccaagtttcatcttaagcttttctcatctatcatagactttctcatggctcagttccagttgatgtaagagtaactagtaggaagtgttgtgctcaaagaaggctgataagttttttttacaggtattttagattttgtttttaagagaatattaacagaaacaaataatctttatagtattttttctcttatgaagaattcaatatactctgctgtaaaaattctgactagcacaaagtatttttattttgaaataaaaaattgagattcaaaggaaggtgagtgacttgcccaaagtcaccgagtctcattgtacacaaaattcacatttttttttttttttttacctctagtactctgtctatgaaaaagctaggaatgtatacatgtgcccattcaaacttgctatataaaagaaaatcgtcttttccaagatgccctcttttactgaaagggcatatgtggaatatttaaaaacttcctaatagagttcattttttgctttaattttattttaggatttatgtttctagaaggcagatatatatgtaatttctatagcagtcaagacaaatgtcaggaggagaagcaaggggacaatatatgaatgctagattaaacaggcaactccaggaggctatgaactaggtccttgctgtccacaccattctttctcccagaagataccattctctcttgcactcttctcttccaggaccagaccttttgtaaaagtttcctcttcaataaagtctcctttactgacacagttcagtcatctatgaatatcaagataagtcatctatgaataccaagatagcttcatttcacctcacatgtttttcacaccccttattcaggtttttgttttgtctgttcagtcttttatttatactccttttataaatcacatttttttaactccaaagggcctaacatatagctccatgcagggaaggcaatcaacataaacttgttgactgatcataatatgacatgaatcatgaacacaataaattacttgacaatgtataggattaatacaactcttctgtgtggagatgggatggtaccaaaagaggaatgtgtctaaaagctcatggatcctatttagggagctccacatgagagcatgctttgatctggcaaagttgagttatctttattaataacagctctttggaaattcaggtatttttaatatcttgtttgattctcacaagaaaactgggagtcaatatatattgactccattttatggcagcgaaaactgaagctcccaaggatttagtgatttgtccatattcacatcttgcaagtagttgaaccttgaacctagagtattattttgttttgtttccatttacctctggggttcatactctttccaacccaccaggctgcttctcattccataaagttatcactgcaatgctcacagtttgtgattcattttgaagtaacaaccctgcttcaagtgatatatgcaaacatgattaaccaagagagccccttgactactatacacttggaagcttctagcataataaaattgtactgaaataagaggtcttaaagaactgaaggttacatgaaaaagagccacatgtagctcaaacactacatcctgagcatattgagttctcatgcttcatttgaccaacatgattctggctttacctcagaagaaagtttagtgtaatcttctgggcgaactgacccaccagggggaagattagaacatccttaaccttttctcagaacaaggagggtacatttagtagcaactttctgaaggggcagaaagtccaatatgtacaaaattgtcaaagagagatgacctattcatgcaaaatagtcatttccataatgtgctttcagaacaatgtgaacaatcacaaggcattagtaaaacttcagttaagcaatatagagatactggtggaattaactccttcccatctaccctcaaacaacaacacctcaccatctgtggtacttcctgtttgttttatttttaagcctttgtttggtcttagctagtttagacttcatagcctccaatttcttatgaagcgtagctgttctggctcagatctttacactgaaccccactgcattgcccaccccaagctgtagagacccagtcttccagatttagtagacataattaccatctataaattttatgtgcattaaaggtggtttccccctcttgtaatcattattaatatttgatggccaaggtatcattctttattgataattttatagatcatagttaatttagaaagaaaaaaaatcagaactgtatgcaaagtactgtagctccactttaaaaagtgaccttgtcaaagagatgcatttttgcttcaattaaattcaaagtcagtcagtcccataggtaatgttagcaattataagaatactttgcaaaagtagttaaaaaacactcagagaacttttatgtgatgctagtgtttaaagcaagaatgactttcttctaaaacttcaattctttatgagatcattttggagtgtactgttacataaaacatgaggtcagtaactaaggctaattaaattttagtaggagcaaaagtcaccaaaaggtttttgcattcatcctaccaattctaaaacagtggtacaatacaccattaatagccttagaattgctaattatttcaacatgaatagcgatatcaacgctgtcagtttaatttaatacactcaggagaattcctgcagaatgcatgatttctctattatttcctggttttcacaaccactaaaagctataaattctctttcttttcttcagagaga

SEQ ID NO: 63768 - DNA, 908 bp, Bovine  19866880492020
tattggaagcatcataaacatcatgcccatctgtcacttctctgtcatcatggaacatatatagcctgtaatcattcatagcaatatctcatggctctggtaaaagcttatgaataaccttctatgtccagctgtgtatttctgagtaattagataaatttaaaaatccaacaaactaaattctgaacgatgactcagtggcaagaggaatagttaaataaatgagtttgtttaagtggaaaacctatatttctctgaagtagagcaatttgcaagaataactgagagaaaaacagtttataaaaagagaatttgaacttggaaaattttaaatgtaactatagtgatatgttagaatttgattgaacaacattttaattatggtcattttctctttgagcttttcatttcataaatttctatatacatacattggctttgctctttttctagaacccaatagattaattttttattgtgttgagcaatgtgtattttggattatgtgtgtacatgatcctaatattgtttttcatttctcatatctgtatctaagcatgtgcacacacacaaagaaataaatgatatttgagaactactcagctctgaggaaggagaacaaatacttgacatgatttaatttatctacagtaaaatacatgacagaaatgatataagtaggagttctgaccaagcaaaatttactatataagcatgaatataataaaaataatgagagattttgataaataataggcaatgaacactttaaattattaatcacacaattggtattataattttagaaattaaacaagatgttctgtatttctttactgacattaatttgaaattttccacatttaatttttagttgtatctatatacaagcataattttaacataat

SEQ ID NO: 63769 - DNA, 2032 bp, Bovine  19866880563483
ctttgaaaagtaaatttccagagtggagaatcaatttgttttgtaagaagccattctcttaaatgcagaagctttgggtcactgctaaaagtatttagtgacaattgtggtgacagccccctgatgatctgtccaaaaaattggcttctacagcaaatttctatatttgccattcagcaggaaattactcgttttatattatgcttttgtaactgatgtttttggaattatttgttgtagttatgactgtagccaagtttacaaattgaattgtataacaccccttctaatgttatgagaaataaaatcttttgggttgaaatagtgtatatttggtctagccaaagaaatatgagggaagcctagaataaaataatatgtcccatctgcatgagagattagtgggctgaaaatatcattattactataagtccacagtatacttacactaaaagtctgtaatacacttttaaaataggggaattataaaagaaatacctccaaaatagacccctaaactgcagtgtagctgaagatgaaaactccattagaataaatggataaatgatcataaaagtatgactttttaacaacaaaaatagaataaaatttgaattaccattattcccataatcactttagatatttaatttctacatgtgattgaagctaaattttgatttttataaactcaattatactttcctattgcctttcacattcaagatgtcttattactaattttaaacccaaatcataatgagatttagggacaaggtaattttgtcagcagtgttttatacaatgtgatatttgagcctattcaatttttagataatttccccaattctatttttgagtgataaggatgaatgttgaatgatatgaagagaagggaaaggcctaaccttctccagatagttctcatttaggatgtggcatcatttgcacttcctttcctaggtgaaattctgacattcgaataattggagggataaacaaagtcttcaggtccaattccattccctccagaagctgatatgcatgacattcgggtagtttgtgtgtgtggcaggggttggggaggggcgggggcggggccggttggagattggaggagaagtttcctgaaaatcccccttgatccccctaatgaaaggttacttttctttggaccaaataatagttgaccagtaaagcaaatctgatctaatggattcaggacttaggaaactataaaatgagggaagcacagaatgagtggcagaacactggataagaaaaacagagcaggtgcaaatgatgaaggaggtaaggacaagttctagtctcatacttccagtgtgtgaaaagcaggaaactggggctcagggaagctaaataagttggcaaaggtgctgcaaactgggtagactgataatttgaacctggaaatggcaacccactccagtattcttgcctagaaaatcccagggacagaggagcctggtgggtttccgtctatggggtcacacagagtcggacacgactgatgcgccttagcagcagcagcagtaagcaacaccaggatagcatttaataataatattcctagccagaccaaagataatctccataatatctgctactagaaaaagtgtacacttaggagttaatttttaatttattttaaattcctcatctccagctgccttgggacagaaagcttcatttcctttgccccagagccccctcagtgagtgctagctagtcttttccttaagccttgagcagcctgcagtgacctgcccttgaagtgcaggtttaacaacctttgcccaagcactctctggctctttgtacatctttaatagtttccttgacggactatgaagaactgccagatgacagttctatttcatttttgtcactgcctagtgctccttttttctctggctttttctcaagggcatgattctataagtcaatgtggcaatgttcacgatggggtattgctctttcaaccactgtatattgatgcagtgcgagcaag

SEQ ID NO: 63770 - DNA, 1611 bp, Bovine  19866880588856
acatcaaaattaaattgcaaatacattaaatgaaaatgatcaacaaaaggaaaaaaaattataaatctgttaatatttcatgttgatgtcaactttctgtgtcatatttaatttttctagaggagtttcttaaagcaaattctgaaattaaatggtctaacaggaattattagataaagattgacaagggatttcctagactttgattttgagcttgtatccccaaatggtcctggtggccctataaccagccctaccaggactttggttcaagcagcaaatctgtgataatatgagaaatggaaaaagaaatattgtcctggaaaatatgtttttctagacaagtctatttttctcatgggatgatggaatttcccaatattgtggtgataattaaattattactcaaatattatccttagtcatttcactcctcaaatgtgatgagggccccataagggtttgtagtaagagaaaaatgcattgaaataattagtactaaatttccttaactcttttcacatttacctaatgtgatgaaaaagctatctaggtttaaacaagggtaggaaaataaaattgaataaacagcattcatttattcactctattcatctattcattctgtaaaacgttagtcaacatcccaccatgaaggtgaatgtctctttttctgaaagcattatttactgagtatttccaatatgtcaggcatcttgcccacaaaatggtacaacatgaaagagctaatgtcccctgcatataagttcatagtctgatgaacattttcttctactggtaccaacgttttggccttcgtcatacctcctgccaagaggcaccattatattaaagcaagccaggcattccatgatttcgtaatatgcagtgctcttagaggaaggaagtgaggttcaacaaccatgaatagaacctcacaactgggaagcactgagagcctactccataaatacttgtatgttgtttaagaatagaaagaaatacagcatttagagggaaatattcctttggcccaaggggaagagagtacaaaagaaaaagaagcaagaaagcaaaacatggaaaacactcttaaaaaaagataaagaaaagaaagcagaaagaaaaagtgaaaaagtgttagtggaagagtctgcagatgaacgttatatactcagattgggaatgatagtcaagtccccagaaagaactggaaggccattctacttcactccaccgtatctgtagttcgacttacgcacaagtcttatttcatttccattatgaaaaacctagggtagctgctgcattatacgatcctcatcagtcactgacatggccctcgagtaaataatgatctcttgtgcagcatgatgctgctgccagtaatgagcatataatagtgatatattagcatgttaaataatgacatgcaaagttacagtgtatatgttgatgtcatgtcactgctaacctgctacttgcactaaatttgtcattctcaacgtaatgtgttgttccagatggaaaatttaattttatctgatttcccccattcacttgcagctctggataatcacaaaccactttgggctctctcctgtctcccta

SEQ ID NO: 63771 - DNA, 1271 bp, Bovine  19866880634265
atggctggatggaatactgactcgatggacgtgagtctgagtgaagtccgggagttgatgatggacagggaggcctggcgtgctgcaattcatggggtcgcaaagagtcagacacgactgagcgactgaactgaactgaaatataggtgaccctagaagccgatttgaaacttaactagtttcaaagattgatggggtcagaaattaggttacagagtcaagggtgaaaatgaggtgagaaattaagagacagcaaatgatgactattctttccagaagattgaatataaggaaaaaatagacaaattcttgcaattaataagataccaagttggcaaagagaaaacatacatttttttgtaaagacagagaggccagaatttatgcctctaggttaagaagtggaaggaactagggaacaagaaaggttgaagatttagaggagaaagaatgtcacaaatgttcttatgtgatttcagagctccttcatctcctggcctctactttcatgtttgccagtaaattgtcaccctagcaaaattttcagtagtctgatgaaggcagccagttgtcagggtaccacagtccatgtgatcatcaatagatgtgaagaaaggaatatatgtagtaggtatacacacatgtggataagtaagtatgccaactggtatgtatgttatgtgtatgtgtacatatatatatataaaactatatatgttggtggtgactggtgctcagttgtgtccaattttttatgatcccatggatggtagcccaccaggttcatctgtccatggaattttccatgcaagaaacaactatatatgtatatattatgaatagcatatgttcatataaaaaatataaaaacacattcatttccttcctttcttcattattttttttcttatcaatactatactaaagaaagagtataagaaaattcacattaattactttcactaggaaagggatccactaaacatatccataaaagaatatttggctgaacttgggactcactaaaattctatggttctcaaatgaaagctaaactgaattgtttataatccagtttatatttctagtaaagtaaaatactaacaaggataacagaaacacttgcaagacagatgtcttcaaagatagcaaacatatctctgataatattgccataaactcagagttttatgataagaaatagattgcatttcctttttcacatagaataaacaatagcataagctgggccttctttatttagtgaaaat

SEQ ID NO: 63772 - DNA, 1741 bp, Bovine  19866880681972
tgctgagttatatgccaagataacttttgaaaggtatagccacatgggtaattggcaactatcccaggtttgtgttagatatgttatggaagtgtttctgtaaattaggaatccatgcaaacaggtaaattttattatctaataataattctcattggaagtattcttttactttacctccctttttcatgtatttacatgaaattgcctcaaatgatgctttctcttttctcttaaagagcccatcaatagatatccaaagacagccataattaggtaagctggccaattaaataaggaaacacaatatcttgttagcaattggcatcaactgttgggtgacattttgataaactgcttcaatatagtgtatagcattttggtgccttttcacttcttaaaaggtcagtctctgtaacatcaagatagctgatatttaaagggtataggaaaattcaaataaatagtctgttctacttctatatatttcttcttgcagtaaaatccctgaaaatctacttggcttttttattattaatattgtacttattgaggtctccattattagaaggggataatgatatatcttttttttctctaattctgatttgctgtcacttgaaacctcactctatattttcaataaagaatttaacgttgactcatttgggaaaatttgtgtggttacaagtgtttcccttcctaagatagaactaaaaatatttctagaacaatacccattagtgagacttttaggaagcctcttcaaaccactgtaaagagtgtgccctgcactgctcacaggtgggaatcaaccccaccaagactctaggctggtgtttcttacaataaaaagaaagaaagtgaagttgctctgtcgtgtccgactctttgcgactccatggactgtagcccacaggctcctccgtccacgggattttccaagcaagaatactggagtgggtttccatttccttctccaggagatcttcccgacctagggactgaacccgggtcctccgcattgtaggcagacactttaccatctgagccaccagggaaatttcttacaatatgaccccacaaaccatctaccttaaaatagcatctgaaaagtgctttatcaaaaatgcagatacttgagttaaagtccagaagaactgaatcagaatcactgaaggtggagctgaaaatgcctatttttttttctttaaataagatctccaggtaattcttaaacttactttgaacaacacagctctgtgcaaatgggggacttagaactaaattctatctctcttccttcatacgtattaaacttctcacatctcatccagcagggaaaccacttctatctaacacagctttaaaacgaaaaaacaagttgcctttttctaaaatgacgcatctttgactttttatccagactgttgcaaaggctgtgtcttgcgcattgtgtactcctcatggacattttggggctgtgtataatatcattttattgggagtggataatttttcttttcaattgtcctatgtagtgtaggaaatgtcacataaacttcttttacagctttgctagaaaggtctgagagctagagcaaatacatgtctgtgcatgagcagagccctatcagggctttgctgagcatgaattggttgaatcagccagtggtcccattgttcagtccatggcccacaagagtgcaggtggcataactgctctttcaaagaagtaagg

SEQ ID NO: 63773 - DNA, 1885 bp, Bovine  19866880714156
aaaatgaaagtaaactttcgccaacaatagtgtatatttatacatctgaataatcttgtttttccaagaaagagatattttatatatcttttcattcttctgtccctaacttttgcttcctgttttaaaaacatattgctatcttagttcacagttatcccagaccctttttgaacaaaatccttctagaagaaatcctggcttcattacaattctcttttcaatctgttaaaatctatccaaatttgtgttctctaattgcataagagatttagagaaatgttcaagaatctccaggacttgtaacctcttttttccttcatttgtttctaaactgcatctgtgttgtcagacaaaatattgatagagcttgcttagctagatttagtagaatctaggagagtgatttatagagtagagggaaatccatgttaaaccttcaggtctggaaatttaagctttatattgatatctatttggattggtatttcctttccttgctataaaaataaaatgatgtgtgagtgggtaacccagaaatacaaaacataatgtttaacattacacctgccagttgcaagtcagaaggtatgttagtactttaaagattcccaaagtgaaagcatgtcaacactatataggatagagctgtgctctgagagtacgctgaaggataagaaacattgttttagactgagggggacaaagggtaagtttggaggcatatgaacttcatattagaaatagaagatgaaatgcacatctggactttaagtacatgtatatacatgtatatatgcaaacacagcatatatggcacagttatatacatgtatgcgtgtgtatgcacacacacacacaagtacacatggagtgtatgtgagtttctaaacatacacacatatactgttgttgttgtccttaggggataggctggtcaaaccagctgctgacaaacaggcagactggccttttgcctctggaaggatgtcctgaggtagaatcctgcatgtggcaggcagccagtacaatacatcactacagctggattaggaggataacacccaggccagaccaggaataaggatgaatcctttttgtagaattgtatgggggcgggggggcagggggggttgcagatcactttttttttttttttaatccaaaatcactatttccaaagccaaaactgaaggaaacagttgtcatccagaaaagggtgaaaaagaggacagtgggactcttgaactagggcgtgaacctgcatgaagtcgagactcctgccagccgttgaaagggttaggggaggaggtggctgcactgcggtacagcaagacagggttcaaaggcaaccgagagaggcctcaagagtttggatcctggattcaagtttcctggccctatttactgagcttttcctcaggaagtttattgagatttaaaaatagcttcagcgtggaattcagatttctacaagcacttgttattttcaaatatgagcaaatagccagacttccattgaatcacccttgtttcatctattgatgagtttttaattgagtcccaacaatctgcttaaatcagattatcttcctaagaatatttgaagtttattttgccagaatctactttggttactatttaaacaactttacagatcacagaaattattttaaataataagctcataacaatacaagaacattttgcttattagcataaccttttaccaaccacatctactccccatacaaaaatataagaactcagaatttgcacttggtagccatctgtttttcctctgaacattttacttttaagtctctttctttgagttgttaagatattttaaatcatgatgttcttgcacagcatgtcagataga

SEQ ID NO: 63774 - DNA, 2008 bp, Bovine  19866880797406
aggtagggaaagagtctaaggaaaaatataaagtgctctgcagatgagagaaaaaaattggtaataatctgttatgtggaatgatggagaggtagaatcaaggataatttcaaggtctttagcctggatgaatgggaaaactgtagttctggaaacagagagtaagattttgaaaagatagaaaagatatggaaaatgtgccatctttggtttgagagctattgaatattaggagtctgcaaggtctaaaggtctttaagcttgttataaattgagtattgaagtttgagtgagagatcagtgctaaaaatgaagatttggaatacatccacttggatgattatctgaaactgagagtaaacaatgctttgaagagaagcaaacttgaaaagtcataaataatgcaacatgatttattttgctcagatctattatattacaagtaggtagatgatacaaacaagttagtgaatctctcttatctgtctttaatgatccaggaatatgtgaagaatattagatgagttgagaatttcaccactgaaggattaccatcaataggctgatacgtcactgcatactgagtcatcaaagaaacataactgaatccagactataatatatactctgagtttaaaatcatgtccatgtttaaaaaaaaaatgaatctcctttcttgaaatgttttggcatcacagatagaggaaaaaatcatgctgatgaaagcatgctatagaaacagagtgatgccattagtatttgatttgtatttaataaggtctgcttttattataccactcagccataggagctctattatttcattattgagcttttgctgatattccttcagcctagctttaacccttgcttccaatggagtgggaggggagtgtttgtgtatatggacacatgatgtactttattttgctttgtaagccatccatgtccactgaaaaactatgatttttaacagtttgatcacaatagagaataattgcctaaaacccaatttcttcatttcttatatatctctattagaaaacccatccctcaagacagtataaggtaccatgaaaaggtgaatattgttttttgtaaaatcctttcatagttaaaaagaaaatttgtacaaaaatcatttttcagttcaacctttcttcactcctggcatcctgcaacaggcacacatttgtgcatagattcacactgtcccactgcatcttcttatctgaaattattaatttgatgacaaagacctcccattaatattgttctcctttggcaaaagtcaaatctcctcagaatcaccttcaaaatagcttgaccagtgactaaatttatgaatttttaaaatattgtcagtcagcattgaatgcatttacctacttaaaatgagttttgtttcaaagcactttgctgccatccatggtaattggaaagtcagtttgagatatcttctaatgtgctttttaaaattgaccaaggctgcagaaacagcttcttaaaccaaatataattaatttctatctgtcccatctgatcactgtaagatgacagtccctcatattctttatttttaatgtatgtgttttttttttttcaatagagaacattggcctttcatctctccctttccctctgcaaattggcactttctgtcttctaggagtctcattaccatccaatgattttttatgccacttcacaatgaaggcactaaactgggacacctacaagaaaacactcacacctacttatatagcacattttattttctttctctgaatcttcctccatgtggtctttatggtttcaatagttctcaagtgtcaacaagacctgaaacttttcaaccgttggctgcctacctcattcgccctccattcctcccaggcagcatcctaagtagaatagaatgttacagcacctgattggctcatggatagagcattcattctccaggaatgccctgtagataccaattgaaactgcatcatccataaaa

SEQ ID NO: 63775 - DNA, 832 bp, Bovine  19866880863597
ttatggtacagcaaagacatgttatgatagctgaatacaaactttatgagagccagaatgcattgtatttcttactctgttactgattttgtatctctagtaactaaaatgatgcctggtgccagaggtggatttgccacaaatgaaaagactgtgcttggggcttgaggggaattgaaatgtttaagggaaaaccttttcccttgaggcttggagttttttgaatgtatttggtatttagaagagcatttgtaaacttggtgacaaaagttgcattagaatattcaggactaaagccagattgcaagggactgagaaggcatacacactgtagaagtcagtcgaatgtatggcatgttcttcgaagaagtttaatgaaaggaacaagagtgagggaactaatctggggggagtcaagtttaaaaggccattgtcttcttaccatttttctcagtcaggaaattgaatccattattggtaaccaagggcagataatattagtaaggaatatagtatatagtaaaaaacacaatgagggtagaagccagttagagggagaagaaaaaagattataataagatgactgatatataattctaattttttgaaaattgaaattaatttcctttttaaatatgcctatttacatcctatgagatattccatgatggctttccttagacttcttatctaattttcattaaacttattgtttattatgattcaaaacacttgtccaagaaaacgaatatacttttaaacagaattttattaaaaaataataaatgatgataaaagtaatgaatgtcgcttagagaaaatttagaaaata

SEQ ID NO: 63776 - DNA, 1440 bp, Bovine  19866881022564
atgtatactagggttggagggttgttgttttaaaaatattttcggtatgacaagttgaaaattttagctcgtaagctaagattacctcaaaataaatatgttaagtaaatccacaagatacaaatgcaaggattcttggcatacaagaaagttaaaatataattttttcacaaggaattgacataattcataagattctttacattctcaccatttattttgagaatgtccaatttgtgcatttttcatcaacttatactgttaagtataaagtgtttcccccaaaaaaggattcctgaaagattcttgaaattgccttctgcggtttccttcctcactggagctaactataaaatccttacactgtgtaactaaaatgctagattctttccataattcatattgatttttgcataaaaggcctattctgagctcagaactacataatcaaacacaaccatcagtttctgatgctaaacaaaattatccctttgggggaatttattcacaccttctctggagataaaggggaaaataatcttctcacttcctgaaacattatagctttacattagataaaatagacacctctatctggagtcaatttccatgtcaggtaaatcaaatagtcatagctccacagtaaagaactaaatttcatctgtaagtcaaatttctagacagttcctgaggcttttaaaccttcaaatacccagagaaggaggtggtcatgaaggagcttatgaaaagtgacatttttcccagggaatttttatctcctattagccagatgctgtctccttcatgtcagttcctccctaaaacaaatcaagactgccaaattaatcttgggcagaatttctctttgtagaaggtgtaatcctaaaaccctatcacttcctctctttctcatcgtgttgctttggggagcaatacacaagctcatgtcctcccagcccccttgctctgcccccacctccctggagacacctacattgcctttccccctcttcttggtacaccatgaacagctttaacacttgctgttgtcccctcttcctgaaagttttgtccttgtacattcaaattggggttttgtcacactgtcaaagtttcagctcagctgtccctgtcctagggacaccttctctgaccacacatcaaaagtggcttcatcaggaatttcatgtcttatccctttggtttcattgacttcgaaatagtcatcatgatctgaaactcatttgcctgtttccttgtttattacctggtttccccatttcccactggaatagaagcccctatgagaacagggtttttacttgtcctctgtcgtcttctgggcttccctggtggctcagcagtaaagaacctgcctgcatgagaggcaagagacatgggttcgattcctgcattggaaagatcccctggaggaggaat

SEQ ID NO: 63777 - DNA, 716 bp, Bovine  19866881031554
caatgtgctccatatgtgggcaaagaaattctctaatgttccttgttccttgacaattgttggaaaagatccatttacatttattctatacatccttcatcccacactcccaacctagggcaggaagttttgggctattatgcagttcagcagaaaggaagaccctacacagcctcagaagggcctgcctgggagataatagaacagagaaagagagggtatccctagagcaaataacagtaaaaacagtgcctcttcagatgtctcttgtccacatatatctagagcccaggttctgattctctaagggcaaggtcttctagcaatgtgagtaaagagagggtaatgtgcatttctgtgaaaccttagaatgagagtttctgcttgtattactgcagtaaaggtccctcagagcccttcttgtaaaatcaaggaagttgttctgggatctgtagctatactccttgagcctgcctcccatgcagaaacaacactgcttcagtaagaagtcaatgaatattttccataagctttctcctttgccaagagcgttaagactgaaggcaaaaaagtaaacttataggagcaaatggggaggtgagcagtaaatacatgataaggctatgcggtttgtaggtgaagacaaattgttttgaagactataaagactttcttggtccacatgcaatatccagaacacctgcaacaacagctta

SEQ ID NO: 63778 - DNA, 2699 bp, Bovine  19866881034159
acactgatagttgggccaattgtgacagacactactaattttcttccagtgtccatttgccccttttcattttagttatagaacctccccatcatccctgggtctcagcatggcgtgtagcaagtcagctagacaccatatttccaagtctgccttaaggtaacatgtaacttaatgactatgtgcttgtagtaggtttgtcaagaaacggtcttttgaggtttcgaccttaaacactgccttaatgcattctttctttctcctgactaggagatagcaagagcaggataagctgccttgggtcagctgaggatgacagggtgaatccagcagcctgagcactacatttcctgtggagaaagggaagcttccagctctggactgtttagctctgagttgtaacgcaaaagagcaatagatttctagttcgtttgttccactcaactgctgagtctctttattacagcattctgatctgtatttgaaccaatatactagggttgaaagagaaaggggatattctacatgtattttatcatatataagaaagtgcagtaaattagtgaactcaatcagctttctttgatattttggaagtaggcttaaggaacaataattccacaattacatcttggaaatggtagtaaaagataactggataccttttaacatgaagacaaataaagcttgcaaaaaattgaaccactacctcaagatgaaaaatgaaactatataaaactgtatatgtaagaattttgtgggccataaagtattagctacataataattgttaatgattaataatttaaattatttttactgatataatcattattacttgtgttctagccagttcagagacctaaacagaacatatttctactagcatttaaactatactttaaaaatatcataaagtggtatgtttcaatcattgcattcattcattcattcagcatatatttgtggaccacaaatataacagaccaccactgtaacagtgaccctacaaaaactcaagtttcatatatgtttgaattcagataaatactcacacaacatcctaaaatgtttctaatgagaaaatttccagttgcatatttgatttgtgtttatgaatatagaatatatgcgtatagaaaactatacaggacaaatgaggacaaggctcaaacgagttggttagtggaattattattttttaattgtaaggaaacagtaacaaagtgaatgactggtttaaagaagaattgaatgagataagggtattcctatggaattgcataagataggaaactcacgttttttcctacttaaaatttgtgggaagcattttttaatgttgcatacctctttgtatgtgtggttacataatgcccttgattctgttgaagataactggttaagcctgtgaaatgttcattgatctaaatggatgggtctgaggggaagggcttgtcagcggagacagcttatcagaagagggttgttcttccaccccccttatttatccctaaaccaggggaaattcccctgggagcatagaggcctcagcgggaacattgcagagactcaagagagaagaaatggtttgtaaacgaacatttaaaacaagaaaacacttctgtttttaaagccaatgagtataaagtaccagtgggagacgtgagttgacagctgggactctgcatccgtctggccgagggattctgagtcaatctctgacagacgaaaagtgggacttggagaactcgggactgtcagaacctactcaaaattcctgggcttgccatttcaaaccaaattcaaaccttccagagcttgagattaaagagagtgcttacagaaaaaataaaagaggtttgaaaacgcttattaagaggcatcttagaaatctttataaagcatcatctgtgatgatttacatgcaaatgaatacgaatgtgcttggcatacattatgtagggttttcagacttgatcaaatccagactgatcatacagaaagaaaggcacagactagagccactagagagactgaaggaaggatggcctgcccgctcctggtttgcagcagaggagacatgagagagaacacactcttattcagtcacttaaggacaactattgctcccaggctacagtctgagaccagagataactcaggaggtttctgggagcctgagatgccctcagagctgcacgtgtgcatcgaagaagccttgagcacgaatttaccccttactccaaagtgccagaggctgtagcctctttccagggtttcttgggggcctcattacttccatcatgagtttccaggcttcccaggtgtctgaagtgacctctctcggtgacaggacaggaaccaggatgctaggcctttgctaatcagtctgaattattaaagaagtttcccaggttcagaaagttgctacagagtgtaagatgtagataaaatgtaaaaagggaccaaaaaatgccaccaggtcctcaaactgccataagcaggaaagtctgacagggttatataacaagctaaaataggtctcttgaaaaactaatggaacttctgagttcttatttaatgctgctgctgctgctgttgataagtcgcttcagtcgtgtccgactctgtgcgaccccatagacggcagcccaccaggctcccctatccctgggattctccaggcaagaacactg

SEQ ID NO: 63779 - DNA, 2922 bp, Bovine  19866881056568
cttgactgcagatgaattaggaattggtatatttggctgcttggtcagtttcttgatcctgtgagaaaaggccttaaattgaatggactttttagggaagaaggactttttttttcccttattattctcaagaatgacacattttaatttagtccttgatacaagacagtagcacgaggaacgtgtctatcatttatagtcacagcttcctttccttgacttatcaaagtagctaataaggtactttgaattttttgtgtgttcaaatggtttactggaataacagaaaagaaaaaagatagctgcaagacattgcagatgatgctgtgttggcataatagcgtttacatttatggaaagcaaagatagtttcactaaattaatatttgcaaaaccaattcagttcctaatttttctttttaagtggattgggaaaccttctataatataatgtaaaataattacatactcagttactaatcctaatagagtctttcagtgttcatacgattaccatctcctctttaaaataatctcttttcggtgatcccctaacgcagcatttgatgagttcttttcatcactattttttttggatgtttaaaagttggcctccagatagagaaatgggctgatgatatgaacaggcatttcatagagaaagaaattgaagtagccagtgtcaatctcagtaatcccaaactacagctatcacttgggtgtgtgagtgttctaagttgcttcagtggtgtcagactctttgtgaccctctggctgtagcctgccagccttctcttccataggattatcccagcatgaatgttgaaatgggttgccatgccctcctctaggggatcttcccaacccggggatcaaacccgtgtctcttatgtctcttgcattggcaagtgggttctttaccattgtctccacctgggaagcccatccatcatttgggcaggattaagaaatgatattggttttggagaagtgagtactgttatgtgctgcatgtagtcctataagttggttcagcctttttgaaggtaatttggcagaactcatcagaaaacaaaaaatacagcatctctttatccagcccttccacttttgaggatatattaagttgactcaaagatttagaaatgactggcaaactaaattatgatttatccacacaatggaataatgtatagatcaaaaattaagttgcacaaatacgtttatatgtattatgaagagaaagaaatggattaccaaatactctttttggtataattacattttttagaagtatttgtacaaatacatgcatagaaaaagatctgaaagataaattttaagtctgtggaaagtattaagagcatttatataatttttgctcatttgaatttttgattctttcctctaatgagtatgtattgcttttgaagcttttttgttgaagatgtagcctctatcttaaaatgcacagaatagtgtaggagcgaaggatacctgataatcaacaggatgtccccattccccaggtcctattctgaaggttcaccaggagcctgttttcttttacagctggttcttgaaagctatgtgtgagggttttgttttttttttttttccttctgtgacaaatgcctatcattttctaaacaagaaagccaatgtcccggttaggtgtgtggagttcttttcattcatttgcagcgctgttgtgttaatactaaataggcagagacagcctaactggtggtgtaggatggtgagccagtcctggggctttttctggtcagcccagaatcctctgattgccacgttttcctaatttcccatttccaaggcattacttgaatgacctttcttgctgaatatgatgctctgaatctccaagattttcacatgcatttggaagtgggcagccaggcgattgtttacaggactcccaatgaactgtgtgctcacagcaagtttgataaacacacatttcctccttttatcagtgagattgcagaatgtgaagtatgagtttccagttttactcattcccctcagcccttttcctgtttaaaaacttagacatactaattggatactgatctgtccctgttttttattttgcttactggtagttgacggcttattccactacttacctaggcaaggcttggcagtccttcaaaaataaactttccatgtatacaagttaaaggagattcatcccaaggaatgtaatgtgagcactaattaacagtaatgactgctaatcactttgctttttatactcctttagaagcactgctattatccaatgtagttaagtaaaatgcttgtatatgaatcaacaatgctgcatccttttagcagctattgctcacaatcaagctttgcataaattcaagttaaacaaaattgattttaatatgctacatttctttttataataggaaactaaaatatctacttaaatatccttaatactaaagacaatacctgttttccttttttacaatcatccttgtggtagtcggaaagcaatatcccaatttttctcacagttcacgacatttcttagatttctttgacattgcatgtggtatactcttcatagtcacagctccactttgattgtattgaatgcattttatcagatcagtgaaaagccatgggcttgtatttaatttttctggttttgtacatttacttcctagagatcgtacagtttcttaaaattatatggcccatttgtataaacttagttcataggattgtacattcagtgttgattaaaaaaggttgttttattatgtttagtgtattattagactattatagaagctttctgtttatttacatgcactcagcatacctataaactgccttgcctcaggaagagactaagcaaaactcataaattaataatttaag

SEQ ID NO: 63780 - DNA, 1721 bp, Bovine  19866881239036
aaatgccaaatttagtgatagaatttaagataactgattaacaattgagtttttcaaaacaactcctcctcaataatattcttgttggactagatgcaacttaacatcataattggaaggaaaattattttgaactttataataaaaaacaataattgattttaagaaactctattatagaaaccattcagatcatatagtgtgtgtgtgctaagttacttcagtcctgtccaactctttgcgaccctatgggctgtagtctgccaggttcctctgtccatgggattctccagacaagaaactggcgtggattatcagtgccctcctccagaggatcttcccaacctagggactgaacccacaactctattgtctaacctgcattggcaggtgggttctttatcactagagccacttgggaagcccagattatatagtacaaagctacaactgactatgcttgcttgcttgcttagtcgcttcagttgtgcccaacattttgtgaacctatggtccatagcccaccaggttcctctgtggggattctctaggtaagaatgctggaatgggttgccatgcgttccttcaggggatcttcctgacccagggattgaatatgcatctcctgcatcttctgcattgcatgcagattcttcaccactaagccaccaaggaaacctatgactgactataagaacctcttgaagcttacttgccataatgtcataattcatagaaataattaattatgtttaataaaaaacattttcttttcaaggtgaaaataatagtatgtaggtaacaaagtccccaaatttgagatctatcccaaggttctcccagtcacattccttacattggcttccatataccctgtatagtaataatttgtattctcccttcattgtgcttatctagtgtttaatacttcaagttgttttttatacataaaagcctttggaaaataaataattacttttatttgatactttggaagtccttggagaaggaaatggccacccattccagtattcttgcctggaaaattccatggacagaggagtctggcgggctctagtccatggagtcacaaagagtcagtcacaacagagtgactgagcactggaagtccttctgtgaattatatcctcactacttcactcatttctagacatttcagatcatattggtatatagacacactactcacagctttatagaataagctatttcaagattgtgtcctctagatacaagctccttgggagaggtctgtgttttatttgtctttgtttctctctgccatgtatagtaccttgttcatgtcagctgtttcttaaatgttgaataaatgaacaaattaatgaataaagactaggtctactctgtttttcctaatctgtcttagctcttcctgcttagtcaaattcaatttcattttcccataaatatctgtttctagttctaacaacaatctataccttaagttagaaccagagagaagagaagtgtctgaaagttaggacctgatctttctctaagaacttcttctgtttctttgcctgagtaaattgatgccaacaaaaaataaatatgcagtagggtcagggttaagggtccttttgtatgattttagtaaaaacatatttttatagaaaagtatctgcaatagcctccctagagttggtcaaatcaccccagaattggtttccaagacagtt

SEQ ID NO: 63781 - DNA, 1700 bp, Bovine  19866881249069
tgaaagtttgttcatgggacaaagttccatgttacagaaaaacttcacatgaactgtttggtcaacccaataaaattatgcacaccttgatcaagtctccctgactgtcttaatgactttatgaagtccaatcaatttctcttgcctcaaaacagatggcagaagtctgtggaatgctggttaccctcagctgatggcaaaatcaaggttgagctgccagatggagcttggcactgtttaaaggaacaaatagcccaaagttcctctctgccacagaacctagtctttgcgcttcctttcacatttttttttcaacatctattgtattcttaaaaatagaaacacatgtttctgccagtccctccatgggatcccagatgaaaaacctctaaaggagaaaaacaaaatgcaatttgaatcaaagtctgtgaagcttcccagacacaccaagccagggccattgggacgcagcgggtaagatgctgacagcccaccaacaatgagaccacaggatctgcagctagaaggacttctgcagtcatcctctacttaccagacttctccctcctcttccccatgcttgcatttgccctaattgaaaagatccttcggcgatggcttcagtagagcagaattgctgttccttactcaaaacttaaccctatctttccccatggctttggctctggattctcattctactttgggcagtcaaagtgttagtcgctcagttgtgtctgacgtggcaaccccatggactgtggcctggtaggctcctctgtccatggaattttccaggcaataatactgccattcccttatccaggggatcttctggacccagggattgaacccatgtctcctgcattacaagcagattctttaccatctgagccaccagggaacgagtgaaatccacttgactagaagtaaagatactatgaaaaattatgaagcgttctctcttctttgatgctaggtttcctccctgtacctttatgttcccagtttcttaaaagctgctcccaggggagaaactaatactctctattacatttattgtttgcctctttcagagctcagagtttaacagccaggcagagggtgcagcttacatggtggtatttcaaacatcagtaaaatggtgaaggttattttgcagcactcctgataccatacttcgtgaactttcctgatggaaagttgatgcaaactggattttcatagcaattcaccttgactatattcagatttagcaagaggttctgctgatggaggttggtcattagttgtgatattgtttaccactgtgtgttaacataaactaaaatcctactcacttaatgacatttaagccctcaataacctaatcctgtgctattttcccactactccttgtgattcagccaacctctcaattgtttattttccttgcttgtttcaggtttgcagtcttcatgccctccctcaaaattagagtcagcctggcataagggcaagagcactcaactcagatggggctgagtgcggaacatggcttaaacaaattaagtgatttatgcaatatgatagctatatgactttgagcctttagcttaatcatctgtaaaatgacacttccaactgtgcaatgttcttaaaagggtaatgtaggatgtagaggactatatacagatagggcactcaataagttatctttt

SEQ ID NO: 63782 - DNA, 1111 bp, Bovine  19866881273284
tgttctcctgttggcaggcagatttgagtattgcacagtaattgctgggctttccccccctctctccccatctcaatcccggctaggagacagcaactacacattgcaagtaattgtcatatgaaagaccaaaaactgctaacaagacagagtgggtagatgtgcaatcctggtgatgccaagacctaatgaccacagcagtgatattttttgattggcaaaataaagtgttaaatcttcttttttcccctttagacagttaattagggagatccctgaacttttcagaacactgaagcattgcctgtaggaaagttcagctttgcagtccaagggtctagtttgggtgattaatgctgtcgatgcatttttagtgagtttgagaagtgtattgtgtcataagtagtggtgagtgggaagaataaggcaatgagcatattattttgagcaagtgatacaatttgacactcctccctagacattaaaggcattcaaaaaccaaagttattaatctagttaatcaataaaatatcaaaatatgaatgaatttctagtgttcccaggtggattggtcgggataaagtccggccttggtaatggctgacagttttctttttggctcagagcttccagcaggcaacatatatccatgtatttgttggattatctagctaactggaggagagcaccaacaaggatgatccaggatcatgtgtgtatttgacatcacatatgtcctcaatcataaggatttgtctggtgttctgggaattcataacagtttgaatctgagttccaaacttgtaagcattaaattgctcaaagggctcataactccatatctttcgtagcttagacagcaaggactgcttatgtggtatttacacaaatgaaagattaaccctgagactgctggctgagattgcttcttttcttctgactccttttagcttttacactttctccattcagacttgtatcttataaagagctatcaaaaagagatcttctatgagcttactgcaggtttaaactggttgcactaaaatttttgtatagtgtattttggaggttcctgataatgatgcctatggaattagaagaatccaag

SEQ ID NO: 63783 - DNA, 759 bp, Bovine  19866881294122
tatatatacacacacacatatatatatatacacacacacatatatatatatatacacacatatatatgtatatacacatatatatatatacacacacacatatatatatatatatatacacacatatatatgtatatacacatatatatattcaaacaatcagtcacacaatctatatatattatggaaaaacacaaatttgagataaaattttcttttttcttcccttgtcaaacccatcttccttttgccacatgttgctcatcttgaagcagtcctttctgatgcccctttacccagagcccagtatgagggatctgtacacaacagtaatcaaagtgtaccatccaggagacagataaccctttccgagaaaagctctattttcatccttcattgcctctccccctgctcttgttctgatacttttggagattagagattttaactgtatgacttgtgaaatgccatttttcttccaacagctgtgtttatgatatataatctattagctgcccatatgccagcatttaaaagcattctgatggataatactcagcaagggattaatcttttccagcatcaccctcttgacctgcaaatgtacattagtggggggtataatgcctgctctgacatttgtttgcaatgtatccaaatacattctggaatgcacattcaggtttcctggcattgagacagacaggcgagtcagcactaagacatatagttcccatatgccagggttaagggaactag

SEQ ID NO: 63784 - DNA, 1413 bp, Bovine  19866881296034
tatgcaagatgttactattaagagaaactggctaaagggtattgggacctctctgcattatttcttagaagtgcatgtgactctataattacctcaaaaataaaaacagaaaaattattactatcattatgagtccactactagagtctgtattaccatttctgcagacattaggcagaattatatcaagtgactgactggatcacatcagaaagtgttgggaactcgactgaaatgaatgatttattgtgaatcctgaaggtgatgccaagattagaagcttgagtaaccagttcagttggaggacacgatcaagaggtagcattcatgtcataggtccaggttgagcagaagggcactggcttgagcttgactgtaggctaggctttctggaagcagatgatgagatggaatttagggtgtttattgaggagtgacaaatatgaaagcaaggtgaaggactgaatagacttgaactctggagggagtatttcttttcagagtcatcctgagttgtaccctatggctttactcagtcatcaaatatagacaaccctcagtgggcatgacctcaggtgaacttgctctctgtaactgaggcagatcctcaaaaaaacctggcagcttcagggtctctgctaactgcattccccacagctgggcaagttaatcctgcctggaaggaggttcaggcagtatatctctgtgttgacacagttggcatacatagacatacatagtcagtgactgagctaatattgaattcaagtaaatagtcaaaaaaatggaatttggagagtgagactgggaacacacatgcagttcttcttaacaacacgattggatgtaacaggatggatgcgggaaggcactggcttctcccttcaatttgaaaaaaaaaaatgcagggaatgtggcatagactttggtcttttaagtcttgccttttaaaaaaatatcccattctagatagggtttgctgttgctggattactaagcaatacagttgaagtgatgcaagggcttttattattagactgtatctttaggcttttcagaaaaaagttttaacccaaccacttcttaacttaaggagtgacttgctacctattcgttagttgcataaaatattgccagagttttactcactgaacttatttcatcctccattttagcaatgtgatattttacaaatatgagaagctgctatttatcatccacttagaactcttacagtgcattcataagaagatggttagaattggcatgtaacacaggaaaactcttcaaaggagactcttaacatttccttatacccgctgaatgaaacctggaaaaaaagctattgttacatttcttatggagtttcccaacgcctcttatgaatgagccatatttagtttaaacaaattt

SEQ ID NO: 63785 - DNA, 907 bp, Bovine  19866881311043
agtggatataccttatttgtgggttttgaattaattatatcaaccataaacacagatgaaacaactttgcttgtctgccagaaaacaattcttgattatgagatttcaggtcttctaatttgttttcacttaaagtaataaaaggtgcttgctgatcattaactggagaaagctataaagtcagtgaatctggaaactaacatttatgacacacagaaggccaagaggcataggaaaagatgctcaacatcattaattatgagggaaatgcacatcgaaactataatgaggtatcacctcacaccagtcagaatggccattgtagaaattaaaaattctacaaacaataaatggtggagagagtataaagaaaaggaaaccctcctacactattgatgggaatatacattggtacagccactatacattctttaaaaaactaaaactagatctaccacatgatccagcaagcccactcctgagcatatatctggaggaatccaatattctgaaagatacaggcatcccaatgttcactgcagcactatttataatagtcaagacataggagcaacctaatgtccaataacagaggaatggataaagcagatgtggtacatgtaaggaatggaatactgcatgcatgctcagtcatgtccaatactcttgcaaccccaaagatcgcagcccgccaggcctctatccatgaaattttccaggcaagaatactgcaatgggttggcattttctacttcagggaatcttcccaatccaaggattggaccccgtgtctcctgcatctctcactgacccacctgggaagccccacaatggaatattacttcaggtcattaaaaggaatgaaacaataccatttgcagcaacatgggatagattatcatactaa

SEQ ID NO: 63786 - DNA, 1370 bp, Bovine  19866881385100
aaatgagctttgcattaaacaaaatctaaacttaagtaagcaggagcaactatggctaaacacgagaaggctgttgtcaagttcagtgcaaatttcacatcttggtattttctactttgccaatcaagctgtttcttatttcctatgcacctgaactgtttgctgaataggagatggcaaataatggaactgatagtaactttccagtgagtaagaacagtcccttctatctgagaggaagaatgtgaggtctgcaaaagccaagtgatctaaagcacccaagaggaaaaacgcccaaagtgactccagcaccttgggtctcctccccaaacaagccctgtgctgctatcaggtttgataagcaggctttcctcacccatgaggctataacatgataatgtcattcaataaccctcacaccctttcctgctatttgtccagcacaggaaactgaggattttcttgtcgtgtggacacagcggaaatatctagccagcaaatactgacccttgcatgcaaacagacccatatcctctttccgcctgacaacttccttcctgcatactaagaacaatctacccttcatttttttttttttttttttccggactttatactgactattctgaaagcccttgggaagaagacccatgtaaacttccactctacagctggattctcaaataggctgccatagttgaaggcactaaagatgccctccaaatatggtgatactgtattaggaatggtttctatgtactgtttgtgttttcacaattacttgaagaatttgacctgtatggacaactctactagatatttcagactctaatataaaatatttaaaattatattaaaggccagaaatttctcttctctatttatactaaagaactgaacctgatatcattttatgttcttcaaatccaggaatttaagacatagcccatttaaacctagagaggcagagaatattatagctgcacatccagcttagcagctaaattcgtgttgctcactcaagcaccttaggattattagagagaattcaaaatcactgttcttccagctgggctttcctcgtggcttagagggtaaagaaataccctgcaatgcaggtttgatccctgagtcaggaagattccctggaggagggaatgactacacactccggtattcttgcctggagaatctcatggacagaggaatctaggggctacagtctacagggtcacaaagaggcagacatgactgagcaactaacgataagcgcgagtctttgggctaggcagtaagactgctgaggtgagttattctgctgtttcatcacacctcacacctcaagcacgcacactgtggtttttcaaatt

SEQ ID NO: 63787 - DNA, 1574 bp, Bovine  19866881629443
catcaatgtgtgtgttagtggtctgataacaagacagaatgtaaagaaatataagaaaagacaacttggaacatattcccacctggggccatttaatactggagcaagcagctacttgaaattcaaaccccacagtactatgtggatcattaatatattatagaaaactataattagatccataatgattaccttgtataaacaggataggatgtcacaaaaattatgttcagtatattctttaatagaaggcaaaaatttctaatatatttaaagaaatatttccatacaaaatgcttcatagttttgcttagctttaatatttaaaggaccaacattaacataaccagaatactcatttgtaaaaattcatgcatgcattccctgaaggctgtacactgttgtggtactattaagtataattgtttttgaagaataatactggtatgtctgaactagttggtgccctgaacagctccctctccacccacaaaaaaggccaagggctttctagaaccacaattccaatacaagttccaaaaaaatgtttctgagccccatttcctaccacccttccaaatccactagctctggcttggtgtccctagtcactaccctgttgctttgttcctgctttgtgaatcaattgcttaatttgttcccaagtctggctttagcttgggatataattcagatctcccatagctccataccccagagaagcactaagagaaatacaatgtgaagtacaaatgaaattcccaatttccagtaactacatttaaagagtaaaatgaaatagagacaatttactttgaaatacattgtacttagcccaatatattgaagacaattgtcattaaaatgttgggtttttttacatttttttcaatactcagttggaaatattgtgtgtactttacacttatatctcattccaagttcagtggctacatgtgactactgtctaccatattgaaccatactgctatacagcacataggtcaaaatcactctcaattcccagaaccctgcccttggctggagtttcagattccctaatggtctctgagggcagatcctattgtatgccacattattggctagaggtttctttgtatgcattggtaggtacttaataataataatattttaaacaatcttgccttttgtaagtttcatactaaaatacttctaaatccttttttccttccagttggcattcatatcagctatgtaaacagttgataaagcaggcaccaatatccccatttgatagataaggaaactgagacttggagaaacttagagatttatttaaggttgcctaacaaagataacaattcaagggaaactttgtgatttctagtttatagctgtttgcataattcccattacttcttaaaacaattagagaatgaatctatttactgattcttggatgcaaattcccaaatggtcagcagtagccaaattctctctcttaagcaacgaatgatatcaaatatatattgaaacatgcaaagtcaacccagagaaatcaaggataatagaagaaagtctgtgtgaaatat

SEQ ID NO: 63788 - DNA, 729 bp, Bovine  19866881691508
atgaatggtactggagacggccctgatattaacttccaatgaggttctgtgacaatgaaaggtacataagtatccctccctagcatcttctctataattaatgcccttggccttgcttaggagctgatgccattcaaaaattagaaaaattatttttgggaaaaattcttatgatgctatcaatggcacattatagtttattttttcacacaactcatctttcacatgatgcgaacagaagttagggttttcagattcttaagacaatgtttcaaagaaccatagataacatcacattaaatttttttagtcactattgttttcctcaaaataatttttgaaagccaactcagtagaaacaaagccccaaacctaaataacatcaagggacaaactacacatctcacatcatggaaggaagaaatgtaatataatcatattttcatttaatataaacatagtcaataaatgtaacaattccctaaatcatactgatacgctgtttatataaaataatgggaattcttttctcttttttctcttcttttttaataatgaaattctaattagctttctgtttagatcttgatttgtagcatctgtatttttgtattattctttaaaacatacatatatgaatgctgcacattatggaaagttactaatactcgcagaaaatggaatacaggggagtggaaacaacatgaatggcgaacctaataagaggat

SEQ ID NO: 63789 - DNA, 929 bp, Bovine  19866881841751
taaatatagttaatgacattgatatttattgattgaattattaaatggtttttcaaaaagatcaggacaataattcaaaatgtttcagaaaggattcctaaagcatctaaacacaatcacatagataatttattttcggagttactgccaaagagttctatctgctgaaaatcctttctctctccaaatacttgtcttgtataaatcttctctacagaagatcagttaaacttgtcacttctgagttaaagttgtcactattatagatacagaaaggagattttgagtgaagaaatctggagtgatggagccaatggagagatgggacttccaattacttgttttatgttttaccagggttagctagcaatcacatgataatcagcaggaattctgtgcttccttctcaaatctacttatgagtacttattaactcacaggcaattaaagggcctaagggcacaactctctgtcttgtcagtaaaatgcagaggtattgcctaacactaaataatatggaaactactattttgaatctattcttgaattagaagacaatagtacaatttcaaatcaatcaattcttcagggctaaagataaaaatactatttagagttgacggagaaggaggagaaagtcttttattattcctgtttatgaacttttgaaagttagaaaaatctcatggaaacctagtctttgggatgcttttgaatttaagtcaaaatattattctagtggagctatttatctatatttgaacaaaaactgtccattttttttcttatggattttacttgagatgtgcatcatagatatatttttaaattaatcaatttgacatagtagtttaaaatacaacatgtcccttaagacctaacatctttgaaagtgggaagcttgaggttgaaatagcttaaggcagagt

SEQ ID NO: 63790 - DNA, 1486 bp, Bovine  19866881970761
cttagatgtatttttttgtttgattggctcatttagtatcatgaagaattaaagaaagggcttatatatatttagatggagcagaactcatttgttcattaatttccagagttcaccttattttattgtcacatttattcacttcatatatttgtctttaacctgcctcgttcttgaacacgtttgagctttcatctgatttgaaagatttcttcaattgtgagattttaggcttctctttctcaatataaattctcctctctgtttgcacagttcagcgtctttatttatccattatggttttcttcacctgccttggagcacctagtgtagtatgagaccactggtgttgtaactgaagctccaaattgggcagacttatccactttgttttgggcagtacagcttaagcacggaggtgcagagacaaagctgaggactcttctgtaaggactattcataaaaggaagaagaacagagtagatctaggcatgcccagtgaccctttccaaattaaattgtaagataaagcactctgcctccccaggcgtagggtgaaaactagaattgcacttcttgggttcccttcataggaaggaaacacaaggaatgggaaaaatatattttccattaacattggtgtcttttgttaattattttatatgtataggtttggcttcccctaaagatgagatgtttgagagcaagcactaacatattatttctttgtttaactcaaagtacccaggactgagtcaagacttcatacatactaaatactattactttagataaataataatcagtgagaaatctagaaactcaagttatagtcctagctctgccactatgagatcttaatgtctccaggccgtgttttcttatctgtgaaatgggaggatttaaaaaagaatattatccaggaggaaatcataggacaaaacccccaaatacggttgaaatagatggcatgaatcagttggttacaagaatctattcagaagttaaaatagaataaaattattctagtagttattcactgatcttgcagaactgacttgccagtcagtgaaagagcttgaatatctacacaagcatctgataatgatatcagggtcttttctgtacaattacttcccatttgcaagtgcctggagctccacttatttttgtacagagtcgtacactccttgcttatctttttccatcttattttatctttaaaatactgatgttcttgatcttagcaaagtgtcctagaggagaaggatctggtaacctaatctacacataggtgagaggttcctattgtgtatctgttcataccagaattgtaggaaagtgttacactctaggtagggagatattctggggcatggagtttttttccagcatctctcataccatattacataggcatctgttaagtctatgcacacttgtaaagccagctcagcctgtgtttgggagagatgattgtgcatgt

SEQ ID NO: 63791 - DNA, 3963 bp, Bovine  19866880342182
ctagcatcagggtcttttccatgagtcactcttcacatgaggtggccaaagtactggagtttctgctttagcatcattccttccaaagaaatcccagggctgatcttcagaatgggctggttggatctccttgcagtccaggggactctcaagagtcttctccaacaccacagttcaaaagcatcaattcttcggtgctcagctttcttcacagtccaactctcacatccatacatgaccacaggaaaaaccatagccttgactagatggatctttgtataattgtattttaaaattattttttattatgaacaagcatataacaagcataacaagcataactgcaaaaaaagtattatattgacattgatgaaaatacttttgtgtgctgatccagtaaaagacacagtacttaacatattatttcgatgggaaaatgatgtctgaagtccaagcaaaatttagggtttattaattggagactgttattatttaattagttttaagtacttataagtcttaagtgatagtcactcagtcatgtctgactctttgtgaccccacggactgtagcctgccaggcttctctgtctatggaattctccaggcaagaatactggagggggttgtcattcccttctctaggagaacttcctgactcatgggttgaacccaggtctcctgcatttcaggcagattctttaccatctgagtcaccagggaagtgctatacataattgttctattggctgacttcgtatcttgttttattgcaatttttccctgatacattcttaaaagcaaaaggtaactaagcaaaattaaatttccctgtggaacagatgacagatttgtcatcatccttggatcttcctttcacatgaaatatattataatggtggaaacgattagcatattaatagtctaatattaggggctacccaggtggctctagtgataaagaactcatctgccaatgcaggagatataggagacaccagttcaatccctgggttgggaagattccctggaggagggcatggtgacccacttcagtattcttgcctggagaatcccatggactgagaagcctggtgggctatgtccacagggtctcaaagagtcagacatgactgaagtgacttagcaagaaaacaagtctaatattagtatcatctgacttcatttcttgtttacaaatatattaaaaaaatgagtttctaaattcctttaaaattcagctgtagggaaagaattaggaccatagctcataattacttattatgcgagattatgaaatcagaggttactagtatgtcttgccttaagggatggataaatacagacatgccatggcagactgcatacaaggctgaaagaaactcttcagttctactgggagaagagtaggaggaaacaacgctgacctttcatttcctgtaggttgcttgtaatttatgagattctttttttaaaacagcttcaaatatctttaaaccttacatatactagttaaacttcaataatgaaagctgagatcataaacatcaaaaactccatttagatgtagggtggatttttctaatgtaacctagagggagagcctctcagaagaaggagtttcatgttttgatttttaactgctaatttaaaaattggctgctagagaaaagggtgtgagtttgttttagttttggtctccatttcctgtgtaagtactttgggatggatgttaagttgagatatgaagccactggaaaaaaacaggtaaagagaaaacactatcatgaaaaattaaacactaattttccacatagttttttggaaaggaaaatcagtttggcaaggtgaaaaaggtctttggcaaaatagacggcttgagacctccctgatatataggctccctgataaaagagtccagtctatggacagatccccgctaaagaccagcaggccatgatccaacaaatgcctctttaccccacaggctgaagtctgcaagaaacagatgaatgtttagggcttttacagagttaactaagcttttcagtcctgctcttttaattaatgatgtactttacaagaccaggtagctgtaacagacagttacgcccacttgttaatcacttatttcagtaagaagacacattggcgtttatgaatggacattggtctgtcactatatgttgatgaaaatgttaggatcttggtgaaaccacgctgcaaatacacagccagaggcagcactgattttccaataccactgctgaggctgggaaaggagacagaggattggttgcaggcgaccctgagggatgttactctctgttcttgcttgggcgaaatgactccttgcaatgtagtcaataaaaggttaaaaagttaagttttcatataaaaatatttatagttcatattcttctacataaacatttaaaggtggaaaaaaaaaaaaaaaccctccagcttggcatgaaaaagattaaattttctcccaaacattggtttggaaattttcccaaaagaaagctgtctgatcaaactgctgcaatcttaagcagtaaaaagaatgtactatatttaaatgtagcgatcggatttttctgatcagagtactgctgctgctgctgctaagtcgattcagtcgtgtccgactctgtgggaccccatagacggcagcccaccaggctcctctgtccctgggattctccaggcaagaatactggagtgggttgccatttccttctccaatgcatgaaagtgaaaagtgaaagtgaagtcgctcagtcgtgtccaactcagcgaccccagggactgcagcctagcaggctcctccatccatgggattttccaggcaagagtactggaatggggtgccattgccttctccgtgatcagagtacaagaaccctcaaaaatcatcttgtctggaatcttcagaaaaatacagaagctttatgatttagtatggatcactgtaggaggcctctgggaatcccacaactttttttcattgtcaccatagcattccaactgccttaaccttcatgactgtaaaaacaagtactttttcaaatttgggccatatctcccatgtggcagcgttctgggttctttgtcctcaatgtggttatgaccactccggaaatttaagaaagacatacacctctagatccaagctctagaaacatttccatattggagctgagaactctaaaaataacatgttagcactaagtccttgatattcaagagcaaaaatatagagcaagctgaaagtgtgtgtgtatgtgtgtattttaggaataggagaactttagaacacaaaattatgtgaagcttcactcactcaaagcacaaggaaatgtgagtaactgggcggtgaaggggacatgttccttgtacagttgggctgccaaatcatttctgttccctcaatatctagtgaagacacccctctctttgaaacttctttattgaatgaaatcatgggctcctggaggtgaagaccacatttcacaacccataaagcatgtgtttctggatcccaagcacctagtataaccatagtacataaagtactaaatataagattgatgaatgaaaggaatcaatgaatgagtaaacatgtatttataaactgctgtgactgtgaaatgtaaggctttgctcaataaaattagcttatgatatttttcagttgaaaatcttggttcaaacagctgcttggtttctgaaagccacccactttttatttttccttgtttgtttttgttttcctgagattaataattttgaaatgaatattaatgtctgtgaaagcattattaaagctctgatgatatttaagtgcatcacaggtttaatcatagtgaaataataaatagatccagatttcaaaattatctatattagattaaaatgtcctaatcccacatctcagatactttaaaaattctgtcc

SEQ ID NO: 63792 - DNA, 961 bp, Bovine  19866880527869
agggatggtgtggagagggaggagggaggagggttcaggatggggaacacatgtatactaattaaataattttctattaaagaaaaaaaataaaaaaaaataaaaaaataaaatatggaataaaaaaaaaaaaaaattctgggttttcaacttcgaacactgcatatagcataatatgcagcatgtaacctcacatacaataatttttatggttttcgtttgatgagaaaaattatagttcatatggacattagcttattttgaaatcttcaaactttcaactgttaataggttatttccgctgttctgtgaggaaaatggtctcagaactgtgattccattaggaatgagaggaggtagggggttcttttcattatagaatgtagcagaataattttaaggagtgtttggctgcattagatttcctgtgggataggaaaccaagaaattaatggctatgggactaaaatagacagtgatcagtgcctgtgaatagagctgcttcagtactaaaccaactcagccttactgtttgtagggtaagatgactgtaccatatgactaccaaaagaattctttgttttgatttcgatgctccataagtaaaactcattcattcaagcatgtagtaataaagcaagactaattgcaatagtgatacattcttcttgccttgcacaccattattttgcttttaagaatacatcttttatcttcccaccttcagtagagtcaattatttgtggttcgtatctcaggtatagttttacatcctagtccctctcttttgatttgcccagttcacttaaaagcatcttgtatgtctgaatcaatcctggcattttgtcttatatgaggtttaggcttgtctagtaccctggagacttcttcagttcagttcagttcagttcagtcgctcagtcatgttcgactcctttgtgaccccatgcatcacagcaca

SEQ ID NO: 63793 - DNA, 1616 bp, Bovine  19866880705806
aaactactccttttattaaacttgatttttaattacgacaaacaatactctgataagatgcattgcgtatatttttgtgtacatatcttgcaggagatgtgggtttgattcctggttcagggagctcccctggagaagggaatggatactccagtactcttgcctggggaaccccatggacagagaagcttggagaactatggtctgtgtggccacagagagtcggatgtgactgggtggctaagcacacacgcacgaggtgtttccaaggacacagacctagaattggaatttcagggggaaagggctttatattgttgttttatatatcttgaaataaatataaacttttatgtgtcgagatggacaaagtatataaaaagttaattcacaaaacagcaataaatgaccaacaaacacattaaagatactcaaacttttactagcaggaaaagaaaaattaaacaatgggatattactttatagctattgaactgtcaaacattaaaaaacaataaaacctattactgagggcaatacgggagtaaattgccttagcttttcttggaaagcaatctagcaacatctattaaaactaaaattatatatagagttagaccaacaaactcattcttagaatccaacccataaaaagaaaagaccaaaaggttagaatatataaacaaagatgctttgggcaatattcatttttttctacaaatacttgccaagtgctatgttgccatcacttcagaaatgaataagacacaggccctgccctcaaggtattcatagccaagacagctaagtacccaagcagttggagttcacaagagaggtgctgaggaagcaattcaggcctgagatggagggctgcaaaaacttcactgaaaagtgcactcacataacttggtaaaatatagcctgttcctaaggccttggatttaagttgcatgatccaggagagctgaaaaggataaagataactggacatggggaaacataaccctaaattggacatgaaacaaaagtcacaggtaatctaatttttctaatggcaggggagacagaatatgaggtacacagtggaaaaaggacttccttgttgtgatagaatcaaaagagtctatgattaaatggtagccaaaaacattgtattgttctatgcctggtacagagtacactcttgaaaggtatttgttgacccaacgaagatgggaagagaatgtaaaaatgtttagctcagtggtgatcattttggaatgtacagaatatcgaatctatgttgtatattagaaagtaagatgatgttgtgagtcagttatacttcaaaaccaaacaaacaaactcaaagaaaaagagaccagattggtgattaccagagttgggggggaaggaggaaggggatgggaaattggatgaaggtggtcaaagggtacaacctccagctataagataagtaagtactagagatgcaatgtgccacatggtaaatataattaacactgctgaaagatatatacaaaagtcctgaagagagtaaatcctgagttctcatcataaggattttttttcttttattgaatctgtatgagataactgatgttcagtaaatt

SEQ ID NO: 63794 - DNA, 1611 bp, Bovine  19866880777409
aatgcctgtactttccttccctatacattttcatggtccaattaaagttttatagcactcaggcctgtgtgggaggtgacagtgtgcaagcttcagctctcttcaaagaatggaagatatttaaggaatcaccaattgatgtgttcttttcacatgcacagacccagcagcacacatgcacacacatacacacacacacacacacacacacacacacacaactagcacagcatcacttcagttcagttcagttcagtcgttcagtcatgtctgactctttgcaaccccatgaatcgcagcacaccaggcctccctgtccatcaccaactcccggagttcacccagactcaagtccatcgagtcagtgatgccatccagccatctcatcctctgttgtccccttttcctcctgccctcaatccctcccagcatcagagtcttttccaatgagtcaactcttcgcatgaggtggccaaagtactggagtttcagctttagcatcattccttccaaagaacacccaggactgatctcctttagaatggactagttggatctccaagttcaaaagcatcaattcttcagcactcagcttaggaagcattcattacattaattaatgagacaaatgtaacattcaaattctgaatgcgattttatcttagctagaaatagaacaagaaaagtgaagccatcatttggttagtgctgtggcacggcaggagaaatatatcaattatatatgcttgatccacacagaaacagcacggctggcaaaagtctgacttaaatttaggtcatcagttaataaacctttgctcagttgtcccctgcccagctcgtgggatgtatccaggatttcccatggcactgcatgtgagtttggaaagaagaaaaaccagaatcttcccaaatctacataaatcttcaggggtctactgtcatgggtttatgtcaggctgacctctgttttgccctgcttagagaatccagcttgaataggtcagtcgtgatttacaaaggcagaaagagaaacacatgtgttcatctcttggactgaaggatcttaccaggtcggccatgctagtcccactcatttttccaaccaccagattctcttttctcattcctctttcttcacacacagtctaacagcctattcaataatatgttttttcaactacactctaagaactatcaggacttacaatgacagtgagtactctgactatgagaaagtcaatgtttaatctcatctttttctcttacctctatgctcattctttgccttataacacagaaatatgtcctttttatttatttgctgtgtaagatctctggctgggtatagaggtaaatgtaatctgcagatgataacatagtatattttggtttttgacgtgtgtgttacaaattgccaatgattcccaagattcattttgtgatatcccagttgtaatatcccaaaaggtatcataaaattctcaaaactaaattaatttggatttaccattaaatttctgaagtaaatatggaacaatagcatttcttgacacaaaacataacaaagtcgttctatctccaaacagattcagaactatttattgttct

SEQ ID NO: 63795 - DNA, 1164 bp, Bovine  19866881028120
aaaattgttgttgtttgtcgtgctcagaccctcagtcgtgtctgactctttgtgaccccattgactgtagctgccaggctcctctgtccacggggtttcccaggcaagaatactggagttgggtgccatttcctcctccagggatcttcccttgacccagggatcgaactcttatgtctctaacatcttacatctcttatgtctcctgcattggcaagcagattctttaccactagggacacctgagaagccccattaaaataagactttacatattaaatccactagtagcaaaaaaaaaatttagaatgtcctcacatacacatacatttgagagaaaaatgtattttcaaatcatgagcataattcaaatgaattcgataaatctgctaagtaccaggcactgagagttcagtgttccaggtatataaagctgaataaggcaagtcctgccctccagaaatatattatttggtagtggagataaaagtaataacaatggcaataatgcaaggcagaatatagtaagcgtagaggtataagcaaagtgatataggaccacaaaaatggagaaattaatgttgattggaggatggggatggtttattctgagttttgaaggactgagaatgacaaagatcagtgagtcaggaaggacatttcagactagagaccagtgtgagcacatgaatggaggttagagataggactagtcaaggtggctgccaagttggatatgacagaggatggagtagaaaatcaaattacgaaaagttgaaaagttaggttcaaagtttctcagtgggtgtgctactggttttagggggtgaatgggtctttgctttcttagggagtgtgtgtcttctaaaagtcatcagtgctccatggcattttgaccaataaaaagaattctcaaacattttcaaacccatcctggggacaggcagtatcaaccctgcagaaaatgactgaaggtggcttggattccaaatctgggggcagtccttagccctgtatgtaggtgctgagtatctactaaaccagttctgactagagcaagggcctgagcaggcctgggattcaggacaatgatctctggagattaatcaaagaagagaaagaatgggataatcaagtcagtctatgcaatagtctagagaagag

SEQ ID NO: 63796 - DNA, 1784 bp, Bovine  19866880129395
tgaaagtgaaagtggggagtgaaaaagttggcttaaagctcaacattcagaaaacgaagatcatggcatctggtcctgtcacttcatgggaaatagatggggaaacagtggaaacagtgtcagacttaatttttctgggctccaaaatcactgcagatggtaattgcagccatgaaattaaaaaacgcttactccttggaaggaaagttatgaccaacctagatagcatattgaaaagcagagacattactttgccaacaaaggtccatctagtcacggctatggtttttccagtggtcatgtatggatatgagagttggactgtgaagaaagctgagtgccgaagaattgatgcttttgaactgtggtgttggagaagactcttgagagtcccttggactgcaaggagatccaaccagtccattctaaaagagatcagtccttgggtgttctttggaaggaatgatgctaaagctgaaactccagtactttggccacctcatgcgaagagttgtctcattggaaaagactctgatgctgggagggattgggggcaggaggagaaggggacgacagaggatgagatggttggatggcatcgtggacttgatggacgtgagtttaagtgaactccgggagttggtgatggacagggaggcctgtgtgctgcgattcatggggtcgcaaagagtcggacacgactgaatgactgaactgaactgaactgaaactccatcatttctacacttgagatttaaaatgcttttcattgaatttttcagttttatcttatagtaaactttatatgacttactggccatttattgatattttaagcctttcagaaatttaagctgaacaatcatgaattttaaaaatattttaataatttcttctttaatatttttgagcatgtaaccaaaaagtccctttttgtaatgctttaggccttaaaagggcctccctggtggctcaagacggaagacttgggttcgatccctgggttgggaagatcccctggaggagcctggcaacccactccagtattctttgccctggagaatccccatggacagaggagcctggtgggttacagtccaaagggtcgcaaagagtcaaacatgactgagtgatgtttagcacacagagcacatggcacagatacatctaagatagggcagtacataatagggaacgtaactgtacatactcaggtgtcaaaatatacagaagttttcttatgctgtcagttgtcgggaggaaattttctgagaaattcaggccagcagtgtttccctttacaaaaattaaaaaacacacacaaaaaaaacacagatctccctgtttgctgctaaggaaagtgaaagtgtcaaaactaatttcttcctgctactgctaaaatcttaattcaaaaaacggaaatctcggctgctagtttaattgtatatactatttgtatcccaatatcacacacattgacattctaaaactaaatggtaataaccacaaaggttaattattttcttttcatgtgaggagaaaaacacttttaaaattaatcatgttttccacaaatcttcccttggaacacagacctcatgaggcagctgggtcagctttggctcacaccatcgttacattcattatatattaaaaccatttatcaagagcatagcattaacttgacttctgcaagaattttaagttcatgtgtttacataattaatgaatgtagtatcatagttcggaaagaaggcaatggcactccactccattactctggc

SEQ ID NO: 63797 - DNA, 1494 bp, Bovine  19866880340144
cttataatattgtttgttgttgttgttgtgctaagttgtgtctgactcttttgcaaccctgtggactaaagcctgccaggcttctctgtccatgggatttcccagacaagaatactggagtgggttgccatttccttctccagagggtctccctaacccaggaatcaaacctgagtctcctggattggcatatggattctttaccactgagctaccagggaagcccatatacacattgtgaaacatgtaggttagctccagccgtcttcaaaaagctttaggcctctatgttctcttccaaaatctaaggcagtgattttaggagacagtccctatagtctacataccaggtgtagttttcaaacttgttgtgtgagatacattttctagaaaggtgagatatttactcctttgacgaggaagtgatgtttgaaaaattcagtatactttccatgtattttacagtctatagattttttaacattgtaggcctttaatactgataacactgatgacaactagtgaattaaattgaggagcaaattacagatttatctgtttaactcattaagagttacttaatagaaaataatttttatggtttccagaccaattcagtgttccaaaatttgaatttgtcaataaaaactttggtaacttattttggtgtgaaaatgtcagtttgaaaggcttcccttaagctgctaatttttcttttttctttcagcaagttccaaatgcacataaggattgggtctgtgccctggaagtggtaccaggccacccagttttgctcagtggctgcagagggggcattttgaaactctggaacatagatacctttgtgccagttggagagatgaagggtcatgagagtcctatcaatgccatatgtgttaattccacccacatttttactgcagctgagtaagtttttcctattggttacttgtgttcagatttaataaatactataggttgtaaatatttggaaatgtagaacatatgaaatctttcttttattacagctattccagtgtctatttatgatgttttatttatattttatgagatgcactgtggtcactgagtttgggctccccaggttatatgataatagtgttactgctgtatcagctctctgcttagactaggaagtctgctaccagatcttcctgtagcagttttaatttttttttaaaatcattcagaagtgattaatttctaaattgtctttccagaaaaggcatcaaactggcctcattcttcacatttagaccaaatcattaaaaaaaaaaaaaactcctttatgcctcttccgcctcctttaaaatctaagttacatagtaataatatataccccctccctcttagaatggctgaattgattaatttatttgctcatttgctcattcattatgaatctcctgtgtgccaggcactaatttcaaaatcttcggaatagagaattgaacaaaacacatataaatccta

SEQ ID NO: 63798 - DNA, 1836 bp, Bovine  19866880348213
catggagaaggacataggatgagcaggtttctcaggaaggctgggggttcagttttggacatacaaaatttaagacgagcaaacctccactactactcatgacagagtaacctgtgccaggttaacacttctgtgagttaacacaacgtgaaaacttgacaaaatacatggaacaactattttcagaacctgggggatgggtactttaggcctgtaattcctgagaaaagggaaacaagagaaggtgagctctgtgacagccctggcttgcagtctggaagctcttgccgcactacagcaaggaagaggggaaataaacagaagaccacagaatcagagttgaaaagacagtaataaaaatctgggaagtgtgaaatagctgtaatttgtaaaaccaaatagagaagaggggagagctacgctaaaaggaatatggagttatagggaaaaacattccatcagtctacatacataggggtcccctaacgtctttgactgaaggctaagctgcacatgagtagagtcagatatacggccagaccaaaacacagctgtgagagtcaagttctgaccagtagagtagagaatagcatcaaacattcaagacattcagtaaaaacacaagagttgaagtctcaaaaagatgagctgaaccacaagtaacttacataactttaagtaaaacccactgtctttaaaggaataaaacagaatccagatactcaaaacacaacacaacagtgttcagcattcaataaaatattatatgacataaaatcagaaaaaataagacctatatcataagaaaaatcaatcaatgcaacagatccagaaatcatatatgacagaattacttacacatggactgtgaattataaagtacctcagttttcccacctataaaataggaattacaataatactcactttctagagttcttatgaagactaaatgagttaatgcctaaaaacacttagaacaatgtctggtagatactaagccctatataaaggtttgttaggtaatgaataagtagaactaatttgaaaataggtcttctgattttcttggttattttcctgattttatgttacatggtaaatacatctgtatctgatgcactgtgggtaaactgaggacattttcagtttcttaaaaataaaactatatcattacatcatacctcagtgatcagacctcagtgagtcataataattttatagtgtcccacggctatgaggggtattatttcccataaattgtcaaggacaaacaagtttgtaagggaataaacaaaagtgatgaaactaagaaagtaatgtatctcggaaatagcatcaatgaagcatttaaggtaagcatcttagaaaaacacaaatgtatttagagatgtatttgatgtattttagagatgacagaaagtaaatttaaatgagatgagggattcagtggaaacagcacaaataaaaagagacaccacagaaatttagcagaagtttcaaaataaaatcagggtaattgtgtatttaggacagatgaatcaagaaatggctcaataaattaagtaacacaattggtacacaaatgacataaggagattttcatgagaaattacattttatttgaatgagatgaacgcctcacattatagtacgtatgatttcctttccaaaagtacttacacataatgtattatgatataatacatattatgtcatttttatggtcacatctctacaccttcttcaagcatcttcctaaatgccactttcttagtatgattttcattgtccactctgttgtgcaacccctgttccctagtgatgctctcatct

SEQ ID NO: 63799 - DNA, 2243 bp, Bovine  19866880431210
ttcagtaccttggccctgagttcacttcctggtgggaacaaagatctgcaagtcacatggagtgttcaaaaagaaaaaacgttacaaataagaaaatacggaagagcctgagtaattgcggttattgcttagtttgttccaaagtgttctactgtaatagttttgatagaagctgcagacatcagcaaatggcaaacaatggaatctcagtgttttctcctatttacaaaaacaaacaccattatactttctggtcaaaaagtgcctgtaaataaaataataaaacagtctacctcttgtacatcttttaatatgatgaattttaaccagtagctcagacttatgattatgtagatttagtttaagtattgttcaagtaaaacctctctttctttcccttttctagatgatgcagtgtttgaagctgggtgctttatctcggacaactgctagtacccaaatgaatgttcagagctctcgttcacatgccatttttaccattcactttgtgtcaaaccagaatgtgtccccagatagatgctgtgagttagtactaatgtcttaaactttcagatttcatttctataaaatcacatgagtatcaaagagaatatttgcgtcaagtttagtttgtttaattattccttttcctaatgagatgtccctggatttatttaagctaaagctggccagccatataaaattttgaaattaaaaatggactgtatttctgcagtagccagaaagtatggtgatggattagttacttgagacccttcgtttttgagggctgtatggtacaaatttctcttcaatataagcaaagcctcagttgatagctctctttgatctaactttgtctaagcttctagttgcaacaggcgtttttgtgcttatatttatttgactacaggcctatacttggctatatgaataatgaaggcaagatggggttgaaggatatttagtgtcacattaataaggtattttcaattattttcctcaattacaggaaattgcaactgataataaagtgatttctgaatcatcacagatgaatgaatttgaaactctgactgcaaagttccattttgttgatctggcaggttcagaaagactgaagcgtactggagctacaggcgagagagcaaaagaaggcatttccatcaactgtggacttgtaagactaagactttgtgctgggaatatatcagagttattttattatccttttccattttataacatataatacccaagtggaaatccttcatacactgagctgagaaatgaaagttactgtaaacttatagtaatgcattgaattttgatgtcaggctgtcaacttttttctccttttcacattgtaagttttcttcaagtgtaaaaaattaattggattaagttttatgatatgtgtataagatatgtatatatataatagaaatgattttaaaattcttctcaaatttaaaaatatactcaatattaaatattatatgggatgacctttaaagtagttttatgctaacatttttatgacaggctttattttggaaattataataacatgttatttaataacaattaacaattatttcaaaatgataacttttctcattttaggaattaactttaataccctgtttttgattgattggaaaacattttgtgttggagttagcctaaagtggtgtttttgattgaatggaaaacatcttgtgttggagttagcctaaagtttctactatctgaaagaaaatgttttgaaccaaatttttatgtaatctttttttcttattgatttcattataaaagtggttctttgttcctgcttagaagtaatggcattgtaaatttctgtgatgctgacagcatcagaatagatgttttctgctttgcctctctccctttcttcctagagcaggggatccaagcatatggtccttttttttggtcattgcccaatatttgctgttacatgattataactcttctgtgggggaattatcaactgagactgattagagagagccagtcttcccaaccatgcatcttgatgcttctaccatatggttgaatattgtggtcagaggagtgagtgagcaggatcctggactttgtgtattgttttgcattcttgagatataaaatcatggtatggtatttacatttgtgctgtttggaaaagacaaaagccattgctcagttttcttgttcaggctattgaaacatgttcagat

SEQ ID NO: 63800 - DNA, 3114 bp, Bovine  19866880491768
aacttttttcctatagttacctgcgttttgtgttaacacaggagagatgcttttcattgtgcaaaactggctcactttatgtgatctgaacttgagaagctatttctcaggtttcaagacaagttaaatgtatgggagcacctactagtgaaagctgatacagtcctacagaccggttttattggaccttgtaatttagtatgaggaagcccttacgtgtatagtcaagggaatcctgctgccaaaaaaaatgcttattgcttaaattttgcaagagagtggacttaggcaagaaatacaagaactaagaaactctataaaacattctatttagatggaaacacatctaagaaggataagttgtttagtgttgatgtactaaaaggtttcatgagggctgagatgaggtttgcctcctttacttctgaatccttagcatggtaactgacttgaatgtgtcattgtttactgaattaacaaatgttcaccagtttggaatttcttcctcaaaatatttgaaaactagccttttgtcctccttcttccataggaccatatatctatcatttacaataaaaacaaggaaatatataatttgtgtgacaaatttcctttttagaggaaaacaaatgcttctttgcttaaccagaaaccctgagccagctaaaaaatatactataactttggaattaaaaactgtaataatgaaaagtgacctgaactaattaaaaggaaggtaatgctgagttgcaaaggcttggtaatcaaatttgctaggctcaaatttcagctctacagtttaacagctgcatctggttggatgaattgcttaacttctgttctcactttcttcttttattaaattaagagttttgtagagatttaatgagtcaatgtatacacagtgttttgtgcctacatgtagtgcctttgttcccagtcgtgtctgactctccgcgaccccatagactgtagcccgccaggctcttctgtccatgggattatcccaggcaagaaaactggagtgggttgctatttccttctccatgggatcttcctgacccaagagtcgaagcttcatctcctgcatcttgtgcattggcagacagattcttcaccactgagccatctgggaagcccttgtgtctacctgataaataataaataatatctattgaatttttctccaaatgatggtactcattttcctaattttcagtggactgcaagcttcttgggacagggaccatattttatttattcctagagcctagcacagcatctggcataggttggtacttaataaataaatatgtgttgaattaataaggaaaataaatatttaaacaactatttggtgactattgtgcatggtacatcatataacttgtaactgaagtatatgaaaacactcaacagagtcatttacaatatagaaatagggaatgttttctattactggaatgatctgtaattcctttgattagtcaagattttctatgataatttaggaactcacaagtaatgttgagctcaaataactgtatatcagatgggagactatactacagtgtattcacatcatagccatattgtagctttaagtaaccacatggtgatttttaccattaaggaatttttctcatttgctttcattagtacaacccctactatacaatgcttgcttataagtgtagataattggttttgaaaatttcacaacaaaaactgtaaagccttttgtacttggtaattaggaaaggcatcagcaattctgaagaaggaatttgcttttaacgaaaatattctctacatccatctgaaagctctcatgtggcaaatgctgcaagtataactcttaattatatctaaatcctacctctcaatcatacctacatcatcagactggtaaatactctgagctatgtgaaagtattttacatttctaaatgaatataatttgtcataaagtagttatatcaaagacatctcttttaataaaagtgattaccactttatgcatatctcagaaatatgtaacattctctggatatgggttccaatatgtaacaaacttttctaggcttattgagtcaaaaaaactattccaaacagattaaaagctattaaaataggctaagactattgccaaacatgaaattatacttggaatcaaagtctcaaaacaaaattaacatggtcatttatacctttactggaagaacaaaatttgacacaaaaactaaactattatcaggggaaaaccattcatatcagaaacaaatgtaaactccagttgaatttcaagatatattattctccttgagattaatggagagagattttcacacatgatcttgtttacaagaaacacacactattttagactcatgcttggcataacattacatgctgtagaaatataatgcaacattttcatagaatgcaacttactttccaagtttataagttaaccaaaaacaacacattcaaaaatcagtatctataaattcataggttttttttttttttttaccaaaacaaaataaaacagatgtcaaaataatttgggcaaatagattcatttgaaaattgaaatatccttctttttccattcctcacctataattcaaagatggctatatacaaggatgctatattcaaagatggctattttatttatcaatcttactcacatttttctcaaaatttaactataagaatagtaaaacatggtatactcattggatcattttgtaaaaacttaaatgaaacataaatacaaattcaaattacagttttttcccctccaagttaggggatattggtcctggaagaaaattcagaaaataaatggacacaaaatgtgcatgcaaaatatgtttcttttagaactcttaacatttaaactgcaatgtgtacagcttttaatacagaattttaaaaatccttgaatcctcattataaattatgagttctttacttcagccagttggtaggatatattaaataagggctaattaaaaatctaatatttgctttggcattcttttcaaagtttcaaacacaatgtattttttcctaaatgcttatttcaaattaagaaaactaagg

SEQ ID NO: 63801 - DNA, 1199 bp, Bovine  19866880601018
acttttcccctacagtggtataaactggataactactaatacataatttagataaatgaataatatttctcaagttttagttctatgcattttttataaaacctttgatgcctgcctcacctaatagtaagtagtagtaactgacaaatgaataaatgagcagttaattatactaacagaaaaacttagatgtactggttttgatttttatattatattctttcaagtaaggtggttacatttattgataattaaaaatgtcagcatcaaagaattgaaaatgtgaaatgttatggtgttctattataggcaccatgaatgacatccaggtcttctaccaattgaaaaactctgagagtcactgacttagcatctattatggctgtgtctaagtacacaaataaaatcctaaaccactaataattgagtatttctactttttctggcctatcaatggccacacaggcagtaggagattaaaatggtagtcctggctttcctactaactccagagcaatcgaatatgtaagatttatctcataagactattccatatagattatttctcattatgttcaataaatattaaagtgacataacagttccccttttgattgctgggtgtaggggtacattaatattgagtaagagtgcatattgttgaaagatttttctaacattcctgccccattttaagctacaaaccaatgacgtttccattttatacttaatttccatatcttatagacaataatcaaataattacaatacaagcattacaaattctctttacaacatctcatcttttattgctactacagcccagttgaatttcaaggataatagtgaaaatagcactgaaccagggaaacaggaaaactttagttgagcctgggattttcccttaaataaatttgcctgattaaggcaaatatgagtgtcaattttctcaaaagcaaactaggaaaaatatctgcctcaaaagtttgccataaggattaaaatgaagtgatgtaaatgagaactgtaaattatattactataaattgcaaattataaagtactatttcaatgtatattataactctgattttgaaaatctctctattcttatagcactgctatttttaaaatgtggtggactcctttgaacataaaaacaagctaagtatttcggacagaatttgcaataaataatc

SEQ ID NO: 63802 - DNA, 2807 bp, Bovine  19866880613368
agaagcctggaaggctgcagtccatggggtcactgagggtcggacacgactgagctacttcactttcacttttcactttcatgcattggagaaggaaatggcaacccactccagtgttcttgcctggagaatcccagggatgggggagcctggtgggctgccgtttatggggttgcacagagtcggacacaactgaagtgacttagcagtagcacagagctctttatttaaaattctgtcatcacatttatcacatgctaacttttattatttatgtgtgtacctttcttctttattcattcaatcatttattcatttgtcacataatctaaaataactccccaaccagttcctctgtatcacatcagtcagttttattcatataatttatttctccatttatttgttaattgtttcactctatctactacatttgccctctttagacctaaactctgtggaccaggaatctttgcttgtattatttattgcaatattcatagtaccacaactcaatgaacatgagttagagcagactccaggagacagtgaaagacagggaaacctggtgcactgcagtccttggggtcacaaatacttggacacaactgagtgactgaacaacacagcacctataacaatactcagcaggtgggagacatttaaaaagtatttgttcagtaggttcataaatggatgagtaaacaaatgaataaaaaatgatgcaaaagaaccatatatgaatgaaagaatgaaaatgaattaatgagaatgagtgaaatcactgagaaagatacgaaaagaagggcactgtctccttcatacccttgtaaattaaacccacactattaggtaaaaatataatgcttattctttttttctctgttgaaaataattgagcatcttgagacatcacaatatttacttcacacactttctttccttttctctagaataagttaagaagtaataaactggtctcaatcttcccaacaggatgctgaatataaacgttctacaaacatttcttctaattcactgattcagtaaaaattagatatcacattaactgtctaattggatcacctatctccatgttttctttctttctgagctaccagaaatgtatatccttcctctttctacttctctgggtaggtcgcaatatccctcaaacaggtaaaggagacccagaaatttatagatcctatagcctcactattatcaatcccaatgaccatgaggtctttcctcaaattagagacatgaacagacttttgctttcttcaatgtttacataaaattcagtggaaactgaacattttaatgaccactagactcctaatggtaagaacaaaagggtgaatttatagcagaaagcagttcaattcttatccataacaagtctattagaatgtagcacttcttcttgcctcaccacaatcctaaggcacagactgtcttgggcaatgatgagcaaacagagcaagactctgtggggcccagttcaattcagtcagttggtgtccaactctttgcgaccccatggactgcatcacaccaggcctccctctccatcacaaactcccaaagcttgttcaaactcatgtccaatgagttggtgatatcattcaatcatctcatcctctgccgtccccttttcctcctgctttcaatatttccagcatcagggtcttttccaatgagtcagttctttgcacgaggtgcccaaagtattggagtttcagcttcagcatcagtccttccaatgaatattcaggactgatttcctttagaatggactggttggatctccccacagtccaagggacttgcaagagtcttctccaacaccacagttcaaaagcatcaattcttcagtgttcacctttctttatacccaacttatacatccatacatgaccactggaaaaactatagctttgactagacagacctttgttggcaaattcatgtctctgctttttaatatgctgtctaggttggtcataacttttcttccaagtagcaagtgacttgaattacatggctgcagtcaccatctgcagtgattttggagcccaagaaaataaaatctgtcactgtttccattgtttctccatctatttatctttctttctttttttttaatttaattttatttttaactttacaatattgtactagttttaccatatatcaacatgcatctgccataggtatacaagtgttccccatcctgaaccatcctccctcctctctccccataccatccctctgggtcatcccagtgcaccagccccaagcttccagtatcgtgcactgaacctggagtggtgactcgtttcatatatgatattttacatgtttcaatgccattctcccaaatcatcccaccctctccctctcccacaaagtccaaaagactgttctatacatcagtgtctcttttgctattttgtatacagggttattgttgccatctttctaaattccatatatgtgtgttagtatactgtattggtgtttttctttctggcttacttcactctgtataataggctccagtttcatccacctcattagaactgattcaaatgtattctgtttaatggctgaataataatccattgtgtatatgtaccactgctttcttatccattaatctgctgatggacatctaggttgcttcgatgtcctggctattataaacagtgttgcgatgaatattgaggcacacgtgtctctttcagttctggtttcctcattgtatgcccagcagtgggattgctgggtcatatggcagt

SEQ ID NO: 63803 - DNA, 2681 bp, Bovine  19866880662875
ctggcgcatcaggcacttaatggggcaccttgggtggggtcctactctgtagctctgtgcatcagttacttaaaggagcacccttggttgtgtcctaccctgtagttcagtgcatcaggagttgatgggccagcctctctattgttcagctgccaatgctggcatgtggggagagagagaggatatagtgatggttccaccctctacatgtgactcagcagtattaccttgtgtctatggctccccgactttcctccacaggcatttcacaccacaatctcctccctcacatcccctcgatttgtctctccacagtcaacagcagcccttgccctgggattgctccacaatccctaaattccagttcctagctgctgcgccttccagaggacccgcattcctgtttggggtatatatggctgtggcaaggactgtctgattctcattccattgaggcttacgcagaccagctgtttcactcccagccttaaatgtttctcctctgactcagacaattgccccaacgtggggatcggacccctgcttcagttccccaacccgctgagggcaggcccagtcctaccaacactcctgtttcccccctagttccttcatcctaatgagttttgcgtggttctatatattcgtttccattggtcagttactcctgtccattctcagctggtgttctgcatgcacttgtgtgtctgaaggtgtattcctgatatatccgtggagagagatgtactccatgtccaccgactcctccgccatcttgttctccctaacttattttaaaaagagtatttccagtatgtaataatgttaatactctggtttgataattatgggatatttatcaagttaagttcagttgctcagtcgtgtccaactctttgcaaccctatggactgcagcacgccaggtttttctgtctatcaccaactcccagagtttacttaaactcatgtccattgagtcggggatgccatccaaccatctcatcctccatcgtccccttcttctcctcctacttctcctcctgatctacagggatatttatatatgttattgtattaagggagctgaacataagggaactatttgttctacttttgcaactatttttaggcctaaaattatttcaaaatgaaaaactataaatgaaacacacattcgtgtgtgtgtgtgtgtgtgtgcgtgcgtgcatgtgtgtatctccagaatctgaccagttctcactccctttacttgtactggtcagatcatctcctgcttagattacagcaatagctacctaaacatctcccacattctattgctagcttctctcagtttattttcaacccactgttcatagtgactctattagaacataatgagttatgtcatcgcttagctcagtgtgatccaatggcatgatgtaccttgcatgacaatttgatgacactttggcctttctaccttgtactctcaccatcctccacttctgtaatctcatttcccattcttcttcccggctccagtcatattgcccacttcattgctccttaaacaaacatcagatgtgttttcacttgcaggtctttgcatttactgttccctctaccagggatgttattctagtttcctcatgtctcatcctttcacttcttttcgggtctttacttagtgtcatcctcttattgagattcttcctgattattttccttaaaatacaaaacattaccatcacccatgcattctgtatactcctttattttgtatagcattaatcatctttaaacatgtattacattgtgtttatattgcttattgtctttctctctcctaaaaatgcaagctgcatgaaggcaaaacttttgcacattttgttttctgttgtatttccagtgcttaaaactggtttacacactatagatactgaataaatggttgcatgaatgagcagtaatcaccatacagattgaatttaagcagtggaataaagtataaaaaggaaagagaaaagggccccggaccaagacttgtgagtttcaaaccttacaaactgagaagtgaaggcctgcaaagaagtccaaaataaagtcacttgaattactggtttaaatgtagcaagtacctcaggaataaaagagcacagtcaactattaattgctatttggaattcaagaacaataaaggaggacttttagtcatctatgaacatttactaagtatcaaataatatgtattgtttggagatataaatatagtgagcttacaatctagtgggagaaacactgttaaagagataaattcaaagaaaatgaaaaactttaataatacccatgttcaatgtgagtatataaagggggtctctttgatctaatttaagtgtgagggtacaaagaagagcctcagaacactttcaagattgggcagaatttggccaaagacataagggttaaaatggagaaaagttaatgaaagtagttttaaatatgatgtcatttaagtactaaaacactttttgaattgatttaatgacttataagtagaaataaaatttagttcaaattcttttttatcttcattaaaagctcctcaagagaataactgtcctcttggcttcctatcaacagtccttagctccctggacagctagctctccattcccctgtaaagctaccctctatgtt

SEQ ID NO: 63804 - DNA, 978 bp, Bovine  19866880892475
taaaattcactgaaaaactctattcactatttacaactcattattatcaaagttccttgtatgattgcttgctgaacaatggaaagcaggatcttttcaggcagactcttgcttgctgtgatgtggctttcaaccatctggacacatacatttatacacataaaaggctaactcctcttcattctcatgctgattttaggaaagcgctgcgctgcagcatggacctggcagagttacttacccagcaatacgcagacagctaatgactaagaatgtgacatcatacatgaccttcaaaatataaacactagaaattccaactaaaaaataaaagtgtatattccaagtgttattgcaaaataccctcaagctttcctggcttagtgactgctagtggaagaacacaatgctctggggaaagaacaaaagtactttgccataagtgtgtgggttgggattagaaagagtcatgctctctgatgaggcaccttctcatcacatcctagagcaaaaccagaaaataattgcaataatagtagctgagaagagagtgctgcagtgaacaaagaacaatcatatgcaagcaagcaaaatggtctcattttggtggagtgagagaactactctttgctagcagactagactaagacttgatatgtagataagaacaaaaaagattagtttcctgttccagcagtgacgtccacagtgctttccttaataatgcatctagaaattaacagctttctttgaaggtagaacaattctcgcttgcctactcaacacctactccaaaatcagttcatacgtagagctatttctgcctattttttggtgttatttctccatcacatctctaaacagttttaaaccaaagaaataaccaaaggaactaagtggtgcaatttgctcttgccacaattagccatacataacttattccttgcttcctacacagtacatgctttttggattggt

SEQ ID NO: 63805 - DNA, 1794 bp, Bovine  19866881025643
ctcctggacatttatttggtgctcccttttctctcccctgtaccctgtccttcttcttcctctctttcttcttctctctctctattttgtctgctatttaacaacaacaaagaaccaaagaagcatgtacatatctcaagctgtacatatggaagtttccttgggatatatatcacttttttgcaagatacacgcccaactttagtatgtaatacaatcaatgtaattatttttaaaaaacactaaaaaaagtaggagataggttataaggttatagtaccctgggcaaccaatgataatcatgtggatacgggggctaatagtactaactgtgagaagtgatcggacttgggatatattggaactagatgacaagaatcaacaatgctccataattctgtgcctaagaaaaaagggtagctaattaagctatctataagaatgaagaaactaagatggtcttccagtttcactcagggtgaatttattaaccttggaaaaatgctccaaaatatcactgttcttgtaacactatgagacacaataaaaatattttttctttaccttctgctttctcctttcctgcttgatcagaaccctggtcctgaaaatggaagcagcattattttacaatgattaaataaatggtctctaaaacaactgccattttatctgaattgaagtcttggaattagaatctaaaagtagcaataattattttctgagaagaaactataaaaatgctctcaaattatttataaaatatatactgtttcacaaaattttcctggataaaaaacccaagaactaataaaacagactctagacttatggtgaataattaagcataaaataaatcagttataaaaatcaagataagcagagaaatcagtgcattggaaagaatatatcactgaaacactcttatctgatagcaatattctaggtcaacactgctattttctttgcctttccttgtaattcaatattctactaaaattaacacagaatagagagaagataaaaatctatataggatctaacgaaatgttaaatttattattagagcaacttcagttacattagctacgtgtatctgaaacctcagaacttctttaaaacactgctagtcattatggatgtgcttcagaccacataaccttcatgccaaaaactgcactgaatcccaatgataatgcagcatttaagagttataaaatatttgctctattaataatagtgaaatgctataaaacatttattgataatgtaagcaaatacacacaatgtatcttttggacatacatgaattatggtctcaaattcaatagttaagaattataaataaaataacataatgtattctagttatatgatattatacaataacatgacaataaaattgttaataatgagtaccatgtatcttgcatcattctagatactccagagtctttacatgtaaaaactcatttaatcttcatagcaactctataaggtaagttctatttttactcccactttactgatgaagaaactagacacagagaggttaattaatttgtccaaggtcacactgctaataagtgatagagccaggattcaaattcaagaattctagcttggaaattttaaatcagtgccttctacttccttctaagcatgctaactgtgaataaacagagttgttcatttttccaaatgattttcataaactacatgaaggacagttctgaatacccctagactctgctgcttactgaacttattatttacatatttcccaacagatgt

SEQ ID NO: 63806 - DNA, 1374 bp, Bovine  19866881142967
ttctaaatagcaatatatttttcattttgaatcttttattagctaacttctaaaaaatcaagttacaatcaacattttcaagtgattttaatgagtcaactggattggcaaatttctaagatagtgtttttccctataaaatttccctcaagagacctgtattcagcatagtaaatacttagtagtctcaacatataaaatagcacttaagtgttaataatcttcactctacaaattagtaaaaattaaccatccttatgttcctttctcttatttaaaccgatagaattcattttttaattaaaattttaattatgtgaaacagttcattaatcttatgggaaaaagaatcattatttgctgtacattttaaagacatatataataacagatgcagaaaacaaattcattctccaattgtccaatctacaattatgaaacacaggctaacatcaaagcagagtaagtcttaagataaacactcctcaattattcaattattcaatagatgctaacagaattttgcaagtacttcttaatggtctataatggtgatttcagccattttccaaggagtggcattcatttgaaaaaagtaatgtaaatcatttcactacatcaagtaatactgaaaattcaactccttagttttggggaggaaggaaacatgaaatgtgtattgagtcacagattaaatatgacttttccttctccttttctgtttaatattaaactactgtgttttattttctcaatattttttcaccttatgttatatacattcttattgtaaacattttaatattctttgcaagcggacaggtataaataaacaaaaaatgcatatatagacctatcttttcttatattttataaacaggaactatttgccccttatgctatttgtctctaagttacttacgttagcgttcgaacacactttgctgaatctctgatatcccacaccttaatataagatgttgacacagtgaagaccaaacttgtataattacaatattttacagatactacattgttgggatgacctcccagtgacattatctcctgcccagtcaccagattccatactttacaagtacgatctaaaagcaaataaaaaagaggaaatattgtcgataagaactaaattagattttcttagcaataacaatttctctcctatgagaaaaaatgagataagaaaatagtaattatttaattaacttgcaatagcatcctaattctatccttgacattttgcagcaggttcaagggcaaagtaggtataaggattagatgaaagctaggatatctggtgtatgcatcaagtggtattaaagaagtaattatacaaaattttaaaatagacatatt

SEQ ID NO: 63807 - DNA, 698 bp, Bovine  19866881232877
tggactttgtacttgcctttcaaatggcatattggcttacatgaagaggtcctctactagtatttcaaatttaacatctcccagaatcaaacttttcatctctcctcatcttatctgctactggcataaaacaaacatgaagaccataacatgctcagtataaaagatggtgacaacgagatttaagcattagttggatgactgaggtaaaaaaagtctttaaaatccctcccaacatatcctctatgaaaaagtgagaatacatttttaataagacaacaaaatcaggaactgagtgaggaaaagatcaggaagaaaaagtaaagtctagaaatgagaaaaaaggactgattaagagaaaagcatcctatgtacatctgaaaacttcaaacttatcatttaataggagaatataattcaatagccttattatacacactctgatgtaatgatccttggagccagtgatgattagatcttgtccattagaaatccggtctacagtaagacacataacagggcctagatgtcctgttaactttcctgtggactgaaacctttaaaaagaaagaaaaataattttgtttgaaaatatttcttagtatgctgaggctaagtgtttgctaaaactgttcttttttgatttaactccgtctctatgaaacgctcctcaaattaagagtcaaaaaatagccaaa

SEQ ID NO: 63808 - DNA, 731 bp, Bovine  19866881251059
ataaaagtgatttaatgaaatactatattttattgatagtgtttttattctggcagtaatatttaggtctgtttatatctctaactaaaaatagttgtgtctgttaaaagcaaattaataatttaagaaacaaatgctacaggttctttattaccttcaacatctttgcttacctgtttaatcttttaaataatggtccagattgtgctgtttcatatgatggattgaaagtatcttgattttcatttaatttagaaaccaaggaatgagaataattaacattactgggctgaaaaagaaaggaagagctgccaaaatggtaatgtacagatacacaatttaaattatttattataaaatgccatttaagtgaatacacatatattcaaaaaatgtattattttaatctaaaagaaaataattgcaccctattgaaaataaaagtttctaacaatgaaagcatatcagtatttgagtgattattaaaataatacagttgatactatggtgagctacatattttacactggttaaaaaatacccagaacaccaggatctgagtaaataaaagttaaatttctctcatagaaatcacgtaatcttttcaagaaaacagctatacctaactcagtttttccatctactgagtaaaattttagactgctactttaatatttctgaatatcaatatcattgagtgcaaaatgcagaaaggattgggaagactattg

SEQ ID NO: 63809 - DNA, 2359 bp, Bovine  19866881331163
acatacatggggaaagttctaagcagaattttaattgaatgtggattccttagggcaggtgacacaacctcaaccatcttgactgtgcccagccaaggaaagtagcagggattatgggagaccagatgcaatgcaaaggctccaagagacaatgcaatcccttgaaatcaagacttcagtgtgaaatttgacaatggcaaagattttgcatttttcaaagaaaatatgtctcagggctaaacttagtccttgcaaataagctaaaatacagattaaatttctcaaacaaaattatgataagacactgaggggagaaccttaaggaagctgaagatcatcagaagaattgaagagaagactgttaattcaatgcagtaaactaaagttaaaatcatatactttatacattttctattttctggtactatgtgtttttattgaaatggaaacaggagcaccttatatttagttttgtatattttaatctacccaataaaaataatcttatcaaaataaatgaagatgttccagcagggaacactgttcatttttcttcctgccaagaataacatgtcattagactatttgtctctgcatctagcagcttaataacatttgaaattctgcaattctatcagtcacaggaagtactatcacaaacgtggacagaagtcactaccttagctctccagttgcctgagaaagaaggaaccaagagatctgtctttagaatttttgtcatggaccttcaatgttgaaacccaaactaaactaaactaaacccaaactgagtatacagctaatattaaaagttattaaaaatgtcattgtagcttgtcactaattctaaagaaaagaattcacttggcagtggtttcgaaaaatcctattttcaaatcttgaatgccatggtttttgttttcctgaggtcataactgcaaactagttaaggaagacactcacacagacaaagccaaatccagtataacaccgtactatgaccctggtgatgaacagaaaacaaaagtcagtagaaacgaaaatatagctggcttactctgggtaagtactttgaggggggtaattttattatttgtataatctttctagggaaaaaaataagtctgaagttttaaaaagcagaaatgttaaatgaagcacaaacaaagcacaatactattatgacagatacctagtcagagtgggagaatgatatgcataggccctgctgttgttcaattgccccgttgtgtccaacttttcgtgaccccatggactgcagcatgccaggtcccccatccttcaccatctcccagagtttgcccaagttcataactactccatcggtgatgccatccagccatctcatcctctgacgcctcatcccttctgatccccttcatggatcactgccttgttgtggtgaaggggctgagtaactcgatgaagttatgaatcatgccgtgtagggccacccaagacggacaggtcatagtgaagaggtattacaaaatgtgatccactggaggagggaatggcaaactaacccagtatatttgccacgaacctcatgaactgtataaaaagacctaaaagccctgaggctttggttactcatcagaagcagagaatgttgcacagagcaggaggcacagcatgggagaattggtctgaaacagggcaggaaagagatggacaaaagtaatgccacaaatggttctagactttccgatctgctgaatgctgtggttgtcattaaataattttaagtcaagatggataagacttgactttatttcagaaacttcacagagataagaaggataaactgttggaggtgaaatttaaggctgaaaaattctctgcacatcttctggtgttgccctgtcatcttggcctcacaccctccctcacaaaaggaggttcactttgattttctctcttaggaattaggaatttgggagccacctatgtgattaaaggactaaaatttttcaggggactggttcaagatagtggaatagaaggacctgtgcttatcttcccctgtgagagcaccaaaatttgcaactagttgttatacaaccaccaacaggagaacactggaacccaccataaaaaagatatccctcatccaaggacaaaggagaaggtgcaacaagacagtaggagggactgaataatgataaaatcaaatcctatacctactgggtgggggacccacaaactgaagaacaataatatcaaagaagttctcccactgttgtgaaggttctagactccacatcaggctctgtagcctggggatctggcaaagagactgggaatctccagggaattgacatgaaggttagtaggg

SEQ ID NO: 63810 - DNA, 933 bp, Bovine  19866881434135
tgccttcgagactgagagctaggggtataaaagccgataagaagctatgccttctaaaatggtctccattgaaagcaaaccacagttctttatatgcaagaattagagcttatctaactaacatgagtttttatcacaaacaggttggtctatagcagaaaagttgaggtgtttttaggattttggatatttttctggttataaaaatcttttaaatcagctgttttattttacttgagaagtaaaattataaatatgttaaagtcaagtcaaatataatttacctaacaacaattattattcaccaccacacccagagacattttgataaaaaatttcagtgaagatctcatctgtgagagataatagaatgggttaaccatggaggtgcagaaattttagggggagtattttcgtataatagaagacttgtgccatatcagcatttgtttgaatttggaacaggactttcctctttaggttagatctgtaattctgcagtatactttagaatgttaatatttacagacattagctgtcttaaagatatcattctaaactaaaatcagcaacatttgtaacacttaaactggggaaaattcactcttatgtgtttactgtactttgattcaaaatgccttatttatctagagatagtattctaagtaagaaaggggtagaaatgccacaaattgaagcaactcttccataagcttaattaaaatcatgatgatacattcagcctggaatttagtttattttcagctagtcatctgcagccatgattcccacagagggaggctgccagtctcacagcacactgtgcagcttggatgaacagtattacaggctgcttatgagcattttacatctggggatctgtggagagcagccagagcagcaagacagcaatactgaatgcagggcatttat

SEQ ID NO: 63811 - DNA, 783 bp, Bovine  19866881491035
atggtgatgtggggaaagattgaaggcaaatgaagaagggcacagcagggcatgagatggttagatagcatcactgactcagtggacatgaattcacacaaactgtgggggatattggaaaaccgaggagcctgatgtgttacagtccctgaggtccctagtcggacaggagttagcaactgaaaaacaagtgcttccaccattctcagatcctctcctccattcctcagtgcacctcacctcatctcacctcatcccatattctggctacttataatttcttttagtaagaacaaatctatttgtcagttcctctatctaccctctcacttctggaccttgagcttaggccaggattatactttgttcaccaatatattacctacgccttcctgggcatcccctattaagcactcagaagtgtttgtcaaatgaataaatacatagctgaacttttaaatgaatgatgaatatgtggaaacatcatatgtctcttcctcctctcttatgaacattatgatttggtgtttagttttatttagaactatttatctaatgcttttttttttttttctaatctttatgaaactcctctctctcccaaacattatttgaaacatttagaaatatttattttcttggaaaggaaaggcactggcattttaaactggatgtatatttagtatgttcagctttatcccatttggcaattagaatgtttacataaatttgcaagcttatcttcctaatagcataaatataaacacaataaatatttaccca

SEQ ID NO: 63812 - DNA, 806 bp, Bovine  19866881560201
agtcagtggaacaaagaagatctgaactcaaactccaaaagcattactttcctcaccaaagttcatcttaaaagattcaatcataaaagcaaaattatgtaatatgcaaataaacatatttgatagtcaaaaaagtcacaaagatgactgcttttagaaacagaagttcctgttactgcagtcttttttcacataaattagagagcgtggttcttatcagaatgtacagagaacaaacatataagcaagggcggaaatctactggatgattttgcagaatactcatcctctactgctgtgtttattattttgataactgatatttgtagcatttttctgcttgtcaaagacagcaagtgggactagtcttaagtgctaaggcagtcttaagtcatcttcaatggtttgcttacctttctattccatattttttaaattcaatttgtcatcacacttttaccttttttaccaactgtgctatcagggaagcctttatttcacagtaaaacaatgtgtgaaggacatagtcagttcagttcagtcaattcagtcgctcagtcgtgtccgactctctacgaccccatgaatcgcagcatgccaggcttccctgtccatcaccaactctcggagttcactcaaactcacgtccatcaagtcagtgatgccatccagccatctcatcctctgtcatccccttctcctcctgcccccaatccctcccagcatcagagtcttttccaatgagtcaactcttcgcgtgagttggccaaagtactggagtttgagctttagcatcattccttcca

SEQ ID NO: 63813 - DNA, 693 bp, Bovine  19866881827371
ttaatattttacatttttatttacatttattttcctattatctcacttttttttcaaatgaaaaggtaaactatgagaaatataacttattctaaattagtacagcatatattaacaagcaaaaaaagaacataacttaccatctctgaactagaattgaaacaactactatctgttggccttggagagtaactggaagactgactactccgtgaagaatgaagatctgaaaataaagatttaatttgccaagtttattaaggtaccatatatttgctaatttctaaagactagtatgtattaatacatacacaggcaaaaaatagctgctggtaaataagttcagttaacatgctatggaacattttaaaagttaaaattttggatatgtggcagcttgcacttttgacagggtattttggatttattctccatgtatctgccttccaatgcaagacatgtgggctctatcattgagtcaggaagatactctagagaaggaaatgacaacctattccagtattcttgtttgggacatcctatggataaaggaacctggcgggctatagtccacggggtcacaagagagttggacacgacttagtgactaaaacaacaacaataacaacaaaacgtgtatttacaagtaaaacaaggggaggaaacatacgggaagaaacgagaacagagaaa

SEQ ID NO: 63814 - DNA, 989 bp, Bovine  19866881929198
ggtcactgagtttgcaagcagaagagctaggatgaatcaagatctatctaatgtcaaatctgactcatatgcatttgtcatttgatacagatcttcatgtagttgattctgttttgtgtcatctaagatacattttttttttattggggggaatgttatagggtcttcaggctgcccagaaagaggctcaaattaaagtacttgaaggtcggcttaaacaaactgaaataaccagtgctacacaaaaccagctcttattccatatgttgaaagagaaagcagaattaaatcctgagctagatgctttactaggccatgctttacaaggtaatttggattgaattttagttaaatacattgcatggtaactttgctttttgagtatgctatactctacttctttcctctatagcttgactgaatagatgctgtatttacttatgcttttaataattattccttttttaatttgcatgtataaattttgggggatataattattgtcactacaagaaatgattagtaacttaaaaatactcacttagcattattaagcaaataatttttatgaattaaaaaagatcaacaatgtttctgagttggttgtttaaattattaaccaagcttcattactttattctgcatatctaactgtcttaaaaataaatgtataagtgtttgctatggcatctattctgcatatcttataaatggtacataatcttgttttatgtgagagttcttaacattggatctgttttgattggagtattgctttttgtttcctttttgctgttatttatacagatctagatagcgtaccattaggtaagtatgtttagctttctgtgtaccctacagctgcatgaattactaattgttcatgtacactaattgtggtacatcttatttaaaacatttttattgacagccagctggtttttgcatgatcttttttgaaatgtatctgtgaccacaaacatactaag

SEQ ID NO: 63815 - DNA, 1323 bp, Bovine  19866880407749
tcctgatttgcctgaaacaggggctagtttgaaaaccaggcaattcccagaaaaccagggcaagttggttactctccttggtaactggaggttactgctcccttagccagccaaccagattccaggccccaggtctactgctggtaagaaggaagggaggtctgaatccctcacttatttcagaaaataatctatgcaaccatattacactcccactggagaaagcaagttaatggtgcttctgatcaaattactatatccttagatcacgtaggtcaagcacctgcaaacttttcccctgaagggccattttttagtttgtggatcacagggtctctgtcacaactactcagccaggtccttatggtgggaagcagccatggacaatacaaaaatgaaggggtgcacctgtgtttcattcagaggtgggaggtgggcctggatttggcccatggagcgtctgccaaaccctgatgtagattattaatacagaatcttttgagggacttccctggtgatctggtggctaagactccaggttcccaatgagggggcccttgttccctggtcaaggaactagatcccacatgccacactaagacccaatgcagtcagataaatagataataaagaaaaatttaaaaaaaatcatttgcatagataattcaatctgaagaattatttctggaagttactttaattgggggtatggccagtgggccattggggagctgtcttttggactaacctattctagtggaggtgatggaattccagtggagctatttcaaatcctagaagatgatgctgtgaacgtgctgcactcaatatgccagcaaatttggaaaactcagcagcggccacaggactggaaaaggtcagttttcatttcaatcccaaagaaagccaatgccgaagaatgctcaaactactgcacaattgcactcatctcacacactagtaaagtaatgctcaaaattctccaagccaggcttcagcaatacgtgaaccgtgaacttccagatgttcaagctggttttagaaaaggcagaggaaccagagatcaaattgccagcatctgttggatcatcgaaaaagcaagagagttccaggaaaacatctatttctgctttattgactatgccaaagcctttgactgtgtggatcacaataaactgtggaaaattctgaaagagatggtaataccagaccacctgacctgcctcttgagaaacctgtatgcaggtcaggaagcaacagttagaactggacatggaacaacagactggttccaaatagcaaaaggagtacatcaaggctgta

SEQ ID NO: 63816 - DNA, 1113 bp, Bovine  19866880466100
ttataaagattttatgccccagatccttccacttaattctcagccccccccccctttttttttgtgatggttcctatttgttcattcactcattctttcacctattcacccatttatgcactcaaaaaatgctgagggagtcactgcggggattcaaagaaaaacaagagagtttctcctgttaggactgttgtaatccaggggaggagacaagagtgtgcagagatgactccaacacagccaggagcaccgcaagagcaaatttcagcaatgattcaagagacggtcttctgcagcgtgtgcggggcagggctctggcttcagctgtaggagctgctgagagcacagtaacctccacaaacttcatcagagagcaaaggctgtgtctttttcatccagcaagatctggatcattccctgatccacagaactaaatatccatgccaatctctgcctctttctatgcagggaattgagaaccaggaaaggaaataggatcaaaggtacattgaagctctctcggtaaaaagtccatcagtgtgctctctctgggaaagcaagcaggccagtcctccccttggactgcccagggctggatgtccccactctggaccatgctggctggcctggagaggatgggcacaccagtgattcaatgctagtggctccaaggaatctagaccccaccgatcttctaagcaaaaaaaaaaaaaaggaaaaaaacaaaaacatgctcaaattaatgcccagggaatcaggactattcttattgttaccatatttcttttgatccctgaataagaacacctgggcagtcctgctgtttggcacatgggttagtaatcaggtggaatattttccttcatagcttccctggaaccctgggacgcatgattgctaaagcaaacctcataaatgctcatttatttttaatgcgtgtgttttaatgtatgcaaaatatatgatacacataaaaaggattcgtaagatatatgcacggtttgaagcttaataaaatgaacaccatggacccactaccctgctgaagaaatatatgtcacattattagtaataagaagagttaatatttctgagcccttatcatgtgccagg

SEQ ID NO: 63817 - DNA, 1597 bp, Bovine  19866880492010
tgtttgtcactgagcctcccaccaagcctgtagctgatgcttagaagtactggttgaatgaaagaataagggactgtaagaaaaatgctcttctttgcccttgttgcccataggagtaggaggagctttggagaatgatgatccttccaaaatggtcatggtattggctgccactaacttcccatgggacattgatgaagcattgcggaggagattagaaaaaaggatatatatacctctgccgacaggtatgatgccttccttctactctattttgatctttcttttactccttgttacctttctctgtttctctgagtcttcattctgttggcattctgcttatagaagtttataaataaccaatttgctgtttttggagacaggctacagtgaagtttctacattcagggcagtgttgttttttccccccatggaacatgctttattttatttaatactaatacaaccctgttaggtagggaatgttgatcccacttcacagctgaccagtgttcccgaggtcccagacccaggtgtaataatagctgatatttgtgtgcttctactgtgctctctgctgtcttagctcctcgacgtacttacccagtactcctgtgtgagagaaaatatataattagaaagataattgatgacagaattttataaactgctgaggaaagcttagcttggggggaaagatacgagttgatggtacaaaggcagagattcagctttctttgaaatattggagaacatagacgtggctgagtgttgagattttttttctaaacttattttcctgtatgaaaaggttatgtccgtcatgggtaatgacttttagatgcttctctttgcttattactagtctgaacgtgtgtaccttgtgaccatagaactggagaaattgctttctcctaaagggctcccaaacaaataatcgtaatcagaactccactatttctaacttctttcatctgtgttaattaatttcacaggtgtttatttagctctttgctatttgaaggacatttattattaggtattgtgtcaatataatgtgtgacccttgtctttagagagttcctgtatgattggaagggagccatacacctacccggtttaactgcagtgaaaccagggagcacgtgatactggggttgcccatagtcttttggggtggaaatgaagaatagtaaattctgaccgaggtgctgaggggagacttcatggaggaagttgcatttttcactgaatttccatagagaaggatggaaacagaggcatggctgcttgaaaatgagtagacagctgttgtgggataatctggtgggatagaagggtgttgaagaatctgatgggtaaagggtgtggaagagacagaactataaagaaatgtgggaagacaacaggcctgaaagaacggtttagaatcaagagtaaaaggaatggaaagaaaaatagatttagaaagttaaaaaaattgaaggacattttatgaacaaaatctatgccatgaaaagacgtttttagtggaaaaagcaagaagtacaggaatgaaaatagataaaacaagaaaagccacccaaaaaggcat

SEQ ID NO: 63818 - DNA, 1022 bp, Bovine  19866880506531
aagatattattgggacttgcctggtggtccaataggactcagcactctcactctaagaggtcaatccctggctggggagctaagatcccacaagctgagaggtgtgtggccaaaaacaaaaagaaagtgttattactgatgtctcatcactctagcatcagcatcttctctaacaaattcttcagagaagaccagacttttgcactaacattcctctgttagctcattatcatcacacacacacacacacacacacacacacacacacacaccccaccccaggcagaggtcaagagctaaataagaataggtcttgatatctggagtttgaatagaaactaagaatattagactaattcataagtgtatcttaggtatgaaaggcacatctgatcaggaactgagaagcaggaagataatgcaaagcagaatggttgtgctgctgctcagcctgatttctaaaaaacacaactaatgaatcattcatgggcaaaaaatcctttcagatattctgaccattgaaaactgagggggaggggaaattgagagaaatttgagaggaaaattcaagttctgacccctgattgttaaaatgaaagatcgagggaaagccaggatccctttagaaaatattcagagcaaaagtggaggagcactgttagcactcctaaaattgaggagcactgttttgattgagtacaaggatgtaataggtgtcaaagaggttcttttttttttttttttcttttaagaaacaatatcttttggtcatttgcagctctgtgagactatggattaaatacagctttcacagattaatctttatttttgtggattatgttagtataactaactccatgggttaggagctgactgggaataggaagggatacatttagattcaatttaaaatttttcgtactgtaggatatggggagcagtggctcagtgccacatccaatgagtcagtgagttttctggcttgtgttagttgttgtgtaggtacagccactgtgctgata

SEQ ID NO: 63819 - DNA, 2525 bp, Bovine  19866880531800
acagacctcggatttctagtggtggcaagcaagaaccttaaccccagcgtgacttgcaaaagcgaatttagagtctctgaaaggccggcagacttgggtggacgaaagagcctcctttctttaaaaaaaaaaaaaaacactcctggctgagacatgagccacgctccttatcagacggaagccaggaggcacctggaacagggtctgctcagcagatgcagagagatgcagccgtctgctgcagagcccgcttgctcccttttagaaccgttgtcagagaaatgggcttttttaggagacactccatctgggaagacagcggaaacaatgctatgcatgtaaagtacatctccctttggatctttttgatcggagctttcttcctgccttctttgtcctggaatggatcctgaaagaatgcagactgaaccctcacactggaagggctcacagaggagaggaggtggcctgaggtgaccatgttccccttcactcccactgccctcctccccacgactaccccctcttccttagcttccctgaaaaccagtctgaggagccactgctcttcagagcccccatctcccatctcccatcccccttccccagagatacaccccaccacacaaggagtgaatgttaaatgcatgcaataactttatctattcatatcactgaatggatgatacctatgacaaacctgctttagcaggcagattcttcaccactagtgtcacctagctcagtggtaaagaaaccgtctgcaatgcaggagatgtgggttcaatccctgggttgggaagatcccctggagaaagaaatggctactggctccaatattgttgcctgggaaatcctatggacaaaggagcctggcaaaaggaattcatgggattgcaagagttggatacaacttagcgactaaaccacaaccctgacaaacctaggcagagtattaaaaagaagagacatgactctgccaacaaaggtccatacaagctatggtttttccagtagtcctgtacagatgtgagaattggatcctaaagaaggctgagtaccaaagaattgatgatttcaaattgtggtggtggagaagactcttgagagtctgttggacagcaaggagatcaaaccaagtcaatcctaaaggaaatcaactctgaataatcactagaaggactgatgctgaagctgaagctccaatacctctgccacttgatgagaagagctgactcattggaaaagaccctgatgccgggaaagattgagggcaggaggagaagggggcgacagaggatgagatgggtggatggaatcatcaactcaaaggacatgagtttgagtaaactccgggagatagtgaagaacagggaagcctggaggacttcagtccacagggtcgcaaagagtcggacacaactgaaggactgaacaataatggcattcctatcacctgtgttagtcttgagctcttcctgcatgaagcaccttcagcttttgtgctctggggcactcactcagcatttcataaacatgtttattactttaatccttctaaagtgcccgtccagtctcccagccaaactgcaagctgctcaagcctgggactgtatctcatccacctctctcatcctggtacctattcatagtcagcggattctgtgtttattttttattttgatctattacacaaataaaacatgctcacggtagggttgcatgtttattggcagagtaaatcatcacagtacacaattcgcaggctccacagcaattaaagaaatgtaaacgtttagaaagagaagatattcttatatgcgtattgcatggctgtttttgtttagttgctaagtcgtgtctgactctttgcgaccccacagactgtacccaccaggttcctttgtccatggaattctccaggcaaggatactggggtgggttgccatttccttctccaggggatcttcctgacccagggatcgaacccgcatctcctgcaatgtcaggtggattctttaccactaggccagctgggaagcccgtgtattatattaagacaaatcaataaaggtgataaaatactatgtggagacgatcataggaaaggagtgtgctaagacagcattggagggatgctgtaatctggttaaagactttgggttactacctgctgacatctaacaggacgtataaaggtcctcatggtgagacttccctggtggcccagcggttaagactccatgctctgaattcagggggcatgggttcaatccctagtcgaggaactaagatcctacatgccttgtgaaaccggccacactccgggaatcaccacccatgtccaaggcaaggtggccatccggtcctcttgggagtgagtgtgtgcagcaaaaccccagagcagagggtcacaggctgcccagagaggccccacaggctgaggccggcagctatggtgtggactacatcctcctacatagtgaggtggtgccagggagggcacccctggacagcaggaaggg

SEQ ID NO: 63820 - DNA, 968 bp, Bovine  19866880565232
gctgagggaaaggaatgcaaacaaagttattatgcccacttttgtttgtttgaaagaggcagtaggttgtgatagctgagggcgcagacttccgtgtcaagccacctggcttcctgtgacttcctacgtggcttttctcacgtggaaaatgaggaccctaagaccttaacgcagagagttgttatcgtcgtttaggtgctcagtcgtgtctgactctttgtgagctcatggactgtagctcgccaggctcctctgtccatgggaattctccaggcaagaatactggagtgggttgccatttccttccgcaggggatctttccgacccaggaatcaaatcagggtctcctgcattggcaggtggactctttaccactgagccaccagggaaggcaggtcctgcagagagctgttaggaaacgtgaaagaggtgatgtcttaagaagaacccaggcctggcacctagaggtcctcccaaagtacaggggtgactgagggacagggcctggagcaaggagccaggctgtctgtacagacagaggagggcagaggccagccaagtgcccaccccccgggatgctgtcaggatgagggcggtgatacacgagagcccttggagcgagcgtcacatcaccatcatcaggctgccatcgattcatcactgtttctgagttccaacctggtggtgttcagagcaatgcggagagtggtgtgctgggccacagttcacaccccaggcatctggctgacacgcagacaacagcaaacccattcacttgggtctcactgcttaattattgcaacttggcacggcttccggtgccttgagagcccttggacacgcaccatacgttttgggcaggaaggcacggctggcacggggacgggcccgtcaatcctgcagctctgctctgctaagtggtggatgctctccaaacactcggccccaaatgtacgggaagcaaaagc

SEQ ID NO: 63821 - DNA, 769 bp, Bovine  19866880712064
gaaggtgggagtcaagaagcccgtcttccatcaggggtaacgacagctctaagaggcaagtgtggatgctgcctactgatgggatgggactgaagggaagaaacggcagggcagctgctgcatccaggtacctgcagccagagacccccgcacagccaaggaatgaaagtgaagtcgctcagtcatatctgactctttgcaacctcatggactgtagcctaccaggctctgcggtccaggcaagaatactggagtgggctgccatttccttcctgctgccaaatctgtggggctgagaaagataggagacaagaaggaagactgccttgctctccctggaagatcaagacaaaagcaggcattccaggccttcaggagaagcaaagaagatgcttgaacatccccaaggcctaggggagaaatcctagcagagccgataaatatggggttcatcaccttggatctgtctttgtcagaggccaggcagagtctctcttcgagcagaagatagacttacctccccacaggatagccctttttgttggggaaaaaaaatagcacccaaaatggcttgtggggctaaatagaaggtgaccaccaatccatacctgttattcatgaaggtgttaaaaaaaatcaacaacagaaaacctgtgtgcttttttccccaaaaggttgctgttgatccttgttctaaggcttccttttgatttccaagaacagaaataagcaagtaggaaggagatagcatatttaatatattctagca

SEQ ID NO: 63822 - DNA, 749 bp, Bovine  19866880712113
ggcacattaaagttgttaatttgaacattactggttttagagctgtatttgcattttctttatagatctgttttagttttatggttgtatagaagttaataaggattaaagagtttcttctaaaagagcttcatataacattattttagggtgagcagtatgatctaattgattcattttgtatacactgtgttctctgttaatacaagtcttgtgctttaagaagtacaaactgttttggttagctcctctgtccatgggattctccaggccagaatactggagtgggtagcctttcccttctccaggggatctttccaacccagggatcgaatccaggtctcccgcattgcaggtggattctttaccgtccgagccaccagggaagtccagtaaaattagtgaaatcagcacaaacagtcgtatcactaggtacacgcaattaagaggatcaaactgacttgggttagcttcataggaagaacataagctgaagactcgtttgaggatggcacgagtcttattacatggaaaaaaaccagagaaaggatctctctctctctctcacacacacactccaaaattctgtcatggatattggcttgaaaatgcaaagcataaatggattttataccttcttgatcatgtagtagttcagaaaacaaaggaagtgacatgaatcaaacattcactttctgtcaaatgccacctaagcagggtgtgtacagaatagaccaaaaatttaaaaa

SEQ ID NO: 63823 - DNA, 1329 bp, Bovine  19866880759187
aaaaagcagacggtctggggaccatggtgattcggctggaagtggcgaagcccctcgtgccccctggctgggtttggtcattcactgaaccgttcttcttgtggctcttgcagctcgtgttggtatctgggatttgaacttgacctttactcctaaggacaatcacgaacatttatgttggaagcaagagcacagcacatattttaaaatggaaaatctcagaagtcaagtgaaatggagacatggaaagcggggaggttcttctggggtttaccctgggaacttgagcggaaagaggactgctgctggaacgtgacacaggcaaagtttccgtttagaaactttaaagtcagagcagagaacaagtgcccttaggcaccaaaaccctgcacaatgagtggactatgctgaaatcaaattttaaattgttagccactaaaataaagttaaaatagggtaagactgaacaggaagaaatagtctacaagagaaatctgatgtgtgaaattttgatttttatcctcattataaaattttttgtgctttctgctagagatttctgccaagaaatgtgatatgttgaaaaagaagaggaaatgtactctagatgctgtgatgagaaaaggatgtttaaagtgacaggaatcagttgagtttctcccagtgaccaaggttataaaaatcaagctctgaaactcccaaagctgggtgagaaaacaaaacaaccaaccaaccaaaaataaaataaaaacaaaaacaaacaagaacttgagtaaaagcaacatctaaatctatgttaatataacttacatttcccacaatgtttgtcttatctttgttcatgtcagatctcttatactgttaattccctctcctgagagccgtcactgctagagccagataggcagctggggagaggaggcggggtgagcgggtactgtgagaagcagggctgtttttctcatgacctccaaatccaaaagatgctgccacattcgtgggaggtgcatcaggctgtcagtcaagtgctcaggattcagaacaagccaggtgggaggagccttccccaccaggtctcagtcacaggaaatctgatgccttaaacccccatctcaacactcagtgacttcaacttatggctattaattagcatctgtggtctcgggtagcctcagcctgcaacggcttggagcggagcttgggctgggtcgcggcagtgcgagcacctgatcctagccgctagaccagtggtcaatgacaagggccctggccctttggctttgcagaaaagaattgccgcaaagacggaaagcagcgaaacaagtcaag

SEQ ID NO: 63824 - DNA, 1376 bp, Bovine  19866880837843
tctccaggccagaatactgcagtgagtccccattcccttctccagggtatctttccaacccagggatcgaacccaggtctcccaccttgcaagcagattctttaccatctgagtcaccagggaagccttatatgaaagtccctcagttgtgtctgactctttgtgacccaatggactatacagtccatggaattctccaggccagagtactggagtgggtagcctttcccttctccgggggatcttcccaacccagggatcaaacccaggtctcccgaattgcagacagattctttaccagctgagccacaaggaaagccctattcaatattagatcttgcctaaaggtttcttccttgacaggtgaaaattacactgacttctcctatttcaccttctcaatatacttgaaaaggtcacaattctacaaatatgtcctaattctacaaatgtcatacacttcagagccaagacatacaccatacctgtagtttctttaaatcaatagtacagtgttatgttgttgctgatgtttcaaacagcgcttaatctcttccctgcataatacatcaggctctctttctcccagtgcttcatctgattgttgacgtgtttgaatttcgctttttcctggttaccttcctcttagggccctctgtccggctccaacctgagttactgcctcctcagcctgctttatcgttgttcttcaggctttctttcagccatcctcacaggatccactcctcctatagcctttctacttttagtccctagttttgcctgagttaccattctccattatctaggaatgttgcttgaatgaaataatggctttattttacgcaacttggaattgctagttttgtaatccaggggatgtttcttcaggagaaaatgagagaatgggggaggtaagaaagtggttttttatttttaatttttttaatttttatagtgggtaacttaagatgtgttcataacttttttttttaaacttgtttcctgccaggggtctactgttgtaaacgacagtgggatgaaagagaggaatactaggaagaggctggcaagataaggatgctaaaagaaaagataagagaccaccgagtgatttccctggtatttagaactctgcttccactctacctgtacaggttccatctctagttaggaaacttaagataccggccaaaagaaaaaaggtcaccgtgaggtcacttcctccctgttttccaaggccaaccttgcatttcaaggtactactatcttcaaggaagctggtttacagttacacgcccatcataagctgttgcttcagagtccaagacagaggctcaaatgactgtatttctacctggaagtgatgccagtgg

SEQ ID NO: 63825 - DNA, 761 bp, Bovine  19866880986668
ttttacaggttaaggccctagtcccagatggccagagtttcaatgctgattttcagtgttttctcaaagaacaaatacaaataatctgtcaaaattatgaaatgatggcgcctcccctagtggttcagtggttaagattccgagctctcagtgcaggggtctgggttccatccctggtcagggaactagatcccacacactgcagctaagagtttgagtgccacagctaaggatcctgcacgccacgatgaagatcgaagatcccgagtgccgaaacaaagacccagtgcagccaaataaacctatgtatttttttaaaatatgaaatgatggtcagactcaaaccaactgcgtactcttccacaacacggcacaccaaggaggagtattcatcaacgtgcttgccgtagaatgcctactcttaacacatgagatctaaatttagatagctacatgtggaaaatatgatctttaagacagtgaaatggaattccgtttcaaaaagatgggcacctggaatgctgtgaagttctgctgctgcttcagtaaggcaaaactgaagaaactttacaaaaatgtatttaaacccaagactctatatcactactaacaggaggctgaggagactgtatataaaaaggctaaaaatatctccatttgaaaatagcagattgtgaaagagtatatgactgacagatattaaatattaagggcatgactaagatgtgtatgcattcgttcactaaagtctcacattcaaa

SEQ ID NO: 63826 - DNA, 1165 bp, Bovine  19866881090099
ctgaaagctcttggggctggactctggcttgcctatttttgatttctacttcaagaatactgccaagcacgtggtgatttatcatttccccactccctttcccataaacatttggttccgagggattaaaagagtgcttcactcttccttcgcggattttattgccagcaactgacacccatttttcaagtctggacactggtgtttttgatgttcgtggataagtatgcaatgacaactgtagcctggccaacagactgtgagaatcttcattttataagaagcatcttgatttcatatatgttggtaataagtcaactaaggtctgaactgatccttgctagagttcagctctgtttggtttcatttgtagaaaacacagtagtattattactaatagcctttgcattgacccgattcccccccacccccccataatagcttgagataaaattacatagtgtatttactcatttagtacagaattctagaatctccctggtggcccagtggttgagaatccactgtcaatgcagaagacaggcaggtgaactaatatgcttctattttagattctgggaccatggcacttctacacaccaggctagtctaacttcaacatagctatctgctacagagtaaggtcaagaatgatggtggattattggtaaaatacagagggtgggaggagtctggtacaggacgtaggactgccatatcctttttggtgatgtaacgttactggttttcctaaaacagtaatagctagtgaaacttattgacctgagatagcttagtaaaatgagtctgattttgggaaaaggcccagtggcagcttgggaagtacagaggcaaaaaaaaaagtctataatttgcaatgacgtctatagatttgccttcactgcttatagtaaaaggctgcacagtcctggttagttgctcttcagcacatctgtttttggaattgtaacactaaggaagaataatattctaggtctgtctgcctcccaataggtatagtagatggcagctttggttggtaaggtggattcataatttttagtgttcataaaactgagagactggaagaatttttgcttatgcttacattttctattcatgaactatctcctttatgtataaaaaaatcaatattttatgaaat

SEQ ID NO: 63827 - DNA, 1050 bp, Bovine  19866881171666
ttaacataaccaaagctactagaaataaaaagtcatagtgaaaaatgtccttggttctttttactttcatgagagaagatgacagttttcacgtggtggttgaggtccatgggtctacaggcagactcttcctgaaggttctgaagcgatgccgggtcgcccctggcccggcagcacgaaagacaaagaccacggccacaccgcgcccggcagaccgcttacaggatgacacaacagttactctctccagtcttttcacgattcctctgacctaggcaaagtgaagagaagcctggtttataaagatgcttgggggaagcagagggattccagcataataagaaacagattttttttttttgcttaatgttggcattttttaaaattaaaaggctataataaatacccttttagttttagcctgtctccaaaatgcctggttatccgcttagcgagctctgaccataaactatgaaaacatcctttccccagaatatccaagagaactggagccatttgtgaatgcctgcctctgtggtgcaaggcagaaagctcccagcacacagctcaccttgggagtttggctctggcaaggtctctctggccaccaaatgcatcactgttgttttgccaaaaggaagctttaatgctgtgtgaaaagaagacagtttgttacatatacatcaacctgttggaatcactcaccagaattgagaccactttaaaaattgactgctttctgtatgacttcctcaacagatagcacttcttaccggatacagcatttcttacataatgaagttaggttaatattatcagaagcaatttttataattcagaaattatttagctatgactattagtctgacatataaaaacatactgtgtaaggaaggggaaagagaaaatacataattgcttaagctaattttatttagtcacctaataaaattcctgcatcaaagaggtcaccacaatgtagaaatagaagaaatgacatattaatgattttaaacataataataatacataattttattattttcaacc

SEQ ID NO: 63828 - DNA, 1137 bp, Bovine  19866881258880
atgtttatatatttgttttaaatcgtatatagactaaaaacttaggttttcaaactctggtcaatgtagttaactaatagctaactctattacaagttttggtgtttccttttaaatgagtctactacgaagactggtcctattgctggtttatgccctcttcccacaaatttgctagatttataaataaatttaggtattttgctttcacttcaaaataacaattttagaatctgtttaacctagggtatatagttctcaaaatatacttaatatatatccatcttctaaaatagcatagctctttttcagagtaaataggatttttgtttaattgtctattgacttttttttttccagggttcattgagaaatccttagtgctattgacatgtttcaagggacataaattagccaatgactcggaatgacggattccccgaagagtggaaatggtttgccaatggttggaccagggcctgatatagggaactcttcactccacatggtggggtacttgggaaaagttagtgcacttattttttgcctcagtgcaaagttggttttttccctcctgtttttgagacttaaatttggttttaattttaccaattaatttctaaaaaattgtatcttccacggaaatcttacagtaatggcgaaagactgtttctgtttacctctctgtttctttgatatgtgaaagtagaaaacatagaccttatggtttactgtttgaatatatcaaacatattttcagtggtaactgacgttactttttctcttgcaaataaaactaatgctattcttaacacctactttaatatttaaaactagaatatattctttttggaataatagctgtattaaagcctgtatggatttcttttatttgctgtcttttaagatatcttgccaggatgcttctaggtgaaaattatttaaaaatgttctggttacttttacatttaactttttgtaatttgataaaatctgtgagtgtctaatttactttttttctcttttagaattatgattcagtgaaagttttgtcagatggatattgccctgcttgtagggcgaagggaaagttaaaagccttaaagacttaccgaattagttttcaagaatctgtct

SEQ ID NO: 63829 - DNA, 1274 bp, Bovine  19866881419144
cttctcctctagtgtggtgaatgaaatgtttatcaccaagtcttatggaacaactgttcagtggctaagagtaatgtgtgcatttactcccagctttgttaatcatctgtctcataaccaccagtttgttggatgtgatgatttagggcctattggagtcagtgagattttacaatagaggtattcactatctttccacacatttcaggatgatcaggcttgaccacgctacctggacaaccatgttgccacagcagacttaatttgtttcctggttaataatctaccacatacctcaaacaaaactggaatatctggtcatctggttgccaaatgcgctaaagaaaattgagatgaaaacactggagtttggttaatacttgaataatttgagtttcattattttacaaagctttttcagatagggatcaagcatatatgtgttttctgactctctttccaaaaatttattacagtccaacttgtttcaatttaaagcaccagaataccactcaagatgccatctcttggaaccccaagacacacagcaggagtgaagtgatcataaacataaccttttaatattacagattctatctgtaatattaatattacagattaatattacagggctaatctcaaaagattgaggagtaacctgagtgaactttgattcaatggtttgatatctaaccatttgtactcttgtcaaggacctgaaatacatcagagatttcctgtttgaactgagggccatagtcaggatggacacatgttggttatactctgggcgtgattataagctgtcttcatgcttgaactcttagtgaggcgaatgcattttctccttcctttatgaggctctcatgagctttgtagtgcctggtaattaaggaccatgatgatatagtggaggcccctcagctgcatgccccatgggaagctgaacaacatgctgtaatgagctggggaggtatggctggagattgtgggcttgaatggcaaccctgccacttatgagtggtttgatattgaacaggtctctccacctcttttctttctgatttgcaaaaagggataataacatgttctttccagactactggaataatgaaacaagatagtatatgtcagtacatctggcacctggtagatcttaataagcattagtcaaacctgaatctggactcaaattcaccaaaaactggaccaatgtgtttgttgccagcactgggccaaaggagtaggcatgcatcctgaaagaggtagggcct

SEQ ID NO: 63830 - DNA, 2874 bp, Bovine  19866880422292
ggatgagttacagccccgccgcctgccgtctgtgatggagactgctggctggctccctacattcattctccccttctctctcagaaaatgttccttccttgttttcttccttttcttcgtttctttccttgctaggcaggagtggctgagaatcaaggctacatcttccagctcgctttgtggcaaggtgtgactttctgactcaaaaatccgtccaataggatttgagcagccgtgatgtcgacctgtatcttctgtgctcttaaagggccgggaagtcctcccctccgccctcgccttgattttcctggtgggggcaatgcagacgtggaggggagagaagcggtctgtgtggtaagagcagtactaggactggcagagcaacgagacggaaggggcctgggcccctggtgctggccccgccctttgggcagctaacgggagaaagagtcggctttccactcttgaagctgccagccggcatctctggcgtcgcaaactccgctgaacaaaacctggccctgctgaggactaccttacccactccctcagcctggattcagtgacacttgctcctgtggactttgcccaaacaagatactggggtgagtttttgttatgtgggctgactttgtttttttttcttatttaagctattgtattgtgaagttgctcagtcgtgtgtgactctgtgcagtcccatggacgttagcttagcaggctcctccgtccatggaattttccaggcaagagtactggagtggcttgccatttccttccgggatttgaaccttggtctcccacattgcaggcggacgctttaccctctgagccaccagggaagcccaagctattttattagatacctgcaagttgtatggatgtgagagttggactgtgaagaaggctgagggccgaagaattgatgcttttgaactgtggtgttggagaagactcttgagagtcccttggactgcaaggaggtccaaccagtccatcctaaaggagatcagtcctgggtgttcattggaaggactgacgctaaagctgaaactccaatactttggcctcctcatgcgaagagctgactcattggaaaagactctgatgctgggaggcattgagggcaggaggagaaggggacgacagaggatgagatggctggatggcatcaccgactcgatggacgtgagtctgggtgaactccgggagttggtgatggcaaggggaggccttgcgtgctgtggttcatggggtcgcaaagagtcagacacgactgagcaactgaattgaactgaactgaactgaactgaagcaagttgccagatccagttgtgatgaagaattttcttagaccaccaggcagccaagcccttcctaacccctccctgaaacgtctgcttccactgggtgcttgtctgagagcccacaaccagcatcgtgtgccaattccaaaatcctaacacagcattttcataattacctagaaataacatcctaatacattgccatgggttgatctgtctcatttgttctgccaaaatattctttgcatcctaagtactactgaatagacaccctcatggcactgcgctcatttcatcacgaacttacttttccccatgctcaattagttgttcactgtatccgactctttgcaagcccatggactgtatcctgccaggctccactgtccgtggaattttccaggcaaaagtactggagtgggttgcgatttccctctccaggggatcttcccgatccagagatcaaacctgagtctcctgcatctcaagcattggcaggaagattctttaccagggagccattttggaagaccccaattttcccagagaggtttaacttaagagttaatatcaaggacctttacatagctctgtgccaccctggtatatccaaatgatacaaccgagaagcatttgtcaaaagtagagtgtattctgaagagacagatgcttacattttttccccttaccttgaactaaacactatttccagagcaaaaattacagaccagctttgctgcaggccacagcagcaaatccaaacaatagctttcctggcagccctaaagcagacccgtgacccccagcacccgtcatgacccccagcacccgtcacttctgtgggttgtcctcactgctcttctctccacaaagaagtacattttccaaaggacaaaaataagcaagcaaggctgtctgtcattttaattcttcatttttctgaatagaatgtttgtcttggtctattaaaaactacagggccactcattcggaatcccttcattaacgggcagcattaagcctaatcccttttgctattttgaagaactgtcttctgtgcgtttaaaagcatgctctcctggtgaggttaaaccctccacctctcagcactgtttcattttgctcaagctcctgacttctaggtacacagggcatttttatgatgtcactgtaattaattagagaacagaactcatattgtacctagagaaagtattcttgtattcactccagcattcttgcctgtgaaatcccatagactgaggagcctggcaggctacagtccatggggttgcaaagagctggacacgaccaagcaactgagcactcaggcacccatattgtatccaagagatgaacatatgcaacagtatttttaagctctaaagaaaagtacaaacactggctgcctttattatccttcagtacctaacacatagcaaaggctcaatacatgtctactggacaaacttaaatgtggacaaataataaaggaacaaagagaaacatttcattaaaataataatacattaaaaatatacaatctcccaaggtgccagcattgctg

SEQ ID NO: 63831 - DNA, 1321 bp, Bovine  19866880761890
aggaaagaaatatatggtttgaaagaagaaagaaatacatcagagtttggtagagagggaaggaaaaacagcattcagttagaactccacagactaataacacgtacacaattctattgtctaaaccacttaaaaaacaaattgctaagaagagattattgaaaaggcgctttattgaagacgttagattcttccactgaacatttattggaccccattatgtgcctggcactggaaatatccccactatttgttaattgcagtctgtaatcacacaggggaaagcactgtgtattttcactaagactgaatagctagggccaacaaatttaatatttaaatgaaatgactaacctccaggagagatacacagtgagataatccttgcttaaggaaaaagcactctttatgttccttttggacagtaattggtcttgaaagcaattatttattgaacgcatatgtgcccaagggactgtctggaaaatggaaagtatttccagacttgaaggaattttaggaggccttgtagataagggatggatgcatacatcagcattgcattgcatgtatgtgggctcagtcacttgagtagtgtccgactctgtgtgaccctatggactgtagcccaccaggctgctctgtccgtgggattctccaggcaagaatactggagtggcttgccatgccctcctccaggggatcttcctgacctgggaattgaacctgcgtctgcctgcgtctcctgcattgcaagtgtattctttacccactgagccatgtgggaagccccagccttgcattggtagatggtgaatgtgccttgtgcatggaaaaaactcaagggctccctgaggtcttctttggggagggtgctatttccctgcagctggtaggcaagggagttatcagaacacatttgacaagtcttaacatttctatttgtcaggttgaaagttagtacaccatccatgccaatgcatgtttagacatttatttttcttatattacactctggagacaagtgagaaaggaagtttgacaagcaatttgtgttatgtcagttacaccaaatcacagcccatgtctgcccctctaatcacacaaagcccatgaggcgtgaagttccaggggctcatgaggttaccgagaagtatggaaaagacacaaggagatgttagcaagcagaatcttctcatcagtaacttgctatgactgtcctgtggtgtttagaaagtaactcaccttcacccatctgtaggggttccctggtgtgtgctaagtcgcttcactcatgtccgattccttgcaatgtcatgga

SEQ ID NO: 63832 - DNA, 2346 bp, Bovine  19866880884589
cccatttggcattccaatccattttattaattaacttttatcgttttcaactgaggtatagctgatttacaatgtggtgttaattcattttaattcattttttaataatgaatggccaggtcagaagtcagggcactaaacaagctcagtcccaaagacttatggaacatttatgagtcctttgcaaaaagtaaaaagttcaaagaaacttttacaaaatgttattatttattaatttattttttggttgtgctgggtctttgttgctatactccgggttttctctagttgcagcgagcgagggctactctccaggtgtggtacgtgggcttctcattgtagtggcttctcttgttgcagagcaagtgctctggggcacccaggtttcaatagttgtggctttcaggctctagacctcaggctcagtagttgtgtcgcatggactgagctgcctcaagacacgtgaaatctttccagagcagggatagaacctgtgtctcacatcagcaagcagatacttaaccactggaccaccagggaagtccgaaagttaaaaaaataataattttttttcagcttgcatggtgaaaacatctaggaaatactgcacattaatcttcctcttggtgtcacaaagcaaaataagttgtaaaatttctgagaagtcctgaaatatcagtagctctgtacttttgtttaccctagactctcaattctagagtttctgagtcacgtttgactataaaaccctttcttcccatcagacctgttgggtgcttggtgcttttgcagagaaactaggcaacactgaagagggaagacactggcattgaatgcctgacatctacagaaaccaataggacctacaacttctcttcaacacctgagacaccagccttcatgttcatcacccgacctgtctctttcctcagttcgtgagaagaattctagaggtcattaagacaagctgacatcagaaacgatcagtcagcatctctgagaaccttgtccgtgatggcaccacagatttggtgtcatctgatttcagctttaacccaatttttagcaagttttgacaaggctaacttaattagcaagcagacgatggcagcaatgcaacaataaaaaagaaagaaggctcctttggatctccaaggtgatgacgcatttctgctttggttccaacttctgcttgccatgagtctgggacttggcattcacctcctcgggccagatgctaaattaagtttgaagacattcaaggtattcattattgattggggttttggcagcaacagagagaactaaagaagcagcagctgtggtttcaaaggtaccatctctaagttaagacttgccaaaaataacaaggaaactttccaggtcatctcctcttggagggatcaaagtcagctgccctgggctcttggcagaaacaatcaaggaaaacagtgctcccagtggccccatcgctccctgcatggaagaaaagaggagctgccaggttgagagttcacattaagtagcaataataagcctcttaagaagtggatggcaacccactccagtattcttgcctagataatcccatagacagaggagcctggcagtctacagtccgtgggttcacaaagagtaggacacgactgagtgtctaaacaacaaaaaaaaaaagagaagaaaaatggctctctctcacttgagaaccacatctgtcacaatattttggttgcacgtgactgaaaccttgacccagactgcaacaagcaaaatagaattaatttactcatgtcaacagaaattccagaagtcagcaggcttcaggcatggctggattcagaagccagataaaatcaccatggacctgcttctctctatctcttaactctgtctccagggctcctggctgtaataactaggtgcagatgtcataaactctctaagaaccttgtcctctcaactgtaaatccattaagctggaataactccaagaagcctcagcgaaagtctcagggcatctcattagtcattatagggtcccaggcttatccttgaatgagttactatagatggaagaatggaaagctctaaagatacaaactgtttaaaaattattacaaagcaagcaccacactaagagctttcctgtgtatttcttaaagcctttttaaaatcccaacatacctgtggcggattcatttttatatttggcaaaactaatacaactatgtaaagtttaaaaataaaataaaatttaaaaagtaaaaaaaaaataaagtgcaaaaaaaataaaatatacttttaaatattttttaaaatatttgatcttatagtcaataaaagaga

SEQ ID NO: 63833 - DNA, 1167 bp, Bovine  19866881516297
aaataattaaccttgaaaatggagaatagttgttctttccacggaggatattcgctggcacccaaaatagatatgaggacagtgtcagccagtatatgtttttcctctctttgaaaacagttttggaacttctttaatctggtaagatttagttggaatctaaacaaggatttctcaataggcgtagagagactctttagttctgaagtaacaaatacatgtttttttgtgtgtgttagctgtccttgaaggctcctggtgcataaaactcgtcaattctaatttactatgagtgacttgagatataaagaaagggtggtgtaaatccttggagcttttaagcaactcaagttcatccactcattcagcctaggacatttacagcttgtacttcaatcacttcatcaggaagctattttttaaatgaaagttaaaatttgaattgttgccatgcactgaaaaaggtaaccagctgagacactgctcacttaagaaaaatttgattgctcaaaattgtgccagttttccagtcatttttttaagtggaataaacctgttgatgtaatcacaacgaagcagagaaagaaaagattccaaattagtggtagctatgcaaacattctcctcatttcaataacaggtatcacagagaaaaaaaatggaaacagactattcagcgcgtatgcgattgaagaccaagacagattttccctaaggataaactcacagttcctcttcactataataaaacaagcttccatctatttttaaggtaaactgtttgttaaaagagtcattaaaacaaattccatcaacaattccaaaagctattagaattaaatatttagactaaatcttcaaggaccaaaagggagtatttgcaatttaatgcaaaaataaataccacctgacacaccagttatgttcattagtttgtttcagctccggtgcctctaatgaaatttaattaaattgatttggctacttaaaggtacagtatacgtaaggataagtctttcacagtatgtaccatcttttaagggctccccaggtggcgctagtggtaaagaacccgactatcaatggaggagacacaagagacttgtgtttaatccctggttcaggaagatcccctgggagagggcatggcaacccactccaatatgc

SEQ ID NO: 63834 - DNA, 1227 bp, Bovine  19866880431567
cggtaataccagtgagattcaagattacttgcagcagctcaccggagccagaacggtacctcgggtcttcatcggtcaagagtgcataggtggatgcacggatctagtaaatatgcatgagagaggggaactgttgacacggctaaagcaaattggagctctgcaataattacagagcagacccagactgatatccccccttggggacaggatggcattgcagataatgacagcagttcctggaggatggacctggggtgactgtacccagttacagcaactgtttacttaaaattctgaaatattttaaccgcaataaacggggaagggaagtcaatggcttcttttgactcagtattaaaaatggaccaacttgcccaaaataacaggtctgatggatgtctcgggtttcttgtggattggccctttgggttcccagggaccatgacaagatatgcttaggattcactcactgacccaaaagatggtccttctctttggcacatgttcttacatggttctcacaagggtctcttctgagctgggctgcctctacctctaacgcctgtgtttctcaaccaagtgtatctcaggccccaaagcatgaagctagagttggttttctgctactgcttggaaattattttgttgagtttgacttcctagaatttgtattatgaaatcaacaggcattttgaatgtgctttttcaaaaggtgtcttcccaggccaccatctccaccccaccccatcccttcctgctttgaaagtcactgctgtgaaccactgccctgaaccctgacaactcacagatctcacaggaaatgttcgacggttctgtctgttctgtctctcaatccgagagaaaccacgtgaaaagttaagcacagttggtcttcactttgtgctacagggatcagaggtctaaatgtaggtgcggtgatcatacggcaacactgttaggtcagacggtgtccagggaatcctggacaagcatatattgtttagatgacacccagaaggaacacacaaacatttaaatgttacgcagaaaacctgcatccccctcccgcaaaaaatgtctgaaaacagccaaatttgggaaacactgttctggatgattttctctctccccttctcccccctcactttatgagaacttaagaattccttattgtgaaggattctagaattgcaagactgttaatttctttctgtagatgcaagt

SEQ ID NO: 63835 - DNA, 1787 bp, Bovine  19866880489894
agcagtagctgtgttctcaactgtcaggcgtctgcgagtgtttcagggagacacaagttttccctctgtgaacctgtgcgttttggtgtttactgagcacgaacataggcactgactggactgcgcagtgctctgtccagaactcaccccacctctgggaataacgcagaaaccatctcagaacggtggcccgatgtcctgagcatccctgcctttgtcccagggctgatagccagctcagccccaggctctcttgctcctgagacggtgggttctctttcctgtgatcagaagcaaaagcgctgcaaaccgacgccaccagctttcagtcttcacgcctttactttctctcttctccgttctggttaaacgttttttatttctgttgccaagcatggctctggctggaagaactaacaaaatttacaagtgcccccaccttaaccgtcccctcgctctccctgcaccacctctgccaacctgcccagagcccagcgcgtggctcgggctctcagagttccccgggaggccacggctgagcaccaggtttcaggtgatgtttctttgcaacccctcgtgttcttctgctcaactgaaaggaccacgtcccggcctcgccccgccgctcaccggtccacgtgcagtccccacgtcctgtccctctgccgggcacagcctccactgcccctgctgctcctggtctctgctgcctgggacccatcccatcccccccgcctcggctcccacctcctcctgaagcggtttctgccccccgtcagggtctgcgtctctctgccttgaaggcgtcccgaggtccaggaggcagcgtcccaggttctcaggggcagcacacagtgaatgggagcagcgtgcctcccaccaccagcccctgctttctgccccaccccggcccccccacgctccagtgcctgtcggcccccagtgcggcgggctgtggcagcgatggccgtctcctagctgtgaccccccgggcctgcttcgtgctcagaagtggctcagagagacagcacagaattggagagattccaaggaccgagaaggggccctccctgagcacagggtatgaaggctcagggacttgaggtctgtaggggccagagtgacagaggcgggctgcagccccacatgagccatgagactcagcctgctcatttctttgggcttccttcttctccgccgtgacgggggcgatcatttgagaatgaagagtggttacgtgtgaagtgtttacagcagccccaggtacttagcaagtgctgggcccaggtcatagttcataaaccagcatgtagacaaagccgttcagtggagggcggagactgagctttaggagaaccgaaatcttgatgtcacacccatgatggcgcagtattactttttccccttccagaacatcctccacactctcacagtcagcccctcgcttctcaagagcccatccctcttggccctgcaaggggtacactcctccacaaagcttttccaaagcccccagctggaggcactgaagacaatatgcttcaggaaaagcgagagagccaccttcctgtaactcgcttccttgccaatcagcgcatctgtgatgaaaggcgctccttccggaaggttcatctgcgctagtgttcacccaggaacgtttgcctagggttttactgcttgaggatgctactcggttagatgcaactaaaaacataaattacatctcaaactgaaacgtgagcctgcttgttctctgtgattgagctaagctgctaagcctaatccgt

SEQ ID NO: 63836 - DNA, 2159 bp, Bovine  19866880841197
aaagaataaaatcaagtagacccgggactgagtccatctttgctggtattttgaattaattttcctcatcagtgctgggaacacagaacagcaattctacaccttgttttgggggagccttatgctcagctaattaagtagttcacaatacaatctgatgcttatgtcggtgaaccgcagtctagaaaagtgtgggctttgaagccagatggacctgctcctcctgctgctggctgcggggcgaggggcaagtctcctaagcctccgtttgctcgtctgtgaagtggggatgtcatccctgagtgctgttctgaggatccaacacaaaccactgcttacggtttatgtgtctggtgcagtgaagggctcaacaaatttaactgttagaatctgggcgcctactgagagtgtctgcccactgaagacactcagcatctggtgcaaagtgggtgccagtggtggctgttgggtctccctgccttttcagagcatcctgatgctcccttaaagacaaagaaccgaagacgctcaagtctgcaaagcttgtttctgcatcccgcccattttcttccctcccaggcagattttccggctacttcaaaatgctccctttaacgtctgtctcccacacttccatatcttctgcctgccaacctcagtattttaactgtggctttaccgcatctgtttttaataacctctgttcaccagtttaaaaccctcttctctcttcatttaatatcacttgttggagaaaagaaccggaagggatggatgttcgttagcatcgggtcctatctcctccccaaacacaggattatgagagtctagagagttttcacagaggagtcatgaaaattcacaaaaagcgtctttaaaaatggagttctctttcccacaatgaaattgactttattttgaataactcttgccagtgtttaagtgatgcaattcttaacttcactgtttttcttaccaacttccactcgtctctcagccctggaaaccccaagactctcccttagccctttcctaaacctcatgttcctaaatcatctgcagaagcacttcaccccacccaagaacagggtattagagtgcctaataccctttatgagtcccttaatacccataaataatgaagtatttatgggacaatcactttggcgggggtggcatcccaggtttcagaatgatctttcccacagacacttgggcgttatccaaaatcagcatggccagtatccaacgagacctcggaggcgctctccgtttcactgtgccctgtcagctgcatactgtatagagctcgatgcatttgtaattactgagtttcctttgaacctgtcactgttcaccatttccagttagtgggtcttaatttcccagaggaaaacctttggctggtcacaaagttcaacctcatttattacacagctaaagaagaaccacttctttgcctactgatgggggatgaccagagagaaatcaacaagagtgggatccagtctccacccatcccatcgggagaggcttgactgctctgtgatcagactggaagcagtttctaaaaagcagtatcacacaggacacagctctgcagctctttcctaatttcctgataaagagccaggtgacaaggtcacttggttcttacgtctcaaagaggcagggcggacctcagctcttaggtcggtgacgaatggcgggtgacactcaggctggacggggtgggcacagggagcacccacggctcttcttcagccagtggctggcacgtaggaaagctgacccagcacggccagatttctcatcttccaagagaaatcagaaatctacactttggctggaaatctcatttttaaaagttgaccgctgctttgagtcttctcaaacaccccacagcccatgttagcttcctggaactggctgctacaggctcataggagcatatattctctctacacctgctttcagtgaattcacgttcatagcttgaaacgttcgtggccatttagggaatatttacatcacagaaacaggcaaatgctgcaatgcaagtcaggctcttgtttctttgctctttaagctgccaccaaacatttctcagcacatctccacctgtgggccaaacaaatcatgggcacctctggccaaag

SEQ ID NO: 63837 - DNA, 1376 bp, Bovine  19866880158639
ccagtattcttgcctggagaatcccatggacagaggagcctagtgggctacaatccacagggttgcaaagagttggatacaatgaagcaacttaacacataacacacaccattaacaggtaagaacaaccaatgcacacttttctacagatggatttacttcactatttagaacctgatatacccagtcaagggtggtgggaggtgggaagcccaaccaacccagcactctcctcctctcctttccactagctctcaccctctaacatagtttaatgtacttatttgtgatgtttcttccttgtctccctccatttaaagttccctgagataaggcagtgcccggcacatagcacgcactcgagaaatattcacagaaggaagtcgggagttgctctgtgcccagtggcgccctgagactgcttgtcctgggcctgtggtggacacagaaatcacgagccaatgtccagacactctgagagctgccgggcatctaaatgcatggtcatttttcctgtggttcatctttatcgtattttacaaaagcatacgtcacatgatggattggaaatgaaaaaacaaaacaaagcaactggtcctttgccacaggtggcttgagaagcgccagaccagcagacaagaggtctgaaggcccgggacacaggaaaagtgaacttcttgctgctgctgctgctgctaagtcacttcagtcatgtccgactctgtgtgaccccatagacggcagcccaccaggctctcctgcccctgggattctccaggcaagaacactggagtgggttgccatttccttctcccatgcatgaaagtgaaaaagtgaaagtgaagtcgctcagtcgtgtctaactcttagcgaccccatggactgcagcccaccaggctcctccatccatgggattttccaggcaagagtactggaatggggtgccattgccttctctggaataagtactgggtgatgtgctttaaactcaggttgtctgcttcaagagggtgtgctgttttcactgctatggattgcctccaaagggtttatttaatatttattacgttacttacatggactagttattttgtggatcacaaacctatgcccagaggtcataataaaaatgaggcagagttgtaaattattgatacatttgctttgagaaaatattatttgctatcttggagcagattttactgtagctcaactggatgagtgaaagacagaatcagtgggtaatgggcttcttgtgtgtgctcagtcacttcagtcgtgtgggactcttcgtgaccccatggactgtagtccaccagctcctctgtccacgacatttcccaggcaagaatactataatgggttgccatttcctc

SEQ ID NO: 63838 - DNA, 2807 bp, Bovine  19866880426189
caaacaatttatactagtgaaaatacaaacagcaaaatggtatatacatatgggaaaatattaagtcaaaagtcataaaaagtcaataaaacaacaaaataacatgtttggactatgaacttatctaaatttaaaaaacatgaataataattcttgcaagagtattttctcataaactgctatggaaatgttaatcacaccgtcctttggaaagtagttttccaaagtgtgttgagaacctgaaaaatagtagtattttttcactcactgatagaaatttatctaaggaaataaactgaaataccttatgcataagaatgatcctggaaacacaaacatacatttatattactaatagcttaaatggttaacagtaagaggatggttaaatgagatgagtgattatggaaacatttaaaatgatgttttcaaagagaatgttatgatttatatgaaaaagaaataggtaataatgtatgcatatagtttggtttcaattatgcaatgacagcacatatacaagatagattagaagaatgaataaaagatattaatggcagaccagtcagtagccttgcttcaatatatttacagtagcaggatcatattgttgctattaaaatttaataggtttactttacaggagcaggtgttactgcccatccgtgatgataagaatttgattgaacaataatgtcttttctgccatttgttaactggctttggaaagcagctattcactctctttccacctcagattcttggactcttatgctattagcaacaataatacctcagtctcaaggtcattgaaagatagaataaagtatgaatgtggaaagtgtgctgtaaatggcatttatatgttatagttttcattaaataattataaaatatttaataatttgacaaaaacttgataattccataattatcaagtatcctagtcctgcatgggtctatggctcaattctactgccacagaatcagtcatactaataacttcatggccacctttgagtgctattcctgtaaagtttgaaaatccaccagtggtacagatttgtctgtcaacatcaaatcaaagttatattcatgtcagcaagttattatacacagaaagagctgtcaggttgttaatatgaaaagcactgactaatttataaaactattcagttgaaagataatggaaaggcaagctgccaatgtgaagagcaatgtgcaaatgagaactggagcctaagacctagaaaatttatcagagaaagacttgaaagattttggtgtaaaagacaaaaatgacagacacaaaactgaagggcgtcagacctttgagcaggctattttgattgaataattatttttagtctttaaaggaatctttaaaaggaatgtttttcattgtctgggtacaatgtgttaccaataaataagggaataaaacccagagaggacaaaagaagaaggagcggactcaagtgcagtgtgagaaaccgcctctgtctagaattctggagcttgtagactgtatccacggatggggcttggatcaccaccttctttaggtgagtcttgagataagtcttttctatatccccatttcccttgccatggttaattgcccctcaaagttaaataggactgcaaaacagagcagaaatacgaagctcacaatagataattacagtgtaagggcaggaaaggaagaaaaagaggtagagtaagtagaggtatgtttatacatttggggaagaaaatgtcagcgtgcgcacttgacatcacactcctccctatggtcaaatggacacaaccaggcacctgctgtaactgttgctctggtttccggtgtaagagaatcatcttctctatagccttgttctccagctaagcatatgaatggccaaaatatctggttagcatggctaattctattgaggctcttgccaactaattttgaaaaaaaaaaaaaaaaaaaagcccaaataattaactgacaattaactgcatgtatcattggtcaacaattggttgcacttcttttccttgaatctaaaatcaaagtaacttaagagtgctggagtagtttatgcttaatctcctccttgataccaaattccctacatccaataaattttactatttactctttaatataaaagcaatacattctcattaaatttttacaatatagagaagtagaaaaaaatggttaaacattatggttctgttacttaaagctccatgatttttcatatgttgtatttctatttgtatttttgcatatttatgcttagcagtataatttatactttttatttaataatgttactatgtgtttcttaaatgtatatcttaatgactgtgttgtattccctctggttggtggtaccattaacactgattcactgaattattcctcactggatcactggttcagtgaaacagtgaacactggttcactaccatatggagctagattgtcctgctgctactatgatatatacacacagggctaaaaatctttgtatataactcttctatatggctgtaattattaaatattttcttagggtttatttcaaaaagcagattattttctaattatttttgctaacagttgctatctgaatcattctaaaccacattactggtctatacctcagaaactattagataattgggtgtgaaaggtttttaaagcctgtaaaatgataaaatatatccttcttattccaaagccagcaagtgtttaagaaacattagcaccattttcattaaagtaaacaataaaacataagtatcactta

SEQ ID NO: 63839 - DNA, 745 bp, Bovine  19866880449042
aatccttatgccctactggcttaagctctgagccttattttctcctcctaaaatggtgacaaaaacagcacgtatttcttagggttttccaataaaaattacttgactcaattcatatgaagaactaaaagagtattctcgtgttttaagccctcaataaatgttagccatgattattaattaaaatatatatatatatatatatatacaataaaacaacaatatggactttaaaggcagatctaaaattgtttccaacagatgtgcttttatgtgcttcgcatgcaacttcctggcaggtgacaaataacaataaacttaattaaggggtgacttttctggtcagtataaaggacagagcagttttaatcctggcaagaagcagagtctggaagcttttcatatttaatcattttctttaacatgaataagtcgagtgctccattagttctggagaggagagtataatagaatcagttctataataggggcattaagccctcctgcattataggaaattgttgaaaaaggctgccaggctctgatttccttgccaaaatagggctacagatactcaacagtaacatccatcctgattaaaaaaaaaaaaaaaattactttaaatagcaagaaattcaaatggcagcatagaatgggaatgtcagttttgagcaagagtagaaatcaaaagctatagacacactccgttcttaaagcaggtgcttattagcactatcgctttatt

SEQ ID NO: 63840 - DNA, 1760 bp, Bovine  19866880449486
atcattccccaaactaaccattagcacagagctaatgattaagcaacatttataataataatgaaagcacattagaagaatgtgttgacatctttcaaattttgacagctcctaaaaaataatttttattttagcttgtctaattaaatggactacagttgcttggcactgacctaaaaatctgactaaaaattataagctcataattgtatgaaaataaaagagaagaagaaatagaagagcataaaaattataacacattaaccaagttcttgataagtaacataggtttcacattcaaaaccctagttctggtcactggtcttggctctttgccctgaacctgctcaggtaacctccaggtgtgaggcagaccctggttaccaaacagcagttccctgaagtcatctgccaacaagccttgactttggagttctggctgccctagaattcccaggagccctgttagaacaccctacctcattaccttgaaccttttaaaggtaactacttctctgggctatgatatgttgatgcttaccctccttctggcccacaacccttgttcatctttaatcaacatgaatttcacaatgtggacaatatttctaacaagaatttcacttgcgcttgaaatgtcctacctagtggcatcttattcccccagatagattgttctgagatattaataaaccaatcatcaactatttttgcccccttagctcatcattagttaacttcaaaaatacaaaagaatttgaagttacctattctctgaaaatttaaaataaataaaataccatatttatgcacaagaaaccatgaaaagaatatagagcaagggtaaaaagttgcgtgtgtcctccaaatataggataattttttaaaagaagctgtctctaaacttcctgcatataaacattgtatcttgagtttttgagaatcacatcctagccctaattctgctctcaaactaaacagaagaccttacctaaactgctttgcctctcagagaccccgtttgttaaaagagagattgaattaaatcaatgttcctgagtagagaggggatatgagaaccatcataaagaatttctaaactcatatcatccatcttattgtctagagaattcagacatcatctgccttatatctccacatgagagcacagcagaatatgggagacctgggcaaatttcatttgaaacagcatccccatgtaattctattattgctccctgccttcaattgccactgacctgatggtcttcaaggacttctctatttcccacattctctgtttccagaaaaaacagcactaggacttccctggtggtccagtggttaagaatccacctgccaatgcaagggccaggagtttgatccctgatccgggaagattccacatgctacgggcaaccaaacccctgcgccacaactgccaagcccatgtaccttagaatctgcgttctgcaacaagagatgccacgaaaatgagaagtccatgcagcacaactagaaagcagcctcagcgccccaaatcagagaaatcctgtgcacagcaacaaagacccagagcagccaaaaattaaaaattaagtatttttttaaaaaagaaatacacttcttaaaaaaaataccatactggaaaaccttgatctgtacccttgatatataagaaggctttaagtaggcagaggcagttattctcgagcctttgcgcacataaaacttttgatttagagagcatttattcagta

SEQ ID NO: 63841 - DNA, 975 bp, Bovine  19866880562019
ttccttaaaggccagggaagtgtcttatcattctcttatatccagctggaagaagtaagcccctggaccttataaaaagaattttacctgtgaaattaaagttattgagagatggtagctgtcatttaccttaagctcatcttcgctcaaccaagctgacctttcatgtgtttatttagctcagatgtgtctctactcagaaagctcaagacatatttgctttgtacctagaataaagattaagtatatataatcactgagcatttcctaggccccaaggtagaacagaaactcatcagatccactggacagactcttctctagggtagtaattactgactattacaccgccaagactatccttgtcatttccttctgtagaccacatgatttgaaaaattttgtctacaaacaggcacatattaaggaataatttattttcttttttcattaatctaatagatgcagctgtcagtagtcagaactctggatagattgagataaatatattacaacaatggatttgtacaatcccagcccaaagcaaagaatcttaacattttaattagtctgttaatgctattatgaataaacgtgtcattcctattttatttttagagacatcaaaaatagctcataaatcctcattactatcctgggagctactagacgaggacaaagctcccagaccatccatccctctttgattacctttatccctcggtatttctcttttctagtgccagattgtgaaataccagtgaaacattctggcgcatcaaacaattaatgccttacccatgtcattgtctaatatttcatgtcttcattcctgcttcccaataaagtattaacatgggttcctaaagtggtaacacccctcacccctagcttggccctgatgcccctgtgcttgtgtacaagacagcaaaagagacactgatgtatagaacagtcttatggactctgtgggag

SEQ ID NO: 63842 - DNA, 833 bp, Bovine  19866880662487
attactgtcctcaaagtgccacaatgccagtaataaaatattcctccttgaaaaaagtcttttgttcctttaaattctaaacaattgctgcggttgctacttgattttagcaatatatctgcaagctacaaattagcacattttaattcttatccgatattcacaaacattgtcttctacatgggggaattaattcaaagacttccttgttatgtattcatcccttgacacatgggagctcagcctcatgcttttgtttcaagagtaagtttataattgttcggaattacttgaagtacactggtgcttgagttcttgtcttcattctttatgatgcaatttttgcatttaaacagtagattagatataacaatgctagcataatgaattgtgaaggtgaagaaacagaacttgtgttatgccaattctgtcatgccatttgacacttggaaattttacatttgtgttttaatttaaaacagtgggaaattaagtgtgaattttagttcatatctgaaatattttactcagtttgaataaagttttaaaacattttttttaaaatttcagctttattgaggtataattgacaaaattgtaagatatttaaactgtacatcacagtggcttgacacaaatagacatcaagaaaggattactgtatctcattaattaacacatgcatcatttcacttatctatctctccccgctctctctcctttttttgttttgttttgggtgagaccatctcagttccgtcttcccagcaaacctcagtcatacaacacattttatcaactagagtcaccacattatatgcggctcctcagat

SEQ ID NO: 63843 - DNA, 2638 bp, Bovine  19866880690008
atgaacgcgtgtgtgtcaagtcacttcagtaatgtctgactgttcacaaaccccatggactatagcctgtcaggctcgtctgtccatgggattctccaggcaagaatattggagtggctgccatgccctccttcagggcatcttcccaatcccagaatggaacccttgtctcttatgcctcctgcattggaaagcaggttctttaccactagcgccacctgggaagctaattatgaatagtcctatacaaaatagatggggaaacagtggaaacagtgtcagactttatttatgggggctccaaaatcactgcagatggtgattgcagccatgaaattaaaagacgcttactccttggaaggaaagttatgaccaacctagatagcatattcaaaagcaaagacattactttgccaacaaaggtccatctagtcaaggctatggtttttacagtggtcatgtatggatgtgagagttgaattgtgaagacagctgagcgccaaagaattgatgcttttgaactgtggtgttggagaagactcttgagggtcccttggactgcaaggagatccaaccagtccattctaaaggagatcagtccttggaaggaatgatgccaaagctgaaactccagtactttggccagctcatgcgaagagttgactcattggaaaagactctgatgatgggagggattgggggcaggaggagaaggggatgacagagcatgagatggctggatggcatcactgacccgatggacatgagtttgagtgaactctgggagttggtgatggacagggaggcctggcgtgctgcgattcatggggtcacaaagagtcggacatgactgagcaactgaactgaactgaactgatacaaaatagagcacttgcctttaaatgaaattatttgctgcattttatgatgtgatttcatcatatccatgtctgcctttttacttataacaaaactattttggcttttaaagaagaagtcaatgggaaataaggttaacatttttgctggaatattttgattctgtatattgaattaagtgatggggcatcagtattaggctaaattcctatttgaatcattggcaatatgactcttttttcaagttagcaacctgaacacccataacctgcaaccatatgtactttaaaaatattttctcgaatgaattgaaatgggaatctgaagattgtcagttttcctttcattacttcattatcgaatgatctgggataaggatgtcctggggctttagtttccatgtttttaaaccaggattagtagtgtctgcacttaggatttaaactcaaatggaataatacgttatcagttccagcaatggtgaatacgtaggtaacttggattatggtgacagcaataaaaaaggtcagagacagctgtggggcagaaatgaagccttccatgtgactgtggaaaattaattcatctttcaaatatttctgaaagagtagttatgagttaagagatctataagaaatgaagaagggaagcagacagatggcagccctttgctcctggaccagggttcttacgtaagacctggtgaaacaggattcagaccccaggatggccagactgtgctctgaggaaccaggaaattgggagcatctggttaaagtgatgaatgtgtggggaagagaaactgaagcttctggatggcagattttgaagcacaggtgctatcaactacattatcacccaaacctgaaaacttgaagctaaatatgcacagagctttggtacatgacatatggtgtttcaaatataaaacttatagaccatctgtcagatctagtggggctttagtctggaaggatgactgaagattggagaacctgctacatttgcacacccagaagtaacttgacaatacatattaatttactggtcatcacagataaagtgtagtttctgtagagagttatagggaatatggtctggtccttaaaaagataaagcaagacaataacagaagggcaggcagagtgcatggctttacattgcttctagttcttaagcttcgatttcatggtccatcatcacgattactcttgtgcatttgccgtaaatatccttgtcttccttggccccttacatgcttggcaaagtcacaaccctgaaaaatagaatctctctgcctttccaaacttgcaatcatgcaactgaatatctctggagaaaaatacacggtcatgtcttgtcttactttaaattcagggctgtaaagctcagcgggttcttgaaatggttagagtgagagaatgaagtcgctcagtcgtgccgactctttgcgaccccatggaccaggctcctccatccatgggattttccaggcaagaatactggagtgggttgccatttccttggttaggctattgaattatccatcccctgttccttccctcctcactcacctagcaggactctctcctttcttctctgctttgcatccttgttctcattcccagggatgaatctttatttcactgagaagattgaagtaatcagaggagaatgtcttaaaagcccacatcccagttacctccctaccaacacctacatccataccctcagattccttgctgttcctattaagcat

SEQ ID NO: 63844 - DNA, 1554 bp, Bovine  19866880692458
cactgccctgctcctggcatctcctctctatctgtcttcctggctaatcttgaacatggctcttctctctgattctgtggtgttaccatagaggcagacccggaaagatcatttattttgcttggttatagtagaatttttattgattagtttcagacaaaaaagtgttatattacataattactgactgtgcttttaattttaaaagttcttagtcttaaaaccatgtgatggagagcaggaggaaggacagatagagtgtgtggactggggtgatacataaagacatctgggaaaacaggaggaatgctttgccagtgtatagcctgccactgtctgcatgtaacaagggacatgtgtgctacctggagacagcaccagggagagaggaagggagatttccaccctcttaggtagttaaagtgataaacatctctgtcaatttcatgtcccacagaattacctgttactttgaattcatttaggatagtgcttttacccctaataaagataattttggtgatatgttgttaacatatacaagaataaaaagaaggaaaaaatgacagataatcttaccatccatagataatcactcatacattttaggtgcttctgctgtagagaagtagcttattgaaaagctctttgggaaggaatttcatcttcaactggactaatgttaaagtatcatatttctatcatacttttactctctatatatttatttaaagtgggatttctgtgaagtgaaagtgaaagtcactcagtcatgtccgactctttatgaccccatggactatacagttcgtggaagtctccaggccagaatactggagtggctagcctttcccttgtctaggggatcttcccaacccagggatcaaacccaggtctcctgcattgcaggtggattctttaccaactgagccacaagggaagcctgggatttctataggtgacatttttagttaaattatttgattttgttaacttgtaatttttgcgtttatttaagtccaggaacttggcagatctcttattaactcttcagttgatttgagataattcttaaataaattatttaaatttcataaaagatttttttacttgaataatgcaattatgagttcagagaagatgctgggtaagtatgagaggagattgacaaagatgataaatatgaaaaaaacttaaaaacaattcaaatatatgctgatttacctagtattcagagatgtactttattaatattgatttaatcattgaaaggtctcagtattatttttaactttacttataataaaaatggatactttacattttaaaaagcacatgtggatatattacttcatttaattaatactagaacccatcttggaaggtaacactcacataactgatggaaactctgggactttcagaaattaactccgaaatttacatagttatgtgatgggcaacccaggactcagacttgggactctttaaccaagtcttgtgtgctctttatacagtatcacagataagaataaagacataaatcacttgaaa

SEQ ID NO: 63845 - DNA, 1346 bp, Bovine  19866880752088
aatgtattatgcccatttatttctaaccaaaataaattgtttcaatttttagagaaaaaatatatttgctatggaagttggacattttaaaatattgatttaatgtggtgtcgaatttccaatagtaagggtatctgtggtttctagggctcttaaaataatgttttggaagctagctgtcttcattttccctatttgtatccatgacacagctattaatctttggacagttacatattattaaaatatcttccaattaatgtcttgtcctttcactttctttcctggttaatttacacggaaaagaagcacttaatttgatgcattcagttttattaatcttttcttgtacattttgtttcttatgtgtttgtttaagaaatattttccatcctaacatttaaaatagcgtttgatatttttctcctaaaagatttacagctttgcctttcagaaataagcctcatgtgaggtaagactcaaattctatttctgtcagcatgataacaaattgttagacctatattctcactgactgatgatgccatatctgttgcattatcagcatgtcataaatgcagattctgctctgggctctcgatccttattcaggagttactttctctatgaagcataaataccacttcattaaatgctgcaaatgcagactaagtcaatatcatagagagtaagttcccacaccacattcttcaggcaagttttggccatttttcttttcctcaaatttttagaatcagcttgtcaagcttctcaaaaatctctattggtacttttattaaaattgtgttgaatctctagcttaatttgtagagaacaggcatcttctgatgctaaattttctaattcactaattaaatatctttatttattctattcttccttaatgtctttgaagaagttttataatcttctctacaaaatcttatgcagtttttgttagatttattcttatatactgttatacttttgtgctattgcaaagattatttttgaagtacatttgtttgttgatagtgtataaaaattcaattaacttttttatatcttacagtcagaaacattgctaattaattctactaataagtctaaaaacattttgaaggttttatttagataatcatttttttacaaataataattttctttcttcctgctttgtatcttttattatttttcttttgtaatatcttggctgcccttaatgtaatgaagatagaaaataaaataatcttaaatttctttggaaaaagcactatttattaaggatatatgatcgtactgttcatagtagatttagttcagagcatttgctcaggatttcttgt

SEQ ID NO: 63846 - DNA, 1190 bp, Bovine  19866880845979
tctgcttgtctggggcaatttttagcaccctccaggacacatactttcttctgctagactcttacctcatcagtccttgtggcttggaaaacacttcgtggcctacctatttcagtggtaactgtttccttctatacatttcattaaatgctggtttcaaagtcccccttttctgtgagtctgtaaaaatcctggcaggggaataaaatcagcacagctgcctgttaacttcagtatgacaagaatagttcctaattaaactcttatgtctttgatttaaaactccatttaatcaaattattcaccaacttaaggcagttgttgattacagggagagtataccttgaatctttgtgagttataactcccttccaggcctcatcaagcttctctaaaggggtacaacttgtgccttcttaaggagagctgaaaatctttcaacagctcactccttcctccttgaggctctttcttaaatcatgaagggtctggctgagttccaggtgtagactatcattcttgcttcctgtatatccagcctgatttcagggcctgcaatagctactgaatggtttgaggatggatataaaggccactagacttccctggtggagaaggcaatggcaccccactctagtactcttgcctggaaaatcccatggacggaggagcctggtaggctgcagtccatggggttgtgaagagtcggatacgactgagcgacttcacttccacttttcactttcatgcattggagaaggaaatggcaacccactccagtgttcttgcctggagaatcccaggggcaggagagcctggtgggctgctgtctctggggttgcacagaatcggacacaactgaagcaacttagcagcagcagcagacttccctggtggctcagatggtaaagaatccgcctgcaatgcagaagacctggctttgatccctaggtggggaagatcctctggagaagtaattggctacccactgtagtattcttgcctggagaattccatggacagaggagcctgttgggctacagttgatggggtcacaaagagttggacatgactgagcaagtaccacttccaccacttttcacataaagaccaatgcctctaggttgctaggaagctagttgtaacaagcaggtgagatggcccagaggtacctgatggcacttcactta

SEQ ID NO: 63847 - DNA, 843 bp, Bovine  19866880898181
ctttggcatagtcaataaagcagaaatagatgtttttctggaactctcttgctttttcgatgatccagcgaatgttggcaatttgatctctggttcctctgccttttctaaaaccagcttgaacatcatgaagttcacggttcacgtattgctgaagcctggcttggtgaattttgagcattactttactagcgtgtgagatgagtgcaactgtgcggtagtttgagcattctttggcattgcctttctttgggattggaatgaaaactgaccttttccagtcctgtggccactgctgagttctccaaatttgctggcatattgagtgcagcactttcacagcatctcttagtgtccttgtaaaaggaaacgcaagattgcttgtgctgtctgtcacgtggagacacagtgagaaggggctgtctgcagaccggggacaggggtttcaccaggaactgaattggttggcatcttgatcttagacatcttagcctctagacgtgtaagaaaacaaatttttgttgtttaagccacccagtctatggtactgtattctggcaccctgagctaacgcagcatccatgctcctttttagaaggaaattgaggctcagaaatatgactttaccctttaaaaatggaaattagcttttaatcaggaaggtgcttactagctagatagaagacttctgtcaaggttttgacatgcagagagaagataagactcctagtgctaatcaacttttaatttactttcttgttacacgcattaaggtacttttagaagactccctagttccaaatgtttgtgaaacgttgttgaataaattacttaagtcataaa

SEQ ID NO: 63848 - DNA, 1394 bp, Bovine  19866880924776
gtaataggaataatcacagttgcctaccttatagaactactgtgggaattacataaaatatgctaagtatcagcatatgtaggtatgttataaatataaattacatcaaatataatgataataataatatcaaattttaatggaagcagtcattaatgtataactcctgaatagtctattttcactgaatttctggtaagaaataaaagcccaaataaacaattgaaaaatcctaaatggtttttagggtagtacaacaagccaacaattatttccataatttgaaggttggtgcttaaatgtatgtacttactctgccttttcagataaagcctctctagtttctcctcaaatacttctatatgcaagctgccccaagacttctctgaagccggcagacacaaactgtgtataaggatcactactgcaaagttgcttcaacaaatactccatgctttgctcttcatgtaattttcctggattttactgtattaggttctatgatattcctgtatttgaagctgactggttataatcactgatctctacaacacaacaatgtcctttcccttttcctaccagccctctcagaatatagtaacagagtctccaaaatgtaatacataccttcttattttagaatttctaaattcttattttaggacaaacttggtttggttttcaaacttggatgcatgttggaatcacacgaagaactttataaggtacctatgcctagatcccacccccatagggtataagttacttgacatgggctagagcctaaatattgggaatttttaaagctttccaaatgactctaaagtacagtcaaggttgatcatctctgatggagggatttcatgtggctgcagagatctgaagcctggaaccgaagcattcctttctctgggtggcctcctagagctccccaaagtcgtgttgtccacatgtccctctgttccctaaaagtatctcctttatagcatctctcatgattatttgcttctatgtacctccttaattctgcactgtgagcttctgagagcagtgatcacttttctctcattcccaacacctcacagaagctggcacataggaggtgctccaggaacacatgtcccatcaaactgaaagagtttatcccttctacctctctgaccaaagtaaccaggcaagagcatctctttccagaaagccagactgagatgctgcacatgcagcacctgaagtatcccccagaggaacccctccactgaacctgcccctcaccaggaagtcagagacaggcgtgcatagctccatagctgacagtttataacttgcaaagtgttctttctggaggctcaagagtgaatgtaattaaaacctctgcgtattacctcttccattgt

SEQ ID NO: 63849 - DNA, 1122 bp, Bovine  19866881278622
agcgatgtagctcctactttgcctgtgttccttttagaggaaagcattttaatgaaagctgcagtattctaagaatgtaactaccccatcacatgagattgttctgcactgttgcatgttaaaattaatcattgtgtgtagcacttattgtatatccgggagattactctgtagatccatatttagttaggcttattgagtttggctcatattattaacattattatggaactaataatggatgtatgtttcattttccattggtagggcattctagttataatactcaagtaatagctcaagagatattttcaataaaatgtcccatttatagtcactagtggaaaaataaaacactcactcctctggcataaaaatttaagtttactaaaatgagtttaactcagtgactgaaagaatactgtattgagtcatgtcagctaaatctttgaagaaaaggttagaggagaaaagaactcaagtttgggaccaggacctattggtgaagaattcaacttccaggtaatgcttagttcagttcaattcattcactcagttcagttcagttcagtcgctcagttgtgtctgactctttgtgaccccgtgaatcacagcacgccaggcctccctgtccatcaccaactcccagagttcacccagactcacgtccatcgagtcagtgatgccatccagccatctcatcctctgccgtccccttcttctcctgcccctaatccctctcagcatcagagtcttttccagtgagtcaactctttgcatgaggtggccaaagtactggagtttcagctttagcatcattccttccaaagaaatcccagggctgacctcctttagaatggactggttggatctccttgcagtccaagggactctcaagagtcttctccaacaccacagttcaaaagcatcaattcttcggtgctcagccttcttcacagtccaactctcacattcatacgtgaccacaggaaaaaccatagccttgactagacggacctttgttggcaaagtaatgtctctgcttttgaatatgctacctaggttggtcataactcagttgtgtccagttctttgcaaccccatggagtgcagcatgcaagg

SEQ ID NO: 63850 - DNA, 1235 bp, Bovine  19866881353989
ctgctgggttctgtgtgccaggcttacagtcagaaattaaattcctttgacaaaaaagaagaaataaaaatcctcctagagtaaacacacagagaactcatatctaaatcctgcaaggctggctaaattctaattttatccttttctactacctacactactctttagagtggggtcaggggtatttattactttagtttatgtgcaaactttaattccaatatgaaatcaagtgaagttatttaaaaatcaaagctgatgttaataagatgatctttttcatcctcccaaaagaaactaatgaatcattgtgaatttattgtggtagaaagacagtggctgctggcaattatactgatgagcagaaatcctcacaagtgggtacttaaaagcaattattttccatttggttctaaaaaagcctctgagtacaactaagctttgattacctggcatctgaaaatatacattctcagagggatatttgtgatgattattttagtggaaagaaagtaaacagctactgtttgtgaaacctcagttgtgagcctctttaaagtttaaatatgaatcgtgcaaaagatggagctctgacttaacagactagcacaatactattacattatgttcccaactagaaagagtcaagaatttattgggtttctgaggatcaaaacgctgtttgaaatgcattctctcaagaacatacttcttccaactcaaaagccaatggcatttttaataacagactctccagccttaggaccaaaactcattcctccattttttccttcttggccccaggttcatgaagaatgttgtatcaaaaagtgacaacgcagaggtcactggaacaaaaattgatccctccaagagacagaagccaaaggccatccaaagagggaatcaggtggagtattttgtacttgatttatttttcaagtacagaaaggttgtgggttcttatgaagaggtattaccttcttttctgtctaattcaagttcattggtattcaacggaagccaaaagaccactttttaaaaggagaggagaatgtgtacccaaggttcaaaaccataagaatgagtattcagatttgtaaactcagctcataactccaggtctggagattgtgagtacaaatacagattgaaataatgaactttttcacttgtcttttccccaaataagagaaatattaaagaaaatactgatgatgcaatttcagtagaat

SEQ ID NO: 63851 - DNA, 854 bp, Bovine  19866881383768
ttacctcttccttgtccctggtactggtccctgcctgttgttcagataagacaagactgatgaatgtgaatatgtctgaagttaaagcaggcagtagataatgaaaaaggctgattggaaagtccttatcaactgaagagagtcctaagatatgcagagcaggaggactgcacgtagtccaaagttaagaagtgaaacagctgttgctgcaaactcctcaggcttctcgccactgacacagaacagtcccctcaactccagagagaatcatagtctacggaaaggcgccctctggagttgtacaactcagtagccttaatggcctgtgatgggaagattcccaacacctgtaatgcaaggccactttcactataaacttcaaaacaaaatcacttatggtgatgattgctactttcatcccatatcatcccatatcccatctgactcactcccagacctcacctctccattcggacaatctggtcaattcctgagaacctctacctctgaagtcctgttccaagctcccgtctcctctcagccccgagctctaacctagcgacatggacattgttaaaaccactggaattttggtggatttctatactgcaaatattgattgctgccttccttcgtgttgttaccttgctgtgacggaacaacattagagactcagccttcaccccattcctgccatggcagaggacagtcggtttttaacgcatctatccatcgtcacgcccactgttcaaaggctcctcccaagtcagtagggtgtagcgatagaggtgactgaccttggcatgggatggtctgggttccaatctcaagttcactacttataagtactaaca

SEQ ID NO: 63852 - DNA, 880 bp, Bovine  19866881564449
aaaatcaaagtgaaagtaaaattattcaatactactacaaatgcatactttcaaagagcttatatctaacagatgtcttatttaaccttccatttcattcaacaatctattaatgcttttgataacagtgttccattttcttttcttatatcttttaaatgaaaaccagtagtgccttttcagattggttcttcactaaacattatcagatcttaataattcaaaaagagagaacaataaaaattcaaagaaagagatagtgcttatagatattattatagtaagataagggtggagaaattttatctctacatttttatgaaacatatctttccatgaagaaacctaaaagataattcttaatagtatcaattcatgctaaaagaactgatttctctattttcctgcttcctaccatctacttgcccacgtcaaatccttggctctaaaaatgtcttacttacttacaaataaataagtaacaagaggctgagacactgacttgggaagttggagaaaagtaagaagtaacaatttgaaggttacttgagctccatcctctaaagcccaattatgtatcttataatatagcaaggatatgtttatattatgtggtaaaatagacaaaaatggaatatagataggtagtagtttaaatttactttgtgactttttttatgtttatggatgttgttactttcttttaaaaggaggaggataccaaagatgactctagaaaataaagcacagcagggtgtgacaacaaatatccaaagaccatagaactacagtaatgagaatgtgataccttataagaaaccactaatgttaccagtaacacgaagaagcgaagtgaacggttctatgcagacctacaaga

SEQ ID NO: 63853 - DNA, 469 bp, Bovine  19866882059478
tagttccacactgcactagccacacagtgatgttccacttgttggggagagaaagtgtagacatcagtgtaggaaatctgattcctacgttattgtacatgtcgcttttaggtagacgtgtttaaatgtgattggagattcaattagcagtcagcgcactggagcatgccatgctgtgccacagggtgaagactggaaaaataactaacttttgttagtaaagaacttttacatttagaactttgatgttcgttcactgaactattacaggccagatggcgagattgttattcagcaagagtgaaacaatagaaagaatgtaaatgatctggaaaaattagaattgattgaatgagtacagagtagagcaattctggagaaataggctatggtgttaaaacaaatgtcatattcttaaatcagacttatgatagaactcacaaatgatgttcatctttgtgtgtgtgtg

SEQ ID NO: 63854 - DNA, 883 bp, Bovine  19866882086287
cgacccccatagacggcagcccaccagggctcccccgtccctaggattctctaggcaagaacactggaagtgggttgccatttccttctccaatgcatgaaagtgaaaagtgaaagtgaagtcgctcagtcatgtccgacccttagcatggactgcagcctaccaggctcctccgtccatgggattttccaggcaagagtactggagtagggtgccattgccttctccgaatcacaccactaaattcttcaaatacataatttattaatagctgcataatactggatcatatggctgtataattatttattaaaagattttctatcattggacattgagttttccccctctttttcacaattgattacaatcaattttgtgatgtacattttttatataaaatgttgactgcatttctgattatttttatgaaggtagttttctataagtgaaaatactgggataaaggacaaacttttttttaagattccagatagatattcccaaatgcctttgcagaatactcataccagtattactgttactaaaagtgattaagaacttgccttactccattttaataactcagccctgaatatgaaagtatttgtcagtttggtgggtataaactattattttagtttggttttagtcttaatttaaatttgtctgattattagtggagttgtgcctttaaatcttcttctgtggattgtcctgttcaggtattttgtgtttttgtttgcttttttagtatattgagaataagtattgatttctgtgaatgttttatctataagaatattaatattatccatcattttgttagttatgtacctttgaattttattaatgattcttgaattattttttagtgtttttt

SEQ ID NO: 63855 - DNA, 1849 bp, Bovine  19866880432936
cagccatcaagagaggcccagtgaccacacagggtgagtccaggctgaaggaggaggtgggtccaggctgaaggaggaggggctgcccgagttggtggaggcaggtgggaggatggagtgatggagtgagccctggctgcctgcacgaggtagagagacaaggagaggagggaaccaggtggcagggggcagaggagggggtgagtaggaggaccccccccccagatctacagcgtgggctggtggcctgaagaccagcagcatgggctggtggcctgaaaagaccttcaggtctcttagctttcccacctataggatggaagaagaggttgcggagcctccttgttctggcacgtctctgatggtcacacattagtaggagtctgagcttcacctatgtacctgtcattgtgggcagaccagggttggagagttaccttggcttgtcgaggacaagggttttcaattgcgcttccctgcttcatggggatctgagctgggcccatagggatttgcctggagccaggggtcaagcatgtggtcccacaggtctcagcgcagggcaagggggcagctgtccccaccccagactggcaacgccctctgcattgggcaggccactcatcaggagcttcttatccaccattaatccaggtactgagcctgtcctggtgctgaggctgacacccgctggggcctgcccatccgacatagactgtatatttggctctgggtggaacttgcctcatgagctccatgacttaccacataaagtacttagcataatgcctgacacttacctagggctgaataacattggctgttcttggagttataatcatgatcactgctatacgctggcacttggctaaactctttgtaggtgttaccccatttcatcgcatttaatcctcacgagcaccctcttggcccatgtggatgttatcctcatcttgaggcccccagacgtgagatatttacagggtccatgaaggagagttggaagtcagtgctacctgaattagtctggggtgagggtaggtggggatctctataaaagcttgaactttattatctttttctttttaatttttttttcaacccccacccgcgcggggaactccgctgccactgtctccgccccacagacacgttgcaggccagagcgaccgggacgcagggcatctctttttaatttttaaaattaattgattgacttttggctgtgctgggtctttgttgctgcacctgggctttctctagctgcagtgagcaggagctactggctagtctcgagggcgtgcaaccttcgctagttgcggcacatgggtttggttgctctgaggcgtgtggaatcttcctggaccagagatgaaacctgtgtcccctaaactggccggtgcattcttaaccgctggaccaccagggaagtcctggactttattatcttgtttggaatcacagatggaattaacaagatttgctacagagagtccctccctccattccaggctctacctgttgccccttcctaaatgtttaagcccccagagcctgaagatggtaggggttcggggggcactgacccctggtgggagggaataaggttggaggcctcaagtgagcagaaggtcaagcaaggccggcagaagagaagaatcaggtcagaagcaggctgttggctgtacttccttcctggaacaggcacaggaggctctggtcagaacacagaggtgagattaagtgcagcagcaagtgacagcaaggcagctccagggtgacggctttagcgtgggagggcccgcaggtcacagagatctcagcagcccacatggaagggggggtgggg

SEQ ID NO: 63856 - DNA, 1977 bp, Bovine  19866880493846
ttggtgcaacctcagtacctatttccttttaaaagttactgctttgaaaagcaacctagccatttacactccagttcaaagtaagggggagtttgatcccagtctcatcgacatggcaactcttttaaaattatttactaaactaagtgggcttcccaggtggcccagtggtaaagaaccctcctgccaatgcaggagacttgggttcaatccctgggtcaggaagatcccctggaggaggatacggcaacccactctagtattcttgcctggaaaatcccatggacagaggagcctggtgggctacagcccatagggtcgcaaagagacagacaccactgaagcgactgaacatgcacacacacactaaactaatcatctgagctactagaggtctgtaaatcaggaggctggtgcaaagctctgaggcactgtggggtcatcgaaaattagcttcataacttcctgcatcccttcctttacaaaggcatccccatatttcagatgtctttgcatcccagtgcaaaggtatccggaagtactggagggaaaagctaagtattgtaacttagagaccaaggcaattcttcctaaacccatatggtattggtgtgtgtggtaaaagggagggtggatttaagtagttttaaagtttacctaaaggatgaactgatgagaattactaagaaatttttgaaaaataggagaggtgaaagaaaacttgtctttccagatattaagctcttagcattgcataaaaatagaactaaagataatgtaggccaatgttatctgatttaaggatgaaagaaggacttaataaacccaaaataatgaagggaagctacaaaagaaaagtagattttaaagttatataaatcaaaaagcatcacgagcaaaaatttaatgtctttggtaagttagagcacatatttttatcatataggaagaagagttagtattcctagttatttattcatttaacatgtactgaatgcttgcaactgttgggcactgttataaatgctgggaattcagctaagtattaaaatacttttatatttctataagaaaaaaagataagaccctagtggaaaaataggtgcaaacataagcaatttacaaaagaaaagatagaaatagccaataagtatattaaaaaaaaacctacctccctaatagtcatgagcaggcagattaattcaacaatgagaaataagttttcattctaaaataacttaaacattttagaatagttaagctgtgttttggcccattgaaggaaaaactagctgaaacattttggtggaaaaaaaattttttgaagtttttttgatgtggaccattttaaaagactttattgaatctgttacgttacttctgttttatgttttggttttttggccacaaggcatgtgggatcttagcttcctaaccaggaatggaacctgaaacccctgcattgggaagtgaagtcttaaccactgaaccgccaagaaagtcccaataatttgatagtatttttttaatgattaaaaaaattcatgtaatttgatctagaaatcctaggtctttatcctaagcaatgaatccaagacgcagccgagtttaaactgacaaggatgtttatcatagccgtgccatcacacacacatgcacacagatacagatggggatcaaagtgtacaactgtagtaaattaaggtgcatctatattacagagagtattacatggacatcagaaactttgttttctaagaatatttaatatcatattattaggcataaaaagcaagttgtaaaacactgtgaatgtttaaattctatgtttttaaaagcacacagtgttctatatgtgtgtgtgtttaaaggactgaacagttgtggaaaaaatctggaaagatgcacagcaacatgatgactttggggaggagcctcttatttctgttttacaaccaatattttattttaaaattt

SEQ ID NO: 63857 - DNA, 1671 bp, Bovine  19866880521584
tcatcctgctgtccccagatgctgaaaccactgcctcggcctggcctaacgtggccaaggtctgggtgactgggcggaagcggagccgggccgcccccccacggagcccctggcggcccctgactccactactgcagcaggtaggggccatgctctaggggaaggtggcccaggcgtttggcctgaggcctaaaggctgcagtgtgtgcagaggggcgtgcaggggccctggcacccacacctgcactctggtcacgttcagttgtgagaagagccaggcaggtgggcctccctcctgctgtcctccctttgcaggtgaagcctcaaagcagatggtacttgtgctggagtgggtgtgcaccaccctcctgggcctggaggaacatctgaacgccctggaccgtgctgccggtgatggagactgtggcaccacccacagccgtgcagccagaggttggtgccagggcccacctggggtaggagacggggtggtacggcacactcatgtggcgtttcatgaatcagtgatttcaaaagcatttggagtactcacatggggctggcaactgttattttgccaaaagacgtcatcacaaacttagcgtgcttttcacctgttttcataaagggatatgtctagtactacagtctttcagtgaataattgtgaaagtcgctcagtcatgtctgactctttgtgaccctatattctccagtccagaatactgcagtgggtaggctttcccttttccaggggatcttccagatccagagattgaactgaggtcttccacattgcaggtggattctctaccagctgagccagccacaagggaagcccgaataacaactttaaattatcctaaagggaaactcacacccttactctttctcagcttacccagccgaggcaaaagttctgaattatccagctattatcttgttcaatcaagaaaaatatatttagtgctgaccatgggtcaggtgctgccctcaactctatggatacaatagctagaaaaatattaaaatcactgctcttgtggcttatgttctggtaggaaaaaaagaccattaacaaggtaaatcagtaaaagacaaaaaagagggaagcgaggaagcatcatcgcttctcattgaccaccaaggtccccatcggtgacctgtcccctcctctctccagatgcagcaggacagagggggccggggagtctcttcatgttggttccctcagcctctcctagcgtccattccttccgcctggcagtgaggcctgggtacttggttggggtccaggcagacgggagggaaggtctctgaattccttgccatctcttatctgcctgcagcgattcaggggtggctaaaggagggcccacccccagccagccctgcccagctactctccaaattgtccttcctgctactggagaagatgggaggctcctcaggggcagtgagtgccagcagcccccgggggtggagggctgacacagaggggttctgggttggccaaggccccaggccaacaccgtgctcagcatcctggtcctccccagctctacggcctgttcctgactgcggcggcccagccactcaaggccaagactgacctcccggcctggtctgctgccatggatgccggcctggaggccatgcagaagtgagccag

SEQ ID NO: 63858 - DNA, 1259 bp, Bovine  19866880554933
gctgctcctggccaatgtcgtggtgttgctgatcctggtgcctgtaaaggaccacctgcttgaccctttactgctgcgctgcaagctgcttccctcggctctgcagaagatggccctggggatgttctttggtttcacttcggtcattgtggcaggtgcagtgtagggcctgggggagtgggatggcctttgtctggggctggagggaggctggttcccccaggggctgatgctggagctgtgggtctgggccaagtacaccctccacctgtgggtgccagtcttggtttctggaagatgtgaactgaaagagaccctcctccttgagtccagcctcctctcatttttgacagatgaggaagctcaggtcaagagaggaaaaaagattttccccagtgggatgtaagccccctgaaggcagggaatttttttttttctttttttattcactgctatgaataatgaggggttctctggtggctcagatggtaaagaatctgcctgcaatgtgggagacccatgtttgatccctgggtcaggaagatcccctggagaagggcatggcaacccactccagtattcttgcccagagaatcccatggacagaggagcctggcaggttacagtccatggggtcgcaaagactcggacatactttgttgagcgactgaacaacaacatgaataatgaacataggtactcaataagtgtgtagaatgtgttttccaaagacacacagctgttcagtggttgggggacttttttcaaaaagtatttactatttattctcttctttcttccatttcaaaaggatttgaagctgcaaagctgcttacaagaaagggctctgataaaagaagctttgcatgctactgtactgacctcaaccctttcactttgtgacataatgatcctgaagtttcttagtgtctctgaacttcatctttaaaaaggagagagtaattcattcagacactatgcagggcctgggctctgccctcatggaatgtggtctaacaggagtgttgtgaggattaaacaagatgaagtcagtaaatcactcagcaccatgcctggatcataagtaggagccagaggaattaaagctcagtaaacagtattgtgtttgtttactggaggatgaaaggatgaaaaccaaactagattgtttttcaactaggtactttggtaaattttgtcctatatcaccctcacaagaatcctgggatttttattcctgtgtgcgtgctcagtccgct

SEQ ID NO: 63859 - DNA, 3711 bp, Bovine  19866880636452
tggggttcggtgtgtgacgacacatgggacctggaggatgctcacgtggtgtgccggcagctgggctgcggctgggccgtccaggccctgcccggcttgcactttgcccctggccaaggacgcatccactgggaccaagtgaactgcaccgggttggagacctacctgtggcactgcccggggctgcccggaaatgggtactgtggccacaaggaggatgccggagtggtgtgttcaggtgagtgggtgatgctgaaccagggtcatccagcactcactataggcctgctgggcctccatgagtgctggagagacccaccctgcccgtgggaggtcccagtccaaagggaaggtgagacccaaacaaacataatccaggagagagagtggcacatgacctacgaaaggcagccaggtggggttaagaggcagcagacagcgcagaggcggagggtgaagcctgcccgcctcctggaatgggtgacattagagacaagactcttcctgagtgagagttggtcacctggctcagtgcagcaaggggagctggaggcagggaggccctgaggaggccgtcagcggctcccccgatgaggaatgaggttctggtccagccagggcttctcgagcccgagaatggagagggaggagcaatcttgtccaaggtacattctgcgtcagtagatctgaggcagggcttgagagtctgcatttctaacagggtcccaggtaatgccgaagctgccagtccttgaaccacgctttgagcagcagagatgtagacagcacagggtcagccagagcagacggggtggacgagaggggcgtgcagaggcagaagggagagcatctggagaccccttggctctggggagtctgcatccgtaggtcagggctggtgggggtttccactcaaaggatcctgacctgactctgaccccccgcaccccctgcagagcaccagtcctggcgcctgaccgggggcactgacccctgtgaggggcaggtgggaggtgtacttccgaggggtctggaacacagtgtgtgacagtgagtggtacgactcagaggccaacgtgctctgccaggacttgggctgtgggaccgtggcccgggtgcccaaggggctgccccactccttgtcgggcaagatgttctactcatgcaagggaaaggagtccaccctctccaaatgcttctggcggttcaacaactccaacctctgcagacagtcccaggcagccagggtcctctgctcaggtacccctcctcctcctccccactccactgtcccatccccaggaattccatctgaatccacaacctaagaacttgtagcccaaggaccagaggttgggctagattaggaatgacaaatactggcataagagggaccatggcccttaccgtgcccagggtacacggtattgatcaggtattcttttcccccagatcccttgtcacagcccccagaatcatgaatccaatctttattaaggcattattatatatgaagcagtgttccctagtgactggagttggctcaggaaacaaaatcaatttgctatccttgggctggtgatcactgtaaaaagaaaaattagaagacactaataatagggctacagtgtctggagccctaatcaggtgccaggcattccttgggacttggtatgatttcagcaaagcctcctacctgctctatgaattgggtttcaccgagtctaagatggcattgatcataagtcacactgttattgggcttccctggtagctcagctggtaaagaatcctgcaatgcaggagaccccggttcaattcctgagtcaggaagatccactggataagggataggctacccatccagtattcttgggcttccctggtggctcagctgataaagaatctgcctgcaatgcgggagacctaggtttgattcctgggttgggaagccatcccctggagaagggaatggctaccccactcccagtattctggcctggaaaattccatggactagtccatggggtcccaaagagttggatgtgactgaacaactttcactttcacagttattcctttatgcaccatcggggacaaaaacgctgccaaaataaactcttgatatgccatcaattgaattgattgatattaccacccctaatttccgaggtgttaaaatgtgaagaagtaaaagcattagacttgaacaaacacagtgtcagcatctctgtggagttcagacaccaggctatgaattccggctctgctgattaccactgggaggcttccttcatgaatatgcagatgttgataccaggcagttcacagagtagctaggaaatcaggcagtatccactatggaatgtggtaagccccctcccttaccagtcaaatgattatgataatgatgagactgtcagcttcccacttcttgaggcaggtgtgaagaacaaactcaatacaagatggaaaggggaaatatttgggttctctagcagattgtacagaaggaagggctaattctttcattagctctttattttaaccaaagaatcctccttgcatttaatccatcagatcctctttattgtggggtgtgggactcagcatgtgccccggtgggaacacgcccccagtttcaggccacttgtctgtcctgtccactttctagcacaaagcccagccaccccaggtgtttgggtgcatgtgctgagtgaatgagcggtgctttctaacaggtgcccggagtctgctcaatctgtccattactgaagtccctgcaagtggtcagccggtcactgtgggtgagtatccctgggggtagtttttcagaagcttgtttgcatgcatgcatggtgtgtgtatgtgtgtgtgtgtctgagagaggggtctgatggtctgtcccccaaccccccacttccagacaatgaacttgactccccaactgtccctgggctctctgggtgttctgtgctctgctcatttcatctgcctctgcatgtcagctccacagttccgtgaatcctgacattccatgggcaggagtcctcttcccactctccatgagcgtgagtagggcaggaggacagagctagagagagtcagagctgatctgacaccagccagaaagtggggacgccgagggtagcagccagtgtgtttataatgtgctgggcactggccagggctttaccatcattatttcccaaccctttaatcctcccagcagccccctggggaggtcttcccgcaacccttacacagaagtagcagctcaggctcagagggtgggttgccagcctgccaccattgcctggaacctgcatctgaggctcttaactccgaatccacacttggtctgtcctccagctgtgtgtagcttagccatcgcgggtgtcgacttctggggcccaaccctcagctgtacctcttgctagctgtgtgatgctgggcaattcttaacctctctgagcctcagatcctagactacaaaatgaagatgagaatcacagtacttctcacctagtattgttgctgtgagtttctggtgaagagcacacttcacaacagggctcagtacacagtaagcactacctggacatcagttattcttgtttattgatttagtccaggtgtggagccccttggcagctccaggataagcacaggggtcagccctcattcataggcttactcctcactctgctc

SEQ ID NO: 63860 - DNA, 1308 bp, Bovine  19866880647711
tctctctggccttgcgtctgttgtttctggcattaacgagaagcttttcttcagtttgtgagtggggggggcgtgtgtgggacctccaactgtaaggtagggggcaggaatagggtcttcaaaaagatgggtcataggacccgtctgagggagggaagcctttggggttgagctcgttcctgatctggaaggtaatggactcatctttctttaggctgagattggtaaactggtcgccaaatacttacccagcatcaaagtgatttagaacctactctggcagaaactattctaaacgtctcaaatttaatcctccaagtgccctatagcgttggtaatgttgtccttgccacgtatgaattagggaacggaggcacagagaggtttagcaatgtgccagtaagtggcagagctttgagttaggggactagagctcgtacacctaaccactaccgttctccatttggggagggagttggggtgcaatgaagagcagacaagatttgaggtcagacctgggtatagatcttggctgtgccgtttcctagttgtgtacctcaggacgagttcatgtcatgtctgggagcttcagcttcctcaagggtagacagcattctgcagacactagtcatggcagagacttagaaagtatgttaatattccaggttgcagcgggccctgggaagtctttcttatcctctgttagtggcattgggtcccacattgggcaaaaacaggtagaaaagtttctcaagggcccgcattgttttgtcattctcaggaaaaatggcaccaagacatactccaacttgcccagtgaggctgtctttgcaaactgcgctgggatgctggtggtggtcttcgggctgctggtgctctatatcctgctggcttcatcttggaaacgcccagagccagggatgcaggctgagagagaggtatggggtcttggtctcctgttgcaggttggggtagggccgggtctgaggggtcagccagtagaggcttgggctttgccaggaagaccaacccagtaacgtggtgggaaacaagtagcttgaaggtggggttcggctggctgatggggagcaccagagtgaacccagcgcttcctgtcatggccagtgcagctgctcctagggccctgtccgctgggggagcaggggcttcctcccctccccagatggctgtggtctcacggggaagtgtggctttaccttccccaaggaagggctgtagtgtgaggaggaggtatgctgatttctgcttctccagcttcagagctcatctagtgggatgggagctttc

SEQ ID NO: 63861 - DNA, 1208 bp, Bovine  19866880648376
tgaaaacaagcagacctgaggtgcagtcttcccagggggacgtgagccatgggggtcaccagcaggagtgaaggtgatccagcaatggccatccagccctggtcccaagaagcacctcctgatgggaaggattttcccagcatgcccttcagaagtggtccacgggaggaccacattgtgtgtgtgtttaggggcatatgggggcggggaaggtgggagggaagcgtctctatcagaaaagaaccaggaagactggaaaggcacacaaagtgacttgtagaatctctgcctcccctccctcagccctccccgctgtggtaaaccaccagcactcacccaccaccaccccggcagggatggaaaactatcaagaggtccccatcaccattgccaaagaaggtaggatgtcgcctgtcctggggttggggagggcaggggaggtcaaaaagggaatactttttggagggtcagtactgcttaggtcaaagcagtgccccagctggagaagagacctgggccagcccacgcatgctcacgggaccttgaacaagtctagcctcagtctgggcctcagtgggcagatgactttccagtgcactcattctagagctctaggcttttgaattctggaccaaaacaggcccaaggcattttggaccttagttctcaaggagagctctgttctgctaattggccagtaggtttgtgacatcatcacctcttctaacagtctgcccagaatcagcctgtctgcagagccccatcaaagttttcctggaacataaatgtatttcatattttccaaataaaaaaaggaatcagtcatccatctttaatgatatactgatgtatatctcttcaaagtcttgtgaaggcattcgagtttaatcccacggtgttatgaaagtattaaatcacctttatttgaaagagttcgatgacacaaaaccaatacaaaactcagagaaatattataaagattctttgcacacaggatccatatatttgagaagagaacatgaacacagaacctagcacaagggtaagctcagagcagccactcactgaatatcatggtgtagagattaagagcccacactgcctcttctctgggctatgtgagactctctctgtgcctcagtttccccagctgtaaaatggggaccctaacgtagctgcctcacagagttattatgagcactaaatga

SEQ ID NO: 63862 - DNA, 1670 bp, Bovine  19866880676386
tggagaaaatgctagagaggatgccagaagaagggaaaggcaggaaggaaggcactcccatgtggtacccaagccccccggagacctgggccctgctagggcccacacttggccagtgtcacagggtcccagtggcccggcacgtaggctcggggcccagggagctccggccgagcccaccaactcacctcccattgctttcctccagatttccagcccaaggtgcagagccgcctggttgggggcagcgacgtgtgcgaaggctccgtggaagtgcgcagtgggaagggccagaagtgggacacgctatgtgacgattcctgggccaagggcacggcacggtgggaggaggtgtgccgggagcagcagtgcggcaacgtcagctcctaccgggggctggaccccagcgagaagaccttggggggcttctactgtcccccggggatactgtcccggtgccacaagcttgaggagaaaaagtcgcactgcaagagggtgtttgtcacatgtgagttggccatggtccgtggtggttagagggtgattctggatttttgttctaagactcagtcaatgagcattatttccgaagaacagtccaaggactaaagagagagagccctaggacaggatggagagatgacaaatagggggagaggggacagtgtgctcagacagcaatgagcaggaaccatcaggaggagactggccataattgtcaggaggctagtgaataataggattcttattctgtcttctgctctttcagatggaagttaggaaagcaagggatggggtacatctttcctatattaatggtaacggactaatacgtgaaagagagaaatggatgggtggacggctattggtagatgaaggcaaggcgatcactcataagtaactggaaaatggtggaaagttgatagcagaagtggtaaatgagagccggatgatcaattgtgagatagtaaatggtggctaaatgaacagggagcagaggatttcagagatggatggacagacagacagaaaactgcttcccacacacgctggccaattcctaggggacgccagccagccagccaggagcttccctcaaatggaccgttttgatgcccctcccccactccgggccaggactgacctccctctgcctcctgcaggccagaactccagccgagcgggcctgggcgcgggcgccgtgatgagcattattttggccctcgtgcttctggcggtgctgctggtcgtgtgtggccccctggcctacaagaaggtggtgaagaaatgtaggtgacggtgccctgagccacttccctcggaagcccctgccggggagggctgcacgtcagcccctgcaggggagggtccccgccttcggagagctggctgggctcacctctgcttcacctcccagccctgcccctccctctcctgcccactggcccttctctactccaagcaacaagcaggaaaatcactgattcacccacatctggggcccaaaggggaccccactccaggcccaagggaggatgtgggtattctttagactgtgatgggtccagagggtctgacctcagaagacaggtgtcccaagttggctccaccactttgcagatgatggagccacttcctgtactgagactactgtgtgtttccccatccaa

SEQ ID NO: 63863 - DNA, 968 bp, Bovine  19866880701258
ttcacttcccaggactggcactcaacccctgaattataaagaacctcacagcttcctttgatcaagcacctactatgtgccagaaactggcctagaaacttgctgtgcagtaccttattttcataaactataaggggtgtattgttatgtccatttcacaggtgaggaaacagaggctggggtgggaatgggggaggtgggcttcacctgcttgcctaagatatttatccaaaaagtgtcagaactagaattcaaacagaggctacaaagtccaaggccttgacccagacacaggacatgaatacggagttcataagtgtttaagaactgcagctgggctttgggggaaatattaacagcctggaaaaatgaacacatgtagtgggagtgggagatggggtagtggctgtgagggttgtgactgggtgaccaggacaggttgatgtcacctggaataagactcacagatactgtacctggcatgtgccaaaagatggataaatagtagctgagtgaaggaaagatatctgttttgtgctgcttccttgaaggagactgactgctcttgtgcctgactacatgtgaatacagggggccgcgtggcagcctcctcccctccagccccataaatctgcccacttgcactctaggaccatccctcccctcatggaaagaaagtacccacctggaatttggctccactggcccgactcgatggcaggtgatgagcgtggtgtggtgcttggagcccttgaagcgttccagcttggtagtccagagggtgggctgggctaggcgggcagccatcacgtgcagccccttctttaccttaatcctgggggaggggacacaggtacaatttgtcatgggtcgggtggtgtatgttgaagtgtgggctggattggagcaggaagataaggagctctggtctgaatcttctcctcaccaccctccaacccagggggacc

SEQ ID NO: 63864 - DNA, 1332 bp, Bovine  19866880884888
ctttattttaaatcaaagctagaaatgatttagcttagtgaggaaggcatgcttagagccaagataggcggaaagctagtaagctagggttttggtgccaaacacttaccaagttatgaatgcaaatgaaaagttaaataaaaaagaaccaaacagtgaattggacactttacatgggtgaattatatgttatgtaaattatgtctcaataaaacaagatgaaaaaaccctaaaaacttaaaaagaaatcaagagagctcaatcctggacatggtaaatttgggatgtttattaggtatccaaatgaaaatgttgaataggtagttggagatataactcagaaattcacaggaagggttcaactgtagttacaagtgtgggagtcattagcctatgtacacatatatgagactggatggtcttcagagagtgaagacaggtgaaaaaaagagaagtctaaagaccaagccttgattaaaaaagaagatggatgaggtggtataaatcattagctcaaatgtatcaactcaatgggaagatcagatcagatggaaagtccaagggaggcaatagtggaagctttgctccgaaggcagcaaacaaacgtactcagaaaaaaaaattgagggaatttcttgtcaacagaccttgtgacaacagttgcaagaaatgtggaaattttttagagggaaggaaagtgatatagatcagaaacgtgggcctacaatacagaaagaaagagcattagagaaggaataaatgaaggtaaagtgacaactcttatttttattactcttaattgatcttgcaggtaaagtttgttcaaaataattatagcaacaatatctggtccttttcatttatgtataagtaaaataaatggcagcaatgatacaaagacaggaggaaaagttaggaatatcttgctattataagatacttgtactatcagtgaagtagtatattgttatttgaaagtagatatggatgcaaactctaggataactactaaaaaaaaggaaataaatataatataataaatatgctaaataaatataataaatatgttaagaaaggagagaaaacgaatcatgtaaaatgctcagttagaaccacaagaagcagaaaaaaagactggaagacaaaaataggtacaaagaagggcaataagtagaaaacagtaacaagtatgcatattaatccaactatgtcaataataattttaaatgtcaatggtgtaagtaggggcttttcaggggcgctagtgataaagaacccacccgccaatgtaggaaatgtaagacataggttcaatcctgggtcaggaagatc

SEQ ID NO: 63865 - DNA, 1654 bp, Bovine  19866880940278
ggcactttcctaatccctgatcctaagtagatgctcaataatatttgtcgaatgaatgaataaacccttcccttgggagtcactcgttaatgataaggacattttggcgcagctgtttcttcatgcccttgacacacattgcttttttattgtcactaagtggtgcacacaacagatgtctctgatgccactttgttcatttctagctgatttatccttttgtgtttgagcagaccatagtgtgcataaccttcatagtcagaaaaaagccagtcaagatctcaggtctgctccacattattaaatatgattcatgtgtattactggaagaaccaaagtccaatggagaatttcctctgcagtttggagatgcaaatagagttttctattgtgcccccacccccacttgcctcccagtcaaacaaagttggcataatcagggaaagcagaagtgatcctagatgcagccccaagagcagactttggcctgatttaaaaaaaaaaaaaaattcaggccccccagcaagggcagaagggctgaaaaatctttacccagggtttggatcaatctgcgacagccaagccccaggcccacttccggtctgctggctcggatcaactgtactggcagctgtcctgctcctagatcctggtccacagattctgactcagcaggtctggggcagggcccagacatctgaaatctgaaaaagcagtgagctctggaagtcacctctctaaataagcaattctgtaccccatcaccccttcaacaactccccaaatctcagaacctatcattcttcttctacccagagatacatatatccattagctaagtagattttatcaagctttaacttctgtgattgcactaggaaaaagataactaggtattttgttcctttttcaaatgtaagattacagttcacacagatgcatttaaaactgcatccctttggagattttgagggatcctcttggcaataaagagggaaaggcctgtccactcactgaaaatccttgctgtagacttttaagcagaaaatcgaataagtcccataacgagcagtcactccatttattaactggatgtaaatgaatatgacaattgcaactctaaggggaagagcagacagcccattcaggatataaatgagttctcccaaaatgagcagccactttgttgagaatgatggatggcccgttctgaaaccagcaagtgtgttaaaacacttggctcctatgtatggctgttctgccagatgatgccaacccttcccaccctcaagcccatctgactgccccccctgaattctgcaacagcctcctcactgctctggtgtgcccactcttgtgacccccatcaactgtctacctgtggccagagccattttaaagaactcaaatctaatcatgtccatccctgcctcaaatcattttagtgtttctgaactgccctaggggtcaggccagacccctaggcagtctttcagcctggcccggccccacccaaagtccatgctgcccagtggccgagcctctgagaggtcagttctgccaccaagaggtgggagagacaggaggcagtagatggctgaggccctctggaggtcaatgaggtcaaggcacacattaagggcacctggggatg

SEQ ID NO: 63866 - DNA, 1129 bp, Bovine  19866880959669
ttcaaaggctgttttcacagtggcgtcatccgggctgaaggggacgttttttcacctcctaaccaaaactgcaccgtctgtgtctgtctggtgagcatcccaagcttcctgaagcctcatgcgtgttttcttaacctttggggattttagaggaagagggaaaggcagggatggtaaaggtgagctagttgaacaggagggagagctctcaggctgtggatttgggttggaacttgtcacatttcaaagtgtgggggatgggaaggcagtagtctgtggggtcagggaggcttctgctgagcagaaaagagccagcaggcaaacagggtccatctgtcttggaaggggaggggagggtactccttcggaaacttcctaccagggaggctgtttttctctccaggcaaaatatttgccggcacaataaaggtgtccacacgcggagggagaaggctggttaccagactcagcttgttagcattttgctagaggcaagtgcactcctccaagaatagttattaagctcctactatgcgccagacgcaatcaggtgctgtcctgaagactggctcatgagcacccagtgcgcacaagtctagctcctcacctgaggctcctggcagctcttcagggttggctttactgtccccattctacagatgcaaagactgaggctgggaggtgacagaactggaatttgagccaaggtctgtctgcgtccaaacctaggctctgcccaccaatcctcactgcctctgatcatctttaaaagtggccccagcctgtcagggatgatggagctgcaatgtaaaatgggggaggggtggcacgtagaccgctgccaccaccccttactgagcccttcccatgtgccacactcttgtagtgaccaagcacttttgtgcctgatcgcatctcacgcaatcctcaacaaccctggctcttctcacaggtagggagacagaggctcagaggtgatatgctctgcccaaagtaggaggagcaaaccctgggcctcaggtctggctgactccaaaactggggacctttttttggtcttagcttcagtttttgaaaattgagttttaaatttaattctctggccagtatcagtgactggttcaaaact

SEQ ID NO: 63867 - DNA, 1648 bp, Bovine  19866881084289
catgactgaagagacttagcatgcatgcagcatgtttcagagtccttttcacaaagcacagggactgtgttacattcaaatctcctcttccacagccttgtttttggttgaggagtacaaagggaattggtcagaggctaataaaaccttttgccctctaaggagaaatttggccttgggtcagctttgatggagaaggaaatggcaacccactccattattcttgcctggagaatcccatggagggaggagcctggtaggctacagtcaatggggtctcaaagagtcggacataactgagcgacttcactttctttcactttctttcagctttgatacactaggaatattagttgtgttactatgccacatcacttatgaataaaacccctgattgatgagttgtttctggattggttgtagctatgagcctaaattaacctgtgggagaccacagctttgggtttccctgaatacagtgtcttgtagttaatcatgcatgtctctggcaggtaccttggcaactatgcttatggaattactacaatatccttccttactcaaaatatccactttagaaatctgttttaatttattctccaccacatgtttcttcttttctctttccttgtgtagtctctctaaaaatctccaaaaatcattaagctcaggcctttggattttcactctgccaaagaagggcatcatagttttccaaacagccactctctttattactcttcaaacatacccttcaatatcatttatgcatgcacattccattctcttaaaggatttatcaaacatacaacaaacataaaaatgctttccgtaagtatacactccccaccccagcccaaatcctaccctccactttgttaaggctgtttccacagtaaaatttgctgtttagagtcagatactgggtctttagtccatttcttgatctcataagtaattcacttgatacattagaaaaaagatgaaagaaaaaataccataaaatggtttactcacaaatggtgatgaccatatgatgtaccctagtgtgagtaatacagggacactgccagtgacttttacatcctcttcaccgagaaacaagacagcacagagaaaacccagtgtatagtgaaacagggcaagaactatttgcacagcctgtgaggagagagagtcatcatcattactcaagtcaagtctgtcacagatgcatacaatctgagtgactgaaaggtcgtgggaaatgttcaccttaccctggtatttccgaagcagtgatgaaagacttaacatgtcagggaggaaccaaggtggataaaggggccacatttggggttatttaatgaaactgggagtatttgtctttgttttataataatctttggaggtaattaatttaaatctagttggttctagcttagtgaaaagcagagacctatttgtttggttcaggcagacacacaacagaaaggagatgtctggctctggggatgtctcaggctctgccttgacactggtctcctttctgcggttgcttctctgaggccacctccagtgcacacttggtccttttggacttgcctcctttctgtcgtcctctcttgcctgggactggacttgggtttcccttgctcttcaccattcc

SEQ ID NO: 63868 - DNA, 1238 bp, Bovine  19866881170291
cacattaataaaagtctatctacctcattcctttttaatggtctgcattaaaatgtttccacccatacatctggctgtaaggatgtaccgtcattcatttaaccgatcccctagtgatgcacattgaggcagtttgcaatatttcacttagtgattattgtatctgtgagtgggctgcaccgggtgggagtcagcctccgggctagtggtcttatttactgttagttcactatccctgtctgggcctcagcctccttttccctttgtaagatgaggatgtagggacatcggggagaaccctgggatgtctccagctgtagcattctctgacttcttgaggtggcaaccgatttttcaaggataggaagtgtctggtgtcatttagaataaatggcacagctaagaagagtgttcctttctcaaatgatactgtgaaagccctcaaataccaggcaggcttaaacagtacctttatcctgatctgcagggtgactagaaggtgactttccaggacacctcgggctgggaacacataggaaagcagctttgccttcaccactgagaaagtacagccatgcaggcaccggcttttctctcagtcacctggttctctttttctacgcattgctgtcagagtcctgcctttttcttaactatgactttttattgacccacaaacacgttaggatgtcttaggttccatgtttgctctgcagcaaacctctccatgatctacctgccagcagcaccataccctccacacaatgctcttaaaatgggcttctttttaggaaaaaacttcttgttatgtatcaaatggacttcatctcagcactctagctctcaccccatatcatcaaaaacaaacttaactggagaaaactataatccagctgtaattcaaaaagatacatgcaccccttagttcacagcaacactattcacaatagattagacaacgagacaacctgactgtccatcagccgatgaatggatgaagaagatgcgctgcatatacacaacggactactactcagccagaaaaaggaatgaaaaagcaccatttgcagcagcatggatgggcctagagtttatcctaccaagtgaggtaggtcagacagagaaagacacgccacattctatcacttatacgtgtggaatctaaatatgacacaaatgaacctattgatgagacagaaatagactcccacacagagaacagacttgggtcgccaagg

SEQ ID NO: 63869 - DNA, 943 bp, Bovine  19866881183239
aaaactgttataggatcccacttccacagcagagttcttccctagatagtgacctctacccatgggaaggtgagatggggtcttcgttccagtccccatactccacatcttgaattggacaaaagcctgtagctggtccctagacctacaacttctgctttctcttctctagggaaagtccagaggagaaaagaggaagcaagaactcatgatctagaaagcaaagaatttattttgaggtttccgcatatacctgataactcagaaaccaactctggtttcaggcatggtgaatgcctagccccctaagcagctgctcttaaaagccaggcaagtgggcatgagggttggcaggcaatctgcaaagccacaggatgcccctgctttcagcatgaaaacagctctcaaggcaggcacactgtccctgaggagtcaggccaaggtgacacatggcttccggaacttgaggttcctcaactggaaccagctaacacaagaagaggcccctaaaattgccaagaactcccaaagagataaaacatttgaccctcacctttatacccagtgacaagctgacagagtagtggcctggactccaattcttaggctctgaggctccttgagcaaatcacttaacatctgaaggactgtcttctcatctgaaagaaaaccatggcaacaggatgtaacttactgaaaggcagctatgaacagacatcacaccacaaccttaagacacatgattgatcccatgttctcctcttgacaatcctgtgaggggttatttccatttcaaaccccatgtttttaatttgatcacaagttgccagaggatcaagtgagaaaatacattaaggacattgtaaattattaaaattttcttagtagtattacagcatttcatcctaactactaacgaaaccctgaagcccatggctcttat

SEQ ID NO: 63870 - DNA, 991 bp, Bovine  19866881191767
aggactgcctggctcagtgcctgacacaatgagcagtcaataaacagcagctctagtgttcctttctggtgaggtgacagcatgacaccggagatgtgccggtaaattagagaagatggtgggaagagctggcccccgttcctgtctgtgtgcccaaggtttggcacggtgaggagcttgggagcgtctgctcgagagttcagggtcactcagatcttgcttgggtcactgataccggtctaggccgtgggattggcctaggataagagcgtcctcttatcaagggctgactcctctgctgggtgctccccacgcctccccaccccctcactgtggtgtctccctctcccaggatgcggtcatgctccacagcttcaccctgcgccagcagctgcagaccacccgccaggagctgtcccacgccctgtaccagcacgatgccgcctgccgtgtcattgcgcgtctcaccaaggaagtcactgctgcccgagaaggtacagcctccggcctgccatcccccactctggggtccactctggggcaggcctgttttgtaatagcccattcctaacattgccttctctctcagctctggcgaccctgaaacctcaggccggtctcattgtgccccaggctgtgccaagctcccagccaagtgttgtggtgagtgtccccgcagccccgccagcagtggagtgtgcatggtggcccatcggcctcctctgcaagggaggaggagggcattctgtgctcctctggcattccatgctcctctcaccttcctccttgttctcttcagggtgcaggcgagccaatggatttgggcgaactggtgggaatgactcctgagattattcagaaggtacgtcatgctctcgcttggtgggaaagctgatggactctcccttttgcctggagtccaatatgagtaaaaaccccatccatttggagatggagtggagtcgtacagagcacacactcaaccaggctg

SEQ ID NO: 63871 - DNA, 1517 bp, Bovine  19866881215559
cgaccctggttccttccccatccattggccaatgcataaaatttcagcttctcttgttcatacgctcattctctgaattcacgtattctaccaggaattactgagtgcctgctctgtgttaggcacaggacatgcaaagccaaacaagatgggtgcacagtttctggccacagggagctcctactctagctggaaagataaattatgattgaggaggagcaggatgagtaggggaacagaacccaagccagggtgagagtgctggtgtggaccaagccagggaaggcttctcagggaagtggacacccaaaggttgctagggagatcagtgtgtcccagtttccccgggactgtcttggtttaactactgaaaggctggcatcccaggaaactgctcactcctgggcaaacctgggctatgggtcacccaagcaggccaactgtgggcagaacagctagaggttaaggctacctgggggcagacagtctttgaagtggaaagtggaaggaaatgtgtgtgtgggtgttagtcgctcagtctgtccgactctctgcgaccccatggactgtagcctgccaggctcctctgtccatgggattctccaggcaagaatactggagttgtttgccattcccttcttcaggggatcttcctgaccctggactgaatctgtgtctcccacactgaaggtagattctttgccgtctgagccaccagggaagccaatgggaggaaatgttttgaaacaacttctccaccatcttgccctgaccttagaccaaagtgacaagccccctaaaagccaagatgtatggacaggggaccccccactctccatagagattctggtagactgtcctgtctctttgctcagaagggaattggctgtctcatccttgctgagtctctggggtgtggggtcggagggggtggtcccagacattgcttatcctccagtgatgtgcccttctccgggtctctctgactcggccaacttttaccttctccttctggagcacatgtccctgtgctggctgttccagggggattaattatgttaattatgagtgtgtaaagaaatgcagtctggggcccatgccaggatatagcccatccacaatgacctcacctgtccacagtgatctgccaatagccctcaacagaaacaggcacccagttcagacttcctgagtagtaagaagaatcgatgtcaccgaatatcaccacgctgccgctctcttcgttgctatggagagtggagggaaaacaggaattcattcatacattcacagttccaactgaacatataaactgtgtgcattctaagagctactttaaaaaaaaagctttttgttttgtattggagtatagctaattaacagtgttgtgatagtttcagatgtacagcaaagggactcagctgtacatatgcatgtatccattcttccccaaactcccctcccatccgggctgccacataacactgagcagagttccatgtgctatacaggaggtc

SEQ ID NO: 63872 - DNA, 1022 bp, Bovine  19866881601211
tgggtattgtgagaaagcgccctagtagtgaacgctccaagggatgaattggccccactcgtcagttcaactaaatttccaaaaagtatttgctgaggtcaactatcatctgggcattggaggtacagcagcgaaacccacaggagtctcatttctctaggaactaaggttctggatttctttgtctctggacagccctacactggttcaaggcttggataccacagtgccggcatccctgcagcctctttgtggcggcttccctgcctccaacccctacctctctaccccgctccctgcccccacagtgggcaaaccctctagattgatttccctgagccccactctactcaccctcctctctgagcgtacaggcctctgctcagactttcaacagctccacatctcgttttgcacaaacccacctcccaagggggacccccaccccgcccccgcccgcactatggcctgcatgtttgtttccgcggaggctgacatccaactggttcccttgttacggaggcccttcctccatcccctctctgtctacactgtcctccagtttggggaagacggcggtccatgcccacccgagtcgtgctgcccttcctgatgcccacttctcttgacccgtgaacttctggagggtcccaatcatcctcgacagcgatctccctcgtccccagagcccgccttccagggctccgcgtccaggcgcaaagagcagcaggtcccttgatgctggcgcgcccccgtggccacccacgaggaaaaccttcccgcggaaacgcctctgagttcccggatgtatgagtggggcgctctttgcagggctggggcggggggcggggcgcggtgtgaggcactcaccgcgtgagcttgggcgcgagtggcttggcacccaaagtgggtggcaatgactgcaatgaagaactccagtatggtgaagatgtaagcacggccaaatagcccctgcccacatcctggggaccaaaacccacagtcaaggccagtcgagaatt

SEQ ID NO: 63873 - DNA, 1191 bp, Bovine  19866880339765
gcgatggcaccccactccagtactcttgcctggaaaatcccatggatggaggagcctggtaggctccagtccatggggtcacgaagagtcagacacgactaagcgacttcacttttacttttcactttcatgcattggagaaggcaatggcaacccactccagtgttcttgcctggagaatcccagggacgggggagcctagtgggctgcaatctatggggtcgcacagagtcagatacaactgaagtgacttagcagcagcttagcagcagcaggaaggacagcatggttagggaggggtgagaaagagagagactgggaggagttaaagtcaaatcagtctgtcagcagctagatagccaaggcctctggatcttttctacatctaatgggaagccataatggttttgaatgtgggtgagccatgatgtactttatgttttaaacagatgacctcagagtagtagtgtgtagagaacaagaaaacaaacaggaagatgagttaggaggcttaagtgtgaatcccggtgggagacgatgaggcttggatgcaattggtaagtggtggttgtaagatgtagctggactcaatatatattttgaaagttttgttgttaagatttcctgaccgaatttggactttggcttgagcatctggctgaatgatgatgccattttcctagatgaggaaaatgtttgagatgccgttacctgttcaagagaaggtgaccactgcatctatgagccttgagttcaggggacaggttactgctggaggaataaggttgggtgttcagctggtaggtagatttaagtccacaagactggatgagatccctaagggagtgagtgtagtgggtcaagaaaagatacctgaagactgagtcctggggtccagcatttagaggctgaggagctgaagaggaactagttaaaggggactgagaaggaacagtcactgaggataggaggatggtcaggccagtgaaatgttgcaaagctccaagaagagagtgcagaaaatgagagaggagtgaagaactacaggaatgctacagagcggtcaaagacactgaccatgacttgaacactgaaggtagcagcatgaggtcacagtgatgttgacaatatcagtgtcagcagttggttggaggaaaaagcctgattgcaattggttcagttgaagatgag

SEQ ID NO: 63874 - DNA, 1946 bp, Bovine  19866880559881
taatcagaagacttagattttggtttttcttctgtaaactaactgctagctgactgtggcaagtcactggacaagtctggatttccacttcatcctctataaaatgaaggtgatggattgtgctagtgtaagtcattttagtcgtgtccaactctttgtgaccctatggactgccgccaggctcctctgtccatgggattctccaggcaagaatactggagtgggtagccgtttcctattccagaaggtggtggattaaatgttctcaaatcactgttctcaaatgccctttcagtttctagctctccatgactctttactaacaaatgtactgaaaacacagacagactggcctgttgaaaatgtcttgccatcactacagcatcaaaaagctagactagtgtacaaaatattgtctatccacaactcaggctctgtgccccttttattccatcctgggtgcagccccatcatcttgctcccagtgactataatgcgctgtgtccatccctattctattttcttaaactggaaattctgccaaaagagtcatgccagcaaattaggtgattagagataaaactggttctgccggcaatgtgggagacctgggtttgatccctgggttgggaagatcccctggagaagtgaaaggctacccactccagtattctggcctagagaattccatggactgtgtggtccatgagccacagagttggagacaactgagtgactttcaccttcacagttgaaacatggctttaaggaaattaaattggagatgtatgaggtcaggcttccctgctggctcagtggtaaagaatctgtctgccaatacaggtcaggaagatcccctggagaagtaaatggaacccacttcagtatttttgcctgggaaatcccatgaacagaggaacctggcaggctatagtccatggggttgcaaaaagcgttggacacgacttagcgactaaacaggaacatgtattcatatgaaatacattcatatgaattcatatgaatacattcatacataattgaaattgagcattctagagagacttgagaaggttggttctgccttttagagcttgcattatgggcaagaaacctgagcctaggaagaaataatatatatgtgggttattaggcaacttcttcattaccttttttcctttcatcaaagaactatacatatgcaagtaactagatcacctcctctcttcttttttccctttaatcacaactgagagggaagtttccagctgggcattaaattaggtcaacagctaacacagcaggagtataggtgacagggacagcaagaggcatatacacaggaaataaagggcactgtgtagccagcatgggtaagctatggagtagtgcacgggccccattaagatttaaagtaataagagatgagaggaaatacggttaccagccgttgataaacactcctgccttatggaaggtgttaatttcactcactggctcttgatgcctcaagtataatctctcgtggcgacctttatcccccagcgcaggcctaaaggacacctaggaaatgtcacctttgtagttgctcgaagaataaccttgggtaactgcggggagacctgaatacttcaagtatggcaggtgtatggagtttcatccatttacaaaattgttgattcagcttaagaaggtatgaaaaagacgtccttgaccctggtatgtgcagatggaagtggcatttcatcaggagtgtatatggaaatgtgcctggctgcaaaacggaagatattttctgctcaaatatgtaataatttggaaccatttattactagtgaacagcagtgtttcctccccgtgaaactgctaatattggactaggacagcctgtcccgccaggagcactgtccagattgttccggaggtgagggagggggccattcctt

SEQ ID NO: 63875 - DNA, 3609 bp, Bovine  19866880579152
tcctcctgctctcaatctttcccagcagtagggtcttttctaatgagtcagttctttgcatcaggtggccaaagtattggagtttcagcttcaacatcaatccttccaatgaacattcaggactgacttcctttaggactgactggtttgatctccttgcagtccaagggactctcaaaagtcttctccaaagcatcaattcttcagcgctcagttttctttgtagtccaactctcacatccaaacatgactactggaaaaaccatagccttgactaggcggacctttgttggcaaagtaatgtctctgctttttaatatgctgtctaggttggtcataactttccttccaaggagtaagcgtcttttaatttcatggctgcagtcaccatctgcagtgattttggagcccagaaatataaagtctctccaccaagttgtcttccaccaaccttgcctctgtagtattagctttagagtggtgagtggtgagccagaccgcactttcagtaacaaagtcagatctgttttgttgttgttaagcagtctgctctgaagaaagtaccattgagcatggagagggtatcctaatgtttaaagtatacagtagaattgaccctcagaagccataatctttttttgcaagactataaaagagagattagtagttagagacttatagaatgaggggttatctcttctttgaatcttttctctgaagccacttacttgtagtgcaaactccctacatgcttgagactctgggtcttgttttcccttctctctcctctaggatctcctacttcctttgttgctttttttattctgctcttttacctttcttctttatctctgccaaaagtttttattgagtgctaatgcgtcagggaaaaatatgatggtttctgctctcagaagacttagttttgtggaggcaggcagacatataaacaaaaaatcacttttttttgaaacttcacattgtagtgcatcatttttcatcagttctgggctcaagaatacaaacagaagaaagtgattactaatgttggcaaaaactaaaatagaatgcgtcttcttgtacattaacagaacatatttgagaatttgaaaagtatgtaatttttttatatcatccaatgtattatcaatcaaactttcagagacttcaaatatactttctaaaacacaggtaaaaatacgttagttccgtgagacatagacacacagctcatccttgagaaagctccgtgaagagaagggggactccaaggtacacctaaggtacaatttttgtgggggatcttggaccaaggtaagatattctggatatcttaagaaaattgtgtgtttctatagagtagattttccacaggcggtatgtagacagcaaggaaattacagcgagtgaattgaatgaatgctgagagtagacagaatgacttgcttagaaaatgacagatgaaaagggatactcatgcatctatataagaatgcacctgccggtccaggagccacaggagacctgggttcgattcctggatcagcaagatcccctggagtaggaaatggcaacccacaccagtattcttgcctggaaaattccatgagcagaggagcctggcgggctacagtccatgaggtcacaaagagtcggacccaactgagcaactaagcacaggcatgatgttctcatcaaaagaatctgacaatctctccagagccatcagtgctccttctttctgatccagtaatgcaacttctgggaatctaattttaggaaatatttcaaaatatggaaaaatccatatgcatggaaattattcactttggttctatttataataaccaaaatgctctgtgtgtccctcagtagagacatgcttatgtaagttaaaaacattttcttcatggaatgttatgcagcaattaaatgatgatcttaaaagactgtgaagtaatttgaaaaatgcttaaataattcaaaaataggataataattgttcaccatgaccaaaactatgtaaatgttcttggggacacgaaaaagataggcaggaaatagagttaaatgtttataagtattgtgttaatgcaggactatgggtgtaaaattatcatactgcctgattgtatgatgaatttgtgattactttgactatggaaatggtccatatttaaacactgaacaatcgaagtagatgtaggtgcctttctatgatatgtgagcagagtcagtgggaggttttccctgggacatatagctatagtcgagtcaggcttaagtattttgccagtcaatcctaaaggaaatcagccctgaatattcattggaaggactgatgctgaagatgagtcaggtgaaaagtatggcttaagccagttggtctaggagatgacacagaagggccgcagagggaggcagaggtcagacgaggcggtcatgctgatttgagagtgtcaactttaacatgttatttgtatcccagacatcaaaaccccatcctgccacagctggtttgcccagggaaataatgatttttttctctgccttctttggagaccttttgccccacttgattggctcagtagttctaggatttgctcttttcaggagctattgatgctctagaaaaaggctgagtcagatgtattgatgactccgccactgttcttgtgaggaatttgcctcctctctttcctgtagctttagttagaattatttgtctttggactcattcctttttatggaaatgataatagtgttcatcatgacagcagccatgactaactttataagcacaaattgtgtcagatgaagaaagcactcacaaactccccatttttagagggacacatgaaggcttagattgtttaagtaacttactagtattatataacaggtgagtggtagaaatacaattaacttttaaagatgtgttcattatcttttaaatatctttattggctaaaagttggtaacttaatgtcagtccctcaattattatttttctcccctaaaagtccacctgttcctgaaatcaccgggccttggaaaccctggattattttttgaacccaaaactcagggcccgtgatttgacagtggaagagaatactttaaataggaaaagtgccagaaaaccccaactacaagattgccgttaggttcagaagaagaaccaaagattcagcttgctgttcagagtttaacactgtgtacaaaacatcctaagaagaatttgagagcttcattatttaagatgtaggaaatagacatttctcaggccttgtgcaggaaatggcaacccactccagtactcttgcctggagaatcccatggatagtggagcctggcaggctactgtccatggggtcacaagaatcggacacaacttagtgactaaatcaatcagctctgtgcagtcctgcctgtctctccataagcaaggccacttcaccatgcattacagccagcgccgtgccatcctttcccatcaggaatcatctttcaaaagtctccaaattgcaaacgtgtggctctgagtgtcaagtgtggtatgcactgtatttaagtaccacttaggaagaaatgcaaaaacctcagcac

SEQ ID NO: 63876 - DNA, 1165 bp, Bovine  19866880623617
cagcagcagtggggccagcacccaaggaaacagtgaaaagacagggtcccctcgggacaggtggggccaggccaggtgaaccacaagcccagaatcagagtcagaagggctgaggggagtcctgcagcatctccctccccgctggagggaagggtgctgtcgtcatcaccagcagtgagctgtttagcaccacgtgggggaaccaccctggcttcttctgagtatggacggcagttgttctgagcaaatcagacaggagcttcgggggacaggcagctgagcagtcttcaggcagccctgttggaagaggtgtgcacagaagtgagaggggagattggggatgctgggcctcaggtgcagccctgctttttcttttttaattctctaaaacgtctctaggtgtcctggggtttgcagttgctgaggaaatttcattctagcccttcttgatccatctggaaattctcttctctctcaagctctgggagactgaagggctggctctctcattatcctgagattaagggatgagtccttcctgtttgaagggctgactgttatcctctgttttctttttccgtttgacggggcccaggtacagaagaccaggtcctgtcttcaaagatgagaactgtctctccccttcagaaagttacggtccagagggaaagaagcaaaacttgagtaacagaaaacaagtcccaagtggaggcatatggcacttaccattggagcaagggagaaacattatgttttggatcttacctcacatcctttgaatggaaaaagggaataaaaaatataagcattcattttgtttatccattctgtatataatagcttacatttgttaatcccaacctcctgctccatccctccccagtcctcttccccttggcaaccaaaagtctgttctgtatgtccgggagtctgtttctgtttcatagacaggttctacatgagctattatatagagaatggattaaacaacaaagtcccactgcatagtacagagagctctattcaatatcctatgataaaccataatgggaaagaatatttttaaaaaaaaataatatatatgtatatgtataactggatcacttttctgtacagaagaaatcaacacattataagtaaaatgtgtgtgtgtgtgtggaagtcg

SEQ ID NO: 63877 - DNA, 735 bp, Bovine  19866880659877
atgtgttacagaagtttctgctgcaacccataaagataccattttagaaaggagaggaaatccaattaaaaatccaactctccaatcatcacaccatctttctaatgtagaaagtgctggaaataaaattcctggcttcttagtatactggtaaggaaacttaaatatttattatttctaattttagtatacaacttaaaaagattccctgaggaactgcctactatcataaatttttatcaacataattaataacaatagcagagccaggaactagtaatgaggctgtaaacttaattaagagcaatagttacagagtgagtcgcactttaatagactgaagaatcacttgaaagcattacgttgctgctcagattctgtgctgtttgccctgagtaaaaaaagctccctgtccaaatgaagtcacttcggagagccaagaaccatatcagagctgcatttaaacattagacttgcatttaaaaatccccaaggaatgaatttcggtaaatctttccactggttaactcacagttgatttgcctgctcactggtttgctgtcaatgagaataaaaggtgataagcatcagggctggagctctaacagcattaagtgtaaaggcagaaaatcatactaataggaagaattccctcaatccaaaaactcaagattccgtggaaatgccagttttacagggacactggagatgggggctaaagtcactattaggcta

SEQ ID NO: 63878 - DNA, 1945 bp, Bovine  19866880701929
agggaacataacccagtcaacacccagtttcagacttcctgtccctagaattgacagaataaatttctgtttttttttttttcttttttttaagtcagtatgtgatgatttgttatggcaactctaagaacctaatatcaggatttggagccaagcatagaaaacattgatgttagtttgccaaatgccaaacaattttgaatctgctcataatcgggtatcattttatcacgcttagcttcaggaaatcagagaatcgagcatatttctaaatgtgctgcctacgtatggtagcctggaagtggggatatgaagtgtaaaccatgggctcgaccaaagcacccttgtaaacttccgcctggccctgtaactgccctggtagatggtcagcatgaagggaaatggtcccaggaagactcacaggcggaagctgatgccctgcggtccattcagggcaggagtcacggtcgtgtacaaggaggtaacctggttctttgtctctattatggtaaatagagaagaaagcaggccttcctacagcagtgagggattgttaatgaagtaaaggaaacagaagaaatgtcccagtggagaaggaagtgtgtcaaaaacagattgtgcacgtaattactttctcagaccttcctgacattatcagcaggagtggtgttttgatgagaaaacttaattaaaacttaatttttttttaagtggaaaatattcagcatggttacaggaggattgaaatcaggatattgtgtaattttaatcgccttcaagagatgtgcctcacacaggtgagtgtgaggagaaagcagccagagggacagaggtgagtggccctgtcacatctccagcattggcaggtggtggaggccgtatgctggggtggagctttccctgtgcaacctcaggttccattgttggcacatctgcccagagcaggggaagtcttgggtctgttcgggagtgtactggcaaggccccatttggattacacattgtaggaagaatgttgatttttaaaaaaatttttaaatgtatttatttggctgcatcaggtcttagccgcatgatgtgggatctttgttatgtcaccatggcgcacgagcttagtcaccccaaggcatgtgggatcttcccagaccagggatcaaaccgatgtcccctgcattggaaggcagattcttaaccactggaccaccagagaagtcccagaatgttgatttttaaattataaggtttgttctccccaaaaagggaaactgaaagttgaggaggttaatgctccacctgaggcaatagtttttaaatgctgatctctgaatcagttctgtcagaatcatctggttccagttcactaaatctgcttgagaacctatgtatttctgtttttaaaatagatcttcccaggggattctgggagtcaggtgtgggaaccgcaggtttgtaatgagaggagcgtgaacttcgaaacaagtaaatgtggaccatgccctttacttctcgtggagagtcaagctgattgctcggcttcctccatcaaatgggagtaataaacttacctgatggcattttgtgataatcaaagatcacaccagtaagtgactgagacacagtaagtgatctcaagatgataaaactgtataggaagaattgaatcaggctccttgctaaatttggggagataaggcagctttcttcaaatatttagaggacagctgtgtggaaggggtaggcaactcatatcttgtgccctttagaggtcatactcaggtccagcaggtggaagtcagaaggagataaatttcaatgcaatataaagtggaactttaaagcgaatggttcaaggatgacccaggcttacttcagagaacagtaccttcctaatccctggagcaattatgtttgtttgttgtttagttgctaagatgcgtccaactgt

SEQ ID NO: 63879 - DNA, 798 bp, Bovine  19866880713359
ttttgtttggggactgccgctgccctggaggactgcctgcgggtgctgcggctcctgctgaggctgccgttgggtttatgccgctgtgtgacgacaaggccaatctggcagttctgcggagatgggtagggtactctttcattcctggctgctttgctcttccaaaagcattaactccaattcagttggaaatcattctccttttcatcagccccaacttctgaacccattcctccagccacacctccagactgctttggacactttgtggcggggagggggggcggtggggggagtgttttgcttattcttgcttgagttgcagcctggtttgtggacactctctccctagattgtcagttgtttgcagaattcccaagtaccaggaagtattttctgatacttgggaaactttcctgcccaagtaccttcattgagtggcaggaaataaaaagacaagcaaggaactagtagagctgagagcatagccctttatcattcttccttagctaatacatctaatagttatcttggaaaggagaatttatttaaacatagtaaatactgtggagagtgacttttatgtttgtcatagtaataacactgctaatgctacacttcaaggcacagtgaataaacctttgaagaaatatcctcataatatggtttcagaggacatgcatccttctgggacacattgccaaagtagagttgttgtttttaaaattagcatgcagagactctgttctaaggctgtatctgtgctccactgtaatttgtctgtaatgggtataaagt

SEQ ID NO: 63880 - DNA, 1900 bp, Bovine  19866880834184
tgcctcaagacatgggggagctgctggaggtgtttggccggtgggcaacatgctgaaagaaatattttaggaatatgtacttggcagtcatgtgtaggtggggataataatacttaaatgttggctgttgtgaagagaaaatgaaatgacatgactgaatgtgcagatgcaggactaccattctttcatccattctattgcttcctctgaggcctggtgccccccaaggacagaataatctcttgactagtgtattagcttcctagggctgccacagccaaatcccacagattgggtggcttaaatgacaggaattgcttttctcacacttttgggggcttggttgtctgagatccaggtcttggcacagttggttccttctgtgggccatgagagaaggatttgttccagatcgctcccacttggcttgttaatggccatcttctcattgtcttccctctgtgtgtgtgtgtctctgtccaaatttcctcttcttataaggactctagtcctattgcactagagttcatcctaatgaccttgtttatattgacttaccctagaaagaccttacctctcaatatggtcacattgtggggaactggggctttagcactttaacatacaaactagcagggggaaacaccattcaacccataacaccgagtctttttggagactttctttttcaggatcttacacttaggtaattacttaggtaattaattacaggctatcttaagaggtatttcaagacccaggtgccccctcctccacccaccatatgccccaaattatgttcatctcttgcttcctgttattccatcactagaattactcagtgaaataaagcagtgatttaagataatttctgtaagcatgcactccttttataccagagcagtgaaaatagcagccaatgaactactgggtgaatttgtttaccaaatggcaaacaagtactaatatgtgagagctagtttgggaagctatgatgtgctacacagtacagcacatttggaccatcccatggactgtcgtggaagactgaaggctctggagccaggctgctggggtttgaatcccagctctgccctgttgtgcctctgtgaccttaggtgtattaatcgctctgatttttatttcatctgagcattgggcacaataatagcacctgcctggttgattagaagataaataagataaataagctaatatacataaagtgccatgtccagagtcaactttccaataaatattatctgctattattgttataatttcatatgaattacaaagcacaacccttcttggctatttgttgatagaggcaatctttgaatgaggtggtttcctatatcagatacgtggaatccagttgcctcgaatttccccatcctatgtcggttctgccaggtgacctactagtgtgggttttatgatgttttccgtcctcagcatatagcctgtgatatattttctaggacccccaatgataaactcaatacattagaacagaaaaaagttcctccctgttctccaaagtgtggttctcaccagggtacttattgcatcctcaagcatgcagtgcttgcttgagggcaacaaaaataaatggggagaaatcagcattctcctagtgatgaggcaaggttgaaggatgacatcattaaaatgaccacgtatcgtcaacttggaactttgcatgtctgcaaagatggccgatcttgctaatttcaaattttaaatttcaatttataaacagtgctgtgatgaacgatgcacgatactggatgcttggggctagtgcactgggatgacacagagggatggtatggggagggaggagggaggagggttcaggatggggaacacatgtatacctgtggtggattcattt

SEQ ID NO: 63881 - DNA, 1543 bp, Bovine  19866880851530
tacacaaaagcacagccatttgtggacgatgcacacatgtgacaatgtatgccaggcatgtgaactaacttacatggctggacaggcaaatacatgtttgcatctttgaaagttcacaacttgaaggtttgtatgtagggggcctactgtatcccctgtgtttggactttaaaaaaaatttattgaagtgtgtatatatatgtgtgtgtgtgtgtgtgtattctttttcagatgcttttccattagagattattatattgaatatggtttcctgtgctatacaataggacatctttgtttatctgtttatagcagtatatatgtgttaatcccaaactcatgactgatcctccctgtctttccccttggtcaccataagcttgttttctatgtctgtgagtcagtgtctgttttgtatgtaagtccatttgtgttatattttagattccacatataagcaataccatatgacagttgtctttctgtctgatttacatcacttagtgtgataatctctgcaactagcattgtttcattctttttatggctgagaaagagtccacatacatctgtatgtacacactgcgtcttctctgtccattcttctattgggggacagttagttcgcttccatgtcttggctactgaaaatggtgctgctgtgaacattgcagtgcatgtatcttttttaattatagttttctctgaatatatgcctcggcatgggattgcaagatcatatggtaactctatttttagttttttggggaacctccatactgttctgaatttggatttttaaaaactttttgtcaaaagcattctaggctatgacagaggttcaaaagtaactttaactgaacacaaattaggaggcactgcaatcttgtcgtaactagcacaaggaatctcaaattctgctcttgccattgaatgggatggagaaaaagggaggaagcctttatggttccctttctgagggcttctgaaagtgatattccttagtgtttccagctttttttggaactcatacttggctctgctatctccaacacagactagatccctgaatctttctgaaatttattagtccatgatgaagaggaacagatttgtcttttacctgctttttgtaaccatagaaactagatcagggcctggcactctgtagatgctcaataaatgttcactaaaccagtaggtgaagctgagaacatttacaagtttagaatagcagtgttctgtgtttttaaaagtaagagtgagaaatggcctgatcttatggaacacatatgggacagagcatgctcagtgaagcatgcccattttggattaagaaatatgattatcatttgccagctctgattcctgcctccaggctgataagatgtgtccaaagagtcattttcattcattcgcagacaccaaaacagaaggggtttttaatgaatgcaggagctgaagtgacagtcattagtagctagaaatagacaactgattgcaaagtcaagatgaaatgcttcaataaaaaagaccctcgtgc

SEQ ID NO: 63882 - DNA, 1556 bp, Bovine  19866880862822
ggaagaggcagaaagtattgctataaaatagttttctagcagtaacaggggtaagctagtcagggaagggtggtaagaccattaaggtgaactgaaaacctcttgagatttgtgtccagtttttaaagcaaagccagccagtatagttgtttattttctctgtattgagttagtttctctgggatagggagagaatccaaggataattgtatttaatcaaggctgtagttttgccagctgagtaatatgaaagcagaaagaggccaaggtggattggggacaaatgcaggcgagtgattattgtgtagtgtgatgggtcaggtggatggcaagggaaggtgaagccgcagggcttcacgcagggctgtgattgaccgtgaagaggttgtcaggtcagtggattgtggggccactgacatcgaattgttgaaattggggccttagaggaaatgagctggaaatgcatttgaaataaaaaattggcaatgttcctcaggcccaatctccaaaagaaacattaaaaaaattacttacatttagctgcatggctggggaaaactgtatttttcaaatatgacttcccaactgattttgtatcaggatattcaccctgatattcttggacaagttatgaaaattaggcaactatttctgtgtcttcactcataaaagaagatgagtgagaaggcagaactgaatacttagtgattgttggattctactgaatttcactgctttgttgcagtttaactgacaggctagaattgcagaaatgtcatttcagttaagccattgagcctcacataagaagatgaaattggaatacaaggtcgtggttggcacaacaaaagaagcttcagtgtgtcacaaatgagagatcattggatagatgtcatctatttgattgttaaataaagcacataaagaaatctccttcccaaagatttgtcatgtgtatttatcttgtgaagcatcagtgaatagaaaactttctttggaaatataaaaatgttgtcatcgaagatatggcagttgtaaagtttgttatatatatgaaaatatatttaatgtcacagatgaatcttgctattattttttacagtatcggcatagaactattacaatagtcagattcatttcccatttattgaaagcttctgtaagcattctcacatgcattgtgtttttagggaaaattttagatgattaacatatgttgcctagaagtagagctttctgaattgaaactgaaataagataattgccacttttattaaatatccagctggcacactttgaaaatgttatcccccaaagagagaaaatgtgatctcagcatctagcattggttttattttggattccaacttccctatttattttattctgttaggataggggagttagggttacagattttgtgttttccctgtatgactgatcaagattcctaggtctgtcgactttattccagaaatactgacaacagttatttcttgagatagttttagattgattcctactttaatatatgttttgagggaatgagtgctacg

SEQ ID NO: 63883 - DNA, 1017 bp, Bovine  19866880883106
gctctgagctctggctttgtggcatgtgagtgttcagtcactcttccccaaaataggatttcattcaccagttgctgtaagttacttgtgacttctaatagactttgcagcagtgattcatttagccttggctcagagagagagagattttaggtgaggagggatggctgggacaggggaggtgggtaggcaggacaggtgtggcagaatccctccctaagggtgataacaaccttcagcgttatgctttataccaggcatgccaccttacacgttatcctggttgaatctctcaacagttctgtggagtaaaaaggcattactgaatacagagggaagttgaggttcagaggggttaagcgacttgcccagtgatatatagctggtaattagacccaagcttcctgtcacaacatattccttcaggcttctccatttcactggacggtacagcgatgttcatattaaacgcctagctgcgatgggactttctcccttatttctctcacatcctgcttttggtgtagcagtgaatccctgccagcttcactttttcttttttattggtttatgacatcatataagtttgatgtgtacaatactgtattttgacttctgtataccctccatcatgtccatcaccaaaaattcagtttctatccatcaccaaacccttttcccgttttgccctctcccgcccccttcccctaaggtgaccactattctgcttaaatacacccagaatctatctcctctgtcactcctaccctgatcccagccagcgtcctctctctgcctgaccactgtgagagccttgtgcctggtctccctgcttctgcccttgttcccctaaggtcagttcccagcacccaggcagggaagtctgtactagggctgcaatctgccttctacccccattatttctccggcctgccttgccatcattctcatgcttgttcactttacttcagtcgtgttgctatccttgctgtctcttcaaaaatcaggcctttgcat

SEQ ID NO: 63884 - DNA, 790 bp, Bovine  19866880891646
ggatggaagaagaaaataaataaccctaaaatttcattataggaaaccaaagcccatgcaaatttgtagcacaaattcatacagtcatcagggtcctggacaaccctgaagcagaacatttaatgttcaaggtcagagttggtaatgtgtcaggcacatagtgcttaaaaacagttttggttggttgatttttcaagtttgacaccaaggctctacagggggcaaagccttccctgaacaaacgtgaggttactgtcagctttatctcacttagtgtgagtattcacagttcgctgcagaaattctagtgtgtttgattaaaaagtgccacatgagatcctcctaaaatccaaaaaaaccccaaattccagaatacatctgtcccagaagtgtttttggtctttttaaaataaaaaaaaaaaacaaacatttgtctctaaagtctaggaacactgggagcagagaagaaaatgtacttattcagtagcataataattattcaatctcaaactatcttttcttcaggaaattaagtacttaaggaaaatcccaagtcattactcacttggggtttcacttttgttacctgaagacaaaataacactgacctatttcaacttttaagtagatagccactgagcatcttccaagcagagctgtttccttggatacgctactctttgaaaagagcttaaaactagttaaagaaatcagcttaaaactgattaaaaaccagcttaaaactagttaaagaaaaaaacctctgatgagattaaataaatgtatataa

SEQ ID NO: 63885 - DNA, 1442 bp, Bovine  19866880977861
attacatttgcatcctggctggtggaaacacacttcattgtggtaggtctttacttgggttttcttccttggagggacaacccttctatctcagaagttccatctccctgtgtcctggtggctagagcagggatctgttacctgggcttagcccatcagggttcttattctggactttgcccctgaggatggtgttgtagaggccaagggacacctgagagaggtttaaaggcagcagcattgctgcgagaagctgcctgcaggccagtgggccagtgccagctaccacgctgtagacaggtagatcttggggcagccagccttagtttctgcctgggtctctaacccttctgtcagttctgttcttcagctcttcccacacatcccttttctgttgaagacagccggatagaacttctgttgctcacaaccagtgaccctgtgtaattcagtctcaatactgtgtggtttgcgtagtcgcctgacataaacaaccttctgctcacgcaatttagcaatgtctccggtccatgtgcatctctattaatttaacttttatgttgaaaactagtcccttgtggggaagcagggttattttggtttgtgtttaataaatagaaaacagagaaatactattggcactgagcattgaaatataaagcaatgaagttgctgataggtaaagtctcagctaagctccatagatttatttgtttatagtttcttcctatccattcaacagtaagaactagggaaatccatgaaaaagagaaaataaagcaaccaagaggataaatgcttaaatctttcacattcattatgagagtacttcacatttctcaggcaaatttttttccatcgcttggtattatctgcctacacttgcatatttaaataataatttaaacacccaaaaaattggtcaggcttttcttccccatttgattctctgttatttcaattcagtgagacttgttatggaaagcatttaagagttgtaaatgctactaattcattccaaagtaaagatgagaaattctctcaccaattccaggttaaaaggtcctgacatttcttgatgaaattggccttgagtgatcatttattagtaactatcttactccatactgagctgctccccctggaatggctttataacaaggtagagagaagcttcatgggcaccagtggccataaccagcttattgaaaagcaaatcaaattcacctttagcttgagtgctgggtaagatctttggtaggtgaaaaaggagctagaaccctaatactgtttcagctattaggcatcaagtctttcagagttgaaaaaggctttataatcattttcagtagtggtttctctccaaagccctgggtgtgacatgacaggcacctttgtctaagaaccctgtggttagtgggcggaattgccacaggatgcta

SEQ ID NO: 63886 - DNA, 1049 bp, Bovine  19866881244107
tgaatgttttagatttgagacttcagtgtttcaacagaaccaatgacttatttagggggcttgtgccttttgctcctgaacaaatctgatttgagcttgcaaatagaaaggatgaatgatttagatgtttgaaatctctttagtttattacttctcttcttactgtggcagatagtggctaactgttaataacactgtttttcctcctaaacacagagctgatttacattacccaagctcccttgtagttaggtgtggccatgtgactgagactggccaatgaggtgttgatagaagggataaatacctgcctgcaccatcatttactctttctctttttcttcctctgtttgtagacacagagtatccaggtgagagattgagaatgtgcattttaataaggtccccaggtgatacctatgcacagtaactttgagaaacactgtcccaggagatgacagagccattagcaggaaggagcatgggttcctgccttgtagctcagaggagagccacccaggagagttgcccctgggaagagccatcttagatcggtatatgtactagaaaccaccctttattagtattaaaccagagatttgagggttgtttgtaattgcagaactctgtgcacctctaatacatccccttcttacaaatagcctaccagaatgatctcattatccaaattatttagtataaaagattaaggtagatcttaaaaagtgacatgagtgaaacccttgtggagaatttttagaaatcaccagttacaagacactggaaatttgcatttgccatataattttcctctctttcccttctttccatcttcttttttttcaactgcctccttcacttcccagtagcaccaaagttaatgggttaagattgcctttgcatccatgaatgggtgaggaagccactcttttgcaaaatccccatggaagctgaaagataaaaagatgcagatgtaagaatataaattttcatttctcttaattccattgtcttattttccctgattatctttaatttctttaggccaa

SEQ ID NO: 63887 - DNA, 1525 bp, Bovine  19866881489332
tatgtcctaaggggacgtgtcaagctgaagatttggagcaagaagattatgagatctggagaggattttggaagccatggaatgcttttatttgcagaaggaaactgagaaatagactcacccatgattattagcgaagagcaaggctgagctctgtgtggccccctccctggggtgtgcaaacacctgctggatggcacagcagagggctcttcaccccagaatgaggaagatggggagaagagggcaccgcggaggccccctactgcctcttggtccatgggggctccacacatggtgggtctcaggccacagacctatccctacacatctaccccgcctccccagaatgggatatgcatagaggatgcacagtgtaatctccctgctatttgaggcaaattaaaatgtaggaaaaaaagtttaatatcatgaacttgagtcaaataaaggtctttgccgatgctttgtccttgagctttttcaactctgaacagacagttgggaatgtaatcagctcctgcctgagccatagggcagcttcgagggaggtagaagaagggaggggacctaattggtatgtcagtgggaagatgctgttgcctcccagtcagacagggatggtcgtcacgcctgcttctgcaaatgctcaaacctccaggcagctctgcagctcctttctgtcttctggacacagtccccgctgctctgtttacctcatcgatagttcccactgtcaaaaatcacatttctcccggctgctcactgtgttgcttgatttgcgccttgtggtttgctggtgtccggggctcaaaccctgagctgctctggcttggcctctgtggagcagccacgccgtgtgctggagacacaggagggggctttgtgaccgtggggaggtgacgcctttgccatcacactccccaagagctcttgtgctctccctgccagaggagccactggaatccaaacacctactggctgagttttatttctagccctgcaaggtcacaggattttacacacacacacacacacacacacacacacacacacaccagatttctgacctacgtgtggacaaaggctttttatctgtccgaattcatatcagatggaagttttctgtctttgctgcacacacattatcacaagtgcaggtggtattattttctctccatctcagccattcccctcccctgaaccttctgcaccctccaccccacccccaggctcttaaatgtcagaggagaatgtctgaggacagcacataactggtgtccaaaaagagatctctggggaacaaaaaggacctgtttgagggcactcatccatatttttaaaatatcttttttaaattgacatacggttgacctacggtgttgtgttagtatcaggtatagagcaaactgattcacattcttttttcagattctttttcattacaggttattgtaagatactgaatacagttccctgtgctatagagtaggtccttgtagtttctctcttttatatgtagtag

SEQ ID NO: 63888 - DNA, 749 bp, Bovine  19866881510272
aattgtgaaaatcccactgaactgtaatgcaaacagaagcaaaaagcacaaatctcagtaattttccttccattttttatagtaaattggtcacttagtaatctgcgagtatacacacatgcagcctgacaatcactcttattgtcgccactctgtatttgtataataaagacaagctgttggtaactcaaattaattgtaatgtgagctacgcttgcaccctatattaggcatataaaaggcactgaatgttggttagaaagaacctcagtagggaagagctagttaagtttcaaggttagagagaacctgattattttatcacatcatcgagatattttcaagaaaattccaaatctgcttgaagaaaggtcttcactccacacaatgcagacgggtttaataatacagtacatgatgctgaaggaatcagcttagtcctgctaagcctcatcctacggcacactcaggtttcccaaatccctacacctggaggcttagatttcagcagtgtcaattcagctttttattcatcaaaggcaaacacacttcagtaacaagcaatttgctctcttgcagagctctgaatgatggcgaaaatgagtgtcgtgtcagcacgtcatggtcaggaaggatctggctttgaacactgcagagcaattaccagggcctggatcaaaacaacaggtaactgagcccttagttatcccaggggcataataaccaccaagcacctgctactcacctag

SEQ ID NO: 63889 - DNA, 673 bp, Bovine  19866881619139
tgttgaagtgtttagacagccattaatctcatttgacctgacaacaatttatgagataggcagtgtaagtatgaccatgaagcccattattgcagataaaggaactgagattcagagtggttaattaactagcccagggtcacacaggttgggggcagcagattcaagactgaaggtcaagtttcccacctcccaattcattattttttcctttatgcctcgggtggcatttttcacattagcattttctttcattcttaagcacttcagaatataaggtttgtgtaacatcaggttggtttctggtagtacattgattgtggagggccaggagcaagaaaccacagactttaaatgacgggtactcttattggaggtttggcctttattgaatggagggctcttgttaagggaaggtatgcattgatataagaggctggccaatctttcaaacaatggaaacttctgggctccttggggatggctaatgatgattatggaggagtctgccagtgtgaagtactttataaaccctggaggagtggcaggggactgtgtacttctggggagatagatttttacatctcttattctctgggcactgctgcctttggcgtgcacttgttcttataaataagcctgttttgcttctcttttagaaatggtctgttat

SEQ ID NO: 63890 - DNA, 1744 bp, Bovine  19866880350483
gtgggcttacatatctaccctgataaccctgaagttctggtggaggtgactgattggggaaagaactaaacttagttaacaattaattgtcacactttattcaatttattaatacatttcacaaaaattaaaatttctgtggtagtgaggggtaagttacgaggtttacgcatgattaaaaacaagtttacactggactatctggtaaactgcaaagtttctttaaagttacacctgcatttcagtcactacactacacaaatgattattatttttttgtttttatccctgtttttctggtctgtaatgtgttaaaaaaaaaaaaaaaatgcagaaggaatgctgataagtgtaattaagaaaagttacccaaggatgggatttaagtacaggattaatttcagctggtctgttgcaaccctgtgtttacccttaggtacatacctggaaccaatcatgttgctgacccatggccaaatctaaatgaaacagattaatatagtctgccccagggtcacagacagaccaggggacaactggcaccactagcttgtcagcactgttcacagaacttttacagattcatgggttttacacctggtttctgttacgttcccttgctttttgcctttgagcctggtcatggagcccgattctggctatatgaacagagaagggtataaaagacatctctgtgtaagacggatgcttccctgaaaccaaggtattgtacacagatctgagtggtggtccacattctgaagcatgttctctgcgactgaggtaggacccctggaggtgcctgatgattctgaagctctgtgacatccacctatgtatttttttctcctgctgtacgaaaatttcagtatttattgatgttttacataatataggaccacaaggaataatcattaagtgaataaatgaaggttataaaatgtcactaacaatcactagttctgtcgcctctgcattttaaatggcgtttttgctctccaagttacacctttcccttcatattcttttgcttagttgtctgtcactgctgctgttagctctgaatagcacaccacttctaaagtgctacctctgaagtgcctatttgctgaaaaagcagacattccaagtttgtttgaagtatgttgctgacttaggtcaataagatgagagaaaagtgcttaatttaggtaaatggagttcagtacatcatttcacccagggagactttaaacatttaaagtcaaattaagatagctgcatagtacattacatcaagaagatatgttattttccagatcaagtaaaattttaggcgaaaaatgaatgtgacatggaaaaatgctcatatattcattgttttcttatctgccagatttttaaactacctctagaaaagggattatttaagaatcaggaaagccatcagagactgctaatatgttaaagacatggaacaactgtgaaacctcaaataataaaagaatatgaacatcaaatgtacctttatgtagtcaaccagattttgatattcaatgtagttgcctcctcccaccacaaaaacaattgcctaaaaatgcaagtagaagaaaataggtaagttaaaagaaacggaacagtattttagctctcaagcaacatggcttttagtgtggagcctattccacaacttttgctgctgctgctaagtcgcttcagtcgtgtccgactctgtgcgaccccacagacggcagcccacccgtcc

SEQ ID NO: 63891 - DNA, 821 bp, Bovine  19866880352359
tatgtaattaatatataaagaggttacagaaaaatacagatcccttctttctcccccttttccttcctgaattgttatccttgccatacatgtgtttgcatagtttttccacaaatgtagatacccacaaactataatctgtccagtatggtaaaacttgcacataatttaccactaaagtgggcttccttggtagctcaaagagtctgcctgcagtgcaggagaccccagttcaattcctgggtctgaaagatcttctggagaagggataggctacccactccagcatagtccttggggtcgcaaagagtcggacataactgagcgactttcactcatcactaaagcatatattttatcaatttaccttacacccagatctccactcgttgtgggaactaatgctccatctttcctattccctctcagtcttgtggaattttaaagtcaacaggttgcctcattcccttttagacactgagacatgtacctcatttagcttgttctctgaatcccacttaagaagaattataaatacacagataatagggcatgtgtgtgtatatatatatatattttccatgcccttttatccttaagaaaagctttgggtgaaattttcagtatgggttttttattgtttgttcttacagctcagttccaagaaacaaaaatccattccaagaggtaagttcatataaaaattctctgtccctaaaatggaaggatgaaaaggtgaccccagcagtcttgaaggatatctttgtcctatggctttatgatgattactgtttggcagtccttgatcaatctgatccctg

SEQ ID NO: 63892 - DNA, 1482 bp, Bovine  19866880440936
attcccagcagtttatatataatgagcagaaattggaagaaacagatgtccataagccagtgaatggataaacacatagtgataaaaccaaatattattcaacagtaaaaaaaggaatgaattgttacatacaacaacatgtgtgaatctcaacggcattacactaagagggaagaaaagtcagacacaagaacctcatactgcatgatccatttatatgagggtttggaaaaggcacacctccaaggacagagatcggatggaggctgggaacaggaagagaggctcgactacaaagagggcataaaggaacttcatcaggtgatggggatagtctggatcttgtgatattggttacacatttgaatatacttggcaaaactcattgaattataaactttaaaagggtatatcttactatcagtttcttacacctcagtaaacatgacaaggaaggaagacaggaaagaaggaaggaaagaagggaaaagaataaagaggaaaggatagaaagaaaaccaggttggcctgctcacaggagatcttaaaaagatggagaaccaggtttggaggctctgtagccaaaacccaaaatcacgctggggtgatggtgaggcatcgtggctgacgctggtggagacactatggcttccaccactgcctcagaacagtggacaccaggcattgcccctcaggggcttgccctccgctgcctctggaaatgaacagctccatttccagaaatggagttttcttggggtccctgtttcttcatgtcatgattccggtctggaatggagacatctgattggcagagcctaggtcacatgcccactcctcatcagcatgggagactggcagagagagtacgtaacactttcagcttctacagagatgaagaccctgcattctcaaggtggggaactcctctcacacaggaagcaggttcccaactgtctctccagcataattctcttctgggcagccaagaagcgtgcactgtctaccacaccccccacgtcacgactctgatgaagaattttagatgaatgcacagggcctgttcctctggcgtcagcatcctcttgccccactgcctgactggctctaatcactcaggagctgtcattgtcccctgcaggttgttcttttcatgtcctccttccccgtctccatctgaggagctcctactcatttatcaaagcccacttcagggaactctcagccaactcttagcctctctacactctgctctaggacagaatttagtaggtatgaaattaatgtttggtagatgagaactgtccttctccaaaatcaaagaagagaaagatgtacttttaaacataaaataaataacatttaaaactctactcatatagtcaaaagtaatagcataattttttatgttttccagaaattctgaaccaacagatgacctttggctcagtatttttattcctcactgtgtccgaagattct

SEQ ID NO: 63893 - DNA, 4646 bp, Bovine  19866880469224
cagttctaactgttgcttcctgacctgcatacagatttctcaagaggcaggtcaggtggtctggtatgcccatctctttcagaattgtccacagtttcttgtgatccacacagtcaaaggctttggcatagtcaataaagcagaaatagatgtttttctggaactctcttgctttttccatgatccagcggatgttggcaatttgatctctggttcctctgccttttctgaaaccagcttgaacatcaggaagttcatggttcacatattgctgaagcctggcttggagaattttgagcattactttactagggtgtgagatgagtgcaattgtgcggtagtttgagcattctttggcattgcctttctttgggattggaatgaaaactgcccttttccagtcctgtggccactgctgagttttccaaatttgctggcatattgagtgcagcactttcacagcatcatctttcaggatttggaatactatgtattattttccactcccataaaatggtgtatcaagttatttctcagattggaaatacttctaacaagatgttctgcattttgataaacttaactctgcatttcttaaattaggtttgttaaaccttgttaaacatctgatttccaatgaaaactgtgaaagacatacgcagatagattattcttgcacatttttccctcaaatattctgtgttagggttcaagtgataagtgtgtaagtacccttacaaggtcaaatacaatgttacatattttaaattcagatcaaactaaaggacttgagaattaaattttgatttgctgatggctcctacagttttatgtcaaaaaagaaacaaacaaataaacaaaaccccactgggacaccgaggaatcttactttatacaaatgtctatcaactttcctggcagtcataagttcaatgtgccctacggggacccaggttcaattcctgattagggaaataggatcctacatgccatgcagccaaaaaaaaaaaggaaagaaaaagaaaaatgtctattaatagttcttaatagaacttaatacaacttattaagtctatagaaaagacaattataaattaaagtgcaaaactcaaattatggaaaatgtttctataaaatcatcactccattaatttatctgcaattaatttgtttcaacattataaagtcttttactctaatgttcacattacatggggggagcaaattcgtaacgatgtggatattttccttaaaaatatgtaagaaaacaatactataaaactacatttgtacactcacattattaagatcttaattaaagtgtgtcctaagttaaaatgaagcactattaaaagttacatgaacattttttagtcctaaggatatcgctagagaattatggctccattttgcagataatcactttgaaagaaacaatgaaacataaaaatggctgtattaaacttaaatttggggatcagtttactcaaccaacagaatccatcttttttgttagttacatggccacaactaactctaattcaagtaagtaattaatgatcccaatatttgatggtggtcatgaaagaactccactgctataacctgagaggcattattcaccctttctgataaaatgtgctaataacccaataaaactactcttgaagacagataataataatagaaaacacttacacagtgtttaccaatcagacaagtgctattttgaatactttacctatattcatttaatgcgcataatagctttatgagttagggaatgtttttatctccacttcacagacgtgaaaacttagtcactcgccaaaggtcacaaagtaaaatggctgaggaagaacccaatcatgttagctgggctccagcatctgtgttctcactcactgttctgtatctccaggtttgcctcaagactccagtgattcagtgacagctattattgtgaccatggacgcgcaatttcactccccattcaccaccgtaaatcaagttctacccagttgtatcttctattcaaaagctttcacttgttaatatgcatatcttggcagttttcatcttgactccagagcatatcacaaaaggtaattgtaattctaacagacaatttgttcttagttgatctcaacatgcagcttaaagtctgagaagtggctcaatcagataatgtacaactttaagacaataaagctcctgctgctgcatttgtaacagtgtgtttaacatttgtgattagacctcaactcccaaaattcttctgacttattctcctagtgagttcagctaacctccctttctacttccaataaataaaataaacctcgcaaatgctgtccaggataagtttgcagacatgtatttgaatttagtatcattcttgttcagatcagatgtcagggtaaacagagagcctttcaggtggcctgcctggtggccctttacccagcgtcactttttgcttttctgaacttcacaacaaagtagagcaacatggtatactcctggccaaaaatgtaaacaagagattaaagctgtcagatgagagcctcccaaccgtttccagtggatattcacacttaaatttatactggcttatatcgcacatctaagacttggaaaagtcacagttattttaacagaagtcaaatgagctatttcaatagcaggaatctgataaataaatgtaggtcaactagaaggcaacttaaactttgaaacaccaagagtgcagagaagtgagggagagcaaacagtacaggagcagttttggaagttcctaggatcttctcacagaaaacagtaagagccaagaagaatgcaaaaaaagaaaaacctgtacagcaatatctttaccaaaaaccaagtgaaaaacatcccctggacctctggaacactatctactcttaacactagaatgaggagaccacagctgtgctattttaatggcagaagtggaggtctgaaaatgtggtcttgttaagggtcaaaagaggcttcccaggtggctaagtggtaaagaatccatctgccaatgcaggagatggggtttcaattcctgggtggggaagatcaaggaaatggcaacccactatagtatttttgcctggacagagaaacctggacactttttccttggacagaggaccctggtggggctacaagtccatggggtcacaaaggagtcagacacaacttagcaactaaacaataacaacagtcaaaatagccaaggagcccagtaccaagtcaccattgaaaggaagggtgaccccctcccctgcttgaagtgagaaccccaggagagaatctgagtaccacactgagaacttggaggatctctcttgccaatggtggtggtggtggtttagtgctaagtcaagtccaactctttgcaaccccatggactgtagcctgccaggcccctctctctatgggatttcccaggaaagaatactgaagtgggccgcgttcccttttccaggggatcttcctgacccagggatcaaacctatacctcctgcattgcaggcagactatcactgagccaccagggaagcccctcttttgccaatgagttcaaggaaaggtcccatccaggatcctggaggctcagcaacatccaggggaagctcttttatagaaagacagacaccatactgagcagaaaccgttggagtagaacacgataaaatgtttcaaaagacagttagctagttcagctaacactgacaatagctagatcaggctgatcaagtttagtacattacagtagtaaaattgagacaactgggcattctgtgctgcctgctacggtgcaacagaaagtacactgcagccccagtagagaagtactttcatccccaaatattaaaacctgaaccaaacccagtctctagacctaacttccagcttacggacaatatggaggagaaaggaatatgctaaataatacaataaaaatgcaatcagccaaatgtgggaaattctacaggataaataatctcatcccttcaacaaataaatgatacgatgatgtggggctgagaggaagacaaatccaaaaaaaaaaaacaaaaaacccctaaagatacagtaaataaaggaaatatgtaggttttgtttggatcctagtttgaaaccaccaacttaaaaaaaaaattttttttaagataaaacggggaaactatagactagggattagactgtataatggaatcacaattttaaagatgtgataatggtattgtggcatgttgaaaaaaacaaaggtcctactgtgttaaaaatacttggagaaatatatgccaatgaaataaaatgatgcttggcatttactttaaaacattcccagggctgggcatgggaaggagtgtgagggaggccgtgaattccgtttcagggtatctttgagcttgctgagtatacaccattagcaaggctcaccctcttgagttgaaaaaaatttatggacaagaagttatcactgaaattaaatggtgatggacatgtccaagaagtctttggggatttgattcctttatgaatcatgcaatatatgcatgtgtggagatggcaacggcaaggacagaaccatagggaaggcagtaatgtaagaaacttgtctc

SEQ ID NO: 63894 - DNA, 1279 bp, Bovine  19866880676285
actctaacttcatcagtacaccacccaccatggtgtgatacgttttattatcaacacagtgccactgccctcaggaggacaagtttgcacatttccagacaccagggacacaatcttcacctttaactactgagattgtcaagatactctgaaactgccctgttttgttgacagtttatagagtggaatacaaacagctgacccaggcccacttggggcatcagcttggtaacagcgactaaagaccaataatggtcatgcagcaaatacctcatgcaaggattcgaccagcaatgctttctggtaacacagagctcaatggcgccaatctactctgccacacaggcagtacactgtccaaaatacatgggtcatccacaaaatatgaagtcaaattaagaaggccagaattccccgtgaaaggccagcagacagcatggctccagcatggcatcaagctccagaccaacatcaacttctataaaaccagtggcagcatctaacctcttgtgatacagggcaaaactgtgacctagcacacacgccacatctgacttttccagcagttccactagcgtcacctttcagcaccctggatactagataccagcacagatccaaagtcccttaaatcctgggatgtgattggtccaccaaaattaaagccacattttcttacagtgtacgcccaagggttggacgccaacaccatcgaatgattccagcacaacctttgggaagttagtggctgggaaagagcacagggaagccttctggatggtggctacagaggtaatacatatgcacacacatacatatgtgcgatttctaactagtacaacatggatttcacattaactgggttttagaaccagaatgttcaggttaggtttctaggtagattattttggagcaggcgggtagtggataaatcttagtctcttactctactcaatatccttactctaatacctccccaaacttctctgctcctcacggacacagctgaagagtgaaagcaaataccgcaccaaaccaacaacagtgttgtcacatcacaaagacaagagaaaatctctactctgtgatttttttcccttagaagaatcagaaaaatagtcacacacttactggaacagggtaagaactcctctccaattttctatgtcttcacccaaaggcccttctgctacagaatggcaaaggagagagatttaaaactaagccagctgaactacttaactgatgaggcatgcccagtgaggcctgcaacctgtaa

SEQ ID NO: 63895 - DNA, 898 bp, Bovine  19866880726378
tttagtggtaaaagtagtgaactgataggcatatggagtttttgtttgttttggtgtgtttaaaacatacattcaaaagtgctttgctaaaatgtccagtggaaatttagcacaccttaaaaactttatatctttatcatttaataagaactaagaagaatcatttcattagctttcaaatacttagatcaaatgagtcctttaatctgttttacctaatcatcaaggtaaacccaaagtcctactaaacattaaaatgaggggaaaaacaaaacacacaaagaaactaccatgttgcaacattttacatgaaaacaaaaattaaataaattattaccaaaaatccaagggtacaatattaacaatacagttgtcatttagaaaatcagcatgtgacatttttcaaggcagcaagttaaagtacttttcaaaagtctgaactaaagacactttgttgatattgataagaggttaatctttttacctttgtttctccatctctaaagataggctgtgaaaccacttctacagcagtcaaaaggttattatagaatttatttgcttacatactttaaaagtattaatgagaataatccagcccaccaaggccgatgtctctaaaaaccattctaacataaagtataaaatgtaggaaaaaatatgtttataaaaggaaaaattaatttgctgaaaatctgcaaattcactaatataatctaagtaagtatagttaactctcaattgagtgtttattgtctataaaaaatttaatccaaggactagtttcacctctaacactgtcttttccatcccctcctcatcctctccccatccctcaaattaaagacgaagtatttaggaaatgacaaactaactttaacattatcctttaaaaaaa

SEQ ID NO: 63896 - DNA, 1305 bp, Bovine  19866880733425
atgatgttctagaatatttaagactaatttatggtgggaagacatcaagacaatgttttgggagcaagttttgactaaaagcaaggactgactggcaaaggccataatggaactctgtgtgaacttctgtgccttgctatggtttgggttactcaggtgaacaatacctctgacagaggcaggaatgaacactcaagatatgtgtatttcactgctgtaaattttacttccagagagtaacacaacaactaaacaaataatgaaatctagtgaatgatattggcactgatgtattaagggggaagtgtactgatatctgtaatttactctgaaattaagctggagtaatgaacagaatggaaagatggacaggtgcttataaagcaaatgcaataaaatgttagtggggaatgtaaatgtattcactgtaaattctctccagttttcctgtatgtctgaaattctcataataccagtgggctaccgcattaaggttaagaataaaagaaccatatgatagtgggtaagaaagttgtgctgggaaaaggtgctaaaaacgagcagagggtacagttatgatttttatgatagccaaggcaaaggtgagtaaatattattggtcagcctactaagcctctgaggcagtttaagctttaaaaagctgaagttaatattgggaacaatagtcaaagaatgtaaagactttctatgcctcagcaactgccatcattgactttcaaggtgaatgacattctgttgtatcaatcccccaagaaacaatttctcagtccaatttgtgatatgactggcaaagtcagaaatatggacagtatgtcaaggaaatgctggactgaattttgcctaagcaaggacactactccaattaaaagttttcagaattaaatttaccttttcatagatttgggataatggaaataacattacacacaagagtttcctttagagttgtccatggcaaaaccttacattcttctagttctgtggctttttgtttcagctggctcagatgaataggattatcttgctctcgtttgaaaaatatcaacagcaacttaaggtatgttaaagaaacaaactaaaaagtacactttacctgttttatgaactgtgcagcattaaaaagttcactgcaaccatataaaatatgcttgccttgtttcccctgtaaaagaatcaaacacagaactcacatacaaataataagtaacattttcaatattcccaagaagaggggttaaacataacaagactttttgttattcttaaaggtttatttccctttag

SEQ ID NO: 63897 - DNA, 1205 bp, Bovine  19866880798560
gatgctagtggtaaagaacacacctgccatgcaggtagacgtaagagacgcacgttcgaccctggcggagggcacggcaacctactccagcattcttggcctggagaatcccatggacagaggagcctggcaggagcctgaagtccatagggttgcacagagttggacgcgactgaagcgacacagtaaacatgcatgcagcgtaacaggaatacaggtggaaattttttaatattcatttaaatgaagacatcttcgttcaaaattacaaaatattacctgcactgtagagaatacttctacattcgcaacattcccaattttgttcccatgactgtagtgaggaacaggctaaatgtgttccgctagaaccacaacactgacagcgctttatttcccatttgctgaggacataaagagaagcagatatttacatttagtattaactttgtctaatttcaacaaccagcgccaccacatgcctcactgtccatctcacacacacaaccaaagaaaggaaaattatctgatttgatactgtattactttttcctagtgctttttttcctatttcatttattacatttgtaatctccctctttgaatagtctctttttaaaaatatttatttttgtttatttattattggctgcattgggttttcattgctgtgcacaggttttctctagttgtgaagagtgggggctactcttcagttgtggtgcatgggctaatcattcaggaggcttctcttgttgcagagcatgggctctagggctcacgggcttcagtagttgctacacatgagcttagtagttgtggcacacaggcttagttgtccctaaggcatgtgggatcttcctggaccagggatagaaccagtgtcccctgcattgcaaagcggattctgaactattggaccaccaagaaagtccaatattctctatctaaaaataggtaagctaaataacaatgtgaacatgcacatatatccaagaatataagcactgtaaagaatatgactgagaagaaaaaaattttcttttatacttggagatgattatgctatatagggagactgctatgtcaatgtgtctgataaggaagaagcattcagtaaatacactgtcttacctaaaatactatctttcctattcaaggtaaggaattatttcctataataagctgctcagatacctcagata

SEQ ID NO: 63898 - DNA, 1869 bp, Bovine  19866880961039
actaaattggttagccagtcccatcacaatgactattaaaaacctacccccaataatttggtacaggggatttacttcaggcattttaaggcagtttcgtgtgcaactgtgtacttatgtgtgaaaaatatatacatgtaattttatgcttcctttggttaggaagatcccctggagaagggaatggcaacccactctaggattcttgcttggagaatccccatggacagaggagcctggtggcctacagtccatggggttgcaaagagttggacaagactgagcaactcatgttgtaattttatgcaactgtaacttggttttaattcacttaaaaatatttccattgtaggtatcaccatcttctctgttggtgtggcttgggcacctctggatgacctgaaagatatggcctctaaaccaaaggagtcgcatgctttcttcaccagagagttcacaggattagaaccaattgtttctgatgtgatcagaggcatctgtagagatttcttagaatcccagcaataatggtgacattttgacaactgaaagaaaaagtacaaggggatataatgtataagttgtattctaataatattgaaatactacatagcatactaaaatcagagaaaactattatattaaagatgccaaaaatgtaagcaaataagcattcatttaaagataccttctaattacaatttaggcttgattgttcagaacgcttcatcatcatgatccttagaatctcaggaaagagacagtgtagattattaagagttctattttaacatgcatattaaatgtataaatatgcaaattctatacagctcaataaaagaacttgatatttagacccaaagcaacattccttctctaattattacatatataaggaaaatgaaagacaaatagaaaaaagctccttaaaatatattttgacccaagtagatgtcttaaaagtcaatcaacaatatagatgttacttaataccctaaagttgtaattacagatgaaatagaagcgatttaggtcaagcctcttttgcagtgtattttcaaaacttatagcaaatatcacactgaacaagatggcagcatttgcctggtatttttctatttatatccttagttttatagtgtattgatgtatttggcttgtactctacaagtcaccaatgtattgaaaaacaattaagttggtaaaattttacttaccacttagaagcatttagctttaaagaaaagcacatcttccaaacagccgaactgcagcaaagactatttaagcaataaaactgctagtgacttcaggtgcctgacttaccattctacgtgtctctccctagggcatggtaaaatttctttacttcatgtggaaagaccaactgagttttttcttaaaatcacatattaagactttttttcaattacttattgaatgccttctgttctaggcattattcatggccagtaccaggttaaacagtaggaaatacttttgagtactttgttcaacaaagttgttttgttatgaacagtatttttactgttgtgaagttggttcttaagaacagcgatccaaactcccttaatgtaactatcattaccccaccaagaactctccccagatagacgtgctgtcatatcctatcccatcttctctaagaccaagttttctatttcctctcacacatacactgatcttatatgaaatggtttacaaccacccaaaccagtcaacctgcaaaagatgttaactggttggaatatcactccaataaatgttttgaatttaacaattttatagtctgtgtaaaaggaatgaaagggctatgtatcaaaggcagaagtgaaatcgtctttgaca

SEQ ID NO: 63899 - DNA, 1074 bp, Bovine  19866880976124
ctctgtaatggtaaacagaactttccattctgtgtgttacttgggatcttttaaaaatcaaaggaaacagtgggcagtccaggtgacatgggaataatcggggcttgtatccgaaaaggctcccggcaggcgcatcctgggttccattactggctgtccctccccgtccctgctcccgtttgaagcggctgggcagactgcctacacctggaagccgataagacacgctcatggcacgctctcatagttttccaagaaaaatagcaaagaatgcccttgtgttgaggtgcaggagttgctgactggcagggtctctctagaatcaacaggcccacatttctgcctcctcatgttcccaagttgattctcagctcaaaatgagtaaaaaccgatgtgtttttgtaaatcaacaagtacagacccttcactcctttaaatgttgatgtgccaatttaaaaatattggcctctgctcagaaaattactctgctgacagtgtttgcaagaaagggattgtccaaacactggaagtagatagttatagctttgtttacatttgttcatattaacgataactcagataataattcttaagcagcactatgagccaggctctgtggttggtacagggatcagggcagtgaatgagtgtctaccccaagaagcttcgctatttaaggacaggacatggttattttcgaggtgatattgcatagaaaaactgaacactggcagtgtgggtttaaaaacgttgtgtggcattatattttgtgtatagcttctcagagactttcttttcatcgttttgttggggaagagtaatgtcaaaattactattctgagcgaacataattaaagagaaaactgaaactacagaagtttgtgattgtagcagaagaatttttttttcgggtgtctgcctcagagcacatccatgggatgtattcttactgcaggaaaatttagctttggtcttctctcttagagtccctctttctgtgtttttggattgaggaacagccatttgtaggggatgttctgtacttctaattcaagcagacttacatacccaaag

SEQ ID NO: 63900 - DNA, 1760 bp, Bovine  19866881149183
cttgacaggctggagtatccacctccagtggctcacttatgtggcttttggcctcagttctcttgcctcttggcaggaggcctcagttccttacttcctgggcacctctgtagggctgcccacagcatgacatcaggcttctcccagagcaagtaataaaagaaagggatagatatacaccaagatggaactatatgacctagtttttataatcatataccactattacttttcctttattctgttagaggtgagtcatgattctagctcacacttaaggagaaggaaattagttcccaccacttttaagggaggagtatcaacaaatttaggggcgtatttttattcttacaacagcatccatgttaaaacttagatgcttccttgagtaatactttaacataaattcttggtgtttctctaaggtttgtaaactgatctaggaacctaattactttgtaccaagacttaggggaacatgaagttgatattccagattatttgtcttaaagtcatatagggcttagagtcttacagggcttcccaagtggctcagtggtaaagaatctgcctgccaatgcaggagatgtcgattcagttcttgggtcaggaagatcccctggagaaggaaatggcaacccactccagtactcttgcttgggaaatcccatggacaaaggagcctggtaggttacagtccgtggggtcacaaaagagtcagacaggacttagtgaataaacaacaacaacactaccgacaacacaaagtcttaaagtttgtatcacaaaagaaaacctttttatatttctaaacagttcattttactttttatgtaatataattagaagagacctattttattattagtcagtgtgttggtttttttttttcccccctgtaatttttaagtaatctatggcccttttgggattttttaagatacactgattaaaatctctaatcacaagtctgaagtattactgagttatttaatatatttaacttggtcatatcaaaatttcccttatgttcttccttattttattaatgagtgtagtaatcccaaaacacgttgaccctagttcaacacttacaggactggtgtttcattgtgaacgggaaggtatagtaatattataaatgataatggaatattagagctgagacttggaaacaacctagtctgttgtttttatttttgtgtttaatattagaaacactgaattacttgcttagggctccagaaagttgggctcagatcctggtttgcaagccagtacttattcacagcctcatgctttttcttgattcatgttcccttaatatatttaaactgaggttaaaacctattttaaaaaatttattttcattaactataattcaatagattatctataattacgtcttttatgattcagaatccagctagacttatagttaacctgaaatatcactgataattatctccatagtatttattactattacatatacatctttcagtatatgccgctttttcccgcctaaaacttgatcgtaagtgtttattgtttgtcttccttccctttccctgttattttctatgatactttttagaaaccagtttggttatataacatgttaatatatagtgtctttgaaatcaaacaatatgagtagcctcttactttgactatgaaaaataactattataggtaagagatacttgaaattagagtgttttatatccatttttattggaatattatagatatatatt

SEQ ID NO: 63901 - DNA, 1206 bp, Bovine  19866881238164
aatgcaggcactcccacaatttcaaacatcattttcactgataggttaccctctgaaatatatgctttggaatgagtataccgttagatacttttgaagcattctaaattatcttagatcttaaagggaacccaaaagtaacacagtctcagcttcatttttattttatccacaaaggtgctttgatactttttttttgaatgtcggaaactcctgagaggctttgaaaaatgtttctcagttctttcaaatagtaagtgattccttgaaagatctgtctgagcagaattatactggctctgcagtgaacctaaagctgtagaatggtcctggatttaatggtttttatcctaattgcaaataaaagcctcaaacccttccattatatagattgtcgaatggcttcccatggaaaaaacgccataatcaaagcttgcagcttcaggaattccctggcagtgcggtggttaggcagagaaggtaacggcaccccactccagtactcttgcctggaaaatcccatggatggaggagcctggtaggctgcagtccatggggtcgctgagtcagacatgactgagcgacttcactttcacttttcactttcatgcattggagaaggaaatggcaccccactgcagtgttcttgcctggagaatcccagggatggcggagcctggtaggctgtcgtttatggggtcacacagagtcagacacaaatgatgcgacttagcagcagcagcagcagtggttagtactcttccctttcattgccatgcccatggttttgatccatggtcagggaactaagatcctgcatgccacacagtgtggtcaaaaaaaaaaaaaccttgaagcttcattcccaagtatatctgaatgtcatagagcaacatatcccagtgcaaaaagtgatacagttcttaatcacgtttggtcaagcaaacccaaaagtctaaaggaagggcaacactgtaccttcatcctgctggttgaattcctatccacccagcatcttcctctccctctttatataatgacatgaggggagagatgaatgggaagtgagttgttttctccactagtcaatagtggtaagttatttattaattcttacaaagcactatttacaatggatgatttttgtttcgtatctgtcacataaaaaccacctttaaataatttttaaaaagagcctgtgctgtg

SEQ ID NO: 63902 - DNA, 934 bp, Bovine  19866881249631
tatattaaaaatattttgtttgttttctctttgttaatttctttttagcaatacaaaagttgcatttttgtgtggctaaaatttagtttctttgcagtctttcattttatactaactagctttgaagtataaaattttagatgtcttttttctcttaatggaaaattattagctcaattttaaaattactctataaatactataggcatgtaatatattcattttatattaatacattggcttgttattgattgaaagtatcatgtagtatgtccatattttttttctcacatctaattatgtaattgtaaatgagctagaaatatgtgttccaaacatatgtgtatgaatgttggctcattatttttcttctctttaagttttaaacagggtctgaaaactcttggtgttttggagaaaattcagacttacccagaagcattttttcacatcttctgtcataaacctgagaatctttctgcaaaaatacttagtgatctttttacagtacacacattgtctgatgtacagactttggggttttggaatagttacttacaggctgttgagggtatgtagatgttttattttcatttaacttaaaaatttgttttgggatatttatttctttgagttttgcttttcatagtaagactttcatctgataactacaatacttatttacaaaacttgtttaaaaccaagttatgacagtttaaagtgataaggaaagattataaagtttatatttcacttgtttctgtctcattaatttgagatgagagtcattcttcttagaaaactttaaatatatgggtgattgccacagcataggagagtcatctgcttcaaagctagtcatctacttcatcttttcaaatttttaagtcaaattgaattattccaaaaatgaattggtcagaatatggtaatg

SEQ ID NO: 63903 - DNA, 743 bp, Bovine  19866881283218
aaatagatggctattaactatcatcagagtcagctgaaatcggagcgtaatactggcataacttttacttaggtcctgaattgatactagcttatgaaagttttaaattctaattaaagctaccagtgggtcaaagtaattcccttggaaaataccattgggagtaatttcagtgcctgcttcacttattttaaaagctaggcttaacattctaaaacataataatactataaaaacaagaacttctagttggatttcagttgggttcccaaagttgttgcttttcagccttttaataatcagtgtttcatgaccgcattattttttctaaatatacaatgtagtttttctaaggtttacacaatcctcccttttttgtactaatttgcttcatttttatccttagcttctcctcttatgggtgctcagagtttccctaatttgaccacacccggtactacatcgacagtgactatgtcaacatccagtggttactggcagcagcaatgtagctacagcaacaacagttttatcagtgggtcagtctttaagtaatactttaaccaccagcctcacatcaaccctccagtgagagtgacacaggtcaggaagcagaatattccttatatggtaagttacagtatcaaatattgatatttatgtggtgatgtttttatcacatttttctcctggggtgttctaaattttagattagaaaaggatgattcctcctcttataaata

SEQ ID NO: 63904 - DNA, 1386 bp, Bovine  19866881333596
aataggttacaatgcccataaaattggactccttcagtacataaaaagtattagtagctattcaagaatatagtcgtctctaaatgtccagtaggctaagtatgcaaaataacgcaatttatttgctttaccagtcatatcataaggaatgtaatcaaataaattcagtggttaagaagacaacatagaaagtccctctggagattgactgtcattatttcccagttacttaagtttttcaaattaaagatataccaatttagatattcctcttttaaaaaagtgtatttttcttatccctcactgaaataaatgaactatagttttacttgataactgtatttattttattttcatatatgaccactttgacagccaaataacatagtgaggctaagtattagtgtaactacaaagaataataaacagaaagctctacctgtcatcagacatcataaaattttttacaactgaatcattgctcatctttgaaagggaggaaagtaaatccaattaggaatttggggtgattctttgaaattaaaaatatgttttctatttctttttacctaaaataatgtgacaatacagatcaagaataggaacaggtaaaactacaattacaaacattaaaaataagtcctatatatgacataaatacgggacccatttagagagagaaaatacaagcatcaagcaaggctgatattcctgctactattaataatcacaattattgaaatgtccttataaaaagagtatttcaattaaaggaataaaaaaatttcaaagctgaaagagaccttcagacaaccagttcctttcctttacataagagagcaaaccaatctgtaggaaaagacgaaaaagagaaaatttaaattctcagactgaggattattttttcctttggaaataaaaggtttaataagagaacataagagggaaaaatgctgttttctatatacaagtactataagctaacattattttcttaataaacacccctagtaatttgatttcagggtggctaatattttttaacaatatatttgaaaacaaatgccatttctagaaatatgttaaaactcacagatgcagagtgattcccatgtctctcagctccttcacagatagcaaaggggagatgatatcttggccaaatctgtcataaatgagcacctagttaaaagaaagagagtcacatgtttctaaaatataattatcaataaacagtcaatagagaacccaatattaagatactgttgaagtacattttattttgttttatttttgccacactggactgtcagttccccaaccagggatgaatctgagacccctgcagtgggagcacagagtctaaccactggaccaccagggaag

SEQ ID NO: 63905 - DNA, 1597 bp, Bovine  19866881468734
actttatctgataaaaaattgcatctgtatcttgcagaatcttgtgtcatagatccaaagcccctcttcatagtcactattaatggaaaaaaaaattccctcttctatttgcataggcagggatgaacaagctttttcaatgaaaagctgaatagtaaatatttatgactttgtgaatcatagagtttccattttagttactgagccctgcagttgtatacaagagcaaaggcagccatagacagtatataaacaaatggatgtaattgcattctaataaaactttatttacaaaaacagacattgggctgaatttggtccataggctccagtttgcagatctcttatgtagaagaaagtgggggcttcttgggaagatatctttctatgataactttaaaaatggataagaataaacacttttttattttttctacatggatgttttccttgccttcttactaccctgagtgggtcaagtgatcgattttgcaaaggttatttgtctctttactctattttttttgctgttggcttttttgtttttatctttttttggccgtattatgtgacttatgtatgggatttttactttactagatattgaacccaagcccttggcagtgagaacatggagtcctaaccacgaaactgtcagggaagtccctgtctctttccctttttcaattttattttcttattgctaggacagtgtatttgaggcatttaaaactagattagagaaaatttcacagtcacttctaggaacaattattttcattattgactacttctgttaagtctgatatcacagaaatatttacttattccattaatttcatcagttattttcaatcagtttaaactctttcatttgtttctcttatttctgttacagagaaagagctcataaaatgatattagttattgatataatagaacagctaactactggaaaaattttttatacctcattactgtgtctagattactacagctgttgtcttaaaaaatattctttaagcagattaactgaatcaaaatttgaagtaaagcagaagtgtgaagtgaataaacttctggggtgagaggctggactggggcatgctgaacaatgtctgtagtcttttctagcacactctctagctatataacccagtaaaatccccttgggcttaagctggtctagatgcatttctttccacttaaagaatcttagctgaaagaggggatttcatattggtattgagattcaaagggtaatagatagacaagggagggattggggtccaggcagagggaagagcaggtgctaacagatgacaaggactttcttagtgctggaatttagagtcgaaaggcatcgaggcaggcgaaaaggctggatatgcagaccaaatggtgaaggacacgcctttccaaagcgtttaaagtgtgtcctctgtgcagcattgttgtgtcagtcactcagctgtgtccgactctttgtgaccccatggactggggcctgccaggcatgcagtgaggagccatgaaagaagcttgagcaagggagcaatatgaacagatgtgggctaggatatttgttctgatggtg

SEQ ID NO: 63906 - DNA, 1319 bp, Bovine  19866881518722
ttactttcagttctcctgttacatattaaaaaaatgaatatcatccttaataattcagatgtcataagaaatgtcattctgattcattgtaattctaacctttgaggatataggatatattagagttgtctaaacaaagcttccagcagattatagaattctgcagatgagaaaaaaaaatgatataaatatttcttctccttagcaaactatttctgtcagtgacaaataagttccatatttagagttgtcaaacaaagaaacttaaggtcatcatctccattatagcaaatctgtgaataatatttgttaaagtcctggaaatataaaagctgatgcaaagaatacacgaattgaagagtacagtcaaactgtgccccaaacaggctgtacaaagtacttgacttcctcacgtttctcatcaccctgttcattaccagcaaattttaccttatggtcaaaatttgaccatgagcatacagttttctatctgtatccttaacattctgagagataaatcaagaattgttctctgtactgtttttagccagacaggtctttgagaaaaacgcagttccatcagaatccctttttaccgacattctgaattgacttgtcagatcctggatggctaccagtgaacaacgggaagacctgggaatttaaactaaaggtggccttgctatgcagtatcatcagttcattcttctaatgatgaaccagctttatttaaccatttggatctgatttgtttactgtctctaggttgtaatgtagttaataaaaatgaagagtgaattttcagatttgttactagctttagctactctttaatgacttaagacgataaaggttctagggcagaaaatcaaaggcttttggctctttccagactatagatcttaagttctgtagcacttcagagatgatggctgctgccaacagaacttatcacaaatcagaggcatttctcagtgtgacgagtctcgcttcttcctttttacgtacagtacagtgtcactgcactgaatcatcctgcacacagaatccagtgtgagacactatacagttcatccattagctcaacaaaaagtaagtatccactccgccagactctattccaggtcctgagataaggatatgaacaaaacaaacaaaaattactactttcctggagctcacattctagcgaggtagggtaagtcaataaacagaatatgtaaaatataaaatattttggacagtaagaagtgctgcaaaaaaaataaattatactttaaaatgaatataggaaatccaaacaaggttggtagatggtt

SEQ ID NO: 63907 - DNA, 1982 bp, Bovine  19866881535224
tgttgacactgttttgcttaaatttaggatcaaatttaatccttctctgaaaaataatctagatgaaaaatatatgtacgtgtgtgtgtatatatgcatataaacacatatcaccaagagtggactgctttataaaataaaatattccaagaaagaacaaaacaagtgagttattttttaaggcaatttaaagcatgctagtgacacagcaaaagcagttttgttagtgttgttcctgaagttagtacaaaggtcctcaagggggaaaaagagaagtgcatctacaactagaacaggctctccgctgagcaatgaggtagaagccctggcatttctctgctggctacttgtttctgatcttaaaccaaactccgggccttgtagtttctaatcaaatgctggaggagtacctgctgcttcctgagttgccggagtgacttgtctcctacccttttctccctagtagggtcagcaacatatcataagcctattagggttagaaacataccatctaggccttcatttaaacacaaaagcttcgtaaaaatagatttgctaaattatggaaattcttttatttcagtggtcaacagactatcatgagtcaatatcagatgagatgtggttagaacatgtacttcctattccccagtcagctgtgttgtgactctaccatttgctacaggttttcatcacaaatgcattctcttttcgtaataaagtgaccattctgatttctcaatgttgtataaaaatttttgtagaattttctataatattaaagtgtttctttggttatttatgttcttaacatagagctggaacttccagaaatcacctaaaaggtctgtctctgggcaaatacaagtctaaaccatttaaaacagttcattctattttaaggttggggtttccatgcctgtccttgaaaacctgtctagcacgttgcattatgtgagtttcaaaatcatcttttctctaaccatcttaaagtgcctacttttcagctgtttcttacatattatacctacagcacaactgacagaaggtaggtaagttggacttcatcaaaattaagaaccttcgtgcttcaaaggacaccatcaaaaaaacgaaaagacaacccacagaatgggaggaaaaattttgcaaatcatatttatattatatatatatatagagagagagagagagagagaccatccagcatatataaagaactcttaaaatgtgacaatgaaaagtcatctcaatttttaaatgggcagagaatttaaacaggtatttctccaaagaagatggatatacaaatgcccaatacacacatgaaaagatgctcagtcagtagtcatgaaggcagtgcaaatccaccataagataccacctcatttccactaggatgagtgtgatcaaaaagacaatgacaagtcctgagaaggatgtgtagaaattagaatcttcttacattgctggtgagaattagttgtagctgctttggaaaactggtaatttctcaaaatgttaaacataattaatgatatgacccagcaagtccattcatgcaaaaacttgtacgcggggacttcctggtgtccagtggctaggactccagcctcccaatgcatgggccctgggtatcaatcccttgtcagggaactagatcccacatgctgcaactaagagtctgcatgctgaaacaaaggcccagtgtggccaaataaataataaaaaagaaaaaaaaccctgtacatgaatattcacagcagaattattgatagtaaccaaaaagtgggaacaacccaggtgtccatcaactgatgaatatataaacaaaagtggtatatccactcaatagaaaattattcagccataaaaggaatgaagtattgatacatgctataaaatggatgaaacttgaagatggtatgtatggtaagtaaaaaaagctagacataaaaggcctcttgtcatatgattccatt

SEQ ID NO: 63908 - DNA, 729 bp, Bovine  19866881786594
ataacttacacagcagttactgagctcatgaaataccctcaattaagggatcacagcaacacatgggatctgtatacccgcctataataaatcaaatggcaaattgctacaattttttcacctgttattcctaatgtactttgaataaaattggttttcaggcttaagtattttcttcacagatagctaaaattgggtttgtccgaaggaaagcatgaaacaaaaagggtaaatcacaccttgatgtttcccgattgctgaatccaatcttaataaaaggcagaaatagtgctacagagggtcaatggggacagaaacgaaatttagaaagactatgtataatataaaatctataaaatcatatggaatggacttattttaaagggaagtggtccccacaaaacaacaaaaacaacttaagaactaggaaagtaagcaataaagacacagctcctcagactatttaatttacagttcttattcactgtgtagatgaaccactatgaccggttttgattttttttttaatcaaattcattaagtcaggtgatatttttgcatttttttagaggttgaatctcttacttatcaatgtttttcttatttaccttcctttatgtttctgccaaaatttatcaactggagttaaatcgtaagacttcttattttttctctttggtctagcaccagctggagaattctccattcctgaagactcttccaagttaa

SEQ ID NO: 63909 - DNA, 1486 bp, Bovine  19866881814575
atattaaatccctaatttgttaatacctgcaaacttgttaaatgaaaattacatcaaagggttttagaaaaatccataatactctaaaatatacttttcctttcttctctatagactagtttcatttttttttttctaaaagggctgattacaaaccaaaatttaattgagaaagcatatagatggctaatactaattaagagccaatcatcctgaggcctaaaaagctctaaaccttttagaagccgattatacatattactccaaaaagaaaaaaaaagaatccagaaagttgtaaaagatgaatagaactaaacctctgaacaatgataggccaccttgaaagctcagctcttagtgagaggttaatggatggttcagttctccttctaagatctaagatctcattgcagtcctatagacctgtggttttcaaactttccttcttagctaaaccaggttacctaacaaggacctactatgagacctaaaatatagataatgggtaatgaatgagcttgtgtgacaaattttaaaatttcttaccaaagtactgatatttgacaggctaaaggaagatgttaaaaagcagccttatatattactgacaaaataacaaaacatttttaagttaaagctaaagacagggagactggttaggacactaccagagcaagaactaaaactggagagagaaaaaaatgtgagaaaaataagataaaatccaagtaacctgctacaaaagtaaatatagcagtaaattaagatgagaattttggaaatttttcaggtttctagctaagatgactgaatggtgattctattcaaaaaaatgaataataaagggccagaatctggttttacagggtacccatcaaataatcatgtactatctatcaaagtgataacatttattaggtaccgtgataaggtcaaaagctcagaaaagaatggactgggtgtacagatttgggagtcattagtgtttggtgatatttgaagccatgaatttaaatgaagttacccagagaaaaagcacaaataaaaacagaaagcttggggacaaaaacagctaaagtactggaaaagtaagaaaaccacaaagaaaaattaaagcaaagaatatgagaaattagggttaaaaaaaaaacagcaaagagtaatttcatgaaagtaagaaaaaccaagtttcaaaaagaaatgaggagtttatgtcaagtatttccaaaggatcaaatgaacaaaagggtctcataaatatgtttgtgatagaagcttcagggaaattcgaaaatggtaaactagctgagaaatgaacaaggcagactattcacataaactatttttagagaaaggttaagaagagatagactataaagccagacaatgggattaggcatttatgagagaaattctgtgtacctgttttccctagagccatcaaactcttctaaaaaatggcatctactttgggggaaaaaaaacc

SEQ ID NO: 63910 - DNA, 1120 bp, Bovine  19866881087126
tggttagctgagggaagggaagcttatagacactgcttacagatggctgaaccagcggttattaccaagaggaactctgacctgaaaggaagcaatcttaagatggcagagaaaagcagggtgatcatcctagctcttgcaggtgaagaggtgtttgtttttttaactgcatacatacatcctgaatctacagttcatggtttcctttatatgatgaagttacccactgccttgactgctgttttctattcagctttcttgtttttaacaacccaggagcaacaatgaaggatttcaatttccaaatggtttgggaagatataagtaataacacaaacagctatggttaaccacctatgctttccttattctatttttttttttaaagatgtgaacctaaaggtatgtataggatataaagtaaaactgaggtacctcaataatcttccttcaagaacgattactagtatcttttggcacagtttactaaaactttaaaaggtaaaatgtccacccctaacattttccctttcatttctctctcactctccttttctagaccctcttcactttctgtaagaaagggggactaaaacattgtctgcatgtttctcagaatactgtaatgattttgaaacctcatagtatttatcctccgactgtcactttagtacagaagcaaaactcaatttagaggattataaatacgaacaaaactcagttcttgatctcaaggaactttctagggtagtaataatcctaaaagaaatattaataaaatgataaatacatttacttttctctttacacttaaggaagggttacacatgcaaaacttcatctgatactttaaaatatccttgtaaggaagatgggacaaacactattttcccaacattacagaggagatagagataaaacatgcaacatatttaaagccataaaaataactagataaacttatgttgtgattataactaaataaacatgttatagttatctatgtgttgacctttgaacaacacaagtgtgaaccacacaggtccacttacacacggatttttatcaataaataaataatattgtaccataggaactgcagttggttaaatctgatgat

SEQ ID NO: 63911 - DNA, 1334 bp, Bovine  19866881109450
ttgtgcaattgcaaaatggttaagttattctgagccatagatttaacaatgctctaacatctccaagttcctttggaatgtttatatgctttaaaaaagtgaacttaaattgacttactatatttcactttagaaaaaacaagtgtcacaccattttaaagaaatcatagattatataaatgcaagctgatgcaactgattaggacaccagaaattaattctccaaagctcaggaatcacggccttagaagaaacgaagtgttcttcttactcctacttctaccattctaacttctccccatctcaaactttcagttatttctcagatgaggtcaatgaacagtcatggaaggatttttaactagccaagatgccaaaatccttattgattaatagaaatcaccaggcaatactaaactgagtcaatactgttctgctctggtctgtgctgaggtgataacatgaagacgattaatgaaactgctggacctaccgcctcaggtaactgtggaggaaaaggtttgcatttcacgggcgccagagacagacttatactttgggggtgccatttgtagatcaaggtgatggcaaagcgcccagaaatcttcacggtaatgaacttattcacctaggggcaatagaaaggattgttcattcctgcccagaattctcattctcataattcaggtggaaatcatagacatttacatgatgcacagaaggaaatttcagaccagtattcacaaacagcttcagtctaattccatgaagtcagaagtgaggtgtaggttttggtactgccaattcattggtgcttgatttattgacagaagaaagagaagtggggagaaattatttggaattaatgtaattatgtcttatagagaaagattcgttttcaattgcaaaaatgctgggtcggtttacaagtacttctgagccctaattctaatctgagacacagacgatctcaccgaaaagacgcacttggtaacaactgatgcccttgatgttgagaaaagtactttatgcctgccaagtccttagaagttttatgagccttaatattattgtcaaacttattaaagttggaggtattttataagtgagaatggaaaactaatgacaaatgaacaacttaaagctcaaatgaatatctgcagatttgtagagcaaatttaaaaggcttgctacagatgaagtgtccttattgagtcagctgtattaagcatgcaaggacttgtatttggttacaagttatactcccttgtttcctgaaggctgccagctggagtaatttgaattgaataatctatcccattgcaaccctgagt

SEQ ID NO: 63912 - DNA, 1367 bp, Bovine  19866881265973
ctctgggtatgctttggaagggcggttctagtcttccttttataagaaatgtcttgccttcccttcattgatcgggtccgggcactgccagcacctgctgccacttagacagacttttgaataccagcttcctaaaccattcccgctggctgctaataggctaaccttccttggggcgcgtaagaaaacaggtcagcatacataagcagaaaaaaacgactcaagtttaagagatgggactcgccctctccctccacctccgcaataaaaaaagaaagtgaaacattgtaattgtttaaactgcaaatttgagctgttgtaaatgctggtaactggataattttttgcagttttaattttggaagttaaaaaaataaacacgtcttgaaagagcctcttcatcctctatccctgttccccatttttaagccttaattgtcaagccctgcgaattaggggcttgtaaaattagcatagaaatacgactttcaggccgtgcacttgaattccttattatctcttaagtagctgcctgtggggtaaaagtagaggggtggtaacgttgggcctagaattccacttggagttgtctttaaaaccagctttaggtgtaaacaaggaaaaagaattgactgttccctgtgttcaaattctgaaagccaaccataagttaagcacctatttatagaatatttcataatcactgtgagattcaatactcaattgtcttgaaagaaatgaacagtttgtattcttggaaccctaatctttttatcctgagtttagtgtctcgggacctttgaaaaagacttaatacattttggttcatttagcctctctcccccacactgcagtctttctagcttttttgttatactagcttattatttttgcaatgggtagcagatttttcaatccagcatttatcattgtagactattcatgttgaaatgtaaagacagtctgatattgaacaagtagttcaatacatatattgcagaaagttaaaatgtctgggggctgatttggttgtgcatgccttatttttcattcaaaatattgattgtcccaagttttttagcttaaaaactttttaatgattggtgaatttgcatttagcatcgagggaggaaaggaacaggccgagctgactccatcttgaaaaagaaggaaactccgtcttgcactttcagtgagctttggaccatgtgcctggtagccatggggataacatacctatactgaactggcctcctggactgataaacaccagattccataccaagatttcccctggccaaaaagaatgtgataatcccctatgcagtcaatcacctttgtaatctttatggcacccatggtgtagg

SEQ ID NO: 63913 - DNA, 1154 bp, Bovine  19866880399942
ctggaaggtgttttttaattaactgattgaacccggtctgggaattatcaccacaacaattttggatccaaaataataaaaagctgagcaactgaaaaccaagttcaggaaagatgaaagctcttcatggaagcctcagctcaggacactctcctggcttttctaagggacccaggtgccatctgcagtaaagagaacatggccatctaaggttccccaagaaacagcaggggcggccctttcaaggggcagggaacccatgtgaatgcactcatcaagtccgttggctttttgcagagccccaggaaggaacagccgtgtacaccctgcgttggaatgttctctgagggcgggttcagtgccaatggaatgtggggctggtgccattccacttgattctgtttccctctagtggttgatccaacagacaagtttagagagtctgagattgtatctgactcaggaacaaagctgggaggagcagcactgacccatctcatttctctccttgttaactaatatggtcagaggaccccaaacacaagtatattacttcatgcatgagaaatgcaacatcacctgggggctggaacacaatgcttaataaaagtagtataaccttttttactcttcctttatgctagctctgttctaagtgctttagaggtaataattgtatttaatcctcacaaaataccccatgaagtgagagtcatcatttcccattttacaaaaataagttaacagtggtggtgggctttttcttactttggatccaaaattgttgtgagaattcccaggcctgggttcaatcaactaattaacaaatacgtgttgaatgcttgggcttctcaccaagaccttgcactttgtgatggtgacatcaggcaaaacacagacccatgtgctgaatgcctttaactgagcccccacagcgccaggagctgtgatggctgagtgggggagggatctctggctataagcgagcattctgcatctggaaaccccagaggcccatcggcacctgcctgtgagcacaagggcgtaagagaagcacagaaggacggcagatgcactcaccctcctgggggtcctgaagacacactagtgctaagccctgtctgggaaactggtggttcctgccactagtgatg

SEQ ID NO: 63914 - DNA, 2075 bp, Bovine  19866880430054
cttgtttttctaggaacagtgtagtgggttgaatcatcatcctatggccaaaatgtatgtcctaagccctggaagttgtgaatgcgattgtattcggaagaaaggcctttacagatgtaattaaggaaagaatcttgagatgcgatcatcctggtttatctggatggtccctaaatctgatggatgacaagtgtccttacaagagacacgtggaagacagagacagagcagaggagacagagggagaggtcagagtgatgctgccacaagccaagggatgcccaagggtggaagacagaagacggaagagataaggaacaaattctcccttagagcctcaggagagagcgcagccctgcccacaaccagattttggacttctgggctccagaaccaccagagaataaattcctcttgttctggaccactcaatttgtggtaatttgtcacagtagctgggcttcccaggtggcaccagtagtaaagaacatgcctgccaatgcaggagacataagagatgcaggttccatcaggttccatccctgagtcaggaagatcccctggaggagggcatggcaaccactccagtattcttgcctggagaatccatggacggaagagcctggtgggctcagttcagggatcccaaagagtcggacccaactgaacgactaacacacacacaatgacattatctacccgcaagaggagatataagtcaaaggaagattcaaccatgtagttatttcctgctttgtcagagactcatgtggcaggaaagaatgagaagtcctgtgtttccatcccagcttttctatttacgcactgtgtgacactggcaggtcattcagcccctttgagagtgctgcctcatctgtgaaattagaataatatctgcatgacaaggcagctgtgacggataggtgaattagtatacttgagttaatgtacattttcagccctataaaaatgtaaagcatctttgtggctgtgaaggtatttgggaggggttggccatggttacttgatcacagtaataaggtaagagagaggtcagtgtactgttattgcatttagagggggaaatagtgtttaaatgaagatactcattatcatagatttatttttgtaagtatgaagatgacctcccgtttgaaagttcaattatatcacctttcatttcaaaatattaggtagcaaatgcatcaacagtaggcatttcttaccaaagtaataataatggccatcatctaatggtttctttagactgagcatagtgataacaaactcttccctttataccatcagactgagccatagccccaaaatgtaagcattcttcccagacactgtagacaacagccctacaccagtaagtattattatgcccactttagagataatgaaactgatcaaaattaaattttaaaaaattccccaagggcatatacctaataagcagagaaatagactttttaacccaagtatatctgaccctaaatcatgtgtctttaactaccaaaatcttgaagagaatggaaaccacactgttttccactgaattggaacagaagtcttgtctctgtgacaagctgaccttgacttaaggtcctgtctttgaaatcggtacatgatgatcagagtagcttagatacaggcacacacacacacaaacacacacacaaacacacactcctcctttatacctggctcctgtcagccatgagtttgttatgaaggagacatgtgttataactgactgataaagggccagaaagcttagctcatattgctgattacctatgtatctttgagtaagtgatttaaaatccaagccctaatatctgctttgagtgaaggtcataatgtttatctaacccacctcatagggagttgtgagagtcaagtggaatggtgcgcataaaagtatgtttagatattaaagaaaggggagggtgttgttaggagtttctcaaccagtaagagattgagagaaggtttggtaagtaatataaaaaaaaggaaccattaatcctctgcaaagtcactccttttatttcccatgccacttccat

SEQ ID NO: 63915 - DNA, 1475 bp, Bovine  19866880509572
ctagatagcactcgggattcctcggagtaccagtaactttcttttccatgccccaaattgcaactttttctacttcttcaataataaattattcttgctcaccaggtatccaaacttaagaaggacccttttcttcacaccacataccttcacaatgcttcttgttagtttctacctttctgttcccatgagggtcatttgatccagtgtattagtcaggtttatttctcttgcaagttacataaattcaattttaagtagcttaaaagcaaaaaccaggaatatattggatcatgtatctgggaagttgatggggacggttggctttgcccatatcaggaatcagatgaatgctcaggacttcatctctcttgccatcttcctgcttaaatttaaaatgaaccgtcatgaccctggcttacaaccacagaggattctgattgcatccctgtgaccctcctgaataagtcgctatttgagcctgggtgctgtccgtggggtcgctaagaatcggatacgactgagcgacttactttcacttttcactttcatgcattggataaggaaatggcaacccactccagttttcttgcctggagaatcccagggatgggggagcctagtgggctgccatctatggggtcgcacagagtcggacacaactgaagtgacttagcagcagcagcagcaatgagctcaaacttgtagcctttgtgtggagagtggaacaatcacagaaggagttcctcaagaaaaagaggaatttcgttaccaggatgagctgaggaagaggtgctaggtagtcaagagcaactgaatatcttcctgcaatagccatcctgtgccaggtgcagtgttgggttctttacctatatgagacaggatatacagggaaacacaagatatatagtatacaagcttataataataagatatggaatcagattgaaaagtgaaagtgacagctgctcagccgtgtccgactctttgcgaccccatgaactatacagtccatggaattctccaggccagaatactggagtgggcagccttgtccttctccaggggatcttcccaatccagggatcaaacccaggtctcccacatttcaggcagattctttaccagctgagccacaagggaagccttcagtccaaatcctacatctttcttttattagctgtgctattttggataagttaatctaagtccaattttcttgtgataaaacagtaatgtaagatactccacggaatagcatttagcttaaaagggaagaaaattctggcacatgctgcaacatggatgagccttaaagacatcataagccagacacaaaatacaaatactgtgtgactccacttatataaagcacctagagtagtcaaattcatagagacaaaaagtagaagggtggttgccaggacctggaaactgagaatggggagtatttttttaatggatatggagcttca

SEQ ID NO: 63916 - DNA, 1336 bp, Bovine  19866880517173
aaatgatttctagttaagagtgtttttatacttttaatttgtaaaaatataactggtctcataagtgacagcttttgatgaattctgagtcccaaatttaacagaactgtagtcagaagtggtatgtgaacattctaaagcaaactttactgaaagaaggaattaagtaaaaattttaatgtcattaaatactatgttctgttgtgagagggaagttctgtataaactttcaaaatctgaattgaaatcttgtggattaccccattttttacacaggagggtgtgtaaatttattttaggcaacttacagtgagtattaattttaccattgttggctagtattttactttcaacctttatagtgtgcaagaaattttgtgaaatagtggaaacataagttgctagtcctcctattgtgtttgtcagaagtaaacctctctagaagtgatttctaatcgttatcgtttaggaaaagctaatacggatgttaataggttcaggcttagtgtctagaaggtacaaaatgaatctttggggaatgaagtatgaaatacaggtagctcatttattacacatgtgccagctttaggagattgctttcctcttctgcacttacctagtatggcttacagaattgaacctcatttgtaatagtaactggcatattcaactggaagttgaagcctgttaaatcagattgcagagtatacctgtcattaagctataacttttttaaccatgttgattgtcgtggtgactaagaacataaattctagagccagagccctgaggtggaattctcattctgccactatttgtatataaccctgggcaagttaccagtattctcttcctcagtttcacatctcctaaaataagatagtagtaactacattattgggtcattgtgaaaattaaatgagttcatacttcatatatgtaaggctcatagaataagtcttttaaaatgtcaactgtaactatttttacaatccccaagtgattggataatgaaagttgctgttaaggcttcacttttatcctgtaaattcagaagtcatttcagaaaacacaaaagtgagtttccttgtgataagttctgaaaacttttcccctcctccttgttttcattgctttcccagagaggttaaactgaattaataagactgagttaaaaaattattgtcagtttttatttttttaaatcaaggaaaacaccatggccttttcacttatttatttacctaagtatttccatgaagtgtttgcattataaacactgtgctattgtgttaatgcatgagaaccaaaaagtgggactggctatctgttctca

SEQ ID NO: 63917 - DNA, 1308 bp, Bovine  19866880587030
gacgtaagcttcataggaagcctgtagaagaactgcacctttaactccccagcaaggccatgcacacagaaaatgttctataaatatttgttgaatgaatgaatcagcctagagtaggctttctaagcctgggtaaccaataaatctcctgttaatggagtataagcgccccatcctgaggcaatttctttcatgacttctttagaaagagttaaccagtacaaattgctatacttttgagtgaaacctgaaaatttaaaaacatctgatatgaaaagtgaacagtttcttcctcaaggcagtagcaagccccagcaaagagaatcaaagcacaaacacaccttctgtaagctgtcgtttaactatcccggttattttggggctttgtaggtaggcacgcttgcggggtgtgcttctagcttgacttaacttgaaggggcttccttctggggctcccacctgtgtgcctgaagcctccatagtacccaggttgcctctttcgctatctgggagattcagaaaggaaagcagttcaacatcttcccaactgagtcttgattttatattctggtgttcacatagagcaatgcagaaaagaaagtgtctttcagatttaaaatatccttttcactcagcatccagagtcatctttggaaaatataaatgagagaaagtcacatccgtgcttaaaacattcattgcatttcaatttaattccattcaataaggaccttccctggcagtccaatgattaagatgcagtgcttccactgcagggggtgcaggttggggaaccaagatcctacatgcagggtggctctatcacaaaataaaaagaaaagaaataaaaatcttaagataataataaattttaagaattcaaaaaattccatcaatagttactgatcaagcatatgccaggccccattctaaatgctgggaatacatcagtaaataaaacagttaaaaattcctgatttcctgaagcttacagaagagggtaggggaaaacatagaagaaacataattttaaaaatttattatactacattagaggctgacaagtgcaaaggaaaggaattggaataagagggctgttaccattaggtgacatggtcagggcaggcctaactgagaaggtggttggagcaaagacttgaacaaggtgaagggcgtgggctgtgaggttatctgggagaagaagaagaaatgccttcctacagcatgacctcactgggtaacttatcacctcctcttgtgcataatagccctccctctctgctctccaaacaccctggccaccccctt

SEQ ID NO: 63918 - DNA, 2947 bp, Bovine  19866880756860
tatacactagagtgagaccttgcccggctccactcttagataaaagcttgggacttcactggtggtcctggctaggacactaggcttccaacgcagtgggtgaagtttgatccctggtcagggaactagatcccacatgcttcaactaagagtttgcgtgccacaactgaaaaagatcctgcacagtgcaactaaagttaccacttgtggcaagaaagaaatagcatgccacaagtaaggcatgacacaaccaccatagccaaataaataaatatttttaaaaagaagaaggagaacaaagctttcctttgcttccaaactgaactcagtctccttctattggtatgagtgacacaggacaggaggacccttgttgggacctgactcaaaagggtttgtatcataagcagtttttgagggttgtctatgcgtcagttatgctgggtgcaatggatggaattaggcataatattaaaaagagtgcctcccaactcttacctatatgtcagaattacctataacactttttaaaaaatactgaagtatggggcccacccaacatctgctgattcatcaggagcaatatccttgcgacataatataaacctcccaggtgatcttaatgaagagccaaggttcaaagctgtggtgttaaaaatcctaccatccatgaattttagtctacaacaggtaatattgatgtaaataaatctgttataggacaagtagtaaggatacccagagaaggcaatggcaccccactccagtactcttgcctggaaaatcctgtggacggataagcctggtgggctgcagtccacggggtccctaagagtcagacacgactgagcgatttcaatttcactttcacttttcactttcatgcattggagaaggaaatggcaacccactccagtgttcttgcctggagaatcccagagatgggggagcctggtgggctgctgtctatggggtcgcacagagtcggacacgactgaagcgacttagcagtagcagcagcagtaaggatacctattagacaaaagacaatagtggtagatagcatcaagtccgacgcagaaacaaatgaatagatggaaggataaatgcaatattgtcagaggttagggaaatcacagagatttctctgggtaggttctattacatttggttgacgggaggaataatacactctgctgttgttactgctttttgtgtgtgtgtgaatttcaaattaaaggtttatagtcagaaaaagtgcttctggtttaaaaggcaatgctttaacatcttcagatgtatttgaagttgtattaaaattacataaaaggtatacctacagtgtatacaatttgtattaaaattatatgatttttatattttaaggtagaactgcaaataactaatttctgcaaaagactatatattttgtccatgaaaaaaatgaaaaactagaccaatatgctgtgaacatatatgaacatatattacatccatgtttaagtgaattctaggcagttgtatatcaagtgaaaagaaatcaaaggtttgcagtctggctaatgagaggttctctgaagggcattctgtggaatgcatttctcttggcagttgctctagtggatccaattcagttctaagcagatttctttaatccttagctctaactgggtcagcatcatctgattttaagtattattaaagcggacatatgcacaatgattattgaaatagctgcaacaaccttgcctggaaagttgctttttctttcaaaatgctcaaaagaccctattcacataaattgaaaagtttcaggtaggaccactattattataggggagggaacaaagccaaggtagtcctcacatgataaaaataccaaaaattccattgagtttttttaataggctacttagaaaaaattgcttaattaccttatcatagtctctgttttggtttaggaagatttcattgggtgatttgagaacatctgcttgaggatttttcagaaacgtccaaacaaaacagtcagttttgtgtttattcctcagtagaaaccagttatcaacagctgtgtcagtgatactagttcaatatagatgttaggtgctcttcattacattcggattttattacactccactgttttaccaaaagtcccttattatttgcagtttgtcagtgattctccttgaggttttaggtttacgatcatgtttcatctacagatagtgatcattttatcttgtcatttccaagctttttccctccacattccttctcttgcttaattgtactagccaatatttctagtacaatattaaataatagttaagtaatagtagtgataggtatttttgctatgtttttctatatcaggatgcctctggtattgttcatccacaaagtataatgcatattgatattttaggctgttactccacttcatccctagataaaataatattaataatttttaaattacagaaccatccatgaattcctggagtaaactccagtactgacaaatataagaagcattatacctgataaagtcatggtatcatttctcaagtaagtgaactaaggaagaaagaatttaattccatttgcttttgagatctcaaaatagagaattcatcacaggaaacactcattatccatctctgtattcattgcccaaatgcacaccataagaaacatttccaaatgtctgcccatctttgtaactaagtcttcctagtcataaagccagattaaactagagttcatcacctcctcagacactctcctttacactggcatagtacactagctaccaggactcgtggtagtcagtaggtttataaactcagcgctattattgtctttttccctcagtcagatatctctgcccatttgtaataaatctctttccaaactaggacttccacaatagaaatagcaa

SEQ ID NO: 63919 - DNA, 1591 bp, Bovine  19866880780761
ttctctctatcaagtctggacccatggtccatgttttctcaaactagaatcctgaactttttcaaatcctgtcctttttttgcagcatctcccctaaaacatcccggtttctggtaaattccagccctctgttcatgctcctcttctgaggagtggtttgtagacaggagcccatcagaatgacttaacaattatcacctcatctgaccttcctccatagctccttactgtgaacctctcttccctgggcttccagggcaatggtctctcattttgatttcccaggtcctccccccaggtatatagaacatcctaaaggacattttgcaaaccactgcaggcaccaaagtgcattcttaagttctaagggaaaaaactacagtgtaatggataagagtgcagactctgaagcccagcatctggatttagctcagctctcccccttttgcactgggcaaggcaatcttgctgtccctcagtgtcttcacctgtcaaaaggaatcatacttgtatctttgatggtatgtggcctaaatgatctaatcatgaaaagtgttcatttatctagtatataaatgaagtggtacaggcactaaaaacaatgacattcctaactgggagccctagataatggaatagtgaaattatcatgaacataggttcaaatactgaacaatcaattaggggcatgacctctggcactatttaacctctctcagattattaggttatgggttgaaaggggttaatactatctatattataacacagaactgtttctgagatcaaattggataaacagaatcaaacaataagaacagtgcctagcacagagcaggctcccttgcttttcagatcttgtcaggctatgatcattaatatttaattacagatcaaatttaacatatatgactacatttaaaaaccctgcaagttcgctttagtgatgtacagaattacagtaataaatgaaagcctttccacaaatggatgccaccaatcactacaactaaaattatatacagtgaatgactacagacaaggaaataaaaaaaaatatcatgtgtgctcaatgtgttaatgacaggtgatatgaaaaggcatttgaaaaaattttttctgagttttttgagtctaaaatttttgaatttgaggagtctaagtgattccttacaagtcgtaagatcaatacaatgatctatggttacaaaagatgctaatgaatcatcatactactcaaaacatttctgcgttcttgacatacattaatggcaaaaaaaaaaaaaaatttcagaaagagcacaaaacacacctgtgaactcttaagatgtctttttataaggattactgaaaagaatggcattcatatagacacaaggtacactaaaaggcattcttaatgtctgggaaagatgcactactaaagaactttctccctctgacttctttcaacttcactcacctttggcttttaatcatggtttactggggacagttttaagtcagtaagcatgcattttacatggccactcaccaatgagatatgcatcacatttttctaatgcattttgctttcgctctgattcctcaa

SEQ ID NO: 63920 - DNA, 796 bp, Bovine  19866880824322
gaaccttgggtagtgtgtacgtgaagccattgttacatcatgttcattttttccaagactgcttctttgaacgtgagcttccaggcttggttcccggagtatgtgtgaagaatctggtaaagatatttgagccctatggcaggccagccgtggaccgtcttaacattaccttctatgaaagtcagattaccgcattcctcggtcacaatggagcagggaaaaccacgactttgtgagtctttgatcattttctgactctcttcttcctctattagcttcagtctattctttctcactccagggcttccctggtgactcaggtaaagaggctgcctgcagtgtgggagacccggtttcaatccctgggttgggaagatctcctgaagaaggaaatggaagcccactccaatattcctgcctggagaatcccatggacagaggagcctggcaggctacagtccatggggtcacaaagagtcagacacaattgagcaacttcacattctttcccacagaagtttagtgagaaaaatgtgttctatatgtgtgtgcaaggaaggtatagtatactgcagttttcaaagcttgctcacatttatcattttattagatcatgaagttggagagagaggtggagtagtaagttcattgcccccttggtgccagggatggggacatccagagagcgaagtgactttccaaggaagccacgttgtagtggttccatggacgcaagaaccggatcgtctcttgtctttgatgctgtgagctggtccccctatccccagcatcccca

SEQ ID NO: 63921 - DNA, 716 bp, Bovine  19866881005785
cttagtttcagcccatggggttcttcagttgcaacatgtgggatctacttccctgaccagggatcaaatccaggccctccacattgggaggacagactcttagccaccagaccaccaaggaaagtcccaatgataatttcttaacaatgctaatgtaggaaatacgattaacgatgactagtttgcacaccattatctggattggagaaaaacgtgtattattttcttgttagagaggatcctgaaacttttcctttaacttttaggtcagttcaggacataatgtttcctagtcagcatggaaataaaaagattaaggctggggtggggggaactgatctgctggagggcctgagtgagaggtagaagtctcttgctgattaaattctgaaaaacagaagaaggcaaaattatttacaaagtaaccagagaaaaggcagtgtgtgtgtgtgcgtgtgcgtgtgcgcgcgcgtgtgtgtgtgtgtttagcacatctcaaaaatataaaaggtcattttaggttctgcaagtagtgcttactgtgtaaatatttcagtctctacataaatgctggacgcattatcatggtgtttttgtgtccttaaacctttctaaatgatgctgtcctttacctctagccactgcttaatggctagtcttctgtggaccgtgttaaggaaccacggaatttccccaggaagagaatcaggtcaaga

SEQ ID NO: 63922 - DNA, 1856 bp, Bovine  19866881095358
acacagaccccattccttcccaaagctaacctctctcttgcactagggatccaaaaatgtcctcagggctcttgcaggatgttacttcattgataagcctatttttctgtctcagctgcagaaactcctccgtaagctccttcccctcagcctctagccatatgcaattattttctggcttcatgcatcttgtcctccagcgtgcagattggcactgcccactgccctcattcctcacataaactaaactcccttctgtctgtgttttgctcccttcctctgctgaaacagctggtttcatggccatccaagaagaatctaacaggtttttctccatctatgctattctagcttcttgtcgttctgagtttaccttctcaaaagcaaacattcagtctacaccgggtaggtgatgtgtgctattattggctacactgaagtaggcattctctctctcttctcgttgttccttcttagtcttcttttctttactcacactgttcatgtacattatctccaaggattcttggcatagcttgtttggtttctctcactggtcttcctctgggcagcctcattcaagcctatgatttttttttacaggtcattccttcactactctcctgaagccagaatttccaattgtcttttggaagatctcatgtcattaccttttcattcatttaattatccactcaatgaaaacttattgaatgtctccaaaacatgtctaaaatcatctactctttatccccactcccatctgcattttgttctgtccttactctggataaatgacattttgatcactacacctcaatgaggatcttcaatctccttatctagacatctaatcagccgttgagtcataatggcgataaacattgactcctttaacatatgcctactttttctctagaagttagaagctagcttatttcttgggggcagaagctaatttcaattctctctgcaacctcccaaagtgacttagtatagtttctagaactgagtgtaattccataaatattattgaattacattgaattgaaatcattcattaagtgattgacagttttggcaagaatcttagaagatgtgcctaattctttggcaaaaatgcaaatacactaaattatcaattaatacttgcaattaaggttttaaaattctatagaaatgaacagaaaaaaaaacatgtaatgggcctaaaataataattttgagaatggaaatataattgtttgagagaagactatcctttgattagcaaatgaacttgaataggaaagatgcaatccccaaggataaattgccttgtataagaaaagtatcaagaattgaagagtggcagccaaaagcggggcatccctcgtggctccagtggtaaagaatctgtctgcaatgcagaagctgcggaagacataagtgtgatccctgggttgggaagattccctggaggaggaaatggcaacccagtccagtcctcttgcctggagaatcccatggatggaggagcctggcgggctacagtctttgtgtgttgcaaagagcaggacacgactgaattgacttagtatgatgcaggcacagccaaaagggaagagaaagaggagctaaggaaagtaaagtgagggggtgattttttcagagccccccaccccaaagagagccagtaagtagttaagaatggctaagtgagttttaaacccaatggcatccaataattgattttacataattgaccatgctatactctcattttgtgtaagtcttatcattctctcctctgttgtagaacctcagtaagtctcccatgtggtgccctaagtcagtgagtgtggctgtagagtatg

SEQ ID NO: 63923 - DNA, 1256 bp, Bovine  19866881224704
gaaggtcccctggagatgagaatggcaaccccactgcagtattcttgcctggagaattcttgccgcagtattcttgccaaagagtcagacacgactgagcagcaaacacttttctatttaatctagcattaaaaaaaaaaaaaaaaaatctggtgtcatatttgagtacttgatgaaaggaggatgaccaaccatcatagtttgtctggaaataaggaatttcccaagacataggctgagttaatcaccctggaaaggaattcttagtccaaatcactcacaagacagaggaagaaactgaggcccagcaaaatgaaagaatcttccctaatatcacataaagaacatttacagtgttgctggcacccagacccagatctcttaagacctagataagggttgcactgacccaccgaccttgtcctggcagtgagatatggggtcagctatgaagaggaacttaagtttaattactggctcttagacatttgactgctttatttatttattgtctttattgaatttgttacaatgtttcttctgttttatgttttggctgtgagtcatgtgggatcttagctccctgaccagggatggaacctgcaccccctgcattggaaggcaaaaatcttaatccctggaccaccaggcaagtcccttgactgctttatttaattcacatgtgaggaaagcaaagcaataatccaagtacattctaatcagtaattgtaggggtgcaaatgttctaaagcaaagtaaaaatgatgaccacttgtatatccacatttacagaagcataattcaggatagctaaacctaagtgtccattgacggatgaatgattaagcaaaatgtggtataagtgtgcgatggagtattactcagcctcaaaaaaggaaggaaattctaacacatcctacaacatagataaaacttgaggacattatactaagtgaaataaatccatagcaaaaagataaatactgtctgattatacctacatgaagtagtctataagtggtttcttacagatctaagatacaaatactcttagagtatgtgaccactctaaggagtcaaaaaccacagagacagaataagaatggcagttgcctgaggcactggggaagggaaatgaagagttagggtttaatgggtagagagttttagctttccgagataaaaattgttttagcgatggatagtgttgatgtctgcacaacaatatggatatacttaaaaccactaactgtaca

SEQ ID NO: 63924 - DNA, 1774 bp, Bovine  19866881424724
aaatgggaattttcacacagaagtctgttcctgaaatgtttctaatttcagtcagtatcacgactttgtgggcttgtttttccctctataatctcaacagatatgctgcctctaaaaagaaaaattttaagacaaatgtgctccttcaaaaatgagtcacatgtatttttgccaacagaagctaaatacttttcacctgtctcacaagctagactgaaatagattcctaaatttctctaaaattagaaaagagctgagtttttccacctaatctgctcctttcatagatgaagacatggagcccaagagacatctaatgtctaacccagttcctgttggccattttggactaaatctggaattgggacatgtatttcctggcaaggaactcactccagtgactaggagaatatttcctcctgctattttattattatacatttaatgcagtatgatggctagtaaagtgatcaaagggattgtgggcaatagatttaaaagtccttcaggaaacagcagtgccagcgggggccggtccctgagcagggcccagtacgcatcacccaccacacagcctgcggtctacagacagcagtgtgggcggagaggcctcggccgactgcagcattaggacaccagcctgctcgcggatgtgcacctgtagccagggcctttagatgcttggcgacgacggtttcctcccgcctctgctttcttctctagctggcttgtgtttctgcttctcttcccctttcagggtgttgtgatgtccttttttttcaggaaatgaatttattttttgtgttggagaatagttgctctacagcgttgtgttagtttctaagtgcagcaaagcaagtcagccacatgtgtgtatatgtatcccctcttccttggatttccttcccgtttagattaccacagagcactgagtagagttccctgtgctgtataatgtgttctcattagttatctattttgtcctttgaaaccaaaggtgaagtttacaaaaagcgcctctgtgagggctaggggtatgggtgttgtgagtgtcagggtgtgtgtgagtgtgagaacatgtgcgtgagtgtttacaccacaatttgtgtaagcctgtccagtagccaggctcacctctggtgttaatccccaaatacttgaatgcccatgaaagtattgacagatttctcaggtaaacaatgtctcagtctgcctgcccatcatatcagcttgaatggacttttactggagattcaccatgactttgacgtgttttggattggagtgaaaagtaccattagtgagctgaaaaaaaaattaacccatttaaaagtcaatcctggttttaatttttttttaaatcacaatttctggcactgtgggctccacctgaggataagtgaaacttctagtacaaaattccctctgtgctcaccaacagctgccaaatcagacctctgggaagcaccccctctccccagaccctgtgggaacttcacagccccacaggtcagaggctggcagagccctcctcagggctggtcctagtaatgtcaacctggccttctgagggaactgtgctttccagctatggtaggaaactctgctcccctcttcttctcttgtttcctgtctttcctgattctcagccttcaccaggagagtaacagtggcttttggtttgtgcaggctgttcaaccagagaagaaagagccttggaaaagacagaaccaataacagaggaaatggaggacccagaatacccagaaggaat

SEQ ID NO: 63925 - DNA, 1676 bp, Bovine  19866881926070
ctatttccttgagcatcttctctgtgtcaatgtgctgtctgacatgaagcccattggtagctgcaataagctcccagacagagatgttccctgggagtctgaggtggagaatttgaacataactaggatatgttccctgactctgataactccagtctgctgatcagctggagatggacatgttaatagctgacacgaatctaactggaacaagatctaagagagatgtgaagagagggccagggaggcacagaggagtgaatgactaaccctacgttgaagcagaagtgacatttgagagctaagtctcaaaaaatgaatgaatagtcactcaatcgatggggaagggaaagctttttggacttctctgccttgtgtttcttcttttggggaaagaccttccccccactttacagtaaccctgctcagtccatgagactcagatgaagctaacgctgcctcccttacccctgggtggtacacagtcccctaaggggctggtgataggtagagtggccaggccaatactgtccaggaggactgtgaatgctatgggaaagccactccctctttccgcagagattttggtataaggatgaccactgagggctgtgagcagctgactcactacccagtggagaggatctggctgagatcagagtcaggccaaggcaaacagcaaggtaagagggggaaggacacagtgtcctaggtcccctgaacttccaggttatgtcaaccaataaattgtctttatttaggcaaaaagcctccaatactttggcagagaaacagccatttgtaaagaatgacaccatgagaagccagggtgtgctttagggtggtggcagggccagtggggcagaactgaagatgtgtgaacgagcagaggctgggaaggcgggctggggcaggtttggaagggacttgtcttcttggagggtgggtcattaagactgtaagtgtgagagtgatattagcagatgtgagtttggaatgtaactctggtgtcatcatggagaagaacctgaaccaacaaagagtggactctggagtccagggagggaggatttaggaaggactggtagagagatgagaaggcctctggggttcagagagcctagaaggtaagaggaggagctgagaaatactaagagatgagaagacaaagctcagtgactgggcatgacagaggcagggcaggagtctgggcagcaggctctacctcctgtctactccacctaatagctaatggggatcttacctaaactctttaagcctcagcttctatatctgtaaagtgggaatgatgacaaccgacacttgatggagctgtcggaggactgaagggactaacgtacgtgaaaacacttagcacggagattggcacaaagttacacaattaatgagaagtgttgtgtggagggcgatttaagggtgaccctaaaacctctaatttaagaatctggaaaaatgcagaggacttgatcagggtaggaaatgctgaaggaggatgcattgtacagggagggtgaacgcaaatttattttgggacatgttgagtctgatgtgcctgtagaacctgggggtgggagtgtctaacaagcagggggacctcataacttgaggttcggtgacactagcagtggacagccgctgaggcaatgcagacaaga

SEQ ID NO: 63926 - DNA, 916 bp, Bovine  19866882005306
taaataattttttcagcataaggatgttctatttggactccatttgggacatacttgtaccaaaaattgttcactgtttatctgaaattcagatttaactgggcatccagtatttgtatatgtaaatctggtgagacaggaagggggagaggtggtcattcaccatcattccaaatgcattctagctactcgcccctctcagctgcccacaataggtcctgatggtaccttagcatcatgtgctaagaaggaatggctcatgtcgtaaagtctctctgttaaaatgaggcttgggagtgttttcattttttgtggctgctgtaacaaattaccacaaacttagtggcttaaaacaacacacatttattattttatggttccagagatcacattctgaaagtcaaggtgccagcagggctgtgctccttactgggcagtctagaggaaagttcaatttcttgccttttctagcttctagagactgtctacattcctcagctggtggcctcccttcatcttcacggctagtagtggccggtccagtcttccccgcatcaaattatcctgacattgtttattctgctattctcttccacatttaaaggactcttgtgattacattgggttcacccagataatccaaaatcatctccttattttaaagtcagatgaatagcaaccttaatttcatctgcaatctttaattccgctcgctgtgccgcatagcatattcacagggtctgtgggttaggacatggaatcactggggggccagtattcttctacacagggaggtttccagtgttgcttttcctttctgcagtttgctcgtggagtcccagacctgatgctgaaggacatcgcctgcagtgaggccctcctagagcgtttcctgatctttccccagcgccgtgca

SEQ ID NO: 63927 - DNA, 1384 bp, Bovine  19866882054329
tgtgtgtgtgtgtgtgtgtgtgtgtttgctcatgcatgcttcaatgaatatcaaataatctgatggctttgtgcaagtagaattaggactggttatattttcagtatgcagaaagatttcttgaaatattttattaactggttgatgtacaaataaaatttggagacaatctagacttaccaagatatatttattgtccccaaactacttaatctttccactcctgagggtttgaattgctttccttctaggagctatatcctggaggaagacctggcaggaattgatggagaagaaaaactctaatcaacttgtctccctccagtagggatctgatactaaaaacaaatcaccagactatcctttccctttcttttccctgtcaccatgtcaggcagctcacacactgcaatatttaccttaatcagggaaggaggagagaatttcagagaaaaaggaagaagaaaattaaaatattaactgtatcattgctacagtggaattgtccttcttcccaggttgggaagtacaatcccttatttttttctcttccattctgaagcaacacacacacacacacacacacactctctctctctcacacacatgtactcagttgcttagtcatgtctgactctttacgacggtatggactgtagcccaccaggctcctctgtccataaaattctccaggcaagaatactggagtgggttgccatgccctcctccaggggatcttcagaatccagggatcgaactgtgccatctgtggctcttgcatttcaggcagattctttacccgtgagccctcggggaagcccctctaccctcaggagacaaaatcaaatgctgaatttgatctacctagtgcctatataaataattggtacttaaaaaaataactattaattgtttaaaatgatagtcaaaattagcattttcttccactttgagcagtaatttagcatgatctgaggaaaaacagggtctgaatagtctcattcagtacagccaaatgttgatgccctaaatccatgacaaatctgcctttcagtttcattgtgacattactccctcccctgcgtatttaactcatctttaagcatgagaagttggcttgctctctggtttcttccgagttggatcttcccagaagggcaacattattttacttaaagtccagtgaattcccagaattctagaaacatccctattcaaatgttagaataaaaacacattccagagtgagatgaaaaactgcagtctgctccaaagcatggaaagttaagagttgactatttgggaaagttcctgctgtgtcaaaaccggatgaaagcaagtctgttttcatttttcgtattcaaaaaggcctcagtaacaataa

SEQ ID NO: 63928 - DNA, 1658 bp, Bovine  19866880364152
cgggcggcggctcggaccgagggggcaggtctccaagacccacacgtccggtgactctgaaggggcccccgcttgtcacaccgagtgtgctttgtacaacaaaacgagtcactcctcctccccagctacccccaaacctgattctaaatcaagtgacaacttcactgagagaacaggagtccacagtggtgccccggacgcccaaaagcactgaactcctcgcccacaagaatgtctctgctaccagccccagtgtactagtcccctcctgggctgtccgagccacacctgtgggctctcaggggtccccggcccccacatctcccactgtggttcccacacccttgctgactgctcatgacaggcagctgaaggggcctcggctaagctgttgagaggctctgaacccccgagcgcccccaagatggggaggccaggccgtgccagcaattgagttcccttcccgggtctctgcccctctcgcaggcgaatctcaccaagtcccagaatgaatttaagattgttctgaaagagctggaagattctctgctggcccggctgtcggccgcatcggggaactttctgggagacactgccttagtggagaacctggagaccaccaaacatacggccagtgagattgaggagaaagtaagaaaccgtctcagggacccaccccctcgtacccccagccatagcacacagcgggcatggcaggtgggctgatggtcattgagaagagaagtcccagcctcaccggggccccaggacagggtggggggcacggatgcccaccaggcacgtcatcttcatctgctgatggacatttaggtcatttccatgtcttgactgttgtgaatagtgctgttataaacacagcggtgcatgcatgttttcgaattatggtttgtctagttatatgcccaggagtgggattcctggatcatatggtagttctctttcaagttttttgaggaatctccgtactgttctccatcacggctgcaccaacttacatttctaccaacagtgggagcagcaaaggtttccctttgttccacaccctctccaggacttgtaggctaaatttttaatgaaggccattctgtctggtgtgaggtgacacctcattgtggttttgatgtgtatttttttctaacagtcagaaacggtgagcatatttccatgtgcctctaggcgatctgcctgtctttggagaaagtctacttaggtcttccgccctaagtgactttggtttgtgactgcttgtttcaaggtgcaagaggcaaaaatcacagaagttaaaatcaacgaggcgagagagaactaccggccggccgcagcgagggcatccctgctgtacttcatcctgaacgacctcaacaagatcaaccccatctaccagttctcactcaaggtgcggctgcctccaggcccggggctgtggccctcgggtccgggctgcaggtgtccgtgaggggcgggagtcggggcaccaggtctgaccagcaccagcccagggagtgagggtccgagcagtgcccccagaccccgaaccccaacggaaaccaaccagagccagcatgggcggcgtggagcaggctcaggggccgtgcccaagcccctgcctccggtgacacccccaggccttcaacgtg

SEQ ID NO: 63929 - DNA, 2018 bp, Bovine  19866880508856
gccctgatgccctggcactatgccctgaagcggatcgggggccggttcggctccagcgtcctgtcctacttcctcttcctcaagaccctgctggccttcaacaccctgctgctgctgccgctgctggccttcatcgtgggcgtgcaggccgccttcccacctgcgcccacgggcccggtgcccgccttcacgggcctggagctcctcaccggcggggtgaggcttggcggggagggggcggcgagcaggggcaccctctcgttacacccccaccccaactcctgctgtggctctggctccctcactttccctgggaccctggaagccctagggcagccacgctcctccattcacctccgtgttcccctcaccccgcttgctctctggcccttccccttctgcctttctcctcgctccgccttctgggtgccctgcaagcctgagggtgggtcagctgccaggagggcagactccctgaccctgccaggcgttttctccgcagggctacttcacccacagtgtcatgtactacggctactacagtaacgccacgttgaaccagccttgtgcctccccactggatggcagccagtgcactcccgaggcgagcagcctgccctacagcatgccgctggcctacctcttcactctgggggcagctttctttatcacctgcatcactctggtctacaggtaatggctctctgccgtgtgaacccagttctgagcatcactgacccacccatgcatccatctgttcattcattcatctatttgtctacctatccatccgtcatcactccctccgttcattcatccgttcatctgtccatccattaatccatctggctacccatccattcatcatctcttcatccatccagccacccatccagtcatccatctagctacccacccatccattttcccatccactcatccgtccaaagattgaaggcaagaggagaagggggcaacacaggatgagatggttggatggtagggacatgagtttgagcaaactccgggagatagagaaggactgggaagcttggcttgttgcagtccaccttggggtcacaaagttggacacagctgagtctgaacaacaacaatccatccatcatcactctatccatccatctatctatcaaccatgcatccgtagatccttccttccatccatactttcatccacacacccatccactccacacacatttgctgcgctctgctcagggcaggaagataaatgagctcggtgcacatccttgagacgcttgctgtgtacaggagaagacaggccagtgaagaggctgggaaactgttgcgttgctcaggtgttatggagcatgggagtcagaccagcttcctaggggggtggccctagtaccacagagggaggttaaataagggcagccagggaaagacagaggaaggtactctggttctcagaagaggcagtgcacaggtcctgaggtaagccagaagcttctctagccacgtctgggtgggaggcagccggcgtggtggtggggagtgggagctgaccccatttctagccctttgtgcctgctgggcatcctgctggacaggtctgacctagggtgggcggtggtccaccccaggaggctgagagctctgggctagaggtggggcagggagagtggccggaggcccatcagcactggccgggggcggggggcctcctgtgagtggccggtgcactttgtcagatctgtttctcctggcctcttcgccttttgccaagcctggctctgcttctcccagcatgtcccgctctttcggggagagctaccgagtgggcagcacctcgggggtccacgccatcaccgttttctgttcctgggactacaaagtgacccagagatgggccacccggcttcagcacgacaacatccgaacccagctgaaggtgagctgggggctcacagccccctggggccacggtctgccacccccgtgtccaggggaacaccagttggggccctgcagtg

SEQ ID NO: 63930 - DNA, 712 bp, Bovine  19866880522803
ggcctcgccctctcctgccagcctccctgtggccagcgctctccaggggaagcgactatttcagccagcccagactcgaccttgcaagacacgctctttaagaattcttccagtttgtcatttggaattctcgataaatgcacacccacaccatggcggagctctctggggacagccagcgagtgtccgtggtcaactgctgtccttgatgtcgtccgcgtccctcccctcatccgctggcctctgtgtggccttggaggcctaaccctacctccccgggcgactgagcgctctcctccaaggagagtgcccggataccatgtgatgattttcctgtagaactaatcattagggagaattttttctttttagagtgctttatatcaagagagaattatgttccctatcaaatttcctttgctgtttatgctaccaggaaattaagagctaaattcaatgcttaacagtgagatcaccgcctatggttattagcattttctttttttttttttgggctgagtggcttgtgggatcttagttcccagaacagggattgaacctgggcccacgcagtgaaagtgtccagtgctaaccactggacctccagggaattccatggttattagcatttttgctttttatcttttctaagcattagattttcctattgcattaatcattttattaaaaaattttctttcagacaagtttt

SEQ ID NO: 63931 - DNA, 1414 bp, Bovine  19866880656584
tacttctctacagcccaggctgtttgggagctgcttctttaactcatggtttcactctccccaataacctagtttacctgtgcaagagtcaaagtttgcctgcaaagatcccttcaaggtccagtaggactggcactattttctcccaatacacataacgctccttcctgacacactctctactctgtgtctccaaaccctctgttctcacctctgctaacacatgaacacactctgtataaaggagctaccatctgagttgtcactgaaggcaggaatgccagcctagtcctcatatgtcccaccaccagaggtaaccacacactgagggcacctctactcagggcatgcatttttttctgattgtacaaccccaaggtgacagtctaggtcatatgcttttctgtccttttatatcttcacacacatatctgaggggtttagaaagtgctgaggaaaagcatctatgcagtgtttgtgagggaccaggagttcagtactaaagatgctgaacaggatttgctcttggttcttatttccagtgatacatacgattttgttcttggttctttctttatccagtttcaaaaattcactgagggttaattcttcaaactgcttcttgacagaaaggaaagcacaaccagatgaatgctttttatgttcttctctagaaaaaacaatacacgagcatgtcaacagagacagtgaagtaaagggagaagagttcattaccaccagtctccctccccacctcagagacacacgctgctctgcttcaggagcagagtatgaattctgaagtggatggaaccagtacccagacccacattcccacatacctcatctcagcatcttcttggtctgtggacaccccccattcccctcctatggctgttatattctatctggagtcctttagcaagcagtaggaaaagcattacagggtgtaaatctaaaggtaccacatgttaaagcccttaaaaatcatccaggaaccgtttgcagttatctcattttattggacttattacataatctattggttcagagaaagggcactactggcctggtttctccagtgaattcttgtgcctatactaccattctctccagtgggaattatccctgcatagcagactgcactagaaccagaacagtctggggacttcctggtggtccagtggttaggactctgcactttcattgctgagggcccaggttcaattcctcattagggaacttaagatcccacaagctacttgatgaagccaaaaagaacaaacaaccacaacaacaacccagaacaatctggaagaaacacacagccacacaaaattccaagaggatagccaatagtaactatataatctgaaaacattacagcacttggaaatccactccccagaataca

SEQ ID NO: 63932 - DNA, 1629 bp, Bovine  19866880786176
ctgcgccgtggtgagagctcggactgtcctggtcccagactgctgtgccctccagtcagcatgacgatccttttgcgttgagaacttcgatttctatttgttttccttcagatcgtttcactgggtagtgatctggtttgggattgactgcaggaggtggtggagggactgctcagaggtgtgcctggccaggagcggggtcccctcgtggtgtgtttgtaggggctggtggtggtcagggccccatggaggctggtatgccgcctgccacctgcctgtgtcgggatggcggtggggcagggcaggcccgtttccaaggtgtcttggaattcctgcattgtttttgtcacacttgtaataggatttctttccttgcaactgtgagagggggaggcaggcacctttgagagcgagggggtgggggaggggtggtccctaggagagaacttaatgcgcttgatctggcttggcgggcatgtcgtgtggtccaacgaggacctccccactcccctgggaatagactcccccgagtggcctttctcccaagctggggctggagagtcagtcacggggcgcgggatccccagcccctgctgctggctgctaggggcccacggttggttgcagggtggacggggagagcgctgggctcccggggaccggaacgcagctctggttcccagaggggcagcggtctcagccttctcctgcgatggtggtctttccatttaaagccgagaatgagtgcagatgaacccctttctgtttctacgagcgtctctgtgttggatcacctgcagcagcggctggtggactctcgggacgcaagcacagcagctgtgcacgtgaaacctgggtgatccttgggttcatggatttatgacctttacgacagagcctctgcaggggaggtgccagctttcctcctgtcataggagcgtagataacacccccgaggccagcccgcagaagtgcaggggctgtgtcacgccttgatcttgtgttcgggagttactgttgcgaagtccttggagcccttgttgatggacgaggaaatggtaactgcctggttcccgggatctgcctcccgtgatctgggaatcttgtcagtgactgagcagggccctggtgccaggaagggcctcaccggggccgaggggaagtggcggcggttgggctctgggcggccagcgggagactctgatctgctcagcagatcatagatgctatggtcaggcttccagcaaacgcccgccgaggttccagcaggggctggccggcctcagggcgctggggtgagaggagcaccagcatctcctgggcctcggcctcactgctgagagctgggtttcccagacatagaggggtcagggtgcgcctggccccagggctctgggcctggggctgattggggggagcaagtctgtgcccagagtcctggtgctagccactctccccccgctccccaagtagggggactgaacccacatcctgaatcttgagaaaagttgggccgcttgtggtcaggagctgcttccccaaatgacatatttgggatattttctttttcttcccaaacctgagtcccaggggcttttgttgggagggtgacagtccgcaccactgcag

SEQ ID NO: 63933 - DNA, 3275 bp, Bovine  19866880857815
tctagagagtgggctcagaagttgtggcacacgggctcagttgctccacagcatgtggaatcttcccgggccagggatttaagccattggcaggtggattcttacccactgtgccaccaggaaataaggattccagtgtatttgaagggaaaaggagagcagattaaatggacgaggaagggggttggggcagggttataaagttccagggtcgtctggaacggcacctggcccagtgattgagccaggccttgaggcagagagggctgagccacgtaggaaacctggggggcagctggagcaagggccctggggagcaatggccctggaggatgtgctgggcgtgtgttcccagaactgcaggacacctgaggacccagcaggaaggtgggaagcgacggggtgggagttggccttgtaggtcacctgggggccacagggaggtcctgatgggggtcggggggccattgaacagagacggtggtcacctaggaagagatgcagtggtatgcaagggtgccagcggaggtgctgagaagcagttggcttctgggtgcatttggggtatattacatttccacgttatttacattaaacaaaaccccaaagcagaaacagagacctgtgtgtccagtgacgtgggtgccatagaggcgcacgagcctgtgggtgcagcctgaagtggaaagtggggacatgggaggtcccggggagggagggcatcttcactgagctctgcagacagcgtctttccttccgtgctgacatccacacactgctggacacaccacagccaaactaagcagaaccccaagtcaggccctcacagggaagagtggcccgggagcttgtccctagagcccccttgttggggagccttttctggggtccctggggttcacctctcctaacttccacctgttgaaaggggaaaagctggccgcctctgaaagtggatttttttgcagcaaccaaaaaccacttgctactgggcttggcaaatgagtgactaatcaacactggatcatgcaacttttgaccccaaagcagcccccgcttcgaaaagcctgcggctggttttctcaagtggctccgaagtctagttgcaaagcgtctcaggactgagggtacaacctcccaagttaccaggctctgcagcattcagtgcgaagtctcaccccggagttgaggggaaaggtcccctgtgagactgagctgcggtccttacgttcccctcttgtggaacagcagtcagcacacccccgctccccatcagagttgggaagcctgcatgaaatctgtctctaaatcctgatcaaggtcacacctctcctcttctttgttcagtcgctcagtcgcgtccgactctttgcgacccagtggactgcagcacaccaggcttccctgtccttcaccatctcctggagtctgctcatgtccactgagtcggtgatgccatccaaccttctcttgaccatttacctttgtacctaaacaatgtcgatgccccctgagcgcccctggctcctcctccctcaaagcttggggacacggttaaacccactgagaccaagaacacctgcttggccaccttcgaacacctgctcctgtgagcatttcctggcatcacagcatttattcacattaagacttcacttatgaggacttccctggtggtccagtatataatagactctgcactcccaatgtagaaatggctggggtttgatccctggttggggaactaagatcccacgtgctgaaattagagaaacccgtgtgctgcaatgaagagctagtgcagccaaaataaataagtaaaatactttttaaaaaagaattcacttgtcgggggtagagattcatccttgttctttggtctcaccaaaagttgtcaaatttagtaaaataaaccaagagaccgagtgtgtagttaaatgtgaatttcagataaacagctaggataagtgtatgcgatgtgtggaatatacttatgctaatagttattcattattcacctgaaatgcgcaggcgttttctagttgcaactagtttctctagtttctctcgatgcagtggcttctcttgttgcagagcatgggctctggagcacacaggcttcaggagttgtggtgtacaggcttagtcacctcacagcttgtgggatcttagttcccggaccaggaatcgaaccggtgtcccctgcgttggcagaaggattcctaaccactgggccaccagggaaacccctgagcatcttgtcttttatcttgcaaccctaatcccatccaccccatagatttcttgcagggaagctgcatttttatcattctccctttcccggagctgaaatgacttttgctttttgccttttatagcttcacaatggcagcagtaaaaaattcttgtcagcaggatgattgaaaatttacctacaaagggaatcgtttgttacatgtgtgtcagaggcataaaatggattcccagttgcaccactgcagttttgaaatattcccttggtgttggtgctttatagttacctaccccagcacattttatactctccggtatgaggctcctttgcagccagagtggaattatttgttcatgtttgggggcccagaagtaacatttattccccccacaaagtttgatgcaatgggttcttggtattttgcagttattattgtggtaatatttatattcttcagaattatgacaatattcagctactaatgaggttattgtttgtgttttaaagccctggaaataaaatttagtccccacaatacagctgcaattttatgtccccaaagctggccgtaaacgtaataacagaatgcttgtaaaacacataagacatccttctcggaagaagtggtctctctgtgtctcccttgatgggactggcagggtcaggactgggcctaatagttaggatgttcccagtcgttcccaggatggcttcaaagggatgaagtaacttcttcccaggccgcctggagagcaagttacttaacatttcagagcctcaatggcctgtgaaatgggaacaaaaacactgggttattaaatagaaaggttggtcttgagggcatgcgatgggctgtctttggacaatccctgtattggttttctggggctgtcggaacgaactaccgcaaattgcgcagcttttatcagtggaaattgattctccatggttgtggaggccagaagtccgaaatcaaggtgtcagcagggttgtgctccctccgaaggctccaggtagcatc

SEQ ID NO: 63934 - DNA, 1340 bp, Bovine  19866880988129
cacactctgtgattgctatcatcgtcctttttgctattatttacttataagaatggtaatgcaatgggttctgagagtgctctcatattgtaggggtttgtgtgagaaaagagaaagacaagagagagacagagagacacacacgcacacacagaggatggaatctcttgggggcagtatccataactgtcatcacattcttagatgtgtccatgatctgagaaagaactgctacttaaaatgcaggaaaagtaatccggaaattgaatgataatcataaggagtgttttgcatatgtggtttctttcttttttaatgaaggagagagaaagagtggctttatttccttgccaggcaaagggggaacacaggaggctagcggatcaagaactgcaccccacacatgaggtttctaaccctcacgaccatcctgcagtaataccagcctttctgcttccttcaggtctggcacattctctgcacattgcataacctcagattaaggttaggaacttcggccccaacctcctctggggttaatatttataaatattaatatagccagggcttccatattctacccttaaaatcaggctagcaaaagcctgtctgtggagagaagtaaaataaatccaagtgctaaagctttggggatctgctacactgtaccaacagcccccacaggaatgattctaaacttttctcttaactctcatgtaatgtctgagctacactcctcagccccagcctctctccctgtgattctcctacctctttagacatcctcttccagggagcctcgtgcctgtgatttccaccggagacgtccatccccgctttgtaccaccagacgcacatgtaccacagtgccacatgtaccgcgtgtgcgcgcgacccagcctttttatagcaggtgggcagggctcctaccaggccctgatgaactacgctcacctctctggtgacagaccaggccccatccgggaggagccacgcccacctcccggggacagagcctggtacgcgcgtttctggtccctcccacgagggggcgggctgaggccaaatctccctccaatcccgcggccgcgcggtgattggttccgggatggcggccccggcttccgattggcctgctcgccggggataacatgccctgcgcgggaaccggcgggagcctgcaaggcggcggcagcggcgcagagtgcttggtttgccagctccctgaaggtgccatgagctgcatcaacctgcccaacgtgctgccaggctcccccagcaagacccgggggcagatccaggtgcgggcgccggggaggggtcggggtcagggtcggagt

SEQ ID NO: 63935 - DNA, 522 bp, Bovine  19866881021884
tctgatctagggatgtgactctcggctgcttttctggatgtggggggctttggaatgttggggggggcctgctcatcccaggggaccaccttcctctggtcgttttgactcagaccttgacattttgcacacttgcctggaggtgagtagggggatcagtttgccacctgcaggggtgtgatgatggacctgctatgacccaggaggacggcagggtccccgtgagctggcaggcagcccatcactccccagtccttccccattctcctaaacgtccggctccgagcgtctagtaaacacactcgggctgggcaggaaagagagcgaggcagggagagaacgcggtgttcagggtctgagaccaaccttgatgccgccccagccctggtgctgcaggaagtccacgggcgacacgaccccggccttgaacgggaaccgcaggaggaagtccagctccactgggttcagctccttcttcatggacaagacctgagaggtggggggctggcttagctgttgtgc

SEQ ID NO: 63936 - DNA, 1460 bp, Bovine  19866881088118
attgctgctggtgatgaataggctggtcagccagctgtgtacttgtggatggatagaaacgagcccgggattgaagcattctgatagataatcccgtggtaaacaagtgatctgagtaatgtaaacgagttgttttcaaagctgccgggaagtcaagccgattgagggaagtcaggctggttgaagctgtgtggattagtagcacgtgtgagtggttctcggcagagcctgccgggagcccgtggctcccaaggagcgtcagggtcagaagtctgcactaggtctgtggcccctcgatgtaatcgacttttcttctggaaagccaagaatagggtcaccggggccgcgtgtaacctcacgctggcagccccggcccggtgccggacttcttggaggagtgcagcggccgttgggcttctgaagtgacctacgggaattcacactcatttcccttgtgtggggttagggcttgcgttagtcaggaagggccgcctgctgccagggctgcaggaagtctggtcccttggtgtagtttctcgtgtagtttctcgagcctttctcaggaagtgttatgactgttgctcttttctcatcacttcacctctttacgtttaagtgtgtgtgacgggggtggggtgggggtttcttaaaaagcagtttctgaaaataatggcattccagagttctgtttcttttaaaagcttctttctttttcttgtcgtaccgatttgggtgggacccaagccacagcatgtgtaccacgaatcttatcgtacagttcccggagagtttgtggacattcagaccccgaccctgagtgtgggacacttaggtgctcttgcgtgctacaggggacagagcccctctgctgtccatggtggatttgtggttggtgtaggagacagtcctccggtaccccccttttttcttcagagccccacagcccttgttttgcagagcccctaggaggctggcctgcttcctcatgtccacaggtagtgggtggcacctctgcggcccccagggagccccagtgtcctctgcgggtaccctgatggaggtgaggtgcagacccaggcgggattctcgggcgtcagctttccttggcccctccgcggtccctgtgaggacgtgtgagggcttggtcggacctccaggcgcactgccttgcgtcctggtcaaggcgggaggcagtacgtgtgagttctcccctggtcaagcggggaggcagcacgtgtgagctcttcccccggagcgcgtgcagtttcagaatgtttggtggaatggaaaactccggtcttcccacacaaaggagaaatgccttctcccgtttctccgggcttcctttgcacaaaggggtgttgatggcgtctcaaccgctcttctgcccccctctttctcggttctgctggctcctctgagccctgatcctgctgccgtccgtcctgctgccgtccggt

SEQ ID NO: 63937 - DNA, 523 bp, Bovine  19866881178338
ccccacccccacacacaaccactcaagagaaatgtctatcttagaagaatttgtggctattgccccaacatcttttagtaatcaattccaatgttaaacaatgattaatcatgaagtgttttcttgtacagtttaaatatatacaagggaaatgacaaaatggcctaaacatctcgtccttcagagccttttttcaaactttaaaccaaatttcttagtgggttgaggtcaggacatagaagtcatttgacttgactatccactggcgtgaacaggtctttgttaagtaccaattacagaaaagggaggccacctcttctatacaccactcccattaggttcactgatgtaaaatttaaagctgttcagatcggtaagcttccaggagtttcaacctgtgctgattctatcacaaaaacttcctctaaatcaaacttttaactttttgctgaaaatcttccaacgtcacccaatagaagcaagctcctttccatacctagaatcagcacggacggaccacaga

SEQ ID NO: 63938 - DNA, 900 bp, Bovine  19866881423659
ttggggctgggtgggggccgggttgggggcaagctcttggggccccctggaatctagattcccttggttggggcagggccagagacggggggtgtctcaccccaggtcatggagtcgaggctctctctttgaatgggagattcccgagagctccggacggccctgggtaatcggttcatcgattaacagcttgggtgtgggggggtgcttcaacagggggcggggctgctgagttctggggcccagcccagcgaaagtgttgccggtgggaggcggggaaggcggtaattccaggttggggagggtctctgcgcttccgtaagactctgaggatcctcagaggggccccccgggtgccaagcgccagccgggcccccttgggccgctggaagaattggttcccaccagccaacctgttcccatagccagaagttgccatggtgaccccctcccaccttcagctacagcttttccagtaaaaccactgcagaaatccatacttcccgacaggcacgcccccggccccccaccccccactctgcgcggtagggagcggccaggagttaaccctctgcctgccggctggccggaaatattgggggaagtcaggagagtgagagctggccgtgggggacctggggctggaaaggagaaagtgaacagggtagggccagctgctgtttccctcgcggccccaggatgggactccaggaagttagaggagagaaaggaagctagcgccccactgtcaccggctctggagaattcttgctggggtaccaggactgctcccagtggaagccgagtgtccccgctgggctctggccagccgccccagggtgccttccgctgtcggtggggtagcaggactccccagcctggcctgcagttgctgacgga

SEQ ID NO: 63939 - DNA, 1615 bp, Bovine  19866882022376
agaaaacgttttctaaaaggaaatataactgagctcaacaagacctgaacctgaatatatggacaaattcaggctggtaagtttgtgttaaatacaggaactatactgagtgtttctttctatctcctggttgagttatctgaccctcggggccgttggcctggcctctgagtccccagcggcagctgaaacctccactgccgcctgatgagccccatggacaacatgagacagcggtggggactccgtggactggggtgctgctgaaaactggccttggccacccccaacctcacagcatctctggaagagaaggctcagagctgtgtgcgtgtgagcctcagccaggaggaaatcaaggacagttccagggacgggaaggacatgtgcttgctttcatgtcatttcatcccaggggagagaagtgacatgaggcggccatcgttcaaaaccccaggtcctgcctcacggacgtctgacagtgacttgcaccttctccacgactgtcaaaggcagggaacgaggccaaaatcactctgaaaaccactgagaacctgcaggagctgtcatctctatttctggggaagaagggacagtatggtgttttcctgcagattaataatgcatttaaggtgtccatggtcaggagagacagaacagcaccgcctcgacctgtgaagagacccagcagctgaggactgcctgtagcccgcgtcacttcaggagcagtacattagcaccatgggtgttgaatgcactcacatttcagttacatgcagaaataattttgaagcatttccggtaacatggttaaatttctagaattggattcatttcttgacagcagtacttcacttgaaaggaaatccttgtcatagttcagttccctttacaggttcagtgctattttcatatcaggtattaattaaaaataaagttcatgcctcaaacacactgatttaaaggcacataaaggagaccccggtgagcctctgccagcagccttacctgtctagcagaattcaagttttgcatgcccagccctgaggcaatcccgcccagggcctggctggggagtgcactgttggaaagggggggcttcaggcttggtgaaggcaaaaatggtgaagtcgtgggctcttccacgaggccgccatcctgattggggaaagaaagcgtgagctgtgggcagggcccgtccacacacaaagcacaagttcccaggacgcagacaggagagtggatgaacataaaggagtgaaagatcaaaaacgtgtagacgagaggtggagaaatgggcaaaaggaagaggggaaaagaaaaaagagaaacaggattaagacgctgttttcattttaacaattattttacaaacacgcatgtcagcttacatagtctcatcactaccagccctgcctatggggaggtcaggagagagacagcgtaagtcttagttggaaaacactttaaccaccgttttcaaacaaacaggctcctctgagaacttactaacaaggctctaggtatacactaggttgcgatctgctgatattcatctgttttgatttcatatgacttaacctaataataaggtaaattataaagcagacaaaaa

SEQ ID NO: 63940 - DNA, 3180 bp, Bovine  19866880234045
tcagttcttcgcatcaggtggccaaagtattggagcttcagcttcagcatcagtccttccaatgaatattcaggactcatttcctttaggattgactgttggatctccttgcagtccaagggactctcaagagtcttctccaacagcacagttccaaagcatcagttcttcctgtgctcagttttcttgtagtccacctctcacagtgcgcttaggaggtgctcaataggtgtttgatgaaagactaagcaaacgcatggacactgcagctggggagatcagaacaggaagggcaaaggcaaggggttcctcataattggaattctgggtccttcagcatgcctgaccacctcccctttcctttttttttttctttttccctattttccagatgtgctttttcttctttcttttcccaacattccaagtaaagggtaccaggcccattgaccccttgcttggtcagtgacagatgggagagcagaggcagctgggtgctgctggagtttatctcagagctgttgaggttggcggagggggtcagctagcaggctgaacccaactggcatcttaaaggcaaaatgctgggcaatgttttgcagcttcagcacaacagaggtcctgctttcggagggagaccgataaacaatggccccacagcttaacaggattgaaatatgatgctattcaaaggggatgtcaaaaggattaatagcccatctcctcctagcttggtgctaaagccacgctcctgcctcgagttaaatcacgcttagcctgtgtgctacattttaaatcttctccattaagtgcagaccatcaccatcgcagcgtggggctggttctccgggaccctctgcacactagtacaatgctccagttgggtctttttaatggggaccaagctgagcacctggatagcaagcacagctcaacacattgagtctacaaatacacatctgtcccctttcttgggacatacttctggacttgggtagaaacactcgagaaaaacaaatgtctcagaaaataaagagacacaaataaagggacaatgatggactccactgaatgccaagtgacaagagctgaatcttgtcacacatcctgcacataaacagacttatgggggaagagggaaagtcaaggtaagggtgatggagcagattgtttaaacaaagacagtctaagctgctgtgccagcggtggtcgggtcctatgttcaggcaggcacaccccatgaacgtgctttgtgtccaagttcgggttaaaatggacacgactaagcaactgacacttcgcttcaggttaaaataacccaagatgctaagttcagcacctatggatttaagagtttcattctctaactaggataccgagtggtgcttctcagcacacagatgggacccagagatgatggctctccgtgtggtctgctgaatgaagagcagtttataatcctgacttttaggctgaggacagtgtggcctccttgcttcctggtggaaggaatgattcactctatccttcccttggtatccctttgtgaggaaaaccgactgcctctctcacatagaaagtggactccccccctttactgaggtgcgagtgacaaaactgtagatatgtaaggtttacaaggtgatgtctgatggcatcagtttgaagggattaccgcaatcgagctaactcacatgtccttcatctcgtatagctatttctttatggtgaagacacttgagataaactgtcctagcaactttcgagtatccagtacagtattatcaactctagtcaccatgctatgcattaggcctccagaacttatttatcttataactgagtttgtacgctttgagcagcatctttccacttcctcctgcccccagtctctggtcaccaccgttctagtctctgtatctgtagattccatccccctgcatatataaacgataccataaggtatttgtcttcctctatctggcttatttcatttagcataatgtcctccagtttcatccatgttgtcagaaatggcaggattcccttctttttcaagattgaacaatattccactgtatatcatattttctttatctgtcaacagacatttagctattttcatatcttggctgttatgaacaatgctgggatgaacttgagggtgcaaatatcttctccagatagtgattttatttcctttggatgtatacccagaagtgggattgctggatcatgctgctgctgctgctgctaattcgcttcagtcgtgtccgactctgtgtgaccccatagacagcagcccaccaggctcccccgtccctgggattctccaggcaagaacactggagtgggttgccatttccttctccaatgcatgaaagtgaaaagtgaaagtgaagtcgctcagtcgtgtctgactctttgcgaccccatggactacagcccaccaggctcctccgtgcgtgggattttccaggcaagagtactggagtggggtgccattgccatctccattgctggatcatacggtacctctatttttaattttttgaggaacccctatactggtttccatagtggctgtaccaattacatttccaccagcagtgtacaagtgttcccttttctccacatccttgccaacaactatcttttgactttgataacagtcatcctaacaggtgtgaggtgatatctcactgagattttgatttgcatttccccaattagtggtgttgagcatcttttcatgttccccttggccatttgtcttctttggaaaaatgtctattcaagtactttgcccaatttttaatagaattatttgatttttattattgagttgtgtgagttctttatatattttgaatatcaaccccttatcagatatacggtttgcaaacattttctcccattcaataggctgccttttcattttgctgattgtttcctttgctgtgtaggaaccttttagtttgatgtggtcccacttatttgtttgagtttttgttgcctgagctttgggtgtcaaatctagacaatccctgccaagactgacatcaagcttataccctgtgttttccttggagttattttatcaggagacggtagggaggtagatagttctcctgtcctatccaagtgccaaaaaagactgaagaaaactgtcctggagag

SEQ ID NO: 63941 - DNA, 1354 bp, Bovine  19866880376973
accacagtttgaaagcatcaattctttggcacctagccttctttatggtccatctctcacatccatatagactactggaaaaaccatagatggactagacagacctttgtcagcaaagtaatgtctctgctttttaatatgctgtctaggtttgtgatagcttttcttccaaggagtaagcatcttttagtttcgtggctgctgtcaccatccgtattgagcatgggcaggataaatacgacattttctctctctcttcctcttgtctctccaactgactgactttctctcactctcctccactcgggaacaaatttgggggcttctctgaagttatcgtcttgacttggtatggagcctcctgcccccactgctatggaaaatgacagagaacacctggcctgctgctcatactgccagggagtgaggagggattcagggtcagccctgagtgctttgtgttcgtatgggttctgtgggtttgtttgaaaagacgaccttttgttggtggagtaattttagttttagttggcacccgagacaaagcggtctttcaacacacccgcagcctataggtggccaggacttttttcaatgagattgcaggaaatttgccaagtcgtttggggcctgtaaattaggccttgtttaaaaatttagataaagcccaatgtgagagagaaatgctttcataacattaaatgtgaattacactgaaaacccctttcaagttaaatgggaaccgttctctggaagcccagagacatgaaatgcttcaaatgtcaaaagagttttcatttattgtcccaagtgaaacgaaggcattttatgtggtttaatagttcagatgcacatgtaaatggaattcacttggaagaatgccggggctgcttcggaatctattttcacaacctgcctgatttcatctccacagtaaccgtacgaggggtgggtcccagcgtccctgtatcagagataaggagagcctttcccatcaactgcattcttgccaccaacatgtaaagctggaagtattgtcacattttaaatgttcatcttaaaggcagcggtcatggaaccatctggagagatctcacggaaacaccggtgaaaggtgttctcagtgttggtgtctgtttgttgtgggcttcccaaccgggtaaagaatccgcctgcaatgcaggaaaccacaggagtttgattcctgggttgggaagatcccccggaaaaggaaatggcaacccgctccagtatccttgcctgaaaatcccatggacagaggagcctggtcggtcacagtccatggggttgcaaagagtctgacacgactgagggactaagcacagcacgtgtc

SEQ ID NO: 63942 - DNA, 1690 bp, Bovine  19866880396243
tgagacattgtgcgtcggaaagtgaagacaatgaaactgaatctgccaaacctgtgacatctcctaaaaggtgaaatctttttctcatcttattttttcttccatttatgatccaaacatgatcccttccatggaaaaatctctcttcctcagttgccctgagttgactctgtggttgtgacccacatgccacatcctcagtgatccaagactttgttatttatcaggtaaaaatataaagacaaccaagtaaaacacaagttgcagccaagtatttcaatccccagtacctataaaagctgaaattttgaaaaattcctgttatcaaattgaaatcttgttttcattatgtctgccttccagaagagaggaagggtgtttttaaaggcatcttaggtgacctcctttggttaagattccatgtttccactgcaggggacatgggttccatccctggtcagggaactaagatcctgcatgctgagcagcgtggccaaataaataaaagcagcctagaggtcaggattctgtgaatcagacttgtcttgggggcttgccaatatacagacttgcagatccactgataggtctccacaggggtcctggcattttttttttttaatgtagctttctagtgtttacatttggcactccccctcccctccccactccctgcctctggcttccctctcaagggtccgtgagctaggaagacaggcagaagtaaatgccctccaggcagctagcagagcccctccagagggtggtggccccgctgtcatttgcgttctcagtctcagcctaaatggagtctcaaggtctccagggagcccagcccagcacctgccacaagcactaaattctcccagaaccccagagagaaagcagtcctggcagatagagtccctgcttgcggcttgcctctgggccgtctctgctgacttggtgtctggatgctctctcttcatcctcattgtgggaagtggggcatctgtcttttacaggcatctgcctctccctttcgctctttgtatcctacaatccctggattgtttgaaggctagtttcccctacgacatcctcagcatcctaccctcccctgacaacccacaggagcccaccctgcagacattccctgtagggtctgcaaggaacagcatgcaaagggaggcactgaagttttcagggaaaccccagattgtcttcagagcagactttggaattactttctgtcctggcatcaccacccaccatctttgtccatggtgagggttagatttgctcatcattctcagatgggggcagataagcccaggaagctcctggcattgggctgtgagggcctcctgcaggcccagccatctgatggcgatccccaggccaagtcatctgacttgtcttgtgtctccagtacacacatagaaaaagtttctggaaggaagaatgggaagggagggacatggaaggaaaggagggaggaaccatcagtctctcaagattagtccttatttctgcatcctttctgcaagtatgtgtgagcatgtactatgtgccagacacaattctagatgctagtagtaaagaatctgcctaccaatgcagaagacacaggttcgatccctgggtcaggaagctcccctggagaaggaaacggcaacccgctccagtgttcttgcctgcgaaatcccag

SEQ ID NO: 63943 - DNA, 5216 bp, Bovine  19866880423830
atcacattcattgtttaagcctggtttgggtgttctggtgaagtcttagcttgtgaacacttcaaccaagcttggctctcagaaaagaagcttaatacttgggaaaactcatacagatttaagaaattcaaacatggtcttatttttaatggtctatctgggtctatttctgaagatatacctgattagctaaaccaaccaaccattagtattagcttgctggtttgaagttactatttggtagagtagaaagaggttatattcagagcttatgcagagctgggttcagacttggggctttactttctagctgctcactatgagaaagtgttaaatgtccctgaaacttgagtctagtctcctcatctgtaaaacaggtataggggattaaagatagggcttccctattggctcagatggtaaagaatctgcctgcaatgcaggagacccaggtttgatccctgggtcgggaagataccatggagaagataccccactccaatattcttgcctggagaattccacggacagaggagcctggcaggctacagttggtggggttccaaagagtcgtacatgactgagcagttaacactttcccttttcatcactttcagcagattaaagataaatgccctttgttgttcaatcgctaagttgtgtctgactttgcgaccccgtgaactgcagcacaccaggcctccctgtccttcaccgtctccatgaatctgcccaaactcatgtccattgactcagtgatgccatccaaccatctcatcctctgtcgcccttttctcttcttgcctttaatctttcccagcatcagggtcttttccagtgagtcaggtcttcccatcaggtggccaaattattggagattcaccttcagcaccagcccttccaatgaatattcagggttgatttcctttaggattaactggtttgatctccttgcagtccaatgaactctcaacagtcttctccagccccatagttcgaaagcatcaattcttctgcactcagccttctttatggtccagctctcatatccgtacatgactactgggaaaaccatagctttgactatgtgggcctttgtcatatagaaatggataaatggaaccctgggggtgtgaataacagctcactcgaggcttgtgttgggagggacaggaaatttgtatgtcaaacagtgaatgtggtacccagcacagaggagacatccaggtaagctgagttttctttcatttctctaactagtgtggggtccactttattaccagttgctctctcctgctgggactagcctagttggttgaggaattgggtggcgggggtggggagaggggcatgcagggcatcaccctgacttagggctgattggacccctcattgccctctgtaaatggttaaggccagcctcatcagtcatcacagggcacgtttgctgctggacacaaatcatcattagtccatcttcccctgatgcccaagaaggaaaatttccttagttgatgacttcccttggtcatcactaatggtgaatatgataacacatcgaaggctgaatcttctctagttccctactgccaggtctctgcctgtgctctgaccacaggcaagtaagagtctggcctcctggtcactcagagactccctcaaagatcccaccagggctcccacctggccctattccagagcagggaccaagtgtccagctgtgtgcacccctggccccaggcccacgggggcacactgaggcttcctggtgctctcggagtttgttatatctgtagcactcccccaggagagctccagcccagcaagggcgatggaagacatgagcagtgaggtgggaatggttggacaggcttcaagtatctgggggcctgttctggttaggccttgggctttcagtgtccttctcacactcctaacaatggggcaggggctgatggactgccacctgctaagacacatctcatgtagcaaccaggtcacaaagtagggactctgtaggtcatggggaagttgatcatgtaataaagagaaatgacacaagtgcgtaagggcgtctgtggaggcaaagccaggaatttgcccctgtgggtgctgggtgttatctgaagtggtgacactgcggtcatttggcctctccaagcctcggctgactcacctgaagcatgggttatccagagcccacgcttgccaaggtgtccagggagttaaatgaaagaccatctaagccttggcctcaggtacaaacttctgggtgataatgttcatgagactcttccaaccaccttctgaagtgaatcttgtttcctccactgtggcagagaactggaggctcataaaattcagtgttgatcattccagacctgggcagggttgggtggcacaggaagagcagaacgaatcatgttctgaacatgagagaaatcagaaccatttcagaaaccagggtgatattaaatcaggtgagtctggaaacataccaggcatctgtccccctttctatgcccacaaacctgggcagccagaggcatctttcaagtggatggcaagccagagctctgtgcagtccaccttaggccatcatgtggaaacaataagtctgttatcattggccttgtggtcctgaggttctgggcaaatgttgggggtcccagtgcctcttttcagctgcagggcagcagctgcctgccttgaggctggtgaatccagaatgcacccagcttggagcatctgctcttctaggaagtgcctttgggtgatgcttctcattccaaacccaggcaccttagcagggctgaccttgctgcaggcccagagcctctcaggatgcccacctctgatctttcggccggaacagggggagggggcatacaagaggaagtcaggaggctaaattgatctgtgccctgctgtccttcacttccagcttttaggacctactgtgtaccaccatctgttagttctccactgctgcatataaattgccccaaactgagtggcctaaatacacatctattgtttcatgtttcctgggggtcaggagtccagacacagcttagctgggtcctctgcgaaggaggtggccagactgcattcttacctggaggcttgactgcagaagaatctgcttccgagctcccttgggctgttgtcagaatccacttcccactggctgtgtgagcgaggccctggcatctggctggctggcagctggcagcacccaggtgctggaggctgcctgcacttgcaggccacgtgggcttcctcagcaccactgctgacatcatagagccaggaaggatctctctagtgtggacgagcaagacagaatcatagatggatggactggtagatgtgtgtgtgtacagacagatatagatacagacatagattgatggtagataaatatagagattgatggtagataaatgtagatatgtacacatatagagagataaataaagataggtaggtagagatggatgattgataaatatagataagattagatgcatacatatatattcagacagataaatataaatagatttgtacttgtttagtcactgagtcatgctgactctttgtgaccccatggactgtagcctgccaggctcctctgtccatgggattctccaggcaagaatactggagtgggttgccacttctttctccagggcatcttcccaacccaggattaaacccacatctcctgcactggtggtcagattctttaccactgagccacctgagaagctcagatagatagataataacctgctcataacggtgccatcctgccatctttaccgggttctcgtcactagaaacaagtcacgctcaaggagaggagatggcacctgatgtggcacaagggggttgaggtcaaggggatagtctaagaactgtgactgaaaccagcaccttgagcgttaaattgtatccttctcatttctagatgggaaacaggtttagagagagaacttgcccaagctccaagagtgatcctatggccttgctggcgtttcaggccatgctggcccacttctcaatggacacttcttcaccatcatgaccacacttctctccctgccctggatgagtggtactgattaccagtgtgcaggttttgacaagtggggccagagtgctttctccgtggcagcatccgtcgtgctaataatgtgtcttcagtgtgtatcttgtctctgcacccctaccctgtgcacccaaaaggcaaagactgccttcatcttgtttgtggccacatccctctacctagagaggttcttggcctattgcacgcattctgtgaacagtcattcagtcattcaacaaacacttgtggagctggactgcctactctagaaacaaagatgaccaagaggcaatgctgccttcacaagctcctcaccctctagcagagcagagatgttaaacaaataaactacgagatagtgtggtgtggtatgaagatctcagtgacctcctcaggattgcccacccctacctacatccccagggcctgccacagtgactggcacatggtatgtgcatgctcagtcactcagtcatgtctgactttgcgaccccatggaccgtagtctgccaggctcctctgttcatgggattctccaagcaagaatactggagtgagttgccagttcctcttccaggggaatcttcctgacccagggactgaacccgcatctcctgcatctccttgcattggcagctggtttcttcaccactgagccacctgggaagccccagcacatagtaggtgcccagtaatgtttgttgactgttctagttcccttacccagcatactttgctctcttctcttctgcagaggctagaaaataaaaatcataagagattaactgctcaggaaaatccaaagaaaatttttttaaaaagtacataatgacattctacgctggctttggaagtctctgatgcaatcctcagatcctggcacctcccttttggagcggagctttgcatttcgaaagaggaaaaaaaacaaagactgtaattattaaaattgtgtatataggagaatttagcctttcatttgaggtgtcctaatgacacttcaacaactgctagggaagataatagggtttagagcaattacacagaccgtcaaataccgaacacgagtgattcagattcatgcttggaactggaacga

SEQ ID NO: 63944 - DNA, 976 bp, Bovine  19866880428629
gatttcctttaggattgatgggtttgatctccttgcagtccagggactctcaagagtcttcttaacatcacagttcaaaaacatcaattctttggcactcagctttctttatggtccaactttcatatccatacatgactactggaaaaaccatagctttgactatatggacctttgtcagtaaagtaatgtctctgctttttaatatgctatctaggtttgtcatagcttttcttccaaggagcaagcgtcttttaatttcatggctgcattttatcttaattatccctttaaggaccacagagtccagtcagccaggcactgacaacttactgtgggcgagagcgggaaacccaacttgatcatctgtgtggttcattcaggcagcttaattcaggcagctgtgcagcccaggacctgggtttgcagctgggagaacaaacccagctgtgctaatggggaccagtgaaacatgttccatccaccatggctgcttccaggctctcagggtacccagacgacgtggtacttggtattggcagaaggctccaagtgcagaagcagtgatttagctaagtaaccctcaaaagcactaaaccccaagaggaaaagtctgggtgtagaggacttaatggattgtacagtgttactccaactgttgttcatggtcgaggagcatcaacatcctgcatgaacttgttagaaagcaaactcaggctctgccccctcctcctgggcctgaatctctggggatggaacttgtatattttcacaagttctccaggtgcacatttaaattttttaaaattatttttattttattttatttttttttaacctgtgcacattaaagtcagaaaatccttggattagggagtgaggttagagaaggcaggcaggtgagaggtagaccacgtgaggcttcagaggccaaagcatgggagtttgggatcatcttacttgtaatggggaagtt

SEQ ID NO: 63945 - DNA, 916 bp, Bovine  19866880669572
agagtgggacacgattgagcaactaaacaacaagtaggcccctccgtgtgtgtggatgtggaaccctcaggtgtggaggactgactctctagtctctcctcccacagtcctcaggcctccattcttgggatgggctcggaagcagtagaaggaatcagaaccactagggagactaggggcgtttgaggatctgtcttggttttcagttgatgaaaaggtatagccatgtattggctatccattttattctagacagcaagttttctcaagcagggtcatttgaacccagaagtaaatgaaaaagagtgtgagaatgtgaccatgagagcaagtagagaggggcgggggtccacacagactttaatgtgaccaggtcacctggacctggaatttaatcctgcagccaacctgggatgccttgagcaactgaagggaattttcagaagggaggcaggattctcttggagattaactttgggctttggcctggctgagtctcgttaaactttaaataaaaggcctcagggaggggacatatgtagggccatcgccgtgccaaggcctgacatttcttattttgataattgatgtggccatgttgaagcctgtcactgcgggagcgtcatgctgtggctctggtagtggcatggctgtgtgaagagggagaaaaatcaatttccactgtccacggagtgttgtttgatttattactgctggaagaagaaattctttatctcccagtccctcttggagaggactgttttacagtctgctgttcgagagactctataaaagaagttgtatttgtccaaactttggtattttgataaccttccttggcgattcagaggacattgaacactcccaattcttacgaccctcatttgtttttgattaaacaattacaggcattgaa

SEQ ID NO: 63946 - DNA, 1413 bp, Bovine  19866880693018
cctgcattggcaggtggactccttaccactcagccaccagggaagccctctgacctgtcagcacatgtcagtttcctcaagtgagggaatcgtgagaaggtcttcctcacacggggctttgccattagcatgaaatgagatcattaccataatgccagacattgatttctaaataaacctttgccaatatcactacatgtcaagggttcataaaatgttcattggggagaggccagtgttgagactgagaagatggggtggtgcctcactctatggggcaaaggggccatgtaagaggttggcatcctgaccgagtgctagcttgccttctctctctgtctggctctctctcagcaccctctcctgcttatccagacacaaccctgggatcagaaattccttagctaggcagaccctcaatctgagcggatggtgcctccttcccctgcccagttctctggaaccaacctctctccagctgtctccagctagggtgctgcctccactctgtccagcaatgcctcttttacaaactccatcctttcctgcccccccaccccatgccactgcaacctcaattctcacaaagcattccctcccccatcatttctgctttgttcacacttccctgctccccagaaatattactttatccagcgagtgtgctggttgtaaattgaaatgcaaatagatcaacataaatctgaatgtccatttacattaaatatattatgaatataaaaagctaaggccccatgggtctcaactccattagccctattactcttccacccctgggcaatcagcttcggacccatcaccaagtcagtatccacaaaactcacataggcgctgtcacagacatacacaggttccacctgcacttctaattacagcaggaggcccacagtgaagatggtcctcctccacttccttagcataaggaacaattactgatgtgtcgtcccccttgtaagactttgcacagcactctaggatgggaggaatcaaattaaacccctgtagaggattcagggcatctctatttatgcagctaggcctggcacaaatctaatattctgtaaatatgctaagctctgcgcaatttgtccgcgcaccgcgccttgtacagagacgctcaataaaatatctgttggctggttggctacaaataacaaagcaccatgagagcaactcttatctgctctgggggttcattcctttctaggtcaaggccttcaatatgttaatagcagcctgggttgagtgagtcagcagtgggggccgttaggagggagggattctcaggttggtggcatctaagccgcgcagcctggtccttacgctcaaaccccagcataaacagcaaaggccttcactagccatgtttaaccacagggaggaaagtgcagg

SEQ ID NO: 63947 - DNA, 1098 bp, Bovine  19866880763680
caagtaagggttcacattctgagcttcctggtagaccttgagtgtggagggaggtatctttcaacctacttcagggtattaactgcatagccagtcctgatgcccacatgagagagggggaaactgcagcgagaggaggaagccttgctttctgtggagctaaaacatgctcagagcacttgctctgtggcttcccttggagatgtgacccttccaaagggtttgaatcgccccgatgagaagacttgaagatgagcctatattggagacccattccactaaggattagttggttccaactgcccgagcagatagaagtgggggaaactgttgttttagcgagaacattagtgaattgtgctattctcttaaatgtgttcctctgattatgtgcttgagggtctgaattaatccgcagcatagggatgctgaatacattgtgcttttccagtcaggctgactgtgttttatctgaaccaaacatctgaatttcaccctaggcagatttctcttcaggttgtaattattctggaacaaacagagaaaataggaaggagcccctccgtgggaaccacaatgctccctgtatggaaggattcctactgaaaatcttcaaaactgcatccttatgttggtctggataattgccgtctgaagtcctgcttccctgttctgtgtagatgagtcctcgaattttttctaaaaaacaaaaaaggaagaaagaaagaaaaggaatgaaaatagatctcatttttcagattagataccattctatgcaactcttggtgatcacattgttccttggagccaaaccagaacaaaaccctgactctccacacttaacgccttcaaagccatcttcttcatcttccttttgaaaatcaaaatcctttaaggcccagtgcagacatgaaccctgacgtgaccgatgctcagacaggaagataactgggggcaaaaactctgctgattctgatgtaacttcaaaatgctttgattttatggctccagagagacatttttgcacttctacagaaatttctgtagtcaacaagaaggaaatggggagaggggaggaatcaaagtgtctgcaagaaa

SEQ ID NO: 63948 - DNA, 1018 bp, Bovine  19866880857020
tcattatattgtacactttgatatgatattctatgtccctataatctcagtaaagctgaaaaaagaaattatcaatagaaaaaaggactagggggaaatacggcaaaatattgacagtagatgagctctgggcatggaaatagacgttatttctttccccatcagctttcttgtgtattttaagtgcttcatgctgggaatatgctctttctaatttataatggaaaacattttttaaaggaaatcttatttggagactaagtgagaaacataaaaaagagaaagttcaatagtgacatttagtcagtgtagattcatggatggatatccacaggcttattgaacttgcctgatggtagggaggctgaacttagctggtttcagcaaaccaggcttgctccccacagcacacatcttggacaggactgttgggaagagttacagagtgaccaggatggatgtttccaccttggaattctgagaggttgaaactggaatgcttcggagaagagtaacttacagtccatcatttaacacatggatggagcccacaactcaaagtgtttcatgattgtttacaggagtgagagaataggcgtcaccgtggtaaaagtgggaaaataatagagcttggtaaagtgaagtgcaggccttaggtcatgtcctagtgggtgaattgcaaatggttgatgcttttgaactgtggtgttggagaagacttttgagagtcccttggactgcaaggagatccaatcagtccattgtgaaggagatcagccctggggtttctttggaaggaatgatgctaaagctgaaactccagtactttggccacctcatgcgaagagttgactgattggaaaagactctgggattggagacaggaggagaaggggacgacagaggatgagatggcttggatggcatcactgactcgatggacgtgagtctgggtgaactcccggaagttggtgatggacagggaggccctggcgtgcttcgattcatggggtcgcaa

SEQ ID NO: 63949 - DNA, 995 bp, Bovine  19866880891364
gctggcgctttcattctgctccaccaggtatgatcagcaacagaagagttcttaagagcacagccagcccttcctgctcaaggctatgctcagagaatagcatctggatctaactctacgacatatcaaatatctctcagaagctcttagggcccctgaaaggtgaaacaccagtagatgtctaggtacgaatatgggtgcagccagggagaaaacatttagattccttggccagctcagatgaccgtccccaccccgtgccctctcatttccacgttagctgaaaacagtacacgggagcgagcgtgtctgtccctggaggaaattacactgtacactgtgtcaacctcccgccctctttcatgtcgattaattgcctgccaaatggagagacttttgaaaaggaggatgataattgaaatttcacataattacattttaaaggaacgcttttagcttcccctgacttcagtcaaaactccatcttgtcaaaataatcttaatctttttttttttttgttaaacaaagattgatgaaatatcactggaaatcttttagctgctaattataagtcaagcctctttggggtttttttttttttttttttttttcgggatgtttctttgacttctcaaagtgattagtttggtcctctgcttttaaactgttcattttccacttgcggggaagagtgaaatttcttcccgggttttaattacaatcggagcgttatcctcggatggtatgaagggaggctgtgtgactgggggggaggggtgctgccctgttaatcaggggtaaatctagtatatggggaaggcttgtaccttgtcattacattaccttgttggtctaattaatggtattaccctctgaactatgggtagaagcttaaagaaattcaacacaggcagaaaacaccctcaaggggaaagcagagaaggcctaataaagtactgctcatcgcacgtggggggctgctgctaatttcttc

SEQ ID NO: 63950 - DNA, 1339 bp, Bovine  19866880934212
ttacaaagtttttattttaaaccaaataaaaactttgtatttgtttacaaagttgttattttgttcttttttcggtattcctggtatttgtatcactgaattcatgggtcttgggtgagcaaaagaagcctctttgctcagtggtaaagaatctgcttcccaatgcaggagacactagtttgatccttgatgcaggatgaccccatgtgctgcggggcagctaaggctgtgtgccacaactctgagccagggctctagagcctgggctccgaagcaagagaagcctctgcaatgaaaagcccatgcaccacaactagattaaattcatgcaaacctggctaatttgtcagtccttccgtgttggagcaaatatgatgaatctgagacgctgaggaccgcctcaacgcgcttctgcctggaagtctgattgctgtgctgttcaggaaaataaccggaatttttgcctaggtgctcctgatcaccagataaaacgtctcaatgtgacaaaggaagctgcctttaaagatgaggctgaacagtcatctcatctttcagcctcaggaaagaaaaacaaatttttttttcatggatttgaaaattgtggatcaacagagattagaacccataactcaagggccagaaacagacagaaatgcatgtaagagtagccagctaggaactagctttgcctgatggacaccaggtcctgaaatgcactgggccctccccaaagctcatctcctttattctccacacgctggggcaggttcagaggaagcacaaagaggtgagtgatttactcaaggttacctgcttcatcagtgaattctggatcggcgtgctggccccgggtgccttttcacatggcctctctggaaaatgcaatttggggattcgctttcactatatgaagctgaacttaccttgacctcaatgtttttctgactgaaaatggggaaagcatacatttatatgtcccaggaaagaatttactgtctatccacaaatcattgtcatagacatcggttcctttctcatctgtctagcccctaagttaccctgggggtctattttggctttgccattgccatctggagaaactggctaatttgtagctatttcgtttgtccttggaggaagcagaagcataagaaaaatggtgaacttttttttggtatcagctgacagacaaattaagaactattggaaacagctggatcttgggagtgctacagttgaatgttgttgtttagtcgctaagtcatgtccaactcctttgcaaccccatggactgtagcccaccaggctcctctgtccatgtgatttcccaggcaagaat

SEQ ID NO: 63951 - DNA, 608 bp, Bovine  19866880945237
accttggcttcctctctgatgggacacaggtgcctccagcatccccctggctctactggctttatggcctcacattagcctgggtgctcactttctttcccagactaactgcaaggccatgtgaattggtgacctcctactgaacattaaattagagaatatatttttagaggcataatcattgaaattcctcttgcctgtattttattactattattctctcttgcccagcttttctagttctgctgcctcccttggaatgctcatgcccagtctttcacggaggcattcttggagctctcctccagcttctgtgatgggaggagggaactcctctttgaacatgtccctggttcccaccaacccagctgctatgcaccaatgaccacagtttccaccagaaaacacaaggagtggttgccctggcaaccgccaagttgtcacttcaggttggcatcctttgccattggaaaccagagcagccagttgccagaaggggaggcagtgggtgcagagggcagagatggggtgtgggtcccagcaggtggctcccagtgctcatgcctggtcccctctctgcagggggccttctgctcgcccagcccact

SEQ ID NO: 63952 - DNA, 1581 bp, Bovine  19866880976324
ttgtcctagtctgaatgtgcccccattgcccactgcctgacggataaaggaatgtgctttgggctgttttttggtagaaatttgtgccaaatcacctacttgtctcctctgcaagcccgggaattggaattgtagtgtataaactgggactaagttctgcatggagccagcaaagccctgttcacatgaagcccccatgcttggtctctctttgggaccatgctcttctctttaggcaacttccgaagccacagcttgcatggcgttttctaaagcagcagcccccaacctttttggcaccagggaccagttgtgtggaagagtttttccatggaccagggctgggggatggttttgggctgattcaagtggattacatctattgtgcactttatttctattattatgtcagctccacttcagatcctcagacattagatcccagaggttggggacccctgttctaaagtcacacccccgacccagccccccaacaaatgattctcaaaccagagcacgctgatgcaagagaacctttgcctgagcatcatcaagctgtgactggtgtatattctcatgacagctgaagatggagcctgtgatggtgaggtctgtcgggtacaatggggaccgtgggacacagctccaggcaggtgagaggaaagggcctggcttcgtgtgaccagatgagaactttgcatttggaggtgatgagtaggtacctatgaggatatgaggtggttacagttctgcttcatctacagcaagtggggatgggccagaaagcacaggttgcagtaaccatggaggcagtgtccggccttctggagtattgggaaacagtccccatcctgagattgatgccaggccattccactggcttcctggtgtttgtaggtctcttttctggaattctccaagctcacttgatagtggtatcgttcttcctttaaactctgtatttcctttcattcacaaacgtaactccccagctcaccccgtaatgctattgatgagcctagggatttgtttttattattttttagtgttctggcatcatcaactgccactttggatgctttgcaaactctgagattttgttccaaggccccctgttcttttatatttgtttgtttgtcctgtaaattatcaggaaacctagaccatatgtttctgattcattgacgccagagtcatcagtgttttgagtagttgtttgaagtctgtaaaggttttatgtctctggtttgtgttcctctttaattaaatgccttttcctaacggccatagaaaactcctggattcacttaaggaggaagaaaagagaccgagcgagacaactgagagaagtgcccctagctcccaagaacatgattgaagccttgtaagagagaaagcctccccccgaagtctggcagtagccaggatgttgcccagggcccccaggagagtgcctggggggccctgctcgagtctgtaagtgcgagtctgccactgtggggggccacggccccagccaggactcactttcccaggaggaaaacccagaacccacggaggatgaaaggagtgaggaaaagg

SEQ ID NO: 63953 - DNA, 1492 bp, Bovine  19866880999947
ctcataaaactcatgcccacgtgtccaagtacataaattcccaggaagccctgagccacagaaatgatgacaaggactcccctgctctttctcttctccatgctgtctgtcctgtgtcttcccagcccccgccacccgagagtccctaaggaattaccctccctctctgcagatggatgctctgtttattcaaattgtcacgtataaatcctggccaatctaggagatgtatctcttgttcatttacatggtttactttggctgagtgggttttaacatgtgctctggggaaaagggcaaagcatctcagaaggaggcattcaggtctcggcgctctgggtgagaagacgaggagcggggcagagtcaaggacatagagacgagtgatcaggtggtgaaccccaacggctaagttatattcccttctcagcaatgccccacccacttaccgctttgagtagtcctcaaaaccagttatgaaatgaagggatataaagaaagagaaaccaggagggaaacaggggagaggattgtggggcatggggaaacagcccacagctttgagttggggatgtatgtttacagatgtccattatatataggtgtctgtacatatatcgatgggcttcccaggtggttcagtgggtaaaggatggcaggagattcgggttcaagccccggattgggaagatctcctggagaaaggaatggcaacccactgcagtatgcttgcccagctaatgccttggtcagaggagcctggaggtctacagtccgtagggttgcaaagaatcggacatgactgaagcgactgagcatacatacacacataaacaaagtatatacgtacagtacacacacacagttcagcgtggacaccacgcacagttactaatgtgaagactgccattctccttttgacttcctaaagaatttcttatcaaatatcacatattaatgcaaacatatgggatctagaaagatggtaccgatgaacctgtttgcagggcagcaatggagacacagacatagaacagacttgcagatacatttggggaagaagagggtgggacacattgcgagaatagcatggaaacatatccattaccgcatgtgaaataggtagccagtgggaatttgagaggtagggagctcgaaccagtgctctccgacaacctacagaggtgggatagggtgggaggtgggagggaggctcagcagcgaggggacatatgtagacctatggctgattcatgttgatgtatggcagaaaccaacacaatactgtaaaacaattatcctccaatcaaaattaaatttaaaaaaaggtcagaaagttggtcaggggcatcccttctgtgtacatacttaaccaaccaggtcacttctgtgtatttgtcatttgcaaaaagtcctttaataataagaagctgctacatagaaagataaatattaaaaccatacatagtaaccatagactaaaacacataag

SEQ ID NO: 63954 - DNA, 1576 bp, Bovine  19866881140075
ttgtggcataagacaggtcagaacaggacccagtttgtatttgaagccagtgagagcttggggtcgaagggacccctgagtagcccccgagagtggaccctccacgtggtctctctggaatatcagccttcccatctcaggctacccattcctcttccagggccctgtgaacccacatagcctgcagcctccacttgaggaaattaaacactggattggttttttcagcgtaaccaaaagaaataccacagggcctgaccttttgttcacaagcagttatagaagtggcatttgctaacgttccaccttgagcctctgcttctctgctttcctctcctggctcctaaggatacagcctggcttggcagtggctcccccaacctccccccccaaacagggttttctaggtaccctcttatgattgtagcatcaggggtcagcaaaggagtcacccacttcatgaaaagcctgacagggatttctggccttgatctaaaccagacacagtgaagaaacaaagagatctggggaatgcctaaaaattcccagggcatccaaaatgatctaccatcgctgaagtttctgctattagaatcatccaccgtcatttacaaactgtcaaaaggcggcagatctctggacttgaggcatcccaaggctgtgggtctttaccctcctaagcctgaattgccttctctggaaaatggctgtagccagtggtatgctggtaagtgatcaacaaccagctctctccagggtggtggagggggcggctagttgtagcattcatcacactccttgggagctgctcaggggtcccttcaaacccaagctctcactggcttcaaatcagtttccatggagtaaatacttaagctactaacttgacatccccaatggcagagctaggaaggatgcacacagtcagccctgaagagcgcaggaagctggcgcatgaagctggctccagcacacccctgggtaacccagcaccttcctcacagagggtaaggaccacataagaggcagcatatgcaaacacacgctacactgagcagtgtgcaaacggaccaccaggagatcaggaagccaggtcttacagctgctgggaatgggcataagcccagttgcaaacttttctactgtgtgcaaggcatggagcagtgctcacctggctcatggaggttgattcaaaaggcttttatatttttgattcacagattcgctgtgctccccacagtctctcttcaaactcagacttcatggcaagcctcaaagtgggtgctctctaccatccatcacaatctctgaaatgaaccctgcatctgccagctcctccctgccaccactgcccatagggtctggttcccggctactcctctgtcctcatctcctgccacgcacccctgctcattctgtatgagcctgtggtctccttgctctgcctgtgacaggtctagcatttgcctcccccagggcctttgcacatgctctctgcttctctcctcatccccccgcccccaaagctgatctctgctcagatgtcacctttcacaaagccttgtctgaagtagga

SEQ ID NO: 63955 - DNA, 770 bp, Bovine  19866881157825
cggggtctatttcctttttggagctcccgcccgcattcccacactgctcatccacttgacattcaataatggtagtactaatagcagtgagctctaggtcagacatggcgctgagtgcttgacatatattatttaattttatcttgctaatatcctttgtggggggcactgtcaccccccatcttacaatggagataaatgtgtctcagagaagcaactagccttgtgcaaggtcttgacctcacgcctgtgggaccccagaatctgcgttctttaccttccacattcttggctcccttctcctcccaacttctaagctacatctctccggtgtatttaagtccatcttctcctgttctgagtacaatctggtgtcctctgcagaaattcctgtagatggctgaagatagatcccgaagcatatcttagctgtctctgcttaattaagcaatgccaattcaccccctgccaaagagaagcatcaagtgatgacaagaaaggaaaaaagtctgagttcctattgaattgtaaaatctctgattgagcctgcaacagccagacaacaaacatacgctcatatgctcacatttatcctggaaggatgggcacaatggctcttgtcgttatgagaaataagctaagatttaagaaacaggaaaagtacaggttcctcagagactgagatctatctaagcagggaatatatattctcccctttcaatttatttattttttgaccatgccacacggcttacaggatcttagtttcc

SEQ ID NO: 63956 - DNA, 881 bp, Bovine  19866881174890
cataaaaagacatcaggttcacacagtagcatgtggactttggagtgtgtgcatacaggaggacctgtttcctgctcctgctagaacctgggcttcttgacagctctcatccacagttctctgtgctccagcaactagaccagcatatggtccaaagcaagccgtcctggttaaggatcttttcatttcacagaacagaaatccactcaaagtagctcaagataaaagtggggctttaaaagcatccaaagtcccatgcggaggaggggctcaggactctcttctttcttctttcctcccacttctcatttttccttttctcctcccacctcctctctgcctcctctgccttctcatctcacccaggtccaaaatggttgctccagttccaatgagatgtgatccaaggatacaggatcttttagctcaggcatcctgctattaactggaactgctttttctatctcttggtttaaaaggaatctgattggtccaagccagtccctcaggtttcatcttccaatcagctaagctggacctgaggagagagtagcagagatgtcggatgggtaaggtgggcccttctggggctaaaagtaaaagaaggaagtatatctgttttaggtgtttgacagtaaatgcatgatgggcgaatcagctcaccaatcacagagtccttcctcctaacaaatagaggaacagaaataaacaactggaaatgagttagtgacatccctgtcctgggaaaggcaggtctcacagtccgtcctgcaagacaactaagttctaccctcagagcaggtgacactggaccctttggaaagactgagctatagctgctccacctttaaaatagaatagaattacctgcctcacagggt

SEQ ID NO: 63957 - DNA, 1644 bp, Bovine  19866881298283
atagcaaaagagtcggacatgactgagcaactaacacacttgcccagtccaagctagagcatcacagagaagaacccctgccaagtttctgacctgagaagcagaggctgtccgcgctgagctaggtaccatcccaagcagtcactcgacggtgagatgagaaaagcctcctttcgattttattatgacattagtaactgttaattagagagttgttggagcagcaatcacttccctgcattctcacagtgctaatttctcttggctttgctagcagcaaagaaaaaaaaaaaggctctgctattgttctgggggaccctttatttaccttactgtactatcaatcctatctattctgagctgcttatcatctcaaaacagttgtggagaagcccttttgttaaaggaagaatgtgtttttcttctttgatgagagaagcccattgggctgccaggctggtcttggcattgggtgctcaggtccaaggggcagggttgaagcagggtctgtctgggtttctggctaaagcttttggttaggacgtgaggcagtttgattcatctgcctcatcattggaggttttaacgatgagattagtctgtgataatgggttagatagcatcaccgactcaatgaacatgaatcggagcaaactccaggagacagtggaggacagaggagccccggcgtgctgcagtccgtggggttgcaaagagtaggacgtgacttagtgactgaacaacaacaacagtgtaccacagcccacgggtggacaggagctcggcttccggccagaccacccccagcagcttgtatgtccgctggtgctggaagtctggactgtggctaccttggggacaggaggggctgggactgcctctgggtgctggtgatatcctactgcttgagttacatcggtgcctctttccatcactggtgctcaagttgttcaagaaaaccaggagcagcaccaggtagagaggacctgggggacatgaaaacaaagcaacaggaaggacagcaggactgggcaccgtggagacagaccacggatgctagtggcctcctacacttccttaggtctgagaacggagtaaggtttcattctgttttgctttggttaaccaagcccagaaatcatctgggttgctatcaaaatctccttgctgcaatggccttttactacccgtgaggacacctgttcatggaggcaaccttggtgccacctgacggtaacccctagccccatctcctgagtccccgtctgagaagcactttccttgccccgccatagcatccttcagcttgctcctccccgctcctcatttcaaatccactaaagcaaagacttccaaggccacacgcctcacatgtgcaaccgctgagtgcgtgtggggcacctgtttgatcagactcagctctgggtactctgtgtgtttccaaaggagggatctctgtctcagaaccacggtgctttcacaatccaggcaggcgggatgcatgctgaacaccagtgcctcctagggtggagactggctctttgctatccctgcatccctggttcctgcccccatggcggccataggaggggctcagcaaaggttcttgaactgtgctcagctgctagagaaaaggggacagag

SEQ ID NO: 63958 - DNA, 913 bp, Bovine  19866881488030
ataaaaaggtctgggcaagttgaaaccaacttgtattagtcagacatccttgaatttcaggtgacagaaaacccaatccaaattatcttaagccaaaaaaaaaagtgcgatagctatggctcaggtaattgaatacaccagtgtagatcactcaggcatggctggatccaggggctcaaaaatgccagggtggacccttcaggaatggctggatccaggggcttaagcagtgtcaccttgcactctcttacgctcccttctccatcattggtcttgatagagctgagtcatggaccaaaccctggattgaaaggtaaacagatggggtcagctctgcctagtctagcccacaaggtggaagagggatgcttctccaaaggcagagctggggacacacatgcagcacaggttcgccactagttaggggaaaggccccaaaggcttccaaccacttgggtccaaatcctggctcctccatctcccagctgctcacctaggacaagactatttttccttgctgtgcttcagtttcctcatctgtaacgtgtgaataataataacaactacttcatgaggctggggcttccctggtggctcacacgataaagaatctacctgcagtgcaggagttcagttcagttcagtcactcagttgtgtccaactctttgcgaccctatgaaccacagcatgccaggcctccctgtccatcaccaactcccggagtccacccaaacctatgtccattgagtcaatgatgccatccagccatctcatcctctgtcgtcctcttctcctcctgccctcaatctttcccagcatcagggtcttttccaatgagtcagctcttcacatgaggggccaaaggagtttcaccttcaacatcagtcctcccaataacacccaggacgatct

SEQ ID NO: 63959 - DNA, 1030 bp, Bovine  19866881488457
aaaaatggggcatattagttgtcacttcactgggctccaggcacagttatgcatgtgaggcatcaggaaaatacttgacatgttgtaagtctttgttgttattatttattgaaaagtttgacaaagcactgaagctagttctcctttagttctacatgacgctacctgccttcatcgaaaagaagactccatggcatcagaacaccacgtgccttgaacacccagcgtcttgtgatgtacccaagaggtgagctctgataactataatgacgtgccaaaggtgagtgtaaagtattagctctggacccaccttcctttagaggatactatgttcttaatgatgcacggtacttcttaatgatacacatcacatacttcgatctgtagagctgagacaacattgggatggaggttctttacgtccccttttcctccagcgcttgctttggtggaagaggagaggttggggaagctgggcaggcggctccccctcccatttctctccatcctcccagcctgactccccatcacagaaggtgcagaggcctcgggggtgctttgcttgcagacctgcctgtagcaggctccatctgagctctcgtgctagggtctcagttcatcagagggtagaggggacaggggcttttcataagtgggacccaaaggtccagcaaggccaagtcaacaaagacactaaaacaaattgagaacccacgatgtcccaccacacagaagccacctgctccaacagttgttcttgccaaactcattaaaactatattcagcatctttcatgtttccagcagcttaggattccaagggagaagcaagcatgtctacagcgcacagccttgagtctgccacctagatctgaggtgcatcaaaccagcaaggatgttacagactcattcaaccacatggggaggaagaaaagattcctttgcctggattccctccagcttcttcatagtcaagatgggcctggaaggggaccttgaggatgggtgacgtgggccagcaggatgctaac

SEQ ID NO: 63960 - DNA, 743 bp, Bovine  19866881807102
ggaagctgctgtgtagcacagggagctcagctcggtgctctgtgatgacctggggggtgggatctggaggctgggagggaggtcaagagggaggggacatatgtacacatatagctgatgcacaatgctgtatggcagaaagtaacacaacattgtaagcaattatatgccaataaaaaaaatcagcacagccttagtgcagagtaaagactcaacaaatagtagctgtcatttctggaagactgaattcttaggaggagcaggcaaggattgctcatctcagtgttccagttctaacacccagatgtgagggcccagcccctgatttctttcttcaaggccactcctctcacttgccccagaatgtgggaagaactccccttgggccctctggcctgcaaggggagcctgcagccccccagcaagatgggaggaaccccacctctcccaggtgctccggagacctctgctccctttgtctctgcgtctgatgctggttcctctcagtcccatcacctctgagaagcagctaggtatgattggcatcctgtgggagggggtcttggggaccagcttggcatgtcagccagtgccctgccgtgttcatttttgttgacatttaattatatttcactttcatcagctgtcaggccagcttcctgacaggtcgctgaattatgcttgaagccagtcagcccctgcagacaccttcttatttgggccttctcggcttacggccctcg

SEQ ID NO: 63961 - DNA, 943 bp, Bovine  19866882043326
agaccttattttcctttaagttggtcgttcagcctctcactggggagaacaaagcagagatggtggaagctgtgaaaattgtttcttgcttaatgaatgaagttgatgctggaacagaaaaactcattggtaaagggaaggaggcttctgtgcagcttggggcataaatttgtttgtattttttctatgtgtctatgacactcttggtggagaaggcctgtgtgaaagatttgaaataacagagctgagtgtacattcctcaacacaaatttacatctacactagaatctcaaaagtgcacattctttcaaatttagctgcaacactcattgaaatgtgctgatgtctacaaatacgagcttctttttctggtgcacttttatccacttaaaaaatgcagtttctagtgtacatttgccaaaaacatcaattctgataacccaaaccacaatgtagtaacttgactcctaactagccggtgatgtaagccgtgcttcctctctcttccagacttttaaagaaaagcaatgtttcaaagacaggatgaagccaactcaaagtctggactgatcttttactgagaggaagtggtgctgggttctagttcaaagccaggtgctcggctgctgtcttccttgacttgctccacggcagcatggaccgcggttcactgtctcaggcaagaggcttgactaaagacagtgccgtgtttctagggactaagtttcaaaacacaaaagctaatttctcagtgtgacaaagctcccatttcactaaaagacttggccccatttaatccccagttcatcaagcccaactttactttttttctttttttccttcctatttttatcaacagtttccactttggatagagatcatgaatgaaccaaccccaggacagcagggttctgaagggtgtggggacagaaatgtcaggagg

SEQ ID NO: 63962 - DNA, 1620 bp, Bovine  19866880244957
agatgtaaattccagagcacctgacttgcctcttgagaaacctgtatgcaggtcaggaagcaacagttagaactggacatggaacaacagactggttccaaataggaaaaggagtacgtcaaggctgtatattgtcaccctgcttatttaacttatatgcagagtacatcatgagaaacgctcagctggttgaagcacaagctggaatcaagattgccaggagaaacatcaataacctcagatatgcagatgacactacccttatggcagagtgaagaagaactaaagagcctcttgatgaaagtgaaagtggagagtgaaaaagttggcttaaagctcaacgttcagaaaactaagatcatggcatctggtcccatcacttcatggcaaatggggaaataatgagagactttatttttgggtctccaaaatcactacaggtgatgattgcagccatgaaattaaaagacgcttagtccttgggaggaaagttatgaccaacctagacagaagagtgaaaagcagagatattactctgtcaacaaaggtccatttagtcaaggctattttttccagtagtcatgtgtggatatgaaagttggactataaggaaagctgtgcatagaagaattgatggttttgaactgtggtgttggagaagagtcttgagagtcgcttggactgcaaggagatccaaccagtccatcctaaaggaaatcagtcctgggtgttctttggaaggactgatgttgaagcggaaactccaatattttggccacctgaggcaaaaagctgactcatttgtaaagactctgatgttggaaaagattgaaggcaagggaagaagggaacgacagaggatgagatggttggatggcatccctgactcgatggacatgagtttgagcaagctccaggagttggtgatggacagggaggcctggcgtgctgtggttcatggtgttgcaaagagttggacatgactgaatgactgaactgaaacttaaaatgatgctagtcttaaaagaatccatatccccacaaatgaggcagtttgagaaatgtgaactagaacttgacctaggataaaatttctttcaagcctgtcttcctttaatcttaatacatatactttaggctttttctgagaattaaacatgtaaatgtatataaaatgtcttgcatgttataggcatcagccagtgtctgtttgacgatgataatgcaaaataatggtttctgcaaatgtctcctagaacgaatttgctttttgtcttgtctctttcatttgttatgcacacaagcattaatctttctatgatatcttttcaaaatttgtctcttgaattaaaatgattcctaaatgatttcctgttgtacagatgggatataatattttaatgacctgaatccatagatgggattgggacaaagttttctctgttgggatcatccagaaataggggtaaagattaccttgaaccataataaatgtaactctttcacataaatgctctactaatttttacacagcattcactcatgcacatacaacccaaataacaaaaaagattcaaatgtggcatctggcagacttgtacctagatttatgcttctttt

SEQ ID NO: 63963 - DNA, 2180 bp, Bovine  19866880361620
ctgagtgatgcgtgtgccaccaggaaagaccctgaattagaatgattggccaaagaccacccagaaactaatcccatcaccataaaacctgagactctgagccacgtggcagagcagttctcctgggttcccttaccctactgctgtccacccgggtgccctttcccaatcaaatctcttgctttgtcagcacatgagtctcctcagacaattcatgtctgagtgttagacaagagtccagtttcgggccctgaaaggggtccccgttcctgcaacagaagtaaggaagaaggaaaaaagagagacaagaaaaatgagggagggagaaaggcagagaaagaggttggttcttctaatatggttactttacaggaagttttgcccccatgaaattgaaacttgccaaatagtccttttagttttttggagagtcttagtctgatgcatggcagcaaagtgatctctacagtggtacttgggtcactggcagaaaacaggaaggattattgtctacattgtcatgtattaagatttggctactagttttatcaacacttacaaaaaaaagattcccaaattcttttcttttatgatactgaaatatcataaaagaaatcatttcttttatgatactgaaatacacagaattctttttttcaaagtcatcagctttggtaaaacttgtctcaaattacaaaatgaaattatatatatcccaagagctttcaaagaaataatctatgatcttttattataataaagaattctactttaaaaaaacattcttataaaaaattctaaaatgtaatacatcctttctgttaaaaaaaaaaaaaaaaagtatccaaaacttgagaataagaaaaagaatggctgcatgtcctttcaatgacacatccaaggattatttaattgtatagggaatgttgcactcactatttactattgattatgacccaactttgtaagttgcatactaaattgtatatttttgtccagtagagatgcaaatcacttcttaacagtagacaaggtagccacaaaaattatgttttattgccctataggacattaatcagttttgtctctaataacttatttcagtgacttcagagttccttttcttactgataatgtaaattgatgttcataaaattctcttcttaatcagcataccattctgctggtttaatctttaatgggttaaatatttttgacatgtgttcattttatatttgtgtgaatcatgctctttaaatttttgaaaattatattttggcattctaaaatattttagtcatgggtatatgtgcatgtgtgtgtgtgcatgaaatgattaatgatgtcatttaagtaataccaataaagggagactatgttggtcttaactatatatgtaattatgtgtatatatgtgtacatatatatatatatgttagaaatattagagaaagtctagacaatgtctgaaattcagttgccaaaaaactgctaaatgtaataaattatatagttacatactatttcttattctgggataaaaatatttatagaaatattttggaaagactaaaatatagaatctaacttttgagttggggtctgagaaaattatttcttattctcttttacccttcatatggaatatatgcaacattttaaataaatttttaatttataacttaaatactaagtaatgagatttacataaaagattttataactgtagtcatttacagtgtaaaaatgtgatttcttattatttctagctcttaaaatgttaatgtaatacatagctgtgtaattttacaggacagtttaattctcctgaaaatatggagctcagtgaagagtccaaattaaaaagaaattaatatgttttaaatattaagttatttttctagtcttttgagttctgtaatatcttagcctggtgaaaactttacttaaaagaagttaccaacaaccagttctagttggggatttttcatattatcagaaaataaaaatgtttttaaatggatattccatatttgttttattattttaattaccatcaaatatcacaaaaatcaaaatttcgttggcatggaaactaatagaaccatatccaaaaatacataggtattttctcagctctttctatataggataaaagtcttcattgctctgctcagaat

SEQ ID NO: 63964 - DNA, 2674 bp, Bovine  19866880437441
ccctttctcctcctgccctcactattatcgtatttattttacaaaatataaaactgagatccagagaaatcacctaccaagtacaccaagagagaaacataagaaacttgggctctatcttgcataggaacagagactgtcgcagataattccaacttgtctggcccaagtatctggttggatggaaatgctaacaagaagatgtcaaagcccggataaacatttaggtttgggagtgtgcctgtgtattttaagtgttagatttgggtacttcttttgttagagggagttctaagacatccaggaagagatattaagatggcagttggcttagaggtcagaagagaagtcttgagtgaggatataaatcttggagttattgacttataacttatagagtatctatatatgacatttatatatatatatatatatataggcttccctgattccacatgtaatgtgggagacctgggttcgatccctgtgttgggaagatcccctggagagggaaaggttacccactccagtattctggccttgagaatttcatggactatatagttcatggggtcacaaaaagctggacacgactgagtgactttcacttcacttcacttcatatatgtgtgtgtgtgtgtgtatacacttagatgctcatacacatatacatacaaatattcagataactaatacatagaactagctcagtttctgaattcagaatatcccattttttgatcctaaagtttaaggatctatataagttaggattgagtttagctgcttataacaaaaaaaacagattacaaatattacttaggtaacatgactggaagtagggcttttggggtcagagagatctgttagaaatgtagcctcgttatatagcttcctgctcttccatcctaacagtgacatttgctttcattgcgttgtgttgtattctagacagaaagaagaagaaagttaaaaggaggaagggtagcatctatatcaggaaaataaagcattctattttgtttccactggctcgaatgtgttacaaggtcatccttattttttttttttttttaagagagagacctgggaatcaagttcttatctgaatactgtaacctcaaataaaattgaagttctatgacccagataaccatggcactgtgatcactcacctagagccagatatcttgaagtgtaaagtcaactgggccttaggaagcatcactacaaacaaagttagtggaggtgatggaacttcagccgagctatttcaaatcctaaaagatgatgctgtgaaagtgctgcactcagtatgctagcaaatttggaaaactcagcagtggccacaggactggaaacggtcagttttcattccaatcccaaagaaggacaatgccaaagaatgctcaaactaccgcacaactgcactcatctcacatcctagcaaaataatgctcaaaattctccaagttgtcttcaacagtatgtgaaccgagaactcctaggtgttcaagctggatttagaaaaggcagaggaaccagaggtcaaattgccaacatcccttggaccacaaaaaaagcaaaagagtttcagaaaaacatctacttctgcttcattgactacacgaaagcctttgactgtgtggatcacaacaaactcaggaaaattcttaaagagatgggaataccagatcaccttacctgtctcctgagaaatctgtatgcaggtcaagtagcaacagttagaaccagatgtggaacaatggactgattccaaattgggaaaggagtatgtcaaggctgtatattgtcaccctgcttacttcacttatatgcagagtacatgatgtgaaatgccaggctggatgaagcacaagctggaatcaagattgctggggaaaatatcaagaacttcggatatgcagatgacaccacctttatgacagaaagtgaagaggaactaaagaccctcttgatgagagtaaaagaggagagtgaaagagttggcttaaaactcaacattcaaaaaaacaacaaaaaaagatcatggcatccggtcccaccacttcatggcaaatagatggggaaacaatggaaacagtgacaaactttattttcttgggctccaaaatcaaagcagatagtgactgcagccatgaacttaaacgactcctgctccttggaagaaaagttatgaccaacctagacagcatattaaaaagcagagatattactttgccaacaaaggttgtataatcaaagctttggtttttccagtagtcatatatggatgtgagagttggactataaagaaggctgagcgccaaagtatggatgcttttgaactctggtgttgggcaagacacttaagagtgccttggactgcaaggagattaaaccagtcaatcctgaaggaaatcagtcctgaatattcattggaaggactgatgttgaaactgaagctctaatactttggccacctgatgcgaagaactgactcactgggaaagatcttgattctgggaaagtttcagggcaggagaaaggaacgacagaggatgagatggttgggtagtatcaccaccaactcaatgaatatgagtttgagcaagctccagagatgatgaaggacagggaagcctggcatgctgcagtccgggggtcacaaaga

SEQ ID NO: 63965 - DNA, 3040 bp, Bovine  19866880470752
attggtacctctttaattgagaggcactttgaaaggttctgcagcagttcagaaacggctggcagtttcttgcatctcatctgtctttacccacaaatgcaacaggagtggagtgacacatggctgaccgagatccacaaggagacctgagcaagcggaacaggactcttgttctgattgctgtttaagagatcattcataccccgttcaacaataattcttttgactataataatcttttctaatccatcttggaaaccagtcctactagattttctttaatttttgtttgtctaaggagttttttccctccaacttgatccacgagatactactctgtgcaaaatgtaattaggctaatttttatatctatttagtattttttctgggataacttgtttgtcacttaatggaatagaaatttaatcatttatttttatctgtagaaaaccaggctaagttagtgatgaagatgtctatgttagaaagcaagagctcaagtaggatcttagtctgtaagaatatttgataatgctacaaatagccagtgctaactttgtattctgggggaaaagattttaatttggaaggacaaatatgaaagttgtgagctcggataaagtcatcttgataattaataggtatgtgtatatccacaggggctcttatatttaaaactgaatagagtgtgtttgtgagacagtgtatgtatacgtgtgaatgtgtgcacattgcaagaaatccaaagagagattacatgaatctgggaaaaatctttgaaaaagagattttggatgcagatcctgtggtatgtatatgttttaggagaacaaatgcagatgatctatgatgttgtgacaacttgagtgggtgttctacttttggctcatctgggtttctgagtgatacatctgccacaagacctatatgaatagatcattgttaaactctagaggaaaaatatgtctccagtaagaggccagttgataatagcccctcaaatgcattactcacattacagtcatccaatgtcacacatggtggataagctagatcgactgactcaacatttattccaccttccttaatgttctttctgtatggcagagactaaggagcttaaaagtacatttttcagacttccttttgagcagaagctccagaagtaatttaagttcaatcaatcaaatgctttcatgagagtcttgaatgcagagcagagtgaagtagagagaggggggcctggaagggtcatgcatttttctccttgcagggcctgctgcttccagcagcagcttcctgatacttggagcagatgtgaggcactgtcttcttgcttcccagtttcctgtctgtagtcaaggtagcggtttattccagttatgcagtgatgatctgggaattgctcctagaggcctagcccagagcacttgtaaactatccagcaattgtgtaaaaacctcattctcagtattaaatttctttgctttgctatagccccaatgtcttctgttgtctacatggaacactaaatgatacacagattcttgataattcttttctcttcttatgactctttccctcttcacattaacttttgaatgtctattttaatcagtgcctatgttaaacaatgtctacataaggcccaaattaacaaacactaataatatatagattcacttcagagacaccgttaattgaaaatcaatcctagaggttttgagaggaagttggtatgagaatagtttctctcttggctttcctggggactgactttcaaacttaacacaacatccaatatgaataatctatttccaagattaattaaggtccctctttagactagtaacacttacctaaaatggtcattttgttggtaagtttattgactttagtatatatgaaagctttgttaaattttataggaacgaatggcttatgaaaacttggttgtcatttctgatcttcttacaaagctctacaggtgttataagaaacaggaggataatcttttggccaaagggaaaagctgcatttggggtttctttttgctgatataatgtgtttttctgatttaagatgtgtcattttaagttgatttatacagagctggcaatgcaaagataaatttgcctttttttcttttagcatttaataaactttatctcccccccacaattttagatttacagaaaatttgtgaagatgggcctaagaattcccatatacctcttactcaatttcccctattattaacactttacataattatagtgtaagaattacaattagcaaaacaatgctaatacattattattaactaatgtttatactttctttcattttcttttatctttgtctgatggtctctttctaatccaggacccatccacaatatcacatttacatgtcattctgtttctttatgctcttatttagacatgacaatttctcagattttccttgtttttaataacaaaaccttgatagttttgagcagtacttgtcaggtattttgtagaatgtcttcatttgaaaattgcctgatgatctaatcttgagtgactgggattttgggtttgggagaaagaccacaaagatgaagagccattttcatcacattgaatcaaggatacattctgtcatacattcttttgacattctgtcaacatcactgttgctgttgaccttgatcacttagctgatgtagtgttaggattctcgactatgaagttactcttcttcctcttttcacactggatgaagggaaatcactatgcacagctcacactaaggagtaaggaattatactcctctacttaaaagtggaatatctacataaattatttggattcttctgcatgggagatttatctcttcttactgttgatttgactgtttatatcagtattttgttgctgttcagttgccaagttttgtccaagtggaggtgatgaaattccaacataactatttaaaatcctaaaagatgatgctcttaaagtgctgcactcaatatatcagcaaatttggataa

SEQ ID NO: 63966 - DNA, 1877 bp, Bovine  19866880552468
actgttcacttgtgtataagtagtttacacacaactagaagcactttatatgaattaaattaatataaaaatgggagttcaaactattaaatctgtgctgtgcttagtcacttagtcgtgtccaactctttgagacttcatggactgtagcctgccaggctcctctgtccatggggattctccaggcaagaatactggagtgggttgccatgccctcctccaggggatcctcccaacccagggatcgaatccaggtctcccacattgcaggcacattcttctccatctgagccaccactattaaatctactttttcacaagggtagttattttatggttgaaatggacattcaaagggataaaactgacactgaaccacagtataatctggaggctgtaaatgtgttgaccctgggttcaagcccttgttctgccacctatttaaccatgaaaccaagaacaaattgatatgcctctctgtgcctcagttttcatatcagtaatacaggagtaccaatgacagtgagaacacttgctaggcttggcgtacaaattaaatactttgatagatcatgccacttagaatagcacctgacacataataagcactgcataaatgatggtgattaatatcatgattattgcttgattgtcagaggagctgtgaacctaaattataaaggttgggatctttaataagctttctcaaaaggtcccaaacaacctctgggtaggcaaagtaagtaaccaacagaaaaaaaaaatgttttcttccccttagaggtgcaaagtagaagcctgctgagtcaattatgtcaggccagcaccaaaggactgacttgcattcagatagcatagtgaaataatagtaggaacaaaagaagcaggaggggtctgctaaagaaagaaatctcttcatccctctccaccctgaggaagtcttccaccccttcctcacactgcttctcgaaagagatctaatcaatcagagttgagggatctactgagtccatcattatcagtggaggatgaaaaaatggggccatgagcactgggttcctcttgtagcacaaggaaggggctggcccagaacctattttcctgaagtaaaaccatcacttgcattctcttcttcagccccttctttttctgtttattttttaaattttattcttctgaagtatagttgatttacaatctttcaagtgtacagcaaagtgatttatatatatatatatatatacacacacatatatatattctttttcagactcttttccattaacgttcttataaaatattgaatatagtttcctgtgctatacagtagatccttgttggttatctattttacatatagtggtctgaatcaattaatcccaaatttatccctgctgcttttcttctttgataaccacatgcttgttttctatgtctctgactctatttctattttgtaaataggttcatttgtgtcatattttttagactctacatttaatagatatcattatttagctttctctgtctgactttcttcccttagtatgatcatctcttggtccacacacacacacaaacacacacacacactagaatattactcatccataaaaaatgatggaataatgctgactgcagcaacatgcatggatctagagattctttagtcttttctgcagccaaccaaagtgtggtgaagtcctgcttttcagggcttcaggcatagggagaataaaggcccatggactatgtgctgcagcccaggtttctggaacattgcttagactttggtacaggagcccagccaacagtaaagtgataatctgcttccttggacaatcattcctggtttgtatctatctcttccagttggg

SEQ ID NO: 63967 - DNA, 1679 bp, Bovine  19866880610879
aagcctggtgtggaatttgagcacacctttcccaagtgagatccttttttagttttaatttttttatgcttagataccacagagggaggaaggaaggcaattaaatcaatctactcatcttctgacagcagttatcaacctcaggagaaaataagaaaaagccatatcatcatcacctgtagtaagctctgtcccaaaagcctcacctatgcaactccccctgtgactctgatgcttttccactgatgcttttccaaaaagatggcttttccaccactgctctaggatggcagtgaacatctgggcaatttagctcatttataaaactagcaccataaagcaaatcatttaaaatagcactgaaaattcaaggtatagtcttttgcacagatgaaaacttagggccttttaaaataaggcaatatctaccttttaagtgacataaaatgtgtattataattatttaatatttaatgaaggtgaaggccaccagcatgctaggtgttatatatcaccctgcacagacagttgggtatgcgtataggagtctggagtccttcaatcacagcgtcatgcagtgaatgggagaatgcatcataccccaaaagctcagatgaacaacattagtcataactggtttacatacttcatttccaccaaggtttcatctttcttgatacattaacatttacattatactccactgcttatagtgcgatttattgaagattctgactgcctggaaaggaggtaagctttctttgtccaactgtaaatcaccctaaagcaaaccttcttttctttgatatgtgaaatactcatctatctccattgtttttatgagttgttgatgtagagcaatctgttttaaaaggggacagtagctgcactagagatcacatttgtcaaaaaggagagaaaatattttaaggtgaaaaaaaaaaaatctaaaaataaaagaaactaataaactatgtaccagtaactgtgccaaacactttctcgatgatttgcctatccaggatagatttttcaccttagaaacaccatattaaagattatgatcagttttaagtattgaaaattaggattgcaaacagaaatagtactgggagacatggattttacaatgatgcataaatacaccagaaagttctttgtaaatgaaatagagttcccttgaacagttgttcctatgccagtccatgagaaaatttgttttggaggagaaaatagaaacaaaatctcagctccttagttctgattcctaacttctacaagttctaaaaatataaactagtcttcagtaaggatggttgaatttctataatttaaggtacaaatgagaccaacattatcaagctcaggtgcttgtaaattttttgtagtacagcagtttcacatgtactaattgattcacaagacatttctattacttccacagctggggctggatataatcaagaagaagtactgtggcacccagaaataaacaaaagttaatggaacttttgctgagccacaaagagtattttcagtgtttggctatgggttcaatttcacacttgagaactttctggttggccttcttttcctctggtcggtacccctaacacttcaaggaggaatggaaaaaggggaaccacagccgacaggagcagtgtctttcaggaaagaaa

SEQ ID NO: 63968 - DNA, 1378 bp, Bovine  19866880619837
tgggttttggcagccaagaggaaaaattatccatccctaagcagcttgttgtctgaacgaacccagcaatggggcagccaaaaaaggaactgcatcattgagaacctcatgaattttcaaacaagcagcccttggaatttagaacctctcataagggtccaagccgaatgagcttggcacagaaatcagccgctcggaagggtcgcatggtgactagaggggttttggaaaatgttaactatattcaccctcaggcaaaggggaggcagcgcctgtgcatggttttggatctacataaggtgctgcagtccatggggtcgctgagggtcggacacaactgagcgacttcactttcacttttcactctcatgcattggagaaggaaatggcaacccactccagtgttcttgcctggagaatcccagggacgggggagcctggtgggctgccgcctatggggtcacacagagtcggacacaactgaagtgacttagtgagtgagtgagtgaaggtgtctcccagatattagatacattggttcaaagaaagttttaccttgaataatatagggaaatatcacaatgaggggtgtaaataaatgattgctaacagaagctaacagaaggtggtacaaaccagtggcagaaatattaccaagttcattgtatcttagaagtgaaaaaggcccactctattctaaaattgttttaaaactgaaaggcatttagttgaaagtaaatttttgacaaatgaatgttgctaatataaggatatcaggatggtgttcttataaattctatgagacagtaagtttagttttcctgtgtcctgattcagaacgtaaatcatagtttgatcatctccagaactgatgggttttcattttttttagaacttaaaaaaaaggtttatttatttatttgacttttgactgcaccaggcctttgttgctgtgtaaactttctgtggttgctgtggagggttgctctctgattgcgattcatgggcttctccttgtggaggcttctcctgttgcaaagcacgcacggtagggtcctcaggctttgctagttgggacatacaggcttagttgctttgctgtgtgtggaatcttcctagactagggatccaactagtgtcacctgcattggcaggcagattcttaaccagaggaccaccagagaagtcctgtttttttttgttttgtaaaagaattatcaaccgaaaggaagattttccagagtgtgagttagaagaaagttttggctcaaagtcttaagaaagcaaagtagctttcttatattattagcggatgttgagaatgcagaatacaatgaggactcttaagtgttactagcaggtttcagggtaggtaagt

SEQ ID NO: 63969 - DNA, 869 bp, Bovine  19866880657532
ttggtgttgctttcaggttcatggtaagagtggtttccttaggttggaagtagaattattgtcattttcagaatattggtggccaatggagagaaagactggagtatctgaacttcaggaagttttagaaaaacccaaagaattctcttcctgagtctcaggaagaataatgataactgacttggaaagataaaatggattttttaagataatatattcagtttcataatttgttagataattgatcaagttctggaactgcagtgaattttttttcctattcaattgaatttttatgccattctactaggagaattgagtgcaaaagaaataagaaaggcaactttgaagagtctcatcttcatcataaatttattgcacttacctaaaaagaacttctaactcaaccaaggatttcaaagactttttgcttctcagcgcaaagaaaagagaaaaacttggtatgtaaagtgttttacttattagagaacttattatattagcatttaattagtcttaatgtctaatttctaccctagggtaaaaaaaaaaaggtaaactaagactgtatttaaaagacagtatgtttattactgtcataatcaatacttcttcagcattataaagttcatcagtaaaactatcaatgtttcttcttcacattttatgagtcctttttattctgcttttgaacattaaaatgccaagaaaactgaagttttcactaatgaaattggtctagtagaatcagcaccagatgaagagtttacatacacaatgagggcttcactttcataggaaagtaacatgcagaaaagccccgaaagttgtggagtcactaggatgaacggtgggttcaaattctgaat

SEQ ID NO: 63970 - DNA, 1219 bp, Bovine  19866880734564
tcaattgattattagaaaacaagaaagctctcaaattcagtataaaagtttcaatctaccaaattggaaaaggagtggtaaattaaattcaaaataaatggaaagaagagaacaaaaatatgggaagaaataaaatagaaagacaataaagaaaatcaataaaatctaaaattcatccttgaaaagattaatacatttaatcaacctcttgccagactgataatagagagagacagagagaggatacacaaattactaatatcaggggtaacaggaggatcatgagtatatataatatgggcattaagaggatagtaagggagtattacatacaactttacatcaatgagctataaaatttagatgaaattttaaaattccataacagaacactatcgaagcttaccaaattaaaaataaatatctgatatgatcttatggtcagcttcaaatcatagccttaccacttaacccttagttctgagactttgagtagttcttaaacactctttgttccatacttcttacatgtaaaataaatatgataatactgacaggagtaccaaagtataatcaagctcataactctagaatttatgccaaagcataaacaaactcacaaccctagagttatgaagagtaaatgacttaatgcatatgaagcattttaaatatcaaacacttggtacacattagctatcagtactattgctattattattcctgatcaaagggcaaacaaatatttggtaattttgtggcactgagggaaaggctattgatagtacaactcaaatcatttttgcaaccatttagttggctagtcggctaactagaaaaatggctttcccccatgttgtttcttaatatgccaagatatcttgcattccttttttattaaatatcattacaagaataatgcattcttttttcagctgctggtaaggagttacttcccattatgttagaagtgtcccagccagcagctcatggtattcttagctgaggagtatattttatgacttctttatggtgttctctgaaaattaacaaggtgactacattaaaatgtttattagtgtgtttatgctttggcactcctgttagacttctatttaatttcaaaaagggataatgattgggaggacggtttcgtacaaacagataatgtgaatggcaaaggaaactaagtattttaataggctgcagatgccctgag

SEQ ID NO: 63971 - DNA, 867 bp, Bovine  19866880799989
aatgactttttttttttaatttcaccaaaatctacttagtaaacaaataatggttaccatatgagaggttctctcattgagatatgtggaagaatggcaggaggcaatgaaataaagcaaacaactcagttttgtttttacttttgtaaataaattagtaatggattttttaaaatttagaatgtacatactacttaggttccatctctcaagatatattattcttcagtgaaataagtctcttaattctttggagagaacataaaagaccaaatgtaatacatacaatttagaagcagagttataatgaaaatgcaaattaattcaaaggtccatagtgagatcattcagccatctggttgctaatgaagttcttaattgttatagcatcagcaccccagtcagaagacaagatggagaaaaaaatctgcggccttttaatatttaatatctgttgtcttataatatttttaaaattttaattaaatttcaagaaatagtttccagctctgaaacattttttaataccatggagcaatgcaaaccttgtaaatacaaaagttagaattttttttgaataattatttcccatgctgtgtaatgaatagaaaacttaaacactatattcataattcagcatacaaaatatgtagcaatagggattctgtaaagaataacattaattcatctaagacatatttattagcatccatactgtgcctgaaactgttccaggtattgggcagatacagtaataaccgaagcagacaagattccctgccttcatggtgtctgcgttctaccccaggagacacacagtaaagtaaataaataaaatacatagtactttaaattagttaaaagtta

SEQ ID NO: 63972 - DNA, 1727 bp, Bovine  19866880926403
ctcctataaatccattactgctgctgctgctactgctaagttgcttcagttgtgtccaactctgtgcaaccccatagatggcagcccaccaggctcccccatccctgggattctccaggcaagaacactggagtgggttgccatttccttctccaatgcatgaaagtgaaaagggaaagtgaagtcgctcattcgtgtccgaccctcatcgaccccatgtactgcagcccaccaggctgctccatccatgggattttccaggcaagattactggagtggggtgccattgccttctccaaaatccattactaggggcatgcaaattagagattttgagggtcagggtacaatcatcaccaaaaactagaagaagataagccataagaaagtaagacaaaaaaatccaaatatttaaattgcaaatttgacaggatacaggacacttatatgacagcctaagaaaaactgtcatgggatagagtaagaatttattataactgaactaggccaaatgcaaacatattcttgtcttaaaaaattaaaaagactaactcaaataacaatgaaggaagacaaatatgcacacaggaaagacatacaactcagccatgttggtattcctgctttgtaaaagctgttaaggcacagatttaacaagctaaggtgaattggggctctaaattcacatatatcctagatttttagtataatagctgtctaaatgttaagtatcatttaaagatgcaaaatgaaagaaaaaaaatcctagagggcaacgatctgttcacttctttagcatggtttaaaaagaaaagaattcaatttaaaaatataaattcacagggattaatgaattgcatgtccattgtttgaaaaaaaaaaaaacagcattcaaaattgatctgcaggttgaggatatgagtgagatgaaaacaaacatttatttttccctccaaattttaaactttttattttgtactggggtacagctgattaacaatgtggtaatttctggtcaacagtgaagggactcagtcacacatatatgaaaacaaacatttcttgatcttgagtacttacttttagataagcattatgaaccccattttaaggtttagaaaattaagactcagatgttcaaaaagaaagagagaaacttgcttgaaatcatatggttgtataagctagttacactgatagctagatcagtatagttttttctactacacacttttttccttaatggcttacaggtcaatctggttgaagttcgggttactgatggaggtcagatccttacagaaatgcaagatcccaactcagcagtgtaaaaataggggattttttcccctatggtcactaataacacatcctggctggcatataccagtggataaggaagataatataaaattgacagcaagtggtataatcatttgtggttactttggggagcaaatgctatatttatttcaatggttgttgaaaattcttcaaaatcccagcattcagctcacacttgacttccaaggagaataaaaattcttttcagctgaagggaatgtagtgtgtttcctcttcttcctccagttttatattccacatgctgggcctgtttatcccaaatgtgtgtgtgtgtgtgtgtgtgtgtgtgtgtgtgtgtgttgaggtgggtggtgaggagtacagaaggggggattctgcctgttggaaagtggtggtgaatt

SEQ ID NO: 63973 - DNA, 1250 bp, Bovine  19866881015258
cccagtgttctcgcctggagaatcccagggatgggagagcctggtgggctgccatctatggggtcgcacagagtcggacacgactgaaggcgacttagcagcaagcagcagagaaatttgagcacagacatggggataaagaggggagttttgtccctaccattagaatataaattcaagcctatgaaataagctctgtgtgctacttcggtgagcttaagtgaaatggtgattcatcaagcatttattttgcaactatcacatgctggtaactctcacttacattgttgcatttatgaaatgtcttcagatagaaagcagtgcaagtgtagcagttttagcttcagttttgcagtctggattgcttttggttgtgcagcatttccgtagtcaggaagagaaggtgaagcttcactgcctcttcaaggaagagacaattataggatattgctacctccctctatccagctgtgacaatcttccatcccaccctggagtcctctcatcccctctcatcacgtatttgtgtgcctctgaggtaacacattatagaaataggaaaaatggaggaaaagactaagattttaatgagagaaaaatatgtgagacaagaaaggaaaaagtaaaaataaaagtggagaccccaaagtgacaaaaatgttatacagaaaataagaaaaaggtggtgtttgaaaatgagctttttgcttatatcaggatacttatttctacacctaaaacacatattcaacctagatgacaaaataacatgtaatctagtcacatgggggaaaggaagttgcagatattttcccaaagccattatgaaaaatgtgaccagcagaggccttacatttctattcctattctgaataatcttccaagtcagagaaggtggaaacaatgttcagtgtttgtaaaattgtggttgaagaaaggtagcttctgatttcagaacccaaatcacaagcttttttcacttatttgtgacaaaaatggagggcttttattagggtagggtgtttgtatagaaaaattcaagtaagcactggggggatttttaaaccctaatgaggtagctacctgctgcattatttagaatacttgagactccaactgctgcccttttgtgtaccaagctgccactgactgaagtaaggggctcggcattcctcccttaggaggtattatcaatgaaaatcctttaccaagactagtctctgaggtgtgtccttcccctgctagacatt

SEQ ID NO: 63974 - DNA, 1123 bp, Bovine  19866881221763
atgaatagcaagttgcataaaatcttctattgaggtcaagaatatttgactagcatgttgctctgtgttgacaatttcggtttcctagtgatgattcctttcaaatgaccattgaccctctttatacattaatgtttttctaagtggcacagatataacttgatggtatagactagagttaaattttatcttaagagtctttatttatatcttagaagtatctgctgctgctaagtcgctttagtcgtgtccgactctgtgcagcctcatagatggcagcccaccaggctcctctgtccctgggattctccaggcaggaatactggagtgggttgccattgccttctccaatgcatgcatgcatgctaagttggcttcagtcatgtccgactctgtgtgaccccatggacagcaacccaccaggctcctctgtccacaggatcctctaggcaagaatactggagtgggttgccatttccttctccacagatggatctaataaggctcaaaaatacacttctttcccaatctattggatgcaatgctcataatattcatttatcaaacttttaattctaattatacttttagtgctctagcggaaacatggaatacctttgatttgataatgttttccaaatattatatttatattattaatgaaattttgttgtttacataatactattgatctgccctgaatttctctttatagtcctctaggtactatgtcattatagaattgactaatgttctgattttcaagtcagaatcctgctgaaatacaatgaatatgaatacaaccaggtaatctctttttaaacacagtaatattgaattgcttccaccaatttctctactcaaatttgtctttgacattttacacctgaatgtaaattggcatagaagagtgtaaatccttttaaagtgagattggtaataatatgactgctgagtatctgaaagattgatttaaaagaagcttgtaaacagaacaagacaagatcagtgcagtcttccataattcaaagtagaggattagtctatttgcagaaatcaatactagtaactcacatcaatagagggtttttttaataaaataaaagcgaccattaataaataa

SEQ ID NO: 63975 - DNA, 649 bp, Bovine  19866881268175
agctttcatccctcataggcatgaggcaagcacctcactgtgctctaattattgaatgttttttagtccaaaatctcccttgaagtaggtcataaaatattatgcccagccaatagaagctggcaaacctttgccaaaactttgccaaaggtattgagaaattcctgaaaggacaaggagagaaagctaaatgcatttagctaaaagctcaggaataccacagggatgtaacttttgaacattttttaatgctaccattactttgggctacttagtgcagtgataatttactaaataggagcaatttactaaagagactccagaaatgtaaaagaattattgcacctctgaaaaaaagtacacagcatttactctgaaaagatgagacccagcatttccaataaagttgatttactacttaatgcacatctgaaacagcctagtgttggttcagagaacagtttgtagcaatttgatttacactaatcaaatgaaatggtgcattttcctgacgtataaatgaagaacacttttttttaaattacttaagaaaatagctattcaagatatttggtcatcatgatggaagctagcaggcatttcacacttacattaaaatgatgaagcttagtagtctctaatgatacat

SEQ ID NO: 63976 - DNA, 1191 bp, Bovine  19866881748823
ctgcatgcatgcctaagaaatatgtgagaattcgctaatctctggttgatcttggggctctgcacaagcaggacatggaaagagcaacagaactgtcgattactggaacattgatggtattccccatcacacacacatacacagaagccaacgtagttacaggttcaaggcattcaacgaaatctttgcctaatcattagatgagcattaagctaaccaaacagaagctccacttgccattcacaacagcaaaaaaaaaaaaacaacaacaaaaaactttacagaatatgtctaggaaagtctctaaacaaacagaaacaacaacaataataagcaacaacaaatgttgaggggaagggatgaacctaatttccaaagttgccatattatattattttaaatgcccactactcaacaacaaacgacaggacagtccaagaaacaagtaaatatagcccacatacaggaaaagaggccgccaataaaaactatttctgaataagcccagatgttgatcttactatacaaagcctttaaatcagctattgtaaatatgttcaaagaaataaaataattatatccagagaattaatgaaaaatatgagttcaatatctcactgaaaaggaaatagaaagaaacagaaattatttaaaacaagccaaataggaaatatagagtaaaaaaataggatgactgaaatgagaaattcactagagggtttcaacagcatatttgatctgccaggagaaacaattagcaagcttgaaagtatgtctactgaaatgaacaaaaaaagaaaaagaatacagaaaaattaacagagcttcaaagacctgtaggacaacattcaaactcaccaacagatgcatactgtgagtcctggaaggaatatagatgaaaacatcctcagtaataacctagcaattgaaagtcagcagcagatagaaggataaaacacagtgaatgagtgggattcatcccaggaatgcaagattgatttaacatcaaaaaaatcaaccaagacacagtattccaaaaacaaagggagaggaaccatatgatcctctcaatagacacagaaaaagcatctgacaaaatccaacactctttcgtggcaaaacattaaataagctaagaaaaggaggaacatcttcaacctgattaacagccatgccatgcatgtgtactca

SEQ ID NO: 63977 - DNA, 4162 bp, Bovine  19866880472305
atcttctagtctgctgacttttcaataaagtccttttctttgacccacaattctctctcaatttactggtctgtcacatggtgagctatacaaacttggactcagtaacaactaagtaatcagactattctctctacatttgtcatgcttaaaatttcataaaaactcaaaacattaagtgaagtatttcaattaattagataaataaattctaagtcaacaaactgtttcagcttattttccttggaaatccatgcaaggaatgggtaatgactgcctattggtagagaacttttacttaaaggtaaagaatggtaaatactttattggaaagacaatatcaaatagacagagctaatacaaaggaaatccaatcactctcaaaatgaatttagtggaatatggtggcatctcagagttatttttccaaaaaaaatacagcaaaatatactttacattaaataatgtcagaaagtatcatctgaaacagcagccagcaaaatatccccattctttgttacctctaccacaaggggactaaactagagccatcacaagctgaaaaactcatcttcaccaaaagatacagatgttttccagaaaatctttttatacctagtcatcaaccataaaggttactcatttatctcaattctcctttccaaacttgcataactcacaaaaggagttactttactctcctgcctacagctgttatatctaaagcctaaaatagaccagcatgtaacagtctgtaagtagatactggtagaagaaagggagaggggaagtgagggagggaggaatgggagacaaaaatgtcaaaagaaagacttcagaaaaacaagttggaagctacacaaactacaaataaatccctagtttgactgaatataattttggaaaccaactgacagcaaagtgaaacacactgaatccttgaattttcatcatttatgaattccagaaatataattctcaaaagcaatggaagaaagcctcatggaagagcagaagaagaacaactacaagaggaaaagaaaacaggaagaaggaaagttagcgggaagacactgaatgagacgcgacaaccaaccaaccggaggtgggacaggatcaagagctgcagtcacagaaagggtcacctgctcacagcaaagaacacttccacatactagaacacattgccacacttgctgccccagagttaatcaccttcagttttttttaacctgttaacttccatcttcatgttaggtaaccagtcacttttctcatggcttcagaaagcagccactcttgaccatacatattatagaaaatctctgagtaagtcatactatccacacaggtgaggtcctatttgctgactatgatattatcagttttttccacattaccttggaatctgccactttatccagacctaactcttgaataaccttgttaatccgttcatttttttcgtaacttgtcattagttgttggaagccgaagggctgctgagaactgtaagttttctctcactgtcagagttcccatcacaacatcatccttaaagaaaaatggcattttaacaagatatatcagggcttttctaataccatcactctgtagtatatctaacttatccacaaaaataagatacccaagttctagctaataatgaacttgtgtgtgttgtgtgctcagtcatgtcccactctttgcaattctatggactgtagcctgccagggtcctctgtccatgggatacgccaggcaaaaatgctggagtgggttgccattctcctctccagggaatcttcctgacccaggaatggaacccacatcttttgcatctcctgcattggcaggtggattgtttaccactgtgccacctgggaagccccaataacgaacttgcaattaaacaaattacaataattccatgttcagacagctacatagcctgatggattaattttcatttctaacctgtataccaagagagaacacaggtcattatgattattactggcagacatttatagaatgctttacacaaggattatataacactgttctgagctaggggaaggagagaggtgagggtaaggcaaaaaaagtaaaatagtaatgtattttagaaatgatgtgataataagagttgatactactgcccttacaagggtcatattccagactttcttttcatttaatacgattctgaatcttataggatattatgaaaagcgggtataaagaaaagttgtttctatgattatgtcatatagtcaattggaagcacactcaactatcagccaaggcacttgcccatatgaaaaatcagaagaaatctaataggtaaagtcacaaatacttacttgtaccacataacctgagttacatttaaaattggcaggtcgaggtgctccattgatcaaaacatctccagataatccatgtggatccttccttgcagctaagatatctaacaacctataaaaagacatacattattgctttttttccccccaaatcaggctttacctcttagctaatttgaatccaaattaacagatcaagaaattacatggtttaactatacatatattgtaaatcttaccttctttttaaaaattatatgctataataaagccccaaaatatgaaagtaaagctctcttacctgatccagcacagaccacccaaactgcccccttggttgtctgaccttgggggtctccaggcaggcaatgtgatcctttgcttaagatataagccttcactatgccattggctcctctccccactttcaattttatccccttccttttccactccatagctcaagtcatagctgacagctgtatgtcaatcaccttatcgagtcttgttagtgtcctattagtaaagctgacctaataagacttcctcaggacacaatcacaagccagcacaactgcaccttatccgtagcaaccaataccaaaccagacatgcagaaaatgtgcaacaaacagacacctgctcatacgaaagtgttctttaaaagcaccttaaaactgggggtggggaataggtgaaggagatttgagaggtacaaacctccagtcataaaataaataagccacagggatgtaacacacaatataaggaatagggtcaataatactgtagtaactttatacggggacagacggcctgacttatgatggtgatcatttgatgaatgcaaatgtcaaatctctatatttgacacatgaaactaacataatatttatgttgactataattcagttttttaaaaaccacacatgaaaactacaaagaaaaagcttacttatactgttatactcacgaagatttgcctccacctgtgggtcccagaatggcattgaggccaggtttcatgactccactgtaaatgcagaaatatatccagttactgacccagtttaaagccagttctataatttagggtttgtatttaatacactcaatgaaggttgataaaatgatagaaaaaaaagcacaaatcaactcttaaaggaaggagaaactgaattgttgagtaataaaaatctagcaaacaacaaagaatgttaatcactagtcaggacttagaataaaaatgacttgggctcctctaaactcctttcacttaggtctctacaccatttaaatatttttagaaaaggacacaagaactttcaaagttccctgacgtaacagatgttggtgaagcgtctctgttacacttactctcctttcacagtgtaaaataaagtgcataataagtcttgagtgacgcttgacgatcattatcttcacatcatgtgactcactaccttgtcaagttctacacaattaatgtcagtggattcctagaatcatcagtagtagtgtcttcattgctcaaatctagtcagacaaagaagcagtaaacctgcaatgaaattcaatggctggaataaagcacctcaagggggttaaaaagaaaatatcaccagttctaaacccttacaaaattcttaatcaaattagaaaagtaaaatatataccctcaagatatatcattttctttcttgtaaagtataagtagaaatttatacttatttcttagtttagaagtggtgggacgagatacatatatatatatatatatatatatatatata

SEQ ID NO: 63978 - DNA, 740 bp, Bovine  19866881077394
taatgctgaaatgtatcattctaatttaactacagctatgcaaataaaatgcaaatgaactatggaagtaagagcatgcagaaaaagaagtatttaattcagtaacaaggctctatgcaaacagaaaaagctgctaacctaatttggtaaaaaatgcatcactatctccaaatggcttctatttatataaagtagaactcgaatttatcattctgacatctctgtgtgtacatcaggtgtcaggattaaaagtaatacattttaattagattggctaataaggcagagtgatttaggtctacagagcccattcaggcaagccaacttttctgtaatctacgcactcaacttttttcttccatttcttacccccatcctatgaaactattatcaattagtaggctaagcaagatatgtcaagtgtttcactggctctttaagaattgtattttatattctttccttctataactgctttaattttacaaatgttcaccaaaaaaaaaaaaagaaatcctaaaatggttaaaggttcatattctttccttgattatctttgtcctccccagatgtaaaacaaagatacagccatcattatattaggagaaaatctggagggcagggaatgaaattcattttagtttcccataaacttggtatagttcacacttctggttccagcaggatctgaaacaatcagtctgttcccaaatgcaggaaagtactgccaagtgctgctc

SEQ ID NO: 63979 - DNA, 758 bp, Bovine  19866881970218
aaaaatgtaacatatgggtaaaaagaaagaactctgcaaatttttacaggtgaaatgaaaacacataataatagtaagtatcataaaaagactttctagtgaccataactggtatatggcacatggtcaatacacatggataccacataatagctgcacttcaaattgaagcttgtttacatgtaacaacatggtacacatacataaatacgtacacccaatatccctggaatgcaaattttagtacctaataataaagaactttattaaaaaaaaatattcaaaagaaagcaaagatggagacgagcgataagaaataactgttaaagaaatgcaatctgtatcgcttctgtagaagacagcttaaaaaggtttttttgctcatgttttctttgaaaatttgactgacaaagtctaccagttaaataagcaactatgtgaacttaagctatagtatgagaaacaggtctctctgctattctccaagtgagaattattcaccagtgcattctctcttgcttgtctcattagctctcaaaaggtcagcatacataacagttttgaaaaataagatttttagtttttgttaagaaatagatttcttccccataaatttggtgagcccctctcttaatgaaaaaagaggcgataaaaacccctgcaaactcaaactttggctgatagcttctgatgatggttgaactttcaataaccaaaactctttttcattaaaatgaatcccacttaggttataaatt

SEQ ID NO: 63980 - DNA, 1137 bp, Bovine  19866880398655
aataaatgaataaatgagagagaaatgttacgttcttttggttactattgaatgcagtctggataaccactcacctccttacttataccctgcatccactgaattgtggaactgattccctaattagttgaaaataaaaaaataactaacattatttcaaaatagcaaccacatagcatttttccatatagactattccatcagttcagttcagtcgctcagtcgtgtccgactctttgtgaccccatgaagcgcagcacgccaggcctccctgtccatctccaactcccggagttcacccaaactcatgtccattgagttggcgatgccatcaaccatctcatcctttgtcgtccccttctcctcctgccctcaatctttcccagcatcggggtcttttcaaatgagtcaactcttcgcaacactcatcaatacatgtgtagggagaaaatgatttcaaatcaatacagtagagaaaaaacctttttaatgtacttttttttccaggcaaaagagcttcagaaaacatccgtcactaagcagttttacaaatggcacttttggttacattagataattggataccagccccacgtgtcctctctgacagactagttgtagatcagctttacaatgcaactctttcttaggataaaaaatggttaattttttctaaagaaaggaaaagctgaaaccctaaaggcattgttttaaaaatgtaacatttatttcatgctatactgtctattgttatattataattttaattattttgctataacttttaagaaacagagaaaataaatttcaacctaatttaaaaataaacatatatattaagtacatatattaatgcattttacaataccatatagtgactttgattataaacttccttttggtgcacggtagatttgtcctcttggtattgaactgaggaaaaacatattatacctgaaattcttctttgcatgagtaaaaccatggtcatgacaccaacagactccaaccaatttgcaaaactgaaatcttgggttattctgatcacggataatcaaagtgaaacacgattagtattcaccaggagagaatacttaacacttttcaaacagatcttaaagcagatattttcataca

SEQ ID NO: 63981 - DNA, 3067 bp, Bovine  19866880473206
ctgggatttctttggagggaatgatgctgaagctgaaactccagtactttggccacctcatgtgaagagttgactcattggaggagactctgatgctgggagggattgggggcaggaggaaaaggggacgacagaggacgagatggatggatggcatcactcacttgatggacgtgagtctgagtgaactccgggagttggtgatggacagggaggccctggcgtgctgggattcacggggtcgcaaagagtcggacacgactgagtgactgaactgaactgaacaggattggaagagatcaatttcatttgaatcccaaagaagggcaatgccaaagaatgttcaaactactgtacagtttcgctcatttcacatgctagcaaggttatactcaaaatccttcaagctaggctttagcaatatgtgaaccaagaacttgcaaatgtataaggtgaatttagaaaaggcagaggaaccagagatcaaattgcaaacatttatcagatcatagagaaagcaagggaattccagaaaaacatctacttctacttcattgactaccctaaagcctttaactgtgtgagtcacagcaaactggaaaattcttaaagagatgggaatatcagagcaccttacctgcctcctgagaaatctgtatgcaggtcaagaagcaacagttagaactggacatggaacaatggactggttccaaatcaggaaaggagtaaatcaaggctgtatattgtcaccctgcttatttaacttatatgcagagtacatcatgagaaacgctgggctggatgcacagctggaatcaagattgccaggagaaatatcaacaacctcagatatgcagatgataccactctaatagcagaaagcaaagaggaactaaagagcctcttgatgagggtgaaaaaggagagtggaaaaatctggtttaaactcaacattcaaaaaagtaagatcatggcatctggccccatcacttcacagcaagtagatggggaaaaagtggaaacagtgacaaattttattttcttgggctccaaaatcactgtggacggtgactgcaactatgaaattaaaagacgctcgctccttggaaggaaagctgtgaaaaacctagacagcgtgttaaaagcagagacatatctttgctaacaaaggtccgtctagtcaaagctatggtttttccagtagtcttgtatagatgtgagagttgaatcataaagaaaactgagcgctgaagaattgatgcttttaaactgtggtgttggagaagactcttgagagtcccttgaacagcaaggagatcaaaccagtccatcctaaaggaaatcagtcctgaatattcattgaaaggactaatgcagaagctgaagctccaagactttggccacctgatatgaaaaaccaattcattggaaaagaccctggtgctggaaaagattgaaggcaagagaagaaaggggtaacagaggatgagatggttggatagcatcaccgactcaatggacatgagtttgagcacactgggaaatggtgaaggacagggaggcctggtgtgctgcaggtcagagtcagccaggcctgggcgactgacacgggctccccgcacacgggagctgttcctgtgttagtgtcattactagggatagactgtggtgtgcgccaggccaggaaccgctatagaaatactgctcttgcctccgacactcggtgatgtttgttcttagcactggcgtctcatcgacagtgttatagatgggtgaaacaacggggccattgtccatagtgaggtcacatgagatcaactgtaaaaacaggagtttcagaatttttatcaagtctcgggaagaaggggaaacagctgcaggaagggaggaaagcctgagaaaaggagaagacagggtcttttgcaaaatactttgtcgcaagaggccacaagctatgtctctgactgagatttacccagctccaaacctagagggcatacagaagcagctgctttgatcagataacacaagaaaagcacatgagtataatgatcccaaccggtatttggtgccgaagtgaggaactgtgctttacaaaatctgttctgtttctaaactgttaaaggccctatgggataaaaccctcaactgcccttcaagggtgagattagaggaatttcttttaaaagtaatagaacatagcatcatggactatagcaagaactgtttattaatagaagctggactctggttaggcagacctgagtttgaataaacttgtgtgaacttgggcaaactactcaaatttctatgggcctctgtcaagaggagaaaccactatgtactttgcaaggctgagagaattcacggagctcattcctgaacaatgtccggcacatcctaggggctcagtagatggcagctgttgttctcaatagtgaacgctaggcggattcttttgcttaatccctgcaataaccccatgaggaaggtactgggattctcccatttttacgagggctagagaggttttctacctcaggcaaggccacacagctagcaggcagagtcaccactccaaacaagcctgagagcccaggattttcgtaatgaacaagttgtataacattgctcataagagcaacagaagtttagcgggtcgacagaaggcccggaacttgaattctcttgcataataccccagtggcaagccgaggttattgcgctccaactttgcagtggctctctgtttacagggggttgtaaaagacccccaatcttgccctgggtcttgtataagaccccctggtcttaccctgggtcttgtataagaccccccggtcttacactgggagaggcaatgtaagatcagcctgcctttggctctcttctagctccgtccggaagtagattccttcatctctcgcttaagtcaaccaaatgatttgtgaaaggtattctccttttcttagcctagccctgaccatgttccctttaattgtgtgcctacatgcatgctcagtcctgtccgactactgggaccccatggactgtagcccgccaggcc

SEQ ID NO: 63982 - DNA, 4274 bp, Bovine  19866880551734
tagagattctgtggtaaaatgtaagagcgtattattgtgggagtgaatgtttaaaacacaaacagaaaaagaggagagattttcatgtggctctcaagtcagccagctaatctatgggaatatgggtcagaaagctgaagagggaaaagaaatacacactccagtctggacaagcaaacgctggaagacaaaaaaagagggctggggaagtccataccacttgaaaagattcacctcccagtacttgccaaatgtggtatctggaggggaactgtggcatgtcccgagaattccagacactattgtaaacaggggactggggtgtggcgtggaggctccgtctggaatctcatggagtaggaacccagcctggaaagacaaaagttatgctagatctgtgtcaagaagtcacgaggaacatatttcgaaactagaagttcatctccagggtggctggtctcaggacagggcccttacatgcacaaagactgagctccaagtcctctctgtggctcaaccaacagggactttttgctacccagaaatgccgtgaatgacttgcctaaggtgtcgtatggagtagcagagtcaggcagtgaccaagaacctgtgattctttgataccctgataaaccgaaaaggctcactcagtcgtgtccgactctttgcgaccccgtggactgtagccctccaggctcctctgtccatgggattatccaggcaggactgctggagggggtagccatgccctcctccaggggatcttcacaacccagagatcgaaccccggtctcctgcattgtaggcagactctaacactgaaccaccagggaagcccggataaaccccaaaagggaaatctaaatttggattctgggcttaaaatgcttcttactgcaaagatttcacctcttatagggcttcaggaagcctcaagtaggttctttcagtcattggggagctcgtgggctcttaggagactgccaaagctactactttttttttttttttttgcttcatctcatatatggtcagttaacaactgaggaaaagtgagtcagataatgatatctttgtgctctgtgtgccaaaaactccagtagtgcatatactgggagctaggaagcccccatttctgaagaaaattgagtctgtacatatagagcaaaagcataagtagagatggagaagcttaactagagcaacgtttcaagagaaagggactcttcggatgccttgtcccctttttctcccctttctccctcttgtccccttgtcttttccgtgggagctgaacaatgagaccatgttatttgtcgtccccttttgagggtgagaagagcgactgtgccaggacataggtgtagttgggacgtgggttcactgtgtcttagctccctaagctccggagggctgcactgacgccctcatccccgtctgtggcgggtgccgttctctgtgctcctgttcggccacgtcagtgtctctgctggagtgggcgccaggctgcctttcagttacccacgctatgtttctgtctcccgtggaactgtgagctcctggaggctgaaagcctcaagacttccagccttgtctggagaatcccatggacagaggagcctggcaggctgcagtccatggggtcacacagagctggacactgaatgacctagcacacacacatgatttatctctgtcccataagccaagatctgacactcaggtttgacaagggagggtatactgacaacacgtttgaagggagacaagtgacaggattggtgggaaagttattcccaggggaaagagaaggcgtcacgtgtcatagcatagagttgctgacagtgatcatgggcagtcctgcaaatcagtcagccttcatggaatggaggggtgacaagaagtaaggaggaaccagagctggtggagtctacagcctgcccgactattgactgacgcctgctccaaagaggggtggtgcgcgaaggagcacagtcgctcttttgctgtgctccttaatgggatagactgggtaatctaccaggtttgcatttgagcttggaggaatgtgttgggtaagcatgaaaacttgaatgataaaaagagaatagcttctcaaagaatcttgatacttctgcttccagctgaaaccaggaaattcagaggcagcaaaaatgaaatcaaggaaaacgttaatggaaattttgaacctagaaaaggtttggtttgagttttgaaggacagtctgacctggttaataactgctcccaagtactactgttatgatttgcaggctttttatgtgtttgttatatatttcatttatataatatttagcctattattttctaattcttaggggtgggtccctaaattcagcagcttaaccaaggcttctacatttactgcagtgctgatgaagcccaactaccctgaacaggcttgtgttgtaacagtgtgggctgttttgcctcaaatcagcagttctgcttgggagggtcatgcaaagtaatctacagagttttctctgttacttgtgtagaatggtaatactttaattaaagcaacatgtatacataatttaataagtgattgccagaaatgattttctctaatagaaatcatagcaaatttttttttttggttatcacttagggaatcgtgaattgccgaagcctcagtcgctaactattttgatctgtaggaccccaatttctaagggtccatggcaattctgactttggcctctctaaaatgggcagatcaagcttgaggcagttattgtgggtgtggcatgaaggtttgcctgctcatgtcccgtcttcttctcagaagatgaaggtttcaaacctttatttttcgtaagaggaatctaccttctggggtcttaaatgagttctttgctaactgacaaccttccttttgtattcaaaggaccctcttgaacgccacttattttatctatacatgttcctttaagttcttacctaaagggttttcctacgtgtcacaaagctacttactttaaacgctcattactgctcactttttatgctgaaataatgcatatttgagttgcagtttacaaataatgatcaaagagtgcctttctcttaattaaatcgttggttaatttgataagcctttcagggtcaaaggaattaattctataaaaatacaactgtcttgacttcccattcagctgaatcacttcacaattttctttcccatgtggattaaaattctttacaactggaaaataattattaaaataaatatggcatttgaattacagttttggtgactggaagccttgacccatgcgtaggtgatcaaataaaccaccaaagtgataggaacactaaccggattaaattaaggagaaggaactacattattaatagtaagcaagcaaatgttggacaacttgactctcttcatttgagtctttaacatttgatgtacattttaatctgtatttaagacattattttttctctcctagagagacatctcctctatggacggcctgccgtgctctatcggactagatatgatatcttatatcacactgactttgaaagcggttatagtgaaatatttctaatgccactctggacatcatacactgtttccaaacaggtcattgagaacattgggtttcatgttcttcatgtcattacgctccgtgccttaatagaatgattgctggcggaacagaattttgttttagaaaagactttaatttttcctgatgaaagaaatcctacattgggtctattgtaaaatattttgaattaggctttctgccatgttctaacttcacggtaatatgtaaaatggcatagcatactaattctgttagtttctttgactgtgcttgtcatgccccagtagtttcagaagctatcaagatttggctgtgagttttaatagacttattatttagagcagttttaggttcacagcaaaactgaatggaaaggacagagatttcccatatacccacagctctacacatcacagcctgacccactaacatcttgttttttttttttttaatgaaggtttgttttatgttggggtttcagttttggtaaagatgagatagttcggtttatatcagaaattagaaaaatttattacagttgagatatgtttctaatttctgaatacaaaggactacttcaactgccccaaacatagcttcttgttatttgtactcgggcacatacaatacataaacagttattttttttaaataggagatatgt

SEQ ID NO: 63983 - DNA, 1217 bp, Bovine  19866880809263
ccttaagaaccggagatgcctttttaaggcgcattgccagccctggttcatcttctatttactatgctttttctttaccacttttttttaacagccattggcacatactctgactaatgaaaaacgagaacatttttgttctttgctggaggagtgtgtagcaatgtcagaatttgaggaacaaaagttttttactcatgactgcacttaggtcatctcaaacaagtatctcggttgattttgagtcctttagagagcttggttctaaagtctccctgtaatcattctcggtgaaaattcttagttcaaaggagatccttcttctttgtgttctgtccacctttgacattgggagcgtctgattgctcccctttccatcacgtttccttggctttgttttctcaggagtaacagtgtgccatctgcttattatctggcgtgaggagcacaagaagacggtgctctcttcctgcttgtatttgtcctcacgtgaccatgcatttagtgtagtgtccagaagacttaattattcaggagtaatttgcatggaggcagttgcttttgttttggctcatcataatcttatgcatattaattaattatgcatgttaatccatactgtgaggatgttttgtagttaacttcttcatttcatataagacagcaccttgcatgtatagcacatgttcagaattattcgtttctcatttcaggcctatgttgttgtttttaataaagcatttctttattggtagatctcttatcttcttgtataaaatttccaggtaccagttcttggaaatatgtatatgttttaagttgacatttaattagatatttctgacttttgttaaacattgatcaggaagaccttttaatatcatttacttcattctcttaagtttcaaagtagacaggttttgttgtgtttaaattccattatattgtccctctcttcctccttagcatatctttcaacactacatgcgattcttaatttgaacttcagctgctctttatctcttgtcaaaattggaaatgtcagaattttcgaacttacttttcattaaatgtaggaataagaagaaaaaaattccactgatgaatggtggaagaagttgacatggatctttctgcaatggagtaagttacttaaattcaaagatacagtattttctgcattctcatttgttgtgtagcatacatctaaaagtatg

SEQ ID NO: 63984 - DNA, 1858 bp, Bovine  19866880999722
ttttggtgtattttgttagtgtttcccctgcattctccagagattggaaataggtaccttcagtgtttcccctgcattctccagagattggaaataggtaccttcagtgtttcccctgcattctccagagattggaaataggtaccttcagtgtttgccctgcattctccagagattggaaataggtaccttcagtgtttcccctgcattctccagagattggaaataggtaccttcagtgtttcccctgcattctccagagattggaaataggtaccttcagtgatcaagaaggcaggttttttttgccactgttaggaaaatttaagcttatatctcattgcacaattgcattgacttcccaatagcgactttggtgttcattttgtattgcatcttaccgtaaagataactaacaaaaataaatccaaatttattcttctggttttattcttggataatagctgcatgagtttagctttttattcttcagaatgggtggcatgtgcactgttgcagtaaacctttcttcctcgagtcctgacaaggaactgtgatctgaatcgggacttttcctatgcccacgtcggctgcaaaagagagacgctccagagaagcccatcgagaagcgtccttggaatctaggaagctgggcttggagccagcgtatttgctacgtgttcaccgtttgctgacttggcaggaatcagggctttacgccaagaagggcagagtgtgattactcaggtctttatcataatttacagttatgcctctcaagtggaggtgtagtggttagggccaggaattccttagaaaccacgatcccgaggcactggcagacaaaaccttccgattatttccaagcctaatgagccagagggacttgctgcagcgccactttgggtggttattttgctgctagataacttgatttctgaaaggggaacacagggaaagagaggaagttggtttggctctttgtcagcagttctggaagaatgtttattcagggcggagtttgagcactctgagaattcggggattatcagaacatttcagtcctttgatgtcctgcctacccagcaaatgctccttagctgaccccctgccctctgccagagaaagctcctcctggccggggctcagtgtgttccccgcagcttccaagtgtgcgggtgggggaggggtggccccctcaacgttgcagtgagactcacggaatctgacatatgtttggggaggtcactgctgtccttagtggtggcttatgcggaaaaaaaaaagatttttaaaatgcaagttagcctagcattccttaaaagaacacctcccatttttttgtttgtttgtttgttttactctgtagtcaaaaatgctcctcttgataagagcagagcagtagatattaaattatgtagcttggggctttctgggagataggcctttatggagattatagtacaatatgtaaaagaagaagacacaccttatttagagctgtttagtggtccattcagagatgtgttcagaggttgaaatctgagatagagtgtcgcttaaaactgcgtgtaccggaggcagatgtttttcagtatttgtccacaagcccttgagaacagcgtccttctctgtgggcctggaccacctcctgtaccggcaggattagtcaaggcgagtgtgtttctcacggggcagatgaggaagctctatcttctcaagaaagagaaggctctttcttctccaagagctttgcgtccagcttgatgggcctcctggaggagggtcacaggactgcatccctgcctcctcttccccttcagacttaggaaaggaaggtgtcagcaaagggcgacac

SEQ ID NO: 63985 - DNA, 900 bp, Bovine  19866881335528
tagaacatttaatggtttctgtgactgtgtaggtacctggtattaaggtaggaagcatctttacagtagagggcttgccactggggcctagggcagtaggcagctccttttaggcatcataaccctctgttcccttccgtttgtacaggttctggacatctacacgtgtggatagatgtgcacgctgaccttttgttattgctgttgtttgtttcctaggcacttcacacgactggaggttgcggtgtggcgctgtggacttgtacttcacgctttttggcctcagtagaccttcctgcttacccttgccagaacttggcttggtccttaatttgaaagagaaaaaagctgtcttgaatccaaccatcattccagaggccatagcaggcaaccaagaagctgcggtgaatccaagtagtcacacacagctagttggatttcagaaccctgtaagaatcacatgtgatacggaaaaagtatcaatagttttattatttagagctccaaagaagagaattgtttctttagaactagaggatttgagagccactaacagcttctcgcaccattttaaaaagtgctggctgacactgtctcagcacttgacagtctctaaagagctgctgacagctgcctacggcagcgcagcaggtgctgtgatgccagtccacccactgctcgtgatgacagtgactttctgtgctggagcctaaagtgtctcctttgagtagtagaaaattgaacatttaaccaattacatattaaccgaacttgtctgtacacaggaccttgacttttctcttttttttgctactttgcattaatagcgtcattctaaacatttgagaagtgcctgatgactgcttattgaatcattagtaaataagtagataatatgaa

SEQ ID NO: 63986 - DNA, 1475 bp, Bovine  19866881343204
gactagggtgagaaagactttggcatgtgtgagggtctgaaagaaaacaggtgtgcccagacacgacggtggggttgtcagggaacgggtcagcagatccttgtggggaccgtctaggggtctacgtgcaaggaagataattgagaagtcacaggggatggcagggtatacgacaggcttccatttaagattcagtatactggcctggatatgccgtaattctatggcctcctctcaatgtcattccacaaaatgcaactgatactagagagtccacccatttaggtgcagtaattctgcactaatactccgaacggcaagatagaagggtccgtcccattttgaagaactatttgctagctccttgcgtagctagacttgcacttcccctcagactgaactcttctcaaaatagactatacctgaggctttgggggtgagcagttggcagatttagttgagcactgctcctctatttttaatccttaggtcaagcctcctttctcagaaataaactgcataccaaccagcgtgcatttcaggtgagcggttttgccgacaaacacatgtcattcattgggggttatttatgaaagtctctgaatggacagggactctgttaaaatgaggtctggaagattattttaagttggaggtattttttaaatttttttttattttgagaccttggtccattcatactttcattgagcaagctgccaacttcttgcgagcatggtggtcctgttttagcggatagcttcagaaactgcctctctaaaacgagctcactgcaaacagggtgaaccaggaaagcgaccacagagtttctcaagggcaaaaacattctgaattgttcttaagagagctgactttaaaaaaaagaatctctgcacaaaagcagggtttggtgtccactgggtttgcccagattccggcccgttccgcctcgtctggggaagggctgctgcggactgaggatgttcctccctccagctgtctctctagctctttgctgagtcaggtcggggccgccttgtgggtgggaagtggtgaaggcgacaggaattatcccatgaggggagggattgtccggggccgtgaggaacaagatcgagctgtttgagcttggagattggggtaagcagagggccgcgacagggtcaccaggagcgtcaggagctccaacctgggtcgcatttctaggaagcatctgtccttgatcccttctgtcccatccatgtccccacccctggcaggacgtctagtttcggatggaatgtgaaggtggacgtggtgccctggccctgtgaagctttgccgtctggctcttgggagcaggcaaagctccaacccctatgtgagctctgggctctgttcccactaattccttcacagggttcttttcctgcctttaggtggaaactcaggtgctattaatgttcagctgaatacttgagacacttggcagcgtt

SEQ ID NO: 63987 - DNA, 1584 bp, Bovine  19866881354298
ctattgtgctcgatctgatctttctaaataactgttaaaatgtacggagtccctcctatatgccagacactgttccactcactgtcttcatttactcatctacccctttaaataattctatgagttagttatcatcataattctcatttttaaaataaggttaagtaacttgctgaaaacaagagctaggaaaatgatggactcaagattcagatcaaagtaatctagatggctgttaatcactaaagaagattgggtgctaattataagattcactagaggaggaaaaaaattctcaacttttattgcatcagctcacacagcctgtcagatattgcaactgtaatcattgttagctcataaaatagttatgattacacgattccctttttcacacaatgaccaagcaccttgagatttttgtgtgacctttgcaaacatgatgaatacattttttactcccataaatacctccctcaactgcttgagctgctctccagctatcttgtccttgcgtggaggacggtagacagcagtcacgtgggtaaatggctcacagctgcagccgctgaccctggataatcaggctaccgagactgtgcccaggcgtataatttcctcttttaaagacttagtcagagcactttaacaatttcaacactttatcaagcccctttcttggtctttgtctgaaaaatacattgatataacattgtgcaacatgcaaagcagttctccatgcgttatacttttaatcctcccagcggcttgagggtagttttggtgatcccattccccagtggaaaccagtaactgagacattgtccctgggagccgtgaagaaagaacttggggttttctgcaaaggaagctagctgccaggtccagacaggaattaaccccatcttctcagtgattaagaacactgatgagttcagcccagcctagaatattctagccaaaagaaaagagagagggagggaaggaagtgtcaaagatggaagaaagagggggaaggaaaagggtgctgatgactgaggaggctgaagacaagacagcaacttgcccaaggccatgtgatgttacaggaaaaaaagccattctgacgcttgtttaagttgtaaggagggttttatttaagactgttgcaataggagcattgcagcggggggagggagacggctcccgtccaaggacagcaagagcaagtggggatttacagccttggagcagggcaggggcacgagcagatggaatattatatgggaggcgccaatggtcgacgccagggacttggacatcaaagatggaggaggataaactcaaaataacaggagtgatcaggtatcactgtttgggggatggcaggattctttgctaaggctgggctaggtcggtcaaatgcccccctcttgatcctgggcgatcaggactctttgactgacagactcaccacgtaggggagggcattcttccacaaaaagaaaaaaaagttgttttggaagttctgtaaccgtagggataggagcccaggtcgagggctgttgaaaggagggcgcggaggagcggacggagcccggacat

SEQ ID NO: 63988 - DNA, 1841 bp, Bovine  19866881358717
acgagaagtgggtaacgctgtaagtgagaaagcgactcccttgggagggatgtcctgacagtcgctggggcagcgttcactgaccacccttcacaaagcgctctccgtcagccctaactcgtcttgcttccccgtgccaggtacgtggagggcagctccgtccccgtgcccacccactactacagcatcctcaccagctgcctggacttcacgcagcctgccgaccgctgcgacgggccgctctccgtgtccgccttcgtgctgccccacaggcccgacaacgacgagagctgcaacgtgagtgcagacatggcggccctcgaggctgccgcttccgcttccgcccgcgctcctttatctcacgcgcatttcctgccccattttcattgctttaaaagtctctgtattgttattgttttttttttaatttacttgtttaattttatttatttttttaggttttgttcagcaagtacataggtacttattatttattatcattattattatccaaactagaacatttctggaagtgaagggaggatgctatgaaataacaactgcagacagcagggatgagccaagcttaaatgggcggcacagtttcaccctgtgtgtaaggcataaggggaacttgtttaattgtagctggaggatcatcgcttcacaatggtgtgacggttcttccgtgcgtccgtgtgagccggccctaagcacacgggtgtcccctcccacctcacccctcccggtggtcacggagccccggcttcgggtgccccgcgtcccacatcacactccctctggcgatctgttttacgtttggtaatgtatatgtttcagtgctattctctcaaatcatcccaccttcttctgttattattttgtaattggaatatacgtgctttacagtgttgtgttcgtttccactatacaatgaagtgaatcagctatatgtatacgtattaaataaaacgggacaaatgactgtgcgtcaagtttataacataactgcgcagagaaaagaattcaaataaactatatgtattctgactgtagggcttccgacgtggtgctagtggtaaagaacccgcctgccaatgcaggagacataagagacgcacgtttgatccctgagtcaggaagatcccctggagaagggtatggcagcccactccagtattcctgcctggagaatcccatggacgcaggagcctggagggctagagtgcatagggttgcaaagagtcagacacagctgaagcgactgagcacacgtgcactctgaccatactcccttaatgggatacagttcaagaacaaataaagcaagcaaagaaaatttgaactttacacagtagatttggtgttgctagtgatgttgatattttaattttgaaaattaaaaaaatgtactgttataaaaaagcagtgtcctttgggatttgctgacagaattcatctttgtgtcttaaattatatccccacccttgaactagaacacacttattataaaacatttggactatacaaatggggatacaagttgagtcttgggaaaggacccaacaaaactgccaaacacttgggaactctgagtcctaatggcattttatttttcaatgtaagggtattgtgcatttaattaagttctatttcagtgtttgctcttgacaaatgataaaagtgctcaaatgtcttcagttttgcaaaagacaaatatattttgaaaacagtgaaaagcagcacaactttggtagttactgaaatgagggaagagcagccaggagctcattatatcattcactctacttttgggatgtttaaaatttcattaataaaaa

SEQ ID NO: 63989 - DNA, 1151 bp, Bovine  19866881378718
acttagtcctcacccttaccccccaaaactgctgcagagcttcattgaaaaggcttagtgttctggttctcgatggtaattttctccacccatttcaaaccttataagaaggtagcttttgtgtgctccaaagacgcctgtagttttgctttgcttctcagactgttcttcttttatctctatcttggaagtgacttggcttcattttctttcttttaaaaaaaaaatgtctttagaacttaaaaaaaatggtcacacttccaggtatttattggaatatatgtcaaggaaatctacacatcatccatactgaaaatttttaaatttaggcagattcaaacgatagccttagacctttgacagtcatctttctaacctggttccatcctgcagcctagaattagccttgcttttcaagtgatagtatttcatttcagaatcatgctcagctgtgtctccattatgttcttttctgtcgactcgtgctcagagcagtagttccccttgtgtatgggtctcagattgattccagtcccagctctgctgtgcaataggttgctgaccctggacaagggttgtaatctcttgacaaaccaatgtcttcatctgtaaatgggaatggtagagtctttaccctagggcatcatgaagatagaatgaattaacaaatggtacttgttttcttatgcacattatctctttcaacaatgaccagacaatggctatctatatatgacctaaggtaatttgttcccctttagcactaaattcctcatctagttcatcttccttttttttttttttcctatttccttttcttcttctaacatgtctaatgttcttagtctcatgagaaattctgtatcaaccagaaatggtgaagacaactgcatgaatccctttctgtttggagtacctgcttcctttgtcagatctgtttgtactgtgtctgcatcagattttaaatgttcatggctcggggccatgtcttttctagtctctgaggctttttcataaatgcagtcttagatctacagggaaacttggagaccactctgtgtgactccccatgtctgtgatcagaacgccgaggcttagagaggtgaagtgttgtgcccagggtcaggtttcagcggatacgcagagcccca

SEQ ID NO: 63990 - DNA, 2044 bp, Bovine  19866881437494
cctaaggaactccagcaggtaaagagggagaggtcggaacgtcccggtggtccagtggttaagactccatgcttccattacagggggcacggattcaatcccgggtcagggaactaagatctacatgccacgtggtgccaccaaaaaagaaaaaagagggagaggttggacaactccaatactgtccccaattgagacaagtctggcaaatctcatttcatcctggaaaaacacagttactcagtgatcaagcatgcttgattttagagaggtcatttctgaggccagttgtcttcaccctttaggtttagtctgaaaggagcaacagagtagggaccacatctgccttccaaatccttccgtcctccacatcctacccggaatgtactgtgtgcttgataaacaactgtggatgaataaatgaatgggtgtctgggaattattttcagtctttcaaaaagcctagtgccaccagtacatttgccaggaagaagtgatacgtgccaaataaaatagcacattgttttccttttttttgctggaatgatatcaaatcagtgtgttaatgctgagcagaaggcatgcagttcagaagctctcattggttcctgatgacatcacagtccttgttagcagaccccgagatcagataaatgcaatactcaaatgaaactagttgatggacccttgtacaaacctaaagccaaaataaaacagcccctagcaatgaaagatttacatatctctccactgaggcaatatcatctcatgcttaagagtacaactctggagccagacagcctgactttaaatcctggcttctcatattagctgtgggacttgggtgattttcttaacctttaagcctcagttccttcccttacataacagagacattaacagtagctacagttccttacacagagttgtcatgaagattaaattctatgaatctgcaaagtgctgggcatagattgctgccctggctctcagatgctcagctgagtctgactctttgcgacccatggactgtagcccactgggttcctctgtccgtgggattctctaagaatactggagtgggttgccatttcctcctctagggaatcttccctacccagggattgaactctggggctcttacatctcctgcactgcaggtggattctttaccactagcgccacctgggaagcatagattaccgtattaatatacatatcattacttgatattaactattatttctgttattggtaaaataagagtctctagtggttgcattgttatacggctacttaactctctgactttttaagatccattctaactttatgcttcttctactagtttagaaagaacacctagaaaaaccttcctgtctgtttctgtcccttcatctctctctctctctcactcagtcacacacacacaaatgctgcagaccttgtgccttttggtttatattggcaaaaacatacactaagtattaaatatcaacaaagaaaaagcaagagcctttaagtactgtcaagaacatagtactttattccataaggtttttccatgccatggctttaacattttgctttttctactgtttctttttccagaatttatagtttttcttataaaaaatataatattgcacccagtttaatattatgagatattatatttaagatatttatttatagtgtgtatatatatatatttcattagaagtccagaaatgtgctcagaatctagggaaatgctagctcaataatcattacttccttgtcactgaaagattcttaaatatgaaacagtgcttctgtaagtgtggtccccagaccagcagcatcatctaagaactttttagaattgcaaattacagggatccacatcagatctactgaatcaaaaccctgggtttaagacccaacaatgtgtgttttagcaatgtttagtacattttcatgcactcttagagctttagagctactgattttagagaattccaagtctcatcactccacgatttatggactgtgcctaaaaagg

SEQ ID NO: 63991 - DNA, 987 bp, Bovine  19866881529260
cccgtcaccacttcgccccaggcacaggggcatctttgatctctcctgctcagagtctgaacactcactgtttcctctgcttgggttactttcactgttcccatgagctacaccttcaccttctcattgacgttttccttaccatcctttctccaatggcaattccattctttcttgtacagaaagtcccctaaatacgaacgaattccaggaaggtctcttggacatttgatttacacagtctactactgactgtaattataagctctataggacagggatttttaactgctttgtaccttgtagttatcctggtatttagaataagcacttggaacagtacacacacaatacatagctgttgtgcatatgttattaactgagtgctgattttatttctttttgcaggaattcttccaagtctctggaaatctgggagaatgaagggacatttgcaagtgtagcttgaaaatgcatatcaattctattttcctttgcagaggtggtaagtggttgcctgtaggacacatctggtctgctgattctttttgtaaataaaattttattgccatacagatatgctcattggtttatctattgtctaatgctgcccttatgctctaacagcagagttgtatacttgcaatggaggctatatggcacacaaagccatatagccataaaatatttgctgttggctcctttgtagataaagtaaatgttccaacccttgttcttctccgtttccataattttaactgagggtattgctgatcattaaaagaggatcagattaaaagattaataaacattctcaagtgaaaataaaatgaagcacaagatggctttcacaagggtcggtttcatttagaccactgggtgtctctcttccctaaactttacaagtaaatgttgaatcagacatcagccaacttgggggctgggacataccagacaaatattggacagttgctaaggcaactgggg

SEQ ID NO: 63992 - DNA, 823 bp, Bovine  19866881711350
aaatctcctgtttttaatataagggtctctaaatctctctagagatttgtcatccagacatccttacccagtgataggttcccttcaaactttttctaagcctttataatatttacttctaccagaagggtgcacaagaagaggaacccagctaaatcctgtggttgccaatttgactgttgtctcttctagttgttaaggatactttgcttttatcacattgagcaggattccgtcttcccacaagcacctctctggggtcataattaaccttattggattaaaatcacctataaaaacttagtttttgctactctctgtacaccatactatggattcttggtacataatgtttgctcagggactccataatttttacttacctgcttatcgctttagttctctccttaactcaactggaaacaccaagaggcctccagggcagaatatggagtcccaaacaattaagagatgctgagagttataggaagattgagaattgttgggactggtgtctggggagtcatagccagggcctgtagcccggagacagatgattttgatttcccaccttctctctgatgtccttgttgacagattatgtgaaactagctcccccgagcctagtttgtctgcatttactgggtttgcaggtgtttggctccatcctattaatagaaaaatgatacaaattgtctctcaagacttagtacagaaggatctcacgtatcatagaaaaccagaacattagagagttgactttaaagaagatctagtctcccccaattttatctacttttgtatttgaattattttcttcctt

SEQ ID NO: 63993 - DNA, 1343 bp, Bovine  19866881253120
aatgtattttagggtatgcattttgaagaaacctttgacaggatttatagtaataatttcagagaataattcgggtatctccttgcagataccaacgaactacaaacagctcatgaattttcgtcatggcgacctttcgggccaatcagtgaggaacaggaagtggatgggattggacccaggctatatctgagccacagctctccccgccctctctctctggtgcttctaggatctgtgtggtttcctactggatgacgacttcgactagattaaatcccactctcaacttccactcatggaagaaactgctggaacctcagtgccaattttttatgaaattgccatgtgaatttgttgagtccagaaggtgtgttctcagtaatgcctcaaggctgtccaccaactgaattaatacagcatctcagcaccaagttcagcctgccatctcctcctcgtagcaagatcagcctaggctggaaccctcagggaaagcctccccagagcaccacagcttagagggaggggaaaggaaacatttctggaaatgagagtgacaggagcagagttagagtgatgtaggtgatgacaggtgatgatgtggtgaggatggtgaggacgactaacgctcattgagagtctaccatactcactcccagagctgtttaactctttccaagtgtaagttcatttgtctctgacacaaactctataaagaaggtattaccactattttacagatggtgaaattaaggaatggagagaatgaaatgcataagttgtccaaggccacatagctattaaagaatgaaaataggtgggacaaaaagaagattgctgtgatatagtgacttaatctgatttaaaaaaaaaaaagatttattctagtatttttcttgtcatcccctttccttcctgcccaccaccaaatatttcaacatatgccagagcttgttttccacaaacctgcaaaaacatcccttagcccctgacccaaggggtgagaaagccattgtaattcttgctcctgcatatacttagaggaatactggcaagaagttttcctaacttcatttctttgatttagcttcctttcccaaacacagcatggcatgttttaaaattagtttcttcctacaagtagaaattgcccttgaaatttagtttttgtctaaatgatctttctttcctgtttgcttgacttgagccaaatatgagacagcttactgaaatgctcgagttccatttccttccttactacttctcttcctttctgtgtttacacctccttttggaaaatgcctctttccctaaacacacttgaaaaactcattttctcggtg

SEQ ID NO: 63994 - DNA, 1444 bp, Bovine  19866880476148
cgtctgcctacaatgtgggagacctgggttcaatccctgggtcaggaagatctcctggagaaagaaatagcaatctactccagtattcttgcctggaaaatcccatggacggaggagcagcaatttcatttccaaccttgttggtattttaaaaaaactttatttaatgaaacactcataaaagatacctttgtattgcaaatatcttttgtatcaaaatttccatcttaggttttctcttaaattgaacagtcaagaaggtaattaaagtgttgttatcaacagataaaataaaaataaaactgtccccaaaataagattactaaggttatctgattaacttctacaccttggtacaatccatataatatggtgaaattgaagtgaattattgaatagttaagtgaataatgcatttacctctgaaatcaaaccttcaaagacttctgttcaaattttgcaattctaatttcttccagaaataccatttccttacgacatatttatgacaaaacatgaaaattttaagctgaggaataacaaatttgttttcctaagataattaatattaaaaaagaaaaaaataacaaatttcaatttaccttgtgcctgctaaagaagttagaagatatgaagtggtcatcattcaaacacaaaggtgaagaattaaatacaatacaagaaataaagttacttaaattttcttccttaaatcagattattttcttctaaaaagtttctgagatcataccaatcaatttgtcatgttttctctaaagactaatcattcagactttatcttttactcacacacttagaaatgccattcacctcaaaatgatacattaacatatttttcaaagacatattcacagatatgcataatgtgacttattagcataatccacctgcttataacatttggaagtatagtagcaagtggtaaatagctatttagggttaaaataaaattcacaatccatgagctatacctcaaaagcatttgaatttgtgaagggaatggtaacccactccggtattcttgcctggagaattccatggacagaggaacctggggggctacagcccatggggtagcagagagttggacatgactgagcagctaacactttcagcacatcaagctcattacctgcttagtcttaatggttgacttattctaagattttttggagagaacatggttgtctaaaaatgtgtaaatacatttattattagggatcactttccactatttgtcatgtgaaccttctgtctcctatatcatccttcacatgcttcctgttgtcagtgctgccacaaatataaatgccacctgcaaacgcagaaattgttatcaccccagagacatctgttcccaccatattagaagtgacttggtttttaacaagtctatcatttctagtcacaatctgtgagcaat

SEQ ID NO: 63995 - DNA, 711 bp, Bovine  19866881703225
ggtagagtaaaaatatttcaatagaaatccacggccctcctcaaggagcccactctggcatttgtagccccccagtcgtggtagcgcctgtaatcccccggccgcagcaggtactgccgcccccggtagttggtcatctcgtagaggacccaccagccctccagcacattgaaggaatggatctcactgaagtggaagcggtcgtggagtgaggagcagtcctctgtgatctccaccatctggcctcgatagtcctctcgctcatagatcctcagccggtgggaaccagtctgtgggttcagcaatcggcacatgggagaagtcagagaacctagtccttagccactaatcactcacacccctgggggaatgggcatttacaaagtcttttttacatcagagatgacaagtttaaaagacaggcaacaccagagccaccgtgtgcaactgggtagactgcaaactgcagaactgaagggtgtgctattcacatagatcaagatatgcatggttctccctagagttttccagggccacaacctacatgaaccacatttagtacctacttagtaccattcttaagaaacaatttttatatataatttttttgttctttccttgatagatttcttggtggtctggagtcccctcagaggatataaaataatttagatgttaaaataaaaaagcaaatatatctcttgcaaaagg

SEQ ID NO: 63996 - DNA, 628 bp, Bovine  19866880371275
tctcctctattcatttccctctttattgttataccagtgccatgcagattaaattaataacataacttaaaaacagtcatcctcattaatcttcttttccaaatgtataaaggatcctgatactccaaatgatgtctaaaatggttctgtcaagtcaaaaaataccgactaagattttgatttgaaattcatcttaggcagagttccttggggatatagacattacgatggagatttgtttgtaggtggttttagaatgcctgtaagaataaacctatgagagagtgaaggctgcagaggagaagtccaactatgatgtagttgcaacagaggcatcagttgatcccatcagaggcttcagagctaggatgattcttctattgaccagaattgaaagaaaggggttacttcaacaagtcaacagacacagctgagggaggtctaacaggcaaggccaaggccattcttagggaaggactcagctatgagttgtgagtagtcaacactcaacctctggaaataagtgctgatcctgaatgcagacacaggtggtgtgccagagtgtccactacacaatttttacaatattgcttcatttctcaggacaatgattagctttctgttttat

SEQ ID NO: 63997 - DNA, 1021 bp, Bovine  19866880452161
tcagtgccttgcaatgatgttccccctcagtgtgctgctgagagcacattagaaggtgctggagtttttatatgactgcattgctgtgagatggaatagcagcttcagtttccattaggttttagaagtatttcattctttcagatgttaaactaatttttgtattgtgcacactaggatgaaaaaaagataagaaatatgcacattctgaacaaccagtgttctcctggtattgtgacaagatgcagaacagacagtctgtggacatggtgctggggaacttgtagctcgtcagcaggagaatagatggaacccagaggagagggctcttgctgggttttatagttgaagctttaatgttttttaactttgatttgctttttatcattcaccgaaaacgaagggtggcaagtgaggatctctattaaaataatgacacagagttgcttgctatctctggccttcattggggttttggttattagaacaatgaagtaacagtcacaataatggcttttcttcctgttttgttctctcctcccagttgggtttctgatccttttttttcttaagatggtgggatcctagagtccaggactgaaaggcactgtgggggttgtgccaagtacccagaataggccagtcgtcccagctgcctttttaggtccaaggtgtctgacatagcggtcttcaggtttccttcctggtggactctctaaagctctgccgtccaatatgatagccacgagctagctccatgtggctccaaagccctgaaatgtgacttctcctaattgagatgctgcaaatgtaaaatacagatttttaaaacttagtttgaaaaaatgatgtaaaatatctcattagtaattctttgcattgctcatgttgaaatactggttttgatgtattgagttagataaactaatttttaaaatgtatcctaaaaaaaaacttgaatttacactatgacataagacaaagtgttctcactatatatatatatatatatataaatttg

SEQ ID NO: 63998 - DNA, 1936 bp, Bovine  19866880468812
ttttctagaagaatgttgttgtttagtcgctaagctgtgtccaggtcttctgcgaccccatgactatagccctccaggctcctctgcccatgggattctccaggcaagaatactggagtgggttgccatttccttctctaggggatcttccaaacccagggatcaaacctgaatctcctgcactggcgggaggattctttaccactgagccacaggggaagcccttcttgaagaataacgctttgttatttccctaaagtgttttcaattattctgggcccaaggactgagctaggagcttcttctcttcttttgctctcaaaaaggagagagggtcaagagcaagatgacatggacctccgagtaccttcacaatccttgtagaatttcctgaagttatacacacaagcttgaaagtatttttcacacaaaatttgagtcctgctaaatacttctcccatacatatatgtggctctaaatatgggccaactcagttaagctgctgttcttagcaataagcattaaacagtcataattaaactagaacacttaattttaagagtcactataagacaaacagattcatatgaagggaaccaaagcaacacagattataatatccagagagggggctgaagagctgtgaaggaacaattcttttttagttcagctacccatgaatgaattgccatctttcattttgttattgttattgttgttattgtcattgtttgagggtttgcataatttctgatgacaggtggttatggtcaagtctcttcatcattatgcagatcccgtgatgctcatattctgtctcagataattggagtaattagcaattaatttttttgccaatagagactactaaataaacctgaaaacccattaacagcaccaatactttctcttgtgtattctgacccattaatttgactaaatccactgaactagtccactaatctatttaatcaaatcaaatctcttcaaattgtccctcatcctctttatcataaaagcaagaatggatttagttatacatattctgggtagaagaaaacactgaggaagcaatgtttacctaagtcttggcttagtaggaggtggaagaaagagtggatcatggaagaggtagtaataggatatagatggtccccaactttcaatggttccacttacagtttttccagtttatgatggtgggaaggcgataagcattcagtagaaagcatactttgaactgtgaattttgatcttttgctggggtagtgatatgtggtataatcgcctcttgtgatgtgaggcagccatactaccaagagagtaagcaaccgacacactcgcaggcactctgttttatactttcagaggtcagtaaagtacatgagatattcaactttattatagaataggctttgtgttggaggattttgccaacctgggaactaaaaggttgttctgagtgcctttaaggtaggctgggctcagctatggtgttcagtttagttcagttcagttcagtcactcagtcatgtctgactctttgtgaccccatgaattgcagcacgccagggctccctgtccatcaccaactccccggagtgcacccaaactcatgtccatcgagtcggtgatgccatccagccatctcatcctctgtcgtcccccttctcctcctgccctcaatccctcccagcatcagagtcttttccaatgagtcaactcttcgcatcaggtggccagagtactggagtttcagctttagtatcattccttccaaagaaatcccagggctgatctccttcagaatggactggtgggatctccttgcagtccaagggactctcaagagtcttctccaacaccatagttcaaaagcatcaattcttcagtgctcagctttcttcacagtccaactctcacatctatacttga

SEQ ID NO: 63999 - DNA, 3376 bp, Bovine  19866880477948
aggtattgatatttctcccgcaatcttgattccgctgtgcttatccagtccagcgtttctcaagatgtgctctgcatagaagttaaacaagcagggtgacaatatatagctttaacgtactccttgcctgatttggaagcagtctgttgttccacgtccagttctaactgttgcttcctgacctgcacataggtttctcaggaggcaggtcaggtggtctggtattcccatttcttgaagaattttcagtctgttgtgatccacacagtcagaggctttggctcgttgttagagttgccaaatggagaccaccctgtgcttagtcgctccgatgtgtctgtctctctctgaccccatggactagcccaccaggtgcctctccatggggattctccaggcaagagcagtggagtgggttgccatgccctcctccagggtatcttcccaacccagggactgaacccaggtctccctcattgtaggtggattcttcactgtctgagccaccagagaaacccttaccttacaagtgttttacaaaggatgtttcttttctttctttggtttccattaatctatgttatcagatagaccgtgtcatttagatttttataaaccttcatttgaattttcaggaaaagattggggtcacacctgatgatactgaagaaatggttttaaagattattcctgagacataaccaggaataatgaagtgagagagtattaccgttagctactattatgattgtcatcatctgtgtaaaaaaaaggggggggggatattatcattagttggcggagcattgggaaaactgacaaggtaaaacatgacacacgtgaaaaatcctaaataattacattttaaattacccaaggaggaaattttgcattaactttccctgggctttttcacataagcatcaaataaggttaagctctgatggaactgagttttattttgtagaaataacatcctacccaaatgcagcatcctttccaagttttaattattacactaatacgatatgtcccacaatacacttcatcaagaactatctctaaaaacatcaatggcaaagaagaggacgatgctacagagaagaaagccatgaatcttatttactattgtctactaaaggctggtacctgcaaactatgagctgtgagttgaatccagccacccctgtttttggaaataaagttttattggaaaacaaccatgctcactcacttaggtattatctgtggctgttttcatgtgtttactgtcatcacagtggaaacccaacagtggaaataagtacttttgagagaccagttggcctgcaaaagtataaactatgtactctttgatcctttaaagaaaagatttgccaacccgtgatctaatgtaaagagctcagagcatgcaatgaacctttactgtttccgcaaagtagatcaaagtggggaaaacgtcacatcggactcgctctactttatgtgcaggagattgctatgtgactttctaaggacaggaaagagagacttttatatgctccttccttgtccttctgccccaggcagctactctcctacagtcagaaagggactgtaatatttccatactctccagagactgaaattggcaatggaaggagaaagagaggtaattgccctgctttcaatggctgggtgtcttgggagacccacagctgtcacatggaccacgcaccttcatcactgaagggccaaggaaagagaagtcttagcacagaacctcaaacctgctctgtaccatcactcccatacctttagccctgaaagccaagggaaagcataactgctcaaacactctggttaaactatgttccgggcttataaaattctatacaggttttgaatgttactgtagtgaaatggtaattaaaggtaatgagaagcctcctggggaaacagtaaaaatgacattttgtgaaccatcaggtatttctacaaccccaaagccctgcatttattaaaacaaaggcagttaggtctaaactccacttcccagcatgtctcatccccagttcaaggataaggaggactagggtgatggatgccccagtgtgccctggacgatggacagcaaactgattcaattcaccacccacctgatttggagagattctcccaaaagatctcccagccttgacgatccactgaaatgtcctggaggggaaaataacagtacatcccattttaaggaatccccaaaggtgtccagagagagatcagtgagtctgccttgacaatttctttgttcaaagcacaccttaaactatactgggcacacactgagattgctttcagcttttcagtagcgctacagctgatttccagtcgttacagacttgggagtttttcgtgatccctgtaaaaatagttcatcgttgccaatcatttccttgtcataaacaggtcttgccgattggtttaaaatgtaatatagggcttccctggtggctcagtagtaaaaaaaacatccacttgccagtgcagggaacgctcactggcccttgatcgatcctgatccgggaagatcccacgtgccgtagagcaactaagcccccgtgccacagctgttgagcctgtgctctggagcccaggaaccacaactactgagcccacaagtcgaaagcactggagcccacgcaccctgtaggccatgctacgcaacaggagaagcctccgcaatgagaagcccctgcaccgcaactagagcgtagcccgctcggccgcacctagagagacgcccgtgcagcagtgaggacagcggacagccaaaaataaataaattgtttaatgtggtgtatatatatatatatatatatatatatatatatatatatatgtaggaatattactcaaccagtcacagcaaaatggatggacccagagaatattatacttaccaaagtaagacaaagacaaatactataacactcatacatggaatcaaaaatataatatgaacaaatctatcttcaaaacagaattacagccataacaaacaaacttatggtcaccaaagaagagagggatggggagagggacaaattataatgggattaacagatacaaactagtatacacaagatagataagcaacaaggatttagcgtgggacagagggattagactcgctatcttctaagaacctaatgtggaatacagtcaggaaaatataatcagaatataatcaaaattccctggtggtccagggggtaggacttcctttcactgccggggcccaggttcactccctggttgggaaactaaaatcctgcaagccacacagcatgaaaagtgttgaaaagaaatcaagtgtacaacattttgacataaggat

SEQ ID NO: 64000 - DNA, 1497 bp, Bovine  19866880518192
attccccacagttcataccaactaagtagaatttcaaggccccaaattctatccttaaagaggtattttacattaaaaaaagagagagaaaaatacacagtgttccttattcttcagacagctttcccagtcaaatctcctgttgcttattttcctttcctctgcactaatcatagagctgtttcccaaatgagaccaccccccaccccccacccaaaaaaaaaaaaaaaaaatcagtcatctagagatccttttatcaggtcacattccttggccttgcctcaatcttactgaacgaagaatctgggaaaactggcctcagcaatcagtattattttaaaaatttctctaagtctaacgaacaacaagatttaaaaaccactaagtactttgaatatgcattataaaccaatgtcttctggaatcaattattaaaaagttacattatggacatttctagagttcaggaagatcaaaacctctaaatgtcctgatgaaattaagaagttgggtttcttttcattcattaataaactatcaattttaaatacaaaaacagctctgctataaatactcttgtttatatgcgtgacatcaagcttaaccatctacacatcctttcgtcccccatgggtttcctgtttagttttttattagtaacagtatagttcagaacttaaaaaaaaaaacacaaacaaacaaaaggaaggttttaatgttaagaaaaacataagacaacagcaatacagcttagatcatatattaggcaagtaacacaacagctgtattattcagcattaccacatgtcagaaggctagtcacatgtgttcacaaaattgtaacagcctatataagaaaatcagtaaaaaaaaaaaaaggggggggggaaattctttggttttaaaataaaaaccactagattaataattttctctaaatgtgcacatgacaaccaggccaccatgaccaaaatattattgtctgacatgtaacaaaacatgccaagaaactgttgattattaaactcaaactgcaagaaaatattaatgctattcccaaaatacagcatagctcatcacaaaccagaatcacacaaaagacaagtcagttacaggtgttattcagtctcattatgccaattaaaatagtcaaagtttgttgtagtagttaaaatctaggttaaaagaaaaaacaggaagttttcacattaacgcataaaatagggctatgaaaatcagcactgtgctagaatgaaagaaaaagatgccttaatatgttaaaagtgaagttcctctttgcctaaagaggaaataactggtctaaatcagaggtcaacaacattggtcttgagcaatgctaggaaagtaagtcagtgaatgccacttgggagacacaaaagagaaaaaaaaacaggaaaggacacaaaaaattcactggagaagacagtgttaagaaaaagcaacagaattaattatagagccccttccatacaccaa

SEQ ID NO: 64001 - DNA, 1468 bp, Bovine  19866880554680
aagggaaatgtccggccccccccccgaatttatcagccctggagtcaacttgaaggtataatgactccatttgggatcatatcaggtctgaagcccagtggaaccaatgtatcatttcctttctactgacatggaaaaacgtaccagttatagttttttagtatagcagtagtagcatttgtggcctgatacatacaccaacatttttccctctgcccctaaaatattctgctccaagggcactggtagatctcgaggcctgggatttttgactgatctgatagcagaaaagtgcctatgaagtaacttgggtgagtcggaggttcaaacgcaaccctaaagacttgctgcgttctcctactcttcagactgaatcagtcccagacattattataatatcatttttcaaagctctataaatagatagattctcatttctcctcttaagcactgtttgctaaatgttttggccccaaagttcagtcatcccatgcaagcattaatcaatacaggagacattagtggtcactcattctgatgagatctgacattattcttcctctgcctatgaggaggggaggggaatgttgcttaataaagacgaaggtctttgcttcttttgtatgaaatgcaaatgatgaggacatgtgcgatatacatttcttgaatgtgaggctgctgctttttgttgagaaagagaggcaaggccctggaggatttcagaatttgtaaatataaaattatctgccttcgtgtttaaaaataataataaaagggagaaagagttggcaggttgccggattacttacattacagtaatagatttgctgacccttgacttctgctgtagagaaatgtattgaatttttcataatatcagatgaggcagatctaaaaccccagtatactgagcaccattatttaacttgagatttaacaaagccgaaatcttttcaaaccagcaatttcttgtatgatgataatttagtggctcagatgctaataaatcaaggttataatgccattgatttgttaattttaacttgggttgattgtaagtcatctttatttaaggaaaaaaaaaggagaaagaagaaaaaaatcttgcctttcacagcaactgaatttaataagaatctccatgatagcaaaaggctcccctactgtttctgctttggggtggaaaatgttgttctcgtattattcctagggaaaaataaaatctcatgctgctacaaatcttatgcctatggaaaaatgttattttttaatacatagtggcttacctttttcagatccattaatggcatcgtaaataagcattttgctaatctgaaatgtgaaatctgggtaatagtagaggcccatttatctgcctagctttcaatcctcagactacattagatcgggggcggggtggggtgggggccggggaatctctctggatttcctaatgaatatattgctt

SEQ ID NO: 64002 - DNA, 3820 bp, Bovine  19866880567423
tataaagacttttctcctgaaatttcagttttgtgtgaaattactgattacaatttcccttgtcccattttctttttagtgtgtgaccaatttaggcagagttggtttatgtttcttgcaggtaaagaaacctaactcagtaatcgactcagagactgatagagatttatgatgattaaatctcctctcttcctttttccctccatcaaatagagttgtctcatgctgctttatcatttgctgaagtttcccttttgggtagaagcctgtaatcatcttctcttggactagagcattttggagatctacctgaggtggccagagaatagtcaggagaaatgacaaggtaaagaaatctgtagactaattcaattgtgggtcaatggtgtcctttcatacctggcaaagaggaaaactgagctgtgcaaatttctttctgtgaacgtggcaatatgagagatttggcatagttattctaccaaaactaaccagattaaagaaggacaatcaattaggccatgaaattaagtatatggttacaattttcttaagttgtatgaggggaaaagatagagtgcagatattagagcaaataaccaaagcattgtctcattctttcatgctcaggatatgaaaaaggtcagcaactttcagaaaggggcatatgacatgcttagtctctgactggcttctttgttagcattattactaaaaccaactgaaatcaaagaaaacactcactaatagtacaactgatcagcactgatagcattctgattaagtacttgccacatgaaattcactggacttctcagtccacttatggggataaaactcaagaatccttcctactttctccaaaagttcttggggttgggagcttggatttctctgactctgatagctttcttccattgatttttttttttaaattttaaataactgtctctgagatttttgtcatttacttgtcacaagtcagtgcttctttggtttattatgagaagactaaggacacaaaatacagtgtataagagatttgggcaaagttgagtatgtgtgcagaactgagccagtacacagaacagggaacattttacatttgcatttttgcaagataaatgtctttaatatggacacacagcatccatggtccattaaaagttttcagctattcttgttggctgttgttcttcttgctgccatggcctccaaacctccatcttgctagctttcttctctcctctctaccttgagcactttgctttcctgggcaatctgctaaaaatttgtgatttaatacttagaaccacctatgaatgacctctgttattaatgtcaggtaaataaatctgacctaaaataatttggggttaagaattagcagtgcatgttgaggctagggaaattctttggtctaacatgtcaacatctgatggagcagccagaagacttgtaccttcctgactcctaggtaagctggtagaacctaatatgtgtgtatgaggataagtacaaggagaaatggaagttatcaaaagtgtaaaaagaattttttaaagactttttgagtattttttaaagaaagtttgatttgtagatttatatatagaatgaactagttaggaaaataattcaaaatctagggacagatgccaagagatggaaagaaaactcttcctccttctccttcatgtttgtcttcatagaagagccatagcttgccaattccttttctttttaagactatacattcaacgtgtatcacattcttataagacaattagttctgatttgttgtgcgtgataagtcacttcagttatgcctgactctgtgcaaccctatggattacagcctgccaggcttctctgtccatgggattcttcagaccagaataatggagtgggttgtccttctccagggagttttgatttgggagacaactttgttatttatatgggatagaggggaagaatttcttctaccaaatttctcctatctaatgttaaatcgtatatttaattgaagtgaatattctgctcattcaaatttattctccaaatgagatagatgagagcttatttataataatgatgataataacaatggggactatttctcgcacttttatggtatggcaggcactttatgtaagtttcccagcaaatctgcaacagagattgttattacatctccatttttataactgaagaaaaggaaagggctacagaacagttacaagacatgctcaaggtcacatcaagcccatatgtggtcaaactgtaatttgtgtagtgaaggctggcattgcatggatttcattccttagatgctgctgggaggcttggaagcatgattctgcatgctcccatggttgattctcttggaatttggtatttgtatcatcagctagtgaggtggtcactatcaaacctttattttctgttttatagttaatgattccattttgaagaactgagataaaggagaaggataaaaaacttgtcacacgagaatataatcatagaaaactttttaaaaatttccttaaggatgaataataagcaatgcagaaatctgaggaacagatatgctgactgacttgctcaaggtcaaacagatagttacataaacacattttcctttgtcaaagaagttcagtgttttaagtagctaatttattttaatgttgggagatctctataaatcttactgcattacttagataaataattttccacgaaaattgtttttcagtaattttgtttggctattttaatgggtgtttttcataatctctaatgctgaatttctcatcaattcagccctccagattttattaggttttgtgtgcttgggaaataacaccatcaaaacagagttatcttcacatatgcaagacaattatattgatatatcatgtgctgtattttaatttcaaaattattgcctcattgttttttcctagagcccagttttatttctttcctcttatcgttaaaggtacagggacaagtaattcaccctttaaaaaagaacagaagagaaaaggtttgtttaaaaaaaaaaaaaagtagctagaaaaatctcccacagagtgaattcccacagtgttatggaggatgtaaatttagcccagtgtgattcaaacaatcaagttaggaattttaatttaatggtttgttcctctgaattgttagacgctcacctcattgtgcaagttgtgtttgaattggagaaaattaaactaaaatgtgttgaatttgccccaatcaggttattttgggaggtctgattcacaggctgagtgatggactagaaagaatgaatcaacaaacaaaagaaaaggaggcttaaattatttcactttaataatgactctattatctctcaatattttaaaatttaaatatttggtttttgtgatggcagtatcatttcagcagtttaaataggcttggggaattatcttattttcatttcaatacaacccagaatcccatgtttctggtatgttggtcagaaacctcaatggctcacagattaaagggtttgtgaatcagtttctgccgaactggcttggctgtggcaaataaaatgctggaggagaaaaatatgttggatgaaagaacagacgagaatgaaaatcaagttgttttttttttttttttttacgatattttagggaatagtccaataggccaaatggatctaaacaatcatggctcatgtttggaattacaattgtatgatttggttaaaaaaaaaaaaaaaacaacccagcactttactggaaagtaagaaaacacttttaaaaag

SEQ ID NO: 64003 - DNA, 1860 bp, Bovine  19866880598159
tcaatttctaatccaaactatttaaataaatgtttaagtggaaataaatttttactctataaaatgtaaaattttaatgtcaagatcaactacctaaagaatccattgtgatcaaatctgaataatctgaaaaaatcactttattaataagaacagtagtacttagtgattcagagaaaaaattcttagacaagaattatatcccaatgatattatacttatcaaacacaaagattttttaaattcgcaaagttaacaaaaaatgttcaatgtcctggatctactggatggatgatttgactattatctaattattggttgggttaattactgtattgcttccctgatagttcagttggtaaagaatttgcctgcaatgcaggagacctgggtttgatccctgggttgcaaagattccctggagaagggaaaggctacccactccagtattctggcctggagaattccatgaactgtgtagtccatggggtcgcagagagtcagacatgaagagtgactttcacttcacttcacttaattactgtataaattttgtaaatgtataacttagttaaaaattcagtttctatttaatagaccttttctagaaaacctgaaataaaaaactaaatgctactgaataaagtccctacctgattttcaagtaatcaacaatagcactggcttgtttcacatcaaagatattccatttttcatttttgtgtgatggtcctatttcagccataacttctccaagccattttatgctgtcttctaaggacatatgcagtgctgaaaaaaaaatccatagaagtcttaagcattatttttatggatgttttggcaacaaaataaccaaagatgtccttaatgtgtaaaaatttcagtacttgtgaggacaaacggtaatactactgttgtttgtttatgctaataattacattttatgtaaaagaacagcaggtgacaaaccgaacaacagtaaattaccataaacactattcaaatgtctaaagagtttgtttccattttaagatgggaaaaaaccctcaaaaaattactttagaatggaaaggaaaatctttttatgatcttagatcaagagtatagatggaaatgacccaaaggttggttagattatgctggtaaggaaggcctacatggtagacttggccatggtagacagcaaaaccaaacccagagctgaaaatgtaaatgaacagagttagagttgactaatactcagttttagctgattgttaccatgtgggaatttgggcctgaagagtttcaaagacaccagaaatatggatttttatgtaaaacatcaagacttttcatttttcttttccaagctacagacatacatatgctgtttctcaaacgtatgcctgatggtggtggtgagagccagatgacagtgcaaaaacagtgacactggcaccactttgtcaccattacaccaaacaagtcaattatttcactattaaaagcaaacaaccaacaaagtaaaactatttcctaaggcattcagttgaaaaagaagtaggtaagtgtcaaaagcatgagacttaaacttttacaatgtgtatattacaaatattaactttcatcttttcatatttttacttgtggcaggcaaatacaaaatacacatacacagactgtcatggctccctgcgtgctgaggatgaatccaggtaactggagtgtctcggttgtcctttgctgataagtgaagggtgtatggacatgacaccaaagagcatgaagctggagatttgaaaggccgtctatggggttacacagagtcggacacgactgaagtgacagcagcagcagcacagaggaggttggatt

SEQ ID NO: 64004 - DNA, 1509 bp, Bovine  19866880610106
gacatacagatccgcccatttgaagaattaaacttccctgggctagaggaaatgaggcggactaggatttttcacagagctctcagtacctcacttagcaagataggtagctggggttagctctacttttgggacaggtattattaaagcaaagggatattctttattatgtctccccaaccctcacccactaccctgactatttatttcctaaaggaaatagagtggcaaaacaggaaggcagggggacagtgcagaggagataaaagataaagccaggcttagattggaaggagaaattcatggagtggggaactgtacccttgacatcaatgactaatgaggtacactgccttttcagcatccaaggcaaagaggaaactggagtcagggttttccaaaacacctccatgatttttgtttccttgtttggtctcctaccacctgtaccactatttacttaacattttttccttaaatgaactcaaatttttactgaaataatgtttaaaggaaactttctatcacttgtaaatggaagtgtagtaggctacaaatgggaggtaattgcaaaaataaataagataaaatgaagctaacttactgagatctggtagagattaactattaccttccaaggctctgtgcctcagcttccctctttctgggaaaataaaaacatgctgctgctgctgctgctaagtgctgggaaagattgaaggcaggaggagaaggggacaacagaggatgagatggctggatggcatcactgactcaatggacatgagtttgagtaaattccaggagttggcgatggacagggaggcctggcgtgctgcagttcacggggtcgcaaagagtcggacccgactgagcaagtgaactgaactgagtcctgttactaccaagcaggaatactctcttgcccacattagtaaaattaaaaagtataactcaaagagaatatttcttggttaggtttattcaactgaaagtcaccccatagctttcttaaaattaggttgaaatttctaaagtatgtgattactgtcttcattaggtgagaaaaagatccaactgcttaaaagaagttcacttatttctggtaatatgattagggagatttcttttgttcctgtgggtctacactctcgcaaatcttagaggaaacccagtagtgatatcctggagctgtttcttatgtgcccttcagtgtaggctgatggcactgtgaccagcgactgtacaggagtgatgatgagagcacatagagcatacagtgggaggtagcagggtatggacacaggagccctagccctgagtcagctggctgtcagctaaccctaaccctaaccctaaagaaagtcagctggactcctggctcagccacttagttgcactgtaatctttgtgcctcagtttcctcacctgtaaatggggtatgaagcctctgactcatggggccattgtgggtatacaatagtaatacaggggtccccagactccagg

SEQ ID NO: 64005 - DNA, 1876 bp, Bovine  19866880622363
taggccagcaggtatcactgggggaagaaagaaaaaacaccacttttccatgattctcagtaagaatatgtgatacactataccattattggtgtggggagtgagtgagggatgtgaatgcattcacagattcatttgtaagcttattcacattgactgaacccatgaggacccgccattgggtgggaggccacactggggaaaggaagtggtattgagttatgtaaatgtcacaagacaaagggaacagtagctcacaggtggataacatttgacccttaaggaaggtctttcacatcatctcttgaatcctgcagcagttaggaagggccggtagtatttaccccattctagaaatgaagaaactgaggtttagagaggataagtgatttttccaacaatcttactgcttaatatcagagtgaagcttcacatacctacacgtgttctgacctcagggccttttccatatgtgggagcttcttgctccagcaaaagcaagtcaaaagcaaatgacagatgccaggcttagatgctgcagacatcagtctttcccagtgactctcttcaaaagccacggcatgaatgaattctcacccatcaaaatcttagaccaaaaatggacactccttccccatgccctgatccaagccaccaacccagttgctcatcttcactgggaacctcttccctggaagctcaacgtttatcagaaacagctgttttggttttcttttataaggtaccatttatttccctctaattttaaaagtattacaaatttgttgttttaaaaatggaaaatactccctccattcaaagatagaagtgaagaaccctgtgctataagtcatttggaatcatataatacaggtgtttccgtaacgaagtctacatacatgggggtcataatgctattctgtttcatagccttcttttttcactttatatatcatgaacacattcccaaccattaattttttttctttttttaactgaagtatagttgctttacaatgttatgttcgtttctgccatacagcaaagtgaatcaactaaatggttacatatatcccctctttttttgattttcttctcatttaggtcaccatagagcattgccaaccattaaatatttataaaaatattgtgtttttcgtctttggagtaagtttaatctactatatggaagcaccattgtttggtcagccattttcgtttcgatggcacagtctgacttcagttgttggcttttcctttcacctttgcttataaaggaacaggttcccatgccctcactgcttgtcctacatgtgacgtgcctccccatctctacttccatgcatctgaccagtcccttagacttgctgccttaacacctcccttcttgctctccgtcatttccccctttgggccaggctctcccacatctctatgctgtttactgcacttgactaatttattccaagttaataaggttccttgtgtgcttaatctcaaatgtgccctacattgtttctgagtcttatttcttgagattgacttcatctgatcatctactttaatcatttactgattgtttacatgctgtgcattttcacataaatgaactcatttgatcttcccacaagctagctgtggtagacagttgggattttactccttctagcattccctcttctttcatctcataaccttattccaatttttgtctgttgaaccaccactccttacaccaagaccaagtgatgtggctggagtaagaggtacatagcaatgctatgttagcattgctaacaagcacatagcaatgaatgggtatcttaccaagactaaagccaaagagcatctcagattccctgagccgtagcatttg

SEQ ID NO: 64006 - DNA, 2054 bp, Bovine  19866880629679
actagaacttcagtgctgcacccgctgccaacagtgagagtatggtcttttgtattaaatactgaaatacactcacttaaaaacaaaaaatccaatgcagtatcctgcaacgatgctatgaagagtagcaatttgaatttccattatcaattaaaaaaactttctgggttataacactgtcaaataaagcagtttcttgggaatactttgtgaggctctttcatagggttctaaacccaacttaatttactacgattacacctataaaaacattgtaaatttcaccgaatggccatatgaaaagggactctgtaaagtgcagtgcagataaaaatacaattggactagaaatatgactaagagttggtgtgtgatgtgacattatctgaagatgcatttgtgtgatcaaagatgggtgttaagcatgtgggttgaagctgggacggtaactgatgatgtgaagagcagccatcaatgtggacttgtgttatacttttcaaaggagcaagtgatacggcccgtttgctcagctgtgtcttgacttcatcccatccatggccattatgaaaaacacacccagacacctctacttggacctcacaagctctgaatgtgaaaccaagaagctgagtctgtctggacttctgcagggatatgccagtgataaggatgttggtatgacctaaacaagtatggactgaaaacacagaccaatgataacacatgatttatcctaactggtcttcaattttgtggggcacacagtcctaatgcaaaggggaaaattcccatggatacaaccctcatagtacgctaatttggcattatttcttctttgcattattatcatcacctttctgaaagaagctgaaattattagaaaaccaaaatacacagagcttggcaagaaaggattccctgggtcaaaagcacagaagaaaaacaccaagatggggaaaaaagacaacaggtcttatctaggaacaattttcttattaaagaaatacttactgttcaatattagtactttgaacattaatacatttctatgctaatacagtcacatggcaactccacagtaataccgcagacctgtttgccagaagctgaaagttctcatagtgaatgaacctacggagcacacagaatatactgaataatccatgcttgtggttgggggggagtatcagtattgtcagacagggttataggataaaaccaaactaggagaacatctaattctattagcgcctgtaaccagagaaagccaggtcccctaaaaaccacacggcggtgtgcaaagtaaaacgccagggatgcttcccgtttcctcaaaggtcttacgcttgacgcgttcactctgaattcacacactgttcgtgaagcgccgacttcccacgcacgggcgtcttacctctcgtaatgcctgcgggtgcacgtggcggcgctggtgctcccagggttaccgcccaactcatcgtaaatatgcttccactggcggcgggctgttatctgaaaaagtggcaatgagaaattcagtcttgcaccgtaagagattcgcagtgccaggattcaatacatatgcaacagtcagaagagaacaacagtctgtcctggcaacccagaaacagagaagtccaaatgggtctgtggggagactcctgggcttccgggaagatctcacttttagcacttcgctttacagtgagaatggaattccgctttgggctctgtatcttgtcacccttacagcatttttatccaagatatctccctgggtattcatgtagttatttgcccccaagatcccaaatgcatactctgttcctttatgtaatgtgattaaagcatcaaaatacagatttcagctaaaatatgtcttagtatatccatttaaatgaatcagaattaacactggttacttgagggatatggtaatgggtggctgagtacacaggtaaacacagaatttccataaaacatacttctgtatcttctgatttttgaactactgggatgtgttacctaaattactatacaaattaattaaaatg

SEQ ID NO: 64007 - DNA, 1835 bp, Bovine  19866880648809
cattcccttatcccaatacagaatatgcccaacattaatactttaatgccaaactgctttcattttggtcagctattttttctaaatttaccttcctaaagataatttttctccacagaaattttcgtttgtttgtttattcacagcccttagccagtatgccagttctccctaaatatacagcaggaacaccatacttattttcctttatttgttatatacttacttgttgactaatatgtttgcaggtcttgctacatgctagacactactctgagctcttaaagaactatactcattgttttattttcagttcacttcttccaaaaataaaatattatttaccttacaaagttgtcatttcaacatgacataatgtttttcacaaaatgattgtgtcatgacatttagcaatttagctctgcagtggattatatttatttcaattcaccattagtctaaaaataagattccattttcctcttccccaaaatggtatgtattattgttttcttattgaaaaagtaacatttgttcattttagaaatgtataacaatagaaataagtaaatggaagaaaattaaccataatatcacctaataccctgcatagcttttctctctgcatacaataaggattctaatcttcaaattatatgcataaatctgaagatagataatatttaaatgaagcaaaaataatgttccaaattactctgaggtgaactgcgatttattttgtatttcagttctcagtatttcctactctacaaaggcagagtggaattgtcaggatatactagacccaagtttcaaaatctcatgttaaactgcctcaagggtcctcaaaatttctggagcactttttaataaaacgtttattttcaaggaaattaaaaaactaggtcaagatatcctttcatgcacccctaaatcctatctaacaacttaaggactgtcctccttacatgtagactggtttcttgaagtgggccttaacatccagggtttgcatctgggctgctcaggaggcctccctgttagcacagagagagagggcaaccgataggatggcctctagctaccatctgtctctctgccacccctcagaatgcaccgagtgctcctgcagaacacacagcccccagatgcctaggaagcctcttatctgcacctcccacctagagccctttgcctgtgtctgcccatgagaggaaggagttgaggggaggaggagaggccacaaccaaatggccataagctggtgagaatgccccacaaatggagatctgaatacgaaatgtgtatgtttcaataggtaccaagaccacgtgatgggtttgttttgtccatgatctttagcggggaggtggctcaaacggtcaaaaactgcttggaatgcaggagacgcgggttcaatccccaggtcaggaagatccccttggagaagggaatgacaacccgctccagttttcttgcctggagaatctcatggacagaagaacctggtaggctatagtccatagggttgcaaagagacgcaactgagcaagaaaacaacagactaataatgagaacaaaaaagacaggatttcaaataagtcaggaatacctattgtaatggaatttttaagcgtttgaaaaatgcccacatttaggttttataaaaaggagaatacttgtgaaggtgaatactagcactcttaattagagcttttgtgattttgttgttgctgacttttgttttttaatttttttttttttaagtttatttggctgtgctgagtcttaattgtggcatgtgaggtcttccatcttcattgaggccatgtgaa

SEQ ID NO: 64008 - DNA, 1278 bp, Bovine  19866880652620
aagccttgaacaagcagcgtttgtgtttggattcagttttaccttagtcatgcctctttccagatacaagaaacatttaattccagatttcctgcttctggcttcaggcctttgaccagcaaagtgaaatgtattttttattgctgccgtccagccagctgctgagttgagtgaagggaagaaaaaaaaaaaaaagaaagggaaaagaaatgaaatagaaatgttgccctgcctcttcaacttgcaacactgtataaggaaattaaaatctccctagcacccatctagaaagctgggttggctcaggactctcaggacccgtgggagtgtggcgactcttggtgcagcggccacgttattctgttggtctctgcttcctctcctctccttccccaccctcaggtaatgctgacgggagcccctcatggtgtcaccatctcaattagggagtggagctggaggggagagggtggtaccaacaaacaataaccattgaaatacccaggcttcaatgctccttgggttcccatggcaaccaaacaaaagtaaaacaaacctatctgtcctaacaataaaaatgtgttttcattaaagtcaatttaacatattcttcctaatttaaaatattcaatgcattttgctcctggacaaaaatccccaacctgccactattgaagggaatgaagtcgctggcagaactatgcagataaaagcaattaggggaatgttggggacttcacagatgagacggaatacattcaagtatgaacaggattgcttttttctctcttctgcttagttatgctttttattatataaacattaactgtaatattacagtgggaagcaggtatttggcagccacatattattttagtaagtctgcacagagagaacagtttccagttttagcagctgtaacatgtttaaactcagtttgtaatgggatctgaagataactattccccatgggctgtgttgatcttcatggctggcccactgccagatgcagggctcgaaactattattcacgccttcttgcacataccttgtccgagcatgctcagtaaatgaattttctgtctactgtgctgtaaattgggatttgactttcccataatttacttggtattttattaaagactgaaatattacgatcacaaatatccccacatttgtactcacaaacctgaacagttgtgtatgtttaagtagttaagatccaaattgcatagttagaaaccaatatcagaatagctaacaaatattcaaaccaaa

SEQ ID NO: 64009 - DNA, 1320 bp, Bovine  19866880664140
gatctttcctcttcgccttagggctagtgacaaaaggttgagtttgctgctgtataaaactcactccttaaacctgagtgacttacaactatatggattaattaatattagttattggttgtgatgctgcttcctgatgtctattctgggattcaggtgatagagaagcacaaactagctttaaaagcttcttcccatctctttcatgacatttcagctcacatcttattggctcatgtaagtcatgaccaagtataacttcaatgaaatgggcaagtataagccttcttaggtagaggcagaaatgggtgaacagtagtaacagaatctgtcaaaggtatcaataatgtcttccctgctgttgactgttgcagaaggatatggcaactcactccagtactcttgccaagagaattctgtggacagaggagtctggtgggctactgtccattggggttgcacagagtcagacacgactgaagtgacttggcatgcatgcatgtgttggagaaggaaatggcaacccactccagtattcttgcctggagaatcccagggacagaggagcctggtgggctgccttctatgggatcacacagagtcggacacgactgaagcgactttgctgcaggagcagcagcagcagcagcagcacctgttgactgtatgtggtgctcaccaggctgcagggattctcatcccaatataaacatacagatgatatatagaaatgatcttcaagttttttgaaatgttgtctgtttcatgcccagaattctgatactgtggtgttcactgaatcttttatcactatttctgaaactcaatgaaaattagtttttcttttaagaattataattacattgttttatacttcattagtaatttgaccttaattttatgctcaactacgtgaagtactcatcagtcatctctcatccagtgactctgccatttctatagtttttatttggatgattatctgtattagctggtactgagaaatatatttttcaaaaatggtacttgtaaacctgggacatatgcttcttcaaatgttgtctgtttgtgcttatttcatattgtcttgacatctgaatactaatttgagtatgtaatctctacagtcaaatctctccacccccccccacagtaaataccttttattaaatgcaattctaatacaaatgacatatggctatataagatacactaaatgacaaatcttcagttattataggcttcctttgcctgatattccgagtcaaatctcttctcctaaacttcattgacgttatttcttattccttcacatctaaa

SEQ ID NO: 64010 - DNA, 1484 bp, Bovine  19866880665360
actgggtcatgggatacccagatagttggtcgaacattattcttagatgtgtctgtgaggatgtttttggatgagattcacatttgaatcagtagactgagtaaagcagactgcacccaatctcttgtgggcgagcctcattcaatcagttgaagccctgactagaacaaaagtctgagtaagaggaaactcttgcctgactaattgagctgtcacgtgggtcttttctagcctttggacttggactgaaaccactggctcttcctgagtcttaagcctgcagatttttggactgaaactcagaccgttggttgtcctggttcttgggcctttggactgatgctggaactaaaggtcagttctcctgggtctccatcttgctgactacagatcttggggtttttcagcctccgcaaattgtgagatatatatatatctatatatctatatatatatctcctattggttctgtttctttgaagagccctaatacatggattaaacttaaacatgtgtcagatctgtaaccaataatattgtgaatagcacaaaaaaggaaggaaatttttgaaagctatataattcatcaaagaagttgctcatgtcattgatgaaagactgaaattcttggctacgtcttttatcttcacttttattttactcctcaacttaagtgaaagttccaacattcaagttggaactacactcatttgttaatccaattgtaggttacctatggatacaagaggtcagcaaagagttaacaaaaagcatcctctgagaagagattggctctgtggcatttacagtgaagagcgtggcatattttattattatttgtacatttgtgctacacttcctgtgtatcagcaaaatatacaatgaatttatatgccaacacacacacacacacacacacatatatatatataattttattggatgtatgccatatgtatatatctgtatctacatctagatatataaaaactaacacagacatacctcttttggtttgggaagctagttaaatatttagaagtccatgtctgtctaaagctggtcttcagcctgactcacaactcaaacttctagagtgagggttggcaaactgtagcctactacctgtttttgtacaacccatgaactaagaatgtgttttacactttcaaatggttggaaaaaaccactagaagcgtattttgtgacaaatgaaaattatataaaattcagatctcagtgtccgtaaataaactttgttggaactcagccacgcttattcatttatgtattgtctatggcgtctatcacgctaaaatggcagagctgagtagttacaacagagaccgtatggccctcaaatcctaaaatatttcctctcttgtcttttgcagcagaaattgcctgttctagaataggtaggtacatgccttgactggcagcagtaggatgtaaccaaatgaccttttgaattcttttcatgt

SEQ ID NO: 64011 - DNA, 2966 bp, Bovine  19866880713405
tttaaggctgagtcttgtattaatcccacagtgagtcattaatcataccaaatgcattataaaaactttaatcattgaagttgaaactgagattgtaatgcaatccatcccttttaattacatcagctatttttccctttcagatcaagcactatgtcgcaaagggaaaacagattaaaactagagctgtttgatgtttctctttttagagcaattttatgtactttgttttaaaagttatataattaaaatgcttgaatttttcagccctctggtttttgtggcttgaatgttctgtcttctttctctctggggccctctttaactcggtaccccaaaacagagctcctggtcctggagcccccttcccacctcagggctctggctaagacagccgcctctccactgggctgtgtttgccttgtgtgacctctttatcttaagcgtctggtctacattttgacatgaatgaaaacaaactttggatagggtaactcaggcaaattagtttatcttttttgggccttagttgcctcatctgttgaaacaggaataacaacagtaatactaatactccacagggacattgcacattgtggatattacatgaaataacctgtataacgtatctaggccattaccttgcagaatgtaaccctcaggggctctgactattactgttttgttcactgctgtatcttggtttccagaacactgcctgacacatagtcggtgctcaataaagagctgtgggcacaatggtaatgaatggcagcttttgttatagttgctgttattgtgatgttgctattggaatttggccaggttccatggacagtgataatgatgtgatttttggatgtgtccacttgtatccttggtgtacagatttgcaaaatgaggaagaggtcttttaaagaagtatataagttaccaggtgctggttttgaccgggaaagatgaaggcacttgataaattgcttgtactgagaaaaaacatgcacccccacagcatcgacattgctactggcattgccagcctggctgatcctctcttctgatgctctttcaggttaatcctgccgtatgaaaggtttattaaaggagaggaagataagcccctgcctccaatcaaacctcgaaaacaggagaacaattcacaggaaaacgagaataagacaaaagtatcaggagccaaacgcatcaaacatgaaatctctaagagcaagaaagaaaaagagaatgccccaaagccccaggatgcatcagaggtgagttgtgctcctctacagaagtctgtctgggaggtggggcctgcctcggggtctcctggaaccttgcactcaaagcctcatccctgcccaagacaacaccaggctgtgaaccctaaccatctgaacttcacaggtcccccaggagtgggccttctggggcagtgcgagtgttgaatgggataggccaggaataggatctggaaggaagcaaaaacatggtgtagaaagctgagtgcagaggccgacttcaagacagaaggagtcagagcttctgctctgaaagccaagggactctgatgtgaaaaatgtgccctttcacagccagtctgtctgaggagtgggtgactttaaaacactcacccgtgggatccgccgtgtctctgcagaactgtttgggaaacttagaggcttgtttgcctcttgtaactgacctctgtgcaacagccttgggttgagaccaatttagaaacatcttaagtacatattatttataggggaattttgaagtggttcctctgaaaccatgattatctctcttgttaacaggtagtttctgaaccttttaaaataagtcccagctacccacagcccccagcagccctttggtagaagccattactgtcagtgtccagccagtcatgggggctgatctgggctctgtttcaacatgaataataaaaaactctgctgcccatttaaaaaaaaaaaacaacaaaacttagcagccacatttggagacagcatgttctgagattcaacccctgagggaattttggtcctgatattaaacaccccctaaaaatcaggtttataatgaacacataagagactccctaattaaacattggcctaaaacacacaacacacacctcaatctcctaactagaaattaacttacccaactgacccctgtgtaagaagatattaataccaagaagagaaatttgtttttttctttcataattattttaaactctaataattaaaagggaggaaaggaaatgaggcagaggtttctaaacatctgcaagcttgcaatataaatggccaaaagcaaggaaattccaagttaaggctgacattccattcttccttgatcttgttggcttgctgatttattacagggcttgggatcagtgagttctattagataccatatgcacagcattgccaaagcacaagaggacaaactgaggacccagaggccaggtgacctttgaatggctccactctgggcatgaagatttgtgagttgagggaggaatcctcagccatgccctgagcccatcagctggggaaagaccattgtcaagagtcaagcctgatgccctgtgggccacagaaaccctgaaagccttaagactccctgtttcctataggccccaacaggttctctcaggaactatgcagtatctaagtgaccaaggtcattatgatcagggtacctaaactacttggaatcccacaccctctccaaggttgacccaacggtaagaattgcgcctctcatctcctacacagactcctgttattgagcgagtatatttcttttcattgactgatgttttggagtttgaattttattgtttttattgtcattgtttttttaatttttgatgttttcaatgtgaagcagtgaactcagtggaataaaaagcacttctagtcaaacccactatcttcaagtaatcg

SEQ ID NO: 64012 - DNA, 1257 bp, Bovine  19866880715697
atccaaaaccccaactgagtaaatcattgtaagtctatgcaaaaaagctgaattcaggtggtgttttcacattttagtgtacatgaactatctgggaacttgtcagagatataataaattcctgggccactgccttagagattctgaatcagaggttcttaaggttctctgccttcctgcattctcctgtgtgattctgatatgggcagtcccagaacattcttagagatgctgtctccagaatgaatggacatcgttcatagcatgtatttccatgacttgggatcagaggaaatttgctttttttttcttccaatagaaagaaaaggactcaaggtttgtttagtgttttatagactgtgtgaagaaatagagacaaatgtttcaaggatgagggaattaaaaaaaaaaaaaaaagtcatttctaagcacagagtatagccagggactgatttcatccagaagagataattaagaacctagagatggcatcctcatggagaatgaaggaaggaagtgaagtggtcccaagagtccaggtgacatcttctgctataaagccgactctgaaacatgcatttttcccccattgttcaaccttagaagtatgactttctccatttcaagaacgtgtaaagacactagtacagagctgccccccaccaccacacacacacaccactcccatcacagaagtgagaccaacaggcactgttatggtatttactgtgtaccagagatggtgttaggggctgagcatgctgaaataaatcctgggggttcctggttatactccctgactgtcatcttggatgatcttggacaaatcttggtcatcttggacaaatagagtgcaataatgtaattgacacattagaggctgcttcttcaaatagtactcagacactctggaattctgacgatgtttttgtaaatattttcactaacactttttttcactttatagaaagcacaaatttgagccagtgtcttgggctactgtagaaatctcaagtgggcatgccttgggatatgtatcagcatcttcaaattatttttcattggggacttggcttcagtgtaaacgtatttccatttaattaagtgtgccagctgatgaagtggctacccacaaacaaggcaggagtctaagcaacataaactgttaaaagatgtcatcttgaaagcagctaaacatctccattcggaagaagcctccagcctgaggaactaagtaacataattagaaatacatct

SEQ ID NO: 64013 - DNA, 701 bp, Bovine  19866880733401
gcttgttaatgagctcttgtggcagtgaacggggatcatgggtttgtcacatgaatatatgtgtatgtataaaactcaaaaagatagaagagttgttgctgccatgtggttgtgagaaacccaaaaacaattaaaaccttcctagagaccacatttgcacgaatcagtgcaaatcctacaagttttcaattctttaataactgctaatagtgaaatatagttattgaaaattatttttagctccacatgttacaccgctttaagaacttagactaaatactgtcagcctgtgtttgctttcctagcatgttattcatttattgagaaattcagaatgtaaaacatctgggaataagttggtgtgtgcacagtcatctttaaaatgtgtatatttcaggacttcttttgtgtatttatttagaaatatgggaaaattctgtaaacatgttctggaatatatgtagcatttgaatatgaaagagagagttggcataactgaaaacccaaatttcattttctataaatattactctgttggaggagtgggtttctgaaattagagaattcagattatggttagcaatatttacagggaagtagtatctctccctctttgccctggagtgaatgtgtgaaccagaaatgtccattctggccccttctggggtgtgatatgatgtttatgtctaaataaagaagtt

SEQ ID NO: 64014 - DNA, 1380 bp, Bovine  19866880773192
aaacctgcactgaggtcccagagacatggttcctgccctcacgaagtttccacaaagtagtgggagatcactcatccatggttgtaactcaaggcacaatgtagcaagtactatcaagaggagtaggcagtattctgaagcacaagaaaaaggtcactgaggtgatttgagctggcctggaaggaaggccagatggaattatcagctggcagggatgaaggagaaataccctcccgggcaagacactggttgggaaagcacctccatctatggttttatttttcatatgaaaaaatatgtagtgagcacccctcaaactgtagtgctggagaagactctaggagagtcccttggactgcaagaagatcaaaccagtcaatcctaaaggaaatcagtcctgaatattcattgaaaggactgatgctgaagctatagctccaatactttggccacctgttgcaggagccaactcattggaaaagaccctgatactgggaaagattgagggcagcaggaaaagggggagacagaggatgagatgattgaaaggcatcaccgcctcagtggacgtgagtttgagcaaactccaggagacaggaaagcctggtgtgctacagtctgtggtgtcggaaagagtcggactcgactgagtgactgaatgacagcaacgctgtgtgctaggcactggacgtactttgtgcaagccgagtactccagtatggcggaagtactcaagatctgtaaggcaggaatttggatttgaagccttcccaatgggcactgtcgtgtaaaagaagggagtgggtctggcagacatcactgaggtgcccccaacatgctttgtgactgatttaatatcagggacaagggagagttaagtactgaggacaacctccaggttttgagtccggcaaccaaaaagctggtgataccatcaagagataaatggaggaggagccggtttggagaagataaataagtagaaataaatgaacaagccgcagcctgtctgattccagtaagcactaagtgtgtaatccaaatattcctctacatcatgacataaaaatactgaatctgaggctctgtataggctggcgactgtgagtcttgtataaatagagaaaaaaaccacttgaaatttagtaacataggatagaacatctgtaactggactagagatgacctagttcaaccccctaattttacaaataaagaaaccacatctcagacatactctctactgaatggcagagccaacctaggactcccactacacatttaatggtgggatagcgggggtggaatccaaatttctaaaacattcaaatcggaataaaggtaccacctaaatttttcagagggaaggacagggaagcc

SEQ ID NO: 64015 - DNA, 1685 bp, Bovine  19866880780941
cctatttcccccaacccctgcccaatcagttatctggacaataagttatcacacacatatgtggacagctcagttcagaatcccattttgagggtctgtttcctgaggccactcctgttaccgattactatacagtccaggttttgtgacaaaaaggcacactgaagcttggtaattgaggagggcttaaaaaggtggttatttaccaaaaaggaggctgatttaggggaaagcaagaaggatggtttggcacactgttctcatcccagcatcaacctgggaggagagggagcagtttccagaatacagagagaagagttatgtagacaagacaggaactctggccttctgtaaaggccacactcaatatccagtgaccccacagggaggggagctgagagtaaaaacacacagcctctcccttcaaccacccacgtccacacagtggcctacctagaagtcagaaggtaagaagctattgataatttccaaaaacattggttttctgagacacagagaaggatagaaaagggcagaaagtggatctggagaagccaacagaaaacatcaagcaacaggccaaatatttaatgtaggattgtttatggtatttaaaatatatttaggaaatagctatgttcaattataattatttttatctagataactgattatgttgaataggtgactgcactcattttatgaaaatggcataattaaatattcagaactttagccagagtttatcttaagtaacatctcaagttttgaaaaatttacatttatatcagagttatgctcatttacatttaatcacattacttcaaaacattcaatatttaacaaaaataatgaagtactttcacttttcttttctcaattttgactgtaccttaatatacagtactgtacttaatgtccattttcataaactacataagccaaaggcacatatttggttaatgatatttatgaaataaaaaaagaacatcatggtgcttctgggtagaaagcataaagaatttaaaaggactgtaaaagtgataactaatttaaaataactgttataatattatttctattatctttttttttagtgtgtgtttggaaggtactatagttaaactgtgtcctactttgtttctgtttaattgcttgaacatctgtaggtaaccaatgttatgacatcctgcttaatttaaaagtggcctaaactgtctcatttaaggctttctttggtgatcctaggaattaaatcaaagcctctgcagaggaagtttgggacagtctttaagcatgcggacattagtcctcaggtttcatggttaaaaacttgcctccctcctttggttatgaaaattgttgatttaaagtttgtacacagttcctggtgtatactaaatgttcaactagcttaacttcccttctccctaaacgtttgcccagttaacatctattattccaggtatccaccccaaaaagataactaggctcagagaagccttctctgacccactaatcttcagattagaaagcactctctaatctcctttacaataatctgtagttttcctttacagtacttggcttgtaattatatgcctgtgtgtgcatgcgttctgttatgtatgactctttgcgactggatggactatagcctcccagggttctctgtccatgggatt

SEQ ID NO: 64016 - DNA, 1638 bp, Bovine  19866880804913
cactttcttggaaagtagaaaacacttttaaaaagcccatcaagggaaaagggacttgattataagcttttttacatgtctacccataaagaaagaaatgttaatagagtgagccctttaaaagtaaaatggagttcttacctttcagagattttaaaagttagacctgatggggaccttagggccacatgcattgttcaattgcatttcgaagatgttgagactatagctcagacatagcatgtgtcatgccaggggtcacagtggtactggctgagttagagaaggtatttcctttcttttcatattattatgttttcctggtttcctcttgggagcacttacatctcaaataattgtcattgcctttgagtccttttccttgaatttaatgttggtgttagtttacagcacgtgcctccgccctttggagtaatcatagccattgccatacattatggtggctcaattattccagccacaagcactgataatacagtagctcaggatcttttcaccaccatggtaaaaagacttatccctctgtaggcagacccagctcctttactgtggtaactgagccagaagtgtgcttcctcaaagttggagggaagacactgacaagggttagaaaaagcatatggtgctacataccacattgcaagcctttgtgaaaggcacgtctcacaagtggatgaaatatgttgatgtaaaacaattaggtcacgtggaacaaagcaaacatttgaatggagatgggatatcagtacagttcactgtactgattttaccaagagccccagaaggcaggaaacctgttctactgaagagctaaatggcttcaagtctcttgacttctccaaggatgtgtcttcatctgtaaatacagggtttggattaggttattactaaagttgctttgtgttttagcaaactccttaatatacaggtggccctgttagcatgttggaagcacaggaagaattaataaaattatatagactgatcatttgtttgatcctggttgcaatatttctctcagttaagattaacttcatttgtatggtttccctttgagctttagtcccttacaaaaatctgaatgcttttcagtttaatgtgtattaacaacctatttgttcagtgtttaaaatagtaattttgggaaatactttccagaatcctcaaacaagtaatccttaagcaccaacggagtgcaggtactcttggtactcaaaccacagagtttggttggagtcctcaaggggcgcttacactgctgctgaagacagtagagttggaattgagggcacatttaattaaatgacaaatgagtgacctagagaataagtacagtttgtagcctgtttttatctaatcacttaattttcctatattgagaatttctgatctttaaactctctttatcatggtttcaacaaatctattaagagttgactcatagcagtgaataactgtctctttgttttcttgagataattctcagattaaaaaaaaaaaatccttggcatttgagtccagtgatgaaggctgtgggaaagaaataatcccaataattatatctaaagaaatatatgttatatatagcgattttttcttggctaggttaacactgtt

SEQ ID NO: 64017 - DNA, 1650 bp, Bovine  19866880825267
ctccatcaaaaacatgaaggtacagcttttactctgctctacctgaaagggtaagaaaagtaggttagcatgtagggagtggaattaagtccatgccagcaagtgttcaagaagtaaaccttatatagctcatgacttacatcagcaaaaccctcctctccactctgtgctttcagaaaaggggcacacgaattctggaacatcataccctaataattttttaaagactgctgcaaactactgcttttaaacattgaaatattaagaattattctgcacccaaaacagatcatcttattttagaaagtgctttttcactaactatcacaacattcttttgcaaggagctggctaaaagagagtcaagttttttttttttttttttttttgcattgcaagtctgtctcctctgttctagttcaagccaataactcattttatgcagtcacagaccaagaattttgaaatttcgaaggcatcactggaaatagcatattctccatgatcctaaagacacatttcttgataacacattgattactatatccctaaatgggtatttctggtacattgtctgtctagcaggcatatattcccacctatttgtctgggtaatttctggctccagaagaacatatgggccatattcacaacttctaaccattttcagtgtttatctttattccatcaaatttcttcagagttttttttttctatttcccttctgtctctttatctcttcatttttcttgaatgtgctgactagtaatttgtttttgtaaagctccagttttaaagttggtgggataggcaagctcagaaatccacaggcagaagttttctttcttgctctgtcattatttaacgtttacaatttgtataagtcatttagcgcactcctgctttctattccccgtttagcaaatgcaatgagggccgtttccttctatcaacttagctaaaatatagtggcaatgaataatgcacatgaattactttgagagtctttggaaaaatctgagttcttgaccctactctgccaatagtctatttgatgcctgtgcaagtcactttgattattctttgctttggtttctgcatctgaacaatatgagtcatactttcttcctctacctatttcacagagatgtctgtatctcagaaggcaactgtgatactttgaaaagacaaacagtactaagaatttagggcagtatggcctagcttctggaatagaaataacaatagtagtgagtaataacagttatcaatgacctacctgtgccttgcattaattacatgatctcataatcttttaactgtcagtgcaacgtgggtatgctgtgctgtgtgctcagccgcttcagtcatgctcaactctttgtgacgctatggactttagccagctcggctctgtccataggattctccaggcaagaatactggagtggattgccatgccctcctctaggggattttctcgacccagggattgaacttgggtctcctgcattgcaggtggattctttactgctgagccaccagggaagcccattgtgggtatacttatttttacatgtacatcaggaaactaagatttggtgtgtgactaatttatggtcaacaaattagtaagaggcaaaaccagaa

SEQ ID NO: 64018 - DNA, 1673 bp, Bovine  19866880853539
atgcttattgctcttgttgtgaatggaatacatcctgaactctgaagggtttgggtgggctttaccggacaagtctgaatgggaaacctgggagccatccttcatctccttagagagcattttcattttgctgtccaacaaaagtttactgaacctttatggggctgacccccaggctaagcaatgtggaatactgacaaacacacaaaatggataaaatgcacagtttcatctaaaaattcttaggtctgggacagcaatggaaatgccaccaccaccctcccaccctcaccctttcagagctcatttggatggtaatacattgtgtcctggagaacaatcagaaaaccaaaatgacttggtaaatttgcttgattttaaaaatataatctcagggaggggaaatagtctgtctatgagacaaatggttaccaatcttaaaatagttcttgctttatttttacccagccaacaaacattctcttttagagtcttaacctaatttcccagagctgcctggcctatctttctcctctaattttaatgttctactcaagtctttaaggtctcagttggttaatgtttaatgcgttccacaaccagtgtttgatgtttatactttattgggctaaccaaatttgtagagcaaattaaaagtgtgcaggtctttggcaagccacattgagatatgtgttgctcagaaaccatctccttgttctatactgcatgccccaaatagtttcaattaactgttctctgttcttggcaatatatgcagttttctgcattgcttttggggagcaattaacttcctagatttataaacatcataccctcataccctttcagaaagcaagtcacagccgagagtaccacttctgtgtgaagtgagagtgtcagcaacaggtaacctattaagccagattgacccaagaccataaaaaagtgcacttgagagggagtgggggaagctgggaggggaagatggggggcagggcgagggaggagggagtaagaattgaagagctgatatttttgttcaagcagaaacacacacataatttgaagaaatcatacaaatataatcacacacagattaggtagagccattactacaatcacctgaagaaatatattatttctcttactcatgggtttaatttcagtctcttattttgaactaactgagcagcgtggtgtcatacaatggacagggtgggggaaaccgaagcttggaatctccagcctgctagctcaggtctcctgttgcaatgttgcccttaacctcgctggacatcaactacaccagaagagcactggctatgatcacttggagtggcttccacttcaggtatttttgggatgtgatcccatctttagtctcgtttttagtcataaaatgcctggggaatgggatatggggcttacactaatcctttatttttaaggttttttttttttttttgatgtggaccattttttagactctttattgaatttgttacaatattgctttggttttagattttggctttttggtcaccaggcagggattgaacctccattcctggcattggaaagtgaagtcttaaccactggaccaccagggaagcccctacaccaatcttcttaaaggacacaagtttcacaaataattgccccaaagatgacaa

SEQ ID NO: 64019 - DNA, 1501 bp, Bovine  19866880904212
catggagtagaataagcaggtttattgattgtaaaaaaaagaaaagaaaaagagccaaagattaattctctatgcttaagaggtcttcataaacttcataaattatagccatcaaaatgtcttttaaaaccatttccagagtgactctttaaagagcctaaaacaaagcactagtatcttaagttaatattctattgatattacagataatcgtattaagaaagatttaaatctgtgtatattgaatagttatcaaaaaatgcaaacatgagttatttcagattcttaagaaagcagatacagtgagcagtgagacaacacatttgttctaagtgtaatagttgtgatgcagctttttttcctcaacatccagcatgagctttccttttaactgacgagccgggggtttggaattggctggtggatatctgacatctggggaaatgaatagcaggagaaatgagttgcaaggtagctgtgaaagtcacatttgagccactgtggtatttgagagtccagttgttagttttgctgggttcgtgacttcatgaccagactttgcagctgggggaggaagcgggaccccctgtgtgcagtctgagcacctagacggcactgcctcctttagatcttaaggaccaagctaggccctcaggtacccactctgccccgatgtctctttacaaaatatttggaattccagtctttccacaggctcctgataccatggtctatagactccattacccccaaaagatgaataaccatttgcagggcagctatgagctgctgcctccatccccttacaggtcctgaaggggctttttcatctgagatggtccccctggcggaatctgtgggccgccagacagaccaaagtttgagaggtctgcaactgatttcagtcaccttcccttcttaagaattctctccatagtcaattctctgaagacccaaatctctcctcactctccacctcaatttagctcctagatattccccatcaaagtgatggtgaaaagcgactataatccctttcttctttgcccagtgcctatcatagacctccagaatatttctacattcctttagaattccctacatcattttgaaataacatatagataacatttggccatttaaatcctgtcttccccctcaaggcacagaggggaaataaagatagagatctgcccatcactggtggtaaaacctgactgaaaaagagttttgctcttgcattaatggcaagaacgcacggagtcacatggtttcagaccaattagcaatacagatgagctagcaagtcaagttccatttataggctgggggaagggggagaagtaaaataatctgtgttgttaagtgtttctgagaaatgaagacctccagggcagagagaaggcggatcaggaaatagctatgcaaatcacatgcctatgaaattactaaaactttgatcagaggcattaacaattgctccagcattcacaagtatgaa

SEQ ID NO: 64020 - DNA, 1550 bp, Bovine  19866880953341
tttttcttaattattcttgtcatttcacccataacactagtgttttttttttttttttttcccatccataacactagttgtctcgatggaagggaaaaaaaatagcttcttgacagactttcctttctacttttccaagtagctcatagaatgatcaatgaagtatccagaattaattaagaaaaatacacttctcagtgatagcattaaaaaaattctctctaaatccaagtgtgtgatcatggatgtgcagtggtggttgtctttgtgtgtgggtgtgtttgtgtgcacttcaaatgtatgttagctctgcagttgttttttttaaatcagtctgtttttttcttaatgagtttgtgaaataatcattggctacacttacattttcaagtacaacacctttcctctcttatgtacttttttctttctttacctcagattctcagcttctggttggattaaaaatcacacatagttcatataaagaaatttacatgcaaaatgaaagaataaggagggggaaatgccatttattttaggtctattgttaacttttctataaatctaaattggcctctagagtgatgtaaaatgtatatgttgatgggtagatatgttaatttattattatcattttggggggattgttacagtgcttaacagacatgactgaaaagtaactgaattacctacattagcaaaatggtattttagatgaagaggctctgaacaagtaataaaatcatagaatgaatgctttgaccaagatcatacatgctttcattggttgttggtttgttttataattgtttcatgatttaagaaatggaccccagagatcaattcataaattctatagctctccacaatgaacttagagcatctacagcctcatagacttgtgggaaaatgggacatgtatagttgattctttcctcatattaactgaaaatggtttctatctcaaggctatattctgatttttgaaaatgtttatgctttactacagaaacttcacatctttgctcataatctcttagatacactgaagccatcttaaatgttgcctactgtgatattttctgacacattgcttttttacaaatacttcttagtattgcagtagccaatttggaggattgtcacagaataccagcagaaaagaaaacttcaatcaaactctgttgtcagctgaacataccaacagagcagacgatctcattgcgacggtgagagctttctcattgtatgttaagggatctaacaaatcaccttttcatttggtgagaataccactttctatacttttcagctcattcttccctagggaaattcaccaattgtttggctcagaaagtcacaagaaaattgtattttgcactattattgaatatatttaacaagcctaatgggcatatatatcttatatgcattaataaatatatttaacttgcagtattaaggaacctttaacacttggatcagacgacctatgtacaaagagagatacagacaattctgaaggaatgatataatgaaaagattgggat

SEQ ID NO: 64021 - DNA, 976 bp, Bovine  19866880954145
attatttttaagggaagacgtatgtgcatagaaattttatattctgtattctgatgtatttaaaaatttctttctggggacttccctgacagtcccgtggttaagagtctgcacttccaatccaaggggtggaggttcaatgcttggttgggaaactaatatcccacatgccatgtggtacagcccccccaattttttttattaaaaataatgcacaatgtctgcccctttttactgtcaagagacaaaagggcatttgcttagaaagatttccagaagttgttatgagtttactttgaagtgttcacactgtcccacctagttgtttctgtgatcagaaatgtggatttatgaaacagcccactaggctccagggtgggcctttgcagaagagaaaagatttagcacttgaagagtgtaactcacctgggagaagatcgcacctttgatcgaggcttcattgtctccctactttaaaagggtgtccataccagtcaaaagcagtggttctgaggactaaaatgttgaactgtaagcttttttgcttcgcatgcacatattccaactgaacttgcttgaaaacacttgctttaaatttcatcaaaatgaggcgatctttctaatctaaactccttcagatggcctgttaatgagcgacttgcaaatactaaaattattgatagtggcttttagaaatcctctaaactctagaatttggtctctctccaactgtaaagtggcactgtgacagctgccatactccacagaactggaaagctgaatcagaaaatagacaccacaaagccttggtaagttcagagggctaaacaactcttgttggtaagttgttgttcatttgctaagtcatgtccagctctttgcgaccccatggactgtagcaccccaggctttccctgtctttcactatctcccagaggttgctcaaattcatgtccatttgaatcaatgataccat

SEQ ID NO: 64022 - DNA, 828 bp, Bovine  19866881013282
ctgtcattctcactgaatttctaatccaattaatagatgttaattttaatacggtttaatgggacactgccaattagtctcaggcacaaaacggggtattttgtgtttaatacgaaagcaaatatagcaacagtaaatcttgatttttgaacactgtaatttcaggaaggttgcctacattttttaacattaaccggaaattctgagagctcaaaaaataacattctgctagaagacaaaaatcagttgataaggaacaggactaaacaaaatcaactggctttgtgtgtttctgctacacccaggaaaaataaaaatacaggcacacctcattttattgtgctttgctttactgagattcatagatactgtgtttttctttacaaattgaaggttggtagcaaccttgcgtgaagcaagtttgccagtaccatttctccaacagcatttgctcactttgtgtcacatatttcaaattttcttattattattgttctgtgatcattaatcttgcatgttacttctaagattcactgaagactcagatatagctggctatttttaacaataaagcattgtttaattaagctttgttcattgttttttaagacataatgcgcacttaatagactatggcctattgtaagtatacttttaaatgcactgggaaaccagaaaattcacgtgactctgtatttcagtggtatggaaatgaacgtccatctccaaggtatgcgtatacaaacaaaccacagatgaagggtttggtatttctttgagggctatcaatagtaatattttcagactcaaattcagagggcagtccat

SEQ ID NO: 64023 - DNA, 1344 bp, Bovine  19866881031910
cccacttcccttctcagcaatgggatgaattattaataatatgctgagggtgtacagctctgccaagatttacttcctatttctacttgggctggtttagtattattttccaatgttctgaaattacatgtcagaatttatttgaaaacataataatttggaaacggatatcttgctaattggatcatctgtctctagctacagctcttttcttctctttgtaacatcctgatttataatgatcatctcacctttgcagatattgcagtatttaggaataatgctcaaccccattctgtctctggaataacataaagtcatcttggattatgctattattctactacctaagaattatctctatgcttccttcctgatcgtgttggtttgttgccaaagcggtgatttatgtttgcttgcttctagactatattatgcaatgctttcatatacagactgattagactctacacagaaaggaacacagttcagttaatcaagtatgttacataccaatccttgtttccttaggcttcctcatggcttcctttctgagatgggatatggaattcacaccaccaatgtaaaaaccctgaccattctcactgatgactttcaagcttacagagcttctgtttctagaattaaaatacttcttgtatctggcatagcaaaagagctgctgctattttgataactgaaaggtttaacagttgtacacaccagaactgattttggttttactcttgtcatttaaatgtacataatttgtacatacaaccttatccttatagagttgggcccttcagactgactggaatcaaggaaatatagtcctgcagaaggaaggggcttctcacattgtctaacatttctctgcaggcagccaacccttaactagcatccctgaccaatagctattcagcatccccatggtcaccttcaatgataaggggttcagtattggagacatagctgatcccactgttgagtattactagttgatgattccttcttgttttcaataggcaccaaagcttcatgtgcagtaatctctaccctgtagcctagttttttctttttttctagagcacttactatggactggatgtttgtatccctcaaaagtcacatgttgaaactctaatcccaaatgtgatgctattttgaggtggggtctttgcgggggtaattgggtcctgaggatggagccttcatgatgagattagtgcccttataaagagagacagaagcaattttgcttcctctctcactaccaaatgaagatacaaagagatggtcttttggaaccaggaagagggtcttcaccaagaaccccaccat

SEQ ID NO: 64024 - DNA, 1767 bp, Bovine  19866881037891
cctgtctaaagaatattaatgtcaaagctgtctctatgtttatacaaaagaagttttgtcacagtagattggttcgttcgagttactatagcttttaggatatgaagagacttttaatttccttactacttactactttcaggggtatgggaataagctctggtgacttgaatcgctttttttttttccacatccagttctataacatgggtatcatccacaataacaattcatttccccaaatgcttttatagtataaaggtttgcacagttaattgatatacaggtcaaattcccattacaacaaatagcacgcaaccaaaaactctctttttaataaaaaaaaaaaaaaagagagatgtttgggccctgggcagtacctctctaattttcacactacaaaagaaattggacctttagcagtaatggatctgactcattttgacactgagaattacaatgaatgcccagattgtgaattgggcagggtgggcagagttggaagtagaaaaaagtgagagacaaaaaagtattggaattgcatttaaagaaataaaaaatggcagaataaaggaaggtacagaaattcttagtctattcatgtaggaaatcttggttatgataataatcatatcatacattttcatatagttctttatttcaaactattttcagatacttttctcattttctcattcatatacccagcaactccttaagttagacatggtatgtagatttctatgttagagaataggaacctgaaattcagcaaggttaagtaatcttcccaaggccacacagctaatcaatagcagttctagggtttagaacctgggtcttaaaccctagttcattaaatcacactgcctttttcaataatgtgttttatgttttacaggaatttacatcaaaatcatctgaatgtttcatgatggaaaaggataatttaatttgctttcacattttccatttactctacaccctaaacattctaacctatgacttggcattcaaaaaacatcctgacctatttcatgacaacatttctcttagatgatcaattctgtaccttcacttctgaatctgactgggtctacacgaatggaaagaaaatgtttgtgacaacaattatgaccttaacttttcagatcagatcagatcagtcgctcagtcatgtccgactctttgcgaccccatgaatcgcagcacgccaggcctccctgtccatcaccaactcccggagttcacccagagtcacgtccatcgagtcagtgatggcatccagccatctcatcctctgtcgtccccttctcctcctgcccccaatccctcccagcaaatctatttatgaattggcacaattaaagcaatggaaatattctggtcttgaagatgtctggtttgaaccaaaggaatgcttttaatgcttttcagacataggccatgaaaaagtgactttttggcaccccgatcatccatgtaactcacttatatgatgctgattgtaaacagtattaccataaaaccaatataagtcaggttaggtcttaggagtttgttctgtgcaaaccaatacaactgccacttgaaataaagttgcatcaatttataacaaacagaattctaagaatgaacagggacctcgggtctttataccataatatgagctacaaagccatttgccatcatgttatcttatgctgcagtacagatgactatttttaaaaaataacaaggtgtctatggatttttagtgataagaat

SEQ ID NO: 64025 - DNA, 1281 bp, Bovine  19866881170665
cctaatatcttattccccggttgactttaaaattatatcagtcatgaaaattttttcactgtcttctgttgtgagtcattgggctatatttaattttaatcattaaaatgtaaaaataataaaagccaccaaatagtctatagtcaattttctgataaagcaaatttgttttttctcccatttgtgatttaaatggcctccagaaagttttttggaactaagtgttaattaaaaatatggaaatggatttaaagtacattacagcgcacagtggaagaataatcacaagagacttgttcacaataccatacccatttctcaatgtgttttttaactatctaggttattggttgtttttctgcatgcctgttcctagaaaaaaaaacctgtgattccagtgaaaacagtaattacaattacaacaaataggataaattgctatttgaacaggaacatgcagttttagccaccaaaagcaaactgatgctcctagactttcctgtttacacagatgaatttaagcatgttctcagattactttataaactgaatgctttttatatcttgccatctttaaaaacaaatttagtcctccgtgccttactttcgttagcttattctgaaacaatgccctacggtgctgtgaggaaccagtgaacaaattctctttctgaaattccctgagaagttatattttcagatatttaaatagtgtgcatatatcatttacttttctgaatctctagtttctcattataaattcaagagaaagatcatgaactagagagaaagattttaggggatccataaagaagcagaggggtttcacttgcccgtaaggattgggtatatggactttggagtcaaatagatctgggttcaagttctgagggaattccacatactctagctgtgtgaccttgatcaagttacttaacctctttgaactttaggttcttcccccaaaattgagatcagtaaaacctctcctcacatcatggtatgaattgaagggcctaatatttgtaatatgctttctataatgtcatttctaatgcctagcttagagcaagtttccctataaatgagagcagccttttttcatcatcagtgttcagcttcctggtcatggcgagcactggcaaaactccagtgggtaccattcaaattgttttgggggttgggggctgccaatggacaacccgtggaaagcaatgtgaatcatgccccccagagttaggcaacagaaaatctagtaatttttgatgtcactcccatccg

SEQ ID NO: 64026 - DNA, 733 bp, Bovine  19866881305950
aaaaataaagttttaaaaatatcaacacgtttggtttcaaaaacattaaaagaagaataaagaaagaacgctacctgtgtgtggctgcttctcaaatacccagatattaactctgaatgtctgtaaactctaacacttttctcattgacattcttctagtcaatgaagtagatagtacaactaagacagtacatttttcccgtgggactcaataaagctatttttattttgaatggaaaataaatacagcccataaattttgtttatttttttctgagtaatcctttccatttctcaaattctgtgattctgtattttgttatgtctttccccacccagaacaaaatactctaaaatgagctattctacaaatatcatatttgtagaaaataataaaattgaaattgcctaaaaatactctaaatgcttttgaatatggttacattctgacatcataggaaccctgtgaaatagttattataatcctgctttacggtgagagaccagtaagagctggaactcagtgcggtctaattagaaataccaagcttttcccaccatacctcttggcctcctcaaagtgtttcccgaactatggacagttacatgattttagggtggaagtcagcactaaggagttgaatattccttctttattgactgttggtaaataagttcatcaaggaacttattttgggtttagaactctctcaggtttatcaataattatttt

SEQ ID NO: 64027 - DNA, 833 bp, Bovine  19866881357629
tgagggccatccattgggcaaaaaatactatcaagctaccccatatttcactttgatgtgcttaaagtcagaggtcatttaaaaaactaattgtaaactacaagacccatatgtttccttttccctactagccctaaaacaataaactaagataacaaatggaattttgcaggctttagttagaagcctttatcttccaaagagacttgagaaggaagatataactgacctttccatgtaagaacgcatatcaactactgagatttgtctttcctgttggcacctccctacaaaagaagtgagacgttaaaatcagctccaacttgtccaaattaaaagtaaccttcaggctaatgggttttcaacaccactccttaccaggcaaaaaaaaaaaaaaaaaaatgtgccccataaaattaaattacctcctcgaaactgacttctctaataaattacaagattaaatacagtaaaattgaaattactacaaaacaatccccgccctgcccccaccagaggtaaccctcctgtcattggtagaatttcagttcagttcagttcagtttagtcgctcagtcatgtccgactctttgtgacaccatgaattgcagcacgccaggcctccctgtccatcaccaactcccggagttcactcaaactcatgtccatcaagttggtgatgccatccagccatctcagtctgtcgcccccttttcctcctgcccccaatccctcccagcatcagggtcttttccaatgagtcaactcttcgcatgaggtggccaaagtactggagtttcagcttcagcatcagtccttccaagaacacccag

SEQ ID NO: 64028 - DNA, 651 bp, Bovine  19866881370769
aatgattctcataattaaagagtattcgccacatatacagctcttaaaattatgatgccctttgtgatatatagttttggtataaaaaagtaagcagttgctgacaggttttcgtgtttgctgtggctatgatagcatttagcctctggcagtgatattctgtggactaacattgctacctgcacaattccaaaaatattttcatattagctgaacatttgtagccctggaaatgtcctccttttttcatgatggattataacattatgtatagagaaaccagtggcaggggcatggtaaaactggggtctttgtttaggtgatttaaaatagtcaacaagcatatgaggaatagttcatacacataaacgttagtaagtaattagaaatgtagaattgtaatgcctatgacctaatttaaggtcatcagggtaactatattttaagaaacattttaatttatatagaagaaatttaaaaaatcaaatactgattttggtccaaatataccttcattgttatttatttatttatagctgtaattataacagctagttttgaaaggtctaccctgcttgccttatctgatgagatattgtttcactttcacagttaagagaaactatttctgaaaagatcacattggtgcca

SEQ ID NO: 64029 - DNA, 2058 bp, Bovine  19866881376940
agggtgaactaaagggaaccttactgagttttaacataggaaaattcttcctgaagcacagttgggtagaaatcttgtttgccataaattcagcatgattttccataaaaagagtattatttttgacataaagcaaaggtcagagtttgggtgtgtgtttatgcccatgaacacgatgatgtgtgtaggtgttttagtttccaaagtcagggtcatgaggcaggttagggctacacaatgtcatggcaactaagcaagctgttcatttcagtccaaaaagtagttcaattcactagaaaacactcagtcaacaaagtttaaattaaaacacttacaaattatttgtgaaaagtagcctatttgtttaaagaaaggtataaaaatagcatagttttccaaaaggagattattatttaaacatgaaacaaaggtcagagtttggatgtgtatgagtgtgcatatgtgtgtgcatgtgttttaatttccaaagtggcagtcagaagtcagattagtactacatcaagtcaaaccatccaatccagttagtcactgcagttcagaaagtagacagtttactgggaaaagttaaaaaaaagtaagttttaaacaaaatatttaccaattcattgtgaaaagctcctggaagtttatctaatgaaaattattaatacaggtgttatttcatgagctttaacagcttgtctctatgtcatggaaataaatttgattaatctgatgagatacatttctcacagaaaatgttaatttctacccaatgcctgtatcttctgggtgcttagaaattgatttccagttcataataaaacttccagcaaaactgctaaatgaaaaactttcatcagttacttttcatttcataaatatgctttgaaaacacgttgttaattttacagaaaatcattaggctaaataaattaccttttggatacacttactaatggagtaaaataactccaatatataatttacttctaaatgcctcagagtttcaggaagtgttaataaagccctgacttcctgtatcttaaaccaaagattaagtctgatcattgctttcctgggtcttagtaaaacaaattttgaaagttataatggactttttggaaagggaatgacatataggcatatttacaaaattcctttctttgatttccaacttaaattaagaaaggttaggcctaaacagaaaaactataatgccactgaacaactgttacacagtactatttagactgtactcaaaggatagttgagaaaggataccgagagccagacttaaactctctagtttatgaagacagaacagagttgcaggtgacatatgatagaaaatctaaagattcacactttcttattgttagctttgaaaagccagaaaatactcagcataggttctggtcttcttctggtaagcaaaattggcagtagatgggaaacagcttctccaagctacaggcagttatctctgatgtgtgcttttaaccaaaggtggcgctgctgctgctgcaaagttacttcagtcgtgtccgactctgtgcgaccccatagatggcagcccaccaggctcccccgtccctgggattctccaggcaagaacactggagtgggttgccatttccttctccagcgcatgaaagtgaaaagtgaaagtgaagttgctcagttgtgtccgacttttagggaccccatggactgcagcccaccaggcttctccgtccatgggattttccaggcaggagtactggagtggggtgccatatcttgaggtaaactttaagctgtagggtatgagatccttcctttcatgtttttctctacatttttttttaactcctgaactggaggatgcttctctgtgttgggagtttatcctgttttgtgatttggtccctagcctgtcaggctcctctgtccatgggattttccaggcaagaatactggagtgggttgccatttccttctccattttaaaaggtggatctgtaattaacaataacatttaaaaaatcagaaagaaggaacaggaggaggagggag

SEQ ID NO: 64030 - DNA, 931 bp, Bovine  19866881412342
tatatatatatatattcatatttgttgctttatctcatacagtagaaagcttagattccagcccagattttatgattctattcaacacgtatagattgaggtaacacttatcatcataaatcacattaaatgaagtaggattgattcatggttggcatcaattttttccatattactactttccatgaacactgctgataccaacataccacacaaacacaccgcaatcataaccataaactaaataactccatactcagaatagatggctgttagaaaatactcacactaattgataatgacatcatgctgctatgcacattacaatgtaaatgaggcttccagactcatttatggctcttttattcaaagtttagtacttattagtttttttttcagggtttagaaggttcttcttaaggctgtgggattacttattcctgctaattttgccccttggaattggaccaggagtaccaatttttgactgtattttaaaacagatgcttagcagcaatgaaacagaattgaaatgtctaatggaaaccacattagtgaaagaaaacaagcaaagagaaaaactgattaacagatttactcaggcagccatttggctttatgaaaaacgtgaatcactctttgcatcaaaatataacagcttccgtgcttttgtctaggtatgtgtgaagagagcatccaaatgaacacttttctttggtgatatattttgaaaagtggtttaagatccatcttaaacacatctgtaaacttaagtgacttctcaggctcatatgaaagatctaggaatatgatacagaactctgaacttcccctagtgtttataaaacttagccagatttagcaaaacctggaaagaaaacaatgcttgatataatgcccaacttttctttggcttctattagtgatgatt

SEQ ID NO: 64031 - DNA, 931 bp, Bovine  19866881421310
atgaacttactcaacaatttgtgatggagaagcttttactttccagtgagtcaaaatcactcataatctattttctcttattcagtttgcaaatgacttaccttatgcccagctcatgctggcagcaggaaagaatagtaagtaaaattaaaaaattagctctttttctcagtttcttctccttcctccactctctcactcttgaaatctggtgtcaaagcttaaaatctgctttggcatcttagttaaggaagttaatgaaataacatcttcatcagggccatttagttactttgagtcaatgattaccagatttgaattttacaaaggagacatttcaggtttggcaaaatgttcggatactaacatctatgcatgactaccctccaaaacagtgaataaaagtctagattgtactgaaactttgaatcatgattttttgcttcttattttagcttcagatgttaatcttattctgcctgctttttaacacacatttgtatggacctatctgtaatcgtaacattgaactgttgactaaactaacattgcccaagggaaagataatgcaagtcatatgtgaattaaaatttcccagtaaccacattttaaaggataaaaagaaacaggtagagttaattttaataacatttaatgtaatgcagtatatccaaaatattttaatatataatcagtataacatgttagtaagggctattttgtgttgttttgtatattcttggaaactcagtgtgtattttatacttgcagcacatctcaattcagactagatgtcttgggtgctcaagagccctatgtggatagtggttgccatattggacaaagcaactctaaacagccctagaaacattttagctttcactgaaatacgtgggataacttctaacattttccgtgtgttctccatgtt

SEQ ID NO: 64032 - DNA, 1647 bp, Bovine  19866881488271
tatgttaccacaaacatttcctttaatctgaaaaatgtgttttttgaaaagccactcagcgcaaataaagctctaagtaaagcttctttttctaaattggtttaaattagctatattttttggagccttgaaaaaaatgagagatacagcattgagtttcgtcagttttttatatatatatatatgtatatattcttctctttctgaagagaagaaaggaagtcaggccaacagtgatttaaatgactttaaaaccaatctttcctctttctgtcttttgtttttagtggtttattggctgttggagccccttctagtgtgtaaatgaatttgtgcaaaggcactgatttagtgtatttgtgatttgtgtaaaggcgctatgcatttactgtgaaaatttaagtgagcttctatggttatagcataaagctaataacgcaatccacgtattttagccatgctttaattaaaggtgactatcttaaactgactgaattccaagtgtctgggcttattttaacttaatggctctatgtctaagcaataatctaattttaaactttttgtttattctaagtaaagtcaaacaatatgtgtatttgttaagaataatcttgggcaacacttgagatgatgtattccattagaaatgatttgggaaatctcttttgaataacctatctaaactgtctctccttatgatctgtagaaaaaagggataaaattaaatatttcttctattcaaaattaactgctgaacgttaaatattttccacatctatctactttggatttattaaagtaagtttcgaaagtgaggcctccctcttccaaattcttagagcattttaaccataaaaggcttaaaaatattttgcaatcccatgggcagtaatctgatattcagggattcttttttaagggaataaatggagtataaataagcttttaaaattagaactttatgtgtgatccaccatagaaaacattgtttcagtgcttatcatgtgccaggtacttgagatataaaaatggaaacagaaagcaaaataaaatttatgtagtactcccctactccttattttcccaatatttaagcattttctcctttgtttcttatagcactcctataagaataagaggtgttctctcagttttaaagattaaggacccaaaagactgttctatattgtaattagcctccaattaaaataaatttaaattaaataagtaagtaaataaagatgagggacccacagctcagtagagttatgtaatttgtccatggttctaaaggcagcagatggagactaaattttaacacaggtagagaaatggaaagaaaggcaaataataaaccgaccacttctgtttcattattaaaagaacacactcattcattcattcacttacaaagctggtgtctcatgtgtttttgtctatatgagcactggggatataaaatgagatcagtactcaagtcatactttcaagtcctgaatatggaatgaacatacctccatcaatatattcggcctactcagcctctactgtctcatcttttgtttcatcctcttttgtcttatacctttaaagtcaactcaaccattttcttcattgttgcatcccttttcccccaaccccgcc

SEQ ID NO: 64033 - DNA, 975 bp, Bovine  19866881665547
tctcaggaaacattacttggtatacacaatggcataaatcacatgttcgtgtttactattctgagccggtgctgactaaagttcctaataccattcttgggcacgtctctatatctaagaaaagaatttcaataagctcatctaatgattacattagctctctgcaaaccaaaaattagcactagataagtattgctgacttactctcaacacaacaggaacataaagaaatacactattattctattaatgtgccttagctctttgaacccagagccgaatcaatatttatatagactgagttgggacgctttctaagttcatcattgttttaagctgcctatttctgtcatttgggttttgtttctccaactgtgtagtaacagcatactcaatcacagattcctctaagtcaaaggagatcatctggtcatatatcagccagctcatgtgtgtggctggcctctccaagtgttgtacaaattgagaaattttacacaaagtccccagacttctaactcctcttataaaataaaataaagtgatatgtgaaaaaaaaaaaaaaaaacaacaaccagaaaacccctctcaaaacaggaaagttgaaagtgagtagggttgctttctttagatgtaaggcaagccctgtagtttgccactgacccccccaccactccctgtcacctcaaattcagcccaccgttcccgtacctgcccggccccttggacaggaacccatcatttaaacttccaagccctaattcatcccacctcctccacggcaatgatgagaacagtaagactcagtgacatgtcctactgccagcttcaggtggaagttggacaagaatccaagtttcctatctgccaacacagcattcatcctggactctggagccagactgcctgggttcaaatccctgccctgtaatttactcccctgggaacactaggcaactttaactttcttggctt

SEQ ID NO: 64034 - DNA, 1134 bp, Bovine  19866881752973
ttaatactaatttttcgtttttgcctcagctctaacacggctcaacacagagctgatcttagttcatttattttcatcttgaagaaagcctttcagagtgtggaaatggtagactactctatgttctctaaggctatgaaacccctcttaggcatctttggtgaactgtgctatatatttctttagtgaacattttttaagaatcttttaagacatatcagtgatggatacaaagatgccccccaaagataaaattctaaaagaaagacgttatgttcaaatgtgaaaagtttagctgacattagagaaaaaattcacagaaaagattatctgacaaaaaatagcagcttacaattttaatgcttctggaactaacagctaaaatccaccaggtggtgaaataaaatgagttacagtgcagtttagctcacatattctcctagtcagagatgtaattttacagagaaagtgataattacatatttacatttttattagcctattcatgaattttccattgtatctttaatttttacaaatgagaatgtatgtattgaaagattaaagatatttaaccaccttacatcctttctagtgcacggcagtgtgtaaacaaacagaagaaaagctctcatttaaaataggtccaggaattcaatttaaaacaaaacaaaaaaccagaggcaaaccctcctacaaaatgattatcttaatctatcaagttttagtagaagaacgaggcacctggtattagactccttagctagaattattattgtatgaaagattaagattatactcttttttaaagttcttatgtgacctattttctcctattaagaaaatttttcaagtctgagacaattgatctgaatggctatatatctttcatgtatatctttattcatttttaataatgataacaattgtgtttgcattaaaacatatcaaaatgatgttttaacatgaatctaattttaggtttaaatgtcttgctgttaagtcacagaattcatcagtatattaaaggcatcatggtatctccaaatctacgtctggcttttcatcatggtccatcatctaacaatgtcatcacaggatgaagatgaattcagacacaggttgattaacaac

SEQ ID NO: 64035 - DNA, 754 bp, Bovine  19866881820271
tatgcagatgatgaggcataattgttctttcccccacaaatacatttgtttatgattttgattttctaagtactcagaaaagcacatcataaagtacttctgtcttaatgctccttttaaaatccctagtaacagcttcatgtgctccatagaaacagaccatgtaatttattcaggaaaattaaaaccagtaatctggtattctgtgtaaagacttttccccccgtgcatgtgcttaaaaaacattaaaagaaaaagaaaacaaatctgcatgtgaaaacagcctttaaaatgaattactacgccagaaaatcaagctaagagaactctgttaaggtaactattttcctttcttgttgccttactgataaaagaaactgatttggggcatcttaaataaagagttggacaagaaagaaaatgttccgcctagaagtgtcttgcactggaggaggtgggtatttttctttgcactgtaatctgcagtaacttttatctataaatcctgaacaagaagtgtctagaataaccacacttcataagctttgctgagttgagatatctacacagcaagtctttcgatggggaaacattaatgctttttatattagtgatcatctgtaacacgagcaattaagtgcaatactaatggactgtggccaggaacctgttactaatattaaaaactgacagagatgaataggtttggaagcaaaaccaggctgacaaagacatttttatgaagtgcttggac

SEQ ID NO: 64036 - DNA, 788 bp, Bovine  19866881926144
tagaaaaactggtttctgtttttaaaaaaatgaataaacaacagcctttgaaaaatctctatttaaaaattcttaaatttgcctctaaatgcaagttgtaattattagaagttggagtttacactgttgagtgtaaaaacaccctcaggcacaaactaatcaagtgtgtatgtcatgctacgaactacagcaagttctttgtttgacccaaaaaaggcttgccaaacagcagttttttctttgtcaagttcctttattgtctcctttttatttcttgctactccccccacccaaccccctttgaacctcactgtagtatttaagaaactttgcagattccaggttttattgatagttttcatcaagcatgaatttaaatttgagaatagattaggtgtcttagccctttttctttttgataaataacaagaggtttctacttatgattttctgtcctcggggctttatcattaagattaaataactgtattctcaagcatgccactgcacaaacatcttttcaattatgtgagtaacagatgccttcacaaaggcactattgaaaattcagaaagcatgtttccaaaaaagaaaggggaaaaaaagtatcagatgacagaagaatgtaattgtttaccattaaaatatatccttaactcttccactgaaaacctcttggaacattttgttttcgtacaagttattacaaagttggatcaaaatgatacatgtttgggagactgttgaacacttcagaagtctggaacctgtggtatctcacttacatg

SEQ ID NO: 64037 - DNA, 1580 bp, Bovine  19866881993414
gcctaaaatacttggtacagtatgcaccattacacacagtaaggttaacaaactactgacgacccactaaattaataagatataacaaaaccacagccatttgcaattaaaaaacaagactagcagcaatttaaaaagcacaatcaaccaactcaagacaacatggataatacactgacaacaaaggatccttctcgacacttgtgggaattccatccaagtgaatgtgagcttgtgctggagcttgcagtgttgccaagcattgtgtgggagccagaattgttagcagagtaatgaattagcagcctcaataaacttataatgtactaaattgaatttatgaagactaaaatttagtgacccctgatgcccacacattaaatcacgatcagttttcatccattgaaatggcaactgatcgatgaatttcattggtcacagtttaataatcactgttccaagatgtctggtcaaccagttgcccaacttttttctattttgaccttctattttgatagatcttctggcagatacttccatacttgagagcccaggcattaggcatctgcttcctatgcattttcaaaaaagtctttagggatctactgctcacctctgagaacacacctgtcagccaggtgctgagagagaagtgccttgtgtggggctcgcatggttcgtcctgacccagtggttagcatcacatttcctaaggctgaaagaatgccagccccttcatggaccatagaacagaatgaccaacttgctccataggtacagggcgaaggaaggaaagggtgcttcagaccttggtggagaaatgctttttggattcctagatgcaacagccaggctaaaatcctttgtgtgacttttcctcagggctctttctggaccactattcaggtaattttgcaggcttccccattccctctcccctactcttacacccctgcaccccttcttgatcccaagcagaggtgaagggtaatggctgacttggtttctgttccaataaacactgaaaaactgaagacgtcattttctaagattccagtttgatcattctcagtctgaatcctcctggtacagctgcctgtgttttttctcagcatatatattactacttaggatactctgtgttacgtgtggagtcatgtcccccagaacaaaaatattgaagtcctaactccctgggacctcaggttgtgatcttatttggagatagggacttcacacaggcgatcagattaaatgaggtcactaggataggatccagtccactatgattgatgtaattttacaaggggaaatttatacccagagacagacatgtacagagggaagaccatcgaagacacggggagggcattatctacaaatctaggaatgctcagggccactagacactaggagaggagcaaggaacagactctccctcacacccgtaggaaggagttgaccctgacaataccttgagttggaacttttagcctccagaactgtgagacaacacacttctgttggttaagccacccagttacagcagccccaggaaactaatacaccatgtaactttg

SEQ ID NO: 64038 - DNA, 760 bp, Bovine  19866880425834
agaaactgagaaagaacatttaaggagcagggcccttaatcaaaggcaagtccttatagatcaaaatatcagagagaaatatgtaagatgcagaggacaggcaaatggagaaatggcactgaaacatcaagcagataatactttattcgaaaggtttctagctagagacgtgagttctgtgtggtttctgcgctgacagtgtccagaggttggttcagaagggaactgttaaagccggaagagccagaggggtcaaaggatgaaggatattattgtgtgtaaaatcccaacctttcatctatggactgtaacctaatccttagaaatctcctgttctgttttccttctagtaaagagcaacggctcacagtaaacattcttctgagtatatgtgtgttggggagagaggagatatgaaagtaggtgtcctgggctgataaagcataaaccacaaggagcagatgctagcatttacccaaataatcagagcagaattatctaaaaattatctaaaaaatttaagcatctttagatttcaccatatgaccattgaaaagacacatttttttggtaaggcctggtcttgtttgtcttttactgttgtcctctgcttaaaacaaacaaacaaacaaaaaactgatagtaggaactagttgcgacaagtcatttaaaaagaagaagcctgccagaaaacagtgaaatgggggtaaaaagaagttgctggtgagcaatctctaaaatttatcagaatcccctgggg

SEQ ID NO: 64039 - DNA, 2671 bp, Bovine  19866880426427
tccatgatagctcagttgataaagaatctgcctgcaatgtagaagaccccagtttgattcctgggttgggaagatcccctggagaagggataggcttcctactccagtattcttgggcttccccagtggctcagttggtaaaagaatctgcctgcagtgtgggagacctgggtttgatccctgggttgggaagaacccctaaagaagggaatggttacccactccagtattctggcctggagaattccatggactgtacagttcatggggtcataaagagtcagacacaactgagcgactttcagtttcactgtggagaacaatatggaatttccttaaaaaaaaaaaaaaccaaaaaccaaaaatagaactaccatatgacccagcaatcccactactggggatgtattatgtgaggaaaccagaattcaaaatgacacatgtaccccagtgttcactgcagcactatttacaatagccaggacacggaagcaacctaaatgtccagcatgtgtttctgagttcatttatggagtcaaataactttatgcacttgtaggcaggtgtttatttacttaaaagttagaacatgtctgacagtggttgaaccatttgcagaaactcaaacaagccagagtagaaatgctaatgataaatcagagcaggatcagataagactgacatgggaatgaaaccctgggaaaagaatgacatgaaaaccctaaagagaaagagaaacttagggaatgcaaggagtgaaaagtgatgggaccacggacgtgaagaattagcaagctgtaatcaaggtggaggactcttagcgtgtgcaatgtgcacaagtgtgaacactgccaagagtgaaaacatgaataaaaatacagaaagatgcaatgaaagtggctctgttgacccactgacagaaacattttctatgtgattaaatgctcactagaagtatgccatgcaaagctgaaagctacaaatacaaaagcagcttagtcattctctccccataaatatcccctagcatgaatcactgaccagtatttaagctcagacacttacaagatgcttcaaaaggtggaatacggaattcattaagtgttgtatcttaaaacaatgagattatttcgtttctcataatcatatgcataaactgattgcattcatatttcttgaaaacttaggacttactagaattgccataataagagtagacattttgtcttttaaccagtttttaaattataaaagcaatgcaggctcatggacaaaaacaatccatgcagatggtcacaaaatgaaaacactttcttccatgattctacacttctttttttaaatttatttttaattggaggataattacttcacaatattgtgatggtttctgccatacatcaatatcagctcctggacatacccactgccactagttccttacattatccttagagaatttttctataagtagagagtccttaacttgcatcttaggaatatctcatttaaaacatgtaccttagctgccaaaaagaaggcaaagacaacacaaatatgaaatgacagtggaaactgagaaaatttttaaaagctcaaatgaagagcaagaaaaaaataagcataggaaaacataaatgttggaatatggtaaagctcttcacaatattttccagtgccatagagttgagcatttttgctggggtggattcaaaggacaaaagaccagagaaagaaaaattaaacctgtatattatttatggaagccagaggaggggaaactgagtggcttccagggaagaactgggaatatcctcagttgttcttaaatttctcaggtcatattgtgtaacgtaaacggcagtgtcttgaatctgtagccaaattcatctagtcttatgctccttaatttatttttaatgtctttgtcgaggatctactatgtgacattagctctgatctcaaagagcttatggcagagctagaaaaaacacgacgagcagagatgaaacatttggggagtaagacttggtatataaaaagagatagattgaatataattaagtggcagcatgcacttaattaaattcaagccataatccatgttctgattttaaaagtctgctacaatttctcacttaccactgtaactaatacctggagttcagctcagtccactcatgtaatttagcaatgactatgtttccattctcaaacagaactctgctattgttgaaatgtgtatatggttgtgtgtttaaaaatacctgtttgattttggggacgggagggtgaatttgattacatctagtgattgattcttcaaacttcatgcctctgggaaaatatgtcacagatcataaactccagagagagaagcccgagaaatcaacaaggtcaatcccttggccaccaggtgggatggaacttctgactgatttcctagccaaagagttacggtgacatccgtatgcatcttttcttcctgcatatattgaatcaaagaacaagcaggcatctggtactgaagcattataaagtcatatgtgatgctcactaatacaaaacgcctggaaggaaatgaagttaatacatatggcattcaatttacaaatgaagactcatttatcatcaaagacccagaatgctcactgccagacattagaaagaa

SEQ ID NO: 64040 - DNA, 1782 bp, Bovine  19866880478004
atagttaggggttgtcatgctctgccacagtgacattccttgcagtgttttatgctgtctcacgactctgcatctttgcggtgatacagatattcttgtctatcttgtgaaaacggtgtgctccatgagcatgagcaccatgtctttttattgttatagccatggcgtctgacacagtgtctggcacgtggcacaatgagatgaaggactggtaacttctaaagcacgtggacgataccaaaaggagacagtgcttgcagtctgagcacagccaccacagtgatgagggcacagttacctctgacagtcacaggaaaacaggaagtgtcccaaaaattggggccaagggaagaaggataggatgagtgatgggcaccaggagaaaaacatgaaatgcttaaaaacaaactgtctagtgcctactttggcagagggctggccctgatgtgaagggtggctcaaaaggaaatgactgcccgacataggagtaaagaataccaattattttcctcttaagtagggccagaccaactcagcagaaaaccagaggatgggcactgctttcctggaaggaagctgatggtgctgatgccatcggctgggttgactaaggagacatgatccaggagccacccagctgaaggctggtataccacagacagacatgcttctaagacctgcggcaattaggaattcaaggttagccccaacttttcagatgaagccttctaattttccttttccctcccccgagcttcttccaggaaacctgccttgtcctctgctgtggttggaaaagatcaaatgtgccctttaccgaaaaggcagggctttcctctccccactgctccttcatgcgcacccccatgtgacggctcatacagggacactcccggggcctctgacacagagctgtctcaactctctgtctctgatcctttgtctcaattgagggcacaccaggtcaagacagaaggccagacctgctggtccaagatggttaatgatgatagaataaagtcaccataaaaaaccattattttgaacagaatttttttgagataaattttgagctcagacaattcagagatgcttttgtgcaatacctttataatttcactcatgccaacttcaaccaaaaactttatcagaataatgaggcaaaaatcatggcggggggaaatgtggtctattctccaaagtggaaaaaaaaagaaaagaaaagttgttgaaagaggagaaagcaatttgattccaccctggtacccaatcttttctcctagaatttcaatgagatttctaaagttggctagacgttctcccactgcaccccaggagcacacaggagaactttccagtaagtattgtctatatattattgtctccattctgcccagttgtatcagtccttataacctgtatattatagaaccatttcccttttacttctgtccctctcatcagcttgtggacttctgggagacaggaatgtatgtcaatgatctcagcttgtcaccgctgggtcaccctttccttccaaagatggtttcctgtgtgtcactgctggtctgtaagctcaccacgggcagggacatggcttatttcagcacataagacaagaagaagacaatgggcatgtactggctgcttgtctgctttggccaaaacattggcaggtcacatatttccatgcccaaagtttgtttgcagatacacacactgttgccctttctgaaatcttcatttttctcacaagagttaaatactgcccgggaaggattt

SEQ ID NO: 64041 - DNA, 1220 bp, Bovine  19866880571423
ccctgggcttcccaggtggcactagtggtaaagaacccccccctgccactgcaggagacataagagatgtgggttcagtccccaggtcaggaagaccctctggaggagggcatgacaaccaaactccagtattcttacctggagaattccatagacagacaagcctggaaggctacggttcataaggttgaaaaaaagtccaagaagttggacacaactgaagtgacttagcacacatgcaggcactcgtgagtcccacccatcgaaagacccatcccattccgatatcaatcttaggcgcaaggttcaacatcttatctaaatcaggtgtagctgaaaccttcacctcttcttatcaaaatagcatattactgttgcttttatctcatagtgaagctagtaaatgattttcattgaagtaaaagtgtcagtgtcaccatttcaagacttgtttaacattcttgtctattttgtgtaaatcagttgagttaaaattaaatgttataaactacaaagccatttacctggcacatgtaaatggaatatctcataggacactgaccaggatccggtgaagcggacaatgctgctatccccccaagcctatggaattctcacttttctgctgtgagtactttaaatacaccataaccttccaaataatggagccttattttttaggttaaaaaattatgaatatgtagtctttttctttgttgttgtttagtcactaagtcatatctgactctttgtaaccccatggactgtagcccactaggctcctctgtccatgggattttcagcaacagcactggagtgggttgccatttccttctccagaggatctccccagcccaagaatcgagcccatgtctcctgcttggcaggggggttctttatcattgagccacctgagaagcccccacaccctaatgagtcgcctggcacagcccctagggtacaaacatactatagtgaaagcaattcactttataagaggacattcagtgaacagaagttgcattaataaaagaaaaagtctgtcacaaagtagggatggacacaaagttgaaagaaattgctgtatctgtaacagaaagtaaattgcagaaatctctgggtttttccaacaactcattacctcagtgatgtagtcaaaacattatggaagattggaacttattttcctataaaatgcatacccagtggagactgatttg

SEQ ID NO: 64042 - DNA, 1490 bp, Bovine  19866880584744
ttgcggcacacgggcttctcattgcagaggcttctcttgttgtggagcacgggctctggggcatgcaggcttcagcagctatggcacacatgctcagtagttgccgctcctgggctctagagcacaggctcaatagctgtggctcatgggcttagttgctctgcagtatgtgggatcttccaggatcagggattgaacctgtgtctcctgcattggcaggcggcttctttaccactgagccaccagggaagccctatttataccattttatctaaaaaattatcagaaattcttttctagtcttttaagttcctaaaacatggaccagcctatttcacggtgcattgtaagcactcatgtattagttcatgcctcttccctcaggttttgtgatggatctcaaataatcttcatgaaaaaccctgatacataattatattcatttcacagacaagggaaatgaggcttaaagggttatagtcataaaaagtcgtacagtgtctgctgaaggtcacaaagatcatgtatcatttaggttgcagaagatttcaagtttcagatgaacaaacccaaaatagattaaccagtgaagaaaatcattaactttcaggagaggaagcccagtaatgggaaaaattctgtgttagctgatttcccagttcaatagggccatcaagacccttttcacttctccattctaccatccataacatcaccttaagcctgggtctccacatggcactacagctacaagcttctagttcacatctagcaatagatacagctcggttgaccataggtttcctccctcaatcctcctccaaacttgggtttttctctttggtccaaagtgaatcacatacatccaatagtgaactaaaacactggtggtggaggtacgattacccttaaaccacctaaggtcaagtccccaaaccacatctctgttactcaacaggcaggggcagaatggatgctggagaaccaagcacaatacccagttcaggcagtggaataaaaagaacgcaacctatgagagcatgaagctaattactgttaataacaatcagcttctccatctccaaagatcagcctacttacagtgaattttcaattaaatatactaaaactgtgattattaaaaagaggtgagcttgtgtagggagatgggggatttagacattaatgagaaaagaaaaaaaaaagtgtgtgtctttgttcatactcaagcatgattcccagctgtttcctgccttgaaactcacatcctgaggaatatcactgagctgctgggagcttccagtatctcctgtcttcctctgctatcccctccccactcagactctcctacttccctcactcctgctcatgttggtccctcctcctagaaagaggttcaactccacccaaatcccacttccttctttggggcgtgaactcctactcagcccacgtgtccgttccaacgtcttcacagagtcttctatgag

SEQ ID NO: 64043 - DNA, 1442 bp, Bovine  19866880596785
tacagccttcagctgattggacgaggcccaccccccattaccagtaccgtctgctttccttaaatttgacaaacttaaatgtgaatcacatctttataagaaacacctttagagcaatcttcattgatatttggaaaacaacgaaggtactacagcctagtcaagttgacataaaaattcaccacatgagacatcagatgcaaatacgatgcatgggaaaaagaatgtttattaaacagtatgcttaacggacgacaacacactacgctttgcttttctgttccttttatgttttttcccacatttgatgaacgggctgagggagatgcttagaaggtttcactcagcctattaacaaaggaaaagtctagaaaaactgagaaagaaagaagagaggcccctgcagtctttacagacaacactacttctgccagagcatagtatttgtgcagtggtaaagaatctgtctgccaatgcaggagactcaagagacacaagttcgatccctgggtcgggaaagtaggaaatggcaacccactccagtattcttgcctggaaaattccatggcaaaggcacccatggcaggctacagtccatggggttgcaaagagtcagacatgactgatcacacacacacggtgcttgtgaagtgctgcgagatgactctggctgtctttgatggccatacacccctgagggtgaacactccttcgatcacacagaaaatgagtgctcacatctctatcatgattcaccatccttctgtttatttttaatatatgtttctaagattaaatttgtgaatttttctcctccacaggcttttgaagcttcttttatattctatcagtgacagaacaaaagaataaattgaattagatggcaccatgcagttagggatgcctgaacctcacaattcctacattattttctgggaatttgaaacttatgacagtcactcaaaccaagaagcaatgtgttgcttgtacgtgaggccccaaatagcctactctgtctttaactagtaaagaaaaacataagttgtttgaaatgacagaaattgatttaggatggggtagtaacactgatttggagaaggcaatggcaccccactacagtacttttgcctggaaaacccatggacggaggagcctggtaggctgccgtccatagggtcgctgagagttggacacaactgagcgacttcactttcacgtttcactctcatgcattggagaaggaaatgtcaacccactccagtgttcttgtctggagaatcccagggatgggggagcctggtgggctgccatctatggggtcacacagagtcggacacgattgaagtgacttagcagcagcagcagcagtaacactgattacttattttaacactcccagtgaaagagggaatcacttttgttgatggttgcagaacgtgcca

SEQ ID NO: 64044 - DNA, 1463 bp, Bovine  19866880635253
ctttactttcaaccaccaacccttgcaaaaattaaacatcacttttgcctcaacctcctccatgactctaatccccaactaagaatttctctgttctttacccaaatttacatctcctaattgtgaaaaaaaaaaaaaaaaaaagggaaagtcatcattatatgcacactgtgccctggggtaattctcagtgctttacccactggtgatcctggaagacccatctctttagtggttatccccagtgaatatgggttttaagatatgagaaataaaggcagagagttttttgttttttttctttttcctgagtaacaaagaaatgcagaaaagccaaattcttggagaagtagaaaaacaactgggaagcaatgtggaatcttaccacacataatagattcaggtagctccaggataatattttctttaaaaaatattcattacacttgccagaagacttgaaaaccattgcttcttgccaaagcaaagaaagaatgctggatttcagaccaacccatttccctatgcacacagttctagaaaaccaaagtaaatatttttaaaatgctcatcatgttttaggcattcagaaaaaataacgtgtatggacactgtactttcccataacataaagtggggaaacatgtaaaatgagacaattggattttatattattatttgaggaagatgagggaaaagatattggaccagtggtattcatactacttataactaactcaaagtaccatatgttaggtactatggcagataagagaacatattttggagttggtgcagctaggcttaaatctagaacctgctttccactttctcccttaacttcagacaagtttctaagcttcattttcctctgtttaaaaaaatggggataataatagtacctatcttattgtatatggatttttcttgttatattcagtgtagtggtaatatctggtaccttgaagtgtttcgtgatgattaaatgagattttatatatatacataaaacacatcaatggtcaatgaatgtttattattatgattacaatatgtcttggtactacctatcaggccaaaaatgtaaataaatccaagccactatttcttaagttatttctgactcaaaattagataacaggtccttaggttgctaccattacatctggagaagccagatttgccatcaaaatatcttgagaaaaccataccaaagcatggagatcagttctgagatggcctccatacccacctcttggtggtcctaattcatgcccttgggtaatcctctcccttgactgtgggcgggacttagctactgcttctaacaaatagggtacatatagcacaagagttggtatgtcacttccaaaattggttatagacagactcctatcgtgtcagatctgtctctctccctagtcccttgtctctttctctccttttctctctctctcagttca

SEQ ID NO: 64045 - DNA, 1604 bp, Bovine  19866880663983
ggacccagtgtgatacagcatgtaacttgtcttgatcctgagagccgtggtccaaaattcaactcctttatatttagaaaagttatgaccaacctagatagattgttaagaagcagagacatcactttgctgacaaagggctgtatagtcaaagctatggtttttccagtagtcacatatggatgtggaaattggacaataagaaggcttagcatgcttttgaactatggtgctgaagaatactcttgagggtcccttggactgcaaggagatcaaaccagtcaatcctaatggaagtcaaccatgaatattcactggaaggactgatgataaagctgaagctccaatactttggccacctgatgtgaagagccaactcattggaaaagaccatgatgttgggtaagactgaaggcaggaggaaaagggggtgacagaggatgagatggttggatggcatcaccaactcaatggacatgagtttgagcaaatccaggagatggtgaaggacagggaagcctggcatgctgcacttcatggggttgcaaagagtcggacatgactgagtgactgagcaacaacaacaaaatgaaatagtttccttactatttgtcttccttactagttttctggttcccttagtaggcagggccactgagttgtcacccacctgtctacagagcctagcaacgtgctgaacatatattaggtgctcaataatgcttgctgactgatctactatcttggcaaaatctaggtcacaatttctggatataagaaaaaagtcaagggttattggatacctgtctgtttgaataaaaatcttgcagtaaaagaatatactgagaaaggaaagggatatctgtcttctgtccctgagtctacaatatatcttggatttcctcaagccctttaattttccgtctgtcatttcttggctatcaacacccctgtctggtggatatggcaaaactgctttcagtaagcaaacttcagggggaaaaaattaaaaagcatgataagcacagcacatgctcatttctccttaattgcctgatcctccatctgttggtctaggataatattgataaaggaattaaaagacaccaccaccatctcctgaatcaaatgagagcagtcattctcaaattacagagcatgacatttttatgttttgcaacatgaagaggaaagagcatttaatttattttaatgtggttaattagaagctagattagatcctctagttaactcataggttcttgacttttaagaccagaaattgtgtagcatctcatttgcacagtggtagctgctgctgttaatattggcttgtgtctaattaacggggatgcttacctggaatcccaaatacagaatctataaactaaaagtgagaactaatgtgattttaaggagagaattactcttaagtaagagccagctgcgtgttgcctcaaactaagcacaacttcaatgcttgaatatgtcaactcgtttttatatgtgggagaaaggtactttaaagcctagctactttctcatggtgagactagatacagtgaggaaaatttcaaacaggtaaaagcaacactgggtcagca

SEQ ID NO: 64046 - DNA, 1308 bp, Bovine  19866880713838
atactgctgctgctgataagtcgcttcagtcatgtccgactgcgcaaccccatagacggcagcccaccaggctcccccatccctgggattctccaggcaagaacactggagtgggtttccatttccttctccaatgcatgaaagtgaaaagtgaaagtgaagtcgctcagtcatgtccgactcttcgtgatcccatggactgcagcctaccaggctcctccatccatggggttttccaggcaagaatactggagtggggtgccattgccttctccgtaacagatactattacacgtaaaatagataagcaacaaggatttattgtatagcacagggaattatatgcaatatattatagtaacctacaatggaatgtaatctgcaaaaaaaatgaatcactatgctgtacacctgaaacaaacacaatattgtaaatcaactatccttcaatcaattactcattcaatcaatcaatatctcctaattcttccagttcaagagaattcagaaatttagcaacctctgtctggggctagaagggaagaaaggagtccctaacatgccctgttatatgtgttcttctcaatcattcactctgtcactaaataataacagctgttgtcaggagacgggggtaaagaaggttgccaggtagggggtggcgaggtgtaacctgaagaaactatgagagaattggctgccggcagcctagagaaaaggtgcagagaagtcagagtatctgaccttggcaggtgtcctcgctcattttgcaggagatcttccaagttttcttggtagctgccttttcaactctgctaatgatgataaactgttgcctcaggacccacagccaactctctacactgcctatgagtttatcactctcatcaaccaactacagatcctaattagaaaacataaatatctggtcgagtataaaaactcacaggtgttatattgatcctgagtgacactgacatctaattgaccaggtttctggtggcagttctcttgggaactatgcaacaaagctagtaatggtaaaaaaaaaaaaaaaaaaaaaaactggagagaataactgtcactttgactatgcatatggtgccccaagtttagagatgaattagagagagcttcaaacctagagggggacttccctggtggctcagtggtaaagaatccacatgcaatgcaggggatgcagatttgatccctgtgtcaggaagatctggaggaggggacagcaacctacttccccacttcagtattttgcctggagagtccccatgaacagaggagcctggcagg

SEQ ID NO: 64047 - DNA, 768 bp, Bovine  19866880926438
tccccaaaaatgtgtgtgtgtgtgtgtgtgatcctagcgatgaatctcacggcttagttcatttaaaaggtgaattctcatcagggctgacttctgtgtccttatgagtttttaacatttcggtactttaaagaaagcttagagctataataatctgatcaaaaaagtatacaggactctaagcaaaaggaagcctggaagactattgctttactatcaaagaaaatctgaaagaactgttacagattcaaatttcaactgtgtccagatttcttagcactgtatgattaaggaagaaatctaggaatagtcactgcagacatttgtgttctttatgttagaagcaagatgtgaaaatggtccaaattactagtattgggatgacatggcaaggaagatacagcccaaaccaatagaaatttgatgctagagtagagatatatgattttagaactgacgattctataaaatcctatctaaggatagaatcatctaattcatcagtttagacacattttggagctattcttcactgtaatagtgaggttgtaacatttgacatctttatgtagaagacttaatttaaccaatatagtttttgttgactccaagctgttgatgttatgatagcagtgcatttatcaggtataagatgtttcttcaatctgagctctatttttatgggctgatcagtattcagctcttccttcaacagaaagctgtctcctggcttgtgagggggggtgtgttctcacagtcacaacatgg

SEQ ID NO: 64048 - DNA, 730 bp, Bovine  19866880976068
aaaatgaataagctaacttatcagatagcctctgattagtcattcagtgctcacattctatagtttttctcctgtgaaagagtaacaaaactgcccatcaccaaaatattgtaaggataagtaatcctaacagtggctggggaaagaggaggaaacaagatagttggaacctcatggcaaagagaagcagtcacgaaaagtgactgtaccttgctggcccagaactgagtcacaatcacaatgcaagataaagacattgtcttgattagaagggtacaggagttatttttttctaactttgggctggatggtaacgtggatttgctaatactgcaccccagcagtgagtttaccccttacagaagtgcccgtctctgtaacattggcagcctggactgcagagaggagatgggcttctgcagcaagtacctgggacccagagagagacaggccccaactacggatgccttgctccctttcacaggcttgcatgtgtctacttgtcttctcctcaccagaggagagcccgtcgagagtggagagagaccagcagtgctctcctcttggattgcctcccacagcacaggaatcgaggaggaagatggctatctgggtgctagcccacctccagtttttctagctgcgtttccatgtggcgaacatggtttttgtgtgcttctctttggtggagctttttgcctgacctgtgatagactctccgtgaggttgg

SEQ ID NO: 64049 - DNA, 1777 bp, Bovine  19866880988825
cgaagagttgactcattggaaaagagtctgatgctgggagggattggggtcaggaggaaaaggggacgacagaggatgagatggctggatggcatcactgagtcaatggacgtgagtctgagtgaactccgggagttggtgatggacagggaggcctggcatgctgagattcatggggtcacaaagagtcggacacgactgagtgactgaactgaactgaactaagttcttaccaggaagaaacaagtacagttaaagcagttctccatctgattgaaaggatgggaaagggtgctaatgcccacctggcactgatagacttttatttagactttctggtgatctcacagctacagataacaaactccttaatcacccatcctttgtgacaaaatccctatgggtgtaaagagtaactctgtgattaaaaataactgtgtccttcatgacacatattgccattttccctgctgaactacaaacaggctttgactccatctggagtctcgggggttttgttttttatctaaaattgtctgaacacaaaactaggttttaagggcttgaccgttgagtttccaacagcttaacaagttactccttaatggaatagccataatgttaatcttgaagtcatttgttttcttctctgcatcataataagagcggaaattatgacaactcggcagtttctaatatgagagacatttgggctgggagtcagtctgttgaattcaaccagcactgggattaggaactgccagtacttgagtttcctcatccttaaaatagttcctggtagataataagtactgtgacaatacagataattgaaataattcttgcttagactctggggagcttattccattcaagccctaggcttagaaaggaaaggttgagaaagagttgacttctttgtcccttgatatgggtgtggaaagtgttgactgtggcagaaatcctactgcccaggtggagagaaggtgactgggtgtttacaaagataggagaatggcttcagcttaggagcaccatcccagaccctgaaatgtagctcatagagtattcaattggatagacatttactgagcacatattagatgctaaatactatactgatttaagacaacccctgccttcaaggatccttcagtccagtgagtgtttcaaagacttagacttttaacttcttagagtcatattaaaattgatccacaaatccagaatccttagtcccaggtgaggccagggtgactagcaacaacagtaacaatcactatcctttattatatatttattatgtatcagctctgttttaagctgtttacaccgtcattgtatcctttcaacaactatgagactcttaagatggaagctattattttccctgcttagtggataaaataactgaggcacagagaattgaagagacttgaaccaggtcccagtttcagaagtgacagggcaaggatttgaacaggctttcttcgaagcccactcttagacaccaggctaagtgtgcaggtgcaaccataatggcatggagaaaagacatgcaagggagagtgttggaactgcaggttaaaaaaaagtacagcattgcacgtataacaattcaagttctgtagagactcacattgactttttctaataatgcaataccctgtgaatatatttcatgattcctttgtgccatgtcccatgccagatactagagttacagttcagaatagagcggaaatggtccctgccctgggtattttattttatttgt

SEQ ID NO: 64050 - DNA, 1325 bp, Bovine  19866881132474
tctcttttaaaatttgcatcagaaacaacagtcctggtttcaatagctcactgggaaatgaaagctttgcagaaatccctggcctatgtagtccattgctatgagattcaaggcttctccctagccctggatgtgtccatcttccttaaacagggctctggtcccacacctttcttggtgagacaccgccaaaaaacaaacccaatataaacagagacaaaatgtgccttttcctcagatacagaagccacaccgcaggtggagaaataggaatgtcctcccgatgccatgtaacccctacatctgtcccaaagctggcacaccttctagaaaaaaagagaggcgaccatttaactggtgggaatggaagaatggcccagaccagctgggttgggggacaggaattccggaaagcatgatgacattgaagctggtataacagcaattacgtgcaatgtctcccttctggctggagaaaaagcagtgttcttccaaacagaattcctttgaaaatgccctctctatagaagaaagtaaagttctaaaatttctaatttcgcttccaagtttcttctatttttccctaccctctccagccacccagagctcagctaatcctccccaaaataaaatatttctgcagttgttcccagccttattctcttggccattatgttttcatgccagctcctcaactatgattatattgatccatgtaacagtaaaagaaagcccaaaatgagtccaagaccttgggatgttcacctcatagctcattttgacagatttatttaagaagttgtgtgtgtgtgttttaactcagttttgtttccttttccaactaagtatatcctcagcatcaaggccaaatttatagacttatgtagtggattccctggaattagtctccatgtaccttccgcctcatcccaaggcagagtgtatcagaccctccctctgtgaactggacaaactcctggcttctaatgctgcgcctaatgccaaaaggcagtgtggtgtgactgccatctgctggcgtggtgctgacattacagcatagaccaccgtgcactaatcaggtgacacttgtttgaaatcaaaagctttctctgaacaaatgaaaaacaagcttcctcaatctagcttcaacacacacacaaatatttacactggaaaagctgaagaattctggaaattttttttatggaagacttccaagtgagaatcatactctgaggaaatgggattacccagggggactccatcaccaaaaacctagaagccaaacctcatcaactcagacagtggattctaccttgcgaagc

SEQ ID NO: 64051 - DNA, 974 bp, Bovine  19866881164194
tcttgctgtaggattttatacatagttgctttgtggtctagttgttaggacttgtggcagtccagttaagactccgcacttccaatgtggggcacccaggtttgatccctcgtcagggaactagatcccgcatgctgcagctaacgcctggcacagccaaatagatgttaaaagaaaaaagctttgaagcatttttaaacattcctttggcattggatcagtggttaggatgaatctgtgcagagagaccagcaagcctagcacccacctcttcaggctctgtacatgttgggtttacagcgatgagtggaataccacaggggcgggggagactgtcgatatctcatgtgcttcctggtaattaattttgaaagatgcccaatgcacagtgggttgctcacctagtgacatttgattacctgagaatccccaaagccatgcatacaaacactgacaaataaaagcagatgcaccaacaggtctggtctacctagccaaagcagaaaaaaccttgaaggcgatttatgatatcataaatcttcaaccataggcttggataagttgatactgtacttcctcgcttgaaaaatcctctctgaggtacaagggaagtaattactgagtcttcccaggatctaaaacagaatccccaaacaaaatgttttaaggtttccttaaattaatttttggagaggatttggtaactgtgtgttctgccaacaacatacaaggatttaacctttaatttactgtgtggaggctgtctgtgccttcttagagagctgaagaatagtgcacaggccacattttccctctgtttgaaaagcactataatttcttacctttatattaatactttggctgggaattaccattattttcatttcctcctttgaacatcatcagcacctgaatatattcaaccaaaaacctagattatctaaaacagtcatcttatcctaggattaaccaca

SEQ ID NO: 64052 - DNA, 841 bp, Bovine  19866881174863
aagctatagagcaaagaaagagaagcctcccccttcattgtgtgcctgggtggagcgggggagagggtacttttactgagattttccaaactcactttgaattactcaatagcggaatcttacactgactgacaatatgtgtttgttaacaggaaattcatcatcccaaggaagtactggttccttaagaaagtctataacctctacggtagccaacatagcgcaattcactcagtattctccagattacaaagtctcggggatgagaactgtgtcctcccctcagcctggtgtgatcacagtgttctgcattgtggtggccactctgtaaactattaattgtctgagtaaaagagggagggggaagggaagaactaagagaacctagacacatcatccaattatttcagtgtccactgtagtttccactcctaacagcctggtgagcagagggagtttttcagcagtcttaggggagacttaagcatatcaatgttttcagtaacttaaaaacccgtgcctcaaactacattcccacaccagacaactgataccaagttcagcactaaataatcatcttccatcagaaaacatgagctttaatggtttccatcaaaggggaacagaaaggaatcatttcaaaagtcacttttctacaaaactgctgtgaacttttaatttatttgtgacaactgcagattaaggaatttcatatccagcttaattataagccttgtcagcaggactttcctgatttgttatactgagaaacaaacgtatcgtcagacgggaaacgaatctgaacaaagtcaacataacttaatggaaacaataattctta

SEQ ID NO: 64053 - DNA, 847 bp, Bovine  19866881213141
ctatcaactgatgggcttataaagtagataaagttgctaacagttggaacattgatacagaaaattagaatccctttccctgtgatggaatctattttttgtcaattatcttttattgtttaaggaatacatattcggtgtctttaaatggtctaagtgccttaacagtagtttctaaatcttccactttaaaattgtgttgagcaccgaataagatccaagtaaattctcatccataaatgattccttatcctcttttattttctcactttacctcttattcctgaaatgtgattttgatgtgggacaggcatgctgattttgaaatagttgcaaccctgaacatagcagtttacacagaatccatagaaaatatctctttaaatagagatacacaaatgtgataaatttgtgtattcatacttaaaaccgacaaattactcttcttaacataatcctaagggggttaatactagcgaatattatggcaatctcaatgcctgtaattgtagtgtactgaacacttacaggaaattgtgtaagaatttgtttaaatggaatgctgccctcttatggttacacaaatccttctagagccaaacataaaattgtagtcttgagttagggcagttaatagaggggtttaattagtggaaagagccaaaaaatgtaagccacacgtggattttatacactacaaattagagtggcatagaggtgactcattgtaagttcatatatctaggtaacatagagccaaggatagaacccagtttgttgcttttctccttattttaataatgcatatttgaacataattttaatttctactttcataattcagata

SEQ ID NO: 64054 - DNA, 1437 bp, Bovine  19866881336535
tacagatgaatctatttgcaaagcagaaatagagacactgatatagagaacaagtgtatggacaccaagggggaaaagggagagggggatgaattgggaaattggaatttatacatatatattatagatactatgtataaaataggtaaccagtgagaacctactctatattaatagcacagagaaaccctactcaatgctctgtggtgatgaagaggacatatatgtatacaaatagctaattcactttgctgtgcagcataaactaacacaacactgtaaaccaactaagctccaattaaaaaaaatcttagcaatgtaaaacagcatttttattaagttcataagttttggggttggaaatttggacaggatgcagcaaggatgacctgtatctactctgtgatgactagagcctaaggttggctgaaatagctggatttggctcatctggtttgactggagccatctgttttggactttgattctggccatcatctgggttcctcagtgtttctccagcagggctagaatgttcaaggttttcactgacatatctttgcctgggctgcgatggttgaaacaactagagctacctaggcaagatctacccctccacaaggaggttagcttgggctgcctcacgttgtggtggtctcagagtagtgaatttctctgagatattatggctgacttttcccagagtgggcattccaagagaccaaagtggaaagtggaaggcctcttctgatctacttcggatgtaatctgttgtttacagttgaatcccagagccacccaggctttaataggcaagggatggctgtaccagttaatactgggaggtgatcaaaggtgggtgggaggggtgccttttttaagaaattaactaccacagtgcttaagctatgttcttaaatagctaattaaggtgctactggcatcttcgtctgtcttattcctttgttatactttctgcttgcttcaaaactgagaccaggaaaattgaaatatttttttactgatcttcccgtacatcaacaaccgctatcatctgtccttgcaatatggtttgtatcagaaatatcctaattataggcaacattcaaaaatgctctgcttgcatgtaaataagaggatgtaaatagatgcttggggattgggatgttgtctaacaccaggtgttagacacaaattggcatcacctcttagttaaggaataaatcctaaagacagaaaaggattttgaaaatgtgattgctaaaacattctggtcattgtcattcccaaattcaaatttaattctttctccttgtagccaaatggctgttggggctacaaggcagttagagcatggaggatgtgaatgagagcgtttttgtaggagtttccatgctttggacataaacgagcctgggtgcaatacagataagcgat

SEQ ID NO: 64055 - DNA, 1337 bp, Bovine  19866881344239
tattggatcttctcagtttacatagaattatctgattctccccatattgcggaacttctaggttgttttaatttctcagttttatacctggcactgcaacggacattcctgtgataaatcttggaatctctctgtacttcttgagagaaacttaaaagtatatcactaagttggattcacatgtaagtcactgagtgtacctgttaactgtaaatttaccatcgaaagtctctggagaacaaagtggatcatgtataccaaataaacaatatatttccatatcacttgaagtctgtatctatccttctagaacagtcatctttcaggcagtactttacttcttctaggcaaacagactattactgggttaatctaaatgcagtaacatgaaacttggctgacccagatttcttcaatatcagtatgcatgcaattacaatattctacagattgaaaaatacccaaggctctcaaaaatacatattttatcatcctttcatccaaaatggtgtacaatgagcattaaaataaaacagggttatagctgacagtggttgatagcaaccagatcttacctagacatataacttacatatagtgtgccttaaagttttcttcaagattcaactttattctgtcacttctagttatagggcttttaaatgctttcaacaaattgaaattattaataattcttctttagaactatatggttgcaatattccagttttaaattctccacagtctatttaaaattttattctatttgcttttcaagatgataaatagggtttgcaaaattcctagaaattgtgtgtatacatacatatgtatgtacatatgtatgtgttattgtttttagtcgctaactcatgtctgagtcttttgggacccccatggactgtagcctgtcaagctcctctgtccataggattttccatggcaagaatactggagtaggtttgccatttctttctccatggggatcttcccgacccagggatggaaactgcatctcctgcattggcaggcagattctttaccactgagccacctgggaagcccccacatgtgtacacacacacacacacacacacacacacacacacggacagagacatacctctaaaatgtttctctcccattagtagtgaaaagtgaagtaaaacaaaacacaataaaaatgccacttatatcatggccatatgaactacagtgtcactcaaatcccaaggcccctgaagaatgggtagttagactaaaatggcggggctgccctgtaccgttgtgcaagctgcacactgtacaactctagggtgtgcaacggtatccgatct

SEQ ID NO: 64056 - DNA, 1097 bp, Bovine  19866881423957
tccagtacagatttatatcttagtaaactcctaaaagaggctgaaatggttcttttacttggtgaccctgatgctgggaaagattgaaagcaaaaggagaagaaggcagcagaggatgagatggttagatagcatcactgattcaatgaacaagaatttaagcaaactccaggagtcagtgaaggacagaagaaccggacatgctgcagtccatggggtcacagagtcggacatgacttagctactgcacaacaaatgttctccaagtcatcacccagctgggaccctgagttttgggtctcttttaggaggtgacatttcactgtgtactcctcagtttatggtaactgaatcatgtcgaatcaggggtaattgctcccaaattctttataagaaaaactcggttgtcatttgcattttagatccctgaaatggattggcaggcattagagagttaatccatcttctagctataagtcatatatatttttttgtcattctccaatttgacacagtggaacagggtgctgctattgagaaattgaagcaccagatgtgattaaataagatcacacatttcattctgtctttaatttcacatcactcttcagcagctgaatctgtatgctccccgcatggagtcagccagcaccaggcattcttagcgtgcccagcagagcgatagcaaaatgtttccaaagtcagccaccctgctgggctcttgtgagtcaaatctgtttttgcctccaaagaattcagtattgctagatctggtttattaaactattcctctccctagagagtaagatccctggcaaatttacatcattaatgctcaatttaaagtaagaggcattaaaaaaaaaaaacctagaatcaagaagaaagaaacaattagaagaagtcttcctatctttcccctcagccttcccttgtttctgctgtgacttctccatctctctcccaacccaccctgattctttgcttctaggaataagagttggaaatggcatttatacatctgctttgcaagcatgtcttaagaagcttttttgtgtggcattcctgatgtcgttgaaaaatgaagttgaaataag

SEQ ID NO: 64057 - DNA, 1110 bp, Bovine  19866881908101
ttttttggatcaatcaaacgtattaaggaaagcttacatgtgcttataatttcaggcaagaaaaaagattagaaaatagttgattatctgggttctataataaacaactagaaaaaattcttctctagtcaaccagttcagcatattacttcttttctccaaatggaaagttttaattatgtgttaaaacactgtttgtatcaggaatgattaacattaggtttaacattttctcattgtggttttatatacaaatttacaagtggaaaaagtaaaaggaaagagtcactttacactagagatttttgaagggcccaaagctttaagtggcttccctggtggctcagtggtaaggaatctaccagccaatgcagaagacactagagacatgggtttgatccctgggttgggaagattccctggaggaggaaatggcaacccactccagtattcctgctgggatactcccatggacagaggagcctggtgggctacagtccagactgagcaactgagcacacacaaagcattgagcagccattattaatcttcaaaatctatattaactcaattgtattaatgatggtgacattcagagaatcccttagtacgtatgttcaatcttcagttaatttgaatctatgaaaagataatgggttttctgaataatcctgttgcaatagttgcttccatcttaaaatcagataacgtcagttgaggcctttttcttcaagtatatatgcacgagacatttaatttatttcttcatttaaatttgttatttacaggacaaattttgcagtaggaatttcatgcttgcaaaagtcctcttgaaataactgcttgttttgcttaatttacagtgttgcaatatgcagtcaacttttcaataaataccatattaacaggaaaattattcacatgtgggctcatattaaagtaggaaaatccaagcctttcatatactgtaccaaacgctgtgtcacaaaattaagtcaataaagcatcatacctgcgcatgcttgaaatataggtatttataaaaaatttttttttccagacatctggcctgtattcatggccttaggggaaagtgtctctcaagggaaa

SEQ ID NO: 64058 - DNA, 1778 bp, Bovine  19866880693278
ctgggtcatcccagtgcaccggccctgagcaccctgtatcatgcatcgaacctggactggtgattcatttcacatgtgataatatacatgtttcaatgtcattctccaaatcatcccaccctcgccctctcccacagagtccaaaagactgttctatacatctgggtctcttttgctgtctcacatatagggttatcattaccatctttttaaattccatatatatgcgttagtatactgtattggtatttttctttctggcttacttcactctgtataataggctcccgtttcatccacctcattagaactgattcaatctcccttttcaatacacctgactttccatttctaagttattctatcactgttactagcagctaaagatagtgagaattattttattatttaaagtataaaatatttttatacattttagtatgcctacaatatgtcatgtaaataagtactactataattgaaagatatatgcatttagttcttttaaaaattaagacctttatcaaatgatccttttataaaaataatcactgaatttaaagacaatatatttaaattgctgtgtatattgtattttataaataccatacagctctattgttagttatctttttcttctccttaatatgaattacaaaatatttaaaatgttaggtgttaaaaacatccatggtgaaatattaggaagtgagtccaaactgcagaccctgtgactacattgtgtgctatgtttcagaattaaatactagtttttgagtgattattttcaaattgttattcaacatacaaaacacatggttctagagaagttcttctgagcacagagctagttaataagacacatagaatttttaatttcacacatgaagcaggaaggtaaagataagcattattttccaccaaaaaacaaacctttaggaaatagttgttattgttattgcagttgccagacactccttgcaattcagccacagtgttctaaaatggttgacaacaaaaattaaaacacgcgtttccctccactagagacagcagcgtaatacaaaggaaggaagaccactgaagttccagtgcttactgtaagataaactttcaagaactaagggaatacgcccaaactcttagtttttcaaccatgtaaccagttataaagccagttcatattattgaaaggccatccacagtaactgcaatctcttgtttgtacaacacaacctgcttccaaacgggaacagcaaatagagtaagtcaaatgtaatgttatccctttaatgctttttcacataaaaattacatttttgtaaacctttaactcttatgcaaaccataacttgcattatatttctgtttctaattattacatattaacacaagcaataaaaatgcttatccatgtaggcagctgctctaaattgtattcaatactttaaaagattctaaaaaaataaactaatgctgtcatgatgtagttgtaataataatttctagtaataaaaacaaattatgaaagaaagattaaattatattttaagagaaggagcctcggtttctggagtgataattaatcttgttacaaactaccacacaaaaaggctttgaaatgtcatctataatctaagacttcaaagtcttataaatattatatcttaatattgaaagaagcaaaagcaaaataatcatataattttaaaagtgtacgtaaaataactcattttaatgtgaacaaccattacatacgtcctaattttaaaaagtag

SEQ ID NO: 64059 - DNA, 1327 bp, Bovine  19866880742418
gatgcagaaatgtttattttggtggagaaatgtggtaaagaccaactgtgaatggtacatggctactgaaaacatgttgaaagtcaggaacaaagactactaaatgacacgattttcagaagtgtgtagaattaggaaccacactacatctgtttccgtgtatccaatatgtatttctggtttatagattaccatatatagcatgtaagagctgccagttttccagtaatatgaatgtaaaccacatctggactagcagggccggctttatagacaaaggcttgatttcttccatctctgaccttcagtcctgctttctacgtttattgtcactttttatgtatattttttaaaaaactgctcactctgagattttaagttttggaggacatgacagagttttgtcaggcacagtttgaatactttataactattgaatttagttgaaaatgtcagtttttatcatgtaaattaatttggtttgatgaattatatatttctttcttttaaatattcttcaatgtattaagtgagggattataaaccaagttccagttacttttaaaataaatcaaatatttcagcagaaataaggacaataagttccttatggctacatttgaagaccacatataatgatcttttgaatgacttaggtcaggaagaaagacgtaccaatattctattttttctgcagatcttcagcaatattttgatagtgatttcattaaaatgttcaatgagaatttaatgtatatttgcatgcaagtaaaatgagagatgacaaatgagagcttaacactgcccggtacagtatagaacagaagtcagtttcggtgattctgtgtttccatataattctagtaccagcacactacaacaccagggcttccacaagacaggcatgaaatggattccgcatgggcatttgctctagcagcatgctcaagatgctttaccttagttttattgctgctaatatggtatagcctgattctgtaaaaagtgataaatattgataaccatgtaatgattagctgctggttacttttgtctctcaaattattcaaagtggtacatttttaaattagtgagttacttttattctgattccattttccttttcctaacatttctattgatttgacgacaaaacagttgtttagaagaaattcttcatacaaaatttgtaacgtatgtagttttggatacttagcagaatttttttaaattaagaaagctgtcttttctggattttcatcttattgttgacatcttactacaggtcttcagcacatactccaatgaagattatgacaggaggaat

SEQ ID NO: 64060 - DNA, 1222 bp, Bovine  19866880829088
gaaatgacacagtattgcaggtcagtcatacttcaacaccaaaccaaccaacccacccaagaaatgcataaaacaagatcagatttgtctttatcaaaggtgggagttgggcgaaggggaagttagatgaaggtagtcaaaggtacaaacttcagtgataagataagtaagtaccaggaatataatgtacacgataaatataattaacatcattgtgtgttatatatgacgtttaagagagtaaatcctaggagttctcatcacaaggaaaaaataatttttctctttttcttttactttgtatctataagaggtgatggatgctcactaaacttaatgtggtaatcatttcatgatgtaaataaaattattacgctgcacaccttaaacttatacagtgctgaatatcaattatatctcaataaaaccagaagataaaaaatacagtataagagctaaaaagttaaaaataaatatatcctctccaaatttccttttattaacttctaagtttacattccaagttatttgcatgcatctctgtctcatttctttttcttggatatctactctcctcaccataaaagacacttattcttcaaaggaacatgttcaagtctttaaataaaacaacttaaaattaaaaaaaaaaaaagagtcacaccaaatggctcagtaaaggctagagggagaatctgatgtggttctctttagtccgcctctccctactcttaatcttgctgcccagaggctaagtcaggacccaaaagttaccatctccaagggaagagggaaggatacccatgaacatacttaggtatgttcctcactggctgagaaaaagtgttctctggttgaatttatttgcaatggtactactccttacatttgtacatgtagccacttcttagaaataatgaagtctcatcattaatcctattttatcttttcagagtgccagtcattaaactgtaataatattgaagaaattgatcatcaagtggatcttggacttaaattattaaaaataaagcaaataactgagttgcagaaaatattaaagttggcttaaagctcaacattcagaaaacgaagatcatggcatccggtcccaccacttcatgggaaatagatggggaaacagtggaaacagtgtcagactttatttttctgggctccaaaatcactacagatggtgactgcagccagaaattaaaagaca

SEQ ID NO: 64061 - DNA, 884 bp, Bovine  19866880853667
agaaagaagtaactaggaacagatattttgggtgaatctatctttacttatcgtgcttctctccccgaccccagcccgcttctagtactggtatttctttcttctccttatctctcggggcactgagtcacatgaattaccagactaactttctgcctctcctgtacacagtcatctcccgagaagtcatcacagtacccacctgaccctggcttctaagtaaaggtcttccctcctggtccctcctgatcagaatcacacctctcccccgtcccctgtggtgatccccaaccaggggccacgcctgacttggagggaccagcgggggtggtgaagaagctgagcgaggggaagggtgggctgtgcagcgctcagcaacccagccgcacccctctgtggagggccgtcccatttacatccaggaaaggccgaggagttccctggacagcttaaaggggctcagagacagaacgtggcttccatgttgaggcagacagtgggcgaaatcacaaggcttttacatcaaatgtgaaaccatagtcctgatgactgatctgcaaaatctgcctgaaaacgtttttgtctgcgacagtttacgggtcacgtgcacgatctgagaaggcagctcagccgcccgtgccatgcacatacctcgtcggatgagagcaccaaggactgagagagtccgggcgttttgggctctgctcccaggccgctcaggtctgctgaactggtgctgctaggactgaaatcgtcattgaaggtaaaattctgaaaaagtaaaaaagctcagtgttaaatgagcatggtgagtgagccagagagaagcctgcttacaagctttagagaggttctttttagtcctcttagaagagatgcagatt

SEQ ID NO: 64062 - DNA, 1775 bp, Bovine  19866880894859
cagtggctggcctccatgctgaaaccgtagtttatcagcacagggaatcctaggagtctttagaaagcagtctgaaatgatctgaactgtaaacatcattctaagtgtcagtggcactgggagggaaggtagctgaacagtgggggctggctgttcccagagagcttccatttgtggtatgattagttcctataaaccttaaaaggactctaattccagacctgttttgtgtgtgtgtgtgagattctgtacattaattcatcttctgtttatacatatttttagaactaataggtacttgatgaatcccagtgatgttaatgaacagaaatgtagcacgactggcaagtacatgatctcaagataccttgctgaaagttctgatttagagacataaaactctgcacttattcttaaccctatagttacaactatcagcaattataaaggcctaagctaggtatataaaattcacttctatatcacatcaatttgacaaataccatgaatgattcagtaaaatctgaagttaaatttaaggtctgatgacggcatagcactttttaaacctaagagttgaacaatttgattttcctttaacagcttgaaaatagatacttcttcatcatgtctaagggaatgaacataaatatgtgcctaggaagaggcctaacctataataggatcttgaaaaatattttttttttaaatgaatccaataatcccaattgcatttacttggtaatatctgtaacctgctaggaagttttcaatcatatcaagaaaataccctgtaaagtcatttgatgagaaggcagcattagatcacattaattttttaacattctttttagtaaataacaggattagggtctctacaatatatgcaattctcacctctaagtacaattctggctttgctatccatttgagtcatcaaaattatttttataaatgtaagtcactaagaattgttttgatttttttttttactttgccagtctccttctcaatacccaaactgcctgcaattctgttaaaatttgttatctttcatttcatctttccatttactagtgttttctctaattaatctcaagcatcctgaggacaagatgtgtattttactgtctttattatactattatttatcagaatctctggatatagtgttttaaaacatgttgccattctctcccattaattatttatcaccccccatcctaaacaggcttttgaataaagtatggatttactacagaagcccataaacacctagaagcttaaaagttacattcagtagactcagaatatacattcttctaattcttttatctttttggaaaatggaaattacttttctggttagtcagcaaataacataaattacatggactgatacagaatttcatcaatctcaaaattaaattgaatttgacatttacagaggaaagtggacaatgttgtaccccccaaaactgctaccaacacagtgtttccattggtatcctgatccttcttctctttctctctttattctgaaaatgcttaacatattttaagtaaacagaaactcttgaaagttctttgtcccaacttgcaaatccactttaaatgaggcaagaatagttcttaccgtttcatcatcttatctaccttcttgactaacattttatatttttaaatagcctcccaaaagggtaaaaaaaaagaatattgatttttttttttgtaacttactatgtgcccaacactgtacattctttaaaaactgt

SEQ ID NO: 64063 - DNA, 1029 bp, Bovine  19866880936215
caaaatactaagcttcttgggagtataaactatatttttccatgactcaatatttctaattcaattcctctttataaatgatagctacttactaagatataaatgtcattaagtctctgatgaatatattctatatgaggagggaaccagtgatccctatttttcccactgatatccagaactaaacagtcaagagaccaaagtagacctctgtaattcaaatgtcacactgcaatttcaaattggcagccttccttgagtttcattttacttgctaaggaaacaatgaagcacttattctgatgccagcagaattgtgggaagagacttaagagatttgtattttcctgaatctttaatctgcagaagagagcaactacactgaccaagtggcacattattattatttcaataattctttagttgtacaactaattgaatcttggaaaatatggtgtattcacataaaaattgactcatatgattgcaaaaatgctgattatcacatagatctagaaattatagcaacagaattgatagtaaacaaaaagtaagaccaacaaaaatatcattgatggtgtttctacggattaataataaatgtactctcaaacttataatttcctttgagggaaaataatttttactcctttcctcattatggctatctggtggtttgtgacaacaatttcttcttgaaaagtgtctgcaataccagcactcaaaagtcttctcgtcagttttcccggcatctttaaactggacagctccagccctgattatacccaacccttcccacaaacccccatagccctaggccattggcagtgcacattctgttccagcagatgcgaggctgggtggagaaatttgcagtcttaaagaagtactatgagtgtcccactttgagacacaaagtctttaagtcattttataggaccctggagagcaggaatcatgtcatattcattttatacccacataactgttaaatataagcaatggacacgacagattttacttttttca

SEQ ID NO: 64064 - DNA, 880 bp, Bovine  19866880941205
tgcctgcccttgtgttgcatattctgcaggcaccatctaactaaatgtcatgaaaaccttgttactctaaggaactatttttatcctcactttatggatgtgaaattgaaacttagatctgaaaagtaactttaccaacatcaagagctgagatttgaacctaggcccaagtaatttcaaaaccaagtttctttaattggtctttggtataacagatactgtctgttcctttgtaaaacctatactgagatctacagccctcctgagtattcaaggctctaatatgtctacacgcttctggtccctctagaaccaccagaagaggcagaagctgtcagttgtacttaacattgtaattatgaatcttagtaaaatattaaatcctccgctagaatatgagtataaaggaagttgtgtctatgaaagcagataaaattctttgtagcgattcagagaagactggtagctcaagaaaactagattgaaaaggaaatgcaaaagagaaaagctataaaaatctagaggaatttcacacttattttgccttgcaagtgtctttttcatccattttaagacagtgcattaattctttggcatatacgctctggttctggtttatataacaaggagtacatgaaacatcagtcagcatacatgtgagccaaaccttttgaaggagacttctgtgcgcttgtccagggtgagcatactatgagagaaaagaagaggacaagaactttggagctcactacaggcaggcacaagtcttcaaagtgaactgaatgataaggttcaaagatgcagagagtgaatctcaacacaacaggattatgcaccagggcttttggttggagagaaatgaaaggaatgtatttccgtt

SEQ ID NO: 64065 - DNA, 1681 bp, Bovine  19866880973079
caatatggattttgtttatttgtttgtatgcctgttcgaggggacttccctggtggctcatcggtaaagaatctgcctgcaacacaggagaccagagtttgatccctgggttgggaagatctcctgaaggagggtatggcaacccactccagttttcctgcctagagaatcccatgaacagaggatcctggtgggctaccgtccatagggtcacacagagttggaaatgactgaagcgatttagcagcagcagcatgcctgtttttaaaaggaaagcagagtggattgtcacctgagcagatattctcaggggcaaggagggtaaataaatattcagtgccaggcattctgccgggtgcctttcctacatgctttcagataatctttataacaagcagaatagaatcttcccccaccccctttttctaaagatgtaataattgaggctttttctagtggtatagctagtggctgccagatttagaatgggaaaagagtccttctggctccgaagcctggactccttgcaacacactgctgattttgaatggagtagacagatgtgtctgtctgtatctaggcacacacagagtaactgggacacaagagatgctggaaggattcccgttttgggtaatgaagtttcttgtaacacctaggttctggaattctttgttctataaattcctattaatagggagattgaagagttattttactataggtaaatacttaatccagaagtagcctgtgaagatagggcttaaagggaagaatagctgagtatacaactattctaaaaaaaatcggagtttagttttaggttaagctttttcttctgcctgcaagttgttgaaatagaaagcaggtgtttgctacaccaagtaaccttcactttattgaaaaggtcaaggagctctttctcattgtttgtttctctctcatgttcctttgggacgtatccctctccctttcttgtgcctgcctcaccaaagcatgcccagctaaaaccaaccaacacacataattgtctgtgtgttggagagatgaaaggtctgcaaatagtgaaaacccactgttgtgtaaacatgtcaatttatttacttgatttagacttatttttattaatgtttccaagtgtttttaaattgattgatttgagtgttatgtccttattttttatttattctctctctgtgttaatgaaaagtaaaatacataatgaaaataaccaatattggttatccaatgagcgatttggatggtccttgaataatttattaatttcatatgtaattgaataatttattgatttacatagccttgttaaccctgagttgtgtaatcaatcacttggtttctcatttttcttaccatttatagaattatcttgtgatttcaaagttagaatcatttttatttgataatatcccccatgacattccctaggccagccaggaaaacctcaaattaaatgcagaacgaccaggttcatccagttaatttccagagccagcacttagatcagcattgtctactgctgctgctgctaagttgccttcagtcgtgtccgactctgtgcgaccccatagacggcagcccaccagcttctgcagtcccttgggattctccaggcaagaacactggactagggttgccatttccttctccaatgcatgaa

SEQ ID NO: 64066 - DNA, 642 bp, Bovine  19866881039348
aaatttttcatcacaatttcttaaagtgggtctcctttcttttttcctaatctgttttcctgttctgtgtttgtgtttatgttttcaatttggtctgtgaatattttcttcaggttttgaatttttttcagtttctgtttccttagaaacactgtctctagtattatctttttacctttcttttcttctctgttttttcccacgcctgagattgtcctcaaacgtgtcctctcacatcagtgtttcacctctctgtagcattaagtatgctttgacttcaagtttccgtatgcttttttagcgcttctaacaacttaattcttttcatacattttagtttccgtgttctccattcatttttcatgcctctttactttctcttcatcctggtattccgtagagttaccttaaaatatctttttatttatgggatacattatttcacaggtttacttatttgaattttcaagttgatattttcttttccctgatctgaagaatttagtaataggcttagttttgcctttttctcatctatttatcttcaatgaggcacaaaccatttttgtatccagtgttaatcaggaatttttcactttttgaaaccacaaagcccgttgctggacctccgtcaggaggaca

SEQ ID NO: 64067 - DNA, 1543 bp, Bovine  19866881180724
atcagccatacatttatattgataagaaagttcttagactttggactcctcccagaaaatcattttttgctgaggctgtaacccttgtgttgtctttgtcttttctgcttttccccgagtcctcattgttagcagctctttactgatacctgtggattctaggccaggccagactcctatcaccacatctgatttatttcctgatggagtctgagagtacactaaacattcactttgagcactggaatccagaatattaaacaaaagttaaagccataattaaagtcagaattcatgaaatggcaagatagtaaaaggaaagtgcatgcttgttctccgttatcaggagtgccctgtcccagagcatgagacgcagagcagtggaggattattccatgctgccgtgttgtttagttctaaactgaggcaggggagaattctcagcgagattcaagctttctttatcgtgcatatagatatcatttcttggtatactttcacaattttcatttttcctgaacaaattattttcagtaacttttaatccccagtaagtaattttgaccatgaaatactattgatttgcactaattaaaggttgaatattcccagtaaatcactgtggaaaattttaatgaacaagccaaatgagtgagaaatcaatacttattgattgtttcctggcatataattaaagccaaaatctgttctcttacccagaaagcaaagcacttaaattgcctgtctagttttgtgcgagttttgcatctgtctacgtgtaatagacttttgttgccaaatcaacaaggcattcaaaaggaggtattgagttgcaaaatggcagctgtccttggttcatatttctcactgcatcttcataagttcacagaagtcaccagacccttcagtcatactgaggtatgtatgagtgctagaagagagctagagatgttttgatagaaagcaagtgatttttgtcagaatgagcttaagcttagtaattttctgttaattttaagaaaagtgagctgcttcctattttattttggcttttgagtaaaattcaaaagccagttgaactataaggtagattgtgatcttctggaagtaaagacagttttgacccaaatgtggaatataactccttttcaaggaacttatacaagatagctgtgttttgaaatgtttcttttgttttataatgtggttcgccatggagtcatagttacatagtttggaggacgccatatggttatgctaaggtaagatgactaaaagaataggaagttaggatggggggatataaaagtagaaagtgcacaaagtgatttgtatatgtagtgtgcacagtgggttcctgtggattattcaggatttcatttaaggtgaaatttattctatcagccaagaggtaaacaggatcaatcatgggatcataacatctagagaattaaaactcaaaaaatgaacagctgtttccagaactgggaccagaaacttatcttgtatgcatgggttctgaacaatctgccaaccatgttgt

SEQ ID NO: 64068 - DNA, 665 bp, Bovine  19866881684648
ttattccatgatgctcagatctaaatttgtgcactgccaaaggtttaggcacagaaaaaattatggcctgtgtgtgagagaaattaatatccctcttttgttatattcagtcttctgaacatttagggctttaggaatcaaactgttgaaaggaaccccttcctctgggatggcctgacttgaagcttgccccatgccatgaggccaactgccagcctgtggactggcctcagacctgctcctggttgacaggtatcagaagccgtgatggtgacgacgaggatagaaagatggttgagggaacttctagtggaagctttaatcttttaactttattcccagttgcataattgtgctttcaaatgcagtcctagctgccaatttacactttaccagggccaaaatttatttttagtgtcatttccatggaaaatgtgcactttgctcttgattgatagatgtattttgacagttaatacaggtttacccagtcaaggcttgttttagttgaaggtgaaaatagaagagaaaaaaaaaaattacttcaacagatcttagtatttctctttttattgcattcgttgtctaacaacaataatactcattggcaagaaatttatttacactaacaaattaaatttaatcacaggtatttttagattggt

SEQ ID NO: 64069 - DNA, 2074 bp, Bovine  19866880356697
ttgggtcatgttttttgttctgttttttttttttttttcctgcttaaaatgaaccaacaattttggcccaacacaatgcaatacccataagaagcatatctatattgtctgttattatttaacaaacaaaaatatatgtgagtggcacatttattatgccacaagaatattctgagaaatagatactagtcacttagtatacatatgaatggagaatcttattttttaataactccagctacttatgaatcccttgttttatctgaaaactgtcattcatgctctctcttgcaagtattatcccctttgtgaagttttactacatgtatagacattaatacagttctaaactctggaaagcatagcaatctgtattgcctcttgtatcaaatattgctgttttctcatcttactgccattggctctccacacacacttgtattttgataaatccatcttccattacagaatatgaaaatgtgagatgcttaatctctctaaatgtgctttccaaatgtggtcagtggcactcgagagagtctgcggggaagtttcaaaagacagtgtctagtattagaaaattagatattggcagataagtcatcctgtgaccatgagggaataaacttaagaatgaaagaccactggctaaggaaagcagagcttcaggaaggaatttttcagaatcttccatgacatgtgtgtcacagaattaaaccaacctagaaatgtgcacctccttgcatctgtgtctgacaataaatccctattttaaaggcaattttggtctcatgcctcttacttggttttgatacactgctctcatacttcatagatagctttctaatttattagcatgtgcagtagacaatgaataaatgtttgctaagttaaagcaacagagaatcactttcccttttatatctgcatgttgtccgacaagaatattggtacctacgacaggaaataacaggaagggaaatgatgccacgggcccttgtactgcacaaattaaaatcaccctatacaagtttacacactgggtctttcattttaaactaaaagtaaaatcattaaactaatttattacagtttacgtagattatgcagcagaagatttacatttactacattttattttagctactagaatgaataaaatgccataaactagagccaaatgctgaatacccattttagaaatgatttcttccattaattgctttcctgttctcaataattcactattatagagcagaaagcctattgaattatatggttgtaattaggctgtttctttaacatgttttatgcttcagtatttcttatgcttcaaaggaaaaaaaaaaaagaaatctgataacagctttatataaagctgtccttggatggcatttgtttttttttttttttttttaatctcagaaaactatcttgtactggaagtttgtccaaaattcaagttattctttgtgactccatggactgtagcccaccagggtcctctgttcatggaattctccaggtaagaataccccagagtgggtagcgagtcttttctccaggggatattccagagccagggatcaaactagggtctactccattgcaggcagattctttaccatctgagccaccagggaagatgtgaaataaaataaagaggtatttttcacccgttgatgtaggcagggaatccctacattaatgttttttgacattaattcaaaaaacaaataaacccaatcatatttttgaaaatcacacacacacacacacacacacacacacatatatatatatatatatcactgttatgactaatctaattaggactgataatttcccacgtgtaacagacacagtctcatttttttccctttagacatcagactttgatgtttcaatagttctttactttaagaattttgaatatctataaatgtcaatactctatatttctagttccattaaaaaggatgctcaaaaatctcatctctggatttccatataaaacaaaatccatacgtaggctacattccagtctttccacaaactttttctagtaaatagg

SEQ ID NO: 64070 - DNA, 1037 bp, Bovine  19866880818615
tgtgttctttttatatcaacaccctttgggcaataatctacatctaaatctgatttttgtttacagttgtttttgttttctactcacgaggcacgtttcttcaaactcagtactccaggcagcagaatatattgaaggatctatggcaaattttagatgaaatagcttgatccagtgcaagtttcagaaaataatagggattgtaaaaatgaaaaaggaggagagaggctgagtgaagattttataaggcataaaaagcaaacttgtcatgtcattaggctgggggaagtgtctgatttttaagtggcctcaataaatattgttatatgcacttgtgtttattaatatattatcaattaatattttggtaaaattaagacatgtgattaattagcattgagatgtacctttaaaagtgttcttttttagcatatctataaaatttagcagatgggtggccagctaagtgatatatgacctgccttccttggaactaaggcattggcagggtttctttaaccatgtatgttccaaagctatctcttatagcacctaaaactatcccaaaatagatttgcagttgtttgtggatataatgtgaagtcactaaaacggtgctactgtggttaaaattcaggattttatgtaacacttactgagtgcacttgagatcattttttcattgcacataagttctctgatataaaattagcttttattttcatgtaattgctttcagccttaaaatgtatggcataggagagagtagtaggctatctgatctgaaatggaggcacaaaggaggtctatcatggaagctagtccttctgtgattaagctagtccttcttgggttcacctgtcagtgttaactccctaggtccagagatacttcctatggttgttcaggctgcacctctttcagaagcatctagcagagaaggagagctgaaataccaccatgctcaacatgctaggccctgcattctggggtgatgcttcatcagctataggaaaggactgtcattcctccagatt

SEQ ID NO: 64071 - DNA, 1429 bp, Bovine  19866880878829
aacccagggatcgaacccgggtctcctgcattgcagacagacgctttaccgtctgaaccactagggaagcccattaaccatgttttgacagtttcaggtagatagtaaaggaactcagccatacatatacatgtatccattcttccccaaactcccctcccatccaggccaccacataccactaagcagagtttcctgttaaataaagaattttgaatattttactgcattgacactgaacattgaatttaaaaataatgacttctttggataaatggacaaactggcagatgagtatcaaaattttgtcataaaacaataacgtttaatgccatgcatgaacaagagtagatcttaactgttcctattacacatgaaaagtggtaactatgtgaggtgatgtgtgtgttaattaacttgattgtggtaataattttgtaatgtgacacatgttaaatcatcatgctattattggttagtcactaagtcatgtctgactcatcctgtagaccttaaaaaatcttgttgtataacttaaatgtatactttaaaaataaacaacaaaaaaaagacacacataagaacaaagtatatcagtgaaagttgcattttaaaaaattgcatattatgtaaacaactactatggcaaactgatttcattgtagttgttttaataattttggctatgatgaactgcataaatggcattgcataagatttataattctcatgtaccagataaaatttgtaacatctactgttgtagatctttattgtgtatgtgtgtgtgtgtgtgtgtaggaagctgaaatcaattattttaagtatctagccattaaattccataattccatttttaatttatctgaattcttaagaatacctagcaagaacatgataattccatctgacataggagctgaccaatcttgattctttgcttcaagtaaggatcagcttccctatgacctcagagccacatgaggaaggaggaaaaacagatccattagaacttagtgtgggggaggaatcagagagggaggcagtgaaccttactccttccctttgaatgtctcagaatgatgtgttagacgaaaatacaatgatataagcacaaagggctttaaggagatttaattttgttgttccctttctctaatgaggcacttgggtagtttccattttgctttagatgtctggggaaacttttgttactattttttgctaattatacataatacaatggttgttttccccatttatttgtttttacccttttctcactacaatgctcttaaatatttatacatattataattcagcttaaagtcatcatcatgatacaacacaataatcttgacaatgtaaatcctactcctggttttagggaagaaaatcagaaacaatcaggtactgcagagatagttat

SEQ ID NO: 64072 - DNA, 2508 bp, Bovine  19866880946994
aatttaaataaaaaaaaaaaaaagttcacttctgctccatgccagtgatcaggatgcaaaataagaatgacctcagtttatttttcctttggaaaggttgtatttgttttgggtaatgcataagataattgcatttttaaaaagagacttctctggaaattcagtagcacttaagaagacaggagttggaatgtaatgaccattcagttgttttggctactcatcatctttctctcctgcagacagtatccctgctcattcttttaagtgattctcatgaagctgaacatcatagatcctgttgtcacctgagtcatagagacttgactaaaggggttagtgaaagtgaaagtgaaaagtgaagttgcgtccgactctttgctaccccgtgcactgtagcctaccaggcttctccgtccaagggattctccagacaagaatactggagtgggttaccatttccttctccaggggatcttcccgacccaaggattaaacccgggtctgccgcattggaggcagacgctttaacctctgagccaccagtgtctgaccgaatacggaccaatgtgattcttcctttggggaatttaaaacttttccagagaccaaatcttcttatgctgagttctccaatggaacattcaaaaacaaggtccacaggttatcagtattataatactgatacttcctgcacactcataacacttgtattttccagacactggttatgtacctctttctttagtttgtgagctgttccggtatccacctccttttggttctacatatacaaagtttctgttgcttttcttttttcctgttatttgaaattaaagaactttgacataatacctagcacagtatctggttccctgtatcacagtaggatgaagtttcttcttcttacaggacaattttaaaagcaaaaattaataaaaaataaagtaaaataaaatagaataaaattcatttactttgaacaggtttgtacttgcttagttgaatttaacacaattctttaagtgaatgagagccaaggagtagcggtaacccttctagcctcatttatcttgcatatgtactgttatgaagcaataagttcaaatttaaggttattttagggccagttgagtctcatgagtgagtcagactggaatagggaattggattagagtctcatgagtcagccagactggaatagggaattggattagaaatgttcttcacacacttatgttcagcagcctgcccacatttacaatttccatgttgaagaatgttcatggggcgtctcctcaaggaattgcagacaaacctccaggacatttgaaagaaccactccttgcactcctggagacacagctacaattgcagccagttattgggctgttccattataacaaggcaggtgctagtgctaaccagcccttaaaataatttgcagagtcactgagggtgcagtttgtttcctggatgacctcttaattgataacctcttactagataactcccttaactgataaacgttcaagagaaaaaagttttattcatcgaagtatggcctcactttgaattagagtttaggtgcttagtatttagggtttctctgatagctcagttgggatagaatccccctgcaatgtgggagacctgggttcaattcctgggttgggaagatcccctggagaaaggaaaggctacccactccagtattctggcctggagaattctgtggactgtatagtatttaaccagactatagctttgtcttttctttctcctctatttctttactaaaattttagtcatgtatataacattggataaataaattgttgtttctcaaattatgtataatttataagtattataaacataaaaaacaccttatctgttacaacactctaggagagtagtttagaaattaaaaaaaaaaaaaaaaaacactaaacttcacttgtggatagttttaaagattatagataatataaaaattgctttagaaaattcacataaaggcaagcatcatttctagataattttaggataacagaggtaaaaatcttaatttcaaaataccattacattcacattagtgtataaacatttttactccttataatattagtgttgagtatcaaccagttaaagatgaggactcaggtttcaagtcccaattttatattttctttataatgttgaactgaggatttattggttaaaagaaaataaaagaaggaggtagcaggaggaaagaaaggacaaagggaaaagaaacctcctttctaacactgaaattgactctaagacattatcccatccacaaattctctttgcctgaaatgatgtactatcttctacctagtcctagtgccattactgagtttctacttgaattaaatacaggtcagcttatgtctataaaattatgaaaaccttaccaaaatttaatgcataatttcaagtgttcagtttgtccactagagtgcaccattgtaatctcat

SEQ ID NO: 64073 - DNA, 2028 bp, Bovine  19866881017714
taatatagtagtagaataattacgacccccgattttgtattcaaagagacctaggctggaatattattagctgtatgactgtggcaaaatggtcaacttctctaatcttcctagccagtaatattattatgatattacttaaaacataagagtggtttttaagattaaaatagatactacttagaacaagtacttgactttcagtaactgttcaactaaactgagataccattattattgtttttgttattgttgctgttattatattatcattatgacctgtaagaaaattatacataatgatgcacataaatcaattaacacaaagcctggcatacagaaagcactcaataattatttgtttttgttaccgttatcataaaatataagatgcttagcattgaatgtggtagatattcaacagtgtcagtttccttatgcaacatacaaatatatctggggaggctgtatggcttaatgcaggctgctgttgtctttcatgctaaacagacctgtgtttttttatcactcctctgctacttccagtctatacaacttgcacagcataattataagcacatgaaggaaacattgtaaaagactgaaatggttgcaaatgggtgtcttcagtgggatactaggtgatttctaagcttgtcctcctaggttgtctgatgctaatggatctctgcacctctaattgtcttagagctattttacaactttgtacattgtagataacttgatagcaatgtaaattattttcccatgggaaagaaaatagtgcccagccttacatttaggtctataatccatattaagcttatttttatgtatggtgttgtataagtgtgctcagtcatgtctaactgtttgaaaccccgtggactgtagcccaccaggctcctctgcccatggaattttccagtcaagaatactggagtgtgttgtcatttcctccttcaagatcttcatgacacagggattgaaattgcatctgcattggtaggcagattctttaccactgaaccactgttagtgaattttctaatttcattcttttacatgtagccaaattttgttctaacagaatacaatttatttccctttctctctacagaatgcagttttgtatcaatttaagtgtgtgtgtgtgtgtgtgtgtgtgtggtgtgtggttttcaaaattttccttagaatcatttggaatatctctctggttccctgattaattaatgcataaaaatcactgagacatagtcattttatacctgtatcaggattacatgatattattatatgataattcctcttctaggaattaacctttttcacactcaatatatttcaactagtcttactaccaacactgttctaaacatttttttttcatgtattaactttagaagtcagatgtacaatactatgtgtgcttgagatccttttaaaaaactcataacaaatgtgctcaattcagtgtgccatagaaaaccaaggctacaaatgtggttaaaacagtatgtttagaatctctagttgtttggctatggtcaaatcatttatatttcctcttctaggaaatggaaataataatctctgccttaaaggattttggttcagattgatagcagtagtggagaagcagtcagctcagtaccaagcacttcagtgaacagtagtcattgttttgaaaattcagcatctgcccaggcaatccatttcagtgctcaacagttctcacacttacatgcaactctcattttgcctattggagctttctttttgcttatctgttttgtttggttttattatgttttactactttccacatgtccatggttctttctttcttcccaccccccccccgctttattttttctttttgatgcaaacactgtttctattctgagtatcttctccaagctaaatatgccctcttccttcatttgttcttaatatggcatatttcccagactctctatctttttggttgtgctgcagtttataaaggtcatcctccaaatatta

SEQ ID NO: 64074 - DNA, 1297 bp, Bovine  19866881127874
tttgtctggaactctcttgctttttcctgatccagcggatgttggcaacttgatctctggttcctctgccttttctaaaacgagcttgaacatcaggaagttcacggttcacatattgctgaagcctggcttggagaattttgagcattactttactagcgtgtgagatgagtgcaattgtgcgatagattgaacattatttggcattgcctttctttgggattggaatgaaaactgacctttttcagtcctgtggccactgctgaattttccaaatttgctggcatattgagtgcagcataaaaacttcataaaaattgagaatctggcaacaactgagttcagttcagttcagttgctcagttgtgtccaactctttgcgaccccatggactgtggcacaccacgcctccctgtccatcaccagctctcagagtttactcaaactcatgtccactgagtcggagatgccatccaaccatctcatattctgtcgtccccttctcctcctgccctcaatcgttcccaacatcaggatcttttaaaatgattcagctctttgcatcaggtggccaaagtattggagtttcagcttcaacatcagtccttccaacaactgagtgggcatctataaaaatgactatggtattattaatttgtcactctatatccttgcttatagagaactagttatacggtaagcttaaaaaacatacatatagaaatcttaatactagatatcttaaattcactacctgtgatataatttatgtgtatattttttcacctatcattttcagaacaatttctaggcaatttggagtgaatgaaaaatagaatgaataaaataaatttgactaatgtactattaagctccataaactatgttgtactataataactacactatttaaatatatgtaatttgtttgatactatttcataaaatgtacagatgactacctcagaaaacgtgccctagaaaaagacaaacatatgctgtaatggtatggccactagtctgcgctgttgtataagaaatactcattttcaacaaagtatttctaaaatgaactagctccatttattctatattaagaatcacaactatcagatctcaggtttatatttacaattttctataaaatattacatgccaagtcaatttgggaaaatattaatataaagtcttgaatggttccccttttcttttaaattaaaaaaatggcatatttaatactataaaatgttgctaatttgtgaaatatgaagtatgttaagctacagaataatggctc

SEQ ID NO: 64075 - DNA, 1057 bp, Bovine  19866881208401
ataagcctatagtcctgagcagtcatctttttccatggaaacagtgctttataagattaattcctcatgacaattcacaaaatgaactttatacctaccaaagtgcattgcactaagcagggcaatttcatctctacctaacaccaaaagttacaaaggaaaaaagtaattggaatttccatctgtgatataagaaatgaatatggttttaatagaagtcattctaaaatacataagatatacatatttccatatatgtatacttcaagtacacttcttctaatttatgaccagacaataggaaaaaagatttagaagtccagatcctctagaaaatacaagctttatactgtttaagcacaaagacggggaaaagaatatatgcttcccgtaattctctatctatatgaaagatggcgactctaggtcaacttcatcttcagaaagggaagagaactagagtgttactgacctcaagaagtctgcaagtagggataatatttaagcatttctgatacttagtataagttaatcaatctctcttaattttattttcctcatttataaaatcagaaacttttacttacctaactctttggactgttgtcagtattaaacaaagcattatacataaaatgttcagcacaaaggttaatcatagaatatactcacttaagttcggctgtgaacaaatacatttcttttttgagtgatggaaatgttctggaattagatagtggtgatacttgcacaattttgtgaatatattaaaaagccactgaatttactttaaaatggtgcattttattgaaaacttcactgtataaattacccctcaaaaataagaatagctatgactgtattttttacactacatattaataaaataaatgggaataccagaccaccagacctgcctcttgaaaaatctgtatgcagggcaggaagctacagttagaactggacatggaacaacagactggttccaaataggaaaaggagttcatcaaggctgtatactgtcactctgcttatttaatttctatgcagagtacat

SEQ ID NO: 64076 - DNA, 1275 bp, Bovine  19866881411480
aagtctgacatgattttcccaattcttagaactgcttccaagatgagacactaaaaatcaatctcatgctttttcttttctaaacagtcatctatgtcttagactaatccatagaagagagcatagcaaaataaaatcattagaaagaaataaatgatactgcttatgttttttgacacagggcaggataattatccatagaaacacgctatctcatttcccatttctgacattagttcttgctgtcatatggagatataccatatccataatcacgtttggtttaagtaaaacaagaggctgcagagcttgatttctcaacaggaattgcagtaagaaattaaaataatggctcttatggcaaaagactgctgtgatgacagtaagctaattttccaggcttgagaatttcaaaaatgttttgacaaccaacagtgaaaagctttcatccttatttcactcttacactaagtgccaggtttttatgcatttgtaatcatagcttcttcaaatgcaagaatattagcattactgacttgttttccattatcacataaaggctcctaacactttagagtgtcctacatatgggtttaagcttcagtataataataataataaacttcagaacagagtattgtaagcctgaaggtgtcagcatagagatttgaaaaaaaatagaaaactatgcataatcaacaaagaggaaacaggaataggtgagacatctgtcattgtgctggttctaaataaaatcatttattaagtctcacattgacacttcaaataatagaggaatgttttcactttaatggatttaacttcagatattttcttttctttatttttgcaaggcaaaatctgcagaacagtgaaatatagggtaaaagtgtccactgtcaaagagatgaaggataatagactattttaatatttgatactaaagttgggccatcaggaatttataaatgttccatattttacttcagaacccatgaatgcactgttcacatgatacctggatgtcatttctgatatttgcaaagcaagattagaaaaatgaatacagtcttatcccttctcattactcatggtcaccctctgcattttaatagagaaaaatagccagttatgccttctctgcatgtaagactgaatggacaacaaacatgatgtttgagcaagaatgaaaactgagcttatatgaaaagactttatccatctaatgcataaacatgaaagtgttaatctggaacatttgaaaaccaaatttat

SEQ ID NO: 64077 - DNA, 913 bp, Bovine  19866880353898
tattaacttcctttattaaaatttcataaaagagatggaagcttccagggaaagactaagcttctcctgggatagtcttagataccagctgggaccccccagggaaaaaaggaatacactgccatataaaaatgttttgaaataggaaaatatttaaattagataccatgtaggtgtctatccagtgatttttcgttccagcacattcatcaaggggagcggcaggggatgggtgtgatggtggcacatttgggggactggggtgtcttgctccccagagctctccctctgaaccgtctggagagcagaggggacctcagtttccctcatcttctgcctccacatgtgctcacacagctcgttgtgcatgtgggcgtggaccccgccgccaaggccatctttctggagcagtgcagcaagaaccgaggctaccgagacgccgacatccggggcttccggcccgagtgcggcgtgtgccttccggatgggccagaagtgatcgcatcagaggtcagcatgaaggcggtcagcaggcgggcggcagtgcagggcgtggaggtggccttttcccgagacgcgggtaggtgcgtcctgatactgggcttggaggggaagaggaagggctgaagcggcctctgaccaaacttcctcccagcatgtgccatcctgtgccatccagctgggtgcttggagctgcccagagtcatcacccagacccacacgttgctcacttctgcctaggactgattctgaggaccctcccactcactagcctttgttggctggcagaagagaaggggtaggtaggggatgttgagaggcactaacattttgtggatgacttttttttttgcagtattttattcttttttttaattggatgataattgctgttttacatatatatatatca

SEQ ID NO: 64078 - DNA, 1571 bp, Bovine  19866880454887
taattgaagaggggacacctggcggggtcaggcagtggacagtggacggagcagacgttgcagtgtcttctatcaagtgtctccgtttatgttttgattcaggtttgcaccttaattcagcagaagctcaagtccgcttgtcaccatgaagtgtgagcttgctgctgcttttgtaactgaccagctgtgaaagtgcatagctttctctctctgctctgccagagctggccatcccctgcttcatccgtatccttgtgcaagacagggtcatgtcgcagtccaagggtgccacttcctttcctctcccgtctctgcccagtagggaggtcttccatggccacacacaccacagggtatgtatggaggccgctggagggctttggctaaaaaaaagacatggagctgggaatccctgcaggaaagtagatgcaaggagtgaccgggtgcagagggcattcaaaaactgatttctgagagccccggactgagccagtttcttttaatagtcagagaaaggctctgtggcagctttccagttgtcaattttagctcctccaaaaggctgggaagaacaggccctactcgctgtaagagttagcaccaaaatagacatgttggggccttagttttttttcttttggttgtgtgtgtcttcttaaaacttaactagatttttaaattataagagtagtacctacatataatttttaagaaatcctaagtggtaggaaagactaaacaattacaaatttaaatgtcctttccttcgtgtctataagcctcaccctcccttctccccatttccagtctgatttttaatagcttactcactaccaacagtttcccaggtatcttttcagaaattctgatgtgcacacacacacacacacacacacacacacacacacacacacacgatcagagcctagtcccgcccccctctcggctcagcttcctcttgggcctcccactcggggctctaaccacggtggctcctctcctcatcctttggggtgtctcattatcagatcccacattgggtcaggctgccgcacggagctctcgcagcatctggtacctctccttgtggcgccttcacgtcggtatgtttccattcacctgtgtgattcttcactaaggcctgtctcactcactaggctgcttcttgagcacaaaacctctggaaactgaaccttccatcatagtcccagacctaacactgtgtccagcacattgtagtgtttaattggttgttgactgaaaggacaatctggttcacatctgacctttttaaattaagaatacactttggacacctttaatgtcagaacacaagacatccatctcattctgtttagtggctctatagtatcccatcccatggacagattgtagcttcataatcaatttcctactaatggattttaagggcatttctaatttttcactattgtcactgaccctgtttctttgtaaacttgtgtgcatctgtctgttagtaagtttatagaagggaaatcactgggtcaaaggttcagggtattataaaactggagagggaatatcaattg

SEQ ID NO: 64079 - DNA, 1670 bp, Bovine  19866880480075
gtgagatttgtgctgagtttttgtttgtttttttgtttttcttctgatgggcaaggctgagtgagatggtaatactgtctcctgatgattgcgtttgtttttttttgttttgtttgttgtttagatgaggtgtcctgcacagggtgctactggtggttgggtgatactgggtcttgtattcaagtggttttgtttgtgtgagttctcactatttgatactccctagggttagttctctcataccctagggtctgggagttagtgctcccactccaaaggctcagggattgatcttggtgaatcaacccccttagaagcagtcagccctcctgttagggattcaatatcctgcgagcgctgagtgcacatccttcctgctccctcacctcttgaggtgctgtgtccttccctcttaaggtctcctagtcttccttgtattgtttaatttccacatatttgtgaattttccagtttgcctctgttattcatttttaatttcattccattatgatcaaaagacatacattggatgattttaatcttttaaaaatttattaagacttattttgtggccagtatatggatataatggggcttccctggtggctccagtagtaaagaaactgcctgccaatgcaggatatgttagagatgtgggttcaatccctgggttaggaaggtacactggagtaaggcttggcaacccactccagtattcctgcctggagaatgccatggacagaggagcctggtgggctacagtccatgcatgggttttcaaggagtcagacatgactaagtgactaacattttcaccttcataaagatgtagggatcaaatgggttggcatttatgaatgcccctagcaaagggccagttagtggcacccaatggcaaagggctcaccttgacttactttgaaaagtttggattttggcaaactaggaagacaagataccaaaaaaggggggaaaaagcacaatccagcttccaattcagaccttctcagccgtttaaagtaaacagctctcatgagtaattaccagagggaatgtgaacgggccatggagaccctagtcaggagggaatgaacaaaaaatctccaagatacaaaaagctgagaagccgtggtgatcaaagacaattttaaagacataggactcaaggtaaaactagtttaaaaggactgctttgtcagctccagcatatcttcaactggatgttgacaattacacagcttttttcattctagcataaaatttcaggcaattaaataaatgaattactgtgttggccacatccatctctgaagcccgtattcccttggggcagctcagacagtcctagaatttttgacatatgcagtgaattgctcaaaaaaaattttttttaaaatgaagtattaatgaagacagatctgaggtcaaaggtacctcaaaacaatgcaaacaccttcccctgaattactaacgctcaaaagctcccgagctgggatctcaggcagggacttaccatcagctgcgctgaaatactccgggttcacagaggcatacagcactccatttcccagcctgctgctatttctgccaaaaagatgaagtttaggttagaaaaaaaaaaaaaacccacacatttctgtttggactttcttccgttttatttgttctga

SEQ ID NO: 64080 - DNA, 3765 bp, Bovine  19866880597006
actgccgcagtaacacaagccctccctcccccgcccgggcctcattcataaaaagccagctctgcctcagcagctgcggagccggcactgggtctgtgtctgcattttccaagacagagggacaactgagacaaagagccccgaagcctccagcccccaggggcctgcctctggggctcctgcgctgctcctcactggctccaggtccgcctggatcagcagagggcctctgcagagcggcttgtgggagcagggctgaagccatgcccctctccagggcatcttcccgaccccaggaatctaaccagcatctcctgcattgcaggcgggttctttatagctgagctaccagggaagccggctcacaggcccagggtggtattaaagaaactcccggtctgctgagtcactcgccgactctctcacctccctgctatttaaaaaataatcacaaaaaccaaaaatcgaaggttcttccttgttggcaaaatgggggctgccagtttatctaaagactgccaaactggggtggaggtggtaacaaacttccagaagaggtggagtttttaaactgtccactttcagcttgatagcaccatacttgaacttttcacagccagggcagaaacctctaggaggttatgcacaactttaattcttaatactactttttacctctctaaagagaacaacaatggctatgcctcattcaggtaggagtccccccacatccaacccttttccatgcctcccctctcagcacagcttctcccaggcccacctccttcctgcaaaggaacatgcctcgctcaaactcaccttcccttaggacagtcagaaatcaccatgatagatgagaggctatccattttctttagactcaaaactcttcttcaaaacaaggcccgaacacaaaggcatgttctaatttagcaggaatggtttcaatgcaagaattaaatagaggcagagtgcaagaaggggagacaggaataaaatcattcttgttgccctaataccagagctgtcttccagtaaactaagatataaattctccccagagacaagatgatcagcactattaactagtcccctctctgctcttgcaaaaaacacaagcagggtttcaaaaatctcagatgacaaggggtgcaggagagtctgttacactctcagagaatcctaactttaacaccagcatccggctatactccggccctgctcatcagggctggggcccaggcagccttgtctctgcccaccccctgccaggccccctgcccagatgggacagataccctcagcgccctcctgcacagagcatccatttctaacacgttctctcccctcaccgaaggcctcccttcccaccttcacccagggactgacagccaaagaaatgagaaaataatgtggggatagcaaatgaatcttgtgaaatacctggtctgtaattaaatcacaataattctagaacctcctcaagggcagcaatgtcaagataacaaactgagagtaaaataaacaagtcttatagaaattacaccagccttgacaaagagattaccttagtggctgctgcctggaatccacaatctttttttttaaattcatctcagaccttctggccattgtgtgagagttcccatgcagaaacctacaggcctgtggctctggtactgacagtcattcctgaggggcccatggagggaggaggtatatgagtcacacataatgcatacagatttagggagattttaatacctaaactgtctctggccccactcctaaacaactgctaatcattaaaaatgtgtcgtaagtccttgggtgtgggtatagttacccaaagacatggcaacgtccctaaaggaacaataaaatacaccctagggtgcacatcacttaatcaagcttcagttcagttcagtcgctcagtcgtgtccgactctttgcgaccccgtggactgcagcacgccagaccaccctgtccatcaccaactcccggagtttactcaaactcatgtccattgagtctgtgatgccatccaaccatctaatcaagcttgatccaaattaaatgggaggtacagggcaagatggctaagctctctgtccttcagcagcctcatctgtagaatgggtataacaatggagctgactcataggggagtcctaagaccttgtacacagtaagtgctcaataaactctaggtgctgttgctaagctcaccctcccgtctaaattctcagctaactttccagcacacagaacaaaaccctttcttttgttcttcctggtgtgatgatctgcctgggccagtcctccgcccctcactcatgggctccagccccatgacctgtctcttcttccttctctgccatcccataagcatcccatatgcatctgccaatcctgctggccctctgggatgccaactgctttctcacaccaatccccacctccatcccggtctaaggcacacaccctctgcccttgatcagggcacgtgccttctcctactggcctctctgcttctgtctgggccctagggtccacggtgaactcagaagccagagctgctcctctgctcagaaccccgccatcgcctgtcccaggcaaagccaaggtcctcgccgtggcccctggccctccagcctcctggctttcctgtgcccctttctttatgtctctgcccaaacaccgtctccctggagaccccctctgagcactctatggaaaagagagccccgcccagcccgccctgctttaacaaacgctccacaaggcagatgctcccggctcctggctctactcctctaccgagaacagcgcctgacaccgatcaggcgcccagtgggtgtcgggtgagtaaacagccctgccccgccacacacacagcccaagatcacccccgcctcgggagcttcctgccctggttctcctgccggcgcgtcccagcatctcctcctggctgactcacgctctcagagcaaacaccccctcctcggagagcccaacaccaaccgcccgaccccaccccacacacagagttactcatctgctcctgctcacagggcgaatcgctgtctaacatgatagctggactgtgatctatctgtgccactagaatggttccatcccggtgggcatctactcatcccggggcccccagcgcctacagcagtgcacccgaggcagggtttgtgaagggtggtggtgcgcacactgacagttttctaaaaggcaaatctgggaacgggacagaagggcctgtccttccccgcgtccttcccacacactctgaaggttctctttcaatgcaacaaccccgtcgcctgcagacacctccatgctgatgggctccatggtcgctggcagaagcactcaagagctggggcttatttatgcgcaaaggaaaacaaacctaagttactaaataacagctcgacatctgtcaccacagaggagcagctccacacacagccaaggatcccacacggcatggcctgtccaaacaccaggcgtcagctccccttccccctgagcgagcttcagcgtggtcatcacggctgcccggagatgggcttagaaaccagcgcggggaccccagcgcccagccccctggcctctgaggcactcaccactgtgcagcgggaacatcgggcgaccctcctaacaagaccagctgcccatcaggctgcacgttttgccgcacctgttgaatggtgctgtgtggcagcggggaagccaggaccacgaag

SEQ ID NO: 64081 - DNA, 1466 bp, Bovine  19866880618689
ttgaagataaaattatttcttttcacagtgataataggattacaaattttggtggagcatagaactgtggttaaaacattgttatctctaaactgggagctttcggaagcagaaatgtatttggaattgattgtaatacacaggtaatttgtcatcacatttaaacaagctggaacattttcaaaatatgagtgttacttgtctattagtctgccgatctagctatctatcagaagttgaactgcaaaaatttttgtgactgagatgacactgagtacaaaaacatgcatcagcatggtggcatgtatttagccttttttttttttgggggcagttaatcatgaataaaatttcagaaatgttaaagcctttgaaaatattttataaatcaactgaaatattctgtaatggaattaaattttcccgaagatgagtcatctaactgttggttgcattttggttacactttgttccaaacaaataattcaaacaaataagttggaaatagtcaaccaagtattccaggaatgaagcaacaacaacaaaacaaatccgtttttgaagctttttagtgaattgcaatgattgaaaacaatgctctaagcaggaagatattacatttttttctccacaaaagcaaaggacgcataatgagataccacttcacacccactaagacggcgatcgtaataaataaataaatggaaaataatgagtgttggtaaagatgtggagaaatcagagccttttgtgtactgctgatagcgatgtaaaatgatgcagctgcagtggaaaacagtctggggttttccttaaaatattaaatatagaattaccaaatgacccagaaattccacccgtaggtaaaccacaaaaaaacggaaaacaggtgttcaaacaaacacttgtacagaaatgtccatagcagcactatttacaatggcgaaaaggtataaatagcccaaatgtctgtcaacagttgaatggataaacaatgtacagtatatccataccatagaatattattcagccatgagaagggaatgaagtcttgatacatgctgggaggtggatgaaccttggtggcattatgctaagagaagctggaaacaacggtcaaacactgtctgagtccattcatatgaaatacccagaacgggtaaacccatagagacaggttgtaggtaaacggctgtcagggacggaggagaaggggtgtggggaaggactgcttaatggcaaggtccctttctgaggtgatggaaatgttttagagctagatagaggtggtggctgtacaacactgtgaagggagtaaatgccgctgaattgtacactctaagatgatgaattttgcttcaattttttaaaagtgaggaggaactgaacacattaaattaaatggtttatatgatttgggggaagggctcctattttttacttttttatattatgtttttaacaaa

SEQ ID NO: 64082 - DNA, 1545 bp, Bovine  19866880621523
tcccggcacaattgacaacactaataaaaatagataacgtatttttaaaacctacagcagattgtcatggcaataaataattgtatcatgttgctgtcatagcaacgaagtctgtgtaacagagacaaatcaagcctatatggaatttttctaaatttaggtgtttgaaaagagttaaaatagcctatagtcatggagaggtgcattgaaaaatccttaaccttcattggaaaaattagttttagccatttaaaaaaactgaattgcttattatttttttgttctctttaaagtataaaatttactttcctttttgttcattatacatacatatgtattcttaagagctttcatgagcagtaaaagactagagagaatgctctctcactcgttcactctctcttcttcagaagtaatttgcaaggcagcatatcataattcttgtattttgcctggtagctaatgacacaatattaatggaataacaagtcacattagctaagccatgccataccaagttaatagctagttttcatactcttggctccgttttcttaaaaagcatttattactgcatgctatctagtgtgtcattaagaactacagactcccagagctaactatggttattctctgacacagtaaactttccctcccgacttcaactagatgctactgaaatgacaaataagtgacattgcccgaaaaagggagaatgatttttttttcacagatatgtaattattgtgctatttaaaaaaataaccaaatctaaaacaattacatgaaaaaaatcctgcagtttcccatgtaacgaaacaagacctctgttatttaaatttttttcttttctttggcttcaatgaaaaaaaatgtgtatttttttttcttctgtagagatttctgcaccagtgaggggctatcaaactataggaacagagttcaattcaaagttcttactacctacatactttgtgaacttgcaacatcaccaaacagtattattttgctctttaaaccatttagaaaaaagaaaatttagatcacattttaattaaatgagatagtaaggcaatgtttctaatgcatagcaagagctcagaaatatgttacccgttattttacttcaaatcaaagattgaattacatattcaacattgataagagactaaaatgatgagatccttaaacagttatgaagtagggggaaaaaactaatataagaattataagtaatgtattataaatcaatgactctaatgatactaatgtttttctttaccatgtagctttataaaaatttccatgatttatttttcttggatgaaactttattaaaaggcaactttcagagtgagcagactctgactttcctggggaaaggggggcgatggtgtcacagaaggacagcattcaccccgctgacgaccactggtttcagaggctggctccctggagcacgtggggcttcctggaaggcaggagacgagcctttggtccctgcagccccagctcttccctaaaaccctgctggctgaccataaa

SEQ ID NO: 64083 - DNA, 1840 bp, Bovine  19866880621893
gaggtgacgttcgagttgaaacctgcaggatggggagtcagcctatgaagagggccaggtcgggggcagggaggtgggggtggagttccgggcagaaggagcggcaagagtctgaggcagcatagcctgctcccccctctccctctctcacacacactcagacacacacacacactctcagacacactcccttccttgaaaggccaatgagctagagactcgtgggttactgcacagatgggcaggaagcctcccatgagagaaacacagatggagcggggccaggggccctgggacacggggccaggagaggaggaagaacagaagggaggccaggccttcgctcccggctgccctggacagcggcagaggagcagccctcctgagcgtctcatgcgccccactcagagtcctgttgtccctgccgcctccctcatttctcacctccgagttgcccagggctgtgggttctacacgtttattgacatcccccgactcccccacgactctgctccagcccctggccactgtctcggagccagctaccaccatccttctccaggacgactgcaacacaaacatgtagagaacacgggcgtcagcggacttgccgcgtacccacaggcaggctccggctttcttttccaaggggacggccagctgctggtagaaaagctgggtccgcctatttctgagccacagagagcaagaaatccaggctcccttttaaaacttagttttcaaactgctttatcttggccgggctccctcctgatgtggagctcagccgtcccgccccgtccttccagagtgcagtaacactcctggcactccctctttccacttgtttaaggtcacactggatttatgtggtaggagatttttgcctttctctccgttcctggccgtccccccgttaacccacagttctcctgcatccggtgaggttttgacaacccctggaagctctcaggccaggatggtccgtccagacccagtcctgcaccctccagactgtgatgccaatttaggaaggtctgagacatcatgcgtccaccacaagccacggtaagcattcccatattagaggaactttgcgcagcaaatgtagccttgtcctgggcagtctgtgttcagagcttatacatgctttcaaagggacagggaagatgggggctgtgtctaggctgctacagttagggggctgaccccgagcagaggaactctgcctggcagctgacgatgtagggcagcctgtgaccaggagacctggattctgattcccactcagcctgtatcaggcaagggaggctccacagtttccccacaaaaggttaagcccttgaccactttaaccaccagctcccattcttatactatatcaaccaatctataaacatctccagtaactaatgagtgcttaaagtgattttaagcacacttctcaaaacaagaacgggattctgtatatgaaatcaatgtcagtatgaccctcttttctttcagaagggatctgaggtggactgctgcagcccaacagtgggttagtcaaagatgattagaaaaatcaatattgagagatcaaggacgaatcagactctacccgtgggctaacatggggctctacggggactccaaactaggctctgaatggtccagagcaatccaggacaatgaggaaaccaccacaaaagctgaagggaaggggaaactaggtgggctgctggtggaacgacaggacgtgaaccatgcagaaggctccgtgtgtttggcaggatggagaaacagcaagggcctgacggtgtgttctaacagagacttgacctgtgcccacataaga

SEQ ID NO: 64084 - DNA, 2214 bp, Bovine  19866880636876
cttcctccttgcttgctggctttcctgtctccgagctctgcttttgtcacaatggcaaactgtccagcacctaactttgctaaactggaactcgaaactgatttcccaaatggagatcatacaacagatgattctcacaaacacttcaattatttgggtaaacttggatgtgctaagtagcttcagtcatgtctgagtcttcatgaccaaccctatggactgtagcctgccaggctcctctgcctatgggattctccaggcaagaatactggagtgggttgccattcccttctccaagagatcttcccaacccagggatcgatcccacgtctcctgggtctcctgcattggcaagcacgttctttaccactagcaccacctgggaagctccgcaaacgggggggcggggggcaaaatcaaagcaccttgtctgagtctactgaaacttttcccagagacccagcagtccactctgatgaatgcaaggtctcatctaatcctcataaggcagttgaagatcttattttgcagatgagggaagttcaaggtaaaagaggagaggagtaacaggactgggttgtgtctgactgtctcctttcttatactccaagctaaaatgacagcaacagatggtctgttggaacccaagaaggccttcagtatcagagaaattaaaaacatacaaacgttcagagagagagagagactgcatgtgtggtcctcggatatgtcttgaattattgagggtaacccccccaacccagacacacctttactgaggaacatcatctagatacagaggcaactctcatgggaatgttacatgccctttccctagcttttcatgctagaactaagtggggaccggcatacagccttatctgaaagcaacaattctcagtctcatgcctccttgctaaaagaaaaaggattcattcccacataggcatggttggctgaagccctttttggaaacgggctatcagagcttgggcatggattcagctatgtagaactcccatccattagaatctagcacatgtgggaatgaaaaatgtgcaactgctgtgtgtcatctgggccatcagcaaccatgaaagccacagcaaacgctgacataaatacaggaaaatcctgaagccgtttaggccaactgcacttttccagaagatgaaatgaccattacttttcccattaaaacggagtaaagctgggtagaataagcaggtctaaggcatcagctgggaggaactctgactcagggcaccactctgagagggaggggaggggagaaagtcaaactgagctttgtgtgcagacctgctaagcatttaaaatacatgaggtatttctgtacagtaagtccccaactgggcaaagtctcctccattttgcaggtgaaaaagttgatatcaaaggaacaagacatgttctcttcttgccccagttctcaaatagacaggcaacagcactcactatcaaccaaccttccaggaagcactacagaaaaaaaaatcacttctcctccttctaaacctagagacaaaacccttctcaatctctagaccaagacaaacttttcacagggaatgtcactgattcatacaagtggcggtggccaccgtccgtccttaactccctcatttgaaatctggagaaaaacaactcagtcacagctttggaatgcaagttataaaaacaagtaattcaccgctgctggcttctaataaaaggcaaggagcatctataagactgagttttctcttacagagatgtgtggtgggagaaagtgaccagtctgcgttctgaccgcacgtgggcgcagggctggtgagagggcgggactggactcgaggaggccttgagcactagccacggggcccttcctgccgcgggtcccctaggagacggggaagggtgcagaagagcatccaccgcccctgtctatgcctgcgcccatccaacactctcctttctttgagggtagcaggaaacgctttggggtatttgtcctgctgctgctgctgctgctaagtcgcttcagtcgtgtccgactctgtgcgaccccatagacggcagcccactaggctcccccgtccctgggattctccaggcaagaacactggagtgggttgccatttccttttccaatgcaggaagtgaaaagtgaaagtaagtctctcagtcgtgtccgactcttcgcgaccccaggac

SEQ ID NO: 64085 - DNA, 798 bp, Bovine  19866880639542
tgaatcttggactgtacctaaattggttacctgctcttcgaatttgaggctggtttgttgaaagaggcaagattttcttgttttatacaaatataagttcactcataccaggagttgttgctgtctggcaggcaaagttagttgaggaagacagggttttattttgctatactgaagttgttcgagagttaattaaaacaatggctgtacagtttatctagtgtggctttcttgagatttcggagatgcttgtttgtaatcaactcctggaagtatccagctcccaagggtgattccttattctggatctgcagagggaggtggctgtacgcacacgctttcagcgccgcctagcgacaggtgtgccggaaggcgagcaggcgctcagtcaaggctaggggctcactcttggggggcttactcttggggagcggggggctggtgggctgaggactgctggacagagtgtggcatgctgggtaatctgagaagtgtggtgaaatgcaggagttagccccgaagcactttaggatgcacttccgctcattagcgtttatttcctgcttatttatgggttacaacattacttacacaacaaaacaaactctaatatgtagtatgctcacaaagtgaatcattttagtgttactattagcaaaaatcataataaaataagatcgttactagaattgttttaatgtgatagaagtgctgaaatgtctttctacctttgcgtctcctccttctaaaaaaaaaaaaaagaagagtcctgaaaagaatcatttggtttcctaccat

SEQ ID NO: 64086 - DNA, 2161 bp, Bovine  19866880656597
actttatagaatgttaattaacaaccactgtcttttaaaaccctttatattgctaattagagacaaaattgagaatttatgtattttttctttatattttatatcattttaaaattactttgaaaattaacacagtatctttcttctcttcagatcctttttgtttcatgcattctctgaatgctctacttaatttctttaaacagcactctacataaagggtattagtaactctgtaaaaattgtgatgaataacttcccatttcttcctctctgcttagaaaaagattgtactatgttagtatcagtcactgagatattaagccttaagtggtagtagttaatttatttttgacataaggcttttcagaagaatacttttgttaaatgtttgtacttctccctttgttgtcacttaattattttttagtattactccttattaggctaaattattttggtatctctaattaaaaattaaatataatgatctggcttttaagaaaacatacagactaatgatcctgaaccttttctctttgctgttggcccagacattgcccgctttggtttcctaatttagtaacagaaataaaactatgcaggactgggcaggtttggtatgctggcatctagccaggaagcattgggtttcttaagtaaatggacctgtggggatttgaggaaaacacagattaagttacatgagctttgcacttcacaaattcctaactatttaaaggaacttggctaacccactgccacctaaataaaactcaattttgttgaaacacacacatactaaatgatgtattgtttcctttttcaaaattacccttatctttgtgcttttaatttcatatttttgtaaagttttaaaaagcactttctcttttaatagtgcaccaaaattatagttaaactctattcaattattttgtgcatttacaatacctttcaagggcttccctggtggctcaggtggtaaagaatctgcctgcaatgcaggaaacctgggttcgattcctgggttgggaagatcccctggagaagggaacagctacccaccccagtattctggcctggagaattccacggattgtatagtccatggggtcacaaagagtcagacacgactaagcaactttcaacctccatcttgtcacccagtgactggataaactggtttcctctattacaaacagcagatgaccataagcttcattattattttttttaaatttcagagcaatgttggaagttctttatgaacctattagccgtataggttatagctcatataaagagctatgcattctttataactctttttctccttcaacaccgctggcctcttctttggcttttatgtgcacctcgacaagttctggagaaggcaatggcaccccactccagtactcttgcctggaaaatccaatggatgcaggagcctggtaggctgcagttcatggggtcgctaagagtcggacacaactgagcgacttcactttcacttttccctttcatgcattggagaaggaaatggcaacccactccagtgttcttgcttggagaatcccagggacaggggagcctggtgagctgccgtctatgcggtcgcacagagtcggacacgactgaagcgatttagcagcagcagcagcagcagcagcagcgacaaattcctaggttggagagtttgcagtgatggggtaatctcttttttctgtgtgttgtttggttttagcaactctcttaatcctaatctccccatcatttgcttttcttttcagttgttttccaaaatcatttatacctgcatctaatctgacagagtcaacctcaaacatccttcccagctgccctttcccaattctgcttcctcagtagtatttagtctatttatcaccatattgctaagtaaacatgtctttattgctatccttactttttagtcttaaatactacacatcgatctttcactataggacatgagctttcacaccttcccctccccctgttcacttgtatgtttcctagctccacttcctgatatgatgacatcatacacatgccatgcagcatctggctgtgtaacaactatgatcacatttcctattatgtatattttctttttcggagttaaagtcatttttctcat

SEQ ID NO: 64087 - DNA, 724 bp, Bovine  19866880734245
cctttgaaatatctctgcctttgtcaaattctttgaagcttccttgaacctgagttgtgttcagaaaactttatatctgatgctgcattctggggccccggctcctggacatccttggctctcatactgcccatcacccttcctgagccacctgtcaacttttgatttggcctttaaaattaaatgcaagtactatgaatggtatttctacctgtaaagattagaggcaaaaggatacttctgaagggagagtaaggcttgccccagggtatggaacagctcaaccgaacacttgaaaacatctgtattgtcactgtatggaggcgcaacggagctggtgaggatttctttggctttttctgcatgttgttttgcttgtagtgacattcctgtggacaaaaaaaaaaagaaaggaagtctcagtttctctttcacttcagttggacaggaatatagttgattttggccggggaatctaatgcggtgacttcacatatctgcatctggcatgtggagttgtttcagggcagcatgaaataaccatcataactggaagaaacagtcactggaagttctcaagataaaaatttttcctccacatgttctttttggaaatcaacagaataagcagaaactgaacagctctgaaacttcaccagtatcagatacaaaatgttataaataattataaaaaacaaaaggaatttacaaagactgcagcatt

SEQ ID NO: 64088 - DNA, 1453 bp, Bovine  19866880878969
actgtagccctccaggttcctcggtccatgggattctccaggcaggaatactggagtgggctgccatgccctcctccaggggatcttccccaacccaggagttgaacccgcgtctcttatgtctcctgcattggcaggcgggttctttaccactcacgccacctgacagccccatcatatcatcaagtggttcttttctattcgagaatttttaaatgggcttcgttttcaaggaactgagctgtttactgtgcttgggcaattcccatgggccggtttgctgaggatgtagtcaaatgggcttggcagaccaagcacggggatggggtcagggtttcagtgggtgaggttgctgacactgggggtaagtccccctctctggactggccagtgggtagggggctgtgcttgcccacttctcctgcagcactggcactttttaattcatctccttccttctggaaaccctcctccttctaccaataatgcactcatgggaaaatagacttttaaatgatttacttagaaataagtcctggccacagcatcaagccgtctggactcagcgtccagggcctggtacattctctctccaccgcatgatgcttttaaaacataactctccccagagttgattgtgcttccacataaattatattgtttaggttgctggaagtttccttggctttctgcttatcactgcaagaacagtttgttccctgccgccgctgccaagcatgtaagcaaacatgtttcttcttttcgtgatgacaggcgcatctcatcgtcctgagaggaagcccctctcgagaggaggcagccacgtctgcacactccgtcgcctgtgccgccatagcttccgggaggcctgagcaccacggtgagagcaagagtgagccttccatgggggcagagtggccagctccctgcctggcccttgcgccctcggggttgtgggctcgctgcctttggcatgggtgaacaggcagagggagctatgatagttgcctcagagagccttctcggttaggtccagcagagccctttggtttctagcccttttcagccttcttctagacttgtattctcaaacacagcaaacccaaatgtagctatcagagcctcagagagttcatgctgggcttacagggaagcctcctgggctttcaaaggtgatctatttttaaagattgttgtggagctactgtggcaacagatctggcctgttgaaacgccagccttcaggctctcccagggctgagctttcaatcaggataaacttacacgtcttcaggattccaaaaggaagttgccacttatgagtcatatagtttttcttagccccacataataggtagaacagtgagcttgggagttttttagtctttcatcccagctccgagcatacagtatgcctctattcatggagaacatgccatcctaatgacttttt

SEQ ID NO: 64089 - DNA, 2115 bp, Bovine  19866880916877
ctttctttaagggcaagttttgcattgtttagtttttatggtggtggttctgaatttggcatttcctgtccataccaagacaaatttgtaagttaaacttaaaaaaacaaaccgtataacctaaatgtgaaaagcagtcctgagaaaggactttacactttacatgcaacctctgcatttaaaagcgtgtatctgtagtgcccttccgtcttcccatctcagcttcctggtgactgtgcagtgcgggcacgtccctgtggcagtgccgaccgggtcgtgactctgttccctgtgggtgccaaggttggggtgggtggggggctctccttccaggggctcctgctgcagccactccccagtccttccagttcagggagggctctttgacctcatgggaaatgtgtgctttggaaacagacaatgtagtttcatttccaaggaaaaacccacccgtttcaactggttaatgcaaaaaaaaaaaaaaaaaaaaaaaggcatttttcatcttactcaatgaaaaagtctgagaatggatcagggttcaggagaacccctgggcacctcccttcccccttcacccgccgacttacctgcctgtacactggcttcacccttaggatatgtgtggtagggagagggttgtctgcaccttcatcctgcgtccacccagactttggggttggggcccacgtgtctgttctaagggcatagactcatctccttatgtctctgctggctgagctaggctcccggccctgccctcccaccagtgtgttccagagaagtgatgcttcgatgggccagcccaggccgcatggtccccgaacctcatggaggaggaagaggacaaggtgatcccccgggggaaagtgtggatgctctgatcagaagaacggaggtcaagaaacaacacccacccactggagacgggctgcacggggccgacagaagtgtatttcagcgtgtgaacaggttggagatacttcaaaggcaaacaggactttggtttctttctctccgtgagttgagagagggagatactctttcttcagagatactcactgtggagcagagacagcctctggcttctgcctctcctccccgctccacccagatctctctgccccgaggagggcctggtgccactgctgtgttctcagagttgcattgaacaggcacatcaaattaaaacctttcgggcttgctcaccaacgtggtttcctgtacagtactcccctgaggggggatcacaagtagttatccatccgtttcattgatctattgtttttattaaaaagaaaaaaaaacccaaccatcagaggaagtgcagccagctgtctcaagaggggagatgatgggagatgatattttgattacattaatccatatcctgttagttcccttggcttctgtcgctgccactggtgaagtcactaatgtgaactaattacatttgctctgaaaagccaaaatttttaatgcgtctcagcaagaaaggttaatattatcaatttaacagcgtgaatgaaacatggtgtgtattgaactcgaactgtcctagaagcttggataataaaaacccagtggctgcttttgtagcccactggagaaacagctgctgctgaaagatgcttcatcccttcttcttctctttagtctgatgtgggcaggcacttctggatgctctctgttgaccgggcggtctggtgtgtgacatagcagaccacgtgacgaaaggtgcttccttcccttttatgtcttcctgactgttggggtgttttcagagagaaacacggatcgcctcacctcccagtgctaacagccttcccgttttaaaagcctctgaattatcaagacttagagcacttcacgtgtcggtcgtttctccggaaccagccagcccctagaggcagcattctagagagctgggtgttctggaggggcgctcccctccaggggtgtctgtggtccagcctcttgtgcccacccatggtccctgcggtgcccgccttggtgacgggcagtgaggatgcatgcagcctgcttggtgctctcggcttcttggaattggtgggtgccttgctctgctggcagcgtgtcgaaggttctgactgg

SEQ ID NO: 64090 - DNA, 4512 bp, Bovine  19866880969245
tctccagtttgccagttgccactactctatactctactactactctatagagtgccagttgcactctatagctgtagcagaaaaaaatctacttctgctttattgactatgccaaagcctttgaccgtgtggatcacaacaaactgtggaaaattcttaaagagatgggaataccagaccagcttacctgcctcctgagaaatctgtatgcacatcaagaagcaacagttagaaccagtctgttgttctggttccaaatcgggaaaggctgcatattgtcaccctgcttatttaaattatatgcagagtacatcatgtgaaatgccaggctggatgaagcacaagctggaatcaagattgccaggagaaatatcgataacctcagatatgcagatcacaccacccttatggcagaaagtgaagaagaactaaagagcctcttgatgaaggtgaaagaggagagtgaaaagtttggcttaaaactcaacattcagaaaactaagatcatggcatctggtccaatcacttcacagcaaatagatggggaaacaaagacagactatttggggggggtgcttcaaaatcactgcagatggtgactgcagccatgaaattaaaagacacttgctccttggaagaaaagctatgatcaacctagacagcatattaaaaagcagagacattacttttccaacaaaggtccatctaatcagagctatggtttttccactagtcatgtatggatgtgagagttgtaccatgaagaaggctgagtgctgaagaattgatgcttttgacttgtggtgttggagaagactcttgagagtcccttggactgcaaggagatccaaccagtctatcctaaaggaaatcatccctgaatattcattgggaggactgatgctgaagctgaaaccctaatactttggccacctgatgcaaagaactgactcactggaaaagaccctgatgctgggaaagattgaaggtgggaggagaaggggacaacagtaggatgcggtggatggatggcataactgacttgatggacatgagtttgagcaaactccaggagttggtgatggacagggaagcctggtgtgctgcagtccatggggtcacaaagagtcggacatgctgaacgaatgaactgaactgaaactctctctattggctcctacacaaaaacagcaaagtagctgccatttgtcacgtcccctgttctgctgtttttctcatggtagaagaataagtatttgtatctatacctctctttcaaagtgcagggctgacataaaaggatgtgattttcaaaacatctgattatgatgctagtattttataacaacaagacagaaatgacactgccattaaactatgacttacaatcagttgtaacatgcactccagtttcaaagatgtttaaatgccaaaagaaatgtgcatctttgaatcaatgaaatgaggactgttacttgcctgccttctgaaagcatttcaatcagtgaccttttggcagtggtcccatatgggacctaaggcataaggggcctttccctccctggctcctgcctgcacactccactgagacagacgctagctataatagtcccactcagcagtgggttgggggattctggtgggacccctctcccaaccaagtgagcaactgtcagccagcaaccagttaacagccctattctgccattgctcagggccactgaaagccccttccccctccctattgttttatacaatcctgtataattcaggattatattcagaaaataattcaggaacaaccctgaatcctgactgagataagatggtttttgggcactcaagtctatcatctcctttgtctgctacccttctgattaaagtcatcattccatgctccaacaactcctctctcaatttattagcctgtcatgcgtcaaacagaatgagcttaggcttggtaacaatcttcctttcaatatgtgtggcaccatacagtaatacctttagcacaaagacacattttccagttcacttactttgagctacacgtttatcatcagccacttttcttttctttctaatagccatagctgggatttaaattttctttagaaatcagcctaggcctacacattgacttcccaagtctcacaatccactggcccacaactatcagacagacatacccaatcaattgatgctattccttctgccagacctgtccagtagaatgctgaagcacatgatcaacaccagatcaaagtgagaggaagtagaggtctgaagtggggactcagtcttccatttccaaaaggtgatgttcataaatttaataactggtatggcaggaggaccaatcaatctgtacagatgacaacgatgttggagttagctaggttccgaatgtccccagctgttacagatgttaacctttaggtgctgacaggtggggagctgtagagaggctagagaagaggcaggagctctctcagggtactggcttttaggaaataataaccattatgactgcatgagagtgtattagttgaaaaccaatcttgcccgtatgtaagctgcagcatcaaaaagctgtgaaatagaaaaacatcccataaagatacagaataccaaaactgaataaaatggaaacagaaaatctgaatagaattataacaaacaaataagttagtaactgaaaatatttatacaaagttaaacctatgcccagatagcttcagctgtaaattctacaaaaactttcaagaaaataataatgtgtattttttgcaagcctcagaaaaaaaggaaagggaacactttccagcttattctatgaagccactaatatagaatcaggaagccatttcctgataccaaggccagacaaagacaacacacaaaaacagcaaaccaataatgcttgataaatatgaacacaaaaaatcctcaacaaaatatatgcaagccaaatctagggacatataaacagatgataagctatgactgagggagattcatcctgggaatgtaaggtttgcttaacatatgaaatcattaatgtaatataccatatttaaaaaatagaggaggggaaaactgcatgatcatcttgatagataaagaaaaattatttggcaaaatccaacatccatttatgacaaaaacttcttcaacctgataaaagatttgattttaaaaacttaaggtcaaacatcacacttaatggtgaacatttgcatgctttcatcccaaggctggaaacaaggcaaggatgtttgctctcaccgcttgtattcaagatgggaatggatgttctaaacagtgcgataaggcaagaaaaagatacaaaaggtatgcatattagaaaggaagaaattaaaccttattattagatgacatgatcctatatgtagaaaatcctaagggattcatactgaaaaacaaacaaacaaacaaaaaaaaaaactactagaaactactgaacaaattcagcaaggttgcagaatataaaagaaacaagaattgtatttctatttaaaaatgaaattaagaaaacattttcattcacaagaaaaacatcaaaaaaataaaatattcagggataaacaaaacaaaaaagtttgatttaacttttttaacaaaactttttttttggatttatcaaaaaagtacgagacttttacactgaaaaacactacttaaaatagtcaaagaatattaaataaatgaagagacgttgcatgtttatggactagaagccttaataacactaaaatagcaatacttcccaaatattgaactatacagttaacgtaacctttatcaaaattccagctgcctcttgctgccccctagaatctgaccttaaattcatatggaaatataagagacctagaagctaaaatgatcttgaaaagaacaaacttggaggaattatatttccaattaaaaaaaaattactacaaagctaaaataatcaaaagagtgtggtgctgacacagaactgacatatagttcagtgggatagagtggagacccgccccccttcatcccaactcgggcattcccagccccttggctgcatctccaggctggggagcctgatgtggagccgagaaccttcacaacagtgcaaggacttctttcatatcactgttctccaggttgtgggtctcccacccagagggtataggatttgattttatagtgattgtgcccctcctactgtttcgttgtggcttctcctttgtccttggatgtggggtatctttcaaactcatagccccctcagagtaggcccccatggagaagaggccatgctgccaactcacatgaggggctggcagttggggtgatgaaggtcccactgccagcgcccagtgcccctgatctgtatgcccagtgtgtgtacccagtgtgtgtctcaggccaggttgccagcctcctcccgcaggaacaggcctgtggcagaagctgtacctgggaggcaccggttccagagacctagtt

SEQ ID NO: 64091 - DNA, 2790 bp, Bovine  19866881007242
gtctccttttttctgtttaagggaaaaagttctttgaaagagctcatcactaagagaatatttagattctcattttgactttgccacatgtaaatatgatctggtgaaacttcagttattaattcagatttattttacttcagagagtcttctttctctaataaaataaaatagaagtaggaccaaagggaccttcaagtccaatccagctataatataaattcttttgtccagaaaaatgagctacaatgcacatgtgatgattgcttttccaggataatttttagagaaatcaatgccacagatagatctttgacaagatggagatagataaaattacagtagatactcttccccaaagtcaatacttaatagtcttcacattttctctgctgattgatagtattaatttctagttgctatggttgctgaatttggaagctaacttactagctattatatgggagaatcaataaattaggataaatgtttatttcccttgtaggagaaaaataatgatcaatcttttacaaagtccttggccaatatgctctgggtaggggggggaagtcttcatgtgataaaagagaaataaatcaaagagtttctggattttaaaaatacatatttctgtaatatacaaaaccaacttcaatttcttgtctttctttttgtcattaagtatgttttattgaaggaagacagagctcatttaatagcccctaccccaatggccaaatctcttttaagcccctgctgcaaggagaggattgcagctaaagaaatgtgtttcagtacgaggtgtcctagccttctcagatgacaaatggagatcaaaataactgcttctaatacctgcttcctaggatttttgtgtgtgtgcctgtttgagagtattcaatgtggaatccaatagaatctaaatagaacctgcactctggagcacatgataatcacccctgaaatattatccaccattattatcatcttactattatcttcttacctcccctgttggtgagctctctgatccctgaggtgtgtcatttgatagttggactgttttgaaatctagaatgtacttctttttataatacttcgaaagaaagaaagatcaccacccactctcacagaaaacaaacaggcactttcttaaattggggaaaaatataagtgtagagatcgtggtatgcatgggaagcctggagtgctgcagtccatggggttgcaaacagtcagacgtgacttagcaactgaacaacaataacagaggccattgcagccctcagcagaactattggagttggccaaaaagtacattccagttttctgggaagatcttgaatgaactttttgaccaacccagtagctgatggccattaagaaagcagcataatagatagaattacttttcccagagagaactccacaaatcattagttaccagatctccattggttactctactgatgtggctgacgaagatctgtctagtcaaagctatggtttttccagtagtcatgtatggatgtgagagttggactataaagaaagctgagagctgaaggactgatgcttttgaactgtggtgttggagaagactcttgagagtcccttggactgcaaggagatccagcccagtccatcctaaaggaaatcagtcctgaatattcattggaaggactgacactgaagctgaaactccaattctttggccacctattgtgaagaactgactcatttgaaaagaccctgatgctgggaaagatttaaagcaggagtagaaggggatgacagaggatgaaatgattggatggcatcactgactcaaaggacatgagcttgagtaagctccaggagttggtgatggacagggaggcctggcgtgctgcagtccatgggattacaaagagttgggcacgactgactgaaccgaactgaacataagaggtagtagagaaatacatattgaatgaatgggtaaatgaataaaaccctgaaaagagatggtaaagaagtatgcagagaacagattaagaatttaagaaatacaagctccttgagagtagaagcttcatctgctttgtgctgtgttccagtgctgagacctggcacacaggaggagctcaagaaatacttcctgactcatgggaaaccactttagcaggtcaacgccacaaccagtccgtctagtacacacttgtcaaaggtcagggcagactcctttgttcctttgtgcactcattcagcaaacaacgtgtcgactgtgccctgaggtactgcatcactcacactgtgaaaaggcactgtcgtgtattttctcttgtgccaaactcctcagagcaggaatgcaacctcaagtatcctgcttctcagtgaccagggcacgggtataaaaagaaaggttccttacctcatgactgctggcataggacttggctttctcttcagagaggcggagtttctcccgaggaggctggaacagtgctctctgaagcagctggttttgcagtttctttctaggtgttatgctgacggcagcaacaatttcatccaggtggttggatatgtgagtttcctgtgattcttgcatatttttatatacattaccctctaatttttaaataagaaaacaaaagtattaatgataatttccaccattacttttagaaatacatatttttcctagaagttggtgttagaatttaagaaaatttcaacactatacccatggcttctttgaaacaagtagcttctatccaaaaagctcctagtgactagtactaactt

SEQ ID NO: 64092 - DNA, 2161 bp, Bovine  19866881008173
cgtgagaagaggcctgtttagagtagaaggcccggaaggatttatggagggccgcctgctgaaatagagcggtcattaaggagaggtgagcagccgttggaagcgggagtatttggtaatgacatggcacaaatattggtcagggaggcctcctagaatgtactgttttctgtttgctttgtaggggaggagagtctgctgcctttttttggaaaatggggattaaaagatgtgaatttagtgcctgtgagaagcagaggaaaggtctggaagcagaagtccttaactcggccccagaggcgcaggtgggcttggctgtggccctggaggctgctgctgggggccaagtgttcgggcagaggcctgcagaggggactggccctggacacccacctgccacccccagagcctgggagagacttctgatttttccatctagcttgcacttcatttcacctgcaaagatcagcaagacaagcttttactccttcccttttaggatttattttaaaacccctaacactctcaaaacggctttaccttagagtctaagtcttagacagattttcgtgggtgctccttgagagaatttgcaaactcttcttgaagttcttgttacttttctgcattgactttcccccagacatgggtagctgcatctgtaataatttccttaataaattcctgcagttggaagcctaaagtgtcacagtcatgttgtctgcccaactcccctttctttagggaacatcccctccctcctctatatgatcctgctgtatgtcagtcaagggactctcacctccctccagaatgatgggcatatgacccagggcagacatgctgactggtctaggaagaacacatgacccagacaagcataaaaggagtgcccttgggaaatggatgcaggttaatttgaaaagagacgtgctttctcctggagcagttaagctgggccatctcacctggccacaggagggtcttgtctagagtaggagagaatggtgccctggcacggggaaggagaatgcgaatggggaggcagagggatctgaagtcattatctgtgccctgggatgaagctgagcttagagtcagtaacactctggggcattttagttgggtgaaatcccctttgggtgtttaacctcttctgagctgtgtctctgtcacttccaacccaaagttcctaatacattaagaaaataaactttgtagaatggaaagacatttcatatctccaaataagcatttaaaatattgctttttgagtttttttattttcctttacttccaatggcccagtccttcctttgccacgtgtgcacctaactcaggtgctcccaagtgctcctcctctgtcctgttgcatggtgccccagcttgcaaaggccgagcagctgcagcagcttgaggcaaccaccttgttggtgatgaagtgcccgttgtgagaagggacatctgcaccatgacgctgtgccctggtgctcccaaagctggcccagagcagtgcaacagaaggaagttacctggaggcagtgtggtacagtggctggcagcgtgctttgtggagccaggataaccgtagtccaatcccagatttaacacttaacaactgtgcaagtttggcccagttccctgtgcctgaacggcattatctgttcagtggggctgataaggatatggaatccacagggctggctgaggattcagtgagttgttattattactaattgaaccccagagcccagaagtgggactacttaggccagagcctcacaaaaatcttttcatgaaatcccctgtcttatctgtgctactttggcgagtcccttaatgtctttcagcccacttttcctacctaacaacacatccctcataggaatgtgtgaagtctgggggaaaccgtgcttgtaaaatgtacataattgtgaagtggacgcagtaagcactcaggacacatcagctatcaggatgcaatatagttcttgcccagcaaattaaaatggacccacctcagtggtctctgcaaagcgcaaagctctcctaggtgcttggagtggcaagtgtagctgggcctgacgtgggggccggaagttctgctctggtcaagggcctcaaggcttcggcgcatgcccctgaggatggggggctccat

SEQ ID NO: 64093 - DNA, 1498 bp, Bovine  19866881009755
ctggagaatcccatggacagaggaagcctggcgggctgcagtccacagggtcacaaagagtcagacacgactgaagtgccgagccaggagcatgtggactggagaagcaggggagaaaagaaaaaacacatttgttctgcctgaaagacactggtccattgcagaatttgaaattcagatttttccatatttacttaacaatgtaaagttacagctgattcccatgtgttttctgtttagtcttggcttcgttggagcttgtcaagcttagagaagagggccatgaaaactctgattgcaatggtgtttccatccaccacagctcagagattctgagcataaatcaagggcccactgctgcagaggagcccagagcagaggtgttcaggaggctgtgcgagcacggccccaggaccagccctagaatgacacccatttgtcaccgtaccttgtggtcttctccgttatgggagagcccgggtccatcatcctgagaagtctgcccacgagtagccacggcctccttggaatgtcctgggtgagctgccctccccaagcaagacagtgaggtcagcaaatggagtgactctcaagggagcagacagacaaacgattactaatagaagggggaccccttatgatcatgtaaagcgtggttccccacaacccagttccatcctttttgatcttcaccctgacatttgctacgtgccctcctaggacaggaacacctgccaggttgttgggagagcacctctactcaagcatttctgagctggaatttagatctattctcccagctgttcaggcattatttggagtcatatttccccttctattcctcagccctcccctttgcgcattggaattcctactcacaagagagacatgctaatttagcctccctctgcatcctaccaaacaagcaccaacttggaagggggtaactttcttatcctactgtataacctcccaacacctcaaaatccatatgtgaaggtgtggtggggggttcagataccttaggcaaagaatgggcagttttctatttgagctgaaaagacaaatcgcatttttcaaataaagaatacatgtactacattttacctatataaataaatatgtacagtttcatttccagacatcataaatgaccaaaatttggtttgggaaattttaattataagcatttaaaaacaccagccctcattagctctctgtgatatgtaaggattttatacaacacagtactaattgcccatgtactttccttcacaaaaaccagccttgctcactactgtatcctgatcacctggacagtaagaaatgttgagaaatgctccgttaacagtgatcagctggatgagggaatgaagtagatcattcatcacacatcttcttcctttcctggtgtgtgaacctttgtttttcacgtgttatggacacgtgcgtgtgtgtgctaagtcgcttcagtcatgtctgactttttgcaatccca

SEQ ID NO: 64094 - DNA, 1973 bp, Bovine  19866881030622
tgtgtccgactctttgtggactgcagcatgccaggcttccctgtccttcaccatctcctgaagcttgctcaaactcatgtccatgaactcggtgataccatccaacaatgaacaacagcatacaactcatttaagaataagaaagggcattaatctctggagatctgagtccatgctcagaagctcaaaagtgaacgtctgaaattcacagcagtggtgcagccagggggctttatagcaagcctggttctgagctccattaacatataatgtggcaactacgtggctttggtggcaggagggggtgagccggggaagaaggggtttcctggggcctgagcatcagtcaggagtgttgctgaccacccagtaactggacaccctgtaggactgactgccttcccacccctccagtgtcagggcagggccgtgggacggattctgaccagtgagcaaaagtgagttgtgacactctcaggccagagctggctgctggcatgagtccttcaaaaggtctccatgaaacaaaagccggcaagtttaagaaaaaggctgcctcatccatctggtcctggagagacaagaaggcacagacccccgccacgatgggcgtgtgccatgagccaaggaggaaccgctgctgctgttggccactgagatttggtgggtatgtgccaggcataacctagcccattgtggcaagttcaaggcctaagttattctcaataatcctagaaaaactacctgcttttccttacagctgtggccaagatacaccagtctcaggttcttggtgagtctgacctaagtctccgggccagttcttccagcaactgtggatgacctgggccccgacttggaaagccctgctgccactcacggtggggtctagccccagctgtaacagttctcgctcatggggctgtgatttcaagccaggctgaggaattacagtgaacaagtggcctccagggaaggcttcccctggaagtgtgggccccacttggcataaaaagctgttttcacacttggctttattttttgctgtgagatgatagcctcctctggatgtggagccgtcagggagcaatctctctccccaggaagacatgtgtcaagcaggacgctgagaggtacgtgcagcctgggcctggtctcctttgtctgagccccgcgtgcgtgctccccacacacagtgtggaggggccctaagtgcccgcgggctgggcagggcacaaaacgagcatccgacagctcctggccagcggcaggctgatgaggaggtggtttttaacagcctcctgcttattgatttctgtgtggtgaggtcaacttcagcctccctcccatggagagaggctgcaaaaccaaagcggtttggtccccatctatttcctgcaggctctcggtagagtgaccagctccctgctggctgtgaccttgggcaggtcgccttgcccaggtctcggttgctctcacatccatgtcccctggcaattacatgcgctggaagcctgactaaggaccaggcactgcctcatgtgactgacacatggtcaggccttccatcctcgcccagctcccttagctgatcccggttttccaggtgaggacactgaggcacagggaggtcaggtaacgtcagtgaggtcatagagctggtggctctggggctcagcacagtgcccggctctgccacctgaacgctcagctgagcgttgcccaggccctttcctggggcaccgccgtttcctgcttcttgtgtcctgtgccagtttgtccctagcctttacatcacagctcccccatcttattccctgatggggaacctcacagcgggatgggcactagctgggcgcacagccaaccagagacctgacgggctggcctccctgcagggttggagacctcgcctgggggtgggcaggagctgccaaaggaaggctgtggcactgggtggcagggcacggtgg

SEQ ID NO: 64095 - DNA, 1880 bp, Bovine  19866881040582
taagtcgcttagctgtgtcccactctgcaaccccatggactgtagccctccaggctcctctgtccatgggattttccaggcaggcaggaatattgaagtgggttgccatttccttctccaggggatcttcctgacccaggtatcaaacccacacctcttatgtctcctgcactggcaggtgggttctttaccattagtgccaactgggaagcccaatactcccaattccatggactatccaaaggattctgtgaccaagatgctgcaagaaaaaaaaaacgtatctttcatcatctttactaccctgaagtaagatatttaaaacataaatgtaaatggtaagatactttaaagtactattgggtttagcagaaccacaggtctacctacatgagcaccatgatcataataccaaaaaataataaattaatacattaaaatattccctgtaatttaaaataacttaaaattatgtccattcttgttttttaaaaaaaaaaaaatttgaataaacagactcacagttccacaaggtttggaagcttctgagcaaggttttctggctgaaaattaaaaactcagaattaaattttatttttgaaaaatgtataaacatttctaaacagcttaaatacaagtactaccttttgaagggctgtaaattttgagaaaatgtgaaaataatacatcagcaggtctgggtttatgcttacatagatcaaactacaatttaaacgtatacatctgaacactgaaaatccatatcccttggagaaaccagatcttatattccatggtcacagaagaaataaaaatgttttaacagacacagagggaatagcaccatgtgacgctggggccagaggtgggagggatggagctacaaagccaaggaacaccgctggtaaagcatcccgccccgcccctgggagctcagagaaaggaggctcttcctcaaagccgtgagaaggaaccaaccccaaccaacaccatggtttggaacttctgtcctccagaactgtgagacagtaaatttctgcattttaagccacctagcctgtgtaattcgttacagtagccctaaatataatactatcaaccccttgtcaaaccaaaatcccaaactactcctgaggagaaaggaactgaaatcgcagagggccagataccaagatataactaaactcagaataaacagagtaagctggagctcaggtgtcctaagggaggtcacatctggaccaggttctaagttctgagtaggagtgtgatgtgacaaggacaggaagcaggccacagggaggaggggaagggagatggggctaggccctgggtagaaggaaaagcctcctgtcagcctgcgtgtctctctctctctcttctcttctctctctcacacacacacacacagacatgaattgtcaagactgaaagagcacactgagtcaggagtaacatttttttattctacactaaaacatactgtagaattaagctagatatcaataacaaagaatcaggaatggttttttaaaagcaattatgactaacttgaggcttgaaagacttaactatcagaggttgctatggagtagggaggaggagagttctggttagctttctaggcacatgaatcaacatgtgaaaagacaaaagagagacaggtgtgtttaagaaatcacaaacacagtttgttctactgtaactgcctggcagcactcatgacaaaatcttacatttcaaaagcacttataaaaataattgtgtcaatagaaaaataaaagtttgggggatttgtaacaagtaatttttcttacaggagcttaggaacagtgattatcattaggaaaaggatagtgctgttattctccatctatttt

SEQ ID NO: 64096 - DNA, 1279 bp, Bovine  19866881061545
atgaaaagtccttgaagcaatggtatctctaaatgatcttcattgaggtggcaggaatggcagtctacacagccctggagaaggaggaggagaggcatggtgaaggccggggctccagaggcagggtgctggtctggctgtggctccctgggcacacaggaaccttttgcagctctgccctcagacttgatgggcaggcaaacccaggagtgaatgaaagttcccttcatggctcttttcatcctggaatcaaaaagggccgctcagagcccaggtcaatgagccgtggtgtgaccgcagacaggcagccacctcagagatgaaacacaaacccaggttcctgccagaatatcccgccgaggggtgagcggccaccgcacaccgaggagcaccgccaagttgcccaggccatgtgctaaggccccttcactgggctgagtgttttgggcccttagggctctgtttagcactttgtcctgatctgcctgtgtttgtctctgtttccctttgctcttattttctcccccagcctgggtctcctcctcctcctcctcccctcctgggggaggcagcataggccagtataaccattctagtctttaaaaccacaggcaggacgctgaatctcggctgggtgccttaaccactgaaaagaattcatctttactatgtgtttgaaagctttacctttaatatcctttccaggcctgtttcctcatcggtgaagtaacattagcacctgccttacaagtttgttatgaggattaaatgagacaacccagaaaatgcccagcacaaaaggttgccacttagtaagttcttaatacatattagctatcattgttcacatttttattaatatcatcatcattggaatagatgtgtagtcatccaaagttttaaatgccctgctttgaagaacaatagtcactcaatgactagtttgctgcatgatattagaaaaataagcctccttaaaaaaaaaaataactcccatatcattacaatcccataccaagttaaggagatgacacttcagtttgaacacaagaagggtaaagcagttaaaattgtagtaataaaataaacatcagggacttccctggtggtccagtggttaagaattcaccttgcaatgaaagggacgcaggtttgatccctgcttgggaaacagatcccataagccacaggcagctaaacctgggagccgaaactgctgagccggtacgccgagactagggagtctgcatactgcaaagaagggtcccacgtgctgcaa

SEQ ID NO: 64097 - DNA, 2685 bp, Bovine  19866881062248
ggaggtgggagtgggccgggctcagaaaatggctggagatgctcagctgtttcagtttgaaacctgcaaaggcagattcattcgtgtgcttattaaactgatacttagcacctacgctgtgtcctgtccctgggtagcagtgaaggagatggaatagatttctcctgggatgggatgaggagacagacgataaacagaaaaataagctagagatgactccccaagaggaatgtaagaaatggggcgctgtggttgaaaggcaggcgtgctggggtgggtaggtgtgtggctgggagggtggtggtgctgttaggctggggagtcagggaagcctcgctgacaagggttgctgggggtcggccacaaggaatcaaggaggcaaaacaaggacagaaggctgtgaagcagatatggactgatgaccaggctggaccttggcagaggggggaaatggtgtgtgaattagctcaggctgtgatgccaggataccagagccgaggtggcttctgctggagacatttgcttctcacacttgggaagctggaagactgagatcagggtgccagagcatggtggggtcctgggggcatctcttctggcatgtagatggctgcctctgctgcgttcacacctggcgggggagagcagctgtctcccaggagaacgctagtcctgttgtatcaggcctctaccctgatgacctctttaactctaattaccttcttaaaggctgaccgtccagtacagtcacacagggctgttagggcatcgccacagcagtttggtggtcggagggtgggttgggacacgcacatgtaagcgaggccatagctctgagttccaaggcgggctgaaccagagcaggtggagcctgtaggctgcggcaggagtgacagcttccgtgacatcagcggggagccagtgatgggcttgaaacagacatgctcgggtgtatataacgacatgctagctgttgtgtggagaagggaccagagccagggggagggcagtcggagtgggatcaggggcaccgatgagggagctgctgggataacccaatggagacagaccggggcgtggaccagagctggctgtcaacctgaggatgagtgacagctgggctcaggtaagccttggccggggggtggtcttgtgcgttgttgggggttcagcagcacccctagtctatgcttcctagatacagcgctcctccctatgagcgtttgcgaagagggtgggaacaggtgggatggggcaaaatggtcccctgatcagcttgggatcagagtgatcgcgtctgatagtgggttgatctaggaatatctggggatttttaaaatgtatagaatatgaagaatggagggagaaaaagagttaaagccaggagagacttcttggcttggacagaacaggggatggaagtgttggttcctgagctggatgggcagtggggaggagcaggtctgagacgcgtgcaggaggagctgcagctctgtcttggatttgcagagtctgaaatgtctgttagacatcccggaaaagagctaacagggagccaaatatcggagtctggggctcagcacacagagatgaagacaagcattgaataggtaaaaaaaaaaaaaaaaaaagattaattcagctaaaaataataagcccatcacgtgtaaacatgtttttgtggtggggggaaccttaaccacctctgtcagtgtagtgagtagggaggcagtgtgtctccagatctctgatgtctggcgtaatgggattcagctgggtcccagcatctgttaccacgttcagtctgctgtcagtatcacacatgggaaaagtccgctgtgcactcctgagacagtgtgagtgaaaaggcaagtgatgtctttgcagcattctgaaaattggttgatctcatagcccctgctcctccacatctccgacccggacacaagggctgcagaacccccaggggtccaccaatcacactttgagaaccaccgtccagagatgtttatgctgtttagcgtgtggccagggctcctcatcactcctctcccagatagtgagttctataccccaagctgacatttcagtttggccctatctagggacttgctgaagccatttccatatatgtataaatttagctgtactctctgatcatcaaaagacacatgcatatgggtaccttcatatcacagaaatagcttcatatcctaaacagcagaacacattccaaggatacgaagaaaagttttcattatataaatgataactgagttacttggatagtgaaagagtcatcttttttaagcaatgcaattaaaataattatatttagaggaaatatttctaaaggacattttcaattgcttgcattgaagagaatataatgaacataatctcacttttctcagtacacaaggtcatcactgtgaaagtagcttcattttctgatgagataataaagtaatgttcccaggtgagcagagcagttgttttcatctgtggcagttgagacccctttaaaggtaaaagatattcactgcccctcagtgtcattgtaaattactctgctataaagatacttaaatactacaaccattagggataaatgtcttatgattctggatcttttttataactatatattaaatatacacattaaacgcagatgagactctaaaa

SEQ ID NO: 64098 - DNA, 693 bp, Bovine  19866881103743
tctccccatcctcaatgagagcgagtctcattctgtccagtgcccccagataacctcgtcagaagccatcgggcctgtgtgaaggcaagactcggaacaccagggacgaccgggtgcagggcgtcagcagcgcggcccttaacgagtgactagctccagtctcgcccaggcctccggaaaggagagaacggtggggggcgctgagggggaaaagtgggggttttggcagaatttggcagcgttaacaatggttacaaccttgggtggacgatggccctttgtaaatttcatatgtccctaaaaatgttaaagacacagtaaaaaaaaatcccatctcaacgtgtttgttttcttatcaagacctatggtgaccggcaggtatgttcagggcaatgtggggccacagatgggcagccctcgcttcaatccgatgcagagggcgtcccgcctgggcttgcggcaaatgtgtttccatcatgaagcagaaagaaagagaaaggtgtgaagagagtgaaagagagacagggagagagaggagacttgattctcaagtgttgctattaagtgttgtcattaaggttcttaaaggcccgtgtcagttaagggtttgggtagggaaataaaaagcggcttgcatattgagaaaaggaacatcccaaatgtgtttactgcagagaagccgtctcctgtggg

SEQ ID NO: 64099 - DNA, 937 bp, Bovine  19866881116202
gtcaaaagacaggaaggagtagggggccccccctgcctcatgagctgatggaatttgcgtggagactgtgaacacataagcatccctgtttaccgcaaaaaacattggccagacgccgctgctgctgcttagctgagcagcccagtgccagccctttccctgcctgctccccggtttcctcatctcttaaactgagcgagtccagctctgtttccctgctgtgctggaaggtgttggggacctgggatggtgctgctggccctggacttgaggaagcactgctagagcacgagataacatgttccaagctcaccgtggcgtgaagtgattgccttcttttttgggatgggccctacccttccttcaggacaggctcccgaagcgggccttggagggtgggctgcaatcagccggctctgacgagctcatggagggggcagcagatagagcacaggccaacgaaccatctcagtgaaagggtggaaggcaagaaaagcggttagacaggcattgagagtaggaaattgagtagaatttatgttggtcttgtgtttttgacgtgactttttctggtctggcttttgctgtaaccaaagttaattattcacaagtacttttagaaacccctatctaatgcggttatgttgcacgaatttaagttcatttaaatcattcttttcaactcaagtaagctctccttcactcggagccagagcaagctgatgggcccgtgagcatttctggctcttgtggccagtggctgacgtctcccgtgatcctgacaaggtgccgtgggctcagaagcacttctgaatgatcagggtggaagtacagcacttgctgagtagcctgggagtggaatgtgttctgcgctgcgtgctggtcctagcagccggctgtggggcctgtgcacagtagttccggcgggcagactttg

SEQ ID NO: 64100 - DNA, 794 bp, Bovine  19866881123952
tgaggggctgatattacacaccctgcatgtcctttgcaaacacgactagtttcctgagcagcaggtaacactagcctgccccgtgggaccctcggatgccgccgagcatgtagccgtcctgagatggaagtgtagtttccatctgaggtttctgctgtactgtcatttctttggattttgtattttccataagggtatcacttaatgtgaagatcacttgggcgtcgtggccggccataatcacaggtattttcctttagctatttttcttagtcctgttaacaacctacagtcatagaatgtgacactttttattcagcacacccccccccctttttttaatgttgaaaatacttggccacaaatgcatccttttttatttcaaagtaggtccacctcaatcaagtctcaatatttctcatcatgtttttttccttgaagtggaagcacaaggggagaaagtcacatgtttctgtcctctggctcacctagtactgcccagaatgccttatggagtttgcatccaaggaggctttgtaaaggtggcattaactttgcagtaaagtaactgaccccagacctgtgtcacttcaggatcggtcaagtgctaaccgagcaacttaaaacttaaacagaggtgtgagcttgataaatcagtgtgtgttttggactaattggtgaccagcattctgaacattaactgcccttgcgtgccaggaggctgattgtgtgtaacctttgaatacctccctgagtttggacgagagctaaactcctatggtgcatttatttta

SEQ ID NO: 64101 - DNA, 1647 bp, Bovine  19866881208081
ctataacaggtcccagtcctttgaggcactacaggtagagctgggtaggcatcatgacaaggttatgaggaagcaggaaacataagtaagtaaaggaaactggcttgtgaagatcagaatggggcaacttacaggaagccaggctgcaccccatgaacgtcccctgcccccttctaataccccatcctgcaagcccttctctgtcttacaacagaaacccccttcttatcagacagcagagttggtacctgaacctacagcacactcccactactccacttttgctgtgtgtgctgtgctaagtcacttcagtcacgtccggctctttgtgaccccatggactgtcatccacaaggctccagtgtccacggggattctccaggcaagaatactggactgggttgctatttcctcctccaggggatctccctgacccggggatcgaacccaggtcttctgtggctccggcattgccggcagattctttaccactgagccactggggaacccagtgttctgctgtttatgtctctgctaaagtccagaagttggcatgacgggcccacgcttgagggtacaacagggtaggagtggcctgtgacatggagtatcaggggacaggagagcagaagggcctggtgaccaacacgtcagctgaggccacttcaaggcatcacaggtcacacgcttgtctggacgcctaatcactccattgaacacttttaagtgccgctcctgtttttacgacttgtatcagcatttggatttcaggaatctgaaatgcaaagtgtcctttttatatttttatacaaaagcaaaatacttattagctctgccttaaattggccgactctccacttatcaatccagcgttttcttcccttgagtgctaagtcttatagatgaatggcttgagggccaaagttaaagtaaatccccactaactttgattatctcaggagaatttcagcataaaataatgaaatgactaaagtgtcaatatgttgtaagaaaggcaattaaagaaccatcaaactaagggagaaactcaaactggcccattaacaagtgttcccccaaagaagtctagctgaaaagatctcattcattctacaacaagacacccacttgtttcaaaactggatgctttcctcacactaaagaggcacaaactactaacagacacaccgatgtggataactcacaaaggcatcatgaaaaagtgaaaacagtcagtctcacaaggttatacatggtaagaccccactgtgcaatattccaggaaagataaaactgcagtgatccagagcataccagtggtttccagaggttattggtgggggtgagggggtagaaaagactagaataagaaggagtttttgagaggggtaaactattctgtattttaagtatgcttgtggttataaaattcacagaactggaaagccaaaatagatgaatctaactgtcagtaatttctttaatgacagttcaagtcacacatataccaaaattaacgtgtttagaaacaatgtgtactcttaaataggtgaaacgagccccctgtgatccaatttatgcaataaatctgcacattttcttttccttacagaatgaaactataaactgcagcctcgctgaaactaa

SEQ ID NO: 64102 - DNA, 1410 bp, Bovine  19866881247819
aacacagtttacattcatctctaaatctgagattaagaaactagtagctggtttccaactggtttcaatactggtttgaagtctgaataattttactgtgtagacattaaatattttgtttaaatattaaacattaaatcttttcctgactatccagacagaaatagaaaaagcaggaactacaggcagaagaaacagtctagttaacagacttgtgacttctacaccatctgtaacaaggggagggacttcggcatgggtttcaaaattgcctgggagctgcctcctaaagtcacctctacttggcataaaccatttttttctacacaaggtatgtgattcctacaaaagaaaagaaacccagaaaacaaaacaaaaagaactggggtggtctcctgctgtctgattaaagggccagtattacactcatttaataagttatagtgggtattctgtagcactaaagggacggtcactttactttgtactactgagtccttgccacgcagaagagctgttcctgagaaaaaaaatacttcaatcctggttactctcaagaggacaccctgagcctgggtagtgtcctccggatgatgatttctggctggcaggaagctattctctagtaacttctaggcttactgcacaaagagttgaagcaccaggcaaactggctatttcagtaaatctcaatgtcacttgcatgtgctcagttaattattcaacctttcctaaattaacattaaaaaaacccaaaaaacaacttgcttctacaggcacatttctttaactactgaaataatatgctgggctgagctgatacggcacttcctcaggatgacttaaggaagcttctcccagagccagttcacacactggttacctcacaatcttctaaactatcactcaaagtcaattaggctgtaaacatcactgaagagctgggtttatggattagggaaaccgaggagcaacagtagcacacggcaaaacaagcctcggaggaaaaaccttttctttgtattttccattgcattgtcaagaggcaaggaggggagccacaacactactggctatttaatcaataaagctacactgaactgacaactaatatacaagtttcagagcctctgttaaattccccagcaataggcctaagctactgtcatcctcctcctccccagtaatatctagttaccattataaacagagctcatttatctgaagttgtggctcaactgtcagggcacacttgtagtagggagagcactctttttttttaatgcatctttttcagctcaagtgtctgaatattctccaagtatctgaatgacttagatgatgtgacagatgacttaaaagtcacatacagcttctacactcaactctgcagaatgtactctcacattc

SEQ ID NO: 64103 - DNA, 892 bp, Bovine  19866881309649
ttagttggctttggtgtttacattgagaggaccaagaaaatgctagaaaagctctgaatgctaggactggtggcgtggctgacggatcagcagtgggtgacgggcagtggctcggaagagtgtggcaggccccttaccagccctggaagctcaagctttggtatgaagattctgaatgactttggcattttccccggaagaatgctttaagacagacctttgcttttgtttttcgggtgaccagagccaacatgtgcttagagtgaattcttacatgcggggttggtttggggatttcaatttctttacggtctgcactgaattatcatttcaactgtgtgccttttttcatgaaagcattttacattgcattgaaaagattacattcttttggctttggaaaaatatttcctgttgggttcaaaccattaaagcctcttagccttttgcttctggaagcccctgcctgggtctgccttccctcagcagctgggcggccggccgggctgcctgagcgcgtgcggaaagcgctcagacttgtttactccctgtggcctcctgcccgctgggagcgccctgctcggggaggctgggcggggggcttccttcctccctgtgtgaggggggctcaccagcctgtgtttgcgtgtgcctgtgtgtatggttgtgcgtgcctatgtgtttgtgtgtgcctgtgtgagtgattgggtgtgcctgtgtgtgtgggtgtgcctgtgtgtgtgcttatgtgtgtctgtgtgtgtgtgcctgtgtttgttcctgtgtgtgggcctatgtgtgtgtgattgtctgtgtgtagctcctgggttggggaggccccctcccctctcctaccttaagcagtgccggtttttgctcccacccagttttc

SEQ ID NO: 64104 - DNA, 766 bp, Bovine  19866881698117
gtggcatattatgataaacaagacgacaataaaacatttttccgctgtgataaacgtatttagatctatcgtagaggctgttggagctacaactgaaaaagatcaaaattacaagttgtttataacatagaatttgtgtctttaaagctttcattttttaggcagaagttgtctccctaggagatcatttccttacctttttttcaagcttgaactttttttttaagttatgactttttggaggctgtcaacacatccaaagtgatttaacaactggctaagggctgggcagcactgtttgcaaatgaacacaagcacttggctcagctcagaggccaagctggtgaagatgccgctccgagtggcctcctcagcctgcagagctattccgggatccacacccaccaggtggtcacaacactcgcatctcattacagcttgatattttgaacaaggagttcaattaacagctgtctcaatgtcccagagaccaagaagaaagagagtaagagaaatgagaaattatgtccagatgtctaaacatccatgccttcgtgccatttcttcgcctctgaaagcatttggtttctatatagaggcttcccttccatactcgacgcacacacacacacaccaaaaaactttaaacaataaaccttgccatccaactgtgactgatgaagatgtgcttgtgaaattggcttgtcagatgcacttacataaagaggatccccacttgatttgcagttcataacatcccttacat

SEQ ID NO: 64105 - DNA, 1529 bp, Bovine  19866880480803
ttcaaaaaaaataataaagcctgaaatctcattaaatagctagaaagagctagaagtacataaaatatgcagatactatcaactttgtgaaattactgatgtcattggtgttttattgcacagataacctttctacacaatttaactctcataacacaactcatgttttttaaagatgtaagaatctgaatctttcagttatgatttgtcaatctgcttctgaattaaaaggaacaaataaacaagaccacaaggtatgtcagttggcaaagaatctttcatggcacttagggagttggttcttgaccgaggtttgctttctgtaaaattcaaaaacaggacaaagcctcctccccaactccatgcccactgggtttttttcgggagaatccttggatttgtgatgccctttaaaacagtgaacttaagcctcattatcaagtccatggagatttgggaagagtcctgagcattctccagggattacttactactctgaaacaaagctggatttgagaagcaattctcccaggcaccagagggttgattaatctgccatttctccactgagataaatgagagaagaagcaacgccagcaaacactgtcctctcaaaggatcctcaaaaagcaagcaatctagaacacaatcgccaagatttacgagtcgcaggaagtatgctagggacttcaaaataaaataaattctactgcttattttggctgtgtatttatattcttttcagactccagacagatggttccccagtaagaaaaatttcctcctggattcatctctggacagtcactctagccggctcccctgggccacctggggctggaatgtactgagactatggaaactaatatctaaattaggtgcaaacaaatttaacctagagggaactcaactttatagtaatgatatttagcattttcagtattaagggtttttctggtgagtgagacagtgaagaatctgcctgcaatgcaggagacctgggttcaatatctgggttgggaagatcccctggaggaaggcatggcaacccactccagtattcctgcctggagaattccatggacagaggagcctggcaggctacagtacatggagtcacaaagagttggatatgactgagtgactaacgctttcacactttcattttccaagctccccaaaaataatgctcagagaatctacctctttttatcattaaataatgtaatcaattagggttagaactgcagatgatgattgcagccatgaaattaaaagatgcttactccttggaaggaaaattatgaccaacctagaaagcatattaaaaaggagagattactttgccaacacaggtccgtctagtcgaggctatggttttcccagtggtcatgtttggatgtgagagttggactgtgaagaaagctgagcgccgaagaattgatgcttttgaactgtggtgttgggagaagactcttgagagtcccttggacagcaaggagatccaatcagtccctcctaaagaagat

SEQ ID NO: 64106 - DNA, 1470 bp, Bovine  19866881136647
taaataatcatactcaataagatgtattttctatataatatccacatatgtcatcaatctgcactgaagcaaattaaaatatctcccttcaacaaacccatatcatctcttcagtcccttgtgcccagggcctggtaacgtatcagctaacaagtatttattcagtgattaggcttccctctgtgcttgcaatactgagaacagtgttctgtcctgggcacagtcagacaacacaggggttaagagcatgaccacctacatagtacctgtgtgtcctgggcttgttaacaagaaagcctggatataacacaattcttagctgatatttacagagcgctaggaaatatcttgaggttaggactagctatgagattgagatttctaaatctagctcactctgatattcaaagtaataacattatccttcaaaataacagtcatgttatcattagtcagtgtgtgctgagtacacacagtatacggacttttaccccctacgttccatccaaacaaaataccaactgttccaccacaatgaggatatgcattatgcataggcatagggaacttaatacatacacgtctagttgaagaacttaatgtctcatcaacttggaatatttgggccacctgaagttaactacatattagttcctatttaatggagtgatgtctcaatttaaatgtaaagcccattgctaagcaaacagcaagcgaagatttcctggcctttcttcagtatcttaggcttcaataaaatccttaacgttgtaaggaaagcatacaacattctgatttcttcaattattcataatcttctgatccccagtaaatctaaagtagcaaactcccaggacctattaccccacaccccaagcttctgtctccagaggagagacaggtgtgagtgatcaactgtcctgcaacgtttgctctcgtggaggccgagggaagcagaggacaaggcctgggttcctagatgccaagaactctagactctgaaaacaaatgcactcattcattcattctgtaaatattgatgaatggacggctagacaccaggcgctgtccccggtcctggaaacacagtcgcgaacaaaagagcaaaacctttgccatcttcaaggtggtgcataaggagggactccataactaactgcactaaaatgggctctggctcagcctctggggagacctgagtggacgggggacaaggagaatgtctgaggagccaatagagttgggaggatggagattcccagcccaaggagaggggcttcactgagaccaccctgagcctgaactatactgacatctgactcctgctgagaaatccaaggagaaagaagggagaagcaatctgcatactgacttactaaaagttcccatcctctgagccctgattgtgcatgcccacctgtgtgtgtgtgtgcaggagtgtgtgtgtgcgtgtgtgcatgtgtgtagaag

SEQ ID NO: 64107 - DNA, 1894 bp, Bovine  19866880480822
tcagactagtaagcaacattttattttcgttaatctagtggaagatttgtttggctgttctgaattgggttttgaccttttgtcctactaacttggggacttctgaggttagtgtcttgcttaaatggaaactttgtttaatgccttactgtggagaggggcctgggtttggggcttcctaagatcttatttagctacatgtgcactgtgacattaggacttctttctaagaacaacttactttcttgtcctttcctctgaagtatgaacctgattaatcacagaagcttacatggtgttttattgaaaactcctttcaagatggatacaacttggaaagtttatcatgaaactggagaattatattcacaatctggagaatgtcaacccctctcagtaaaaaagtgaaagtcgctcagccctcctctgtccatgggattctctagacaagaatgtgggaggggatagccattcctccctccaggggatcttccagacccaggaatcaaacgtgggtctcctgcattgcaggcagaatcttaaccatctgaaccaccagcaaaagcctgccctaaaagctccccaggtctgactcaactcccaggaaggacagcacaaagaaaggaaatcaaacctcccgttgatgaacagggggtggaagggtggtcctccagtttcagtggccactgctatcaccctgctcagaggagagcactgcgcaatgggtacgtcttgtttataaatgataatcggtggcttagcagtgagtcccaggggtcagccactaaaaacaccaacttcaacgttgcattaatacaatcatcactgatctcttcacttaatgtttgtgtaacattggccgagcctttcgcccttgacaaagcataaatcttgacagtgtcattcgttatcctctctaaataaaggatggttttctaaatagaaatgcagcttcattttaacctaaaggccaatctcattgctgaggcagatttataaatgaggccatcttaaaagagaaaataatcaactattaattatttaaagtgcttaatgatgcatgaaatttgtcacatttccaagtgcatttccagctaaatatgcacagatgataaaagcactgggatgtaagtcagcaattaatttcaaataaaaatatgtttgaaatttagcatttacacttgcatttttcagaaacctaaagatttagaagagtctgtaacttgcctttaccattttatttatagctgagaatttgaacaaagagaacctgtttatattagaagggaaatagcatattcttgcaaagctttagaatctcaaaataaatctaagtcaatatcatttgaaagcagctgagttagatttggggaacattatgtttaactctcagtaacaagattagaataaatgctagtaaaacatgaaaaagaatgaggtcactgtgcttaaatattgtactctgtgagttagggaaaaagtagatatttgaaaacacaattaacctttgaaaatgaaaaaagccacattcacattagggaatgggcaaacttaactaatgaaaatttatagccctgtaatagtggcaaagaaaaaaaaaaatctctctcatttgaaatgtcagaagagtctcagatcttctgttaaacactttgttaagcttttgatggtaataaatattggactcaataattgaaaatatctcaggtattatgagactactgaaggacacttgcaaagtgtttttttttttaagtttcaaacatctgtttgttgattaaattatttattcatccttaatcactccttcagtaaatggagtgtctcctaggtgccaaggcattgaattagactccactgacactaaaaatagtgtccttaaggtcttcacagt

SEQ ID NO: 64108 - DNA, 2594 bp, Bovine  19866880666253
ctattgatacatattattagctaaagtccatcagacttcactctttgagttccattctctgttgaagtgtatttattcacttagtcatgtccaactctttgcaaccccattgactgtatcccaccaggctactctgttcatgggattcagacaagagtactgaaatgggttgccattcccttctccaggggatcttcccagcccatgaatttaacctgggtctgctgaattgcaggcagattctttaacatctgaaccaagtttggggaccgttctctgtgagttttgataaatgtataatgatctgtatctatcaacactgtatcagaatggttgtcttactctataccctctgcctttaatatcccctgatttcagccctttctcctttcccccatatcctgggaaaccactgatattttactgtctccttagctttttatttttctggaatgtcatatacttggaattatacaatagtttttcatattaacttctttttcttagcaagatgcttctttaagtttcatccatgttttcatggattgatagctcatttatttttattactgataatattcttttatatggatataccacaattttcattagtttgcctgctgattgatcacataaactttgattgtttgtttgcttttatctcaatctcttccacatagaacctccagcaattcatggatcacacttttggtgtttctacagttacccacagtcaatttctgatcatgagcttctgttcctgataatccttggttttctattcatctatgtctccaaagtttaggggcagctgtttgacctataacttcaattctctgatgactctaagagagttgatatttttcaacttgtctaagttttttttttttttccccctactgtgaggaataatgaccttcagttgattgctaatgctgaatttgactggtttatgtgatagaagcaagtaggagggagggtatgggcttcatgctttcctgcaagtctggctgcttcttgcacatctgtcccacatagggagatactctctggtccccagctcttccccttatctctcttgggaacatttagtggaggtccatgggaaagagacttcaagtattaatttccctgtgtcttaacttcccagagtcccttttcttccctgctagcaaacaatcattggaattttagctgatttactttcacccccacatatggcagctactccttacttctgtgctttggccaggttttccagtctgcacatcctatctctccatactggggcctgcctttcctcagaccttgggctccttagcttccctataacctcagctgtcaggtagcttcagaatatgttacaattttgtagtttatccagacttctttttttgctagcattgtaatgactcatttccagatttataggcagaagaatcagatactaaatttcagaatctaggttgaattaattgtggaagctcaatcctgatttaaaaaatgtgtcattaatctctctgagacttacttattccaacagtattgaaggtggtactgcattatattctttcatctgcatgccattcttttgaaaaggtatagaaatatctcaagtacattgagacctaaatattgagagaagtccgtggtaaaggataataagatggggaatatcataaggtcttaagtaactgctcagagaagcaaataaaatatgtcctcaagagaagaacaaaccattttctcaggaaaggaacacagaaatttgaagggaagttactcccttgagtcctcatacaagaggcaaattgtgatgttgtaaacaccccaaatagtgttcccaacataagcacacattttatgtggatgtatgattcttatgtgtttctctgtggaagttgagggcacaatgctaagcccatattcagtaaaaatactcaccaaaaaaaagaaaaaagaaaaaagaaaaaaaacaacccctccaaagagtatcatttttagatatttatgtgtcttgatgtttgaataagataaataatacagacaagaatgaaagtggaaaggactctacgctgctcaagcaattctctgaggcttagagtttcagacttaaatgttgattaatatcaagaaagagtatatattgcatacacacatatattgatataagcaaaaccataatgcagagtattccatcgtggaaattgaaaaaatatacagtatcatagactttgtgaaataaagcattctaaagagttgctcagtggtaatatgcctgacaatgcaggagacacaagggtctcggtttcagtccctgagttgggaagatcccctggattaggaaatagcaacacactccagtattcttgtctggtgaatccgatggacagagaatcttggtgggctactgtgggattgcaaggagtcagaatgagcaactgaacaacttctgaagactgaatatgtgatcatatcaaattttcaattatcacaataattcaagtctatggcctaactgctactgccaaagaagctgaagtgaatagttctatgaggacctataagtcttctagaacaaacacaaaaaaaag

SEQ ID NO: 64109 - DNA, 1575 bp, Bovine  19866881519780
aatggtcctcgaagatattctgataagtaatccacatattatacaatattgttcatataaaatgtgcaatacagggaactaatagagccataaagtagattattcaatatttattgttgggtgagggtagcaagacgggatgggagagcatttctttctgagaaatgataaaaatattctataattgagacgttggttgcacatacatgtgagtatactaaaatccattgtattatatactttaaatgaacaaattgtaatgtgtgtcaatcgtatctgaataaaactgtttaaaattttttcaaaaagaaatattctgcctcaacatgattgacaattagaatattattaagaatttcttatgaattgatattgatggatttgcagaaggcttcttgtatctgatatacttcctggtggctcagaggttaaagcgtctgcccgcaatgcgggagacctgggttcgatccctgggtcgggaagatcccctggagaaggaaatggcaacccactccagtattcttgcctggagaatcccatggacgaaggagcctggtgggcttcagtccacggggtcgcaaagagtcggacacgactgagcgacttcactttcttgtatctgaataatcccccaagcttactccagcttcaaaacggagaagaaataaattcatctgagcaactctgtctatggtaccatctctttgtaacctcttagctcacttctggattacttctgttacttttgtcatgaactagtatgtgtagaatctccttcagttgtaggatgtgtgtgttgctacacatcgacataggctgttttacattgttgacccctgattttaaaaaagcagaagattaaacatgttcatagtattattgtacttattattatttattgaggcatattgactttgttacatttgtaataaaatcactgcttttcatttttggtggtattgataactccacaagcaactgtgttatttgaaagaggcataaaatcaatcactgtgcaagctttaacctttattagtatgaccattagcagtaagtaaaataaatgtctcatcaattatttcactaactctttcattattcaatcaataaggtttgcagggcttttgcattttcaactctgtcaatattcaggttagtttacaacaggtacctgctttgccttaaacaggtataagttctgcatgtactttctgagtttccaaattcacttggaaatggtttgttttattccagaatttatatttccaaatattgacacataactattctattcctttccattgctgctgctgctgctaagtcgccttcagtcgtgtccgactctgtgcgaccccatagacagcagcccaccaggttccccagtccctggggattctccaggcaagacactgggagtggggtttccatttccttctcctttccactacttaccattaaatataaatttcaaataaatattaccagggtttttattggatttgtgctgtgactttttcagcaataacaggtatttagataatcattcatctgccttcatccatgtttatatgaaga

SEQ ID NO: 64110 - DNA, 1905 bp, Bovine  19866880472630
gaatcttgaagagttgggcatgacttagctattgaacaacaacaattgttacccgagactccaaatggcaagtctcagcttctgaggctccccaaccaagcagggtaatactgcttactcctcttatactttctacctaccttatagcttcacaattaatccactttcattattcacttacagaaatacaaacttcaacaattaatagcaaagacaacacaggttttaacttgtggcttggaaaataaaaatggtgtagaggaggaggaggaggcttggaaaataaaaatggtgtatctatcttatccttcaagatatacctctttttgttgaggaggaggcttggaaatctatcttatccttcaagatatacctctttttgttgagaaaagctgtctgtaggtttcccaagagtcctgggacttccctggtgattcagtggctaagactccatgctcacaatgcaggggccctgggtttgatcccttgtcagggaactagagcccatgtgctgcaacaaagagtttgctggtcacaactaaagatcccatgtgctgcaactaagacttagtgcagccaaatagaaaaaaaatttcccaagaatcctgccaactgcttggttgtgtagattatatctccttaatttttcttacacccaatgctactgtcatggttcaagtctttgcatctctttcctggattattatcatcaacatattcttacctccagttttgactgaatcccacttaccaaccacagtgacctttctagaatttcaatctaactacattgtttccttgattaacctcaatgtccatctcctcttctactgagattttcaatgaatggtctattaaggagtacccagcagacctataacagactccacaaattataagccattgtttcatgacacaaagatacgtaagttcatagtcttttgttttgcatgtctgtttctcttattaggcttaagctccttaagggtatgatcatatctgattcataatcaaatggttgaatgaattgaaaaatgcaaccttccttaagcaaagcttccaaatagatgtttttctcatttttaagctacataaagctataggtagctctgtttcctttgcaaagtgctttcacataaaaacttctattgggcaaaaatgctcaataagaaatatgccaggcaccagtcttagctctttacatgcactaactcacttaatatcacaatagtcctataaggtaggtactatttctgttatccctgcattgacagatgagggcaactaaggaagagagagttacgtatgcatacattgactcattataatcattcaacaaacattttcagagtatttattgtgatattctcacaaccaaccacgagaaagacaggatataagcaatcatgactttgaaataagggccaaggagagaccatgtcttggttgtccttggagattcttggagtattcagaatagaatcacattcaatcaatatctgttaaatgggtgttgaattagtgcccttgaaatctggtggtgggattttctacatcaaccactttcccagactgatgcttaagagaaggaacccttctttctcttgatcaaactcagatacatttgagagtacaaggaggctttgttaataactatgcttagacaacaggcataaatcagcactgtccaaggcaaatcaggttacatggtcatattagctaaaaccagcttaatctgatacctacttatgatgttgacaaagtccctggtaaatataatcgttatggtcaaccttgctaagacacttagcacagcaatatgtgaggagcatgtggtcaaaaacaacaacaaaaaaagaaaggccattatcaagaaagcccactaatagtcacactttacaagaa

SEQ ID NO: 64111 - DNA, 4006 bp, Bovine  19866880485483
ttaatataaattgcttttgttatttagataaagtgccaataattaaaatccattgcttttattttctcaaatatgtttcttcctaacactcccaggaagtaatcaatgtagctcttttgtaaataggtacactacctggtatcaagttagctttaaagacaacttaaactctaaaatacagtgtaacaatgtatttttcatttctagaatcaaaggacaggatagaaagcctgtgaataaacccatgaagctacatatggtcaattaatctgtgacaagggaagcaagaatataaagtgaagaaaacatagtctcttcaataagtggtgctgtgaaaacgggacagctacatggaagaaaatgaaactgggacattctctcacactatacacaaaaaataaactcaaaataggttaaagacctgagtattataccagatactataaaactcctagaggaacttaggtgagacagtctttgacataaatcgcagcaatatccttttggactcatctcttaaagtaaaggggataaaaaatgaataaatagaacttaattaaacttaaaagcttttgtacagccaaaaccatcaccgaaatgacaggctacagaatgggtgaaaatatttgcaagctaagcaatggacagaggcttaatccccaaaataaacaaacagctcatacagctcaatataaaaaacaaacagagctcaataaaaaagggcagaaaatctaaaaagacatttctccagagaagacatcagttcagttcagttgctcagtcgtgtctgactctttgcaaccctgtggactgctgtaccgcaggtttccctgtccatttcaaactcatgtccatcaagtcagtgatgccatgcaaccaaaaggcacataagtggttgttaaaaggactaacaagtaataaaattgaaatttcatagaagtgaagtgattgctgtatctcaagatccaatctgtaattaaaattcaggtttttttccaaagaccagtatcttcaatgtcactgcataagacaccagctaagaccttaggtagaactggtcaaagttcagaacatgtgtggagaagagaggagtttatcttccttgaatatttacaaaagtcatttacgaagagctgctataaaggaataaaaaatttaaattagtaaaggaaaacatttcatagaaaaatcatttaatgttgaaagagaaaaaaatactatttgtttatcatcaacggtgtattgatttctaataacagctcatttgtttctgtgtgttagctttatcatcttattttataggagagacttggagaaatcaaagctaatatgctgataaatgttggacctgagatgaaaatgcagtttctgtgatcttgcctcagtgttatttaataagatgaccataggttgaaaatctggaagatggggcttacaaaaactcaggctgaatgtaatgtttttataaagtttgtttcaaattatttaatgatataatggctcacatagtaaagaatctgcctgcagtgtaggagacttgattgtgatccctgggtcaggaagatcccctagagaagggaatggctatcctttctagtattcctgcctggagaattccatggacagaagagcctggtgggctatagtccaaggggttgtgaagagtcagacatgactgagcagctaacacttccacttcttccatataatgatttatcacaggaatgttcaaatacaaaaccattgaaaactagaatttctgtcttcacaatatgccatttgatgaaaagatatttggagatttaatattttatttcagtatatgccacatgaccaattgctatacagtattcctgccaaagttaataatacttaagtattaaatggtgaacaagttgcagagggatgactaattataaataaggtatctaaggagttaaatttaacttctaggaaaaataaccaaataacccctaaccaaaagggcaaaccccaaatcttgatttaaaacaaagataatatagaaatcttcatcaatagattagctagaaaaatatggtgactttctgcttattaaagtttttgaaatgctgctgaaatcctttaatcacatggaatttaattaacttctcacttattgaaagaagcagtcacttcagtataggttgtgcctactatgacaaaaccatgagagaaaatatttcacatttttgtgaattattttaattcctatgctcaccattagggcattaaaatcactctaatgattcaataaatagaaggtaagattgcctttaaagaatgtgtgcacttgtacatttgcttggatggcacaaaactgatccaaatatatatatttgaattttatatatatatgacacagaagtattttagtcttttaattactctgttttggaagcattctctgtaatgtaaatgaaccaaattgactattaagttttaccagtctaatgtggtgtttggatatatccatggcagtattttgcagttctagttttgaatgttattcataggtttaatgacttgctgttcactcactaagtaatgtctcactctttgcaaccctatggactgcagcatgccaaggttccctgtccttcactatcttttggagcttgctcaaactcatgtccattgggtcactgatgacatccaatcatctcatcctctgttgtcccatttcctcccaccttcaggctttcccagcatcagggtcttttcaaatgagtcagttcttcacgtcaggtggccaaagtatcggagtttcagcttcaacatcagtccttccaaagaatattcaggactgatttcctttaggatgaactggttggatttccttgcagtccaagggactctcaagagtcttctccaacaccacagtttaaaagcatcaattcttcgactatcatagcaccctcaataaacctgaacttctaatgatgcaaatgaggcatacatgaccataacaggcatgccccaaagcagactgcagggtgttgcattttttcagtggtggcctgttcatgtggtaggaatctgaatcctactctcacagcactttcaccaaacactcagttctttgagggcagagggctatgtctcctttattataataaattctcagagaccaccaagtgcttagtaaatatttatcaagtggatctatttaatccttacaacactcagagggataaatattttacaaatttggaaactgaggttcagagaggtaatgtgacttgcttgaggttataaggttagtaagtggtatagtaaaaataacaacaataataattaatgctatttttaattctaaggaaccccaccctccatttatcattttccaaatgtctctgtcacagatttttatttcattctaaaatgggaaaggttctctctgcctgaatgaaacttgaagtttataattcgaattcttgaactttggtgggattttccatgctgccattccaggagtttcagtggctttaggagagatacacctgccacactgtatgtaaagacactctttagcacaaagtttctccagtactgtcccattctctccccagtcaccagggaagaattaatccaatttcaattcagtttagtgcatctttattgaatacctactatgtgccagggacttccttggtggctcagtggtaaaagaattcgcctgccaatgcaggacacatgagtttgatccctgggtcgagaagattccctggagaaggaaatggcaacccaccccagtattcttgcctgggaaatcccatggaccaaggagcctggggggctgcaatccatggggtcacaaaagactcagagatgacttggcaattgaacaacaatagcaaataacaactatgtgccaggcactttattgagtacttgtaaaaataaaatatttagtatgagagtctttatgtctgtcctcttagattaaaccacattttactactttcatgcacagaaaaatctcaag

SEQ ID NO: 64112 - DNA, 993 bp, Bovine  19866881384657
aaataatttttttgtctcttgacatttgtggataaaattagagtttctctaatgatttggcatggagttaaacaaaataaaagtattaaatatagttagcagtcatgctcatgtatacctatgtgttttatagatctgttttttttccccctagagtggttgtattgtacatagataatttcctttagcagcagggaagtggtttcttagaggaacaggtgactaatccatcagatgtctgtatttgggggagagatgatcttagatagtcactccagtatcatagaaacattttttttctaagagatatgagaagaggataaaaagcttataatttggaataatagataattggtagtataagatatgtttagatgactataggtgacactttgttgtttacttggtatcacataagtaagttaactccttaagtttagtagtaaacttacagactttgggattcaatatgaaagaatgtctagcaaaatatttaattttaaaagaacatgttagataaaaatgtatgacaaattgttacaaaatattttcaaaatgaatcttccacacaagaagtggagctatcaaaactctcatttacttctggcggcagtataaactggcataaccacttgaaaaagtttggtagcagctatttaaattgggcatatgcacaccttatgacccactagcaggggtgtacccttcccccgaatgtatatgtatgttcaccaaaggcaggtacaagaatgtcgacagcagtattgtttggaattgctgataagtggagcaacccaaatgtccatcagcagtggaatgtatgcttaaattgtatattatggaaagaaatctctgcagcaatgagaatgaacaaactataagcaacatagtgttgagtgaaagaaatgaattcaaaataatatatgtcttaggatttcattagtgtaaagtccaagaccagtaaaaactactctaaggtgttaaaagtcagga

SEQ ID NO: 64113 - DNA, 1223 bp, Bovine  19866881396762
aaaatggctgtctgaggaggccttacaaatagctgtgaaaagcaaaggagaaaaggaaagatatacccatctgaatgcagagttccaaagaatatcaaggagagataagaaagcctgcttcagagatcaatgcaaagaaatagaggaaaacaatagaatgggaaagactagagatctcttcaagaaaattagagataccaaggaaacatttcatgcaaagatgggctcaataaaactagttctaattctacagaaatcaaaggatcatagggatgaacaagagtattggaaggtaggcagaaggaacttggatggaataaactgttccaagattctaaattgatggaaagtagtttaaatgcccatgggagcttaaactcccagataggaagaggactctgaacaggctgggtgtgtgtgtgtgtgaccattggcccagatggataaggaaatagatgacatccaaaacttaaggatttaaatgagaagggcccagaacacattgtgagaatggggacatttcaaattgagcatctatagttcctgattactggatatgtttaaggaagagaagttgctttgttaatatttacgaatgctcactatttattaggcatcttatatacattatatttaaggcttaaaaatcctacaaggtaagggaaatgaatttctatttttatatacatggaacgttagtttagaaagggtgtaataaagaatttgcttaaactcacacagctagtaagaagtacaaacagaagtagaaacagatccagttgactccagggtcctttgctgttccttctgtatatcttccagagaggaaagagaaagaaataaaaaaaacactgagtctttaaacttggggattcattaacagaaatggaagaatcaaaggaggaaatggttttgttgtggaaaggatagattttattttggttgttgttgtttacttgctaagtcaagtctgactcttttgtgaccctatgtactgtagcccactaggctcctctgtccatcggatttcccaggcgagtatactagagggggttgccacttccttctccaggggatcttcctgatccagaggttaaacctgtgtctcctgccttggccgacggattctttaccgctgagccacttgggaagcccaggttttaggcccatgggaatttgaggtaataatgggatattgatatggatatgatgaagatgcattt

SEQ ID NO: 64114 - DNA, 1248 bp, Bovine  19866882081884
ttccgttctccgaggatcttccccaaccagggatcgaacccaggtctcctgccctacaggcagattctttatcgtgtgagccatcagggaagcccaactgaggttaaatgaagtcataaatgtagagtcctaattcagtaggaccagtggccttataagctgaggaagagagagatctttccctttctctgccatgtgagtccacagctaacatgaaagtgtttgcatctatgagccaggaaaatcactatcatcagaacccatgacactttgatctaaggtgttccaacttccagaactgtgagaaaataaattgctgttgtttaaatcacacggtctatgatgcttttgttatgatagtccaagctgactaatatacaagttttattgtcttactacattctggttcttagacccagcagacctgaaaattacaagctcattgagaatgatctgtgggtttttatttctctgtttttgtgttctgtttttggccatgccatgcggcatgcaggatcttaagtccccaactagggatagaatccacgccctctgcagtagaagcatggcatcttaaccactggacctccagggaagtgccatggtccatgttttagaaaaaattgttctgatggtttctttgatgccctgggttccttttgtggatttgagttgtgaatgcttcagagcacttgctttatttataagaaatagctttttttttttttttgactggtaagaaatagcactttttttaactggcaatgtcctggctcactggtgggtggcagctggcctgtcttccattaaaccaggagtaaaggatactttagcgtcatgatgtcactgcagccagagttctttgctatgctctggactcactgctgggcccctgaaatcacttaattaaagataaacacacatatacctgaacagcattaacacttgtgcttgttttgtcttccctgccatgctgagttattaattaacgtttgtataaaacatctgaatcatagaattcttttaggaggtcatcccttctctctgtagaccaactcttccacttgcatctataatgaaattctgagcttctcatcctccccaccacagatttggtatcctcacaccagtggatccagctgatgtcaaaattggaagcaaatatttaacattgcaacctcggacaaagtatgaggtctaaaaatgtgtgaccttgtgcctcataaagttctttttttaatgaatgta

SEQ ID NO: 64115 - DNA, 1741 bp, Bovine  19866880349914
gttggaccagaagaagctccaaaacacttccccaagctaacttacaccaaaaaaagatcatgatcactgtttggtggcctgctgtccatctgatccactacagctttctgaatcccagagaagccattacatctgagaagtatgctcagcagatcgatgagatctgcaacgcttgcagccagcattgatcaacagaaagggcccagttcttctccaggacaccccctgaccacatgtcacacaaccagtgcttcaaaagttgaacaaattgggctatgcagttttgcctcatctgccatattcacctgacctgtcatcagtgaactacgacgttttcaagcatctcgacaactttttgcagggaaaatgcttcctcaatcagcaagaggcagaaaatgctttccaagggttcactagacaaatcaacttatttctcattggcaaaaatgggttgatagtaatggttcctattttgaataataaaagtgtgtttgagcctagttatgatgatttaaaattcacaatctgaaaccacaattactttttccccaacctaaatattatgccactttcacagagagatttaggggtgtcacccagtcaatgtttgaaccgattctattgatgctaagcccaatcttctatccactgaagtactctgcaggttttatatttggtctttggcagaaattatccaaattatccagttttaagtttgggtttactttttcctcccatatacactgtgccaaactcagagagatgcttgaaggtttatattgatgattccaaataactatttcatggaaacttgaaaatacctcacaaaaccctatttcctccctggcatgattttcttatttcattgaatccatatgataattgtaataacaacaaaccatgctttatatttccagtgctttgaattaagaattagtttgctaagtacaatttctgtgcattctcttttatacttgatgggacatgttttatgatcctcactgggattcggttttgatgaaggaagccaagtgttctaggaacagacgtgatagaagcttcagagagtcgctgcaacccaggccgaggtccagccccagaagaccactgctgctgctgctgctgagtcacttcagtcgtgtccgactctgtgtgaccccgtagacagcagcccaccaggccccgccatccctggggttctccaggcaagaacactgcagtgggttgccatttcctcctccaatgcataaaagtgaaaagtgaaagtgaagtcgctcagtcgtgtctgactctttgagaccccatggactgcagcccaccaggctcctccgtccatgggattttccaggcaagagtactggagtgggttgccattgccttttccacagaagaccactaatggaagcctgatcccccagctctgtaaaatgagttcagtctctattattgatgcagagcttgctttctcctttcaaaggtaaagtgcgttagtcgctcagtcatgtccgactctttgtgaccccatggtctgtccttgggattctctaggcaagaatactggagtggggttgccattcccttccccggggggatcttcccgacccagtgatcaatctcgggtctcctgccttggaggcaggttctttgttgtctgagctactaaaaggcaaatattttcgtggtgctgaagcccaagttgaaatgaaaattgtggatctgggggagagcctgaaaacaaaag

SEQ ID NO: 64116 - DNA, 1769 bp, Bovine  19866880359171
aagagtttgagcaggataggtgttagctcttcttctctaaatttttggtagaattcagctgtgaagccgtctggaccggggcttttgtttgctggaagatttttgattacagtttcaatttccgtgcttgtgatgggtctgttaagattttctatttcttcctggtccagttttggaaagttgtacttttctaagaatttgtccatttcttccacgttgtccattttattggcatataattgttgatagtagtctcttatgattctttgtatttctgtgttgtctgttgtgatctctccattttcgtttctaattttattgatttgatttttctccctttgtttcttgatgagtctggctaatggtttgtcaattttatttatcctttcaaagaaccagcttttggttttgttgatttttgctatggtctcttttgtttcttttgcatttatttctgctctaatttttaagatttctttccttctactaaccctggggttcttcatttcttccttttctagttgctttaggtgtagagttaggttatttatttgacttttttcttgtttcttgaggtgcagcactaactcttgctgtcttgcccttgggaagatctggcccctccccatgagttgagaagcccaataggggctttcttaaaaagcagagttcctttttagtcagttactctggccttgggaagggaaccagtatttaggaaaaggaagtggatgatgaagataataataaaagcaactgatgtcagttcagagttctagtcttctggatgttgtactgagatatatctcacatgtcactattataaacatttcctaatgggatgaatacttttatccctgctttatagatgaggaaatcagtgcatggaaaggataaattatatacatggtgtgggtcacacagctggaaggaggagctgatttgaaccaaggtctgtgactctaagactagccacactcttctgccatcctggggtgctcatgaaggggcagctgaagacccacaaatgtagaacatttcccaccaatgatctagaacctggtggtctaatatggtagtcactggtcatctatggctacttaaatttaaattaattaaaataaaaaatttagttctacagttgcactagtcacattttaagtgttcagtagccatagatggctagggtgtgccatgttggacaacttccatggcatttccattgttgcagaaagtgttaccgacagagtagatggtactcagatgttagaactggagttctgagtggttttggtcaattagggaaacattctgactgaaagcacgagggcttgccttttgggaagagaagtatgtggctattcaagtctacggtgaggaaggccagccagttcagctgcaaagaaagcatgagttgtaatgacagttctgcagatgagtcatcaacctggcagtgtgttgagggatggagcagaccgtgggtaagaagacactgttcgccctcaggcaggaagtgcaaggtgatccttggtctggcccagcaggattagagccttgctaatgtgccatggctggttttggccactactgcccagagagaggcacttaggatctgggaaggttaaaagaattaggcttgctcaactagtgttcttggtccaaattctgtctgtatctggatttgatccagtcacccgaaattgtgaccacatctcactggtttaaaatttgatactctctgcaaagcatccaatcatctcccaggattt

SEQ ID NO: 64117 - DNA, 1072 bp, Bovine  19866880360146
cctggcatgctttggaaggagtagtagggaggtaccaggttaagcacagagagttgaagcgacttgcttcaagttagaagtaagaatgtggtagagtttagagtccaacccgggcagtctggctcctggagtcccagcgtcaccactcagccaggtctgggaaaatcaggtcctaggattagagtctactgggattgggacttgctgagtaaggatgtctggtgagcccaacagagaatggactcaaagaatggagggaaggcagtattcattgacacttaaaaatatttgtgtattcatgaaaatttttcttgcttggtttcttattatttctcatcctccaagagatggctatttaataggacttgatttccaactagagaagtctggaagtttttccttctggacccagatggcagagttctgagctggttctgagccgaatcaaaagatctgcagtggaatgtagctaatacagtaagacaggagtgttatgtatctttacactgtctgatacagtttttagagttgtatttttttctgaaaaacatttttgtttacattttgattttttggccatgctgttttactgaaatgccttgttttaaactggagtgggttgccatttccttcttcaagggatcgtctcaacccagggatcgaacctaggtctcccatattgcaggcagattctttaccgtcggagccacccagggctactgttttaatgcaagactgatccaaatatctgaatcaaatgcacatctacccggtggtgaggattccttcttaaaaaaaaaaaaaaaaaaaatacagtggctgatactgcaaactggatttaggatttctctccctctccttctctttttattttttcttttaaagtaatttttattggcattttccttctatttttaaaaactaaaatctgctgtttggcattttttcccccctgtttccttggcctgagttctgttttgtaactggatctgatttgccctctgcctgatttattttggcaatgcagttaaaatggtttcttttttccacagaaaatgtgtttttatttctt

SEQ ID NO: 64118 - DNA, 1757 bp, Bovine  19866880419665
atgactactggaaaaaccatagccttgactagatggacctttgttggcaaagtaatgtctctgcttttgaatatgctatctaggttggtcataactttccttccaaggagtaagcatcttttaaattcatggctgcagtcaacatctgcagtgattttggagcccaaaaaaataaagtctgacactgtttccactgtttccccatctatttcccatgaagtgatgggaccagatgccatgatcttcattttctgaatgttgagctttaagccaactttttcactttcactttcatcaagaggcttttgagttcctcttcactttctgccataagggtggtgtcatctgcatatctgagattattgatatttctcctggcaatcttgattcccgcttgtgcttcttccagtccagtgtttctcatgatgtactctgcatataagttaaataagcagggtgacaatatacagccttgatgttctccttttcctatttggaaccagtctgttgtatctagaaaaaagtgtcatctttttctgtaaagtttactgctttctatacaattctaataaaaatgatcattgcattactaaggttccacacaagccacagtagagctttgaatagaacacatatgtgccttactaaaagggattttccagaaaaaaggatctgacccctttaataatgagaaccatgttttaagaaattagaggcctaaaaacattcaccgacagtgaacaccaagacctccaaggacaggggattaaggaaggagcaccgtctgactaccaacagtggctgacatgtacacagtgctatgtaccaggcactgccatgctaagcactccagattcagtaactcactctccagtgactccatgagtcaaggccgattttcataagtgggcactgaggctagcaggttcaatagctcgcccaaggctacacaattaataataggaaagcagtggttccagcccaggaggtcacacctggaagcccatagtcactgccacagcaatcacacggagacactcatggcaccatggggtctttcaaagcctgcccttgtctgctctttcctgaacatcaccaatggggaagctgtccactccctgtagctttgaattttctcacattagatgtggatactatggagaagtctgagggttaatctgaattatagcttcacagaactttttaaagactttttgatgtggcccattttgaaagtctttattgaatttgttacaacattgcttctgttttctgttttggatttatggccacaaggtatgtgggatcttagctccctgaccacgaatcaaacccacaccccttgcactaaccggaaggtgacgtcttaaccactggaccaccaggtaagtcccagcttcacagcaatttaaagctgttcatatatttagcaacgttgggcttcccaagtgacaacaggtgagcttgtgatttaccaatccaatggatggtgaggaacagagcactttattccaagtaaaatggaaagttattctgtatctggaaaaacaagggttcacttgggaaggatttaaatgaaatacagcagttccctactagtctcagtacaactctgattcaaaatctacactaagctccaggcagatccacttatgactccgaacggtcccacctctttctaccaaggaaaacaaaacaagctaaacgctgcctctctgctgccttgcctttagtaggtctcccatggtcgtgctaag

SEQ ID NO: 64119 - DNA, 1041 bp, Bovine  19866880550081
tttccagcccactcgcaggggtcttcgtgattcattagctcattcctcaagcatcacttttggatactgtgactccctttttacttcttaagaacattagggctttggactctgatgacatctcagaaatagatacttggcaagtcccttaggaatttgggctattttcttgtttgtgttaagaggggcttagaaataaccatgcctctcttactagaggtggaatcagaattagtaacaaggcaattgaaaagtgttgtagcttaaattttttttattagatcggaggaggggttatatgaagaggtagtgtggactgaattatctgcacttaactgtgctgctgcatggctggggctctgctcagggataaaagtctcctttttgccaagactatctgagggatgatgctcccttcctcttcaggaccacggccaggcacaaggtcagctctcctgaccttcagggctttcatttcctactttaacagtgagggaagcatgcttttctctgttttgcttttgaactcttatgacaggcagtgcagtgaaagtcgctgagtcatatccgactttttgcgaccccatggactatagcccaccaggctcctctgtccatgggattctccaggcaagaatactggagtgggttgccctgccccttccaggggatcttcctgacccagggattgaacccacatctcttatgtcttctgcactggcaggcggattctttaccacctgggagcctgagaaactataggtaccatgagttaatttttttctctatagcttatattttttttcagggcaaaatacatatgtttttttttaaagccaaaggatctcagatttgatggaaaccccttcagttggttccttgacatttatagacagaaactgcactccaatagccatggataggaccacctggctgatttagaaacggcggaatacatttctaaagagtaaaagcagtactttctttgatgcttgggttgccttatatgaaagaccaatcccactgagtccatcttaaata

SEQ ID NO: 64120 - DNA, 1741 bp, Bovine  19866880705591
taccatggcacttgaacttcctaaatagataatcctattatttatttatttatttttaactgaagctatttagaattgggtttatctcatttataactgaaaggaccatcttactaaaggttctattcctgaacgtaactggaaagtagtatgattgaatgtttgatatatagcagtaataatacttgtaataggtaatatttagtaagctctactacatgccagacactgttctaagtattttgcatatatcaactccttgaggcctaaggaggcatagttacttctgttttacagatggggaaaacagaggtatgaagatgtttcttggccagtgatttcagagtcaagaataaatttaaacattcaaggaagcactggattatccaaagaacttagcttgtaatgtttttcaagtgatgttaacattaccttaaacatttttgaactgcctttgaaaagaattattattagagccagtttatatcagaaaataaatatcacagtgtgtaataaacgcttcgtttggccataagggcatgcctgtgcttgctaaattactttgtttactacttgtgaccctcaatgctatttaactgttcacacaaatcaaattcacctcgaaagacacaggtatgtggccatttaagggaatgtaacgtggatcctgaaggtgatcctaaaaggaagacttccaaaccagtttgtgcaaggtatgcttttgaagaggacatctgagcacataaatcatagtgtgctgttttgaaaacagtcacatcacagtatgctaatgccttattattattcttttaagtatgtatccagtagaggcaaggcatggaggtgtttgcattagggactctgctgactctagttggtgtccggaaggtgagccaggtcctcagctgagcctgagaaagtctatttcattccagaaacagaaggtccaggttgagaaagtaaccatccattgatgtgggcggcacttgggtgaacacgtcaggagtctaacagaagagactgagaaaaagttataggaatgacgtcccacccctaacactcctagcaaccaaatctggatgaagcattttctggtatggagagattaggaaaagagatatttccccacatgttatgaaaatcatttaaaacattctaaaaagttgaaagaagagtacaacacctttattcaacaactgttaaccttttgtttgtatgggtgtgtgtttgtgtatgtgtgtgtgtgtatctagatttttgctgaagcttctgaaaataattttcagacattgagactctttgcccctagataactgaggtaagaattaggacattctccaacataacatcacacttgagataatatttcctaatttcatttttctcatccttactcaagtttctcccaaatgctcctatatcttttatgggtgttgttttcttccactcactccaaattaggatctaatcaatgcattgcattttgttgtttcatctctttattttcctttatgctaaaagtattgtgcactttaaaaacaaacgaacaagccaaaaaaaaaatattgtccctctgaagagaacaggcagtggtcctgtagaaggttccacagtctggattcatctgcttgctctctcctggtgccattcatctcgcctcttttccccatgtattttgtgtagctgaaaggtagatccagcggtttgacaagattcaggtcacacatctttggcataaata

SEQ ID NO: 64121 - DNA, 698 bp, Bovine  19866880775593
tgcctaagggtgtaaactctagattctactccctgtttacatgaagccaaggaagccatgactgtgtcccttaaatcccacaagtagtgtctatttctaacatttattttcctggttaatatatcagtgacttcaccaatgaaaacccatttatgccattcaccaattcatatcataataaatggacagtggatttgcatttaatgacttattttatgtttggacttcctgattaagtactagttgatcaccctgaaatgtaaatttctcactaccccctaaagtttaataaacaaaacatttgtatcatactgtgtatggtgaagtaaattaagttgtagagccaagaggatgtgtaaagaggatgtgtaaattcttagaccagagagtggatgcaggcggagctaagttgagaactggcatcaaccttcacactggactccatgttttcttatgtttagttaccatcagattgcttcatgtattggatttggcttcttaatcagattataaaattcttggaaagagtgatcatttttccacaatggccagcacagttgtagatatatatacttacgtatgtataatatcttttaattgtttaaatttatggcaatatttggcttccccagtgactcaacagtaaagaatccacctgcagtgcaggagatgcaagaaacatgggttcgatccctggg

SEQ ID NO: 64122 - DNA, 1177 bp, Bovine  19866881126625
tccctcagtggaatattatgtagtcattaacatttctgcggtgatttattttcagtgataccatttcaggcataacaattgtgacgtctggactagcatcaaagttattcacaataaatacttttgaatggcacctaacattaaattataactatagtggaaaaaatgatatatgtatgtaggtatgtatatgtatatatttatacctatttatgtatacacacatagatacagatatgggatagaactaacataataaagatagttttgttatagaagcaaaatgatcagctaattttccccctttattttatatagaattatattcatgttgcccaaatttttatgacatagaatctggacaaaattaaaagcacatacatgactggggtgatttattttcagtgataccatttcaggcatcttctaaaattcaagcttttctttgcactgaaactctctggagaaatgtaaattcaacccaaaccaaagtcagcctcagagaatgacagtgttcccaacatgctcggagaactgcaccaaaaaattttttaaaatccaggcccctgtgttcttttaaataatattaatgtggttccaaactcttaacttcctggcaatgctagtcatgccccaagttggaaaatggcattgaatccatgcaggatgtttaaaagtgccttcgtgataatcacaatttcccatattttcaactttacctttgtatcattttacagcacctgcaccccatctggattactttttgttatcatctggggaaaaaagagagaagtgtgaatgacattttacttttttttaaataaaaattgttggttttattgtgggaagacattggtttctttgcagtcagaatgaaggagcggcacaatttaattctatataaatgagtgaatatataaagtatcaaatataaacagtagtgtaacaagaaaataaattgacagaaataatcattcaactactggcaataattaagactaccgtttgaaagatcttctataaataaagaatgaaaaaatactgtcataagattttatagcacacaattgtattccatcctaatttattactattatagttccttcttcggtattagtgaacacatatcatagcctgttaattcactgtgtttattatgtaaccctcacaggcaaaa

SEQ ID NO: 64123 - DNA, 1710 bp, Bovine  19866881203016
catgtaacctacccacagactggcttttactcgcatttatgccatacagcccatctcagtgtacttctctaacttccatgagaagaaaacccaactttcttcccaagtggagttaaattctaaatatgataagcctcagttggcaccaacactgtttgccagaattaacttttccttgtaatttgtaaatgcattcaggcttgttttggggttttcttttatgggtttgcccccacccccacctctaagcagggccaatatctaaatagaaagaaaagacctccagctgggctcctttctcccaacaagctttgcaagctttgcggcatcttccttggatacggttcagctgggggccttccctgtattccaggaggaatttctgcgtcctcacagaggggccctttgttgtctgaggttgtgagaagttaaccactactttgcacaaggaaatatcttttccctctgtgaagcaatgatcaaagaagaatgccatttaaaccaaggaaaaacaaaactgtgatttatctctagaatctctatgggaaaaaagaaaggccctaattacttcagtaacacatcagctgcagtagaaagtgtaaaattcactcatctattgatggatttaagtttagtccttgatgcaaagtctaagtgcttttttaaaaagcatacaaacatttttcttttttccccttttgcagctgctctgctcacaaatacctccaatctttttcaaatgctttaagaattttttcactaaaaatatatttgtatgtgtacatatttatatataaaatagataaaattacacagacatatgcacaaatacatataagcacacaaagtttaggaaaagtgtgggaagaagccttagtcaaggaatctaacctgggttaggtgctcagttttttctcaggatttattttagtctatgtccatttgcatatccattttacacaatatataacaacttcatgtattgcttttttcccctttaacattatattttgagccttttccatgacaatccataatgtccataatgatttttttaaatggctgcaaattattccaattaattatgccagttaaccatttctctctattgcttaatatttctggaactttccatttttgttaaagtcaccctccttgcagtttccaagttccaagtctgtggtgccaaccataagctttatataattgtaacaagtgacctgatttcgattttctttgcctctcaatttcttaattttcttctgacacaaagtaaagatctataggaccaagctgttaagagacagcaggaggctgtttctccatcacaaaccaggcaatgctgcatccataaggcatcaccgctcttcagagctttatccaggtgaaagcaaagggaacctgcctagccatcacctatccaggcagaaatcctcttttaccaaacagttaaaaaccccgcacagtagatgccagggaatcagacctgaatccttattgtttagtcgctaagtcgtatctgactcgttgtgaccccatggactgtagcctgacaggcacttctgtccatgggatttcccaggcaagaatatgagcgtgggttgccatttccttctccaggggatcctcctgacacaaggaccctcatctcttggttggcaggcagtggattctttgccaccaagccaccgggaagccgacctgtattct

SEQ ID NO: 64124 - DNA, 1564 bp, Bovine  19866881210152
ctggacacaattgagcgacttcactttcacttttcactttcatgcattggagaaggaaatggcaacccactccagtgttcttgcctggagaatcccagggacgggggagcctggtgggattctgtctatggggtcgcacagagttggacacgactgaagcgacttggcagcagcagctttcctttatacagttagtctgaaagttgaatgacaaaatgtgaattgaaattgtagccagttttataacttctacagactcagaccaaactattccattagttttatattttacaattgtaaatctgtaaaaacaaatgctggttccctcagtagctttaaagcaacaaataagttcttgtgaatttcagcacaatgcccaattctttaaacttctcccatttttaaagaaatcagttgctgagcccagaattacaggaaaaaaatgatttataaaattctacttaggacacatggagggcatattgaaagaaacacttttataacagtcaccaaattataagtccctgtgacttaaaggtcactaaaaaaaaaaaatgcttagggaaataaggcaaaacacaagagccagcagaaaggcaattacataacaggtcaaggaactgtcctaagatccatgcaaaatccggttagaatctggctggcatcagctatagctacaaaggggaaattggagttccctcccacctctcttgaaattatggacccaacatgaaagacaactaaatgaacgaaatgacactctgatacgctattacactgctcaccttcttaatcaagagccttatcactataattaggcttagggttattatttgacctgggtttcacttttctctttgagaaagcttagataataaaacggaacctaaacctgtctataaagatgactattatatatgccttttatttcaattcaggcctcagtaatagaagaagataataacagaacatttaaaattctccaaatcagtcactgcaattggcattttatgaagtgattctgaatagggctgtggagcagactccggctcagaagttgggaagggagggctgaggtcggataaagggcatagagagccatacaaaatttactttcctaattatcatagacaaaagcaggcttacaactttatattttgggggtataaaatgttccaacctaaaatatctaaaaatcttttttgccttgagcttttgtaacaactttggtctgatagttaaaatagtttaaaaaaccctgctgatttttataaaattttgtaggtttttataaatcatatcagtgagtttcatttatctgtgtttcacttcaccaaacattaggaaatacttttggaaacatttattttccaatgaaagagaaggtggggtgagcactcctccatttgccaaggtccacactagctgctctgcctctggtcaccaaatccattgtcattgggttggtcaccactcttgcattttccttgaatttggttctcttattgcactggcttatgagtctgtcctagatgaagtggttagtaaatatttaaagctctaa

SEQ ID NO: 64125 - DNA, 1093 bp, Bovine  19866881313027
ctgctgttactgtccctgtggctggaacctagtgacttggctgctttgctttactctgggttttcgtctctttaacctcacaccttcccttcctttctgcctcaggtggtgaggggggcttccttagttgtttgtatgaatgttcccagtgttactgggtgaaccgaggagttggaggcaaatgtcatcttatttcttggggatatgttatttcttcattctgggctaccattcttcaagattaatgatgtttggtactttgggtattggaaataatatagaatcgctttgtaacactggtttcggggagtaatgacgaaagcttcctttagggtcagccagattgctgtgattaattcaacaaacatgaactgaatgctgtgtctctggcagctaggaattttgctgcatgattgctgggcaataatatatcataaaacagggtcagtgctgctggaccttagaaaccaggagacctcacagtgtaccagggagtgacttagaggtgcctaagtataacgaggttggatgtgtctccttcaagttgtggtacacagtcaattctttttatttgtggattctgcatttgtgaattcacctactcactaacatttaatttgtaacccccaaatcaatactcatggcactttttatggttatttagggtaccagcagagtggcggaaaatttgagtggcttgactcacatattcctggctgaaatcaaacataatgatgatctgctctctagtttcacttctcatgctgtaaacaagtctgtttaggaccatgtttttcacatcttggtgcttttttgtggtgatttcacttttcagagtgctcttcgagattcctgctgagtgcagtctagtgtcctaagcaggaagtctaatgacgtgcctcacggagatgtgccttccgtgtgtcagaaaagtttcgttcagggattgattacatatggtgctgctggctgtaggttcagggttaatgaatatatagtgtatatcaaataaggagtcctggtggctcagatggtaaagaatacgattgcagtgcaggagacctgggttcagtccctggttttggaagattcc

SEQ ID NO: 64126 - DNA, 1935 bp, Bovine  19866881406213
atgtccattctctaccccccaaccatgtatgttcttgttttgcatatcacgttagttttcatgctttgccctctgtcctacccccggcagccacagtaggctttagcatgagtcggatctcagtcctctgctccacgtactctggcttctcatgaccgagtacagtaaagtctttctggtcagtttcaaggtgacaagaccccactcccacactcttgtgcttatgctgctttaggcacccacctgcttcctctctcctgagcatgccacgcacgctccccaattcctctcctggaaagctgtgcgtgcaccgtccacttggttcttccctgtccctcgtcctgccaccgcctccacagtcaccttactggtgaggctttctccacctttctactcaaaataacaagtctctcccctcacttctcttccctctcttccttcctttttgtatttttctccatagctcttgttaccatctgacttgttgtttacttgttgctttgatatttatctgccctctcttgttagtcccacataaaaatgatgcaagtcccacataagaataatcctccatgaggaaacaaagtcttaccttttcagtacaactctaacattagtcataagaaactgacctacaaaatgatcatttcatataaaatctacttgccccaaaactaagagcattcactaggaacagcattcactaagtagctggtgaataaatgaataatttatccacatactaaaaatattatagaacatcctttatgtactttaccccttatgtggagtttgaatataaatggacatgcaaatacatattaaaagcttttactgatacactgaatctagcttttaattgtatactatgacattttctccactagtaattcacaagcatccatcaacctcagaacatctgtgtggaaagggccaacttccctatcggctggtagtgtttgggttcaagataaggtctttcttcagctaaattaaggccatgatttagtgcatcatctgtcacagagtgatctgcttctcttaccaccactgtgtttacacagaggactggatttggatttggatatccctttagaaaataatgacaaattaatgataatgttccacttgagcatctctggctgaaaatcaccataaaaacaatttttttccacatgatatcaattcctattggtggatctgacacagtgtatttagttgaacaatgtttcagccacagtgtttaaagaaatatgccagaaattctaatgctgagaaacagatactaggatggaataccacatgataaaatgtaaggaaaatgaggatacttattggaggactgagtaatcctcactggtgatcacaaggtgcttggaaattgttgtcaaccccaagccctccctttgattaccacttcaaattattaaccattaatttgcagtgctgttcatggcaagtggaggattttgtcctcacacacaggacaaggagacagtttaagaattttaaatagatatagaagagcaagtatttccctcccccgattctaaaagccttttaagaatcacaaatcaagaattctcacattcatctacaatttaatataaagcattagtgtttctatacccacaacaaaacatggacctgcagaagttttcaaacaatcttccagcagcttcatgcgggtcttctggagctcagggctgtcccattcatcttcatgaactccccagtacagatctatgacctggggacccagagaggaggcagtgttaattcacctgcaggaaaactcaactgacatgtaggctttattcttattcacaatattaagctaatatgacttctaacttttctcttggcagcatgttttgcctttgatagggaaaatgatttttaagattaatctaaaggggtattttttttttttta

SEQ ID NO: 64127 - DNA, 1336 bp, Bovine  19866881557344
ggggggatcaagtatccagggctagactatcttcaaggagccttcaccagcaaagatgcatcttttattttctattacagttaaactgtaagaagaccatcttacaaccagtaacaaaatgagatccaagggttgggggaacagaagcacaggtacacagacatgtgtacacacacacacgcgcatacacacacactctgatagctcagaccgtacacagacagttccactgtacatagtgaccgtcctggagaaactgcagtgtgtacaccaaggccacggatggggaattgggagggatagtggttgggaagattaaaaaaatgagctcttttcctccttggataaggaataaaatttctcaccagacattttttaaaccaaaatttgtttcaaagcaaactgaattctgtatccagcatagcaacagtattcccttttagctttcatccacttgcctgtagactctaccatagaaactgtataaaagataaaaaataattccctaggcaacttcacacgttttaagttctcagtcttttagaactcttcacatatagtcatacctgcaagagaaaacaaaaaggtaaagcattataaaaggcaagcatcatatcccatattaatctgcctgaatattgaagaacatgggggaattgcaatcttccatcctcacctcatcccaccccatcccactccgtcctattgcattccttccctcgttacaggttcttctagaattcggtctagggaaatttaagtaccacaatttccaaaggacctctttattttacaaaccaagaaagaacagaacttgagaaccaccgtggtctgagggcttcggtctgttggacacaaggttctggggtaactggtgggtgtcctccctgcagagcctgtattacttattcaggaacctgtgctttaacttttcatttccattctatgagtaacaagctacagggtgagcgtggtcatcacgagtatcctcacgtgtgtcaggcacagtgtctttcccaagccccccgaaactgacttcactccacatctccactgagcccccggggcagcctgaccgggactttgctgggcgagtaagaacacggtgacaaaatgctcggtcctaggtcttccttctccttcagaaagctatatacgatatttttaggttcttccaacaactggcccacgtcagtgtctatgtttaaattacaaatgacaccccttgtaaacctgaaaaataattttctactttttttctcaaagggtgttttgtttggttggtttacagtggtctcacctaagtgacagttatgtacccttttacttttcccgt

SEQ ID NO: 64128 - DNA, 883 bp, Bovine  19866882022275
catgaagtggattcccagtcctgtgatctgtcattggattacgtggtttctggtgcctgatgctgactatcagagtaacagaatcctgtgtatggaatattgcctggcccgactctatcttttctgcagggtggcggcagaacttagaaggacagaggattggggtttcaagtttacaaaacagattgctactctgctttgtgtctgcttgcaaataaaaatgtgtgtgtggagaacttggtctgagacttgctttcattacatcctaacaggggtgatgctggagactggctaattctcacccacctcaaactttcctctggctgctattctctaagctggatcccacttagtttggttttcagatgcttgaaagagctacttcaaggtcaaatgcaactttggcctttccaggttatatggctgattatactggtttgggcttcccaggtggcacttgtggtaaagaacccgcctaccaatgcaggagacataagagactcaggctcaatccctcggtcgggaaggtcccctggaggagggaaaccactccagtattcttgcctggagaaacccacggacagaggagcctgggcggggtacagtccgtagggtcacaaagagtcagacacgactgaagcgacttagcatacgttcacgtatactggtttactcccattgaatgaggatgagcacccacctcccaggtgatgcaaaatttaaaacaattctgtacggagccctgtggggctcattcattgctagttttcctcctctgcactaatgtccccttgttattcttttcctatcccagaggaaacacatgcatgtttgtagaactgaaatgagtaatctctttatctctattctcctgtttcagttt

SEQ ID NO: 64129 - DNA, 1538 bp, Bovine  19866880237435
cagttcagtctctcagtcctgtccaactctttgcgaccccatgaattgcagcacgccaggcctccctgtccatcaccaactcccggagttcactcagactcacgtccatcgagtcggtgatgccatccagccatctcatcctctgtcgtccccttctcctcctgcccccaatccctcccagcatcagagtcttttcccaataagtcaactcttcgcatgaggtggccaaagtgctagacctatataaaatatatactcatacacatatacatagtaatacacaagtacaaaatacatattctggactggaatttatcagtattatgtgaggaattgttaatagggaagatgggatccagaataaattactaatgaacatatataatataaaaaagaatacgaaacaatccctaggaataacttggaatacaaaggttttgaactatctcaataaaactggaggctttggaggcttgtggtggtagtggtggggaaagaaagaagcaagtatgtttggagattgtgggaatggaatgcggggagtagaaaaatgattaatcctttggtggaggctatatatcactttatggaataaaagaaaaacattggtttaattatgtgcattaaccagagaagggtaagtaccagcagaatttaaaagtttagtagaacttccaaaatgaccaaaaaaagtaagaagaaatgtgacaaagaaaagtaaagaaacaagaaactagcaacaaagttaaatgagtgaaatatattaaagagggaaggagcatgattaaatatttcaggaaagatactaaatagaagttggctgaatttctccagcaaagaccctagactgtcagattatgttaaaaaaaaaaagcaaaattctgttacatgtgttttataagaaaagcatttaaaataataagacaaaagttaaaatagcaagaacacaaccacaaacacagccaaatgcttgcaaaaaaggcattattatctctataacttttgaagtgggctataacaacaaaaaagtaagtctacttaaatctatgttagaaatcctactatttgatattaaaatgatctccttctccttgcacaattgctggaattggtgttatttttcaggagaaattaagaagatcaagaaccacttttattacctttttttgggaggcttgaatggcttgtttgaaggcagaagaatgggagctgctttgacttctctttgaggaatagaaaatgggtacacgaaaagagctcgttgctaggccagaacctaaggcttcttgatctttattatcttcaagaggaattaaatcgtcgtagaaatctgcttccaaatcatcttctttagtttgcacctggaggaaaatccacaagaaataaaacataattcaggaaattagagctatttgtgaacacctaatgcaatgatcattcattcattcatgcattgagtaaacagttattgtggacccgttttcctagagaacaaggaatagtattagtctgtgtcttcaggaagttaatagtttagt

SEQ ID NO: 64130 - DNA, 1816 bp, Bovine  19866880391905
tgttgatagtggacttagagttaggagaactctattacaaccaagctatatgtcccaaataatgtttctttttccctccagatctctccaccatccttcaccttgccctttgcttcagaaggctcactagtatggaattcattaatgggtttctatgttctcaagcttacagttgggcctaaccagtgaaagtacttcaagtggctataggaaagtgatgttggggcatttattcctctgcatccctctctgagcttgctttgggacaaataagtcccttcactgaaggtccttattcctctcaaggcagccttcattatagccctcttctaccagtttctggtaaaactcctgtccttattctttgcagcccagaaatggtaatggtttttcatatattactggccttgagaccggagaaggcaatggcaccccactccagtactcttgcctggaaaatcccatggatggaggagcctggtgggctgcagccattgggggttgccaagagtcggacacgactgagcgacttcactttcacttttcactttcatgcattggagaaggaaatggcaacccactccagtgttcttacctggagaatcccagggacgggggagcctggtgggctgccgtctatggggtcgcacagagtcagacacgactgaagtgacttaatagcagcagcagcaggcttaattttatcttagtaaaggtgaggttttaattagctatctaccaataataaaatacaactaaaataatacaaactttagaagtcctacagtgccttgtggattttctcaacaagtatcagcgtaagaaggtagcatagaaaatgactatgatttcttgcctaagagactggggacagtgttataactgaggatgacagatggggaagtgctgccttggcagtgaaactaagttaacatttattgactcctcctgaagagtctcttctgggatctaccaaggaatgtaaggggctgtgccatgtgtcacggaagcccagacacaacaggagaacttgggagtatgcagtggtgtagggagccccccgccaatctaccctcacccctaccccagaaaaagaggagaattcaagaataaaaggcattgaggtatgaaggataaagaaaatggtcacaagttgtagtacttgtgctgaagaaaggtcaagtggaatgagtttggagaattttaggaggtcagattgggagggtattggacatactggtaagagattggggaagaaaaggggaagaaattgacgaagcaaaaatggatttctctaccaagatttcacctaagggaagacagaatgaatgataacgagaaatgcaggctcaaaggaagttttcttagcatgggcagtaagcagctttgagaataaaactttaactttctagagtctttaataaatcaagtctctaataaaactttaattttctagaaccctttacccagggttcatgggtaaccatcttttctaggtgacccaatgctgctttttaaaataccaaaaactaattttgacccttttttcaatacccaaaatctccagcaatagcaatatcaggatagtctcttgcctttaactatggatggtactcttctgtgtacttaaatgaaacaaaggtaggcacttttttgattttagctttttattgaagtttagatgatttacaatattgcatgagttttagttttaagtgtacagcaaagtgattcagttatacatatatccactttcttagattcttttatatatacatatgtaagttttaaatacatatatattttttcagactct

SEQ ID NO: 64131 - DNA, 2355 bp, Bovine  19866880425159
aacgctgttagaagatgtttgctataaccttgttggagtctcttaaggactccagaataagtacctggtcttggattttatgtttgaaaactgcggtggtatgggggaaatctcatttaagcgatccccctggcttctttctctggaagcgtgtctcctccttcccatttgcggttttttgttttcctgttttctggtaaaactgccttcttagcaaagtcagccaagctaaacgtctctgatttaccagcagaacactggctttcactgttgggttaaagggcagagtgctaaattgcaaaataatgtcattcagagggcttcagagtagtgctggcccattaagcagtctgtgaagatcaccgaatctctatcctaaagtaaacacaagttgaaaaatgattacatgtgcaaataatggtgaggcaaacagcaggagtaaaactggaaaacaaatctgtaatttcttcaagagtacttgaatatatgttttctctataactttatttccctgagatcttcaagaggtctctccccgctgagtaacatgcctgtgtctcaaccatagaggtgaaccacggaggccagtggaggattaaccaaaagagaggcatccaggggtgtgggggtgggcaactctgagcggatggtagtgtttgggagggattcatggaaatacttgttgaggtgagaaaatagatctaaatttctcctgtcacacaacctgactgtgacttattctgtacgttatgagagcaagcaagaagccttcagtgggaaattacagtctgtaagaggctgccagaacagctgaactggatcctctgactagaggggccatgctgtctccagcctcccaagaagagcagcaacattcactgagctaggaatgtgccacttggggtgggataatcagttggctttatattgtcaatcacggaatttatgttaagatttgtgattataataataaatttgttactcattaatatttatattgtatagttgacatttagttaataatgattctgtgccagatttctacattctttacatgtacacgaatacatctaatcttcacaatagcaccttgaggtagataaatatgatcccagtttcagttcagtcactcagtcatgtacaatttttgtgaccccatggactgcagtacacctggcctccctgtccatcaacagctcctggagtttaactcacatccattgagttggtgataccatgcaaccgtctcatcctctgtcctctccttctcttcccaccttcaatctttcccagcatcagggtcctttcaaaggagtcacttcttcacatcagatggccaaagtattggagtttcagcctcaacatcagtccttccaatgaatattcaggactgatttcctttaggatggactggttggatttctttacagtccaagggactctcaagagtcttctccaacaccacagttcaaaagcatcaattcttcgacactcagctttctttatagtctaattctcacatccatacatgaccacctggaaaaaccatagctttgactagatggacctttgttggcaaagtaatgtcactgcttttcaatatgctgtctaggctgatcataccttttcttccaaggagcaagagtcttttaatttcatggctgcggtcaccccctgcagtcattttggagcccccagaataaaatctgtcgctgtttctgttgttggtccatctatttgccatgaagtgatggcactagatgccatgatgttagttttctgaatgttgagttttaagttaactttttcactctcctctttcattttcattaagaggctctttagttcttctttgctttctgccataagggtggtgtcatctgcatatctggggttactgatatttctcccagcaatcttgaatccagcttgtgcttcattcagcccagcatttctcatgatgtactctacaaataagttaaataagcagggtgacagtatacagccttgacgtactccttttcctatttggaaccagtctgttgttccatgtccagttctaactgttgcttcctgacctgcacacagatttctcaaaaggcaggtcagaggctggtctggtattcccatctctttgagaattttccacagtttgtcgtgatccacacagtcaaaagctttggcatagtcaataaagcagaaatagatgcttttctgggactctcttgctttttctatgatccaaaaaatgtcagcaattttatctctggttcctctgccttttctaaatccagcttggatttagaaaatttcaacagtatgtgaagttcatggttcacatactgggaagcctag

SEQ ID NO: 64132 - DNA, 1352 bp, Bovine  19866880447378
tttaatcatggcatcatggtgggatggaggaggaggtaaggccatagtgggagctttgagacacaggattgttggtatcactggctcaatcctggcacaaactgaaaggctaatatgctgcttcatttcttttccatatctttttctttcccttcttttctcttgcctttcatatagtcagtattcttttcaagtaggacttttaaattgcccagattaagggtggatggtttgaagcaaagaatgggttgttaaagccataatttcaggtatcatgagagatgaatattgggattaagggtatatggaaaatatgcctgaaaattgacacgggggaatttttttttgttgaaagagaagtgaaaaacaaaaaggcagaagacagaggctggggcacatggaaaagtctaggcagtgacctgctgttgccactaattcacaaaaacactgctttaatgcattgaatctatctttgaagaattaggcttaatagctcctttcaatgcctgggagcttacgtcatcagtggcatttttttccatatatttttgaaagatgctctcatatggaatataaaatggtttagaaattcaattttatttatgagcagcgtcatattttctatactcttgctgaagaaacttagggtaaatggagggtcgagttaatcttttttttttttttaaccaaaagtgcacatcactcagcagagcgcttagttgttatgagattgaaaaaaagttcctccagcatgaggtgtggggaacttgttggattagaaaggatagtaagctttcttcttgaaataggctttatcaatctactttattatactttattggggtcattcatcaataatgaatcaaacactaggcaaaacttttcctgagagagttagaaactctctggttggagctgaaccctgggatctggggttgtgtctatgaatgctatttattctgcaaaattctctgagcaccttccatgggcccaaatgcaaagcattgctgggtcctgaaaatgtacttgtttggggcccatgtaaatatctctgctggaacaagggccatataatcactccactatgcagcactttattgtagagggagtggggatgcgctttcacggattgcaggattttttctaagcagagtttttaagactaatgaaggttggctcctcaggttctagctgtgagtgaacaagttggagtgtggttgacagttggtggaggtggcttggttagaagcttgcagagctcacctgtggtaacaaaggatctcgagactatttgggcatggatgctggtaagtatgtggatgcacagtgggagtgtgtaaaagtccttttaa

SEQ ID NO: 64133 - DNA, 1308 bp, Bovine  19866880476213
tagtaaatctgaactgataaaatgattctgccaataaaaaagggcaacatttcagtgaatgtgtgtgaccacagttcatgggtgaccaatttctttcgtggcttttgacattactatctctgctatcctgagatcctggaatcccaagtcgggaatggttgagagtgaagggataaacctagatagtccttgatgtatttgttccaggcaaaatcagaaacgctaaaacttcctttctgcacaaattcagctgcagctttttcttagcaaatggaaatctttccaaaggggagaaaggacaggcgggtgccaataaatagaaactgtaaactttgaataaagtaaatctcttctgagctttgagtccctgaattccccaagcattggcgttgaatgaggggctatgtggttcccaggaagagtctgtgaggtgagaacacttgatcccacacacaagtcttcattatattgaaatactacccttgaaagaaaacccactatctgcctcctggcaatctaaatcttgtcaatacacttaagggactctttgtttagagtgtacaaagcttcctttcttccttctctcctttagaaaatcagcagacagaatagtcccctggcagctggggctccactgagggctgaccgtgctcacattcgtttttctggtttatgactccttctgaaacagggactggagtgaacgatgctcctgaggacacagcacactttgggaactctaaacgcccttcttcttgcggtttatatgatcttattttaattgaaaatggctttttaacggttttcttccctgctacaataaaaaaagttgccatcatcaaacaaaacggatggcatcttttgctttgatttgactgcattactttttgttaaacaaacacaaaatcaaattaaactaacaagcctccaggcaagggaggaaggggagatggttcccctgtcttcctgaggacttggaatctgtccctttgaaaactggaagcagcttgaatggttagggtgaaggcgagggtcactcagtcctccaatattcctggtgtgatagcagctcatgtgctcttcatgcaggttaccgtctctgagacacacctgtctgtctcagttcagttcagtcgctcagttgtgtctgactctttgcaaccccatggactgtagcctaccagactcctctggccataacattttccaggcaagagtgctggaatgggttgccatttccttttccaggggatcttcccaacccagggaatctgcatagaagttaaataaatagggtgacaatataca

SEQ ID NO: 64134 - DNA, 1246 bp, Bovine  19866880481886
ttttatctgccatgcttactcaagttttccaagtgccttcagcagtgtctggaatagaagaggtgatcagtaaataagtttaaaggatgagccctgattgtactatattaaaattgtcttccttgcccatctgtccaccacccaaactatgcactctttaaatgcagggagtttcactagtatgtccatttataatatctagcacatttcctgaaaatagtgggtttgtaataaatgtttgctaagtgaatatactcatccctggcctcactaacccatagttctccagggtttgcaatcacaccatatcaaactagaaaatgagtgcaagaatgttgttttcttagtggagaaatttcactataaattctcatggcatctgagatctccaaagatggagtccaatattaattgatatagtgactacagtcagccctccatatgcttgggttccatatccacaaaaatcgatcctcggttggttgaattcatgaatgcagaaaccatggataaaaaggactgactttacaacttcattttatgtaagacacttgagctttcacagactttggtatctgtggtaattcctagcacaaatccctcatggattccaaagtgttagtctcttgatcttgtccagctgtttgtgatcccatggactatagcccaccaggctcctctgtccatggaattctccagcaagaatactggagtggatagccatttcctcctccaggggatcttcccgaaccagggattgaatccgcgtctcctgcattgcaggcagactctttaccatctgagccaccctccaaggatgactgtatttctcctgcagagtcacttaagaggttaagaatttaccatagtccatttctttttttttttttttcctccattatgtatctgtaattggggcatttattttagtaagttagaaaactaaaggaagtcctggggattgcaagcttgaaaaataatatatttccttctgtaacatctctttttctttcctttctcagagctcttcctgccatgatgcagtgggtccgcacacagaagccaggagagagtggcatcaatattgtcactgccgactttgtagaacttggtgatttcatcagcactgtcataaagctcaactatgtctttgaagaaggggaagccaacacttgatggtactgtttggagtaccagtgaataagaaggagaagattcactgtattagatgtattgtctataaaca

SEQ ID NO: 64135 - DNA, 947 bp, Bovine  19866880542252
gaagcagaacagaaaagagtaagacaagagaattaaggacattttcaagagtgaaactctaatgctgggaaatgagaacacgaggggtgacagttatgtagcctacccttctagcaactctcaaagtagaatctttacaacccctcgaccagttttttttctttcagaaaagcccagggcaggtcatagcaggagggtgcttggattaattctgtactaaggcagcctagttcctccttcctcctcctcctccacatggtaacagagaagtatagtcagagatgtgcattgagataggttcccatttgcccatgaggactccttcaagtacatcttcctctgcaccagccaagaagccgaaggagacctacaggaaagcctcccaggcaactaagactgtcattcattcactggagtccactttctttcatgaaataaaaattctccaagtgaatcaaggaacacaaccatcatttacaatgttgaccaaggataaacatgactgcttcataaaaattaattcaaaagaagaattcttctatgtaaaacataaaattagctgacgttaaagatggagtggtctaagagttgtccactcccaggatccataatgaaaaatagacacaaaacaagagcacatctaacaaagcagtgggccatctgtttcagtacctgatctccggaggtgactaatcctggcagtttctcaaggacgtttaactatctcctcctgcctgtcttcctgacccattttcctctcttaacagagcataataaaagcatatgatactgtagaaagtgtctggttgccggatatcatctgaaccagggtaaatttctctttcacattttcttgccttttagagtatatgatttacatattttccctgtcctcaatcttctgagactgatcctaaccctgagagacaggtaatagaatctataag

SEQ ID NO: 64136 - DNA, 772 bp, Bovine  19866880596133
cttcctgaataagtattgttgctagcaggattgcctaaaaacacaattgatgactcatgagcacacatggctatgatatttaaaaaaaggctggggtatggagctccatttatacctattgtgctatttgcactaatgaagggttcacaatgaagaccagttcagcctggagagttctagccacacttgagggataaataaaacatctcttaacaggaagtcaccttattgagttacttgtatgaaaatagaaaagaaaaatagagtgttaactttttcaaatacatttaaaaaacaaaaagtatcaacttactgttgcttactgagttgatttttttttaaaaacaaactttattagaatgaggaagacgtgggcatgaggcatgatgtgacgtgattaaagcctgggttcagagaggacctctgagcgtcattcaggcccagattccacggggatataccgatttcagtggagctgggacaaggatgtcccatgcaaggagcgcacagacagtagtgtggaaacaccccacattatgcttgatccctctgaggcgaactggacttcaacctgatcctggagatgggaccatggagggggacactggttttctggggaagcctattaacactatccataggggtgctcagagcctccatgatcagtcagtagcttcccagggttttatccccaggggttcttgttttctctctgtgtgcttttattttgcaactcttccatccaaaaatcagggcagcatcagatctgagc

SEQ ID NO: 64137 - DNA, 3243 bp, Bovine  19866880606191
tttcttctgattatgatgaagctcctttctaaggatcaagcaccaggagcctaaattactatttcccttgaggctgaaggctaatttgtcacattttagatcctctatttaaaatggcaaaaatgttcctactgcttccatgttgggtctaaaagccccacacatgatgccatcaccatctttagccatctccaagttttaccttctcaattatgcactgctagctggcttatgtctctctcaaaactgctatcatactaagtatgatcagaagcaaaggatttcaaataactgggcttaagattttactccttgtaataacatgtcaatgcaccaacatacgagtaattaagaggctttagtatacttaatccagtgtatggcacaaaagatattcagtgttttttgaacgaacgaatggggaaaaaaggggaattccattgggaatcttaggtgaatctcaaaaactgacaaactgtattactttaatttagtcaaaattagtgctaaatatatatagagagagtggatagacattacacttttaacaacaaactgtatgtttctagattttactgtgtaagaaaatttatagctgtagaaataaaacctcatttctgcttcatttttaatggtctattttcattcccagatttcaaagaaagcttgcacatgtcacagacgcttaattacagagctgaaattaatgatgaacattcgaactgctatagttgtcaggactccttgcacttcatacaactcaactaagacatgtcacaatgaattccaggtctgcatgtgaacaaagtgaacaatctgtgggcctccaaggaacgtttttctgtggggagctcttactttgttcccgttatttgagcaagacctacatctggtgtgaaagcagccacttgggttccaatgaacaaccaactctggttttggagaatttcaactaccagaattaattgtgccctaccaagacagaagggcttccctggtagctcagctggtaaagaatccgcctgcaatgcaggagacttcagttcaattcctgggctggaagatcccctggagaagggataggctacccactccagtgttcctggacttcccctagtggctcagacagtaaagaatccacctgcaatgcagcagaccctgggttcaatctctggctttagaagatcccctggaggaggccatggcaaccagtattcttgcctgaagaatccccatggacagaggagccctggcgggctacagtccatggggccaaaaagagacgaacgtgactgaacgattaagcacagcacagcacatcaccaaaacacacctttcagaaaccattttccatgtaaacagtacagctcagtgattcagagcagagtcaaggacctgagtgtaaaacctcactccactccacactagctggtcaaggatcctgtgtcttatccatctgctatacctcaggggtgactgtaagtgtccagcacttagcaagtgctcagtaaccttgaactgtttacataacatacactgaacatttctacaatctactagggaattctttaggctttcttggtggctcagatggtaaacaatctgcctgcagtgcaggagacacaggtttgatccctgggtggggaagatcccctggagaaggcaatggcaacccactccagtattcttgcctgaaaaatcccatggacagaggagcctgacaggctatatggggacctacatggacacagtccatggggtcacaaagagtcctacacaacttagcaactaaaccaccagggaatttttcaggaagtcttaagttcctcaatgaagttgaacacagaattacacagaaaatggcctaaacaaaattcccgagacccaaagaaccaatgaaaccgcaacccatatttgggagcaaaccatatggctggcggagaagacaatggcaacccactctagtactcttacccagaaaatgaacggaggaaatgaaaatgctcctgccattgacggaggagcctggtaggctgcggttcatggggtcgctaagagtcagacacgactgagcgactttcactttcacttttcactttcatgcattggagaaggaaatgggaacccactccagtgttcttgcctggagaatcccagggatggcggggcctggtgggctgccgtctatggggtcgcacagagttggacacgactgaagcaacttagcatatggctggcctaggatggtagcaccaacggtattcttgtggtaagaacaaggtatctagatgactccattcacactgagcttcaagacataacacagatcaaggaagaagagaaaatgagatgcagaaggattaaagaatgtcacagtttcaatattcaacagtaggttagctatgaagccaaaatatgactaactctcacttgagcactctattctaaccacgccaggctgagccttacaatgtgctatgattcacaaagcaggaacaatcgctgggtttttagcaataaaaaataaatcccaaaaaagagatgtagtgtagtgtggtagcaaaaaacactttattaggagtccaaagaccaggtgtttcattttaactcttccatttaattgtcatttggtcctttaaattctttgtgctgtggttttcttttcaactgccaagtcttctttcttccttacctgatcacggtaggaagaaatgttctgaacgtgcagtatagtgggagggattgactctacatccgaatttttagggtgagtggtgtcttgttcatctccatcaatctgctcctttctttctccatgaagaaatgtcaaaaaaggtagatgaccagacaccaagtgaagcatcaaaaaagctctgactggtcctcaaggcttctgatttttatatatatttccttctttgctaacttcatctaaccttggtgaacatttatatctctttcctccacctgcttctccagcttttctcttctccactgcatcacttacaggcctcctacaaaatctaggaaaccaccattttctttttatccaaccaaatactttctattacttgcttcatggtgatgtctctttaattctttagataatctgtgtgcaattttgctaaagtcttcagtataaataattctggttaaaggataataaccctcatgtcatcatttcaacaagcttcatgttatcataataaacttaatccaagataacaagttctcttttttaca

SEQ ID NO: 64138 - DNA, 1923 bp, Bovine  19866880624056
aagtctgttgagtctgtttctgttttgggtgtgagttgatttgtatcatttctttttagattccacgtttaatggatgtcatgtgatatttctcctactctgtctgacttacttcactttgtatggcattctctaggtccgtccatgttgctgcaattgtactgtttcatctttttatggctgagtaatattccattgtatatatgcaccacatcgtctttatccattcctctgtcaatggacatttaggttacttctacatcttggccattgtaaacagtgccgtatgtatgtaaacagggttcatgtatcattttggataatgtttttaggcatgttacattttaatatttggtcagggtgctaatagctgtctgttcttctcttcatcacaacaatatatttttccattttcagctagaaagtgatttgtcaggtgaccctctggcaccattaataccctgttctccaccaagctttcaccatgttttagcatccattcatgatcactggctgcatcagttactaaaaaaaaaaagagaaaatcactcagtcgtgtccaactctttgtgacccccatggactatagcctaccagactcttccatctgtgggatttttcaggcaagaatactggagtgggttgctatttccttctccaatcaattactaagttgggtgattttttcaaaatgtaaatctaatcatcatttctcttcagtaattttctataactacctaataaagtccaaaacacttagaatgccttccaagtccctttgaggtctgcttatccctccaaactgttctctcgtttctctcctcttcactctacacattctaaccaaattggttttctattggaaatatgcaagttatattgggaagttcacatattctgcctttagcgatgcatttgaccttctaaaaaatctgcttttctgccctttgtgtttattttttaggaggaaaaaacatatgacttgaagcaaagctgaaagtctctgtgaagtgagataataatgttttcttttaagctaatctcttttgcaaagctgtggcttcgcaaggctcttagcaggcaatagagggtctgcttctttgaagggataaaatgtccaaaacagtttcaccctgatttttagcttaggggaaaggaagagaagacatctgatgcactttctgtgtaactactgttgacaaaaagatttggcctgaaatttctgcccctccctccatttcctccagacgaggattaaagcgtagacaaatgataatgagcttaatttttcttgcagcaatttcagcttccactaaatttcacttttcatgttctttagctttctgaggtcattgctgttaacagaaacaatgattgctattattattatgactgtaatctagcatctgtacttttattctgccatctggaggacatcaaaacttaaataacccatgatgatctttttaggtgagagatcaactaactcttctgacaatagtcagcgtgtgtccctctgaggtcagtcctttggatcactcagtcctgcatgccaatgggtagcctctatctgtgttaataacagaatagcaggcaacctagaaactatttgttaaagaagagagtaaagtttgaagcaaacttacaacttttaaactaggagaccatgcctatatagtgtaccttaacaacaatcaacattttggtcaggaataagcaggacattcttctacagagttctcatttttttccaggttcctatatgttctgaggggtgggttttccagctccaaagtttgcttatctttcaccctatttggttcacaaaaaagactttctcaattcttggcacttctcttcagtattgcccttctgcgcctcatggacttccagggcaaaaatctcagccaattttaatcacgt

SEQ ID NO: 64139 - DNA, 4435 bp, Bovine  19866880662768
cccagtgagggtgagtcttctaccatctcctactgtcagaattggagtcagaaccaagaactgtactcagaaacagatgggaagcccagggccaagtgagtagaatgttcgaaacaaccagatccattcagcatcctcttctgctaaacagtgacacagcctagcatatggcaggctggacaccgtgtgaagtgtgggaccatagccaaaggcagatctgatctggcttaaaagagacatgtcagttttcagaatttgagagttaacgctaggaagtgtctttccacgtgagaagagaccggataggttgaaaaagttcaagaaccattggtcctttacactgatctatgacccatgctccagtcagaggtggaacaaactccagaatgatctcaggtggcctctgcctgcaacatcttggagtggagcttgggttcccagccagagactgggatttgtcgcagcaatgagagcaccagatcctagtcactagatcagtggtcactgacaagggccttcagctttgcagaaaagaattcccacaaagatggaaagtggtaaaacaagtaaggtgtttattaagaggaaaaagaatacagtgcatgtggataggcccattggcagacttagggagagagtgagtcactgagtcacacccttgtgacggtttgaatttcttttatggggtatttcttctgggtttcctttggatgatcttgatttgcatggttcacagtccatatttggtatatctcaggatcctcctatgtgagtacacacatctcttagccaagatggattttaccgaaaaagcatctgggtagaatatcccttgatttaactccccctttagtctgcaaggagccttttctatgcatgtgtggttaggaggtctcttgattttgggaaaagaaatgtgtggtcaggccaggacccagccttcttccttagttgtcccgctattctcattgtggagtttcgattcacagggaatgaaccaccaatcactttaccctgggttgagaggcccatctgcctcctgcctcaagaagacaggagtagatgcacatctctttgcagatttaaaggcaactctcctagaaaagagaacgctcttacccttttggtgggaatgtaagttggtgcagccactgtgaaaagcaatatgcagtttcctcaaaaagacttaaaattgagtagccatatgaaccagcaatcccactcttaggcctagatccagacaaaactataattcaaaaaatacgtacacttctatgtttgatggctcaattgtaaagaatctgcctacaatgcaggagacacaagagttgagggtttgatccctgggtcgggaagatcccttggaggtggaaatggcaacccactccagtattcttgactgaaaaaaatcccatggacagaggagcctggtgggctacagtctataggatcacaaagagttggatacgactgagcaactgagcactatgttcacagcagcagtatttgcaatactgacacatggaaacaacctaaatgtccactgacagatgaatggataaagaagatgtggtgcatgtataccatggaatactactcatccataaaaaagaatggaataatgtcatttgcagaaatatgaatgcagctagagattatcatactaagtggagtatgtcagaaggaggaaaacaaataccatatgatatcacttatctgtgaagtctaaaatatgacacaaatgaatctatctatgaaacagaatcggagacctagagaagagactgctggttgccaaggaggagagaggttgggagaggtttggattgggagcttgggattagcagatacaaactggtatatatggaatggataaataacaaagccttactgtatagcactggaggaggaaatggcaaaccactccagcatccttgcctggagaattccatggacagaggagcctggtgggctacagtccctggggttgcaaagaatcggacacaaccgagtgactaacacacactgtatagcacagataactgtatttatatcctgtgataagccataatggaaaagaatataaaaaagaagatatatatatatatatatatatatatatgtatatgtatatgtataactgagtcactttactgtccagcagtaattaatgcaacattgcaattcaactatacttcaatcaaaaataaattaaaaaataaaggcaacaataatatgcatgggcatgacaaaataatggtggtatcatttcggatgatatattaatactagatatctactactcctctttctttctctaatctgtatttaataataatggtacccatttttactttctacacatatctcattgggctattacaatagtcaaatgaaagaacaaaataacattttttaagctatagggctttctacatgtaacagttgttattattacccattttgtgggctgtctaagggtctcaggaaggcatatccatttctaccccttaggacagctattaccctgaagaacagttccattgctgatatctgcattacaacgtgagttttcccatagcaattgggtagataaggtgatgaagcatgccttttcagggttccagctgaaatcctgagtcagttggaaaaggtgagtagtttcctccttccaccccaggaactagtagctagaagcagaatataataagtcttagctcaataccaagagaggggttcagggtgctgtttgattagaccatgaagaatactcctttgttcttgttctagctagcaaggcaaaaagacagcgagtgactgaagaatcaacaggagagcagcaatcaggcctctgagaaatccctggagaaatcccaagggaagaaaaaaaatcctggaacagaataatacattaatattaactactccctgattagcagttaattgttgcaaatgagtttaccaaccttttccctgatgattaggagagtgctgtcatcacaaagctgtcaagctatggcacaaatctgtactatacagaactgtgatgactggacttctgtgaggaagccacagatatttggataaggtgactctgtgcacaaggggaggttggccagggaaatttgcccacagtggagcctgatctggtgcacatcagactagctgaacagactgagcagggttttggagattaggatatatgggatagagaaaagaaaagaacctcaaagtattgtttcatctcactacttactaacagtttggaattatctatggattggtttttagaattcaaatagcacattaaggtttccaaacttgagctctatcaaacagacaacaaatgtaattgcctcttcattattagggggaaaatgtcctgactgactcagggtagtcttttcaaatggtaataaaggtatatggcagtgtagtattctagaagccaatgcataaacatggcatctatttctagaacttcagctttacctgatatttaaagaaggaagagattattttcatcaaacacacacacatacagacatatattttaaggagaacaggacaaaatttgcttctcgttttaagataaaacatgaagcttccaaaactgtcttctctgtggcaagctactctaaacaacacacagacccacatccctctgttcaggggatgtgggccatatacagctattagaagtacctggatggaaagctctaaggaattctagtgatgtaaagttctacacggaagcagagagaaagaaccccccaaagtcttttataaacttggaaactgaagacaaaaaatatatgagttttatttttcggcaaacaatatttactgtgtgcctggtggtagcctaggcaatatcctaaagtcctccagtttatgactaaactagatcaagggctcctaaagtggacgtaatatcttattgttccctctcttcttcctgtcacataccttccccacatcttccaccccagcttccagctgaaaacacattcattcataaactatctgaaccatttgttattctgacagtgacactaggtcattcacactctctgttagaatttgaccccccaaaattttgtcatttcctatgatacccaacaaaatgatgaaccattacatcccgaaaggttacactgttcatcgtaaaagttgccttgtgtatggaaagcagaagagtcagagaggggccaagactgaactgtgggcagcagagagttctgggttctgccaccttggggcagtgactgaggccatgattaatggacagtggatgttactttatgtcattattagttccctcttctcctatgtttggagaagactcttgagagtcccttggacagcacgcagattaaaccaatcaatccaaaaaagatgggacacgaaagataactccccaggtcagtaggta

SEQ ID NO: 64140 - DNA, 1361 bp, Bovine  19866880700610
ttacagtagccttttttctttcctcctcctttctgccctattgttttggtgtatgaatgatcggtggtgtttgtactgttaaactgcgtatcagccaacaacagccagaatgcttctgaaaacgaatttaatttattcacagcacagtgtgcagccagatgatgatggcaagttaatgggctttgccttaatgagataactgtttgccgcccaggtttagaggtttatggtagttttatttgtcagtcttccctgagtgcagagaaggaaaaaattgtagctttacgctgatatattgtcaggtccatttgcagagagagacagatgttatgacctccttctgctgctgtgttctttgagccatttcaagttttcttctctattcttggcaattaaatgcaacatcccttgttgttcacccatgtggcttagatgaggaggctgttcaagcggcataatccgtggaggtgcatcttcattctagtatgctgttatcaaacagggtctgccagtgtactggctctggctctttgcttcctttcttctttgctcctgatttccctctctcttttaatccagcaggttttatgatcctggaaataatatggcatgagagcctaagcttcccaaagaaagagaaattagcatgacactttggctttttcaaatattttggcctagtccttttcctctcaaattctttttctccattcacttcaattaccactgaatctttaaccctggctagcaaccacctcttttccagtctgcctttctggtaacttattagtgtttagcaatgagaagaaaagggcaacggttctattaacacaaccaaattgattcataatcagtcatgaaccaggagctgggtaaggcttttttacaagcactaaaggttaatagaaccattctccagcccattttccaaaccaaccttcatgaagtattctgacctccacctccagacatatagccattgcataagagcttttggcatgggtggcatgtaggtggaagttatttatgaacattaatagctttttcaactattgagcaattattagagcacccctacaggtagccctagctaagttcagaataaagtaattatatagttaatttagcatttatctggaagacggactttcaaattaaaaagcttgtttgttcagttgaaactagcatttatttattctatggggatttttacacaggctctatttgccagtatgaaacacccatgtgaagctcgttttcagaattgactagttgagtcagatcacagtccaatcaatttgagaatgaacagccagctggatagaagccatactttccattactggttaattgctttgggg

SEQ ID NO: 64141 - DNA, 1228 bp, Bovine  19866880748588
cctaggtttttctctttgttttctttttattctgctgaggtttggtggagcttctttgaatctgtgacttaagttcttttggcaatctttaaaaatgttggtcaatgttttgccaattaaagctccagcctcattctctatttcctcttcttctctaacattttacacagatattagatctttttcactatgtaccatgtgtctcttatacacttcccagtattttttattcctttattctttctgtgcttcagtttggatattgtatattattctatcttcctattcactaatcctctctttcagcatctcatctactcttttttcatctattgagttcttaatttcactttatcatatgttagaatttctctggttaaactgtctatctcatcgtctattttcttgaatgtattcaccttttctaatggctgtgtctagtgactccaacatctggatcatctatctgtcgaatattgtggcaataatttgaggctttttctgagggcctcttgagggaagttttcttttttttgtggggtggagtcagattaaaaacagatcaccttattcctctcatagaatgagatgtttcagagatgggttttcatctttacaaaggcttgtcaacagatacatgtatctgtaactgaatgactttgctctacccgtgaaactaacccagcgttgttaatcaattttatctaatgcaaagcaaaaaactttttttaaaaaagacttacctacttctgggtccacccttatttctgcggtagcccttctggggaactaactggaacactaagttgttagctaggagcttttctttcctgctgccttaatttctaatttttgtttcccgaacttcataaggcagtttaagcttttccaatcttttcagactcttcgctgtcactttgtatttactttctcagtgttttagctatacaaatctcataaattagcaagtacctcaaggagaagaatagcatggaatgtcaagtttaagaatataaagctaaccgcattgtgcttctatttttgctgaaagttccagctgccttgtgtgctctttgatacccaccctcaaaccttttctgtgaggtgaagtggatgtggagggtcatgtgaaaatggatatgttatccagctctcctggttgttgctttctgtgaccacttttacctgcagcagtctgcagcaccattactgaagcagaaaattccct

SEQ ID NO: 64142 - DNA, 2548 bp, Bovine  19866880869084
agagaattgctgtgatgcaaagccacctcctgagataggtcgatgaaaaaatgagaagcagagcccctagagggtcaaggaagcatttgctttcctttgtatttccttctccctcactttgaccatataaaagaatgcagtgggctgaataaggtcccctttccagtcccaattcctatccaaccggaacctcagaaagtggccttatttataaatatgaatgctttgctgatgtaattagctcagcgtgttgagataaaatcatcctcgatttggggattcgagggctagtgtccttatgagaagagaggacacacagaaacccaggtgagaaagccatgttgaagacaaggacagaggctctagtcatgttggtatatgccaggggatgccaggagccatcaaagccagaaaaagcaaggcaggatcttcccctagagcttttagcaagtgtgcacccttgatttcagacttctggcctccagaactgggagaaaataaaattttgttaggtttgtactagtttgtatagcagctctaggaaactaacactgagagtgaataactctgtaaaactttctgagacagccggaaatccccatgaggcctttgtatctgactacatacaggtggactggatcagtcattaaacacctcatttgttcctagagagggaccaacagcagataactactgtgtgggtggggtgaacctagccaagtgaaaatctcattatatgcagccacattaagaaacattgcacatgtgtgggagtagtatatggtaaaacattaataaacgaactgtgtatcacttctctggctgggaactgacatgcaggcaaattctgatggagattaaaagaaaatacaatgtgtctgatggcctgagtgttgagtggagaagtaaacctggctttgggagtctcccttcataaacctggtgcagcacacacagctaatagcagctcgaggctcccaagagtaggcacttttgaaagaaaggtgaagaaacccagaatgagtattgagaaacttatgtaaaatgtttttaaaaaaatgtctgaaacaagataaatgtgacaggtgtttaataaacataaattcccatcctggtcccctccctatattactaagcagagatcaaccctacagaattatatataggtagctcagctggtaaaaaatctacctgcaagtcaggcaacccagtttgattcctgggttgggaagattcaactggagaagagataggctacccactccagtttctttgggcttccctggtggctctgatggtaaagaattcacctgcaatgctagagacctgagttcaatctctgagtttggaagatcccctggaggagatcaaggcaatccactccagtattcttgcctggagaatccccagggacagagaagcctggcaggctacaatccatgggctcgcaaagagttggacatgactgagggactaagtacatatgaaatacttttggagctatgcatcatttatctcaaggtcagagcagggtcatatctgaacaagtaaaggccaaacaactgctttaaattctctcatctgcttctgttcccctctactataaaattaggagtctcttactctttgaccccaagaaggtgaaggtgaagtcgctcagtcgtgtccgactctttgcaaccccatggactgtagcctaccaggcttctccgtccatgggattctccaggcaagaatactggagtgggtgaccattgccttctccaggggattttcccaatccagggatcgaacccgggtctcctgcattggaggcagacgctttaacctctgagccaccagggaagcccatatctgtatataccacgtcttatttatacattcatctgttggtggacactgaggttgcttacgtatcttggttaactgtatacagtgtggctatgggagatgcatttgtctttttgaattaatgtttttggttttttctggctatatacccaggagtggagttgctgggtcatatgttattgtttttaggtttttgagaaacctctgtactatttttccatagtggctgcaccaatttacgtgcccaatttatgtgcatgagggttaccttttctccacaccttaaccaaaattggttgtgttccttttcttttttaaaaggtaaacagttcataattattggaaggagttttttctttctttctctttcttgtttcttttcttttttttgtagggtcggggatgatggccattctgacagctgtgaggtgatatttcatactttgatttgcatttccctggtgattggcgatgttgagcatcttttcactttggcagttcattttggatggttaatggagagaaagaaaacaggccttctctctgggggcagataatcaggatttgtatcccaaagatgtacgaccttgagcaatttgcataacccacagtctcagtttcctcgtccaggagtggggacaaccactgcagtatcttaaggaataaatgatagaagggtccagcaggttcaggcacc

SEQ ID NO: 64143 - DNA, 3036 bp, Bovine  19866880999627
catgcccctactggtggtgaaacttgaaaccgatgggaggcacttttctttgaggaaaagttgcaattttatatctagggatataatctgtgatattttctgattacatataaaataataatataaatcttggtttaaaaaaataacttttgatttcttaactattatcttgctgctgttgctgctgctaagtcgcttcagtcgtgtccgactctgtgcgaccccagagactgcagcccaccaggctcccccatccctgggattctccagtcaagaacactggagtgggttgccatttccttctccaatgcatgaaaatgaaaagggaaagtgaagtcactcagtcactaatattcatttctattagagcttaagtacctttttataaatttgttttcaggcttcagtgtgaaatgacacagcatccttgtgatgcttctatctttaaaacatgattaggaactatgtaataaccagaacccaagtgtccaattctcctaaataaatcagaattcttgatcatttgactcttctacaaaagaaatcaggaatttattttaaaagacaccaagccatccctggggtcagtagaatttcagtccctctattcttatatctcataatggcaaatagttatatttaatgtgggttccctgagtttttcctaactttaaatgagcagatgtccatcatgatctgctttttaagagaggagataggacatatgtctttgaaaaggattttcagtaagaaagtcttcaaaattttttgcctgacagagttaactgaaatcccagagatttacactgtgatgggctttccatgttgcctcttacatttcattacagttatcctttctactggagtaatgtttgctcactgaatttgatgtctttgccattgagaacagcatcaaccttaaagctgagcaaaaatgattgggggaagtctctggcccttgtcttggtttcgtctcaccctagggaagaaattattctggtcactgctgctgtagcccagagaataatttctcattcgataagctatactcatcatgtatttacagcaaagctgctaaaggcttagagttcaggccagttaaaggactatgtgaatctttaatcaactatccaggactttaatagttgaagccctataactaaaatgaagagtgatgagctgtactttcttcctgaaacactctcactttccatctctttctctttaaataaaggtagagactttagacacacagatatacataataagagaaagaaagagagtctgaggtgtcctataaaactggaaacatacaaccatacacacctatgtacatatacaaacactacacacatgtatataatatttatgtatatgtatataatacattctcatattttatatgtaatatataatcttatagtcatgaaatatgtgcatatatatatatgtgtgtgtatatatatacttctctgagtcacaataataatattggcacttaattttaactgtggtttaagatgaaacacacttagaaaaaatctcattaaaatggaattctccagtgggtgtgcttgtctgtctttgcccactctcatatgcttcatctcatgtggatgaatccatattttggcctccttccttttcccctttttagttcttttccccttacttcgtttgccacaatgtagagctagagtttaggcttaattttatttgctttattcaataagagttatatcccttgtcattaatttaaaaaaaaaatgactcgaatacctctgagtactttctctagtgcaagaagaataaaacaaaattaaattgctttttatttgcatctcttgatgtattcctcaattctgcaatgttccatggtcaatttaaaaccttgaataaaaagttgaccttgctctagtgtgcaaggtaaaaagaacttcagggacacagagaaaacagtaaacaattaaaatatcatgttattacaacatggtaattttaaatttcttttgctgggaagtcatgttctgctctgactgaaaaaataaaagctattcacccccactgtttatcagtatgacatttttgattgacactgttgatctttgcccagtcagagtagctgaggacatttctgcaatactcattcctgtgccacatcaaactcaggtttgagactgcaagtgcttcagcatgaagcaactcctttgtcagtgtggatagggtcagacgtaagctgtagggcatcttgtggggaagaaaaggctggtacagaaattcactgataaagccttgacattttcaacaccgcatgaccaataccacggctcacaagagagattcatcattcaaatcttgaaggattcccctgtaaccatcagaaactgaaattaacgaggtttatagttcattaattatgctatagttaatgaattggtcacatgcaatttaattttcatttataagtcatagaagctagggacttgcccggcggtccggtggttaagattctgcctgccaatgcagaggatataagtttgatctctggtcagggggctaagatcctacatgcctcaaggccagaaaaccaaagcaaaacaaaaaacccggaagcaacattctaacaaattcaataaagactttaaaaatggcccacctcaaaaaatcatttaaaataaatcatagaaatctaatgaaagaataagaaagggttagggaaccattaaattcctcacacggcccaaacacttgactaacccatttataagaacaatgccactggaagaagaatgagtcatatttattcagcctaatcaaaacagccatcttttttgttagaaattaaaatgccaggtacacacgagggcctcaaaccaagacatttttttactcccaatctttgatttctctctttgaatgtgtcaaactattgaaaaaactacaaagtaggaagcctcatccgcatctactcagcttcgttccttggtgagctgcacacccaggtttatattctagcatcacatactcacgtggtgc

SEQ ID NO: 64144 - DNA, 2203 bp, Bovine  19866881013753
cctcctctcttcttcccctgcctgggaagctgaagtgtacggaccgcatcaatagacttccttgtcctctagcttcaggagtgtttgatcattgtggggttctggcagaaaaggagggaggaaagagagtacagttggggtgtttattcccctggctcactcctaggcatctctgaagcccctagaatgagactcaactcctcctcaactaaccctctgtcaacaggttttcataaatgctcctctctcacaacttctgacttaggcgtggaaaaaaatgtaaaccagttcagttcagcttctaccaattcaggaatactgccctgtcgtgtgcagttttctttactcgacccacatttctgtaaatagtcccaccaataaagctcctctggtcctaatttaatcatgccatctgtacccaacacttagtaattacttcagctatatttctacaaaggagtgatttcaagtgggatggtgttcttggaatgcaaatctagaaacatatttcaagaattagaaaagcagctgcttttttctctgtcggtattgctttaagagtttatgtctctggggcttccctggtagctcagtggtaaagaatcagcctgcctatgcaggagagactggttcagtctccaatccaggaagatcccacatgctacgcataactaagcccatgcgccacaactactgagcttgcgctctagagcctgggagccgacactactgagcctgcgcgccctaaaggtcgtgctctgtgacaagagaagccatggcaaagagaaatgtgtacaccacgactagagagtagcctctgcttgcagcaacgaagacccagcacagcccaaaataaatgaacgattaaaaaaaaagtttatgtctcaagggaatttcagccctaatctcctcaaactctaaatcctcaggttttgttattttgtcccattttatacagaaaacaagcagccttaagtaatccttcagcctttctcaccagccagattagaacactgcccgacaccaccaatggtcagccctggtgatccaggcaaaaacaggcagcagatggactggattgaaatgtgaaggaccttgatccttggtcagtaacacctttgatccaacagagactagcatctaagaaatcattcaatctgttttgaataaaataaaacagagaataaaacagagcttacccacattcatagggcattttacaaacacatcttgaattctgcagtttctcccagggctgacatttaggcactttcggtgtcaaaggtgcttctaaaagaaaagaataatggagatgtgaccattaggagaagagcttctttgtagtaaacaaggattatttcaattgttgaaccaggcaataaattcttataatcaataaattaataaagctataaagcattttataagaggtacagcgtcacagatccaacaaatgacgtctttggtcataatagccaccatttcttgagcatggactcttgatcctgccctttttatatgatattgaattcttcttaataaatagccatttaagagatgaggaaactaagagtcagaaaagtcaagaaattcatgctagttaacaaattgtccaagccaggatttaagtctatgtttgtctgaattgaagccccatggtgtaggctccctttcttcaaaaaggtggagtttaaaatatcatattaagagagtagcactgaaacataaacattacacatgtaaaagagatagctagtgggaatctgacgattgatgcagggagctcaacccagtgtgctgcgacaacccagaggtatgggatggtgtggggagttggagggaggttcaagaggaagggacacatacatacttatggctgattcacatttttgtatggcagaaaccaacacattgtaaagcaattatcctccaattaaaaatttttaaagagaaggtggggtttaaaaaccatgtgttatttgggtacattttgctcactacacctatcacgagacagaaagcataccataagctgacctatagaagaagaactcttagtatctcaaggatgactataataatctcttacatgtaaatgtccaagtggtctcccctcaacagtgagtaaatgtctggaggtatttacatagataaaatcctttccttcatgttttctacaaactgatagaaagccaattatcat

SEQ ID NO: 64145 - DNA, 2722 bp, Bovine  19866881026543
gtcccgcctgctgctgctgccgctgctgctgctgctgcgaaatcgcttcagccgtgtccgactctgtgcgaccccgtagacggcagcccactaggctcctccgtccctggggttctccaggcaagaatattggagtgggttgccatttccttctccaacgcatgcatgcatgcttagttgcttcagtcctgtccgactctatgcaaccctatggacagcagcccaccaggctcctctgtccacaggattctctaggcaagaatactggagtgggttgccatttccttctccaatgggccctgcctacaagccactaattgtcaagaaaggaaagttagtgaggggattcagaaaacagtggagtgatggtcatgaggtggagagtgaggtaacaggtagatcctggctttctcccggaagccctccagctcacccaggcttgggccagcaggtgagccggcgtgcccagggaacagactgagggctgtatcctgcagggctccagagccctcaccaaggccatcaactagccttggcccaggccttgaggcagcagtgaacctctcccccaatccttgtctctgtggccagatagcagtggcagtctgcctgggtcgcagtttgtgggacctgatctcccccctctttgggtggcctgaggagcttgagagctggttggattgggtgcctggctccttcagtgatgatagctgggcagagtctgggaacctggccctcagggcgctgccaactgagatctgcctcctcttagccaggactgagaccttggagggtgaaagttgtgccttgggacctttccctttcttgtcagggcagagaataacattcatttggtagagacttacagccccatccttacctgacaatgacctgactttaagagcaaaggatctgtcaccaagaagtttgtaacaactaatcaggaccccccctcaccttgcctataaaagggctttgctgaaagttttcagggttcttagggcatgagccatgcatctccttgcatggccctgtaataaacctttctttgttccaaactccaatgttttagtattgtttggcctcactgtgcatcaggcacaaggagttgcattttcagtaacaatatcacagacagtgaggagggtgagggaaacagctttctcagaactcacaggacatacaaggcagtgtctctgttttcctttaatttttaatcaaaggcacgtctctcctgagagaacctaggctatccaggggcagccagcctgggatggcaggacaaagctggccagatgctggtatgctggtatgtgactgtggcttccttggaatgcagtcctgggaggtgacggcagaagcgcacgctcggggaccgaggttcactctcgggctacattttgacctgctgcatgggtctgaggctcggggagacggcaaaggggctccccgtgctctttttgatgtcctccactgttaggccgtcccagagctccatcagggtcagccctgtcttcttgtgcacgtcaaacacggccttctcggtgatgattcggtccacgcaccgcttcccagtcagtggcatggtgcacttctccacgatcttgggttcgttggccttgttgcagtgctccatggtgactaccactcgagtcttggaactggacaccagatccatcgcaccccccatgcctgtcaccttcttgccgggtatcatccagttagccaggtcaccgtatttggaaacctgcatggctcccagcaaggtcaggttgatgtgtccccctcgaatcatggcaaatgattcatcgctagagaaaaaagagcccccgggaagaagggtgactgtctgcttgcccgcgttgatgaggtccgcgtccacctcctcttttaatggaaagggacccaagcccaagatcccgttctcactgtgaaggtgcacggtgatgttggggctgatgtagttgggggccagaagagggatgccgatgcccagattggcatacatgccatcctcaaattcaagagctgcccgcttgatgatccgtgtccttatgttatctgaagacgtgcaaatttcatcatcctctttccggacggttaaacgctcaattcttttctcatatttttccccctgtattatgcgatctacataaatgttaggaacatggatgtcttctggagcaaaggaccccacgtccacaatttcttcaacctccaccacggaggttctggcggctttgcacatgggcacgttgaagttcctggcgctggccctgaagatgacatttcctgcccagtcggccttccaccctttcaccaaagcaaagtcagcggtaatggcgtgttccagcaggtagtgctgcccatggaactccctcacctccctgggctggctgaggatggcgatgtggccgtctggtaagtacctgatgggtgcgcctccctcctggaccaaggtcccgtaggccgtgggggtgtagaaggcgggcacaccggcgccccctgcgcggatgcgctcggccagggtgccctggggcgtgatctctagctccagctcacccgccaggtactggtgctcacagagcgagttctcccccaggtaggagcagatgatgcgggtgatctgcttggtccccagtaaaaggccgagaccgaagctctccacccccacgttgctgcgcatcacagtcaagtccttcacgcgggtcttcagcagcgc

SEQ ID NO: 64146 - DNA, 1010 bp, Bovine  19866881036841
aaaaagaaaatacaacatttccttcctttcaagtcccaagtgatttctgaaacagaatcaattactaaaggaaaacaacttattctatctataccagcagaaaaaaaaaaaacagttatgtaagacatactctctgtagcaggtgggaaattcaacacagtctttcaaccccactcagcaggcactcttctgggactcaactacttgaatatcccatttctctactgcagctggggaagacatgtgcctgagtgctagacaacggaagagagggaggagacatctgtagtttcaggttctggcccataaaaacctctcacatagaatccttcatgctccttcaagttctacaatctggacattgacatcatagatgactgagcttccttcagcctgggtccttcaatgaccatgtggagcagagcccacttattcagaaacaaactgcattgttcaatacaagtgaaaaataaacatataagatgctaaaccactgaagtcaggaggcttatctcttacatcagctagtgtgactaataaaatggtgtgttgtccaaaacagttctatgtaagggacagaattctgcacagaaacagaactaactgttacagctgcacaacagtgggggacctgaggcctcttaaggagacgttgtaccactgctcttctggcggggaggggtgtgactgtcctaggcactgtaattacctgtttatccaagtgtcctacacactgcttgacacttgatagagttgaaatacagatctcatctacatcttcatctccctcctagaaaccctatatcctattcaatatacaaaataaaaagctgataaaacagagaggttaaggagctaaaaatacacttttaaataaatcacaagagagaaagtggtatttagagaaaaacaggcctataataaagaagagattctgggcacgatgaaatactgggccagggtgacacaaagtgggctttctttagaatctcatcagcaaatacacattt

SEQ ID NO: 64147 - DNA, 830 bp, Bovine  19866881118530
ttagttcctcaaagtcagaaaccaagtctccagctctaaactcgggttgtgtggatggagagatactgggaaagaaaaggcattcttgaaacacacaggggctgtgacaagcgagctccagtgcctggactccagcctcctttactgaatgggaaggggcatagtgggctggggggtttccagctgggaatggccatgtcggggactcacccaagacatgcatctgtcatcacaggagcaggatgatgtgaggctgactgccatcctcttatttgagaatctggcatccctaacaggaagaaggtggaagattttttttgctgaagaaataaaaaagagcatgatttcattccttctccacctctgggaccccaatcccaagattggaactgtaagtggcccttgcagagacagctgcacctcttcctctgcccgtagccaagaggtgccaggaatcttggtctggctgggccagaagccatatctgaagacaccagtctcaaatgaacctgaaaaccagttatcccatcttgggttcttttttggccatcacttcctgagtttgcacttccatctttgaaactgggaaggtggtagcactgactgtccagcccttgcatcactctttactgctcttttcccaacatacctataagcctgccttcccttctggaaggggaactagcattatgcactgtgacacagaaaactctgttttccaggcttgccgtgatgtcctgatcatctgcattccttttctgggtctccaggaactctatggggtattagaccatctcctgggatgttcaggatctaccaagggccaggga

SEQ ID NO: 64148 - DNA, 1904 bp, Bovine  19866881379060
tcagactctttgcaaccccatggactatagaccatggaattctccaggctggaatactggagtgggtagcctttcccttctccacgggatcttcccaaaccagggatcaaacccaggtcttaagcagattctttaccagctgagctacaagggaagccctgtaagagaaccagtttcacccttctctgacagtgtcatcattttttatttttttgctaattttgttgcagacaagtggtgttgtattgtcttagcttacatttatctaataacaaatggaggttttcatatttactgaatacttacatgttcctaagctatatccaggtttctttatatcttcatgtctatactatatgtcagatagtgagaaaggaaaaggaaggttccagtgtcatttactctgtgtttataggtggtgtttagtcactaagttgtgttccattcttgcaacttcatggggagtagcccacaagactcctctgtccatgggatttcccatgcaagaatagtggagtgggttgctctttccttctccaggagatcttccccacccagggatcaaccctttgtctctggcattgcaggcggattcttgccagactgagccatcagggatgacacatgacatgaaaggacatatgacatcgataaaactcactgttccaaacttagaatctctcttctctctctcagtcactcacacacacatacacacataacttgagtgctgaagaaaacaagtagataaatgttagatcatacaataaaggattaagtaatgccaagcaagtgatggtttgtttatcactgtaataagttagacttacagtctggttttatgtccccaatctttctctactcctgttaccatctccttcaacattgcatttccatcagaaatgcatctgaccccttcaagccccttcagatcctcagttctctggaactcaactgagatgtgtgttgtttggcgatataatatccacttctccacgtggttctcatttcagtaaattgaaacctcaactctcactgaatgaccatcttaatattcttgaggagaatattcggaggctgctgccccttccacccttggaaaaactcagaaatgagggcgagacggacaaagacaaggagcacatccaagtatgtgggggcgaggccagaggagggtgaagaaccgggtagaatgaatgaacttgaatgaacgcgtgctctcagcttcactgtcactcacttcatttcagtttctctacgaacgatccatggatgctctcggaaagctgctgaggaccatgatgtgggataacatgaaagcagaggactgccaagaaatgttcaatgtgagtaggtcccatggatcctaacctgtgctccaggtcaccctccaaactctgcctcctcctggggactcatctagcctgacccacgtagccccccagcaacaccacagagccagcccacttacacagtgtttgtggggaggccagcaccctatttcagaagaggcagagtgagagcaagagaatgagaatggataaatatgaaagaatatgctactggagatcagtggagaaataacttcagaaagaatgaagggatggagccaaagcaaaaacaacacccacttctggatgtgactgttgatagaagcaaggtccaatgctgtaaagagcagtattgcatgggaacctggaatgttaggtccatgaatcaaggcaaattggaagtggtcaaacagaagatggcaagagtgaacatcaacgttctaggaatcagagaactaaaatggactggaatgggtgaatttaactcagatgaccattatatctactactgtggacaggaatcccttagaagaaatgcagtagccatcatagtcaacaaaagagtccaacatg

SEQ ID NO: 64149 - DNA, 1402 bp, Bovine  19866881387704
aataacttttcaaatgggctcaatattctcatagaatttgaccattccttttattttaatatttatttaacataaaataaaattaaatactttagcttcctgaataacttttatttacttattaattatggcagagattacttattgtctgacaatttataatattcctaatcttttattatttctcagtagatcttaactgttaatacagtacaaattgtacatatggaaaatgtatatccagcatttaaaatataaattatggtcatgagcatgtagttgattctgattgaggcaatgattgtgaccattttcaaaaacacaaaaatgataatcatctggataaaaaaagattcatactgcaaagactcacatttttcagataccttagagattatctagagtgaccagatccctcattttgaagacaaaggaaataagttgatatgcttaactatgatcactgtttaaagaaaaatttacacaggtctaaaacattagttaccatttcagtttatttaaagaatacatttttgatcccattttttgaaagtatgttaaagttttacagccactattttctctttcttggctctaacttagaccttttctttcctctttttctatttcctctcttttagtttaatatatgttatgttatgaaactgctcaccctattcaagttattagagatggtttataaaaatacataaaaaataaaaacttaggattaccagtcaaagggacaataagggcatcaaaaagatgagacttgcttcttcagatccttctagcccaataaagtagccatttagtttgtattcattgagctggacacgactgaagcgacttagcagcagcattgatatactatacatagactgcatagtagatactaaataattactttttttattgacctggatttccaatagcttaacatttctttcagactttggtactttgaagaaactatttttcacttacctgatcacacttattagtgtagaaaagactaatcaatgtgagatatagagccatgaaaacatcaggattactttgaaaaggttcacctcaagtcttctgataatcatttcctaaggttttaaatgagttgtttgcattaaagttttagtgtgtgattcagtgagaaacttcttttcctaactggacatgtgctttattttacagggtccatacccattaaaaaatgaagttgatgcagatctaatcaatgcaggtaaaataactcattacatgttcttctagcattttcctttgctattagtttcgttctctgccaaatgattttagagtaaggagttgggcttgattctttgatgtttcctggagaatatgcactgtactttacttggaggaggcgagagaagcctttccagtg

SEQ ID NO: 64150 - DNA, 2464 bp, Bovine  19866881406043
ttaagacttctttccgtttgtggtctgattcccaaaggaaaattccaagtagccctggtttccctgctaacagagtcaggtataaattgtgctcctatatttccaaacacctgtatccaagcaacatattaaagtgtgctgccaactgatgtatgtatagtcggtaggtacacctgactttccagaaaaatggttaagagagaaaaaaaggcatcaaaagcaaaattaaaatcaaaaggaaaataatactgtttttttccctttttaaaaaattttctctggtaaatctgcaaaaaatactattattgtgttctaaattggctattgttgtttaataagtttgtaatgtctggaaggaattcatagtttctcactaaatgatacactttactggattcttctatagctagctattctagcctgaaaaataattcaaaaaagtttcttggtagtcatcaaaataccttcttatttggcaagtagaagagactcataaaggcccaaagcattgatcatgcacaagagaatgtggaacaggaaactcaccagccaggactctaagagtaataacatgttagcatgttactggtgtctggtattccagaacacagactatattcctagcacaatccttcttaccttagtggatccagaaacatatggcataaactggcagttttgcctggaaatccatattcacttcagattaagctcttctagacacatgctaagacacatgccagctctatgcccttgggaaatatttttcaccatcttcaagccttagatacctcatcctcaaagcagaaataatagtggaagggagaatggggagttactgtgtaaagggtacagagtttcagttttggaaaattaaaaagatctagagatggttggggggtaatggttatacaactttgttaatgtacttaatggcacttaaaatgcttaaattgcaaattttatcctttatgtattttaccacaattaaaaaaaacaggaataataaaagtaccccatgagattgttttgaagtctacagagataataaacagtgtgtgtggtgcctagcacatagcaagtactcagtaaatggtcattattagtgttgtgattcatagtaataatcaaaattggcttgaactcctgcagagtcacaaccagtatcaatgcttatcattgtcggtctcatcacctttctcctccccaccacactgcaccttcacatccctacccttctcttcactgtttcccttttccagatctgcattctttccaacctccttaaattatcaagcccagtcatcgcagaaatccaaaaaatgtttggtagattcaagcccttctgcttaagttgcatataaaaacaatccttaaaagaaattaaattcctctttcagccaacaaaatgatcttcaaagtgacttgaaagctttaacagttgcgagactagccaaggataaagctacaaaaccagcttggtttctgtatcctcctattccttcttagatgagaatagagccaatgagcagcacttctaggttttgagtgagtttcacagatgtccattcattcagtccaccccctccaggtgacaccccaggaacaagtcaccccaagactatcactcttgatcctacaattgggatggtgtcctgcaacctttatacactgtgatgcctaataggatctatcctccaagttcttcctctttctccaaacacttcaaaacaaatagagatagaaagagccttggaaatctttcagtcaatgctcttcatcttaccaataaaagcatgaagcccagcctggctagataatgagatgcactttacacatctctgctttggatcccactgtcttcagccttttagataccttgtgctattaaggattccccctcttctgtaactgccgtcttgcctcacaactcgctcttctccccttctccctacttccttccagttctcagtctacatctcttctttcagagtccagttctcagaggcacaagttgcacccattcttctcatttgctcacctctcacacaacttcgcaccccagtgtcatctggcatctacccttactacactttaaaagctgctctctccagctaagaactgaattcttctaggtctttatgttcacctttcaaacatcttgcctgatccttcaatagcatttgacacttttcaagtagttcccttttaaaatacccttccctgacttccttgctgtcactctctcttagttttgctgcaaattctgtagtcactccatctcagtatttttggctacctgcccatctctgcccataccttcaatgttaaagtgcctcagggctttatcctgggtctttctctttaactttcacttcataaattcttcctgagcaatttttctgcttctgttactttactggccaatagttcgaaatcattttcttcgagctctatatgagtg

SEQ ID NO: 64151 - DNA, 784 bp, Bovine  19866881434139
gcataaattatgtagtaatttatttataatctgcttccaagtttgtgttggttttgtaagtcatgaaataattataaacctaaattttatttcatagtgaaagcttggaacaattaaataagtggaatatagagaacctaacagagcgagaggggttgagttttgacttccagatctttttggatacctcaccactaaactggaaaacactgggctttccttcaagccatttgtcaggagtcaaaaaatgcctaagagaagaatttctttcatataactacaataaattttaaagactgctttacatctattgaattcttaaaaattactctgtttctaggtttcatttcctggcaggagagcccagaggagaagtccttgataactctttcactggaggagtgtgtagaactgtcaaaagcagtagagcaagtaatccataccgtgttccggccaatctagaaaatgtcaacttcgaggtacgccagcctatcttgagggcattccaagtgccaatggtgattataagctaaatttcagtgaaaaaagagtcatgaaggaagggacagaataaaaaggtaatgagcattcttcatcgctatcatgtgctgacatttattccttccacagctcagtaatgtcagtgttttcatccttaattcacagatggaaaacaaggaaactaatttgcccaaagttatacatctatcaagaaattgggttcaagatttaagcacaacttttccaaattctggaatccatgctttctcccatgaacaaatag

SEQ ID NO: 64152 - DNA, 1143 bp, Bovine  19866881480988
gcagcagataattaatttgtaaggctggctagaggattagcaaccacttgagataatagacaaatcatctgaaagagacattcatgtaagtatagctaaaatttttaaagattaaaataaaatttggaagccaaaagaaaagagtttggtattatttataagaataagaaatatatgaaaaataaaaacaaagtaaagctaacagaatttctgaaagaagtaaagagactagagactgggcaatattcaaagaaatcaggactaagaatttttcaatttgattagcaacatgaatcctcatatttaaaaaaaatcatagatcctgaataggaaaacaaaaaataaatctacatgtaagcatattgtgctgtaattgcaaaacaacaaaagtcttaatagcaacaatagaggaaagattaatatgttataaaaaataaaaccaactaccagaattctcagtaaaatcattagtgatcagaaaagagtgaagtagtaccttcaaaatactggtagcaaaataatcatactagaattgtctattcagataagttatttaaatgagagcaaaattaaagacatttttagaaaagcaaaaactctcacaaaacacatctcactaaaggctccaggtagcccaatgttgaggaaagaaccagttcagggacttctgactgtgagaggccctagaacactgagacgtctggctctggagtcctgccctctatttgcacgtagagctgtggagcccccacctgaaagtggctgtggttctgagctgtccagctcactgtcccctggctcacttgctctttcccattcatgcccgattactcaaagaccctcatttaagtgaactactttaaaaaggaaagggatgaaattataaggacaaagatgccagaagtaaatctgaataaacattaaatgcaaaactattaacagtgattattaatttggacagaagattgaaatcaaggtagaaataagattttgaaaataatgacttataaagtgggaagaatattcagttttctaattttattatgtttttcaagagaaggatagaaacattgatgctagactgtagagtaagtatgtttgtttaaatcttaaggataaggaataaaatataagtattaatag

SEQ ID NO: 64153 - DNA, 946 bp, Bovine  19866881529297
atacattttgggccatacagccatccctttataaaatcactctggacaaaggagaggttacaaaaagaggcatatccttggcccagctccttggacaggggggtgagtctgttacaagaggggcaacatagatgctggttagacacctgggtagggccacttcaaaatgcaagtaaaatctacatatcactggaaaattactcactactaaaggaatgttgggcttccctggtggttcagcagttaagaatctgcctgcaatgcaagagatgtgggtttgatccctgggtctggaggatctcctagaaaaggaaattggcaacccactccaggattcttgcctgggaaatcccatgtacagagaaacctggtgggatacagtccgtggggtttcaaaagagtcggacacgactcagcaactaaagagcaacaacagaggaatgttagatacatgcgaataaataataacacatggaaatccgggataatcgatttttgtagacaaataaatgattgactctgacaagcagcaaagtcagaattcacgtaggtagacatttcacttgttctttcatgaaggataacatcttttctttgacaagagcaaaagaaaaaacagtcacttgattacaagtggttaagtgttctaactttattattggctatcacaccaatctctgttgcatcattcccacatttaaaccattcccaaatgagaaaaaggacaatcacactgatcgatatccatttggaatatttattgtagttcttaatgcatttcctaacacctatggtactctttaatcaagaatataaagtcatctacttagaatttgccactcaacatgaggagctttcttagaatcacagaagaagtaagtttacaaatacagcaaccatcaatgtcatacattttccaaaccataactctaacacagatgtaaat

SEQ ID NO: 64154 - DNA, 1187 bp, Bovine  19866881534142
tttccttgcagataggctgtggccctgtaactttgggtcaaataaaggtaaatagaggggagcatttttctaaccacttcttcctcctttgcattgcagtgcattcaagctggaacttgcaccacaatttttggccataaattagaaggtatggtctctgagctgaaaaaccaaccttctcaacagaggtgttgctgtaactgtccatttgctggttgaaatcccgactcagttgaatggtccaggctacatcactgatcttccataacgattctttgagcaactgttgtaggaggtgaaaatcagatatgaatgtgactgtttaatgtgttttcttgctacttttctgttacaatatattctagaagtataaaatgtatactatatgggattattccttttcccataaaaacttgattactttgaaacttttcttcttattttagaagacatactctgtattgttctgaatttccagtaagaatcagatccacaggaagtggaagttaacttcatgtaagtgccttctgttttccttttaaataaaaattgccaaaaaacttacaatagaaactcatccaatctgaaacttaaattgaagttaacatttttcaaggtttcagtagatttggaaaaactccacttgtcaaagttagtttgctttattatttactaagaaaaagggacatttttggaatagtgagttaaaggccttgaagaaccaattagatatacaagcacaagttgccaacttcaactggagtaatgaaatattcctcatttcatcaattattttgagccagggccacaatcagtcatctgaacccatgtctttcttcattgaaccatacatgaagaggtgtttttgtccttttggaggacaaaatccattgcaatttctaaaatctatgatttctcctgcgttttctctatcttaatcttagacagaacacagtgtcaaaaccattgaaaaagtttgtgaacatgttttcttaataagaattcattcaatggatcttttgaaaagtaaaaattgtacaaccttggcattataagggaagaaagcaaatgtagacagttttggaaaaagaagccaagaagtatactcaagattggaggaaggggaaagtaatgttctcaaggcttcaagaactttccttcctagtaagaacagttattttaaaatg

SEQ ID NO: 64155 - DNA, 931 bp, Bovine  19866881581141
tccagccatccatctgggcacttgtgagtcatacactgcatagagagtcattcctctgggcttttaaaatgttgatgagccttgatttttgtgttagcccccatatttgttattgtaattcttctatagattctaccagcaagttcatttctttgtgttctctttccacattttttcacctgattcaccaaaagccaatagtattgtccctggaaaaacaaagaacacagacttcactcttcccagatctttctgcttgagtcaaacttgttgatgtttcaccaaaacattcctgagctgcctgactcttagtcacttatctccagacgctgatgctcaataaataagattctcataagtgacacctcatctgaggcttcctccatagtagaagcgcagggaaagtaaactctaagtacattacacttgctgtactttaaggacagtggaagccagctaatcctgaagactgctgctctacccaggatagaagggaagaagctccctgccctccccttccctcatggagagggcttttctctactggttcaatagacagatatgccgtattctacaataatcactttgaagcatacgattgcccaggtcttgcctctgattccatgagaactgggtggtgatgtcaacgtgtgccaaagaggtgactctgactagagcttccccctcccatctgctcttagcttgctcccatcacggacctggtgagaaacatcccctgtgcggtgacaagacggaacaacctcaggagagcttttcgagagtatgcagccaagtttgacccttgccagtgtgcccgatgccctaacagtggccgccccgtgctctcagggaccgaatgtctgtgtgtttgccagagcggcacctatggcgagaactgtgagagacggtccccggattacaaatctagtaa

SEQ ID NO: 64156 - DNA, 1388 bp, Bovine  19866881714394
ctaattttcctggctattttctagcacagatccaccatgtcttccctgaatccacatatagtctttgttaacagattgaacttagattgaaccatgctcttgacgtagtttccctacagtctattcatgacaaagtaattattataaatattttatttggagaaatgggaaatataaattaaacccttccaaaatgaatctcaaagatctgaaagatgtattttcatgaatcactttttgtggtattatggcgttagttattttcataacctgagctaaattttgaacctgagctaaatcataagagcaacagcttttctgtttagtattctagataagcagcagttatttgctgaatttgctcagttttacattggccaaatctcacatacatttccaaagggcagcctgtgcttttagcatctactaatgaaatcacacattacaatctcacctccacatactgctccttcaggataggatgccacagctccagaaacaacttgtaagcttcttttcttttaacagctgaggccacagggaagtaagtgatgagtgggtgggaggacggaatattttaaagccaaaattcaagctatacttgtaatttctgtgggaaaaaagtcaattatgataagaaagtctctagctagtcctatctaattatttttagtactttaaaataagttaattagaaacaggctataatcccagacatacagggcaagagccagaagatttgcacttcatataataaagccaaaattagtgtcttcagttgatatgtgtagtattttcttctgaagtcctcccaggccagataaactgagaaaatttcatatatccaacttttaaaaaattgctgttatattgaaaacattatgaaagaaaacattttgtcaattgaatataagttaaaagctgaaacatcattgcctagagtgatgttagcaagttattagagattatttaacaattttgttagggggagcccacttctagcaggaaagatttggcttatatcgtctcacttaaataagcacttttatttgttggaatcactcttggcagttaatagatcagtcatccaaagctatactgcagacaatgactgcagccatgaaattaaaagacgcttgttccttggaagaaaagctacgacaaacctagacagtgtactaaaaagcagagacattgctttgccgacaaaggtccatatagttaaagttatggtttttccagtagtcatgtactgatgtaagagatggacaacaaaagaggctgagtgccgaagaactaatgcttttgaactgtggtgctggagaagactcttgagagtcccttggactgcaaggagatccaaccagtccatcctaaagaaaaatcaa

SEQ ID NO: 64157 - DNA, 866 bp, Bovine  19866881870223
ccgcttcctctctccttgcagtttactgtctttctatatctttccctgctctttatgtgcaatggaatatgattctgtagcttcttgaaattaatgtcctgtgaagttgttttttgggcaggttttctctgactattcattattcatccctcaggaggacctttagccaagcaaacttacaatgacacaaggatttaacttataaatgtatgagaaaacagatctttcaacatattaatgaaaaatgagtaaaatatagaggtaactatgttgtattttcttgaacttagatgctttcttataatattcgcttagattagctttgtcatatttgtcatttgggtgctggaaaaaaaacaaacatgctgaagcattagattaattgtgcagtttttcaactggagaaagcatttaattgcaattaataatctgcacatagagaccttgtttgacaagagatatttccaagccaatgtttggtttccatgtggatatacagtatttaagtagcaggcactgagagtacatggacttgccttaatttctaaaggagggaacaggtagatgtgaaccctgggtcctccagctagagggagagttcactagaagggattcctttgcaaggagaatagagagaaggtgcctttggctgtcttctgtccattggccctgctctggaacacacttggggagcaggctgtgggccttaataaagaggtggggtgaggactagcgggatgtgattagagtttaccatcagcctaagctcctttgtcttagttacgcattgtgtttccagagcatttgagcacaagggctacaaataaacccccaagtggtaggagatatgtcttggtgcacatttt

SEQ ID NO: 64158 - DNA, 1524 bp, Bovine  19866880355438
cgctctagtgtgaagtgtagggcccctggattccagtagcctggccataataagctgagagccagagtaaacaagcccgtcctcctcaacaaaactcaactgcgataaccagctgcagcagtgttggaaaagtctctcctgcctcggagctgcgtcagctacaaatgagcccacggctcctggagccagcccccagacaaggccaatgccggcacaactgagggagaagctgcagccctccaaccacccccctcagtccctctccttcagcctctaaaagaagccactgcttccttagtgggtaagtacaggacagccctttgcatatgtgaagtgtttcagtcctgtcaggacaccagaaggtggggaacggcatcctactttacagatgaggaccccgaggctctgagaggttaagtaaatttgcccatttaaaaaaagggaagaaagggacttccctcatggtacagtggttagagtctgcctgccaatgaaggggacacatgtttgatccctgggctgggaagattccacatggcgtggggcaatcaagcctgcacaccccaatgaagagtgggccccgcctgccccagctagagaaagcccatgtgcagcaacgatgacccagcacaggccccccccccccgaaaaaagaggtgcgggggagctcaaggagggagctcctctcaatttcctcaatgactgactctcggagggtccctgaggcaagtacttctcaaacttcaacatgcatatgaatcacctgggagtctactaaattgtgatttctcatatgatggggtcttggatgggcctgagattccatgtgttcaacaagctcccagtgatgtggtccagggatcatgctgggaagaccaggctggccatacagtagcatcacctggggggctctggaagcacactgatgcccaggccccacccccagagattctgacttaattggctggggacatagccaggcatccagactcttaatagctcctccaagcgattcattttaaatgcgcagccaagactgagaaccatctttaaagcgacacttctcaaactttcatcagtagaggaatcccctggagaccttgttaaaatgcaggttctgactcaggtctggtgggccaaggattctgcatttcacaggctcctaggtgaggctgctggtcaacagaccacactttgaggggcaagaccttggtgaaccacccacccccacgctcaccagctctggccacccccgtcagtgcccctgacgtcagcagcctcaggccccaccttgttcaggtggcagtgcaggccattgtggatgatggaatggaagttctctaggcggctcccgtggaaggcgtagatgaggtcgcgttctcctttggtctcgtaaaatttggcattggctgggtcggagtactcgatttcaaacaggaagtccggcacggggacaggcgtgtgaggggtaccagtcagtcttttggatcttttcaaacttaaaacatgcaggaagtcggagtt

SEQ ID NO: 64159 - DNA, 3383 bp, Bovine  19866880445772
aactgcacctagctaacatttgaatggcattgctctgctcaaattcacagcaacccacatttctttatagctcaggggcatggtgccaaaggagacaatgtttatgaatttcacctggagttcttagaccttgtgaagccagaggtatgttctttccttccttccctttctattttaagaaataaatacttatagttttgtgaaatggggggcaagccttatggggaagaagaagataaacctaagcagaatatacttttgtttggaacagagcccaggtgttagccacagagtaagaggaaaattggagaacctgagttgaatctgggctttgtcattattagtggtgtgaagaagtctcctcacttctttgcatttcagttttctcatatgttacatggaggattgggttaagtggatctctaaggttctttccagctgtgagtttcttaatagtcagcagtggtttaagggtttcttaatagtcagcagtctgggacttcatttggaggaaaagagagaggccatacaaagaaataatgagctggagcacccctaagaatttgagtttagttgagaaggctctgtagtgaaagactgcttttaaaaaagctgtaactgatacagtacagttctggccttgatgcaggcctttctaaatgctggaaaccactgaccatttgaattgaatcatcttcatgggaagatttggaaggcagtagtgcccttgagaaggcggttggatgtagagcctggcatgatgtagatccagtagggagttcatgctaatttctaattagtagggagttcatgctaattaccaagataatcaagactatctgcctttcttgtctggctttcctcctgtgtccccagtggggcagcgggtggggagggaaccggagcaagatattgctgttcttggcgttcttccttgtgccagcccttggtctagatgttctctttgccccaggacttttaggaactgagaaggaacagcagtaagtaccatgcagcttctttgatgggaaagggcattctcatgttcttgctttctctcctagccggtttacaagctgacccagaggcaggtaaacatcaccgtgcagaagaaggagagtcaatggtgggagagactcaccaagcaggagaagcgcccactgttcttggcccctgactttgatcgttggctggacgagtctgatgctgaaatggagctcagagccaaggtcagtaaggatctgggatctagacagaagtcatgaggaacccaagttatttgggccacctcagatatctatcaggatctgatagaataaggacaaaaatataaattcactgaatgacctggagacgtggttttatagaagtattgggcatgtattttgtagactgttcctcagttgggttttgtttgatgtttttctcatgattagcttagggtgatgggttttgggtaggaaggccacagaggtaaagtgccattcttatcatgtcatatcaagcttttaatactctcaacatgacctacagctcttgatgttaatctagctcacctggatgtggttaatctttggtaggtttctccactgtatggtttctctactataatgttactcttctccttcctttactgttttctttggaaggaagtcactatgcacagttcacacttaacaagccagaagttatgcttcccattcttagggtggagtatctgtatactttatttggaattctgcatgggagatttttcttttctcctttatttattgtcatttatttatatcagtatggatattgtcatttatttatatcagaacagatttggtttatagttgggctgtaatccaatactgggtaatatatcttgttgctcatattgttctatctttggccactggaagctcttgtggttggctcttgtgtccctttgacacagctcccatcatcatgggcctttttttttttaaagtgcatccttaatttctggcactgtaagctgctccaggtttatcttgtatattcccaggcctgttgtttttattgcaggatgatagtggaaaccaggatctgggtgatctgggtgctaagtgtgctcattgctactgaggtattacttttaggttctctcagctgacagcacaaggaaatatatgtgtgtataccagcccatgtatatacatgtacctctaagtattttccatatatatccatctatatctatattatcctaatataagttcacactaatgttggagatttgattttagcttctagaaaattatcgaagtcttaaaaaatgaaatagcaatctatttcctgtcttaaatttctgttttgtttctacaaccatgacagattttctagatgtcttttccagctctaagatcttaaggctgcccactttgtagtttggaagccagctgattggtttaattctgtgagccctggatgggtcattctgtagtgccagtgctacccagtaaggagtcaggctccttagtaccgtgagttcagacatttttcccaaggaagtgagaacacaattggaggaggaggtggctttgaaggactcagatcatttatctctcatgtgggcttctgcaagcatctgggaattttaacttgtgttttttttgttttttcaatttatttttttactgaagtataattaaaatacaatgttaaatacattattgttgtacagcagagtgcctaatttatacacatatatacacatcctttttcatattcttttcccttatggtttatcacaggatattgaatatagttccctgtaccatacagtagtctaacttgtgttcttggaaaacttctgtccaaattctaggaagaagaacaattaaataaactcagactcgaaagccaaggctcccctgaaagtaagttgcccctactgctatggtgggtaccagttaacttgtgacagagatgggagtgtggatgagtgtgaagcagcaggagggcttgtattgggtggatgagtttctgagaaatccttaatgcccaatgcttaagctgtgcaaacccgcatctaaagtgttacttacttttaatgtttccctgctgttgggggcctgacatcatctgagtacaccaaggttggtgtagcagaatggaagaacctcagcctcctggactggcctagtagggtgctaggtggcagcaagtccttcagagacctggaaagtactgcataggtccatgactacagttcttccagtctggtggtgttttcctaaccgagatcataagggctgttgttgtcagccttaaagatggaaagtattctgtacagtcctgctgttcattaaccttttaaaaattcagttctacttctatgtctgtccaagtgtgtc

SEQ ID NO: 64160 - DNA, 1693 bp, Bovine  19866880482635
ttctcctcccgccttcatctttccagcatcagggtcttttctaatgagtcagatcttcgcatcaggtggccagaggattggagtttcagcttcagcatcagtccttccaataaatattcaggactgatttcctttaggattgactggtttgatctccttgctgtccaggggactcgctccaaagtaaccatgaggaaatctcccttttgcccttcacatgcttccacctacctgttagagcagaacgcaggtgctgctgctgaggtgtcacctgtgtgacgagtgatggacatgccaaggcctactctcacaccaggcaggtcatctgtaagtatgccagggtgcagaagtaggtggaaatcagtactccacagcctgacctcttctgatgctcttgagaagctgtgaggcgtggtgcaaaggcccttgcctggacaccggtgtcctgcataactgggcaagtcagtcaccctctctggacttcgtttttctgattgtaatattgagtcgttggaccaacgttcatctctgcgctgcgatattaaggcttcctttccatccagttagtccttgggactgcctgcctttctgagccttttcccagtctattcttgcccctactcgtcccttacccaatccctccccaaagaccacttaattcacagtaatttcttcctcgccctcctaaggcggggagtacttgtggtctgtggcattcaggctcagccttcctctcaatgggggctgccctgcattgttaagtaactgttttgtggctggatattccatctgtttccttaactcgattttaagctcctaaatggcttctctctcttttgtatctctcacgtcctctgcctgtggagcccaataaaaactaaatgaatatgtggccttgtaggtgcaaagctccatcgctctctccttctctttgactttctctgtttctccccacctcgtaattgagagcatagctcaaagggacagaagctggtgaatggggaatttaacacactagaggcaaaatcttggggaggctgtggctgcgtgtttttctctagaggagctgagactctcttcttcggcagatggcgtgtgaatcagaaaccgcattgcttggtagccctcatgcctgggtcttggggtctcctgccttggactgtattccctggctggataaaggctgtatccccaggcctgctggcctcaactgtagtgggaggaccgcccctcgccccagcagcaggacttgagtgtggaagttgcaagcttctggttcccacaccttggctccgctgccacaggcagccagctggccccttgaacacaatgtgcagatcttctctgttcccgttcccggcattgtccatggccgggcgccttggctgggaatgcgggccggtgaatagcggaggcatttgcagcctgcaatgaaaacaggccccccagcccccgctagccccccattccctccccaacccccgggagaaaggactttttcacttctggccttcttgtattgccttcccctcgcctctccaaagtccctgcaggcatgtgtgtgtgtgcgtgtgtgtgtgtatgtaagagacttttcacagcagcttgaaggctgttcaacacagccctcaaaaaaacaagtagaatggaacagaagggcacccaggatggaaaaccaaacagctcactgctg

SEQ ID NO: 64161 - DNA, 1931 bp, Bovine  19866880558791
ttcttatcctacccatatttttcagttttgaaattttttgttctaccttctgtaagatatcttcaattttatcttgcaaccaatatttaaaaaaattttccattatcatatttattatttctaagatttcctgttcttttttcattaatgtctactaagccagtttccacatagaggctccaagcaattagagacaatataaggtaggctgtaataagatgccgaaatgttgggtactaacactgagtgctgtaggataaacgggactagacaaatcgtctaccagaaaacactgggacaactccatggagaatgtaggataggatccggacctggaatttaagtacatttgggtaggtgaggaatagcagtgttgaatgggggaagaagtattgcctttgaaaccaggcccagctgtccctgtgaaatctgagcctcaattttctcatgtttaatgagactaataatatctaccctcttgagttgctaaaaggagataagttgtatatgttaagtattttgcacacagttgtaatttaataaatacccttcataaatactcatattcttcattgaggccagaaaaaaatatcttctctagccatacttcctagcatggtgcttcctacatagtgaggtcttaatatagacgacgaatgagtacgtgagggagggaataaataaatgaggaaaagagagcattgcagacaggggaagaacggaaacagtggccaaaaagttggaaataagcatgttgcctgggaaatgacagttgggatcttggcctgacttagaaaggcttatggagtgacaagtcttcatggaaacatctggaaagctgaaccaataaatttttggagggggtaggaggagaggggcagtgacagaggtagaatggggccagtacaaggcacccaaattaatgaccagattggggttagagcacctctgggtcagttagagaagctgagctaattccagttttcaacagaaacgtgggcaagggatttaagctccccagtcttgttgggaaaatgattcctgctctgtctaccctgaaagatgacacggataaaatgagccaagaggtaataagtatgctttgtaagtttgtgacaaaatatcattgactcaggaagcaggtggaaaaatagaaatctttgtttatccacgtggctataaactcaacatggctttatgtctgtggaagcagtaaaccagtaacccgtaagatgggtatgtttcaccaagaaggtatttcttccctgctcttttccttaaattggctatatgtaatttcacttttaaattttctcaatgtctctacctatgctgtctgatccagtagccactcaccacaggaggctattcaaatttaattaaataaaatccagttcctctgctacactagccaggtgtcaagggttcagtggtctcatggggtgtggctacctttccttatcacagaaagttctgttggagagtgctgggctagactatgtagaattgcagtatgtaggtatacatatatttttatatacactttagtattattttatgtatttttatcctcttatgaccttaatttataaagcagataagtaaaacttgtatatttaaagacagtaagctgtttttcacttgcctgggcctcagttgattgttcagtgtccaacgttagtgctgagaacaggttccccaacctgacggaagttaatggattttcttaattagggaggtaataggatataggagatcgaatgattcaaagagcttctaacctaattggaaatgtgcttgactgtgttttgccagatgtcatttcaagcttgtttttttcttttaagatgctaaagaaaacccttatggtgaggatgataataagagcccgttccccctgcagcccaaaaacaagcgcagttatgcccaga

SEQ ID NO: 64162 - DNA, 874 bp, Bovine  19866880664764
cttaatatatattattgcctagccttgaattaaaaattaggttctctttctgtttcaaatttgtatatttcagtttgtgtaaatcctaccttaaaagaaaggaaaaagagtattgaattctaattaatgaattttttaggggtgaagtgtactgatgtcttcaacttacattgaaatacataaaaaatgagatgggaatgggtatgtgataaagtaagtgtaataaacagttaaagtttaaatttaggtgttcactgtacaatgatttaatttgtatatttgaaaattttcataatgaagcatgagagaaaattaaattgtaaaacccactgggggaaaactgaatgtctctagtgcattgttaatatgtgttctaggttgtgcttcttgaggaactgcaggaagcacagggctgtgggatatgaaaaacagacagctagggactgttctaccccaagaacttctgcttataaacagagacaaagattctaattggcctcttttcttttccagggttatacgtaaatttccgttatctttataaacagcgcaggcggcgctttggacaaaaaaagaaaaagatccactaaacggaagagatttagatgactttttgccagtttgagcctaatctatagttcttacagttttaccttcttgtactgatgtaaaagtttttttaaagttaaatgattcaattctcagtggagctatcttctttttttcccagtaacattcctgaatttactgtattaccttagtgtagtcctcgcatgacatggggttcctgatacccgatgacaggttcattccttgtgtattctggttagtgacagcaaaagactcagccatacccccacccactccatctcta

SEQ ID NO: 64163 - DNA, 1808 bp, Bovine  19866880681846
cattgtaattcccacaaactatcttatatgctattggtatcttttaaaagaagacaccaaatcgacaccagtatactcagaaagcagcacaattatgcgttaaggaaagcatcttcctagtaaattgacttattgaaagctggtatttgtataaaatatagagggctcgcagtggaattttagaacactctctggaagggatgattataattctgagtgatagaattgtaaacatctgtacaatatagtctgtctgcattattccagtgtagcatttattcagcacacttttaaccttctcaactattgactcgtctaaaaagtgaggtgtatcaatgttataaaatcggttgccctttcccgtgagtccacattaggtctacgttagcatcaaatcagagcagagttgtagcaattgaacatttgccataaagaggtactttgagaagtggtgtattttaaaggagaaaacagtaaagttgccacaaggaaaatcataatagtctacaacaggagtcaggaaactttctgtattttagcctttgcaggtctgtggcagctcctcagctctgttgtagcatagaaacagccatatatattaagtaaataaatgaatgtggtttctgttccagtaaactttgcttatagaaatagtcagtggcccatagtatatgattttttctatagggtcaaatacagaattcctcagtagtgtcagcagcatcagtgatatttgttttttaaataaatataagattgtagctgcctatagtgtaaaatctaccccaatctacaattggaaagattaggggttgacctaagtaaagcatgaaggaatatgagaagtgatggaaccggtctgtatcttgatcgtaaaagtggttacatcgctgaatgcacttgttggaactcgtagaactatatacaaataagggtgaattttactgcatgtaaattgtatctcagtaaacccagcttttttttttttttaagcttttttctcttttcttgctgtaaaaccatcctgttgatagagtatgatgtcatgagttggtgaagaccctgacctactacaataaggttaaaatcagagcactttagtggacacttgctaaaaaagccaataaatacgttttatttcttttcagaaataaaaatctttggcaccttacttcataattatttggtacattacagactatctaacttcctaactataatgaaaagtaacgttttgttgttaataccctccgaactgaaagctagcggataacacagtttcatttgctacttcttcagtgtttgaagaaactcagaaagtatgtaagagccagaccttatgcaccatgcagacttctgccttttaatgttttcttcttcctttgcaaaaaggaggaatctgaatttgagatatactgtaccctgagggcaaggagctgggcctggatccacttagacttgcttggtgagttttggggtgaaccaggtccaaaccacagtggaagttattagtgattgttttttataatcagttactatcaaatggatttgttttaatatggaatatttttagccaaatttttagaaagctggactatgtcttcgttagacatagtccattagagtaaagtctgtttcatttggacattacaaaaaatatttcattatcacacagcatctgaaaaagctagtggcggaagtaaataattaggtagcagctgttggtacttgaaagagggatatgcgttgcctgccttcccaagagatgacatctctccagggaacctctattaagcatgtttgggctt

SEQ ID NO: 64164 - DNA, 672 bp, Bovine  19866880705845
tattcctgcaactttgttgagactgagtatctggtgtggcttgtgggcccagatgcaatacttgagccagtgagaagatgagtgtgtggttgtttgttgctgaggctggaatttcaggtgcgtccaccagtgagagtcccagagtgtgtctgcgatgacgaaagtgagaccggctgggtggtggactgtgtccgtgatgctgagtgtccttgggccagtggtgctgtgctggtggttgaccgtgccccccaccacaggtacacgctgctgcccaagggagtcctgcaaatcacaggccttcgagctgaggacagcggtgtcttccactgtgtggcctcaaacatcgccagtgtccgggtcagccacggggccaggctcaccgtgacaggtgcgggcctctgccctgttgcattcttcccccaccaccacatcaccctcccttcagtggaaccccagggcctggactgccgagtgtgtaccgagcaccttctgagcgcctagctctgtgctcctcctcccgaggagggtgcagggaccccgaggagggcataggaccctgaggagggcacagggaccctgaggagggcgcagggacctcgaggagggcgcagggactccgaggagggtttagggaccctgaggtccctcgctagctcagttctctcggaggaa

SEQ ID NO: 64165 - DNA, 2845 bp, Bovine  19866880782141
aatgatataagcacaagtgagaagctgtaaatcacataaccaaaatatgttgctgaagacttggttttgtggagggccttctatgagaagtagctaccactgaaaggtgatggtgagtatgaaagcagcaatgaaacactgaataaaaacagtaggtcaaaaactggatattgatcactcttggtttgtaaccagtgatcccatataaaaatggcttttagttttattgttttcattttaatatatattcctggtcacagtgaaggaaatattaactaccacttggaactagaaaagtcatttaatcttgcaacagatctcatatacaagatttggttctactaaataaatacatatacattctttccattagggcttccctcatagctcagttggtaaagaatctgcctgcaatgcaggagaccctggattgattcctgggtggggaagatcccttggagaagggataggctaccctacccactccagtattcttgggcttcccttgtggctcagctgctaaagaatctgcctgcaatgcgggagacctgggtatgatccctgggtggggaagatcccctggagaagggaaaggctacccactccagtattctggcctggagaattccatggaccatacagtccatggggttgcaaagagtcggacacgactgagtgactttcacttcactttatttgtataatgggattttataaaaggtaatactgattaatgttggagacattgccttctataataattttttacagcaaatgcataaaatttttaccctgatagctcagttagtaaagaatttgcctgcaatgcaggagacgctggttcaattcctgggtcgggaagatccattggagaagggataggctacccactccattattcttgggcttcccttgtgggctcagatggtaaagaatccacctgcagtatagaagagctgggtttgatccctgggttgggaatatcccctggagaagggaaaggccacccactccagtattctggcctggagaattccatgaactgtccatggggtcacaaagagttggacacaactgagtgactttcactttcacttcacttttcatttaatttaaattttttaattttttggctaaggtcaaaaacagtgttaaagtccaaattagtgaattgtgtgagggaataaactaatattattcaagcgtgatgttttctttgtgttcccaagtactttatgtaacaatgtttagaaaatttaaggaattggatgcctggcctattattaaaaacttatgactttaccataaaggagaatggggaaactttcacttatactttgatgacagatagatttgaggtcattttctgttttgaaagccttaaaaaacttttttaactttggtcaaaatacaagtttgctttttctaaagatgcttggttttagagacatacatacatacacctatctatgttatctgtccatctatctattaaaataccttggcacattctgcaaaatgccattctgtggtttatgtcaataaacacagaggttaatctgtgttttctttacattattaatttttagtgtggagaacagttgttctttaactttatatgaggctgtacaattcaaacttgcagtacagttgtaatatttgctacatttaaggatcagtttgattcctgacaatattacctttaatatttgagggtgttttgtaattgtgtactaatttattttttagggttttatatgactggaaagaaagattgaaacaagggtgtgaaattatccagagtactccctatggacgccctgcaaatattagcaggcagtacctcatcacaaagaatttatatcacttaccgaagagcctctgaaaacatgactcagaatacgttggctgttacagacatatgtattattatacccagtaaaggagaaagtccaccacacacattctgcaaagttgacaagaatctcaataacagtatggtaagtgactcttctgcatggataaaattagccacccatgaaaagagcataatttaaaataaatctttggaaaacagcatggcacaattactgaattaaaaaaatagatttcttaaagatgtcatatattttatttttaggaaagtaatttagctgtactttcaaaaagaactgtgcaaaaagctttctttctttttttttaattaaaaaaataattttttccccttactgcaaaagtagcgcgctagctgagggtaaccgctccacttgtgcactagatcccataaactcacctatttgaaatgaggccatggcttcaacaatcctccctacttttttgtgactcatcagtttttcactctactggatcatttacttcagcctgcaaaagcatgctacaatacctcccatctttacagagcttcttgatctttgtatcccactccatgtattcccccatttgattgtctttataataaaaggtcttagaagagatgactatattccatctccttcctcactctgactctttgcagtaaggcttttgtctccatcattccaccaagatttctcttgttgaatccagtgattcaatgcttaatcttaatgtttcagtacatttagacatagatgatcacttcttccttcttgaaacagtggcaagaaaagaagatgtaatcgtgtccaactctttgtgaccctgtgaactgtagcccacctggctcctctgtccatggaattctccaggcaagaatactggagtgggttgccattcctttttccaggggatcttcccgaccaaggggtctaacttgggtctcccgcattgcaggcgggattcttta

SEQ ID NO: 64166 - DNA, 635 bp, Bovine  19866880792223
tgaatctctatgtacaggtaggcccttggatggaacccagagtctatcgtttgaaacataaagctttttggtggtggagagagagaactataaaattctctgtaggaatgaagcactaacttgataaaggtggtctccatgagtaatttatagaattcaagcatagtagagacacctgggtgcctgtctgcccactctcccttctctatgaaccacaggcctgaactcacacactgaggagccatttggtaccatggaaccttggctcccagattcaaggaattcagtcaggacaccagacttaaatggagtcagtctgagtcccatgaagtgacttcttggtcgaattttaatgcattaaaacgtacacacaatctaacacacaccacctcttcaaacacctgcctaaactgatattagaacagtgtgagaaacagctgctttgcagtttggcaaatagtgtcatgacttaaaaaaccaatcatgttctttgatcctgtctgattcccagagacagtcattatgatattagaacagcagaggatgggaaggacctgattcatagcagcagaggagaagggtaaacacctgcttgagaagcagcgtgctgcaatttaaaatgttagtaagaaaat

SEQ ID NO: 64167 - DNA, 1423 bp, Bovine  19866880838964
cgatcattctctggaaacagaccctgccagtggtcacttgatcttagtcaaattaagggaaatgtacagtgaggaagtcagagggctcagatgccaatcacgacaagcaaaacctcaggaaagatgtaagagtctgggccatctgcacttaccgtgtgtcaccccctcggctggctgctgtcttccattattcaaactttcaggcaaatttttcaaaactgaaataagctttaaaaaaaagagagagaaatatattcaagatgaaaagaacaaaaacagaaatacattacaactcagtaccatgaaattggggtcaggcaataaatcggcttaagccgtgacgagccatctacttggtgaggtctcagtggagctcttgcttctctgcaggctacaggccaccgatttcctttctgagaatgctgagccctgaccggccattagaacagcctgagctcagctaaccacactcccactctatatgaaggaaagctgtggagatttaaacagagtgtactctggagtcacagagttctggatcaaatcccagttccactgcctactagctgtgtctctgtggaaaaactgtttcacgtgtctgtgaccttcaaggtcatcatctataaaacagttgaaaaaggtttgttggaaaggtaaaaaaaaaaggacataagagcatctataatagtatacaacaacagtatctaatacagtccttggcacacaagccagtgctccataaatgacagacactaccataacagcatttccgaggggactgcctagaatggagagcaccatctataaaccaggggagaacgtttttctctacagaaagtttagttcagatgaaaatcactaattgggtcattaagcagttactcagacagattgaatgaaaaagtcccagagttcatttacagcaagggggtcagcagaattccaaaacacatggatgcagacgactggaacataggtacaaaagtgggaggaaagctgtgactcacttaggaaatgctcctggtccagtttgacagggatgaatggtatgtccctgagactaagagtgaaactggaagaatagtctaaaagcctctccatggaatgcggtagatcatataaaatcacatatttcattcaaaagccttgattaagtacctcctttgtgtaaatgttcaaagacttctaagctgatttttaggaagccagggataaaaatcattttttttaaatgagtctaaaattatatatcataaaagtgttcttttcatcataaacactttggaaacaagcagggggatattgtgtaccatgttggcacccagtcttgacagcactgcttccaattcctttgaggtgctcttgggtggcacagggaaccgtctcctgtttgaggattggacctacatcaaacctaccaaga

SEQ ID NO: 64168 - DNA, 1398 bp, Bovine  19866880913520
tattatgatccactgagtgctttaaaaaaaaaaagcctcagacttcctggcagtccaactctgtgtttccactgcaggggacatgggtctgatccctggtcagggaactaagatcccgcatggcgtgaggccaaaacataaaattttttaaaaataaataggcttgtctgaaagtagtgcattatctcaattgattgttcacagttatagatcgaactcctcatcctactctttcccccgtctcactactgcacttgactagtcttttatgaaagcagcctagatgtccatcggcagatgaacggataaggaagttgtggtgcatatgcacaatggactattactcagctataaaaaaggaacacatttgagtcagttctaatgaggtggataaacctggagcctattatacagagtgaagtaagtcagaaagagaaaaacaaatattgtatattaacgtatatatatggaatttagaaagacagtactgatgatcctacatgcagggtagtaaaggacacacagatgtaaagaactgacttttagactcggggggagcaggtgagggtggggtgatttgagagaacagcattgagacatgtacattaccatacgtaaaacaggtgaccagtgcaagttcaatatatgaaggagggtatccaaagtcagtgctctggtacaacccagagggacagggtagggagggaagaaggcgcggggttcaggatagggggatacatgtatacctgtggccaattcatgctgaagtatggcaaaaaccatcacaatattgtaaagtaatgatcctccaattacaataaattaattaattaaaaaaacttttaattcaaaaagtatctttaatgttttaatttaaaaaaaaacactgtctcaactttgcagagcacatagatgcaggcagaactccacacatgaaactttaatctcaaataaaatgagactctggataagacagtcttatccatagtagaaggagcactcaaacaccatcctggcatttgtacccacctgaaaatttcaactgtgctccatatataaaacacaaagaaaaccacagctttgttttgcatctcttccatggtaccaaagatgataaacaaaatgaagtttcttccaagaagctattaaaaagacccaaaagagaaaaacaagttttaaaatacattcttaaaagacaacacataaatgtgttatctgaaacataaccccattaaattcaaggtaaatagaaaaagactgagaacaacttagaacaagtttaagtaccaagtcagtaccagtattacagactgtgtgtgtgtgtgtgtgtgttcagataaaacactgctatttctctgcaacaggtagaaaagttaaaagtacccaagccagtaccag

SEQ ID NO: 64169 - DNA, 886 bp, Bovine  19866880920583
cccgtgtggcgcctcccctggcttggacgggggcccactgaggcctgtgcggctctttcctgctcagctttcatccatgctgacccgagggagcagctcggcctctctgcacaacagcaccatccgcagcaccatctaccagctcatgctccacagcctggaccctctgggggaaggtaagcaaggcctgcccagacctgcgtggtctccctgtccactccttcccttctgagctgggcagaaccggggcttgtgaagcgcagaggcagtggagcgagggcgggagtcggaggatggcaagggcagccagtcggggaagcctcacccagaggaccctgtggagctgcccttacttatgcacacccctccctccctgtctctttgtccctcctgtgaaacgaaaggggttatctgcagtgagtggggccctgagggtcgcgtgccctgcgctggtttttgtgggggctgccctcagtgactttctgcaaagcccactcccatgagtcagccccgatgtcccacagagtctccagccggatagtgtggccaaggttgcttctgggggcacctcctgtggggccccatggcttggaagttctggctggtaccttcctttgctctgtattcagctctggagtcccaggaagctggctgacccctcccccagccaggaatcccaaaggacacctcgagagccagcaggaccacttctgggagtctgagggtccaaagtgcagtggaggctaaagtccaacttgacaaatgatagaaacagctgagagtctcaccatcctccttccacatctcgcctattgccccgcttcctcagagcgccgtctcggacaggctttgcaggccccgaggggcgctctcaggtacactccta

SEQ ID NO: 64170 - DNA, 1968 bp, Bovine  19866880921376
aactcaagtgatggctgcctgagtgctgaattgagaattttgctccaagcttggctgcagagcaccatgattcactggtgatgtctgaaatgggcagggaatggggaaataatgacagggaggtgttagggaggtgttcctgcaacccttggactagactgtaaggtctgcagtttaccgtctatgaatttactagaagctttgctctggctccagaggcactactggtggccatgttcataagcctcccctctccagtgggaaagggaaatgacggatcatcaagctcctgtcacactcctttcgacctcagacacctggaacccaagcagagcctccttccagacccctgtgcacgcctcctgctctgctggtggtcctcagagcatcatgcacagaatagcactgtcctgattgccagaaaagaaaaatggggacggcagctctctttcgatatgactatgttccaggcaacatgcaaagtgctatagtttcagctgagaggcacaagactgagctgcaggggctcaggagggccctcctcacagctgtgcaggccgtggggtgaggacgagggcacgggcggcagaacaaagccgtgggtctatctggggtccaggctggctccgcccgtgagtgccgggtggcctggggaagcctgtgcaccctcgctacacctcagcgtcccccctctaaagaagcaacaatatgatacacttggaacactgatatgggggtctaagggacaaaataaacaaaagtactttaactgctgcattaaatattgctatgttagcttcgattttggagccagatgcctgggtttgaatcctagttctgccaagtgctagctgtggatccagcagggtgatcctctgtacctcagattcctcacctataaaatcttaacagagttgttgaaggaatccatgaatttatatacgaacatgcttaaatcagcgcctggcagctacaagatactacgtaagtgttagctatgacaaccatgatgagctgacaacactcgctgagagcagctgttccacccaggaagcaattctgcacctttgaggcccagcattccagagggtctgagttagaatggaccccaaagatcctctagtccagaacaccggcacactgtgaagatttgggaatcaaactctgcctgggtccagaatgggtccagaagcagaaacaggtccagagtttccttctctcaacctgtctcctgaacaatcagggtggttcagctgcagctgcctctggcaactggctccaccccacacagccatcactctggcacgtgtgatcccttgaagcatcctgtccttggtgggcctgctcagcaggtcccatcagaactgagatgtcagaaagtgagtactccactgcctccctcatgcagacagctccagtgccccacggacactgatcaagcactgcagtcttctgctgaacaacacataacttttccaagggctcccctggccccagtcctggtgccaagaatacctgtagactgttgcctggaggggctggcaagaaaatcaagtttccctctttattcttcttcttcattacacgccctaacctctcatttcccatgccctaaggaacgcaggtcagcttcagggcctttctctgtttcttcatctctttcatatacatacgcacacatccatgtgaaatcaccagaagaagcatgaggtactagagaggtggagcccctgcccagggtaagagttcagaccacggatcagctctgtggaaagagctggaatacttggaaagggtagaaacatctggacagtcatctgaatatagcatacggaaacacaaacatgtgtctggaaagtgctgggaacaaaggtcttcatcccagcccttcctgggtggaatctcggggtgcaggataagggctggcttctctgagcaggactgcacgccagcaacatcagcaagcct

SEQ ID NO: 64171 - DNA, 1155 bp, Bovine  19866880938671
ggtctgtgccccgtggctgtttctgagcctggggctaggggctgggtgatagggattgtaataattgatctacatggagccccagcaatgatattagtagtataggtctccactatactctcaaaatgacttcacccttgcacacagcttcaataatctatgtgccagtactcacacatgaaattctccaattaggcccttctaagatcaaactttggaaaaggcaatggcaccccactccagtactcttgcctggaaaatcccatggacggaggagcctggtaggctgcagtccatggagtcgctaagagtcggacatgactgagcgacttcactttcacttttcactttcatgcattggaggaggaaatggcaccccactccagtgttcttgcctggagaatcccagggacagcggggcctggtgggctgccgtctatggggtcacacagagttggacacgactgaatcgacttagcagcagcagcagcaagatcaaacttataaatgcaactgcctacaaggcctctcctccataatgtctcaagggtgcctcaaactcaacataaccaaggtaaactctgacgttcccctcccccaaactgctcctcttcctccaggattccttatctcaaggaatgtctaagatacacacaaaagcttgggactcatccccaacactttcttccccttcactgccacccatctcaaattcccaccagattttctctcctaaatctctggaatctagccatttcatgctacctccactgctgccattggaatccgagcccccttcgtctctcacttggacaactggtgtccatgtatcttctcatgccttatcattctgttacatacaactgggatgaaattgatcatttcaagccattctgatgtttaaaagcctccaatagttcccccctactctcagaataaaatcagactcctgacaaggaattccttgtcaggtgtctggcccctactccctcacttgccgtctgcattgccctctcagccccacaaagggtctttacatacactattccagatacctgcagtgttcctctttgtctcttcccaccagttaattcttcagagctctactggaacatcatgtccccaaaaagctttccctaacccccaaacttgaat

SEQ ID NO: 64172 - DNA, 1505 bp, Bovine  19866880941385
acccctgctggagatgttaccaaatacacagtatatactgtgggtaaagggttaacaacgccttttcccttcagcatgagttaatttcctatccacctgttcccctggagatcagataaaagaaatatagcaattacatacataactaagcaacactgcttatggtaactacaacccaaatggtaactgcagctggactggaagaaactgtgagtggggaatccatggttggggtttccctgagtgtggtgacgttttgtgaggaccctggtagttatgtttatgatattgttactagaggggccagcctccgtggagcatggggcttcattagaccagagcagttcctgcagtcactccatgtgaatctcatctccttaacacctgagttgtcacacttgagggcaaagaccagctcctggacctctgtgtggaccacaacaaggacttctgcagaaatggaatgcctgttgtgagttgtgatccatcccagagccttctgatataagctagtacctggtgtgtgaggtggacaatattgcctctgtaaaatcaggcagaatctgaatttcacaacagattcggtgccaggatttctgataagcgactggggaacctagactagcagagaggtatctgtagcttttgctcagaaattagaactgactagaagccaaatctctccagaatgggatttaaaacaccactgcagactggtgccacctgtgaacatactccctccaagctttgctcactcagtcccctggaatgccccttccctcaactctaccaacccaggcaacccctctcctccaaacccctaaagcactcagccccagtactgtctatccaaattagccaggactccccaagaccaaggactgtcctgtgttttccaagttctgtttccctggatgtagaggaaagaaaagatggatctcaggttgaatccctactccttagacctggctccgccactagacctggctgagcctcgatctcctctctaacatgcgaaccccactatctatctccacgtgggttgtcaggaagatcaaagaaggtaacagaatctcagcgcctggtctatacagtgtatgtccatttcttttcttctaatttgtatttctccctggacaacacatacctttcctagggatgtagttggtacttcatgaatcccagcagttctttcctctgtttctagctcgttcacagttgcaaaccttgggggggtttattccctaaccctgtaacatttcagagttgttttattcccatctctgtttctaaagatgcaatcaacagactcaggtttctgataaaactaaatctgtatgctttgtgggccatcagtgcggatccaatttaaaaacaggggatgtgtagatgctccacaagaattgatgctacacagtagggaagcagaaagagaaataatcatgacttacaactattcactgtcataacaaagaaggggtacaaactacaaaggggaacaagag

SEQ ID NO: 64173 - DNA, 1813 bp, Bovine  19866880980277
gcaaacctgtcaggcctcgagctctggaatcagagaaataggcttctcagactcagctttgctccttactagtggcaccccactccagtactcttgcctggaaaatccaatggacggaggagcctggtaggctgcagtccatggggtcgctaagagtcggacacgactgagcgacttcactttcacttttcactttcctgcattggagaaggaaatggcaacccactccagtgttcttgcctggagaatcccagggacggggaagtctggtgggctgccgtctatggggtcgcacagagtcggacacgactgaagcgacttagcagcagtagcagcagcagcttgtgccctgggaaagtcagtgaacttttctcatctgtaaaatgggggaaatttttctgagataatattcaatcattataaaaaggctttgtgaactatcaactatccaacaataagactctaatgggtactgagctcctattaagttccaggcactacactaggtatttagccctcacggcaacgtaaaaaagtaagtatatattatgggcttccctggtggctcaaagaatctgcctgcaacgcaggggacataagttcgatccccgggtcaggaagatcccctggagaagggaatgactacccactccagtattcttgcctggagaattgcatggacagaggagcctggcaggctacagcccatagggttgcaaggagtcagacacaatgagcaattaacacacacacacaagtatatatcatcttctatttatagcttggaaaagaggctcagagaggttgagtaacctgcccaaggtcacagagttcagcaggagagaagccaagtccaggacctgagcctgctgcctcatagctttgctcacgccacgttcaggaattattgtggctgctacagtcacagccgacacagtcacagctcggcagctgaggacacacgcttgtcctgagggggcgcagctccctgggtgagggtgtccccgcccctagggggagctgcacgcaggggaggtggatcccttcggcagctgggttaagggcggtcagaccttcctgaaacagaggagtggtgggagggcggcgggaggccgaggcagagctcaccactcttgctggggctgccgggctctttgagctctcgcctctctgcttcagccgacaatggcctggttatccatggtgtcctgagccccacgcccgattctcacctggaggggcatttggtgcactcagtccctcccccacggctctgctcgtgtctcctcaccctcctgtctctgttcccccctgctccaccctggtcatgtgacctctcgctcctttaaacacacagggtgataaggacttctccataatccctgatgcccagtttttctctgagcctggagctttgtgctgccactcatcttttccaggcgggctgttagtctgagaacatgtccttgttcttggttccaaggcccccgccgggagaaatcagacagcaccatgggctgtggctcctgaaaggcaggggacaagtcaacgtcacacatctctgcctctgccaggtggtgactcaccgcattctgctccttcaggtccagcctgacggccacgagtcactgcagcacagccaggtgggcggccaggtgaagggctgtgttgccctactgtaaggagaggggctcccgaagggttggtgggatcacagacactggcaggtcctggggacccgttggagcggaggtccagagaggggtgacacttccagggtgacggaacaggtctgtgacaaggtatagctctg

SEQ ID NO: 64174 - DNA, 1673 bp, Bovine  19866881062836
actgtctggggctgtgcaccatggagacagtgtcctgggctgcctctacccctgatctggttagaataagcccctctccttcgcatgaatctccaacctgacatttggaacatcccaaaataaatcataatattctgaagtaagatagaaaccaccactccacccactcctgttggcactcttatccacttggaaagagtttttagaaaatttccagtattccactgcagtgcccacatagcacagccctgagaaggggaagaagcatttattgaatgcctactgtataccaaccactgggctaggctttgcttgtattaaaaatctggtggtgaaagtgatgtttcctgcactaaaatttaactgcaagctctttgagggcagggcccaggtcatctgtgtaaatccaagtatctaagatattgtggaagcttaagaaaagcttgttgattgaataaatggatgaaaggatgtatgaaatttctttgccatagtagagggtaatgtcagcaaagatgactgaggtcagacaagaaaaaattcattggtaagccagtacagatggatgagggtttcagaaaattttatggacatttttcagttgatttcagagtctcattctttgtcaccaagaataccttttgggagtagattggggtggggaggacagagtcttttaaaagtttcatttttaaaggctcagactcaaaatgcaaatggtcctaagagagattaaattattgatttgatgtttattcatacacaagtgtaagtgaccgaagaggaagccattcctaagaacaggttttagtaagagtttagaaggggcggggaagtggtgagagagaaatccctggaagttcaagggtgagtggagttttgaccatgtgagggggtagggggagagggctgaggccactggagtcagacgtacttgataacctaaaccccttgggcccagtgaaatcagcctgtggtgctgacaggcccttctgccctggcaacattggtcacttcagtcaaaatgcctgctggtggggcaggaggagacaaggccggtccaaattcctgggaagtatggactgcataccgtttaaaggtgtagttcttactgttctcaagcatgtccaggctatcccaaagaggtccgtaacacatcgcctatcagaggtctgtagggatttaaaactatatcaataataatttgagggtttacgtatgcttgaaaagcatttatcatcttagtttctgacccacttatttctttggtttaatatttgttcttgtcccctgaggtccatatcactctcctggtaccgaacccagcttccccctagggaatcaatttccactctccctggatattggtaaagctgaaggcccctcccatccacacactcaagggggtggagcagtggctgaggcccaagccagtcagtgagtttcagccccgcacctctgcgtcagtgattggttcagacatgggcatgtgacccaatcagacgccccaaggagattgtttttctcgagctgctaggaaagaggcttgtagtccttctgccgccatcttgctgccttgggaggcttcaggctgatgccaacacagccggaaagcaaagccaagaggggaagaggaacagggtcacagtgttgttgtttgagtactgaatgca

SEQ ID NO: 64175 - DNA, 875 bp, Bovine  19866881100040
catgtctcataagcacagtgcacctggatactggaaacaggcacaggggaagtctcccctgacacccacactataatgagagctttgggctcagcttcattcacctttccagccccgtcattgcagacccagtaggtgagctctgaggggcacatggcactgcatgtggggcacggagggacggcctctcctttccacccccactgcctgctcagagattgggccatcagcctactctgattcaattgacttcttctaaaccttgcatccaggggctgccagcggccaaatccccctgattgtctgagatgttcccgacttcagagaataaacagtctcccctgtccaggcagctgtgctgaacagcattcctgtctcccagcctgtttggccgggtggggctgcagcccggtgtccacctccagcagaggcctggggggcctggtgagtagctggaagggagaggggaggtgaccatctgtgttcagactgcacagcacattcctgtgcctgagtccccatttcgcccccctgccaggcacctcagccactcctggcacaagctttttatttgtactaatgactcttgtgacttcagacaaggtcaagacaaggtcactgtccctaggtttggagccccttcacccgtgcccagaaagctgcctggggaatttgaagctcctacatcattctaggtagatctgaaggcatcacacccctaaggcttgttttacagaggtgcgggcatcgtgagtcagtgcagaagcaaggcaagaccccagggtttttttattttttttgctgtccattaccttgggatgttgtggctagaatgacgtgaggggctctgggtgagaggggcagcccatgttttt

SEQ ID NO: 64176 - DNA, 1706 bp, Bovine  19866881160289
tttcagtcatactagccacattcaagtaaccacatatagctagtgtttactatattggacaacccaagaataaaacatctctcctgttgcagaaagtgctattgggcacctctggaaagatttgtgactgcccaaagcttcagtcctactttcggggcagagatttggacaggagtagaatattgagactccccaagtaggcatggagggtcttgctaaactctcatggagatggtagccttaggatctagaaacttgatcacaaaccccccaataattaaatcaaagctgaaattctgcctccgaagaaaaacacaaaataacttcaagttgaagataaaaacaatgtggccactgacccgactccagttccacagccccccagctctgggtcccccactcacctggctcaggctctgccgccccgtcttctgcagagccatgatggccctgtgcagagggtaccccagggcaaccaccggcccaatgaggtcttgctcctcctggctcagggcagacagcaagtcagcagaatcagggtgcgatctgtgggcagcacaaggctggggcacccgtccaggaggtggcaggcaggtgtacgggctgagggactgaaacaaaggcaagctgcaagtgtcagttaccctggaggtgacacctggctgggcaagacatttttaaaggtgccttcgctacagagcacaggggttaatattgtgaggatcttggagccctgcagacctgggttcaaatcccagctttctactgtttactcagtttgttgtttagtcgcttggttgtgtccaactctttgagaccccatagactgtagcccaccaggctcctctgtccatgtgatttcccaggcaagagtactggagcgggttgccatttacttctctaagggatcttcccaacccagggattgaacctgagtctcctgcattgcaagtggattctttaccactaagccaccagggaagccagattattcatgtgtaaaatggatgcaatcataccagatacctcacagggttgttacaaggcttaaataagatgaggtgagaaaagtgactagcaaaagggtttggcatacagaaactgccagtagatgataatatttattgcttagaacaagcctgtgagagaaatacaataggctcattctatattttatagctactgaagtcaaggttcagagaagctggcaaatgacctgacaaacaacacagttttgggacctgtaccctactcagaatcaacgcagggttctcgaccccatagcttagggagcacgggagcaggactgagcttcctagccagaacttccttcttgagtctggctggactagggcttggttaggcaaggcgcaggataggaactgggtacagctgtggtgctggggaaacccacagagaccctggactaaggagggtggcttgaaggcatttcaataggtttggctggcatcatccctagcctgttccccatgaagaagcatccaactgctaaccctgtcccctcctccagcaggaaagcctaggtgctgtcctggctccaggagcagactgcctgtgacatgtgaattccctacacgtcctcatcttctcagcggtttccctgccatggcctcaccttaagatctactctttactcctagagtgaaaaccatgcaagtcttaggatttgagtctatgcttgtgac

SEQ ID NO: 64177 - DNA, 971 bp, Bovine  19866881161783
cacttgcctcaagtcacacagctgctgccgagagtatctggcgttggagccctggggtggatgatttggtggttggggtggggaaacctcagggtctgaagaagctcctgttgtaggtgggcttagagatggatccagttatgctcagaggagaggttacttcctcagtgtttctccacaaatagaggagttcccgcacctcccagcatctagttaggcctctcccaggaggctggagctgtcagttcctggactctggaagtgtttgcccccaagtcctctgaaaattgatcctcatctataaataagccaggctcatatgtcccagcacattgtgtgtggggtgggggataaagaaatacctaaaacagcaacttgattatgcccaaggtatgtatttttacacatgcccggatagagttcatgtacaaatatgctattcataaactcgactcagaggtttgaaggagaccatatgcccaggtgtaggctgtgcacatgtgcagttaataagcacacgccgtcagggtctgtatgcatattttgggcactgagggcaaagtctagaccctaaggcaattgcctgatacttacactaatttctaatgagaggggatcatttttcttccacaggaaccaataatcaccaagagcaacgtttcccaaatcacaggcattcacaaactcctgtcataatcttggccacccctaagacatttatataatcactcactttatacatttcttcaaatcaactctctcttttgtaacttttgtgtctgcgtgctaagttgcttcagtcgtgtccgactctttgcgaccctatggactgtagcctgccaggctcacctgtccatgggattctccaggcaagaatactggagtgggttgctatttccttctctagggggatttcccgacccagggatcgaacccaggtcctctccacattacaggcggattctttaccg

SEQ ID NO: 64178 - DNA, 976 bp, Bovine  19866881205256
gatgtgtcaggtacgcttcagtcctctcaagcagctctttccagtggtcctcaggttcccgcccagggacactgccagcccatagctcattgggagatcaaccatgattgacaggccctgagcccaatgactgacctagtccttcctggagcatgttgtccacccctcggctctctttggcacatctactgaggaagacagagggtgaaagtcatttggggggataggactaattttcacggcagacttgtgtcagctgtgcagccccactgatgactcaggtctactccccacccttccccttcaggaagaggccctgtcataatcacagttgtgctacataaaaatagtttcagttcacagtgcatgaacactaggcctttcccctgagggaagaggaagcccatttccccacctacattcccctgacccccattcaaaagcggatccttaggggtggggtcttcacacttctccttgaatggcttgagcagcaatttcctccccggctttggggcagaaggcttttttgcagctttgcaatcaacttctcacattttctcatttgtccctcataccagagatatgggacatagcagctgaggttattgtacccattctgcaggtgtggagacccagaccaagggaggagaggtgacttgccctcctcacaccatgagctgatggtggagctgagttgtgggcacctgactcctgttaccgtgatctctctgttctggtatgtaccttctcctcagaaaatgctgtggtcacagccaaggcaaagaagaaagggggaggagagaaaggctggacagagcccagcttcgaggagcaagacattcatacaacaaacatttgtgggacttccctggtggtccagtggttaagactttgccttccaatgcagggggtaggtttctatccctagtcagggagctaagatcccacatgcctcgcagccaaaaacacaaaa

SEQ ID NO: 64179 - DNA, 3398 bp, Bovine  19866881213110
ggtgcagggggtaggatgagggtccagctttcaaaggactcttctgtgggaatccctcctccctaaacagtatgaccaggctagagatctagaatggacagaactagtacagggcaagagggggtggtgggtcattttattagatcctgtagctgaagtgaggaaggagggaaagctagccttaggtcgctggcagagggtggggcttacatgatgggcttgggggcctggccatagtatctgggaatctagaccgtggttttcttatttattaggcgagcgccagcaatctggctgcaatccgagcctgctggcctgggctgttcgtgtgccaaccaccccccacctccacccccaccaaaggaccattctttgatgtctgagcttgcttcccctgcccaccagctttgttcaccctgtttcaagaaaggctgaccctttctgactgccctcgaaggtaagggaggagcagagagtgttctctgtgaatcggagcagctccaggggcacttcctggacaggtgatgatgtgacctatggaagggcaaagacaggggtccagtaagggcctgaagaggggcaagcgaggaggaatgccaggccagaccctggactccaggcagatggaggggatggaagtgtgggcttaatccaggccagctcaccacctgattcaggcagatggaggacaattcaatgcagaggactcccagcccaccctctccatctcttccctggatcttaggctcctcaatcttcgacaccccctacacactctgcctcgcccccaccccctcctgtgaggtcacgttcggggtctttgtcttagaattcctcctgcctcctggtttctcctgccctcccttcttcctgtgtccagctctctttattgttctgtttcctcctgcctctggctccaaatgtagcaattcctgtgtccaccctctgctgctgtgcttggagggagacaccgctgcaaaagtaggtgagctcaggcctcggcacagagcaaagagatgggaagaggggagtcagagaggatgaggtgcaaagaggaccccaaaggaaggcgttcgtggcctccccagcaagtcagagtctcactggggcacaccttccccgggagaggaatctgagaatgctggcccctgcttgggccctgtctctgagcctggacactgaccacggtgggtggtgggggcagccccaggctactctctggaatgctggtgttgggttgcagtgcagatgcaagcagtgataatgggcaggaactggactttctggtctggctgctgcccccaaggccattggaatgtgaggggggactagcaagaggccccagggacttggagtgggcagatggagaccagaccacctaaatggagaggagggggcagaccaccaagagagaggaccaagttctagccttttcactgagttgcaggctacagtcaaagaagcctaaaattcctggtccatctaggaccttggaagtctgcccagccccgcagtgggatcacaggcatccagactgcatccatttggaccttgcctggtcccacctcctcgttttacagaggtgaaaactgaggccctgaggaggtatcctgcccaaggatgtgattggtcctccagcctgggcaggttggagagcccctggagtccctcgtgccgcttgccccgcccaatgcctcaccgctttctggttggggatgggggagatctttttatatctcctccagggcatactggcacatacatttccatttttctcctgatctacccccacccctgtctgtgggggtggttctgaatgtgagtgtcagccagtgggtataggctcctgacatccatggcacatctcagagagtccctgagtttccagagcaccccggattctgggctgagtagtgtgagggctacctacgtgctggctctggtggggaacctgtagtagtagcaggagtcttcctagtctaagggggctgcactgtcctaagccctgtgtatgttaatttacttaattcccacagatttccattagtaggcgttactagtcctatttcacagatgagtaaacagaacttttcactttcatgcactggagaaggaaatggcaacccactccagtattcttgcctggagaatctcagggacgggggagcctggtgggctgccatctctggggtcacacagagtcagacatgactgaagtgacttagcagcagcagcaaacagaagcccagactggttattaacttgcccaagagtacacagtaagtagagacgctgggttttaaacctggtctgcctgactcaaaattcagtggcctgagtgtccttaaagggggctagagtcccttgagaacataatcagtatttttgcctaagaaatattaatagagccatgctcctgtgagagtattgggagcaaacaacttagaaccctggccaaagtgggagccacttctgggtgtgcaagatggggctacatggtccccacccccagctgctgctggaggtctggggagaatcaggagggcagttaggctgggtgctctgctgggatgctctgcagagaaaagttgtcctacctgagaggctgggcagagtggctgatacaggttcccagcagcaggagaagtccggagggtgttgggctgtaggtgtgagaattgcttgtttcaaggaggaaagacaagttcccctcccccggggcccctcatctccctttcgctttcttgtttcccccgcataatgatgctgattgctccacatctgtcataattactctttgtttgaaaattcagaacaaatcacaggaaaggaactggtgtggcttgagtaggatccttctccctaggggttccaggggtgggggctgggtggtagggaagagacgtaatcagccttggaagatggagaagccaggctgctgattgtccttttgctgtccccttgcctgggcagggtggcctaaggcctcgtgcagttacgtggccccccacccctgaccacagtccctgcccgctgtggtagctggaagattcggctactacccatcctgggtgagtggtcgacgtgaggcccctgccctctcggctcctcccctgccctcttggccccactgagcagtgtgttggacggcaggctccatcgtcaacccagcagcactgcagggaggggcgggctgtgcctgctgggagggcacagggcgggggctttactggccatggggaggggccagttgcggctgggatccttagaacagggtgaactttgggtctctgagtgagaaccggtaatgggggtggggagggagcaccaaccagaccttcttgggatgctgcggcagccctgcgtgctctgcatttcttcaccctcactctgagcaa

SEQ ID NO: 64180 - DNA, 1837 bp, Bovine  19866881268788
tggctgtgtaagctactcagtctatggtgttttgttacagtaacctgaaccaactctgagcctcagtttcctggtgggccacatagggataccctccctgcctagagcagaggaataatctcagagatagtgtgatgaaggtgggtcatcttaaaaattgtttaaaggtcaaacttgggccagaagtcactgatgaaccactgggtttctctatgtccaaaccttccaaattagcactgctcaaggataatgaaaacacgggcctataaggcaaaagcgggagcttctctctgtgatctaaatgagccagtagaataggtttgcaggtggctgaaacttctagatggcctgcccacgagggccggcccggaggagagggaaaggaggcaaggcgcagccctgctgaccgagccctcgcgctccgcttccccagcctcctcacctggggtgggggccttctctgttttgcccttccacactgccgcatagccatcctcgtgtttgttgaacgccacgagcttcacctcgtacagccggccagggactggggaaggccatggaggggggtcactcttgtgtcccctgagagattccatctccaaccaccagcccagcttgcccagccccccgctggacctgtgtcaatcccccccaccccccgggcggccctcctcacctagctgggtcagttcatactgcttcactttcttcttgagccggacaggccccacatcccaagcctggttccccccacgccccctggagggctctcaccatccgtctcctcctcctccgctcccacctctcgccagtacagtttgtagccagagatctgggcggggtgcgggggtggctgccaggacacgaccagggactccatccttgcccgtaccttcagctctgtgggcgcaaaagggactgggggcagaggagccggaagggaggaggagtaagagaatcaaagagaaggaagaaggggaggccggggaagggaggcaggaaggagcatgaggaagcagaaagcaggaagacagcgttgagtgaggcccttgccagagttctccccatatatctcaccactcagccaccagcctaagggtcaggcccaggctgggtctagaggagaactcactattccataagcccagagtgctgggaacgcaaggacgtttcccgggggtttgcaaagaggttggccaagagcatttctggggcagggctgacaatacctgacttagaggagggctctgtaaatcttctgaaggcatgaaggcatgggcaccagcaggcaaggggatcagaggggttgctgaagccaggaaggagggatggagccaccggagtggggagacctccttggagcctgagagtgggttggctcactgtgtgtctgatgctgtcctaagcacttcatagcatgtattttaactttattctcacaaccctacaaaataacaaacctactagtgtccctgttttacagataaggaaactgaggctcagagaagtccagtaacttgcccaagatgacacagattgtatgtgtgccaggctttgtcctcatgggaggcttggtgtgctgcgattcatggggttgcaaagagtcggacacgactgagcaactgaactgaactgaaccactctactattgggcctctcaacaaaacccacaacagtcataatcacagaagcagctattatttatttattttttcccagctgtgctgtgcggcacatgggaatcttagttccccagccagggatcaaacctgtgcttcctgctgtggaagcatggcttcttaaccactggactgctagggaaggcccctgtttgcta

SEQ ID NO: 64181 - DNA, 2199 bp, Bovine  19866881274885
ggaggaagcatacgcctcaaattgagtgcactagtagctatggagagggatgtgggacagggtgagctccatcaggggcgcttatactttatcacttggattttttataacaagaatataatcaaacattacttgtataagtaaaatgaattttttaaaaagcatgaacaaatcaatgcgtgagcaactccaaagatccctctgcgtttatcccatatccatcaaagtaacctgattctgttctagcagaaagagaacatgctgagcattctagtccatttggatgtttcttggaaaaaaataataaagcatattgtggggcatcacctctggtgagtttggtccctctgacccccagttttttctctctctactcctgaacagatccccctgtgaccctgccaccacaagggtcttatacatcctggatgtcactactgccctcccagaccaaggataaaatctacacatctgggcagatcatgcccagccctgcttgccctgatcttttcctgttccccacaaaagtcacacggaagcacagacttgtccttcttggtgagatcctggtattctgcccatcctgctactcctcctggaatacctctttccttctctgagcaactccaaatcctccatgtccctggggactcagcatggcgttgtaactgttagtgctctctgattccagcccactgccaaggtgtagagtcctgctctgggcttctgcgttgtatacagggcttaccccataggataactgatcagactgttaacctctcctttattcttttaatgttgtatctttagcacctggcccacagcaggaactcagtatatatccactgacaaaactgaagaaaggttcattcccccaacactctgatagcacaaatgcacacaattaaatatttgaatttgcagaacaaacagtgggggacgtcagtctgcttgcctctttctccaacctcccattccctgtaccctgaaacccctatgcactgtggtctagatctgaagccccctccacacaaccctagcctaagctgcagtggacaaggcaggggccaggaagctgggccgttgtcccttgaccatctgggagtgaaaacaaaaagggtcacccaatactgaccacctcatcagagataattttaaacatctgttgattctaatcatgatcaacattctgtaaaaatggcttgtaatattaagagattttctaatgttgaactaatttcacatttctggtaaaaacccaacctattaataagtaattattctttttaaatattgctaattttaggatcctaatagatgatttctatatttatactcttcagtgacattggcctataatttccttgtatcattcttattagatttagtatcaagattacactatcctatttttctactctggaagaatttgtgcaagactgcaattacttagttcctcagtgattggcagaactcaccaatgaaaccggggtaggccctggagttttttctgagagaaaacctccgagcacaaactcaatgtctttaaagcctataggcttttgattttgtatttctcacagaagcaagtttggcaagttcgatttttctaggtaattccaaatatttggattacaaagataactaatatctggaaggctgaccctgaggtgaactctgcaagaaattaagtgcctcctgaatcatcagagaaataacagcttacatgtgcactggacatatgttacaatttataaaagtactggccatatattaggtcatctgaagatgaggtcccggtggctttgatgacttatgatgtctcattatttgcaaagggatagataacttcctatttagcagaatcagctgattcactaggaaatgctgtggaagcctatgaaacttgaattcctcacttcatctcttgggagtgtcaatatctagggtgttggggagtgttctgagctcctggaaacaaaccttccccaagaccaggctgggggtgttaagtgcggggctggcaccttcacgaaacacggattccacacacaacgcggcccggacgcagtgtcggggacgacggggcacactcaccagggccctcgaagcctttgcagtcgtggcgggcataggacgcgggggaagggccgcagcactgagtcgcgcttgtagctccgcagggccgaggcgaagaag

SEQ ID NO: 64182 - DNA, 1940 bp, Bovine  19866881420874
agaatgccagggatgggggagcctggtgggctgccatctgtggggtcacacagagtcgggacacgactgaaggcgacttagcagcagcagcattctgacagatgagaggtaatatctcattgtggttttgatttgcatttctttgatgattactgttgttgagcattcttttcattttctttaatctgaaatagttctctttccatttttttttttcatgacattaacatgtttggagtccaggctagttgttctgtagaatgttccacaatctggatttgtctgattttttcctctcataattagaatcagtttaaaacttttttttttttctggcaagaatactacattgtagacaacctttctcccttgtagtgagtaagctgtgggatgatactttgagatcgtatataccctggactctccggacagtttttatccaatggttctgatatcttactccttttaaaagtatcattctgcaagtctgtctcatcaatcttttctgtattaatctggttttccttccatttgagcatgaaaatagacatttgagataggaagagagagtagtaaatctgtttgaaacatcttattttctagatgagcagttaatgtttcgcccaagagcagtcatgtgcatgcatgtgtgcgctcagcttctcagtcgacccatggactgtagcccaccaggctcctctagcagtgggatgttctccaggcaagaattactggagtgggttgccatttcctcctccaggggatcatcccaacccagagactgaacccacatctcctgcactggcaggcagattctttaccactgaaccaactgggaagcccctttttttcaaagtaaccctctgaaaccctttcatacttatagcaaatctcaattcagactagcctcactttaagaactcagtagctagaagtgcattattaaaattagtttcacctgcttttttttttttaactgtttaaaaacatgccttgacatgcataaaggccaggggaaggagagagggtgaagctgcactggcctttacacacgcctaggagatgcctatcggagaaggcaccccactccagtacccttgcctggcaaatcccatggacggaggagcctggtgggctgccatctatggggtcgcacagagtcggccacgactgaagcgacttaatagcagcagcagcaagagactcctatcccttcttccgtcagccaacccctgcttgtccttcaagattcagctaagcatcacctcacctacgaagccttccttgactttctgttgagatgtccactctcagcagtgctaaatccctcagcacttaactatatcattacacaagatacagtaaagtttagtcttacttttctgtcttccccactaaggggaatttaccacagaactgataaaccttaaacctcagggtccctctgccccctacacaaaccgttccaaggcctcatgtttaattttgtagcaatggttttatattccttttcttaaagagtgtcagaccccacaaaacctggatcaactcctgttcctctgacaggctgagccgcttgtgggctgggactgtgccttatttctgactgtatccccagttcctacacaggtctctgacaaagagagttcataaatgtttgccaaataaacaaacattggagttctttagggcttaatcctaaactctctctccccctctccctctctttcagagtagcatcagctggtccttgattttaacaaccatacatttgttggtaattgacaaatttctacttccagccctgaccttgttcataagctttaagtccatttgtgcaactgcctctcagaggcatccactcggaggtgacataaaccctcaaactcattccagggtgggaacttgtctccccggaacccgctcttcccatactcgtc

SEQ ID NO: 64183 - DNA, 1182 bp, Bovine  19866881510984
ccccccagcaccctcaagactgcccccgcggccttccacggccggcgccatgcccccgctgcggagccacaagcccacagttgcggtaaggaaactgtccccttggccaaggccacagcttagcagcgagacccccacatctgggtcccctgcctggttggacactcctccctaccagctctcacctggccctgtaccatgctgtccttcctgcagccctgtgcctagagtattccctgcttcgaggtccccttccttgtttcttgctgtgtctccttctttgcttctattagggcacctgttaggataattgtaattacccagtatgcgtctcttccaatggaatatgacttctcttagggcagtgattggattgcatttgtttccagagcacccagagcacacttggcccccagggggagctcagtgaatgtctgttgaatcaatgaatgtggctcagatctagggcttcccactgttcaaggattgggtgagttcaatcaaggaatattcacagcgcagttacttcttgcaagagactggattggaagagacaaagtcaaaagcatgagacgaggagattggcaaggaagagtgagatacggcaacactgcccggtgggaggggtcaggtcctgagggggaggtgaaggctgctgcaggctggggcggcttcaggacaaaggatgtgcaccaagaactgggagcagatgtgaacgcacagtgaaaccagtaaagctggagcttctggcttagctcctcccaaggctttgagcaagtgtgctcagttgctcagtcgtccttctttgggacccccctggactgtagcccggggcctcccaggtggcgctagtggtaaagaaaacgcctgagatgtaagagacatgggttctatccctggttccggatgatcccctggaagaaggtatagcaacctgctccagtattcttgcctggagaatcccatggacagaggagcctggcgggctacagttcatagggttgcaaagagttggacacctcttagcatgcatgcgtgcacggactgtagcctgccaatctcctctgtccgtgggtttaatcccgacaggaatattggagtgggttgccatttcctcctccaggggctcttcctgacccaaggatcaaacctgagtctcctgcggctcctcaattggcagga

SEQ ID NO: 64184 - DNA, 773 bp, Bovine  19866881557711
agccccgctgacctggctctcggagaactggaacatctccatggcctcatccaccagcccctcctcgtagccctgtcgcagcagccggtcacaggcgctaaggtagctgagaaactgggcaggaaggggcacagagggaaggacagtaagagcaatgcccaggacagcaggtgtggtggaggaagcacccaagggcctcaggaggactgagctcagggccaggctgactgggcaaccaaccatacacagcatggccccagagatccatgagccagcagagagggtcagaggcctccctggggacaggtggacagcaaagcctcaccaactgtccaaggtgggggctggagtccaggaagagagctgccggggtgggtcaaggtgttcccagaacctaagtggggaacaggccaggcttcaaacacggtgtctacccaccatccacccagcctgctcaccctccttggtgagcacccacctgtgtgagggtgcctccttttccacccacctcatgcacccccaccccgcctccagacacataatatctttgcgatccaggactccacgggccccaccccagagcaatgttgcaccaaagctggaaggagaggggacagccaagcgcccacagggccgtgcacctcttccagccactccctgcttattcaccaggggctgcttttgccctcaggataaagttctgccttccaaccccacgttcaaagacctactcgctctgtcagcagcctggctgcttccctcagcaccctcag

SEQ ID NO: 64185 - DNA, 1560 bp, Bovine  19866881829486
ctccacagttaaatgagaggattagaggggccctagagctccctcctcttcctcttccaccactgctccttacactccctctgaaccctccttcctgttttcagcagagcagcagcctgtccctacaggtcttcaactgtgggggcctcatcttctacctccagttcttattaaaacctttctcttgggatgtcccaggcggtcccagtggctaggactccactctcccaaatcagggagtccaagttcaatccctggtcaggcaactagatcccacgtgcctcaactaaagaccccacatccctcaactaagactcagtgcagtcagagaagcatataaaaataaatatttttaaaaaccctttcttacacaaacagctatctcactgagaagaaggctggtacattctccactaccttgtacatgtgtatgtgtttatatgtaactgtttgtgactatgagtgtatctacgctttaatgtgtatgcgatgggcagagaggaagggagagatgatgggcgccccctcctccagggagaatggatccatttgctgatgtctctctgttttcccaacacagagacataggcttctagggcacttacccacacactccagctttgtgaacattcttcaaatatctatttgtagcgaactcagctaggtaccacctcctcctctgggaacccttcctcatagccaaggactgagataactgcccttcttctctcttcaggagccctgtgccctgtacactcctcccacaaagcgttaattgcattctattgacattgtctgtttccttgcctgccccatctctatggtgaaaaccctagaggacaaggaccgtgtccagcatcccagcacctggaaccttcagaacctgtgtatcccagtaagatattccacactcaggggccccacttctctgtgcccatctccgcagggcagagcagaccaaacccaatacacctgtggggctttccccttggggtctccaccctagggccttcctgtggcccaggcaaggcttgctctaaccctgaagatggaggcagcctggaatatagggtgtgggtgacgtgactgatcccgccccaccccagggtttccactgcagggagccttattcctttttttcctgaactttttggccctggcctgaaccttgctggcgcccatgggcttttaatattttccgttcctggctgttgtacaatatttcacctcaaaaatgcatcctcccccccgaccaaagggcgcgcctctccagtgaaaggacctggctgggtgagtggaagtgacccaccgcagtctgaagcttggaggaggcccagcccagcatgcagagatagagggggcaagaaatgtctccccacttctggggagacagggccagttcatgagccagcctgaggcctcgtggtcccactggaagcccctctggaagcctgggtgcttccagcagggtgcaggtctgaaggggacccttgtccctttcacttgccctctgaccccaggcaagtggtttcatttctctgagcccagtgtccccacctg

SEQ ID NO: 64186 - DNA, 1235 bp, Bovine  19866880339909
actggaaacaatccgagtgttcctcaagcatagaatggataaaccaaccatggtccatctgtacaatggaatactagtcagcagttcagttcagttcagtcactcagtcgtgtccaactctttgcgaccccatgaatcgcagcacgccagccctccctgtccatcaccaactcccggagttcactcaaactcatgtccatcaagtcagtgatgccatccagtcatctcatcatctgtcatccccttctcctcctgcccccaatccctcccagcatcagggtcttttccaatgagtcaactcttcacattaggtggccaaagtattggagtttcagcttcagcatcagtccttccaatgaacacccaggactgatctcctttaggatagactggtcagatctctttgcagtccaagggactctcaagagtcttctccaacaccacagttcaaaagcatcaattcttcagcactcagctttctttacagtctaactctcatatccatacatgaccactggaaaaaccatagcctcgactagacggatctttgttggcaaagtaatgtctctgcttttgaatatgctacctaggttggtcataacttttcttccaaggagtaagcgtcttttaatttcatggctgcaatcaccatctacagtgattttggagccccccaaaataaagtctgacactgtttccactgtttccccatctatttcccatgaagtgatgggaccggatgccatgatcttctttttctgaatgttgacacatgtatatgtataactaaatcactttgctgtacagctgaaattaacacattgttaatcaactatactccaacataaaaagtgctcactttgctgacatttccctagacatatatccaggctccataaatgctgtccataataaaacacaggctgtccattaacaaaccgaagtaactatgcataataagacacaagtcattactgctccattaccagggagggggcattagtggaaacacctggaacagatttgggatttttttttttttgtccctaacaagccttttcaatgaactgtatgctcacttactctcatgcttgtatagttcagataataacagctctctgtttcaggcacagatctgaggtcaatatcgcaagaagctgtttgccaataattctgctttcagaccggtgatcaggtaggagagaagatttgcaaaagcagaagagggaacagaa

SEQ ID NO: 64187 - DNA, 1380 bp, Bovine  19866880396543
catagcgactgtgtcacagtgactcttcctccctcccaagcccctccttcctggctgcttagttgccaagctctgtccattctttctccctctacttcttgaatcagtccttttctttgattcttgctgccatcatccttggtcaacggtctcattttttctctgctggacttttcctctgtcttcccatttagtttcccaataacagctcctaccagctgcaatccattttacacatgctctcagttgagtcttctgatacatgcgtctctgttcactcttggtgatgccctgttgcctactgttcacagcccaaacatggtgattctgcactgcttaccaaccaaaatccaactgatgaagggacagctttattcatagacaggaagctgtccagagactcacatgtcaccctatgaataaaggactgagacccagaaagttgctcaagcttcagtagcccatgtactagtggtaaatttcatttgtcctatttcaatgggtttctctcctctacatccgccttgtcacaattagaaagtcctttcctgtgtctatcctgaattatgcctcaagctcttgaattcagctcactttaacactattacatcttttaatagtgagtcccactctcagaaatgagatgagcacagtaaaaaaaaggaacaagggactactaagaaaaacactacagaatgaccacagcttgagtggagaagatctggaacagaacgaggagctcacgggcaactgtgactcttgtttgttcgataccctgcatctcagggccacaaatgtccacaggctattctcttgactttgagggggatttctttgccatacttatgcttcagttactgaaaacacaagtatttattatgtatcaccacaattagaccataataatactccatggtgatgggaatggcttcatggagaaatatatttgggtaaagatccttgggtatcagagcaatgcataaagatcatagaaagcaacttggagaataatgcatagaaaaattactcagttacttcacacatcttgacagcattgtcatttctggggctgaatgcaacagtggctaggaatggatattaactcttcacagtgggggaaagaggggaacacaccatatcacacacaattgtgaagattccagttctatacagcttcttgttatgtgtgaaagatggacataaaggaatctccctctccataaggcctctgacatttgtattccccttttcccagaagtagcatgtactgcagtaagagcctaggggtgaagagtaatcttttctttaaaaaaaaaaagagagggagagaaaatgaagaaaagaaacaagtaaatacagactctaaaggacaatctattg

SEQ ID NO: 64188 - DNA, 740 bp, Bovine  19866880459353
attaaaaaaaaaagtaggggggaatctagttaaaaatacggtgaaccagtgtgccctgtgaactgaattgtaactgtgtgttgcaaggaagtgctgcattgcatttcactcattattccctgcttttctctcaagcttcctgtcctgtgtcccgaaagctccagttcacttctttctcttttcttcccacaacgcactcccccccttcatttctccgccttattttttttttttatctgccaagctggatttgcacttttaaagatcagtatcaataatgccctgcttgtttcggtggcactctccctttaaaagacagccccctctaattgatgcgtctgggctagtctagactggtagtgattgaaccaaccaccaattatgttattcatttcactgaacttcactgatgggctccgtgaggaagaaggggtgttgagaaacctgcccttacactgaagcagttccctgctgaaatataaaatctcatgtgtcgttatgcactcctgattgcctgtgtgatcaatcgtatgatagcaacctcaggacatgagcaacccacttgaaaacatgtaaaaaactgaaagagtgtcttggaatagaaattgtatcactagtattaaattactatgctattatcatttaaaaatcatagaagaatcacatctagtgtgcttttattgatccccgcatatattttcatagaataagatgtagatatattttgacttccaaaagta

SEQ ID NO: 64189 - DNA, 1113 bp, Bovine  19866880480689
ttctgagaagatattatttaatgagtgcatataaattgaaatggtagcataagtgggaagtaaaggagaataaagactaaaagtaggggtgctgtcttctttccttcttttttctgagaattgaaggttttcctgaattatttctagggctttagtgagaagagaagccaggtgaaatttttttctttattttattttacccatccaaagaccagctccaaatattatactccctcagtctccctggaccatcagaattccctgctccagcttaccacagctcatgaactcaagcccattatttttctcttttattctggatcctgtgtgataatacaagacgcctattgtttgtgccatctcacagtggcgacttctggactctctgaagccctgaggtcactcagagagaaaagtaatagtaaccctggggaactcagagtagccctgctcgaaatgtttaattttcataagagagtgatgataacttaaatcagtagcaaatatatagcagagaaataggcccctggtccacatagagaggatcaataaaggttctgcttgcaagatgaagtaaatcagagagctggggtaattactgaacaatttttctccagaacctctgctcaggaggggtttaatttgagtgcttactttaaatttattgtcccctaaattcattaagtttatcagattttacttgtgcaggtccaatctcctctctcagtttctctctctctccccatccacctcttttctctcctccgatttcctgtgtgtgtgtgtgtatatatgtgtatttttctaggtggctggaaattgagtgatgatcctgtaccaatctcatccttagtataaatttcattttctaccaggactggcaatattatcaaaattgttaacaaatcagtgtgttgagttatggtcccttaaaggtgaaagacaaatagttgactatcacacattacccttagtatagttcttttggtaggatataattattttatgtttttgctggcatggctagcaccaggcatcccagtacatcacatatactctgttgcttaaacctgttgccatgacaacctcagcattctcccacagcaacaaaat

SEQ ID NO: 64190 - DNA, 1137 bp, Bovine  19866880482901
ggggtggtttggccttggcttagccagcagctgatgcacaggaggcctgttcgcaggactggcaaagtgcacgctaaagaaagaaggaggaaattttgaaaagcaaccctggggagggttcattcttatgaaaacattaaaaaaaattttttttaactgaatattctcaaaatttgatcagtcccagcccttctctccactcccaccgaattgtcccctacctcccctcgtcaaagcataaactacagagttacagtctctagatttggtgtatcgcttcctgcccccgcctccccctccccgcccagttctcggtcctctattgaaacacctcgcccaggcgagcgccctgcagctcacatttccccccctggctcggatggtgctacgggagctgcagcctgactccacttccaatgggtgagtttaaaacgctattcgtatttatactttccaagcctccaaatcctcctcctcggtcttcttctaaaaacccaatttggatggttttgcatgcggcatgttcgcccgggggaaagagatgcctccgattttctttaccgtccttagggctagttgtaaattaaagctttgaagagacgttcaatcctgactgtagaccgtggtttgcaaaacatgggcatttctaagtctattcatactattttccattttactaaactcttttgcccaaagctccaaagagttttctctgatagactggcgattgtgtgttcaggtatgtatatgcgcccacagaccctgcgtctgtgtgcctgtatctaagtggaatccagatattgtggacgagggctacttaagagagtgagggaatattctgccacctgtttgttgtcttttagtcaacaacctcgagcacaaactgcttgtcattcctgttttgctttgttttgtctcaagaaagaacaatttagcgcgcgcctctcaatccctgagaccctaacttgtgatgtttaccgtttaaatccacgggttaggctcttgggagctgcgagtcgcgcccttgcatcctggaaatttggtggaactttttttctttgaagcaaaaacaaaagaaaagaaagttggtcccgaagtgcctgagtgcacctctgaggttttcattgttagggtggg

SEQ ID NO: 64191 - DNA, 1480 bp, Bovine  19866880483105
atttaatattcactgtattcttttaatatcatgcattctagggatattgaaaaattcctaaagagagttcaggcatcctcccaaggcatgtatcacagctaccatacatcttaaaatgtattttgggaataagaatttaagtactattaaagtgtctctcccatgcctttgcataaaaacatgaaatgcgaaacatgcagtcaatgaattaaagttgactgaacacattattttttaaattgatgtaagcaaaccaatattggattgagatatattccttgaactatcgcctgtatggttgaactattgaacaagcaccccaaattattcagataaaaattctctcattgaagaaaaaaagtttaagtcagaattaattcattcagatagcatctgtggagtgccagttatgagtcagccccttttctaagcacaagagagtcaatgattaaaaagacacgcagcctactccgcttgtagtccaataagaaagagaaatgtctggataaataacgacaatgcaaagtgaaacagcaattctcatgaagtgccctgtaaatgcatagtgaggataacaactgtttagtacagggaagtcagcaaacgtatcctcaaaagcgttaatgcttgagcctggtcttaaagatggatgggagaatagaaagtttatcagtcagagaaattagaagaaaaacacgtcagggacaaggcatacgaacaaagacatgctgaaatcatgaaaaagcatgcatgtatgcatgctaagtcgctccagtgtgtctgctagtctcctctgtccatgggattccccaggcaagaataccggagtgggttgccatgccctcctccaggggatctttcccacgcaggaatggagaactctggtctcctgcattacaggcagattctttaccgctgagccaccagggaagcccgtgaaaaagcataagcacttttaattggtgcatgatttgtgtagttggattttagaattcacttagtgaaaagaagtaacagatgaggttggggtgatagggtggggccaaataacagagggacctgaatgctttattagggcacttggactgtgttcttgaaagcactgaggaaccagtaggtcttaatagaccaagtgatctgaattagatttataatttgtcccagtgagatgtccatatgaaccaaccttcaaataattactcaggtctggcaatctatatatctcaaaataattgtcagttgcatttttcttttcttgcatttagtggtttggcattgcatgtgccaaccatgcagatgaccaactgaaaggtttagtttatatccagatgtcttcagtgttgtatagacaatcacaaacattgaaagaaaaaatattccgtgagggtgaaagtccctgtaccatgcttcccaaataaatctttgtggagggtatcactaatagcagttccactctgtctaaacacagttattaagatca

SEQ ID NO: 64192 - DNA, 1464 bp, Bovine  19866880599601
ggagcacattctaggacccttgtgccaaggtaaatgatctgaatctcctcaaccctttcgacccattaaacagatgctacacaaataacaaaagatggaaaaattgtaaatgactaatatccattttattttacttgtgttaatggccacccactccagtactcttgcctggaaaatcccatggacagaggagcttggtgggctgcagtccatggggttgcaaagagttggacacgactgagtgacttcactttcacttttccttttcatgcattggagaaggaaatggcaatccactccagcgttcttgcctggagaatcccagggatggcggagcctggtgggctgccatctatggggttgcacagagtcggacatgactgaagtgacttagcagcagcaaagattaactttccgatttgtaaagaaaactaggattgactgagcaagcacagcgcacatcccctgcgccaggtaaaggatgcacatgctatctcactgacgtttcacaatgaccttttgaggcacgacccgcctatctagcagctgatggaactgaaggttacagagatggtatatgcctagaggcaggacctgtgggttgcactgggggttccagccaaaattcttaagactttcaaaatcagtactctttcctctatgctcttccttggttctctttaatgatttatgtccctgccacactctgggtcatcattctaaactctggaagtcatagttcaacagagtagaaatatgtattattaagctgaaaaaaaaatttactgaaataaatatacatccaagaagcaaatgctttgctaaactcctaaactctgtggcttaactcctttgtctctttcatctcatattgaaatatataagaatcattccaattacttgaggcattgggtgagttgattccagatttccagagacttaacgagaagtttttcaagtctgaaggatctttcgtggataatggctatttgggaaaggagatcagatgagcagatgtaatgctttcacagctgtcccacccacggggaacacggggtgaaatggaagtgcaggaacctgggggtcatgcacacctgagtgagaaccgtggcttcacccctggggaaagctgagcaaacctcttcccttctctgcacttcagttttcatctttaaaatcagaatgatgccatcaagctcaaagtggtattgtaagaaccaactgagatgatctgtgcagaagggctggcagcagacgtacccactccaactagaaactaaacttcctgacaaacttttagaaatgaaaagctcagtttccttctcaatcccttcttttgtccctcaattccttctgatatggctgcttattgacatcgttgcttattatgattgaataagctgggttaaggggaacctccctggtggtccagtggttaagactctgtgctgcctctgcaggggg

SEQ ID NO: 64193 - DNA, 900 bp, Bovine  19866880616575
ttatgtattggtggtatatgacctggggaagagaaggaaatgtccccgttcttatataaatgtatgcgtgctcaaattccaaaacgctcatggagggagtaaactacttgataaatacaattaactcattactgaccgggggatttttgcaaaacgaatgcctgtgaccggcagtttttattttggccagccaaagattaattctggttatttctttgtgagttactacaattaacaggtatacctgacacacctgtaaagcccaaaggagcttttcggccaacccggcgtgtatgatacacacggtgattttcaccatgctagcatagggtgcggataactcaaactgggcacctaagccacccattggaatttgggatggataataagatccctcctctttaaacttattttccttttttggttaagttcaagctaccatgaaaagaaggttggccacctgttgatggggggcaggtgacccaagaatgtcagaagctgggctggtttcagcactgattcttgtgcctggctggttctgctgctgccgtttctagctgggccttgtgatgtagggatgggggtcagtagtgggaggtgggggtcacgcagaagtgccccagaactcaccaaagactgactgtcttgcctttaggggaggacgacgaagatgctccgatgataactggattttccgacgacgtccccatggtgatagcctgaaagagctttcctcactagaaaccaaatgttgtaaatattttatttgataaagatagttgatggtttattttaaaagatgcactttgagttgcaatatgttatttttatatgggccaaaaacaaaacaaaaaaacaaaaaaaaggaaagaaaggaagaataaactttgtcgtaatcaa

SEQ ID NO: 64194 - DNA, 980 bp, Bovine  19866880640376
attgctaaatgcatttcagacagaaggatggagttcaccccaccgcaaagcctgaggcactgcaggagcaaaaatgcctcaacgcgaggtggtgatgggctagtcgctcagtggtgtccaactctttgagaccccgtggaccacagcccgccaggctcctctgtctgtggaattctccagaaaagaatactggagtgggttgccatgccctcctccagggaatcttcccaacccagggatcgaacctgtgtatcctgcattgcagaggttgattttttattgtccgagccaccagagaagcccaccaacacaaggactaaagcaaaaaaaacaaaatgaaaaccccagtctcgaccagcatctccctgagaggggcaaggtgagctggaagccgtatcagaggtgggacaggcctcctctggagctccaacagtgagcaagaatcttggcatgttcagactgaggcaaagctcgaagaggttctgccctcggcatgcccagcggggtggaggatgagccaggggtcctggggggccacactcaccactgcaggcatgctcatcactctcgtccgagcagtccaggaagccgtcgcagcgctcagagagcatgatgcaggcctcaccgtcctggcactggaactccagggccgtgcaggtcagcgtgctgtgcgtggctgcaacacgtgagggtccacagtcacaaaagcgttcccaggttctgggaaagggaactcatcaactagcgctccccgccccatgcaaatatgcacacgatgcgccatgactctacccatacgcaaaggaagccaaacagaccactaaaccagggtggtgatccagcagcagagagtctactaacaacgggtctttatagccttctggggaacttgtgaagcacagagatttgctccaaatactgaggcagaaacacagcactgggcacgtgcaggatttacaagctcctcagtattcctcaga

SEQ ID NO: 64195 - DNA, 3114 bp, Bovine  19866880736415
tgactcttgtgactccatggaccgtagccctgccaggctcctctgtccatgggattctctaggcaagaatactggagtgggttgtcatttccttctttagatctttgcattgtggtattaattgtatcactttaaaaacatactgatacatctccagacaataacatttgggtaacaaaagacatattaatacatttctggtcaataatgtgatatctccctgaccttaaatttctccatcagcaaattgtcttttttccctctctccctttcttccttaattttcctttctttcctttaattcctatctgctgcaaatctccatgccctagtagagaacagaaaaaaacaaatgaaacactaaaataaccacacaagactgttgtaattaaatgacctgatatcaaggaataagctctatatgcatctgtaaagcactctgtaaaattatgatattgtaatgggagaatgacattcttgggaagactggataacacagaggttaggaacctgaaccttggcacagagaaaacaagagtttcaatcctacatgctgtgtgatcatggacacagtaaattttccaagttgaaatttcctcatctataaaatacaacatgctaataaaattatataaatcaaagagctgttgtgaagattccctgagtgagactatatatataaaatattaggcacgaatgcctagcatatcataaatgctagatagctataggacttccctggtggtccagtggttaagacttcaccttccaatacagaaaatacaggctggatccctggtcgggatcccacatgcctcctggccataaaaccagaagcaatattgtaacaaattcaataaagactttaaaaatggtccacatcaaaacaatctttaaaaaattaaagaaggttagctgttattattattgttaaggaaggcaaagtagcttgcactattatcatttcatttttattgtttaacagtaataaggcaaaggaagcaaaggtcagtgggggttgaaggagtcaagacttctgaggtgtgtcaatttcctctgaagaaaggcattcttgaaagtagaggcgttaactgtgccccagtagagttaatggtgaaagttcaagctcttgagcatccttttctgactgtgagctgtgtgaaggcaggaattacattgtattcatctttgtaccccatatcttaattacttgtgcttagtacagcagagaaccagacaaacgaaatgaatttgtttatattgccttgaattcaaccttgcaaaggaaaaagccatgagtctgctttcctgagagtttttaaggtcttgctggagttaagttgggagcatacaaccaaggaaagggcccaagggcttggaattccagctcaaatcccctgttccaccacaagctgcctctggatttcagaggccctccattactgactaggtggccttaggtcccttgaagctggagttaaagataacccgtatgcaatatttggataagtgccttaataatgtggactctaaagatcatgaggcaataagaatgttccatttagcttatttttgctgtgtgcttatcagagcttggagcacatggtccaggacattcagatggctggggttaaaatgattaaagggtgtggggtctgcatttggcttaatgctgctaagaaattccttggctaaaaaaaaaaaataataataataatctttcttttcttctttttatacatttgtataagttgatcgaaaaaaaattctttgcagttcaagatggagttttctttttcctttcctctctgtctcgggggccttatctgattttaatcagcactggcttgatatgatttgaaacagctgaggctgaaatgcccttaaaaaaatatctgaagttagaactcttggaactccctacctcttctactccccttgtagcagtatgtgctattaagtgtaaaatattggggattatgaatttacccttaaaacttttcagtgccctgcagagttttctcagcaatttgaaagtcctgttaaccataatatagccagttcttgattattcacaaaaaaggaaatgaatagtggcacagataatccaaaacagaaaaacaatcaaaatgtttcttatattttactttggaatgctttgtatggcttttgggggttcagattttccttcccagggatgttgcactcaggaaaaagttaaaatgagtttgcattccctaagcccacactaaatagctgaagggggatgtggcccagccacatgctgggtggcagggagaaggagcctgaaatcgaggggaaagaattccactgataacctagaagtggaaaatgcccatatgaataattaagtgctgactggaatataattcagtcttgtaaattagtgtggacaattttccaccctacatttttgaaaaaatcaggttattctcttcagtggagttacactggtagttaaaacaaatgacctcagcgctctttattgctcccagtccattggtgctggcactgtgtggaatcaggacctattgctaatgctgtggggagttagtcctcagctaatgcacaccagccccatcctacaccatcttcaaatgaacatatataggtttataaaatgcctatactaaatatcatatcatccactaggatagatatcattattggttttgttttacagataagaagactaaggctcggacaggtccattactgatttaagataacaaagttagttactgggagagactaaatttgagcccatgtctctcttacctagtttaggataaggaagggaaagaaatagaaatgattttaaaaaggaggtttagtgcatgaatgaatggaagttagtgggtaactatggtggaatgtgggggatgttacttcaggaccaggtacaaatgccatggagataggttttaatgatcaaacagcacttttttgagagctctgaaatggacaggatgggattctcagtggctgaaataactttggcaggaatatacgggttagaaaacaccagacatgttcacagaacaatgagttggtctgaaaaaagaatttgctcaaggtgaagagatgttaaag

SEQ ID NO: 64196 - DNA, 3084 bp, Bovine  19866880758658
atgcttttgaactgtggtgttggagaagactcttgagagtctcttggactgcagggagatcaaatcagtcaatcctaaaggaaatcagtcctgaatattcattggaaggactgatgctgaagctgtagctccaatactttgaccacctgatatgaagagctgactcattggaaaagaccctgatgctgggaaagattgaaggcaggaggagtagggaacgacagaggatgagatggttggatggcatcactaactctatggacatgagtttgaacaagctctgggagttggtgatggacagggaggcccggcgtgctgcagtccatggggttgcaaagagtcggacatgactgaccgactgaactgaagtgaactgagtgagctgtaggctgcttccaaatcatagccccacagagactaatgctaaataatgatactctggatgccataatgccatttcaccaccatgatcacacagataatggagacaatactgattgcacatacttttctttttttaatcactgtgcagcacacgggatcttatgtccctaaccagggctcaaatccatgccccctgcaatggaagcatgcagtcgtaaccactggacctccagggaagcccctgtgtatacattttgagaactcaaaataatagagggtaaattctttcctgtaccatgcttttgagtttacaaaacacttcaccacccattgttacctgaggtccacatgacaacctggtgagttaggattgatattaacatatccattctacccttgcagaaattgatcatgagagtttaaactctctggccacgcagcacataatttaatttgtggaaacgggactcaaaattcagtctttttgaatcaccctaggtcagtctgcaaaaaggaaaagagtagaaataaaaattgctccaggcgagagaaacagcaaaatatatcacacaatgttgatgtggaagcaagtatgatcttcttctgagcatttcttactttttgccttactcatcccttctcaaatcctgagtcctgagataaaggttacctcagagatggcaggaatatagtttgctgactacaaagaaaatgtacacatttcttttcaaagtcctgatcttttcaaaccaaagtaacatcagttattgcagggatgttcacagtaatatttaattcctacacattggatgtgaaagtgttttagtcacccagtcatgtccaactccttgagaccccatggactgtagcccaccaggctcctctgtcccagggactctccaggcaagaattctgaagtgggttgcctttcccttctccaggggatcttcctgacccagggattgaacccaggtcttctgcattgcaggcggattctttaccgtctgagccaccaggggggcacttttatttatccacaagatgatcccttctttcatgacagacactcaggatataaatcttttccacaataccgtcatgctttgtttctaaaaatcaaataactctttaaggaggctctgaggctctgttaagactctgaggtggcacacagatagtttatctggctacagggaagatgaaatgggctactcttctcccagagttagacagttccagttagagtaggtccaggttgtgaaagaccctccaatccaccaaccccaccatcctgctctcctactaacatcccagaagcccctccatacatcacaccaggaaaacagagtgggtcgcagagtgcccggtatgtataagcatgaactccactagccagcctcacaaataactgctattctaatgctcagcccagagtacactataatggtcggtgatacataaagtggtaatgatgacttgttttatttcactccctgtaaaggatgacaaagaatctgtacatgagttggggtgggactggagactgctatatgggaagaagggagaaaatattcaccagtgatttttgccctgcttcttaaggcttttttacacttcagatggactgaccttaggtataaaacatatgagtggaagcttagaagggtacatgtttggtttaactcaaattcattccatcaatacctttctaagaggaggggcaaattttgactcatgtgcctcttactctccagcttctgcttttcagggggtggtcttggtataaaaaagtgaccccacatttctggggtgttgtgtactgcaacctgaatctggagccagaaaccctagactctgcatttgctgtttattacccatgtgatcttagctgggctaataagccagcatttctacaactatgaaaataataattgttatggaaatgaaataaagtatattaaaaaaattttgaaaactttaaaacacccttcacgtgtagcacatccactcacttcacaaacgtgtctccatctaggtgaaagtaataaataaccaacatccttccttgtataagtttataactagaatttctaagaagatataagctattttcatgaggaagaaaaaaatgaagtgggcattcaaacagttatctaggaaaatcagaccatggaaagggtaactcagtctgttctaggcacggaggggaaggaagctttatgttaacgtggttcgatttaatattgcgcacatcagtcactgtaatcacggtgccaggactgacacaggaatgccctgctgttgaaaatctcataaagaagagaacaggacttcaccagtcgccccccaaccacccgcccagaagagttttccatcatttcgttaaaagagaaaaaaaaaaaaacctaccacatcctgctcaatagggtgactggctcctgaacaggcaagagattatttccaaacacattctttccttgcttttccatccccatggggccctgctatcattcccggcctcctgaaaccccgtggctgcagcctccatcttactgagcagattttcaagcaaaggtctccttgttgctgtgcctgccttccggagctgccggcctgcctgtcggggggtccagggctgaatttatttcccacatgggggacgcgctgctctctcgccaccctccctctttcccctcaagc

SEQ ID NO: 64197 - DNA, 1736 bp, Bovine  19866880886540
ctgtgagaatattatactaagtggaagtcatgctccgaagcttccctgttacatggttccatatgtacgaaatgtccagaatgggtgaatctgcagaagcaaaagcagattggtggttgccaggggctgagaggtaacagagtggtatgagattttctttggagatgataacaatgttttagaatgagatagaggtgatggttacacagtacagtgaatgtaccaaatatcactgaatttaaaatggttaattttatgtgcagtttttaaaaatactatggaagaagaaagccacctaaataaattgactgtctaggaagacttcctgaccataatttatgtactcttggtcgtttgctgagtctgtgaagacagtctgttttatttccttacaattttttttttttttttttgccttttgtagtcccatcttaagaccttggttttctgtccctccatgaagattcagtttctgtttgagtcacttctttcattcacttcctgactcactcattcacctgctgtccaggagaatgacaattaataggtgatctgggacagatgacagctggccctgctttgtaaccttggcaagcgtcttaacttctctggtcttagggagatatcaacgagatctttgcttgggattctttcagttttaaatttctagatttaagaaataaggaatgcattattagggttactttaaatagtctgtcagctaaattctccgattcctttactttgaattcatttatcaatctagctagacagacagaaaaaaaataaattacagttagaatgagcctcctctttttccttagacctcagtaacgaggagaatattcatctccatgtctggggtaaaacttctttgaccacgggaaacctttcttcatggtttttttttttttttttttaagattaaaaatgcctaaggcatgaaactgatctacttttcttaaggtttgaaaagcatcaaaaaagatttttttctctttaattataatatattacagaaaacagacactgcaataacttaatagcccatcaaaacactatcttcaagggtcatttaatatttccatgataaattgctatttttagaagcttatgtaaccaaacaaagaatgtgttcttggctatggccatgaagacaagttattatcgtgggagggacaaaggaatctgagaggctcatgagagacggagccaactgcagggaatagtttatagagtgccctttcttctgggtctccagtttctgcaatcaggataactcagtgcctctcagagccattttcattttttgaagtgctctttcaccattagctaataaatactcaccaatgaattttcctccgcatcttggaagttgggggaaaaagaaaatcgctatcttgtaagtattattccccatggggtctcccttctcatgctcctaatggaaataagaaataaattatacctactctaatgaaagggccaaagaccaccattctttccatagagagcacctggaaatttgcatcagattttaatgatcttcagtaactacctcactgtcatagcagagggaatgtctgtctcccattatcatgctctattttcatgaggacagttgagtggaaagatgctttggggggtcttctcagggagctgtgtgtatagagttgagctaagggaaggtggggtctgagcatgggtttccagggacttcatatctccaatttcta

SEQ ID NO: 64198 - DNA, 1560 bp, Bovine  19866880908880
agggattacaagtagatgtgatggaggtcattagtatagggaatcaaaatttgttgaacatctactatgcgctggtgaaaatgttagtcactcgtcatgggagactctgcaaccccatggactgtagcctgccaggctcccctgtgcatggaattcttcaggaaagaatactggcaggggtagccattcctttctccattggatcttccccacccaggaatcgaacccaggtttccctcaatgctggcagattcttattgcagggaatcctccaaatgctggaagtatataaattaaacacataaataatttaatcctcacaataatcctataaagtgggacttccctggtaatccagtggttaagtatctgctttccaacgcatgggacacagatttgatccctgatcagggaactaagatcccatatgccatagggcaactaaacccatacaccacaatcagagaaaagcccacaggttgcaacaaaagatcccacttgctgcaaccaagatttgatggagccaaatatttttttttaaaattctacaaggatttacccccattttacaaataaggattctgagacataactggccctctagagtcaaatcttagaaatatagaggagtaatttgaatccagatctttctgaatccccaaatccttgcttcttttctgctttgttgctgtattcagttggtcagtcacgtccgaatctttgtgacctgcagcacaccaggcttccctgtccttcactatctcccaaacccatgtccattgagtcgatgatgccatccaaccatttcattctgagtgtgtaccttttatatggtggctatgcatagtggggcacatacattctcagtggtacccttgtagggggaggattggacccagtgtaaaattcaaagtcttgggaccagtttcaataatcagggccaagtagtgcttattcacaacaacatctaatggaatacaagggtcaaatcatgtgaaaatgccaatacttgaccatttttcatctctaaaaatggaaacttcattcaacctaataaaagtaggatcatcagtgctaaccacacttaatatttctcacacataggactgaaataaaaatctggctattaaaatggaaagagaaaaggtcattcactttggttcccaaagttgtgtatctacggctctaggccacttggatggggtcacccagctctagacttgcaacatctgcagaatcaagcctctaccgtgagaaagaaggggagaagtgacctccaagcccactcatcacatcatcggctgtgagatacgtggtatagttcctctgcaactaaaatcacctggcttgctttccagccccgtgtccctctaggcttcacagaaggctagtgacccaatgttacaggctgaactgtgtccttcaaggagatgtgtcctgacactgcagaacatgactttatttggaaagaggctcgttgcagcttcaattagttaagatgaaatcagactggagtaaagggggcctttcatccagcaggcggtgtccttcagaagagag

SEQ ID NO: 64199 - DNA, 1578 bp, Bovine  19866880916414
cagagcatcacactacccatactgggtattgatttatcttgtcctgagcaaactcagggaggtagtgaagaacagggaagcctggcatgctgcagttcatggggttacaaagagtcagacacgactgagcaactaaacaactccaatagagaagtacccaactgagatacttccgaggacacaagactacacaacaggagaataaccgcataaaaactgtccagtctcctgatacctgttgttgaggctttgaagtattctgagatttacatttaattccatttttgtcctgcttagagtttgacttcgttattcccctgctctaatcagatctacaatatccaaatggaagttcaaagttagccatttttgataaatcgggggaaaaaagtgaagtattatcatgtttccaagctttactcttttctcagctagcagggccagctgagccacaaagtggatttggcttaatgagcccattaaaaaatttatgtctggatggtcttggtgtttgtctcaaatgggtgaagatagaaatgtaggcggagctttgcagataaacagggctggtatattgccaaaaatagacatacttactcaaacctccctaatgaaatcgaaagacagacatgttatacatttatgcaatttaattcaacacataagccatttaacccgtatttcttgggtgccgagtgtgtgttaattttggaaaatgagagttaagtaagacttactttaaggcgctcacagtctaagttaaagacacaaaaacaaacataatttcctatccatgtagtttatgcctgagatacaggtatgccagcatcttttgggaacatgaagggtgacatttttcttcattaagattaccattaacaagcactacacacacacacacatacacacacacacacacacacacacatatacacacacacaaatgtatatatatggtacccagtagaaatagactaagaattatgggagctgccttgttccttcccaattcttcattgccaaggctgcaatgattaatcttgagaaaagctacagtttagcacctgttgaaccatattagaggaaatcatctgtgttgcaaatagagaatatgctagggaggctggactcaaatggctccaggttttgatatctttctccttctgttttagcagacaaataatctgttgcaactttgctgcttctcttccctcgcttggctcttttcccatgcaccattttgttctaggggatgcctaaactgattctgcagcgttagccaaaacaaacgaggagcttggctctgggtctggtcgcagcagctgctatgattgaagttctctgcacctaaagacagtggggcagctttccgtttgacagatgaacacattttcattactagagaaacaggaaacatggcatactgggcagaaagggagaaaaagggaaaaaagagaaatatttgggaagtcgctttgttctttcttctatcaattgtggttattggttcagttgagatgttggtgaaggaggttgaccgagtgggagcctcatacccaagcgtcaggcttctcttcc

SEQ ID NO: 64200 - DNA, 795 bp, Bovine  19866880955748
ttaaggaattctagatttctgggcctgctttctttgtgattttagatgcatcttttatgctctttggaccggaggttttccacttaggaaactgggcagttcatttagaatgataaaatcaggccctttcacaacttacagggctctttagatatcagtgcagatgatgacatcaaggtccctacagtgtctggagcaggtctaggacccagtgccccgagcacccacggcctgttcttgtccagcagaatctggaggactgagaagattaagtagccaggtggactggagaaagcctaggctttggacttggacagccctggtgctatgacttcattatctttgttactctcggtgaccttctgagagtcctaaacctcgttctcatctataaatgggggggtagtcctgacctcacaggttgctgtgaaagtgactgagtttttaacgtgtacatctgtgcttgtgtgacactggtgaaccccgaggcttgagctaatgccccttcaggagactgccttctgcctttagggtagtcccccgtcatacctgttagaacacgccagctttgtagtcagctgctgagggtgatggggctgcggaggtgaaggaggccttgaccatgtttctctcctgtttcgttggcagccatctatcacacctgtgaggcctccaacttccagtgccgaaacgggcactgcatcccccagcgctgggcgtgtgatggtgacatggattgccaagacggctctgacgaggatccactcaactgggtaagtgtagggcttggcccca

SEQ ID NO: 64201 - DNA, 1556 bp, Bovine  19866880986738
attctgtttcttattaataaagcagttaacaatcagtggttactccccagcattaaatgcagaatatttgccaccaccataattaaaactctggttggtatctacattagctagttgatctcaatgttagtcactcagagctctttgcaaacttacaattagttgggagggagataaaatgacaggatttatttgttattgatataactttagggtccacacagaggctgaatgctctttagtcaggaacactttatggaagcacattggaaagttagagtcagtgactttgaataccacttctaactgggaagttgtatgattggatgacttcacaagaaaatcaccaatatgggcatcactgcaacatcctatccctgctggaaaggcctcttgttcattatatagaagaaactgttaaaaatggacaatgatactctcactcaaacaccctgtagtgctccttgatgatgtctgggcccccaagggactgattctgccatgaggctaaactcccctggccccagctcatcactcagacacatttgtctgcagtgggtcttagcttgtgtccttttctggccaaagtcaatgtggatgttttagagctcagcattatcttagagatttgaggtcacctatcccatcaacagtcaaacagagaacataaaacttcatttaaaagattaaattgtttaatcagtacatcaccaatgttacaaatataagttaaaagagttaggaggcatttgtcttttttgagatctaggacttaagttcaagcactgaacatgaaaatattcaaatccagaagaaaaaaaaaagaagagggtgaaaggaaaaccagcacttagagaaaaagtggagtggaaaggctacatcatgattaaaatttccattatgcaactaatcaagtgtgggctatatcagaggcaaccggaataaaaactagaaacactcacatgtacccttagaatccaagacctctagaaaaatgttatccatttatagacttacagaaacacaggctcaggctaccgagtgaccattttatgatttttagagaagcagaaaataaagtgattatcttaggggagcttatatttattactttttggtctatgacttttaatattttattaaaatactattttagagtgaaggagcaacaaaaccatgaccagaacttaagggccaagttctgaaaaccaagttaaactatgaaattctctttttttccttaaaaagctttcaaagagagaaaactagtttgttaaatggcaaaatatataaaaatgtacagtattcatagagaggggttttgatccaattatctaaacaactgcctccatttctcctgcctgtttatgcatttaaattcatgctctgtcaattattacttttgttgtctcccaaaccaatctccaaatacttgaatgcttttcttttatccatcttaatcgcttgccatgtctaccatggttggcaagcatctcaaagaatcactgaaatgcttgaaatcacacaaacccaacttcgcttttccttaggtaaga

SEQ ID NO: 64202 - DNA, 1438 bp, Bovine  19866881084710
ttgagatgtgtctctaggcgccttttggcttgcctgccctgttaacatggctgtttttctttctgcctctcaaagaacagactccttaaagattttccaagatgatgtaaaaaaccatattttaaaaatctgaatgctatctgaatcagcttcatgtgcatctgatataacctttcttccagactagcctggctgtgttgatcatttgtttactgatatctttccctttttccacaaaggactggaagggttggaggaaggcaggtggtgctgaaatgagaggtatctaatgtgttttctgttcttgggggaatttgagaaagcagtaagccaacttataaaggaaaagcactattttggcaatctagacagaagagaatcctccattgcaggactggttgttgcattgattttataaattagttcttcctcttgttgatgctctaggatcgcacagtgtcctggcaaatgtgtattcacattagagcgagacagtcctctgagtcctggcaggcaggacaaacagccaacaagcgacaaggctggatttcctggggtctgggctactgcagcttcctgaacgaatgaaaaaaatgcaggtgacactcccctgcccccaggccaagcaggtcacagggcaattgcccagttgcccgctgggagaggcccaccctgttcctttccctccaggttcatttttcatgttgattgagtcatgatggctcagtgccacaaaacatctgaggatgtgccttgtagggaaaaggtcagaaaggacaccaaggatctccccttccctaaaatgcagggctcgctcgcatgcggtctgttgtaaaggatgggctggcagcgctggttggggggctctgtctctctctgcgagtggcaggagcaaaccctccatcttgctagcttcagggttgcctggctgtgttatttcaactgaggcagcacagcttgctttagctttgaagtgtgaaaaccaaatacaggttggcaaaggggagagaaggaagccatgtagccttcttggagcatgacggcacacactcagccctgtgcaccgaacacagaaacttttcccatccccttagcaatcccttgtcccgtggccttctcctgagaattgtgatgaacacagcagcaggcctggttggttgccccttcctggagctcttttctcgtggctggtgggcagatgctgtgaatttctctcatttgggaagggtccagcatatgcccccttccaactctctggtgtgtgtcttcctaatgtcgtgacagtgaggccagaacgcacacacaggcacacacacacacacacacacaggcacacagacctgactgtggtgtgtcctagcaccctgagcaatgatttaagctatttattttctcccctttcgcggtcctagagaagattttcgaatttctaatacag

SEQ ID NO: 64203 - DNA, 1091 bp, Bovine  19866881095205
catatctgaggaggttgatatttctcctggcagtcttgattccagcttatgattcatccagcccagcatttcacatgacgtactctgtatatgaattaaataagcagggtgacaatatacaaccttgacatactctttcccaattttgaaccagtctgttgttttatgtctggtcataaattgcctcttgagctgcatacaggtttcccaggaggcaggtaaagtggtctagtattcccatatctttgggaatgtacaccatgaaactctgaagccattcatttttcgtctgaaaaagacttggaaatgaacactttcagaatcattacatttctcccaatagagaggacactcccccacctccccccgggcccccaccacccagacccacatgttgcatgtgtgccgggtcgctcagttgcaactctttgtgaccatatggactgtagcccaccaggctcctctgtccaagggattctccaggaaagaatactggagtgggttgccattttctcctccaggggatcttcccgacccagggattgaatccatgtctcctggattgcagccagatgctttaccattagcgccaatgaaacacccgtacgctttctgtctatgcatatgcataccacgtagactcacttctgttcactttttggtcctctgatctttgttatctaggttagaagaagtagttagggaaagtgaattgaaagttgtatgttacaggttgtaggccttaaaagatggcatatcatcggagaaatatatcctttcttctgagatgcctgtagtattattggtgtggggggcaagtcccccttctcctttccaactctacctctttaagtttcatccattatctcatttattgaaatgaacttcatttgggaatgagaaagttttggcatagctaggagcttttaatggaaatatgagagaagacatctctgacatatataatatgttcaatatgtttccatatattgcacaatctctgatgtgttacccaagattcataatgacagatgggctgagtagaagcaggagcactccccaagtgggaatgtctttagaaaccagcactc

SEQ ID NO: 64204 - DNA, 1081 bp, Bovine  19866881137553
aattagaattattgggtgggatgctaaaaatctgttagtcgctcagttgtgtccaactctttgtgaccccttggactatagtccatcaggctcctctatccatggaattctccaggcaacaatactggagtggatattcattcccttctccaggggatcttcctgatccagggatcaaacctgggtctcttgcattgcaggcagattctttaccctctgaaccaccaggtgggtcatatcttagaaatctaagaactcatctaattctggaatcatcccactcatgtcctttggagttccatcctgtgtctgagtaattctgcacttataaaaccctttccttaattggtactttgtgcagatgactcttaattttaaatgatttctctctatatctacccaatattcatctgtgtttcttccattgtacctttttcaagatacaatatacataatacactgaatccttttatccaacatcattctgggagttttaggacctgattcttgagatcgcttggatgtttttctctagatgaaagcttcttggatccttttactgtttttcatatcccttcactttcctggttgttttcttcctctgaaaatctttctctttgtgtctctatcccttaagtatattgattagaatgagtggatggatctcatcatgatcagaccttgaaaagtccacaatagagtgaacatttccttccatgagctcattccctctgtagtcaacacttgtgattttcctgtacttatcacatcaaagtgtcatgtttgtagttatttttttactggaaaattcccttctcattattttcaagttcttacagactgttgagtgaaagagcctgcctcagaccacatttaaaatcttacctcaagtacaggccatacagttcatggatacataaaccccaaatgaaaataaggaagaaaagggactctgtacatcattcagaagcaaaatgaaacatcaatgctttatgtgagtgtaagtgaaagttgacaggaaattcagggtagggttagggaagggccaaaaagccttatggtttatttttccaccttccag

SEQ ID NO: 64205 - DNA, 1795 bp, Bovine  19866881228533
gttttcagaaatatatgtatcctatacctgttaggtattaggaatagtattaggtatagtatttctaggtatactatacctaggaaaagaaccaacattttcagtgtatccaaagggtttagtgctgaaagagaaacgtttcggtgtaaatcccttttagtgtacctaattcagtatgcatcttcattgtgctaacataatgaagaggttgacaataaaggccttagttaatttaaaatccacctgcaaagtatatttcattcataaaaacttttgtagaataaaagaagcattaatacagctcttcccaaatatccttatctgtaaaatgagtgtgttggattagttggtctctaaaatcttttccagcggggaattttggtaaacgattcttatagaggtgtaagaacaacttcaggacatttgtaccaacagctgccctttaaagttatatttgatcccacctccaggtgctgtatttactaacatattttgccttgatgctaaaactgtaaagactgaagttcattttcaggaagggcagggatggaaaagaggaacagccgaagaacgaaaaaagctacccagtgggagaaggaaattcttgatctgagacctaagcccatttccttcaacattaacatagaagaagcccagacaagcacctgcctttctattttaagaccagaaggactattctttagtctttctgccttcattaattgctcgtagtatcctttggtttgttttttttttcccccattgggttgacatcttcgagtttcatatattccccttttcacttgatttttgaatcatgttactatccccttcaaaagcctacagtagttatattaacatgccaccctcccccaattaaaccttaacacattcaaagcctcctgaaaattgccccacccactgtttcaaaccactcggaatgtataacctcttctcgaattaagcgagcctgctcttatcaggtccatgaatattctctcacccaagcttttcttctctgcacactctgcctctcacctcttgtacatttcagaaatctttcttttctttctcactctccctcctttctccttcattctttctctgcctttcccttccttcctccctgtctgccttttgtggttcctttcattctttctttcagtgggtaccatgtgtcctgctctgagctaggcactagaaatacaaagacacacacaaggaattaacattgactcctagccgttctctgttcactcctgcgttgcagaagtgtgctgtacccacagttattttattttgcatttagtctttagatttagttgaatgtgtccttaatgtcctgtgttcttttgttgttttcctccgtgtcttatttcagtaagttgcctgttggataaaacctgaagcttttcttacggagtgctttctccccaggcaaggagcatggcgctctctcacacactcccgaacaatgctgttgcttgactgattcccaaacaaggtgaacagtgagaaagctccatttttctcgtgatgcagcatttcactcatagttggaaatagcctggccctcaaagtatcgtaacattcctttatttgtagcaaagagtcaatgtgataaccttctgtgacgtgttctgttatttttttagtcgtctccgtgttcctttcagctggtcctatagtcccccttcctcaggaatgtcttcccagtgaaacaacacagactgcagaaacctgtcccgatggatgctaaagccaactgcgaagtggaaacaaagaacagcatcac

SEQ ID NO: 64206 - DNA, 2142 bp, Bovine  19866881228824
tatcgagtgggtacactgagtacccacagacccaagatctaggccaacagtccattgtttgcccagaacaaattttccttccagtttctctccgagaccttgaaaaacaggagaatgtaggagtaagagcacttctctttaagttgagcactgaggttctagacctgctctgtcagcaggaacgtgtagatctggaggaagccaccaaaaatagctggcatatgctcaacactgattacgctggtggactccctgctcaccacattatgtgcatcaacttatttcttccccatggcctgttgagatagacactaatattatgcacgtttttcagataaagctaaataactcaaacctatgcttgatgctgcctccgttcatctgggttactgagagagaaactgagacacactgaacagtgaataatggggctttataagccactgagagctactcaaactcaggacgagtagagaaagcactgaagggtgtctaagtgtaattgatgctttgtgattacggtgaaaaataagaaataaagatcttataagatgaagatccagctcatacccctgaattatggaagattgagtggaagcagacccccagatcagaggtgaattataaaaacacagactaaggaatgcaatgtgtccagccccttctcattttgcaaaaaaggaaaacgaacatccaaagttgcagaacaccatatgcagaaccatacgtgatcaatgcacgttcctttcgtatccatacatattcggacactgtagataggctaggactcttgagttgatactatgctatttttcgacccaccttatagaaagagaataggaaagtgggaggataagaccagtgaatctgagtattcccttaacagagcacttgagtattttcagttgtttagtcactaagtcatgtccaactctttgcaatcccatggacggtagcctgccaggctcctctgtgcatgggacttcccaggcaagaatacgggagtacttcagaactgccattaaactctcaacatgttcctgacatctcttctcctcatgctgctgctgctgctaagtcgcttcagtcgtgtccgactctgtgcgaccccagagacgacagcccaccaggctcccccgtccctgggattctccaggcaagaacactggagtgggttgccatttccttctccacttctcctcataggcatttttaataaccaggtctgcctttacaaagtatccaacagtccacattcaacagaggcaacatataaaaatagaaacaacatgtatccacaaaactgagcttaataagaagcatccagatgtactagagagagcaaaggcttttgaataacacaggtgtgagtagaaattctaagtctaccactgactctttggtaactgaacaaactactcttctgagccttcagttttcttacttataaagtgaacaaaatgatgtcttatcactgaggagataaaatcatagccacagtgttcaataaatgttggcttctcttctattcattacagcctgctgatacaagacttggccaatttgccaactcacaatataactttacttctctacttttaagaagtggaaatgttgtctggtgtaactacacataactgcagatatatcaaagacacaaaccatgtttctcctctctcctatcacaagtatcaatgctccatctaggcaacttgaatgtgcttggcacatccttattttattttacattattttagtagtaacagattttaatttactttcctcagattacaacaggtcaaaatattgatatacctgagaaagtggaagacctacaaattaataagttatatctcattaatacatattaaaatctataggctgaaaacagaaaataagcccatctttactgaatgatagatttagtgtgtgtttactatggtaagattccctgcataattcttcagaagtgtagggacgatgatcaaatgtgataacagtaattaacatctgtttaacacactttgatgccagattctgtgaaacatagtaagagtttggatctgcaatcagatcaacatgggttcaaatttcaccccattaaatacttgggcaagtctcttctctttagatacagaattt

SEQ ID NO: 64207 - DNA, 1090 bp, Bovine  19866881234908
atgttctccgaacgaggtccgctgtgtggcctttgctccttctatctttcccagatgccttattctaccatccaaaagtacagccaggagcagcattcgcaccttgagaaataccacatctgaatgccacaaactaaggatgaaaaaatatttggcaggacatgtattataagtaacatgtcctaaacttcaaaacttctccaaacaatgtttattaaaagcaagcaacgagacaagtgatgtcttctgtcatgtcgacgtgctctgaatctgagtgttcctcccgttcacgtcaaacttcaaacatttaaaataataaacaggagagaaaaatagcccagctcattaaagcataagcaagaaagcaaggagaccagctcagcctttgcaaacaaatcagacataatctgatatgcttttgtttgagcctgggaattttttgttcacatagaggattaaaatattttaaaagattccttattaaatatgtatgtggacatatctgtacatgtataaaattcccaagttaatttaaatttatgggagaaattcaagggattgcaggtccaacaaccccaaaagaaaataaccctaaaaaacaatctctaaccacataaccagtctctgaagtttcacacaccacaaaaatgagatggttgcaatggtgatgaatgaaaataatgtttcacaaccacaatattccaaataaaagtacttaaaacaaagagcaaaatgtccacttccttattttttgagtcaaaatttgtttctgtcagaattgggtttttttttttgtaaatgtcatatatatagtatctataaaagggaggtacaaaatggattcttgtcaactctacaaataagcaacctgagtgttggttttcctttaagagtagaaacagtttataatttcacgttgtaaatctcactaggactgagtgctctcacaaggactgacaaagaaagaattcatgtcagaccaaaaggctgacggtcagtctcctacagcattcttctaacagattcgggccaaaatgaatatagaatcctaagctaaaccatccatcacattttcctagtctttcaatta

SEQ ID NO: 64208 - DNA, 1164 bp, Bovine  19866881241668
cctgattattatccaatatagaaataataactcaaggcagcaggcttgcctttggaaacccaccgcagggtgtcggggtgtatgatgatgcccctcacctactggtattttcatggatgcctccagggcctgagtgcctggccataccgctggatgctgctccaacttcccccccccccatccgggccatggagcccccctcccatggaccagaattctccccaagttgtcgaggctgcaaaacacttgtctccattgatatcgaccagtggtgcattcagtaagaagaatggggacagggagagagccagctttgatgtctccaggggcaggaaatcactcagatgattcttccagggccacttggcagcaggtagagggtgtgacagctggtgggaaggtcggcaactgggatgtgaccgctgaaccatatcggggaactatgctgcccttgcaaacagaaaagttcattcctctagtctagtagagggtagggatgagggagaaagatcagagggcctggcacattaccacctgggaacaagagaattcaaaattgtccaacaatgacatgtcagaagctttcattactttgcaagaccaactggcccaagtcttcaagtcaatctaacaagaatgtatgactgtcaacacctaacaggtgggattcattgtggttaatccatgtaccttgaatgaggacttgaagcctctctttacccatctgttaaaatagcttataacatgtttctgtgagaaataataattactacatactcactatgtgccaaatatagtgtataacacttgacatgtattatcttttttctattcacaacaactctacgggatatttactcttaaatgccctttttccttattaagaaataggcagagagcactgaagtaacttatccagagtcatgcagctggtaaggaagccaagattcaaatccaatcagcccaaactctagagctctattagccaccacttaggaattaaatggaataatatataaagtattgattctggtaccagacacagcaatattactgatcattcgttttactttgccaacatcattattaaactccctctgttgctttgtccaaatgaaaaacagtatatgacaatgcttcaagaagtgaaagggctttatgaaa

SEQ ID NO: 64209 - DNA, 3608 bp, Bovine  19866881265101
ttatataggtgattatacagttccaagtttgtcaggacaaacactagtcttctccaagttggttttgtctcatgtcttcactgagcatttctggaaggcccagggaggactaagtaaaccaagtttttgttaattcagtcaatatatattgggtttgctaaagagttcctttgtgtttttacatatgatattgacatcttaacgaaattttgagccaacccaatattttctaactatttagtgcaagtttggactgcaaatagaataataccctacctcattactattctggtcccactatttcccctacatctcttgccctccaaatttaacttccccacagcacttgagtttctgttccgagagagagactgatctttgatgatctttaatagtttctttctctaatagttgttcttctaagttctattgaacgcttcctttaaatagcatttatcaaactttaattactgtaaacccctcagggatcttgttaaaatgcagattctgatttagggtgtctgaacagggcctgaaacgtggcattcctaccgactctcaagtgaggctgctgccattggtatgtggagcacacttaactgggtagcaaagttttacgtaatcaaatgtttctaaattccaagatggtcagacacttaggctgaaggaaaaacgtttggagacagcttcgcatctttagataagtacaacagatttcctctttaattgcaattgcacagtttatcttttacaaatgttttagtttctttcactaatatagaaccctaagatgccacattatgaaagttgcattttagaaacaaggaccttaaaaaaaattaaaaaaaagaaacaaggaccttgtgacattgagtttagtcctaagatcttcatatgaccctgattattcattcagtatacacatcctcaattagagcctgtaaagagaatccactgggggcatgagtgctggtaccaaacctggttttgccctactcaagtaatttaagcctcctgaacatcagtgcccagttacataaatccttggactagaactggtctattctgagggacttttcaaaggaatattctgcaattctgggactgtcattcaaaagtggtagatggtagtgactagaattttacttcttagcctctgtattctcctgccttataacataaaagtggaaatttccatttctacgtccgtactgtcaaagggacatgagcagaatagtaagaaacaatttgcagtagtggttatcacaccaacctgctaacacagaaagccacattaaggcaatggaaaaaaacagccgaataaaacagtaaatattaattcccttgttccttccatggtttgtagatcattaagataataaagaaaagtaaattaatttctgcctagttaatgtctgtgaacagggttaaaaacactgaatatcattttacagtagagattatctcagtggtaagcgagagggggctatgtcgggcatgtgaaattcaccacctccttccctggttcctgtttgagctcttcctaaacaaaaattatgtgcttcgtgctccaccgccaactgcagtatggagcacacgagagcttctgtggcccttctcaacccttttacatcagtcacagaactcccactgttctgtgctaatgcaaaatgcaataacgtgtagcatcaggacatctctgagtcaagaggttaacggaaaacacatctcccattgtgttcctgcagctctgatactgttaatggtgaaaacaccatggagacaaatagatctctctttattcaggaagctttgagtgaagagaaaatatatatgacatctttacaacatgagagccctctctatatggtgcattaaagaaggatgggggaggggagaggttcacgtaaccatcatgcttgataaagcttgaatcttgtctagggggagttttctgttgccttcattttcattctgttgctctaatattaatcaattcttccagttatggcagggggtggggggggagtgagaatttaatctttcaaggtacaaatttagagaaaggggactctttggataagtatagtggaagcctttatggagtatcttctaaaatgtgtcaggaagagatgtgtgatgacataactccctttctcatcctactcttacatatcttccctttctctgttgtgtgcttccgtgcttccagatagagattatggatcaatatacttgcgacagggaaccaaggcaaaaaaaaaacccccaaaacccacattataattactctgagatttttagttaaaaattacctgaaagtagactgaatgttttatatggccatataaagatcagtgtgatcttattatccattcacttgagaatgtcccttgggaaaatcttagtccgggttacttcttgttcctacagaactttagaaagaagtttgttctatagtttatgaattgcgatcagaagctaaaattgaggtgtctgttctttaggacctaaaagacttttcagtctgtagttaaaaattctgggacaagaatctattttgggagggtgtctgcacaggtttgctgctaagtcatttcagttgtgtccgactctgtgcgactccatagacggcagccaaccaggctccccgtccctgggattctccaggcaagaacacgggagtgggttgccattttcttctccagtgcatgaaagtgaaaagtgaaagtgaagttgctcagtcatgtcttgactcttagcgaccccatggactgcagcctaccaggctcctccatccatgggattttccaggcaacagtaccagagtggggtgccattgccttctccggcacaggtttagatgtaccaaataattatcaaaattttaatgttatgtatagtttttgagggagttccctagtggctcagatggtaaagaatctgcctgtagttcaggagacccaggttcaatccctgggtcctgggttaggaagatcccctggagaagggaatggctacccactccattattcttgcctggagaatcccatggacagagtaagcctggtgggatacagtccatggggttgcaaggaattggacacgactgagtgactaacacacacacagttttttaagcacttgaaagatatacattattgattaccacttgattcagttagatgactccactgggaggggacgagtaagtatttgcatccagcttttgcattggactggacactttcgggatgcgttttcaagccaggctgctgtccttcaatactagtactctaattgttgattcttttgtatcagggcagccaaatttcatgtataaaagttcatcaagtctgggaaacaagaaaagaactttcagaatggctcattgtttaatgaataagccgcaagtgttctgtggttgctgttttaaaatttgaggaaatgtatagaatccaaatcataacttgaatgccaaattggagcagatcaagctcagttgtgaggctgcagggttatagcaaactgttgttgttcagctgctaataagcaacttccaagcataaatgggacactcgtgttgtgtgttctgaatcctctaaagg

SEQ ID NO: 64210 - DNA, 862 bp, Bovine  19866881280300
ggagggtggtgggaaggggacagctctagctcagcccgctgcacttcctcctctccctcgccatcctctccctcaggttggcatccttctctttccttccccggccttatatagtcatgcggtttcacaagccccaacgcagaaagtctgccaacccctctaaccactccgctgccaaggcaatggtagaggcgagcttcaaactccgcatcggagccaggcaccgaatgtatctgttttctgcttctccggcaaggcgcccgaggtggcctgggggcccgggggcccttcccagttcatgccacaggcaccacatagatgcttacaggacactgggatggtgggggtgggggtggggggaggaacccttgggccgcggaagcaagcggtgcacttggacacctgcaggtgcgaacctccggccctctccctctccccgccgagcgccgctgcggctctttgtgtctgcggctctgcgctagactgggtggggtgggcaaaccggaagcggcaaatcagcgtctgggtcttgaaaaatgcctcgaagggtggacattttcattagaaaccctcgcacatttggagagaacaagtctgcctgcccagaggccttcccctcccgggcccccctctttcctcccccggcccactccctatcgcctagcctccccctcggcggtcatctggatctcgttgttcttgcatttccccagctgcctgtctgcatttgcaaccgtgcacgtgcgcagacacaccagtgctcaccgcacccaccctgcggcccccttactgaccacctcacacagctcacagattcgtaaggtaattccttcccggctccaacccccgtaacagaatagcc

SEQ ID NO: 64211 - DNA, 1066 bp, Bovine  19866881452453
ccctgtgctgggcagtgtgatctccttagccgaggacagaggacactgctgtggcaatggctctgcctaaatactctgctatcttcacctccaaagacaaaggtgaatgaagatggggctgtgacacggccatggttgtattcccagtacccagcacctggcacgtagcaggagctcaacaagtagtttttgaatgaacttttacactcacgtaaatgtaatttgttaaacccttttattttgtactgggggtatagctgatgaacaatgctgtgacagtttccggtgaatagcgaaaggactcagccacacacacacatgtatccattctcccccagtaagtgcagttttgatcgtaacttttggagagatctggattcatgtctaaagagccttgggaataatgcttagtaaaatgccacataaaagtagcatttaactaatggtgaatagcattctttttatccatgatgatactctgacagaggttccctctatacccacgtctgtgtttctgaaaaagaacaatttgatatatttcatctattctgaaagttccaaaggtgtgctgttggaagccagatgaatttcatctgaaatctcacctctctgggaattaggaggtaacgtcacgtgataaagccacatccaggatgacgtggtcgtgaaggactattctgagctacacacagggatagagatctcttacactttagagggtgtgggtgagtccagatctgagatcagcaactcagctgagatgccctcatttcagaaagagaggctgagaaggtagaaatgcttcatgactctttgacctaaagcctccagggtttcatagtatgtcttccggcaaaaagattggacaattcctttttttgcctaaggaaagaatatttaagtacgggtaagtggtgccccagggaggctagcttctctgctggtcttcatctgaggaatccctgtctctgaatagagggcaaggggcacaggcaagcattcaatctgtcctctgacagccatccatgcacattcagagtcttagacaccactgatcgggttacaa

SEQ ID NO: 64212 - DNA, 711 bp, Bovine  19866881452835
accattcggtcaagggttcaggggcatcagcccttcccctctccctctttattctccagaaggagaggcactttggcatcatatgtttttgtaaggattaaatgagataaaagttgagagaaagctttatcaactagaaagctctttcaaatacaagagattattatcatcatcagagtccacttcgacctcccgcagtcccttttttcccataagagcctttcgcccctccaccctcatgtctttccccgggagtgagtcgggcctgcctcctgcctcaccatttcaccccggcctcggcccagccgcttcccagcagagcttggctgtcccttgaactttcagtgttggttcgatttcctccagtggtaccacatgctgctgtgcaaacagagcacgtggtccggccaaacaaaggaacatgtgtgtgtgttgcaaaccacccccctatcacgggagtgcgagctccgccaggagagggcccggcccgcgcgcgcgcgcgcgctataatttttcactgcagttgaaacaccccgtaagctctcaggaagcagcgggggtggggggagcggccgagagtaggggcttgtgtctctggctctttccatcaccgccctggaaatagcagcgatcgtgcacggccagaccggagcttcccccaagctgctaagatttcatttcacctccagcaggctgcttggggactcgctg

SEQ ID NO: 64213 - DNA, 1721 bp, Bovine  19866881459375
caaaggatcctggtgggctacagtcccatggggtcgctgagggttggacacgactaaacagctgaacattttcaaagtagggaaccactgataagcacacgctctatgacagttcacagagcctcacaactgacccacagggaaggtgttcttttgacgatgatgaaaagcagctgaggaagatcatttaccccttgccctttctgctctagtcccatcctctgtcatctgaagcccttcacacatattacttcctctgttttcaacaatcttcttccacttctacctttaacctgtaagaacttactcaccattcagggctcagcccagactgcccatctcccagaagtcttccctgcccctcctgactgtgctccacaaattccagaaccaccctattcatctctggtggcaactctgccttttaatattctgttcccttgtccagacccttccactggactataaactccttgaaggcagagaatgcatttctcctttattactagagctacaatgcagccatgtaatagcacatagaaggcactcagtaaatattcattgaattgcgagatcatgcaagtggattcaaaacagagaagactggtcacacggttcttccttttttcgtagggagccatgacactgaattgagtgccattctttcttgcacttaaatcacagtgtccacattctcaactggaattatcaagggctaggcattatggctaaatctatgttcattcaggtttcaaagccttcttctagaaaacttagcaacataaaaaacacgtttagatatgaacttgtcatccaagagcatttagaagggtgcaataaatcagttcaacaaacatttatcttgaaagaagtcctttttctctaagctttttacaactttgtacagctcaaaagaaatgtaatcccttatattgtccccttattggttcataaatcattaatatgctggttcaaataagctttataagataaaaaaaaaaaatcaccctctcactgaagttgttgaaagcagattttcctcttaaatatggaggtcattttttacagaagagaaacctaaatctattataatactgttgcctgtgaatctgaactatcaaatttgactaaatacattttcctattatttatctgtatttacaggatatacctaagattgcattcgaccattctaaaccactcagcaagtcagatatatcaaagctttcagacaatactgaaagttttagtgaagagttgaaagggagtccatgttttggtcatctacagcaacaatgagctgttgaacggaaaaattaaatcactagggctactcagggcagctcacacccaaaataagacctttattcacagccttataaataacctctgcatcacaagtactgccaggattgaataaagagattttaaaagaaggctgttgatagataataagctattatcctccaagacttggcaaactggctgttggccaaacttgtatttggatactcctggaaagatagaatatgacagttaattggtttatgtgagaaaagccaaatatcttaaaaacatagcccatgccagtaaagtgctgctggaagaatattttctcagaaagtcaacatgtcaacaacatcagccagatgtatgaatattatcttcaataatagctaatgagggatctcctctgggtcttctcaccttctacttactag

SEQ ID NO: 64214 - DNA, 756 bp, Bovine  19866881712595
ctttaggacaaattagccatatgttttaacagagcagaattgaatccagggctctgttttcagtccaaggtgtaatctgccattcgtttgcacacttattttaacaattgaaaagcttttcatatcattgcctccaaatatgtatgtagccttcaccgcattttctaatgaggctcttgtttaagtttgtttcttatttcttgaagcgaataaggatcctctaaggaacagaataaataaccatgcgatcattctctttggaccctacccccttgctttttccattaaggtaacattcccagtgttcattgtttgttggttctttaaagaagagcttcagcttttacatgagggttgaaagcacattagagaaataattccctttggatactatacagaaggagccacctgcaaaatgttgatgctgttattgaaatctcaagtggaatcagctttcaaaaaattagatattagatacatccgatataatttgcaatgtgtaattatactaatgtgcatatagttgtgtgttgctttacatgttgcctacttgagatttttttttttcccttgggcatttctcctcatttgaaatgattcctgagtagaatgtttttaaagtcagcttttattttaaagtcagcttttattttttaaattccttattaattaataaaagaagcaaagaactccatgttctcatgtaagaatgaatgtgtctgacctacatgttggaaattaaccgtcactaaaagg

SEQ ID NO: 64215 - DNA, 1886 bp, Bovine  19866880626636
gctctgggagtctggctggctatccagagaggtcaggtgaagaagtgggttgcagaggtcgtagcaagggctggactgtgcagagtcctaagacagaggcagactttgatttgagcactgcagtcattgaccagccaccaaaaccctccctgaaacaaacaatggagctggcttggagtagaaggcttggtgtgggcaggaaccatggaaggagagcgacagaaaaaagtacccaaattctgtattgagaaggaggatatttccaaagatggtagttagatcagcctcccagaataaaatgccaacacagcatcccagctatgcatgtataagatactttagtcccctaagaagatacaagagagagattagaataaaccacccatctcgaagatacttcagtcccacaagaaggtacaagaagtgagagatcagaataaaccacctgtctcaatgccaggcacctggctccatggagtccatgttaccaaggcagggaactcagcagagccaccgccttctgttacccgacagcagtgtccatgcaattaaacagaccatcatctcctgatgggaatgtagagcgagaacgtgcaatggaggagctacttctcttagccatctttggttggtcaccaagtgtggcgggaagcaaaaacatccaagtagctttcctctctcagcagcccagacaggttgagaatcaatcaggtatggacacaatgaaagatacaaccaaagcacaggacaacgcctgcctccctgcagcttgccgtccagtcgagaagaccattcacagaagaatgtaaaccggttcttactcctacgcttaggcgtcaggtcttcacttcaaccgccacactcagattcagcaggaaccaaaaactcaaggactcccctgaggatggacttcctagaaggcaacaaggatgagtagcaggcagagaagaggaaaggcatttcagatgagggcaaagcaagcctgagaatcccatggttcctgagcaaagggtggccagccagaagcccagcgagggggagctgagagtcgtggagcggcatgggaggctgtagaccagatgctcaaagggaccaaggtgggactggggagcaagctcacagggcaccatcacaggcccctggcacggggaggggcacaggatgcgggtggtgccacagcagaggcctgccgtgccccagaagccctcccaccaggacacatggcactaaagcacatctggccttggagactggccaggcacttgctctgcgacctcctgcacagccgccccttcgcagacaagtggattcctcacaggagtatcagggtgagggggccttcttgccgcccactctgtcttggtcacttgccaagggtgctctgtcttgcttcctagctggatgccagagagacaagcaaagagtgagcagaaaccacaccctccccaagaatcccctactacagggcacacacaagcgggcacgtccccacaacacactccatctctcaccatctggctgagcaaactgctggtctctgagggaaaaaaaaggtaaaaaaagaaaggaaacctcttagagattatttgtttaatatctgaaaagtgagggagcagatgaagtatgcaagtttcatttagaaaatcattaaggaactattatagtaaaatgaggcttcccgtttccaaataaagctgaaacaatcacactgaacacactggcagagctggcggataaaggagcttggagaggagcaggaaggaaggaaggacagtaaaaataataactggagacgtcagggaattacaggccgcccccttcccccttcaggagagaggatcagttcgatcgatgagctgagagatccacagatcaacagcaacagt

SEQ ID NO: 64216 - DNA, 1656 bp, Bovine  19866880688133
ctatgcgaccccatagacggcagcccaccaggctcccccatccctgggaatctcttggcaagaacactggagtgggttgccatttccttctccaatgcatgaaagtgaaaagtgacagtgaagtcattcagtcatgtccaactcttcgcgaccccatgggagtggagcctaccaggctcctccgtccatgggattttctaggcaagagtactggagtggggtgctgtcgccttctccgaaatatgttttatatttttgtaaatcaatatgatggccccactggctataagttcatatacttgatatgtgaaaactctgagggaacgggtgccaggaaaacctcaattgtaacagatgagttattggaatctcagtgatgataactctgaagttaaaaattcgtgggggactaacttctacctgccttaccccatcccccatattgcaaaaattaacttcaggagctcaaccaagactgctattctaaatactggagaaaaatccccttttggttctggcaaagggaggggtataagagccaccttgaaataagtcagtgcactatgttcttcctaaatagcatggcatcaggagaaacaaactaaccacagcctaaactgctggggttttatcacagcctaactgatctgggaaaggaaatacccaactctagtttcactcaagctaacctatccccttgtcccacacctaaggataaggagaaaatggagaaacacttttgaagttcacaggccagaagcatagactaactgaaagactgagagctaatacttagactatggaattcttccccttttcccacacttctaaacaatgtcaccaaaggcctatttataatagttccttatacacagtacattgaatcttgctgttaaaaaaaaaaatataaggtataccaaaaagctgaaaatataatttgaagagacagaacagcatcagaatcagatatggcaggatgttggaattacagaccaaaaattttaaaacatacatgattcatatgctaagggctctcagagatagacagtgatagaataaaaaacaaagagatatcagctttgaaaattccctgagtatacaaaaccagtttagtcatacaaacaaagcttaatttagcttatttcacaaggctaacttgacttgggtcgtttctctcttatagctctggaaatcataagaaaaacttcagctctttcccacagttgaaggaaccactaacctatttcctattgtgatcacttaagaaaattctattataactaatcacaatgaaggataaacagtttctgccttctcagtgtatatacggctttataatgatatgcccctgagcctcatttcatgttcagtttgaatgattccagctcgtgaactgtttttggcatctgcaaagtaaactttcactaattacctactttggtgattcatcagttttgcctcttctatttttgaccttctaacaacagcatgcaagaagagaatggcaatgaagcaaagagataaaaatcctaaagaaaaaaacacgttagagattaaaaaaaaaaaaagtaatagaaataaagaaagtccttgacagacaggcttattagtagactaaaatagttgagggaaaaaagtctctaagctagagtatat

SEQ ID NO: 64217 - DNA, 2729 bp, Bovine  19866880733310
gggttctccggcaagaatactggaatgggttgctatttcctattccaaaggatctttcccacctagggatcaaacctgtgtctcctgtatctgcagacggattccttaccactgggccacctggaaagcccctgtaacagccataggtacaaatgtgctgaagtggagaaaaatgtagaccatccatccaagatcggaactttaggctgggcttggaaccatgcaacctctcaaacggcaatttttcttacctaattcccactcccgatatttcagagaggcagagaaacaaagcaatttgtcccgtgtcataaagcaagcctgtgacagagccaggataagaattcggttttcctttcccctaattcattcttgttttccctaataccaagctgcccccacacgacaatgatgttcatcatttccactatgatgggagatggctggaggtggggactaggtgagtcctgctcactgctgtatctttatcccagggcccagcatcaatgtccagcacagaggagatgcttaagacgtcttctgaatgaatgagctttaacctcttttatcccaaatcaatctcagttcaattttcctcgccaatcccaagagagctaaacaccaccgatcccctcaaagcgttaacacttcatgcaaaagtattggggtgatggatggggagagctcagaggttctgtagggcagcaaaactcttctgcatgatacaatggtgaatacacatcattatacatttatcaaaacccagagaatttacaatgagagtgacccgttaacataaactttgcgggataatgatgtatcaacctgggttcatcaggggtaacaaatgcaccattctgatgaaggatgttgacagggagggagttgtgttggggtagggagtagacagtatataggatactctatgctttccactctattttgctataaatctaaaatcactcaaaaaaaaaacaaaaaaacgaaaatctattcataagcagcagcactggaggtcagtccagaaggagccagagggaccctggcaccgctagggtgaccggtgccaaaggaaggcgtggctgggcagcaggtgacagccagggctgccattccctatgccacagcaagcagctccaacagagccgagagccctgggcttggaaaataaaactctatattaggcatcaaacatgccttgatagtaatagcacaaaacgagctcaagagtaagtctatgctggagcactgactgtacaaacaggagcacatgactctccctccccaagtgcccatgacgtcctacagccgtcccgagctcaggctttctcgggttcaattccctggcacaccacgtgaaacgctataccaatcacccctgatatttataaaagtcaaaagctattatgctttcaatgggggaggtcacaccaatctaagtggagcgcacgtgtccatctgatgacccccacctctccccggccctccagcctgggttggggtgagaggctcgttctgccttttttccatgtcaagttttggaaagaagaagttctttctcatctgctggcccttctccctttccctccctcatcctctttgggaccaggggaacagagagactgcccttgggaggaggagccagaacagttgctggttttcctactgcaggaggacaggagccagccgccctgacagggctcctccatgcccagcaccacccctcgtgccaggcccagggcaggagcgggggccagaaggctggcagccacccccagggaaggaatgtaactgctcaccctctatgattctctgccccgcctgctcatccaccaccgaaagtcctccaaacaaggacttcattttcttctctggagttcagggccagagacagtccctgcagctctttccaagcatccttaatatatcaggagggacagaggggccagttcaagcaggcagccgacaacaccaaggtgggggcacagctctctgcacgatcaaagggtgtgcatgtgtgtgcgcgcgtgtgtttctgtgctgtcactgccttctcctcccaaagccacgacaaggtgcctctgagcctccttcacactgaggaggagagggccccagggagggcgcctccggcgcctgctccgtgctcccggggcgggcaggtcctgcagcaccgctgcccttggccgccgggtgcgtcagctgttctgggccgcacgaccctcctgaggctgacacggaggagctgagaaggagcatctcagcatttgcatccgcttgaatggctttctctgtgacgcaggaaggtggaaatgaagcaagtttttctaggccagcaaaataaagtccttattttgtagtcaagagtggagagtactttggcctggaagtaagaactcgtgggtcctaattctggtttggcttatttgttctcaactgacccccctgtgcaaatataggcctctgagccctagttttttaggctgttgaatgggcagagctgaggtcccggctctgcacattaggtatgatgcccaggcccgcacggggaggagaagcagcattaaaacacaggctttagggtgcaggagcccgaagcacacgttctagccatcctggacaggtcatccttaacttctctgagttttaattttctctaggaaagaagagggaaggaaaatgtctatgttttaggatggtaataaggacttaataaaattatatcttca

SEQ ID NO: 64218 - DNA, 1667 bp, Bovine  19866880742568
tgcgcatgagcatgtgggtgtagatacctggtccccggccactttggggagaggttatcccccagctctcgccatggctcagacccaggcctgccatccccccaccccgccccagcccctgcccctcaagtgggctggcgggagggcaggctcttctctgggctgtgtttgctctccaggggggcgtctcagtgaaagtgaactcactcatttaaacctgactctgcagccttgcagccccctgcagcgctaattaccctgtagctctaaactgattgctgtacactacgcttaagcccttctttatttatttactgactacattaatagcaaagccgctgctttctgcagctcatgactgtacccggctggctgcaccccgttcctctgccgctgcctctcctggaggttgggggataggggtaggggttggtggtgcagagatacaccctggaaagcccaccctctcccagagatcccggggccacagtgtgaaagtcacggccttccccctcatactccctgacccaagcggggggctgcttctcttgttctggttcttcaaaagagcaggagcacccaacaccctgcatccccagggggatctgctatttgggggactcttggaagcctccctttcttcatagctcctgtgaggtgctgagcgctggctgcagtatttacaaatcggtaaactgagactatgactcgtggtgatggccggtgaaggtgaggctgggcgctgagatctgtcattccatcagctccgtctcttctctccgccaaggccacctgtccaggtgacacccctccgactcctggcccgatcaacccaggttggaccatttccatttagtgataagttttcacagcttccactcctgtgttgattcaaagcctttatctcccagctttttctgcctcattcacatacctgcccagaatttgctggaaacctgggccctagagcctttgcttcactctcagtagcctatcccagggcagacctaaggccagccttagccagaggacaacgtccctctgccactcacacctgggcaggtctggagagcgaggccagctgtgggctcctgcagggtggtgtcaccaggctgcctggcactgtctgcttcaccgaatgccctcaggccccatgaggcagagctgagccctggccttggggcctggcagcaactgaagtccagatgggtcccatcagggtgcagcatatggacccatggaatcgagcacccagctccactctgactgatgtgtggtggctgctattctgggctccccccaaggaacaggggcaactgagtcctggctgaaagaacccagtgtccagagtcaagaggacctaggtctgaggccagctctgccatttgtcatgtgacctcgaccgtaactccaagccactctgaggttctatgtcctcagctgtaaaatggggtacagaaatgcttgccctgtctaccttcaggacactgccaactgaagcaaggcatgtgaatcagctttctaaacaccatggtgctataaaatgaaacttataaattagtgggagagagggcaggctcggggccagcctgagctgggggaggggcagtggtgctaatggcctaagcattcatttccagagctggagccctgtagccaggacccag

SEQ ID NO: 64219 - DNA, 2867 bp, Bovine  19866880905056
ggctcaccctttcagctcctccacttaccctggaggacttctgtccccgtgggtgtgacccttccttgtccccgccctccaggatcttggtgggctccagctggtgctcagggacaacacacttacgcttgggctgggctcaggcttcgttgtcacacttcagttttctgttttgctacagctaagactttgaggagataaacagagatcactttacaccttttatattatgacaaatacatattgcaaaacactgctgcttccaaaatgtttgggttgcagagcagtcaggaattaacagctctgcagctccccaagatgcctgtacttcatttacacatcagaattttttttacactgttcagtaaaataaaaagcgagaaaacacatatacacacacgtacacatgcgcgcccagcgcaccacttgggttctatatcaggaatgtcttaaattagtaagtagttctttaaaagtccagatgaactgataaataccattaatggcttaatttatactccgggtttgaaatttgacacacggacagtatcttggctcaggaaacacaagtggttttgtgccagaggttttaatgaccgatcagtaatataaattgctgcatcactgaacagaaatagcttccctgtgtcacttgatctggaaacttctctggccaggcagcagttaataaatttaaaaataattaccctcttcattcaaagtcaaactaattaggagtgggttttacaaatcataatgttgtccgagccactgtacatccccgtttgggacgtgaacaggcctgggggcaacagatgggatcgggtggcattaattagagggcaggggagatacctcagctgctgagctaaaggcgagggggctggggcagtctgcagcaggccctgtgggggaggggggagatctcagtgcggcagccttggaattgagctgaaggaaacttcagctcttttaattcatatgtaggagactcagaggcttcacaggtggcattagtggtacagaactcgcctgccaacgcagaagacacagaagacgcagcttcagtccctggattgagaagatctcctggaggagggcatggcaacccactccagtattcttgcctgaaaagtcccatggacagaggagcctggtgggctgcagtccatagggtcgcacagagtcggacatgactgaagtgacttaacacatctgcatgtaggggactcagaacagctccctgtgtacgatctgaacataagagggatggggccaatgctggtgtttgggggccaggccagagagcctgtgagaacccaaagcaggaaaggcagatgtgcagatggctacccagggaggatgagctctcgagggctttattcaccaggcaagctggggccctgatagcgcggttcaggtttgtcttgcaggtttcaaggaagcgggacccttggaacccaaagtcttgagtgtgacattcagggtattcggagcacttgggacctggtgtcagaggtctagattcaagtcctatctcgtcccgtcacttccacgttttatgagcttgggcaggttgcttaactttccctaagcccatttcctccttggaaatgtgacagcaacgatgctgtcgtacaagggatgttgtgaggatttaatttgatgatccgtggaaagcactcagcataggccttgcatggagtaagcgctcagtcagtggtgatggtggttactaacactgcaccatcgtggtcttcgccatgcccttggagggtatcctttcccctgactaggtaggtgagaggagaaggggcaggctgatgtggtaagaaaggaataagaatggggtgcagctgctttgctgagctgatgggatctttgaggatccctgatgcatcctttggtcaagaggatgtttccagtgtacctgtagagccatcagcccctgctgtatgtacagcggggagaggtgagggcataatggagttgtgcatgtggaacagcctctcagaacagatttcgtggattttatttaaggccctagttcctagaatgcccgaagcttcccagggggactgccctcttctgatgtttaaaccgatgacatatccaactaggccggacaggctgcagagctggggttagcacagagcaaggtcttgtgttcccccttccaggagcttgagtcctccactggtgtcctggcccatgtctgtggccattaggaacctgggtattctggaaatataagtcagacctgggtcatcccactttatgccctcgtagtgccctggtaaggaaaagagacagaaagtcattcctgagcttaggagttccggggctgggaagcttcatggacgccttagagcccaggacacttgatctccagacttgctccaaagcagttccactctgtcttccagcccacgccctgcccccccaggttggccagcctagtgacttgtgttcgccacataccaagtagcctgtgcggctgatttgtcccatccttccttcattcatttatccactaagttttgaagtacctactgtgtgcaaggggcggtccctgccttcctgaaggctacagtgtgttgtggagcaaatgaacaagtagggtgaatttgctttggttacagataatatcgtcttcccaggtggcgctagtggtaaaacagacaaacaaacaaacaaacaaacaaaaaataaacctgcctgccaatgcaggagacataggagatgtgggttcagtccctggctcaggaagatcccctggaggagggcgtgacagcccactccagtactcttgtctggagaatcccaggacagaggagccggcagactacagtccataggtcgcgaag

SEQ ID NO: 64220 - DNA, 659 bp, Bovine  19866880925047
taaccatcctattttgattggaattcttgattggaatttttttgcttgccagggaaaggagaaaaaaaaaagaaacccactaagttctaaacttttcattaggtagttgggataagaagtcttctggggtagtcagattagagcttggtggctctcactgactattacaagctaattgagtgccaggagctcactggcggttgcaatgagcattttgctggagtaattatgcaaaggccacggtcgtcggtaacaaggtaactccaggtaaggagagaactccctgaaacttttgatttgctgtaatcctcctcattttatttcttcattaagatgagcccaggagagatagaggcccggagacgagctcttctgagaggttgctgctcactggggatttctgcgtgaatgtccctgccctgatggtgtggtcactttgtgagggcctgttaggagccatcccgcacaactggcccatgatgggccgggtgtacgtggattgagatttggggtccagagtcagatgctctgggatacaggctggagaggaatgagggcaagcactgggagcctggggacagctgaccagggtcagggaacctcacaggccagcatcttgtttgctgacgtgtgcgctgagaacatgcctgaccacaggt

SEQ ID NO: 64221 - DNA, 866 bp, Bovine  19866880954106
tgggagagccctcggtgggggcatttgggagctcagttgggtgggtgatcacatcttggaggtggggccaggctggctctggggccatgggttatccctgacttgagattttcacaggtgttcagccccttcccccagggtccacctgcacgattttagcccaggaccccttttcctaatgcagtgtcactcttaacaataataataataataaagtgtcacctcccctttgtttcagcgggtgccaaagcctttgtctgcgatcagtgtggtgcccagttctcgaaggaggaagccctggagacgcacaggcagacccatactggtgagtgagtgaccccatcccccagggtctcccttgtggtggtgcatggacgtgagtatcttggcccttgtttccctggggagctgtgagcggggtggtttgtgccatcttcagctacccttgctggtggagctggcagggcaggaacttataagtgtggctttgccccagaagaacagctgccctggttcaggccaaggtctctgtctctaataggccacttggagcccatcttcatggagatgatggtactttcagaggctttagaaagtcagtgatgttgtctaactctgaagcccttgtgcggcccagtgggctgtccctccgtctgcaagagtctagtcattgtctaaaagaaagcagtctgtccacaggcgtgcgtgtgaacagtattatccaacagtgatactgctgtgatctcaaaccattgatttcatagcatcagcgtcatctcatcatggtacttggcgtcatcttcatcattgtagctcatgcttactgagcattcacaacatgccaggccctgttcttggtgctttac

SEQ ID NO: 64222 - DNA, 1507 bp, Bovine  19866881197147
ccgtattagaatctgaacctcgttgtcagtatactgcctttggggtggatgactctgctgtgtgtgtatatgcgtgcatggatgtacttgtgtgtgtgcatatatatgcacacgcatacgtctctctgtaaagctagagaggactttctggagaaggaatgcagggatgtttgaggatggccctgggtccctgtcatccctcatcactctgtaatcagctgctgtccatactggtttacacacagagtttgaatgaaggataaattcccatttctcatgctcatgggttctctgtccctcagaggagctgtgaaggaagagctgggtttacagtttgccagcctcttggctctatgatccagaggcattcagactcttattgacaatggccttaaaataagagcttttaataaaataaaaaaggtgacatggggccacacagtcttgtcacctatggctaaacagatctgaggttgctggaccagtgcagggagtctcccaagccagtgagataacatgcttctgcagagaccagatgatgaatatatttttaaacttggaacccagaaccactgattatttctgaattaggaatcgcaaaacatacgaataatctcaacagggtttctgcagatgtattctgcctttaaggtcacttatttgggggagatggttggggctgacgggggagtgaggtctctggcttggttctgtctgtgagtcccaggaatccatgtcatgcgtggtcagtttcccagtcactatgagtgttaggcgaggcacattgctgcagggtcaggtagcgcggggaagcacacagccttctttattttttaatacatcagtgtcaccagcgcttacagcagagttgggagaaggtgggctctggcggccgagtgttcgtggctgtgatgattgaggaggcagcagcctgcaacagaattctcaggcttgtcccccaatgcctctcccctccctcccagcatctctcccccagccttcgaccaaacaaggtccggaactgaggtgttctggaatgccgcccttgctaagctctgggattagggccggtcatttgggaaaggagatggagggagaggaaagaatacccaaacattaaccccttgagcccacagcgctgagaggcctcaccatttcagccacgggcaaatctgcgtgtcttggccacatccctgaaacctgagatgcgtgcaccagaaggagacagttaagccaagccaggctgatgaaaatctctctgtccttaatgactctgccgggcacacctgctccagcctctcacttgctctcattgtcagatggacccaggtattgaatgaccgcccccgtgcagagtgcagctcgaggggccgtggtggaggggagtcatgagctagagggaggctgtgtctcttgtcctcagggagcttgcgcgtgtctgggaggcgtgttcaggctcatccagcacccagggggtggccaaggggaggggactgcagggcactaa

SEQ ID NO: 64223 - DNA, 1532 bp, Bovine  19866881245165
ccacccacccgccccaaacccctcctttaaagaaggcccctccccagccctgcagcccaggcctgattgcttccagagttggagagacagcttagcaggctcttgtttcttgccgatgtaccttattagtagcacctggcatcataacccgctaatgggaaccagcgctctcctcctgcgtggccagtgacaagtagccctgtcagccggagctcgccgtgcgaggaagttcctattagctttatggtcaggagaacttgtcctgttcaggaaatgaatgttgccgctaaaggtcctcagccctgaccctggcggcgtaacctgtgcgggctggggagaccccgctcaggatgcttgggatttcagcccctctctggttcttgtcatatgtaaagagggaatcattgtggtatgttgcagccttgaacttttgatttatgcagcgagggcgacttaaccgtttccatgcctgggcggccgtgtggtgacaagctcagggtgtgcgcctaggtgttggggggcggaggacagagccctcgtgctggccagcggagtggctgctagaacgtcagaaggacactttgcttgcttttccttcccgggacatctggatgttcaggggtgcttgttgcctgtggaagggtgggaacctgggatgctttgcgtctgcgattgaacctgggtttgaatccattctctgcctgtttggagctccgcgatagatagccagccacccgcttcctcatctgcaccaggaagttaatgatgtcaatttcatgcatgctgccatgatgacgttcctaggatggtacacacgggacccccggggccaggcacgtggcctggtctcagggcacagtgttgggaggggacgtgcgtgttcccttttttgcttatcgtaacatggtttgaaaaacgggagagaatggcagagcactttttttgagtatcaagaccatttctctccctcatcacaggctaaaatctttatggaaagactgcttaggtggcttctccttctgtctttttcaacctgtgagtaacatttgtaaatgtgacatttgtggagaacagcagcgtttgacctcattctcgaggtgaactctggcctgactctttgagaagaggcgtttgtgagttgtctggcgaaaggatagatcgtcacttttgctgcggccgctgccttgctaaaggcccctggtgacaaaggggtgaactgcaacagggtcgccaggaaaggatgggcctggtgggagagggagggctgggacgggatgcctctggaactgcgaaaacagtcctgtccctccgtctctggcatttatggcatcgttgacagtagttcaaggaaaaataaaaataagttgttaccgactgtgtggttgggtgcaaagaatgaaggacaggcgtggtcaacggtggcggcaactgatgaccacggtaactctctgttacccagagttttggggagtggggccctgggtcgttgcagggcacacacactactgggaggacgttcttactcccctcaa

SEQ ID NO: 64224 - DNA, 1928 bp, Bovine  19866881327347
cagcatgtgggatcttccagaccagggatcaaaccagtgtcccctgcattggcaggcagattcttaacccctggaccaccagggaggtccctagactgtcttaaggagcctagaaattctctttaggtgatggagagtcctgggacacctttaaaaggaatgctgcaacatcagatcagtttcctagaggccacgttggtggttgtgtgagatgcgctggggaagatgtgctgtgttcaggacgcctcttgtaggaatcctggtggtgatgctggtggctgggtccaggctgtgcctttctggtaggagaaggaagggacatgaatggcaaggtcttaggtcctaaaacattagccagattgggatggagggtgtgggggtcaaggggcctcgggatgacatccaggcatatttagtctgagtgacagcgtgtttgacagtgctggcagttgagacagagatccaggaacgggggcgggattgggagcagaagatgtgggtttcaggcttggacatgctgagtctagggtgcctgtggagcatgctggggcactcggatttatgggttttgtgctcagaggtctgggcgagaggtgtggttgttagtttctgagggccagtgagaccaggaaaggagagttcactgggagagaccatggggcgcggggtgcatcgtgagctgaacactgcagggccaaaagctgagcaaggcctcagccctcatcagcctcagactttgcagaaagaagcacgggcctggggtgcagagggctgtctctggagggctggccccaggtgtggcctgtgtagagacacccacagaggagactgaggaggaggtccagggtcccagcggctggtgttcttgaacccctgggagctcctttgacctgtgccctggtctggggcaggagagaagacaggctgaaggaattatttcagaactgctggggccttaaggggagtcagatctcccctccttttctgggttggaacagtcagtcctctgggccattctagacggttcgaatacctgaccctgccctgcggcatggcccttcctgggagtctcatccagtgagcccttaagctggtcccgcttcccacggccccatctttttgcatgtgtgtctcttttttgaggtttatggtgctaggttatgttgcatattctggaaggaatgtaagcacccccgcttccttccagaggaagctgggatcatggccccatttgggtctgaccttctcttaaaccccatcccccactttcccgctctcaccctgatccccaaatgaacacttctctgggcatgtgggtcccactctccctgatgtccttctctggtggcttggcattttgggaccggctgctagagtgattgacataaagccaatctataaataaagtctttttctcttctcataaagactttgtggttgagtttgccttcaaggtcaagatcagacctttctaaataaacacatatcaaaggatcattagcagagcagcactgttaaattgagatattaacttctgtcaactgcttgtttcttttttgttctgtaactcatgactgcagtaggtttttattattttgtccttaggcagtagcatctggcttctgtagagactgtaaaaattaaaaagcaacacaaatcattgtgggagaaaagcagtaaatccaatgataagaatttaaaattaaaatgtttcagcgcttttatattctgcaaaacatgaaatgaatgagtttgctgcctgttgccataaacctaacccagctaatcgtccgcttgagttttttcctgtctcctttgctcatcaccatcaattctgccttggtacaaggcgagacatcaagtgaaagccatgcttgtgtgtgtgtgtgtgtgtgtgtgtgtgttgtgtgtgtgtgtgtgtgtgtgga

SEQ ID NO: 64225 - DNA, 1716 bp, Bovine  19866881331916
aatctagcccatcacgagtcagtgttgctgggagtcaggaagaatggattgagtttggacatacattctcctcgtttggacatatattttcctgaagcgattctctttaggctttaggggccccagtgaatcctgacttccgtctcttgggaaggttaaaggaactcgtgtgttaaaatcctgtgctggtgcccagcacatcctccagtgtggcaagtccccttttctgacatccttacttgtcctcaacaccacgaggctggagggaggaatatttgacttgcctttccatgggaaccaccactggctatctgtcagtcccattcaccttgggattgtccgtcagacctggatcttttgtgacctggctgtgcagggggtcggagaggggggcaacgctcagaccctctccttctctctcctcgctttctatattatttatagtaaaacatattaggaccgagtgttaaagaggaaggatgagtcattgcattgaaaccattgatgacataaataaaagcaaaatgcttactatgtgttttgtgcagtatttaaggccaggtggtgctaatttgaatgctccccgactgggtctgtgaaagtatacatatgtgggaaaaaattcaggtttaaccagagggaagttggttattgaaaatctatttcggtatctgctttctcccttttatttacttccgatccatattcaaatcctggttgtcatccttcctaatgagagagactggcttattctctcgctaggattggtttatttctggaaggttgaggaatggtgcaaggggggttctgtgtgcccccagtcttcacccttcttctcacctgctgtggagggaaagctctcagaaccctcacctgcctcccagctgtgggttctcaaggtgaccagtaatcatagaccgatagaccgggaaggacccatacattgtttatttcggcatgctcatttaggatgtaaaatatggaggttcaaaagaggtgctgtgattcactcaagatcacgtagcacattagtaaggactagaatccatatccctgcctactttaattccttcttcacaaacctccctgtgactgccggggtctgctccctgcttctacccccaaggaggagttaaagtagggtaagaatagaatctgacttaagggcagtttcagatctttggctgtgtggcgtggatttttgccatggtgactggctttgtgggggtgcttattaacctctttcccgctcaggccgagtggactagtgtgcactgaattctttaggtttgcaggtggtgcactgctttggggttttgagtattggtaagactcaatatttgagtattgagtattggacttgcccttgaggagcttataacttgagcagttgagttaaaatactgcaaatgtgtatgagtaggttgataactaggagagaaagtagaaaatggaaagattatggcagatatacagggaaaaaaaaaacacaaggcaattcggagatgaaatgccttccacctggagggattcatttttaattaaaaaaattttttttgttgttgcacacttactgtgtgaggggccccagattaggcccctggaattcagtggtgcacaagacaagagggtctggccttgtggggctttctggatgggggagaaatgtagctagtgttctttggaaaaactgtggggttgcaatggtggtaaatg

SEQ ID NO: 64226 - DNA, 1155 bp, Bovine  19866882000854
cactttctgccataagggtggtgtcatctgcatatctgaggttattgatatttctcccgggcttgtgccaggagaaatcttgattccagcttatgcttcttctagcccagtgtttctcatgatgtattctgcatgtaagttagggttttggaattcagacaaagagttagggttttggagttcagactgatcattctggtaggtcctctagactcgcccaccaaagcaggaagacccggctccagggcaaatctgtaactggctttatgattaaaaggggggaatgtacaatttaacccttggctaactagacgacatgccggagctgcagttaatctaaacactgtattttaaacctagagagcaacatttctagaagacccaggatcagtctgctcccaggactgctaacttgggcccccttggagaagggcgtctgatccctgctaggctgcacagggctctggatgcttctcctttctgacccttcatccctccttctccctactcatgtctcatcaactctctcaccctcatctccacttgctacctgggaatcccacagtctggccacagatctctaaactggttcaaagtctccctcctcagaagcgcttattactctaaataatgaatttcccagtcctaattaatgcaaagaaagggatgatatacatttctctgttgctttaacttacagctagtaagacactttgagggaagagctagctaaagggtcagataagctaaaatcaatataagccaccacctcgaatcttttaaatcaccacctgccctcccctgactatccctgagccagacccctgcagtgggcacacagcaaccaccaagcctgcaaatgaccatccgttctagctaatattcagagagatcatctcccatccaacccctagttcctgctacccccagtgaccttccctacaaaaagaaaaatcactgaagtctctgggagcaatcagacagccaagaacaagggaaataacctcagggcagccagaggaaagaacagaaggcagacactcggaagacccattaatagaagtataacatctcaaacaacggaggtgagtgtctggttcttcacctgctcatgtcagtgcatacaacccttctgatgtctgcagtgatataaaa

SEQ ID NO: 64227 - DNA, 1485 bp, Bovine  19866880464686
cgggtggttgatacagcctaagtgattctcccatgtggctgtttctaggtacatcttttaaaataagttgtgcttaaattagcaacgctttacttttaatattcctctctcgaagtagcaagcatagtttcaatcaggagcctgattaatatgcaaaaaatgatttgttttgatttcagtctagtgggctttttttttttttttcttcaccaggcaacttctttatcaaattcctctgcttttaaaggatgagaagaaatgtatgtccttaaagtcagagggcatggtttccttgaaattggaaatagaaggctctctggaggctggtctgaaatcttaacagcataactttgccaacagcaaaacatctcttcataattttatgactaccttcaggtatcagctccatgatgatgtcatgcaaaaccttgttggattttgcaaaaaaactgcagccgttggaagttgcaattgacatagttgttccatcaaagtgtattatattttgttgcttattgtatgaccttgggcaagttacttaaatctctgtttattatccttaaagtgaagataatacctacctgttgggattttgtgcaatgtaagtttataatcctttatccaaaaacttgatgaatttccgaattcataattttttggatttttttaggaaggcaattcagcatgtggatcatattacttaacactcccagtggagccttgggaagcaccctgtcatcaaacacattaatatttctccagccaaacccatgaatattcatatagagtagcataaagactaaaaatagcctctcattagtccagggcaaggtttgtaaccaagtgagttataaacagatctctctctttccagagcccttcggactgggggcttggcaatcagaggctgtggtcctgtgatgagacagtctctgtgtctatctactgatttcagctggctccaataatgactcagtgtggtggagtgatgcacgtggaaaggtctgttcccagggtggttcggtttccctccctgcttgtgatgtgagtgggctcttgtgaattttcctttcttctttgacattttaaatcctaatttgcttctcccagggatctgatttcaggcacaactgttttgacgcaaataggcttgaccaaaggttctagagtgggaaaaacgataatgtcattacttaattggtacatcattaagaaaccgaattgtctaaaagttggtaggaagtccaaagaaattccccaggtggcaagtttcaggatgttcagaaggaaacacacagcaagaatttgtcagtgtacacaaaaggctgaaagcccatggcagatcctcaaaactgccatggtactgtctctgctctcccaccctcagcaagccctgcttaactgtgccatgactatgtttaatttttacttactatgtcaaagcatataatatataatacttatgataataaacataagataaat

SEQ ID NO: 64228 - DNA, 1696 bp, Bovine  19866880483329
ggaaaggaaatcaaaatcacaatgagatattacttcacaccctctagtatgattagaatcaaaaaggcagagaaatgatgacaagggtgtggaaaaactggagccctcacatactgctggtggaaatgcaaaatggtttagctgccttgtaaaacagtctggcagttcctcaaaaggttaaatataaggttgccatataacccattaaccccactcctagctatataccctggtgacatgaaaacatatgtctacacaaaacttgtggacaaatgttcaaagccacattatgcatcatagccaagaagtggacccaacccaaatgtctatcaacaaacaaaatgtggtataaccatacaataggctattattcagcagtaaaaaggaataaggtactaacgtactatatgacatggatgaatcttgaagacatgctaaatgaaagaagccagacacaaaagatcacatattgtacaattccatttttatgaaatgtccaaaacaggcatatccatagagacagaaagtggattggtggttgccaggggcagcggtggttggaagaaatgaggaataactcctaatggcattggggcttcttttgggcataatgaaatgtcctaaaatcaattatggtgatggtgcatatgtttgaatatgttaaaaaacaactctgtgtttttaatgggttaattgtgtggtgtgcaaactatcattaacattaaaataaagctgttattttttttaaacccattacaataaaactaaaaagtctaagggaacaaagttgttctatatttcaaaaatctttttgggtgaatttgttgacaattatatctacacaataagatattcttccaagtgcatttcatacaagcagggccactgggaatggttgggcaggttgtacacttaacaaagtattaatattactacttagcagtatgcagcaaccatgcccaaggggaactccatctcagactgtgtgctttctagagtgggagagtacagctgacctgtgcctttgacccttttttgtttcaacaatcaaacagtaattattcttcattttcactcattattccttatttcacatggcccaactcacctaaatcctccaaacaattcccttgaaatgcatggcacacaaaagaaggccagagccaggaacagaacgggtgtgaaacctcagccttccggctggttggatttgaaacttttctatctacttcctgagtctgtactgaccatctgaggactccatctgtctcctcctaggccctgcaaccctgggttatgattcttgctaacaattgattgccatgattccatttcaacaacaatgatctggagttttactttgagtgtttaagaatccttcattatctcctaatggcataatagcaaacacactttaaccactaaagaaaagtgaacagcttggtattattttgagaataaaatgagttgacatatgtgaaaaaaaaacttacaggtttatagagaaccaatgatttgatagaaataattagggagtctacagtaaaacagctgaaggtatgtgttatcaggttaattattttactgccctgggccctcagtttatccatttgtaaagtaggcaaaatggcagtaatcttcccataaagttgtgagtacccaatgaattaatacatataaagaactttagaaaaat

SEQ ID NO: 64229 - DNA, 767 bp, Bovine  19866880521777
tgcaaaatcccttctctcaaatactattagcttgatttttgtttgaaagaggggaaaggctgaaaattccaccctgcttggctctgtgccaaacgaacagatctgaaaatgctactaggtattttgcacgcccctctgcaattattcacctttgttgtcttattaagagactctctctttccctagatgtaatgagagcacctctggattcccagaccctcacgcttcataaatatccattaggaaggagccactggcccacagtcaagcaactaagtaccttgaatgcaactcagttattctgaaggtccttccagtatcttcttggtccagtcagcatttcccctatctttgcagcaattattttcttcattatcatgatctttccttgtcttttgttcttagccaggtaagtaaaataacattcctctatcctttattagaatttccagttctgctttcatgtctcttctggcttgttatctatttggaaaactcctttaaatgaattactgaataacatgaaacagtgattaaaacaaaaggaaacaaaatatggagcaccacgcacagcagagacctaggtgagcacatatgagttcaataccactgttcttagcccttcctccatgtcaaactctcagtggttgtgtaatcttccttcagaggccactttgcatcctctggtacaatttcattggcagtatggagaggagaatttttgtttcctctgactataggcctcagcttcttgcagggacttggga

SEQ ID NO: 64230 - DNA, 1251 bp, Bovine  19866880607695
ttgtttatctattccataaatagtagtgtgtatctgggcttcccagatggcaccagtggtaaagaactctcctgtcagtgcaggagacatgagagacacgggttcgatccctgagtcaggaagatcccctgtggcagggcacggcaacccactccagtattcttgcctggagaatcccatggacagaggaaagctggcgggctgcagtccagggggtcacagagagtcggacccgactgaagcagctcagcaagcacacatgcacgggtgtatctgttaatcccaactcctaatttattctttcctctttggtaactagaagtttgttttctatgggccaggacacagtttgaactgcccacaggcctcgtgaggaagcagtgctcagcatctgggtgctgccctcaggactcggcagagctctcctcctgggcacaccgtccctctcacaagggggacacacagctcagtgtagggctgaacgttgctcatgctgaaagggcccagctcagggcggccaaatccatttgcggaggaggggctgtcagagtccctatttgtcttctcgctgccctgcagcatcctgcattaaagtctcggcagccttccagcagagttttgcttttaactttattatagtggttgggcaacttgggaaatctgaattccactgacacatttacaatcatcttgcctgtcagcccgtggaaaaaacccatctcatagatacagggtcctcctgagctatgggcttcttgaaagataaagactccaccctgttggatgagaaaggggagggtcagtgggcgaaatggttctgacgatgagcacctaccctggagctcctcctccccttggcttttcactgagagagccactgtccttagcacagtcctttgcgtttgctttttgggacacttggttccttcggtcaccaccatcaggttcccagtggtcaccagcatttttttcacagggctttccaagggctgcaaaaagtgtcccaaggactgggcatgggggagcgggcggctgttggctacacaagggaaaaaaaaaaaagtttatttgaaattaaaattaaatagctacaaaattttacattttgttggcaagtcaaccaccacttaactcatgtgggattggcacatgtgaaggccatctgtgtgaggtgtggacaggttgtgtgcagcctgggaagagaccctaagaaagtcaggaggctgtattacactgtctgcaggggaaacg

SEQ ID NO: 64231 - DNA, 1460 bp, Bovine  19866880666621
cttccctttgttttaagatcctgaattaaagcccagagagacgagaggcatagtgagccctagagagtgtgcagggatgcccaagctgcttcacagtgcattttgcagctcccgggaaaccgggccctttggctcccatgtggtcagctctcccggggccccaggtttgcagtcacctcaggatcaggcaccgaggggaggtgtgtggaaaagatgcccatcggtagtatctagaggtggggcgttttagaaaccctctgatcagtttaattagccccatgctaattaaactgaatttctgggcaattttgggacagaggcagctgtgctctttttcagacatcccactggaatcctctgtgcagccaagtttgagagtcactgatctcagggcacctcctgaaacaactttgggcaaggtttcattcagggtgaggcttccctggtggctcagacggtaaagaatcctcctgcaatgcaggagacccaggttcaatccctgggtcaggaagatcccctggaagaggaaatggcaacccactccagtatgcttgcctggagaatcccatagacagaggagtctggcgggcttacagtcagtccatggggtcacaaagagtcaggcacgactgagcaacgaatactttcactttcattcagaataatgcctgcctgcattccagtccctcttacttcgtagaatcaccaggtttaccatacttatcctattgtgtgtgtgtgtgtgtgtgtgttttaatctttatttatttgactgtgccgggtcttagttgtggcatgcagaatctagtttcctaaccaggggttgaaccaggtctcctgcattgggagcacagagtcttagctactggatcaccaggaaagtaagtcctccccactgtgggtttctttctttctttttgacacatttcattctgtaattccgttattcctccatggcagacacaacatttaatagtcatgtttctcaccaagaagatggtttaaagctttcagcagtatgtgaccttacagcctttgtccagcttagtaaatctgctgacttgcgagagccatcgctaagacttcacagttgcattgttttacttattgagttactttgttttacttcaccagttttttctaaagcatagatgtgtttttgctttgccttgaaaagattataattctttaaaattcaagaagctcagggagggaagaagattcttttattctagacttttctcagcattatttctatagaaagtgagttaagctgttctaccactagaatattgggtctctaaactgttaaagagtagagctttactaaatatctgccaatttttacaatttacatctaaggagagaacaggtgtaaaggttgaagtattatgtgaaacaggaagaacaaagtgaaacagccgtcgttgcaattaagcgttccttttcacaagatgtaa

SEQ ID NO: 64232 - DNA, 1329 bp, Bovine  19866880685268
tcatcaaactgaaatcccaaactagggggtgtatttttggcccatagtattattttcatgtttgtgaaaagttcattcaaagtccttttgaatccacccaaagtcctaatgcttgttaaacttgtagaatgatttggctcataggaaataactatttttggtgcctgaagttattttatgagtgtagtattaatctccagtcatttctgcagtgtcaacattgaggtatatggaaccgtatcatttgccagagtgtagcttaaacaacaaatactgttttttctgattctcaagaatagttacagttatcatataccctctcacacatccattattatctgtatttagatagattaaatatgaagccctccttctaccagacacctctcaaattctaccgaatctcatcagttcacatataataagagcgagaggtagcctgttcagtcctcagttttctcttcaatgccaggtgtttgaaagaggttcattctacctttttataaatcatgtaagttctttctagtcgtagggtgaatttgccaaatgatctttagtctgttctttcccgtacagggttagtcatctcattttagtggagccttggggtttttctgaacgaccagaccttgctgatcaagagagaccaattccagtttggatcagagccttgggagcagcgttgactccctttaaccctttagctggcctcaggattgcagggccatttggtgagtgcttttatacctgtatcctgtgtgtgtgtttgtgcccagtcactcagttgtgtcccgctttgtgaccccacaggctgtagcccaccgtgctcctctgtccctgggattctccaggcaagaatactggaatgggttgccatttctttctccaggggatcttcctgacccagggatcaaactgcatctcttgcatctcctgcattggcaggcagattctttaccactgtgccacctggaatgccacatatctgtatccctggagagcacagtgtttatagagaacaacagaggtgtatttgctgaactaccattgttagttaaaatcttgaaaacaaaaacaaaccttactttttctcctcctcctctaaaaaataccagtcaatgcctaaagatgactgaaaccaggctcctctcctcaaagaggaatctttttatggtaaacattacagataattagcaggcagttcagttcagtcgcttagtcgtgtccaactctttgcgaccccatgaatcacagcacgccaggcctccctgtccatcaccaactcccagagttcacacaaactcatatccattgagtcagtgataccat

SEQ ID NO: 64233 - DNA, 1904 bp, Bovine  19866880696813
aatggagacagaagcctcttggttggaggtggattggctgggggctgttccgaagaaaagaacaaaggtaacacaggacattccctgaggaagaagcaggaaacagggcaagcctggctccgaggggacgtgggtccagtcgttggccaccgttgtgggcaaagaggttttagctttagtgagcagctatcaagtggctactttggtaatcggcataccctaggcctgctgacttcactgaattttccagaatacatagtactgacccaagaacagcctgctcgatcaaaagtgccattgtttcatgcgtttttgtttatatcccagggagctgctgcccgggggtgaagccgggtaaaggggcagatgatggcagcactggggagtcaggctctcagaggtggaacaggaaggggtgaattgtattagcgggattttctcagagcagagaccctgagcagcacgtgtttggaaggaatcctttgataagctgcttgagggaaagtatgcccctcgggaacacggtgcagtggcctggtggctgacaggaggtcactcagtaagcatttgctgaagaaatgcttgagaaacactacaaggggtctctagtctgcctcccaaggcaggtgggtctcctttattgaagggccctggtttagctgagtgggacaggcaaagtgggttcctgcttatgagcttctttccccccagagagctcagccccttctctatatcggtgttgaataaatacttataggattcatggagatccctcctctttgccattccagatcacttaagtcaggcacagtcagaagtcagagttcagggatgacaagagtaaactcggtctcttgccagctgtgtgactttgggcaactcacttagcctctctggactttcatttccttctctataaaataaggagcttagacttggactcgaagcccttattgaaaccaggcaagtagctcctgctgaagacgatgctttgggatcccaagaggtgggcgtagggtggagcgggcgccaatgtaaacaataactaacattcatggagcatttcccacagccagcgccacaggagccctgaacacctattaacctgcttgcttcttacaatgacacctgtatttatcaagcacctctctcatcccagagatgttgttaacacctgcactgggggagtgatgctaatgccgtaaccccatttcataggcgggagagttgcaggaagagagggaagggcatgcagctgagggggcagagggcatgcaactgaggcaggacctggcctttttcagcactggccctggcggctggttctccctggaaggcctgtctgtgtttccagctatctggccacagggcctccgggctggctgcttccttcctgggagttgccgcccctcagatcctccctgtgctgggaaagaccttgagatggtgaagcgctttgtgccctagagtccgcctaagtcctgtttaccacttcagcatagccaaatggagtaagtgcagtattgattaaatgcaatttttttttggaatacatattcaccctgatgttttatcattaatgcattaagaagctgaacaagcaataagaccaaatggacttcaaaacgcagcagaatttccatccagtgtggtctgatttacagccattacctcctggcagaagacagctcccactccagaccacaccttggctgaaacttgagagctctttgttcttaaccttatttctttattttctcagagagccggtggacctcaggctctgggccatgggggtgggccctgctgggtgatgggggacccgtgtaaactagggaggcaggcagagagggagtaaaggttttcactgcatgcttacggcgggactgcggaccctgacctgg

SEQ ID NO: 64234 - DNA, 2246 bp, Bovine  19866880809222
ggaccgaggaatattttgggtggaggtggagtgggccctgggtacagctgagaaagagaaagctccagggaggctgggggaagatggtctaaagtgccccaccctcaggacatctgacaccccactggacacctgtcagtgagtccaggtgttatgataatggtgtagaaaggctcatttgtccatctcaaaaatgcctgccaagtaaacttttttggggttctttttaatagtcactttaaaggttttagatgttgtaatctacaatatttaaaaactaatcaagttgagggaattccctggtggtccagtggttaggactccacacagggcacgggtttgatccctagttggggaactaagatcctgaaagacatgtggtgtggccaaaaaaagaaagtcaagttgaaactctcagaaccagacaaatatttatcctgaaggcctaagagtataaggaagacacatctagtaaggagtagagagataagcaactagaagagaatatatgagcttctatgagaacaaagcaagaatgaattacttctgcctggaaggttctacagagcaggtgtaagtgacctggaacctgagagatggatcaggttttcccaggcagattagtgagagggaagggcgtgcccaccaggctagtacacaggaactgtgagatgaaccagatcacacaatgcccgggggtggggtggggcatgagataagactggagagggatgtgtgtgtgtgtgcatgtgtgtgacagagagagagagagagatcataaaatgtcttgcacattgggataaggacctgggatcttgcactcttaagtaaaggtgtcctacgttggtttttttttttttttggccgctgcagggatcttagttcctggacagaggtgaacttggccccctgcagtggaagtgcagagtcctcaccactggaccgccaggggagtccctacattccacatatttttgattcactaattgtgtgcagttgttaataattcttcctactccccttttaagaatattggtaaagactttgtcatttctgcatggtgtgtgagaaataagaaaagtaaaaatatcttactttatgtcatgattattagctattacaatttttccattttccctcacttattaagtaatacatattaatttactttaaattaggtaaaaaaaaggatgatttgtagacaaatgaattatcaagcaaataccatgtttccttttgggaccaaatgtcttaaaatgtggactgaaatagaatcttatgattaatatattcatgacctgattttttgaattcttacatttaatgtataaaatttaagtggcctagtttaacaatttttgtgttttgcttctaaaccctgagacaaaaatgaaggttctacagctggcatttatctgtctatgtagacatcaggtctatgtgacagcttcaggtgaaccacgaaggcactcagccatacatatacatgcagtcattcctccccattaaagcagttttaaggggactgcaaggtctgttataagcaagactaaaacgtgttaaaacgtgtaatgctgtatcattaatttcatttgccaaaactaagaaaagctatgtagctaataatggggtttacttcattgtctgacaagatacatagcagtggacactgcattttgtcaataaattagaatgttaaatttccaccaacttcaatttctaaaacaatggtttactcaatttatgttatcttctttgagaggagacaagtcaaaatgacatgatttgagctagtgctggtaattattgggctttcctggtggtgcagatggtaaagaatccatgagagcatcaattaaaaaaaaagtacacctatggagaaaatcaagaattcatagtaacacaactcatctacactcaggaattttcctttaagacaatgtatctcctactaaaacagcagatacttttattaagtcaacactagtgaaattaacagaggcactgttcaaaaaaaaaaaaacaccccccaaaaaacaggccctttacattcattgctgagtcacttctactgctatcatctgtattaagctactttacatttccatattaaaccttgagttctccatactgcgcctacagcacttcacagtcacacttatttaacggttctttaattcagtgttaataaaaatgctggataggttttatgaatctgtgaggcagattagtatcagagagagaga

SEQ ID NO: 64235 - DNA, 1424 bp, Bovine  19866880853808
gagaaggggacccggaagatgagatggttggatggcatcacgactcaatggacatgagtttgagcaagctccaggagatggtgaaggacagagaagcctggcatgctgcagtctatcagatcacaaagagttggacataactgagcgactgaacaacaacaaaatcccagactgaacaacaaaatcccaatctaacttgctactgtaatgactacaatatactatgtctgcaccaaggcaaaagtgcaaagtgagtgaagtttctgccctgagcctcacccacctcttgagccatgtccccttctttccttttcaaattcctcccagaatcccacctacccagagtccttattacaatgtctcaccctgggcattgcttcaccagcccaagtttcttcttctagccttaacatgttcctgttccattctctaaggttctgcacgttactagttcgataagttaatttcatataaagacatgtaggttggttaagccttgactgtgacagcaaccaggcgaacacatctggcctctaaccaaaacctggtgatgccttacccagaggatggaatgacagtttacgcagtgactgccactgagtcctgaattccatatgacaagcaaatatttaggcttttctttccaagcagaaaggataaagcccaaataatttactccacaggaaggatcttgtagcccagttagcataagttgtgcggcctcattttattaatactttgggctaagttccttggtatattttctttttgtgtcacatttaggaaagaagcactagttctctttgattcaacactaaactgttcacagtactatctacccctagagagtaagactgtaggtgtgtgtgcgtggagggggtggggggtggggcgaaggaaaagggcactgccacattttatgctctagagagtttggatttttcatataaagcacatcaagttttataatttacaagccattagtctcgccctgtggtatggacaaggctcctggcctctctgtttctgagaaggtctcttcatctttggtaactgatgacagatctgatcctcacagcctgctcttctctcttgggaatgcatttgcatccttcctgctgtcacccttctccaacatgaaaggaaatgtccctccagcctggtttttgtctgctccatgagtcagctgttctgatttatttaaaaccttaattttaagtaaaattagaatggagaccacgtctatggatctgcagtgcctcggctcagtgcctggtataaagctgatatgttataaatgtttttgaataatggctgagccctcaggttagtcaaagaactcctgccatgaccactgatccgtttcaatatggcgggcgagcgagccctcaactctttaaaggactttccctgggttgctcact

SEQ ID NO: 64236 - DNA, 1183 bp, Bovine  19866880864711
tatatctcatttgcttattgtctgtaaagatccaagatggcagagttttttgctccagtcccctgctgggtctatggcccacacgacagggcctggcatatggaagatgcctgatgcatttatttagcagatggactgctgctgtccattcagacctgggggatggagctggcgatgggagagcttcattctccagatgatcaagcccaggaccctgttctcctccacttgcagctgagacaaactgttatgcccacagcaaagacccaaagtcagctgtgaagattgaaggcacagccggaactcccctggaggtatctggagacactagttcttgctgctgctggtgctttttaggtcaaatggactagacaccattgtaagtcacactcaaaggcaaactaaggctccaactgggcccttcccagcagccacagcctaccatgccatggacattctgttgaaccatcacgaagtacaatggtctctcccttcagagttacagaagaaaatctggctggggggaaactccaggccatagtgtgaagcccactccaaggggcccaaacctccttctggaatgcactgaggctcttccccagcatctcattttccagcagtaggatggagctgccctacatttttgaatcctcaggattttctgccacaagcttccaaataaggattgggcactctgtgaaggtctgccccacatcccctaccatcaggggttctccagtaggataaccaggaccccctctccccaactgttagaccacaagttaatctctaatatggtttttcatatgccgagccaagtttgaagaccacctaaaggtcttcccacacactctgcatttgaagggcctctcccgagtatggaatctcttgtggctgatgagttgtgagctcttgctaaaagttttcccacatgtgctacatttgtggcactttccccgagtggggtatgtcctggagtccagggagttcagatctctgattacaagttttctcatcatcttcaagaggattctcctgacctgattttaattcatgtaactttacccctgtctcctggcaggaagacagcccagccacaccattttcagactgggctgctctgatgtgttttgctctgatgaatggagagggtatgttttccaatgaaatctttcccacagca

SEQ ID NO: 64237 - DNA, 1636 bp, Bovine  19866880921854
tacatagaatatttactattctcacaattcttttttaagttttaaattattttggagggacccattaaaaattttttttttctttctcttttgaaatctgtcatccataaatacaggcaactgtggttaagtttcttctcaattttttcaaagaagcaggaaaaagtaatacctgaagtaactgacatcacactgaatgtcaatttatttatcatggtatttctttaaactccaattattatatgacccaagtcattacttgatgtactacccaatcttaaactgttccttaattttctgtcttgttgaaaagccactttgggaggaaatatattttatttttatatggaaatagataaaatagatggtttatacatttttaccccctaattgcatcaggtggtttaaaccacacaatgccctttggctttttaattagtctgaaaaattaattcctagtaatccccctcaaagcttcttcctgctcctacccctaccttggcaatttcagaggctcatggagcctggaagtccttgagaaacctgcctacctctcatatatgtctaatcatcaaaggggattcacttttagcaagcaaggtcaacacaaatgttgccgatttgacactaaaaacatccttccttcttttcaaatggcagatgatccaaaggattcaagcaagaatatcttgcttggcacatggcctaaaagttctaaatttatgtattctatttttgcttctttctcagatcagattagttactaggcaactgaagtatttaatttcatttgctaatagttacattttaatagaggctgctagtgtacatgactgatgctgccagtacaaacacaatcccaacgccagtctctgtcgggcagtagtgagcgccccttcattctggttctagacaaacacgactctgttcttgccttttatttatttgactttcaggtacaggaagaaggatgtctcttttggaattctttatagaaagaaaattttaagtggtttgttttcttcactcaaaaagctacctgtttgtatccggtcccatcacttcatggcaaatagatggggaaacagtggaagcagcggctgactttatttttctgggctccaaaatcactgcagatggtgactgcggccatgaaattaaaagatgcttactccttggaagaaaagttatgaccaacctagacagcatattaaaaaggagagacattactttgccaacaaaggtcgtctggtctatggggtggcacagagtcagacatgactgaagtgaattagcagcagcagcagcagtcaaggctatggtttttccagtggtcatgtgtggatgtgagaattggactataaagaaagctgagcacagaaaaattgatacttttgaactatggtattggagaagactcttgagagtcccttggactgcaagaagatccaaccagtccatcctaaaggagatcagtcctcggtgttcattggaaggactgatgctgaagctgagactccaatactttggccacctcatgtgaagagctgactcactggaaaaggccctgatgctgggagggattgggggcaggaggagacggggacgacagagaatagaggcggaggcatcaccg

SEQ ID NO: 64238 - DNA, 1440 bp, Bovine  19866881016927
gggttaacttatttttagagataccaaaggactcagctgggaccacccccttcatatgcaaactaactaacatggagctgtgcctcttctgtctggcctgaacatccccaggaggtgatgttcctctgccttagtcatcccagggccaggtgccaaacaactagaaaccacctggatatcttagagcccactgaaataacttaagcagtccatcctacgctgcccaccctgcactgcctgcatctcccgcagaacccagtaaaggttccctcctggagttcccctcacgcctgtcttctgccacctgatcagaacctgctgcatcttctgtgagccttcctcagtgacctcgctccaggacctgtgagtatactaaactttgttctcctgagcgtctcctatgtcctctcgtgtgggccacacctgactgagcgtcacataaaagaatacagaacgtctggcaaactcctcagacaaatccactctgcggtcacttctctggtctctttgtggtactaggcatacttgtgaatggccatttgtgaattcaagttccaccacaggataggccacaaactaggcctacatgggcacacgtgattgtgaaatgtgagtaggtgaagaacaaaacactgaaaccacacaggaagacagatgagttccctggaacaggtcactaacgactgctgggacaagtcagtgaagtgttcagacgaatccacccaagtcaagtgcctggtgagtcacaaaacatcaatcacttgcagactccaaacctctgcagcctccctcccctttggcagacaacctataacttactttatcaaaaagatggaagctacagctatacctccagtgctctcatggcctcaatctttttaataaagtaggtgtacatattctttgagagaagtggtgttagttgctcagtcgtgtctgactctttgcaaccccatggaaggtagcctaccaggctcctctgtccatgggatttcccaggcaagaatactggagtgggttctcatttctttctccaggggaccttcctgacccagggactgaacccagatttcctgcattggcatcagattctttaccatctaagccatcagagaagccctgagatgagtgagagaggcaaagaaaaaaaaagggaaggagctatttctgcatctcacctctcagcctttcacccaagtctggattagaaaggatgagaaaccatttttatatttttaagtatagtctatggcccacctctactggaatcatcagaagcgtctggtaaagatgcagcccagaaccactgaatcagtctcagagacagggttcagacaccacatttctgataaactacttcaacaattctggtacagaaagaagaatggaaatcagagctctcaccatcacactccgttcttgatcctctccataccgact

SEQ ID NO: 64239 - DNA, 2637 bp, Bovine  19866881160446
ttgtcttaatttgctttccctgaagacctgtgatgtgaaacatatttttatatgcttttttgccatctgtatatcttcttccatgaggtatctgttcaaatctttggcccatgttttaatcaggttgtccattttccagttgctgagttttaaagatacttttggtgtatgttggatagcaatcctttgtcagatatgtaaatattttctttgcaaatattttctcccagtctgtggtttgttctttctttccctctacattgtctttcacagagcgaaatttttaattttaatgaaattcagtgcatcagttgtttccttcacagactgaacctttggtgttatatctgaaaagtcactgacatacctaaggtcatctaggtgttctcctaggtacttgcctaagaattttgtagttttatgttttatatttaggtctttgagatccagcttgagttaatttttgtgaagtgtgtaagttgtatgactggattaatatttttgcatgtggatgtccagttgtcccagtactgtttattgaaaagattatcattgctccatagtagtgcctttgtcgaagatcaattggctgtattttgagatctgttcctgggctctcttactgcccactgatctctttgtgtgttctttcaccagttacttcctgtaactttacagtaagtcttgaagtccgctagtgtcagtcttccaacttcattcttcgtcagtgttgagttggctattctatttattctacatataaactagtatatgttatttccaaataataatttgctgagattttgattgggattacattgaatctgtaaatcaaggtggaaagaactgacatcttgacaaaattgagtcttgccgttcatgaacatggaatatctctcttgccgttcatgaacatggaatatctctccatttcattctttgattttttttatctgagttttacagtttcctcatacatcttctacatatttcattagatttataatttaagtatttcattttggggggttgctaatgtaaatggtaatgtgcttttaatttccaattccgttttttcattactggtatctgcttaactttttaagtgattaatggatgcctggaacttgacctacatatatattcagaaatgttttgccacctgagacctgtgaggaggtaagctttgtggttcaatctgttattagtatttgggaggtggagggagtatgtggaagctattaggtgtttaatttcaatttattatacttttatcaaattctaactattttgtctgtattatggtggagggcaggagtaagaaaaagaaaattcatgtaaacatccatgtctttctcccaagtatctattcagagtaaaaggtgaaaagaatagataccatctttcaaaacagttcagtatgaaaagtttaagaggaaaagaagatcgtctgtccttggcacagatcttactatgttgccctcaagtctgttgctgtcataaagaaaaccactttatattgaaattgtataataagattatttgattgttatatttgctatttatgtatgtatagtctaaatgctacctatttcaggaaagaatttaaggaactcaataaaatttaattggcatagtaataggcacatatacagttaaccaaaatgaaaaccagatgccctctagagaaaaaagatcatttgtttaaaaagtagaactgattagacaattattcaaatagatttctggcttcttggtagccaagtcaaaaaaggtaaatttatttggctcaaagtatataaccaaaataaaatttgatctgttccataaaaataatgtcggggacttctctggtggtccagtggttaagactccacactttgaatgctggagacatgggttcaatccctggtcagggaactaagatcccacatgcctcagggcacactctccccccccaaaaatgacatgtcaagttttagattactaaaacacatttggcactaattagtacttttaaataattatgcgttgatacgtgactatctcagccagtagtcacggttaaaagcagtgtctttaggggcaacagactgtttccaccaattcagtttatgatgaggattatccaataaagggagactttctctcactgaatttatgacataaatggtttaaaagaagaagaaaagagaaacaaaagaagctatgagatactggacagcatccccaaaagttgttgggcagatgttgagacattctatatgttgtggtatctgatggtagtgttcagctgtagaaaaccaggctaaagtgctgtgtcctcttgctctgatacaaagagaggctgtaggagcttggaaggatgggatttacaacacttcctgggctgtttccttcagtgatacccactccttcacccccatgccactgatggcagtgagcgctagttgtcgtggatagagacacagttttctggcttttttgatctcagtccttagaaaactgtattttaactctaacccataaaaataaaagtttcataacagttaaccttgccacatataatatcccagaatattttctgttctgagatatattttctgggttgtttttttgtatgtttttcatgtaggt

SEQ ID NO: 64240 - DNA, 1129 bp, Bovine  19866881211313
gttatttccacatcttcctcccagttccctcaggagagtgggcattgcctctgtgatgttccttcctctacccaagcatttagagggtgcttggaaatccagctggcactttatacacatttgacgagtcaattaacagatatacatggagctggagtattgatcatattgccattcatagccttgatgacagcccaggaagtggtaaggagagaacaggataagacgaggggcagggtgggacttccctggtggtccagtggctaagactccacactcccaatgcagggggctcaggttcaatccctggtcagggaacgagatcccacatgctgtaacttaagatcctgcatgccacaattaagacccagcgcaaccaaacaaacaaataaaagatgggggtcaaggaggctgcagtgggggcagaggctgagacgtgttcggttgccctgggccctgcccagcatgggggtcttggccgccagcttctagctacagcctcgaggtattttacatgttccattccaggtggaaagactagatgtgtgtccaggtgcggggtggatcttattcttcagcaagacttgaagtctactgtgaagtcttactggtctagaggatctgaggggccaaatccccccacaagctgtgaggagggaggttgctgccatgcccacctgctcagcctgtgggctggggctcctgtggagagctcatgcataaagaaaagcatcatgctccatggcaatactgtgtgatgcatatgcgcccgcctttctggaggacctgcccggacccatctacctcaatgacctgtgactcttgctgttcaatgtcatctcaaatttgctgggcaacgggaggcgaggtccttggcccctctgggccacagttccatctgagtacaagaagaaataaagatttttgtgaaatgttggctgcgtttgaactaagagaatatttctctcagagggatttcttttcttctagaaggagagaaccataaaaggactatcccccaaccctcccacccccgccctggtttggccaactatctgagcaaaagaaacaactagaaatccatctccaacacgaaattcatcaccctagaggaatttcaacatgtcat

SEQ ID NO: 64241 - DNA, 1018 bp, Bovine  19866881307202
tttgactatatgaacctttgttggcaagcatggtcactgcaaaaatgatggggaattctataaaggggagagccaaagaagggagcctttaaagtctgtatataatctctgtccaaacttccaagctggttgacaggtccagattatagctaaggatataacaactgaattgagatttcagctgtcaccaggagagaagtgtttgtagtggtctgaatccaatcaaattaaacaataaaccaaacaaaaaaaatcaaccctcctatgtcagacgtattgggggtggaggtggggtgttaacatgtagattcctaggcccacaaatcaacagcatcagaatctcctgagcggagggcctcaactccgtgcttctaacaagcatcctcaatgattcaagcatagagctccagcctcgctgtttctagagctgacgcagtccgcaactcatgctcagatgtttgctgaaaagactgcacctgaagatgcaatgtctgtctgccaagagaaatgtgtcagctacccacatttttggtgctgggcacatgaagctgtgaagtcatgtggagacacagagatgcttccctccttcagatcatcactgaaaacttttatggtctgtcccatcacacagggacaggacagctgcccctcagtagtctcccacaggtcagcacaaggcctcccgcctccaccagcttttcctctttggatcccacccaccccatggaaagcagcatgttcaagccttgaatagatgtaagttaaagatgtgttggggtttccataagtcagcagagatatagcaagctggttggcactgctgctgctgctgctaagtcgcttcagtcatgtccgaaggtgaaataccagtcattcgtgtctggcgtcttggtcacaatatttaatcgcttccactgctgtaacttccagctataaaaacattcacaagttaaaaactaggctatagctcatcaggaacacaacaaacgcagcagtaatgtttgtaatgcacctatcc

SEQ ID NO: 64242 - DNA, 1043 bp, Bovine  19866881847956
ctgatttggtgggggaggggaagctggtagaaagtaaagggtagaaaattaacagaaacctctaattgcctaggtttgctgcctggggtatttctgcagtatctctgcggcaggcagcactgtcagtgttttctgacctgacagtggatgaagacccagcaaaagaagcaattaatacttccttccatccccattttatagacagcatctatcatcctgccttagaaaaaaataatggcttgagaattaactttcctagtttctttttccaaaatgtccctttttacctggggtttccctgggctttcctggtggctcagctggtaaagaatccacccacaatgtgggagacctggattcaatccctgggttgggaagatcccatggagaagaaaatggctacccactccagtgtcctggccttgagaattccatggactgtatagtccatgggattgcaaacagttggacagaactgagcaactttcactttcacagctctccattcatttccaggaaacacaaaatggaatgttcataatgatttaattttcttagaatcccaagaaagttaactttatatgttttcatgtttagtagcagggaagggttaacagagaaaaagataattgaaatattttgtccagtaactttgtatgcataatatgcacaggactttatatacaaattctcacccctgcaattctaatgagaaacctcagtcacatcctgtatacatgttaaaatagatatggtcctgaaatgggctggcctaataatgagtatacggtacaatcacaggttaaatgtgttctcccatctaacaaggaaagtgagtgaagagagtgtgagagagagagagagagaaaaaaagagggtccctgagctaattttctagccatcagtcagactattgttcctactaaaagagattgaaagagagagtgagagtgagagttattataataaatataaagtagctttagccacgggaaattacacttggaaggtcaggggggagaatcagagaaggatgatgaagg

SEQ ID NO: 64243 - DNA, 755 bp, Bovine  19866882003960
atctggtgtcctgccccttccagacaccgggcagcctgcagcctcctctcacctgcggacatcagtcctccacgcaggctcctgggtgtgcccaccacagcccagcccagcacacccaccctgcccgctgcccccgttcacactcttgtcccaggcctggtatccttctagcgttcagatctggcttggaaaaccctagggggctcttcctctctctcatttcctacagtcccttattttctgtcccatttatcattaaacaattagtcatgtcctacttctggctgccttgatcggctatgaaagacacacacttaactcttcagctgcccctgcctaacgattccagctagacccgcagtgctcttatcgtgtgcatctctccgcctcgcccagcattgagcagagtgggatgcacacggaaggtgccggaaaggcagcatgccaccctcctccactttaaaatggggggatatatgaataaaagaaggcaaaggcctctgggagagtttgagtgccctgggaaccagaggaggcacagggacagtcattcaacctctgctgtcctccaaaccacctaaaacgaggtctccagtttgtggcttctgtgttttatataaatctggcctcattacacctgattaaatatattgccaattctatttaaatagaggttacgacatccagacattctcctcatccaaagacgctgaaatgcttctatattctgactctcatccgagaccctcatgtga

SEQ ID NO: 64244 - DNA, 1519 bp, Bovine  19866880912795
gcagcatatcacgcagaagagaaccagatgcaaacacagtgagaactgactttatattcataccacatgctaatattttagatttcagtgctgtcttttctcagtgtaaatagtccacactcctggcctcatgttgagcaacacacctgacaggagaaagaaaatccggaggcagatgatctgctgcattgctcatagcacttgctctgtgggaaagctgcgctcattttgaactctgctgtgcatgagaagacaaaccccataacctgtggtaagccgaaaaacacacaaaattaaccttgataggccaataatggagaaaccaatcaaaagacaacatattagccagtacactaactctgattaattcaccacacttttctctaacaaggcatttatggtccttgttaaagtaactggcctgcttttgttcctctaaattcacacttataaagctagtctatttttaaaacattttatatattcttttccaaatgtcattttggcagtcttctatgagtttttatagaacacttatttttttcctagttcttcataactaaactttgcatgttattaaagaattattaatattattatttactaataggataatagtatgatatgttttattattactaatactacttttaaaataaatggttgttattaaagaaccatctcaacataataactatcctattctataataggtcaacataaggggagtctacagtctcatttcctaaattacacattcatgaacttctttcatattcataattcttccttacatcaaacctaaattggtcctattataaattaaaaaccattttctctgggtcattggaaataggcaacagctggttgcattttctgtacagtgaaattaagggtgaaattgttagagagacatttaaatttagcagatgacacatgaatcgggaagactggagatcccaagtagtcactgtcttatccttcaagttaatgcctaaataacttcaggaagattaacaattattttctagaagaacacttaaagcattactaaactatataggtctttgttgccaggacataacagtaaagtgagtattaaaaattatactatgcaactctctgtgtttttattattagcattttattcacctgagcattcattgactcaatggtctgttccttaacaactcaaggtatcaaatcaactagaatatggattataatttttaataagacaataaagtaatggcatttattgatagtatttttctgtttttaatgatatattaattgcatttctaaataactaatatatattaaagttaaaatttatttaacaaacacaaacactgcagtcatcatgtatgaggaataattataaatgtacttaaaatattagctcatgtaatcttattataaccctttaagataaattatattatcttaagtttagagtccagggggtgtgtcaaggtaacagtgcttataggtgggtattggtacctgggatatttaa

SEQ ID NO: 64245 - DNA, 2253 bp, Bovine  19866880944441
tttgtgaaaaagttttctttttattgaactgctgaaacaaaagccacatttcagattctcaggcttttacactagcaaacataaaattattttagtacaataaaactttttaaactgttttggtatgttagtaaattaacaattttgtctttagtccaagggaaaaaaatcagcagttttaatatatttataacaaaatctctaagattttagactatttcttaaggcaatgcaaatgccccctgccaccccacactgagatcagacacactttcctaacaaccttgaaatgttctactataaatatttattaatatttcgagaggagtcatattttactagtggtagattttaaaccagtctacaaatgcacttttacttgaactcagctgggagcttcaggagatataatcaatataactgcactataattgaattgcaaaaaaaaaaaaagaaagaaatactgaataacacaatttgatccaaaagagttctttttaagggaaaactttttagagtatgatgggaagtgaaacttctagaatggcttgattattttttaattacatagcaatctggaagtcctatgtctaaatgcagagaatgccttgggcttccccaggcagagattgtattgatttctgcatcaggccctgaacagatggatgtgggtcatagtatcttatgccagaaatcaatgccatttgactccatcactttccaagcaataaatattctgttgtaactggtgctattattttagtgccatctatatttaaattctaaacacaatgtcaacctattaaatattctgtattctattcccacaagaaagtaaatgaaagagatgattaaaaaaaagaaagaaagaaagaaaggcagggctgccagcatcagtatagaaattatattttaaaaaagctcttttctctattcctatcaaatttcagctcaagagtgttatagtaaagatgcctaagaaaacctctggacaatgacatcaggaaatgttccagatgaaaatatatctaatgtgcattccatctggtgcttgcctgaaagcagacttcagagagaacgagaatatagcccagctgctttctcaagtggcacccaaaggaccttctgtatcctccactgttaccccacgcttgaatgaatcttttactcaggcatgatttctgttatcagaaatcagagatctttgatttatggtacattaatttatgaccccagcagagaccagtaacttttagcctctgttcttgtaagacttaataaataccttccttgttaataaccatgttcaagaaagaagtgctctcttagcaaagagaatttctcaaggaatttgttttactttttgaaaactttgattttgttttgtgtctcttttgaaatgatagaatttgtgattgaggatgacctgtaactttccatttccattcactttctcctttgtcttagaaataacagaacaagatggctgagtcctcatgtatattttgtcttcttttaatacctcttgaattcctgaaaatgcatcctatattgaaaaccaaataaggataggaaatgttttgaatgacatatagatagaaagggactggaggaattattgccagaccacattttgtatattttacttcatatgattatgagtctgtagcatctatgaaacttggaagcttaggtctcaaattctgttcaaataaccacaaagttcaaaattaaaacaaataaacacactatctgagcttctgcccgtcactgacttgcaaatatgaaatgtgtataaagtatataaaccatgcatgctgttgcaaaatatgctttgtttaatattaaaaccggtagctaacacgcatgggatgtttacagcagatactttctaagctctttatgtaactaatgtcatttattctgtgaaagtaataaatactcctaatctacaaatgttactttatagttgggatacaaaggggtcaaatactttgtccagctcaccataactgtatgcagttagaaatggggatccattttggacatgtaggcttttgaaagtgaacaattaaatagacttaaattccagcctctaggtttaaattttcagtctcaaaaatgatccaaagttatgcaaattaaattacagagaacctctattcattcccaccagatgtgagaaccccttgaatcatttctttgaaacttctgaatttttataaattccaaagctgttattcttacaaagtt

SEQ ID NO: 64246 - DNA, 1659 bp, Bovine  19866881301738
tatttggggcaatgtcacctaggaattaagggaaagaggactctagcagatgggctaaacatttatactgaccagccacatgaggtagtgccctcctgcagaccaatggtgctcattaacatattaatatgtctgaggatttctgtgccaaagatgaggatttactgtgtttattccagcatttctcaggggtatttagcgacagaattcttagtcttggtgtatatgtgggcattttgaaacatattttggaaatattggaataaattgttgtcaataacaaatattgaaattaaggaagagatttttatcagccagagtgctgataaaagactttgaaaataccattcaagagcatttccattaatctgtgtttcactgcatgaaaagctagtgtgatagttggtgctattttcctgtagggaaaagggatccaacacttgccaagatttttccacagggggtctttaactaaataactgccaaaaaagacactccttgtgggagtttggggggcgtgattaaaatccagctttaactgctgctttttaagaacaatgttcttttcaaggacaaagctagtgaacattgtcagtacctttactgggcttttatggaaacatcattcactgatagaaaataattttagatatgaagaggagacagttgaaaaattaatcttcactttgtgagaagtctacttttcttgatttctgcttaatttgtgagtgattgatgaattcgtttttacttttcaaggaaaaaaagtaggcctttcttaattgagaaagttttgattgcatgttcacttgacaacttagggaaagttttgtttttatcagaatactaattctctacttttagctatgttgtttctagtaatcttctaatatgtacttacattcaaaagcatgtaaaagaagggccttttaaaatttgactttcatttaaaaaaattaaacataacaagagaaccaagagtttttttgtaagtgtggatagttattttgattttcaaattgcagatgttattgaaaactactttagaaaatttcttcattttcttttctttactgtctgtacttttcaagactattggctcatgtacttggcatgaatataaacaacataaggacaaccaaaggaaattaatccatcacagttctaatttcaatttgctatttttgtcattcacatttttgccatctggaaaattttccatcactagctaaaaatctgatacccattttcaaatactttggagttttatagacagccacaatgtaattttattctcattgtatatggcattatttagtatgctttaaagaaatctgctaattttaatgaatatataaaacatactacatacatatgtgtatgttaaaagattgatatttgtatttatgtgaaattaaaaaatcaggaaaatagctataaagatacggacttgagttatattaattttgcatgaatatccttgcaaaatataaaaaaaattaatttcatataatatgttctcttattatgactagtaaaattgttgttatgaatattcatgtagttttaaaacctaacgttaggcgtattaaataagtagatatttacaaattgattagaaaaattttaataacataattttaactgttttaacatttt

SEQ ID NO: 64247 - DNA, 1299 bp, Bovine  19866880166503
gaaggactgatgctgaagctgaaactccaatgctttggccacctgatgtgaagaactgactcattggaaaagaccctgatgctggaaaagattgagggaaggaggagaaggataagatggttggatggcatcaccctctcgatgtgcatgagtttgagcaagctccaggagttggtgatggacagggaagcctggtgtgctgcagtccatggtattgcaaagagtcagacatgactgagggactgaactgaactaaactgatgttatctaccatcatctatatataccgtatatgacatatactataatctgtatataccctatatgatatgccataatctccattcctttagtctacttttgtctttatatttaaagtggttttcttgtacacaacagataattgagttttgtgtttttaatccactctgacagtctctgtcttttaattggtgtatttagaccattgatattgaaattgattactgataattgattacattatatagtaggattaatatccacctgactttatacttttcactattcattgcccatatctttgtcactattttatctttcactcctcttctaacttttggttttaactatgcattttatatgattccattttctatcctttcttagcatagcaattatacctctttaaaaatttttttaaactgtttgccctagagatggcaatatacatgtctaaccaatccatgttcagtgtcaaataacactataccacatcacaaatagcacaagcaccttaaaataacaaaatattcctaattcttctctctggtcttttgtatcattgctgtaattcatttcactcatacatactcttcaatcttcaaatacattggtgctattattgttttaataaattgttgtatgttagatcaacttagaataagagaaatatatttttattttcttgccatttattcctccttcagtgctcttccagtctttatgtagatccaaatttctgatatataattttcctcctctgaagaactttaaacatttcttacaaatcaggattcctggtgatagatttcctcaatttttgcttgttaaggaagtacttatttctccttcactcagaagaataatttcagtagatacagaattctaatttggtgttgctatttctttcaagattttaattatttcattccattctcttcttgcttgtatgctttcaaaggagatgtctgatataattcttaccctagtgcctctatgagtaaaataaaatctctttgccttatttcaagattttct

SEQ ID NO: 64248 - DNA, 2700 bp, Bovine  19866880404281
tgcaggtaccttggtttccccagggtgtgacacacttatcaaaacagggataaatcagttgattcattaagctgatcatcatttgacagcacacaataaattcaaagaccaacccgtgcaggaaagtcaggttgtaaaaatgaatctgtcttacacacccacgtgtctttcctgtgcagctgttttggggactatacagcagtttaatttacgaggactcagagaaccttttcaaaaatctgcctggaatttcatcctccgggccaatgacgtcctgtgcttcttctaaggaagttcaagtcactcagatggagaatcttcttcaacagccttaaattagccttggccctccgttcctatgggttcatcatcataactacctaatgagttttgggggaaacaaaaatctcaggccacacttgttgagattcccataggggatttgggggtagagaccagacatttatcatttttcaagttttctagggcattacaatcaggcttccctggtgcctcagcagtagagaatccacctggctttccaggcggtgctagtggtaaagaacgtgcttgccaatgcaggcaacataagagatgtgagtttgatccctgggtcaggaagaccctctggaggagggcatgacaagccactccagtaatcctgcctggggaaatcccatggaccaaggagcccggcaggctgcaggccacagggtcacaaagagtcagacacgactgagcaactaaacaacaagaacgacaaacaggagattataatcattagaattagaagccgctggtctctctcaatcatctgttatttgacagaagcgcaggaggtgaggtctgggattacccagtctcccctgagatgccgctttaccgaggactcttccctcatccacaaggggtgggtcttgacccacggagttttagtgccggactttcttccaggccatggagatttgaccaagggaaggattgtggcataacccgggccaacttttttctcttattttatttaaattgaatcactgaaagagctggagcaggggacacagaggagtagaatctcggaggcccacgtgacactgctgggttcctaagataaccctggttcccacctttcctgatgcccatgctgttcaacttcccttgaattctgcaaaacactctgcattacccactgggtggcttaaaacaattggaatttattgtctcccagctctggtggccagaaacataccatcaaggtgtcggcaggcttggttccttctgatggctctgagggaaaacccttcccctgtgtctctcccggtttctggtggctgcctgcaatgcatggcatgttcatggggtcccgtttcctacagctcgcacgtacacaccgtctcctggctgccacgggacaccggcgtttcccccatcctcctccacgggagtctttatttccctagccagccccggcgcgtgtggtctgtggtatcttctccacctcagagaaggctgatcctgctgggcacagtggtcattctcacgtgtggggtccctctcgggtctctctgtcccctgcctccacaagccctcccacatgtgcagaaacttgtctcccacaggaagaaagaccagcgagagggcttatcccagggaggggagtagatttccttttttattggacatacttcttttgttgctgattttaaaataatttcaaacatacagaagcatttcaagaatagaagaaactccccgaacagtgtgagagtaagtgactgatatagtaccccatcacccctcaatgctttagtttgtaatttgtacaaacaagaacgttctcctatgcaaaatggccaccatcaaaatcaggaagttaacagtgaaaccctcataccctgtaatccatagatttcatgcaagcactttttctctatgatcacatattgaatcttctttgatggctttccttgatgttagctactcaagggaaaatacagtttatctttatttaaaatgtgcccttcacgttgttcttgagcaaataaggtgagagtttcccagaacaggtgggaacacacgagtaagggtggaacataagcattgtctctgatctcagggctccatggaaggaagtttgggctgggacccctggagaaggactcgagtcctccaccccccactcagttgctttccctttttatacagcaagcatttgcgtggccttccaacggggacacaatgcctgcctgagcatcaggcagtccgaagttaggtggcagctgttcagggagcgagtctgcagtgcctgctgccagcacctgttgacctggggggaagttgcctttggacacagcccctcctgctgggggtggggaagttctggacccattcagattgttgccaggcaacctaagtcttcagggtcagacagtcctgtttgtctttccacaagtatatagacagtttgtaaagaaaacctatcttaagtaaagcttagattgttgagggaacattgcatgcgtgtgcccagtcatgtctgactcttttgcaaccccatggactgtagcctgccaggctcctctctccatgggattctccaggcaagaatgctggagtgggttgccatgtcctcctccaggggatcttcccgatcctgggagcctgtgtctcctgcatcttcctgcattgcagacagattcttta

SEQ ID NO: 64249 - DNA, 1684 bp, Bovine  19866880442371
ctcttgcctgtatctaaagaagctacaaggtcggtcacctggtgaaatcgccatgattcaagccatcaggacggattctccccagcatcttgggattgaagcagagagcttgtcaagcctccagacctctaggatggaagaggagctcaaacgagctcaccagaaaggaggaggccagtgagagtgttagaatctttttagaattttaaggcgccatagcacccagagcagccaggaagtcagaacacatcaaatctttattttcagttccagttttgttaacaaggtgagaatctctttttcgtgcacttttctctaggtgtaaaatttgtcatgctcccaaataacctacgaatttctccctgcctgttctgtcatttaaaaagaattatgttcgtgcctttatcatatcttcactggcatccaggccagtgatgagagaaccataaaaagaatgtcatgacttactttaaattaaagaaatactcttcaaaaaggtattttcaagtcactgcagataggaccggatagccttgtttcaggtacaacaaagtgaactccgggagaaagtgagatggccttcatttgctcttgccctcactagagctggataccacttccctcaccccatcgcttcatccctcctgttctttccttccccacgaaggtaggtaggaacaggaccctagacaatagagttactctgtagcacaggagtggtcaacaggtttagacatcactgcaattttcattgtcttttcagtgattaattcatttatatccttgactgtatatattgcaggagtattcatgcctggcagccttttttggactaatcaatgagctgggtcaggcttttttcttcttcttttctctcttgaggagccattacaatttaatcaccttgctaagatcacaatgaagaagaggctcttgacacaccagtattatccagaagaagcatatggcaagaacaaggacttctataaatttagacccagacagtatatggatctagaacaatactatccaagaaaaatataaggtaagtcacagaagaaatttaaaatttctggtaacgtcattaacaacagaaaaaggaatcaaatgcaattcattttaacatattttagttcacaatgcatttctaaaacattactatttccacatatatcaatgaaacaatgctaattaaatctttgtgggtttttttgcattaaatctgtgaaatctggtgtctttcatacttatattaaatctcaatttggacttaaattcaatctcacattttttcagtagccacatagagccagtggctacccagtcacacagcctgaatgcacaatatttatctgctccaaataactatacaacctcagtcatttatttgctgctctgggtacatgaatgactgtacttagtaatggtgtggagtctcccccagaaaattctgcctcccctgtcctctccactatccattctgaagcagaatttagggacttccctggtagtcttgtagctaaaacccagttcaatccctggtcaaggaactagtgcccacaactaagatcctgcctgctgcaactaagacccaatatagccaaataaatattttttagccataatttaaaacaaggcttagaattcagttgctgctaagtcacatcagtcgtgtccgactctg

SEQ ID NO: 64250 - DNA, 1936 bp, Bovine  19866880471102
cctggtggctctcagacaataaaagaatctgcctgcaatgcgggaaacctgggctcgatcgctgggttgggaagatcgcccggaggagggcctggcaatccactccagtattcttggctggagaatcccatggacagaggagcctggtgggctacactcccatggggttgcacagagtcagacacgacctagtgactaagcactgaagaggggaatggcacttccctttgttgtaatcagctgtgtcttgagacagcattcggcaggaccagggcatctttgtctgcttgcaccgagttacactaaattgatttgcactgatcagtccagttgcggcagcggtcagtgtacaaggggcgtcacacacgtgctttgccgtcaccttctctgcgtggcagtgagtgattccccagacatacagctcgcggaggtcaaagagtctcttgattccacctttttttgtttttacttatggtggattttctgacaggaaatgggaatttggttgataattaccaggcgtagagataaggtttcctcattaaagtctcataaaaccatgaaaataaatcattgccagtggagagagaaagaaaatcttctgtttagacttttccatgaccgtttaggccaattctttttccccttccagcccggtgactttatatccagctagcgtagggcctgataatcacaggaaagaatgtagaggcctctcagaccttttctgatttcaagttaatggcttggtatgtcaaggacaggctgagcctggcagaataaattatgaaagtgcagctgaagaaacacagtggaggaaacccacatcatacacgtctgcagatacaatacagacataaataaatcctaccatttcagggaaatcgaaggggtccgtttggcctgccctggagatcaaagctggtaggagtcatggagtggctgacagtcccaaaggcgactcccctagaaatgggatcagaccgccctttcctgattccccctctatcaaagccgggtcttagggaccctgatgcaactcagtttctcccaggatttcctcttcaggaattccccaactcggccacaaacccaagagctttccaactatcctgccataattttctctggccccaagttccagctttaggggcactttgctttcagcagagttgatgtgatcagctgatgagaacaatggtgtgaccgggtcactagatgataacagtggctttcaggcttcctgaccaatacctgaccttggttcccagtacagctgtgcctgcagcctgctccctcactggatcgccctatgggagtcgggagagacccaccctaaagtcagctggtaatttcagtctaagggaatccaagttattcataaaccaggtcattaaaatgaagatattgggggcaggtgaccgacgtggagttgcagtgatgaaacctgacaaagtcagacaagccagccccctgccgggtggaccagacacagtacctgaaccaaactcagagctcctttcactctttcctgagagactgaaacacgtcttgggcagtgactgcaaagtaccccaatataagaagcctataagcctatttcctcaccttcagtggcaagtacagcatagtcctgaagctccagctgaaaggctccatgtgtctccagatgtcttggtctgctcgggtcgacattaacaaaataccaggccgggtggcttaaactacagacatttgtttgctcacagttctagaggccagaagtccaaagccatgttctgtttctcgtggggtctctcttcctggcttgcagatggacaccttcctactgtgacctcaagtggccttttctcggcgtgtctgtacagggacagagagagaaagcaagctctctgatgtctcttattataagaacagtaatcctatttgattgaag

SEQ ID NO: 64251 - DNA, 1291 bp, Bovine  19866880484262
gagtaagcgtcttttaatttcatggctgcagtcaccatctgcagtgattttggagcccagaaaaataaagtctgacactgtttccactgtttctccatctatttcccatgaggtcatgggcccagatgccatgatcttcgttttctgaatgttgagttttaagccaactttttcactctcctctttcaccttcatcaagaggctttttagttcctcttcactttctgccataagggtggtgtcatctgcatatctgaggttattgatatttctcccagcaatcttgattccagcttgtgcttcatccagatcagtgtttctcatgatgtactctgcatataagttaaataatcagggtgacaatatacagccttgacgtactcctttccggtcacagctgcccgtgctgaaagagtacaatatagtgtaaacataccttttttgcactggaaaaccaaaaaaaatgtgtgagcctcactttaatgacatcttgtctttattgcggtgatctggaatcaaacctgctttatctccaaggtctgcctgtataatttaaatattagaagagtctcacttcagaactgggtcctttaaaccaagagctttgggttaaggccgtgttcatactacaggacgtgaagaataaaaagggcacatttataaataggctggttgtcaagctcctccctctctggaactttactactgttcttctctgacattttgtcaaattctgatgttaggctctcatgaaagctgttggaacattggaggaagggggacctgtgtagggtgacatgtgcctggcaactgaagcttataaatcaagctgaaacctggtgaatctacaagatttatggctcatgggaaaatatgctaactcaactgcaaattgataccacaccaaactggcctccgtcttcttacataacaccgctcaaattgtcaggccgtctttgggggaatttattgcagcacgttcgatggaaacagagtctctggccacttgactgagccctttcagaccagctcgaaatgatctctgaccagcttgcagaagagatgggcagagcctccaatacacaccttcaaccaaaacagtggaagggatttgaaaaactgaattcacagagtcatcaaaaagcgatggaaatttttgccctgaaatttaatttcatagaaccctttagaatatatacaaagattccacacccctttacttaggaaagcataacctggctttaaaatcttttgaacacgatcataaaggatgacaaattagggaatgttg

SEQ ID NO: 64252 - DNA, 3799 bp, Bovine  19866880566549
gattggagctgcagcttcagcatcaatccttccagtgattattcaggattgatttcctttaggattgactggtttgatctccttgcagtccaagggactctcaagaatcttctccaacaccacagtttgaaagcatcaattctatggtgctcagctttctttatagtccaactctcacatccattgggttcccttgtggctcagttgataaagaatccgcctgcaatgtgggagacctgggtttgatccctggattgggaagatcccctggagaagggaagggctctccactccagtattctggcctggagtgtatccagagaattccatggactgtatagtcaatggaagagtcagacacgactgagcgactttcactctcacatccatacatgactactgtagctttgattatatggaccttgttggcaaagtaatgtctctgcgttttaatatgctgtctaggtttgtcatagcttttcttccaaggagcaagtgtcttttaatttcatggctgcagtcaccatctgcagtgactttgaagcccaagaaaataaagtctgtcactgtttccattgtttccccatctatttgccatgaagtgatggggccagatgcatcactaataatagtaaccaatattatatgacatttactctgtgtgacacagtgtgctaaacttttaccataggttaatttaattttcagagacccctgagaagtttatgtcaacaaacccccatatttagacttactgagccttagaaagacgttgggatagaaagccttctcaggcctgctgacttgtgttcctgcagtggggagtcccagccagagcagctctttcaagaggatgagccgggcttgtgggaaccacactgggaggatttggttggtgttaattttcattcagctacagttgctttacaaggttgtgttaatttctgctgcacatcagactgaatcagctgtatgtttatgtataccgcctcttttttcacctgaggaagagtttacaggaaaggagaaatgggttttagaggatttcaaggctgttaagggtctccaccctctgcccgttaatccatgctgccgtaagacaatgccactagttctggagactggaactccaagaccgaggggttggccgatttgcttcctgcccagggctctcttcctgacttgtagatgacccccttctcacgtgtcctcatatggctcttcgccatcagtgtgtgtggagagggaagaactgttctctattccttctcttattgggattccccggtggctgggcagtaaagaatcggcctgcaatgcaggagatgcaagagacttgggttcgatccctgggtcaggaagatcccctggagaagggaatggccattctccagtattcttgcctggagaatcccatgaatagaggagcctggcgggctacagtccatggggtcgcgagagtcggacatgccttggcaactaaaccaccacctccacctcttcttttaagaccaccagtcctatcagattagggtccacccttatgacctcactgaaccctcatcaactccaaaagacccctgtttacggttggggctttaacatttggatttcagaagggcacagtctgcagcaccccaccaccgctccaggggacaaatatgacacctcctgtgcctagtacgttctctactacctcctggtgagtggcagtttaaaaaaaaaaaggtatcaccagagggactgggttcacctttgtatcaccagagggcttatttcacaatatttggcatttctgtgggcagcgaggtggcgtgcgttccttaaataaggcaaacagtggccctgctggggaggcctgggagcccgtctttccatgccgggaggggtgtgttgcgggcgtgcaggtctgatgtcgtcatgtctcctgtgatgcatttctaaatatacagatacatctagtcgtcagtcatgtcacaaatatttattcctcctgctgtatgccaggcactgtttatgggctttgacaatacgtgataagcagcacagaatactgggctgccttagcggtgtgtcccctgcaggttaactgaccagtcaacagaaacacatagcacagtatctgtgctgagaagaatacagacaggtgaagccattggggaatcgaagtcttgatggggttgggtgctattttagaaaaatggtggaaaagtatcagcaagagccaggaaactatctgagagagaacgttctggacagaggagatgtaatacaaaatacagaggttcactactagatggaatattcttggcaagtactggaagggggatacaggttctgggtcatattgcctgaaaatgctcaaataaatgtttagtgttgctaccattaatgtgattatggtgcagatcaagaaacagaactttttctgcccaaatgtacttgtcggcaattaagttgtaaccaggatcagcttgccacccctctccccttttaaaatcaagattaactgttccattttctgagtcagtcctcagtttatggacactaatggagcgatgctgtgtttctccgagctttccaccaaagtgttatagatgcaaacactgaacccaagaggatgtgtgtgtgtgtgtgtgtgtgtgtatgtgtgtgtgtgtatgaacctaagagggtgtgtgtgtgtgtgtgtgtgtgtgaacccaagaggatgtgtgcgtgtgtgtgtgtgtgtgtgaaccaagagggtgtgtgtgtgtgtgtgtgaacccaagaggatatgtgtgtgtgtgtgtgtatgcatgtgtgcacaggtctttccataaagggaacatttttttgtaatctcttttctccttctggagatccatgccaattttacgttcttctaagtaatacatttgtgcctactttaaaactgaaatactgttttaaatgcccggcctgtgttgtgggtttgcgtaccctcgcccccaggcacattccctggctgcaccagactgagcagctctggagcagagccatgtgtggatgtcatggcccgcatccagcagcagctaatgttacccagggggattagggtgtgggctgggtggttttactgttagtatcctgtaaagtgaaacacaagaatgttcaacttccttccataaattatatataaagtaaaaaccaagaaaatgccgttttcttcccagaatgagcaatgtaaagtgaagcctaagaaaatccaatctcctgtcaggaacgaacagtgaaattgaccctggcgccatcggaagagaatcaccagatagatgatgtagcaacaagcatttacccccaaatcgctttaatttggctttggaacgtgtaatgtgccactcacttttgcaggctcattttccttctagattaggtttgattaaattattatcctgacggtctctgaacatttattataagtggtcataggtgactccagcgtggcacccaggctgctgtactcttccctcccatccctgcgctggccatgctgcctaaggatccttctcgaaaatgtgttctgggagatcattactaattgatgagggttgccatggagatgagacccatttgctgtctctttcatgttaagcatgtatggacctctttggataattgggaaccagatataaataatccaatggccattctttcagctttatgtatttttaataatatacaaacattttttaagttaagaattacactcagttctatttctagaatagtaaatgaaatccaagaaagtttttagtaaaactgaaaatgctactta

SEQ ID NO: 64253 - DNA, 1760 bp, Bovine  19866880644297
tgcggagctcagctgcgtgaggggaaggtttggccggcgttccttcacttgcccggcatctggacctggtttcggtcattttcccctcctattcgtggatttcgtggggaagtgtggtgatgccttcttttcatgtgtgtttacgtttcattcctcagttaattggaagcaccttgaggtcagaggttctgcggatatgtctcctttgaaaaaatacggcagcttttgcgactttcatattttttcccctgattccatcttacagagaaggaaggataactcagtcataattaaataacccagtgataaagtaattcagttttccgctctttgaccttctaactaattccagtgaaaagagctataggactcaataatggtatctctttaaagcaacagaaacgctgaggataactttgaaagctaattgggagatagcctttcaggttattttcaagtgtagttgttgcttctcaaattggaggcatatttgcctccagggaccagggccctcaccgaaggtttctacaacttcaacatcattgtggacagtcttcctagagggtcagttcacctgtacatttggggaagtaatgttgaatggtgttcaatggataacagtttttatcatttttagacaaaagcagtctattagagagtataatccatagcttgtatgaatttcagggagacttcaagacagaatgatttttttcctgcgttttgaaaacctttctgggcatcccatcactcctgtgcaatggaaaatacaatgtagaaatgtctgagatgcattcaggtgcattagaaatgaacagtctacaaatccaaatgctgttgtaataaaagaaaaagcataattttgagaagggtaacttctcattttccccttgcttctccatagttttcttaccagtcaagacatcatatttcaactcttgtcttctaaacagaagactcacgggctctcagtttttctcactttatctttttcttaatcttttctcactcttatctttttccttcttgccttctttggacatcgatgagaagaactgtgggcagaaaaacaatctgtcctacattgcaatatggaaaattgcacatctgcctccttaatttatagtgtcatatccagagtgatctggagaagccttagaatttaattttctttgaataaattgtacaggctgttgtggaataagagagagatgtctgcatcaaggctcaggtggtccagatactaatcctgactttactaccaactctgtgtgaccttgggcaagtcatcctccccacgtgaactctagggttacctgtagtcaaatgattatgtactagatgactttctgtcttctccggcttgaaaatgccattattctgtgttcctgatgctgggaaagattgaaggcaaacggagaagagggcagcagagggtgagatgattggatgacattaccgactcaatggctgtgagtttgagcaaactccaggagatagtgaaggacagggaagcctggcatgctgctgtccgtggggtcacaaagaatcggatatgacttagtgactgaacaaagaatcctatgagaagtgactgatccagaggcgtttgagaattgtaagttatgtatattagccacgctcttcaccttgcgtggatactggtgctcgctaacacttgtagggataccaagtgtatttgttctttaaatatttagtttccttgcctgtactgtgctgcatcaaatccaactttaatt

SEQ ID NO: 64254 - DNA, 1512 bp, Bovine  19866880728199
acttttttttttccctattgaatttaatcatgggatgaagtgtccatataaagtcccagggtggccagagtgcgcatccatttggaaagtatatcacccttttcccgttacctgggaaacaggtggtcaggtgctccatcagtgcttcttgggtgacaggttttcttgctgagttcattgcggagatggccaagcaaaggatttccccaagtgggataaactgagattgactgatgggagacatgctgattggtgatacatcacctgcagaaagacaattaccaagtaagcagttcgttaagacccagccacttgtcacaaacacacacacacacccctccaaacacatacacacacacacacccctcccatgactcacctattccctgtgctgcaaatacaatcaaccctcaaccctgaaatgtgttactgccacagccacgtgcactcaggtggaaagacttgcacagaacagcagaagcttcagctgcctccacaaagaaaacttgcctttaaaacctgagctctcgttggaatagacttactactgaaaggcgtgcaactgtgaagctttttcccaatgatctctgtttttttttaacttggaactgatttgtttaataactgtcatgcacgtctcgacaagtgcacttgtggtaccttgaagattcattcattcaaacgctgggtgctctctgcacatcagcatcttctgggggcttgagaagcaccttggagagtgaataagctccctcccaccaacatctctgccctcaaggagtttctatgtacgtggaggagacagacagacagacgaaaagttccctatgcagaaggctgaacaataatctggggcagagggggagggtgacgaacacacctggaggtgaggatgggactgagacgcaggaagtgagagaaggtttttctgaggtcatgtaacctgaatctggggctgaagtgggagtgtgccagcagcctgcgaggtgcagggctattttctggggagccgcagagaagggggacaactatgagcaaagaactgagtgcccaagggcttcatcctatgagggaattcaaggagtgagagagtcagatgtgaatttcaggaagagacgcccgtggccacgtggaggatgggcctaccatccagcaggacctgtggcctcctgcacacatggatctgaaagagcaggcggaggggccccacatggctctcggggaggtggcaacattcggcacatgtaactgtctcccttgctgcaatcttgtatcacagtgtgattttcaagtcgtgttctgagaaaggatctccagcattccccagagaggcttctgcgggcaggcaggggagccccctgcagagggagaggtggagggcagggaaatccctcctgacatctggggcccacctgttcctcctggggttctgtaaggtctcgcttgagaaaggccgttcagaaagggggtgaggctctcagcagagtatctgtgagctttgaagcttctttt

SEQ ID NO: 64255 - DNA, 2635 bp, Bovine  19866880769974
gggggctgctgtgctctaacctgagacgacccgaacaggctcccaggtccccaggccgcaacagcacaaaagagccctcagtcctggctgaggggaaccgccagtcccggacatgagaagcagacaacgcggtgcacgacacttttcctaccctcaagacatttacagtccacctgggaaactttacaggcattaaaattagccaggtattatgctgctcagagaggcgaagtgacttgctcaagctcacggtggtgaataatttgtggaacaaagcttacagttctttcagtaaatcaaagaaccaagtaatattagtaacagaagctacgcagaggcaaatattggattgaggcagatcaaataatggcattgttaaagccagacaacctctaagaaatctggccagtgacttttttttttaattttaagatttatttatttatttttttgatgtggattgttttaaaaaatctttattgaatctgttacaatactgcttctgttttatgctttgagtttttttttttttttggctgcgaggtctatgggattcccagcttcccaccccctgcattggaagacgaagtcttatctactggactgccaaagaagcccctagccaatgacttttaaattctcatcatcgccagtattaacagatgtacttcaatatccacctactgggctgccttgcagtgagaaaccacgcacgttctcagctgagcagctcatgcttctgataatacaggcctgtgcccccagtgccttcctagataacagaacagcagcatcctcacactcttaaaagcaaaatgatgaagggtttcggtgtgaccctctctctcagaacaagcacagttcctatgttatgaaaacctgctcagtctgtcgccaacttgaggacagaggagtctcccagaccctctccggaggcacaggtaagaaaaaggcagtgaggctgtgctgaagaagagtggagagggtaaaggagggaccacgaccagagctgagtgacacccagacatcccccaggacgccagcggggggcttccctcctacaccaaggaaggtgcttgaagctgtttaccttcaaactccgagctgctaccaagcccagcacccgagtctctgcagcactgtctggggaaccaacttcctcactttaaattgtgagtaggtaccgtacagccttaaagcttcttccttccaggaagaacggcacagttccattcctgcccttctcatgaattctcctcattctttggctttggggtggggttcggggagaccccacaacctttatattccaagatctgaaaggtgatctcagtaaaaaacgcatggtgagcgcccagcagatgtcaccagaggaataaagatgaattctggaaaacgccgggtgagcccactgaccactgaccgccacacggtcccctggtcttaccttcttttggcttcttcatactggaggctcagcctgaccttttcagctaaatttgatctacttctcactccaatctagttaaaaaaaacaaaaggggaagaagtcaattaactctgctaatgaatgaagtaaaactgcttttgtttctaggaagtacgagtaattgaaaagctaaagaagatagtatcgaaattgggaacaccagtttgcaaaggcacttactttcgcgtctcagtggggacaaaacatttctttttaattcaagcttgttgaatttttttcaaagactttaacatcattttctctacacattaaaatcaggattaaaaaaaaattaggtaaatgcttctggtgtctaagagtttatgaagggcgtacaggtcaataaaatttatgaactggaactaatttccttgtctctgtgagccagaatttccatcatttaacttccaaatgcataaacataaataaattacttcaaaaattaatttttcaaacaggtaagcgctactgttgatctctatctgctctactttcatagcacagaattcaaagaacacaaaaattactgggaacttattgaaaagtaaatatctgctaatggtgtcccaaaaggtagactataaactggtaataatattcaaaccacattaaatattttcaagtgccaggtataaaccaccaatcaaacattttaatataatcaacttcagatgtgtaaaaacaagttctttggtttcatttttaaaggcatatatttatgtttttcattagccttaatgtgtatttggaaggaccttaatttccaaggctctaaacttaagaggaaaacttaaattctcacgtgtctcttgtctttcaatagggtctgtgaataaatacagtatgagaaagtttgaaccaagctatttatctggacagattctgatatgcttggcacctaggcagaaaagataaggctaaggtttgtaaatccagtcttatgagtacgaaatgctgcatgcacacagccggaacttgcaccccttttctggcccccgtcccatctgccagtgacgctataatcagggcccttccacacggatgacttacatcgccggagatgctggtttgtgagcctacgtccagggtctgtctggagagggagagacgcgagctcacgggactggatctcaggtctggctcaga

SEQ ID NO: 64256 - DNA, 1517 bp, Bovine  19866880843908
atgaaacgtggacctaaggggcctctcttctgcctaggacttcagccacggacggcgtccccgtcatcagcaccgtcatcaccctgccccacgtgatcgtggaaaacatccctctccacgtgaacgcaggtgcctccactcaccttttatttgatctgcggaatccaaaaagaatatttattttagctgctaagattttttttctaactttccccattacgagaaatgcccaccatttacaaaaagtagattgtgaccagtcttgtttatctatacctctacacgaccctcctgccctcaacattttgaagcaaatgccagaatgttatttcatctatagagatttcagtatgcatctttaacatcactggctgtttttctaaacataatcacagagtcattatgattactaaaaattagcaataattttgcaatatgatcaaattcctgtgttgaaatttccctagctgactctgaatgttcttcatagtttgttataaggcctctgcattgctgttgattggcgttggtgtctagactcttaaaatccctaggcaggcagacagcctctcccccactgcgctgcctctaccccacatcacctcctctacccccttcatctccccccttcgcttccttgatgttcatttgttgaagaaactgtcctcctgtaaagctgcctatagtctggatttgctgacttgcattgcatcatttttaagtatttctctgcccctataaattggtaactgtgcgtgtgtgtgcattcagtcactcagtcatgtcttcgtgactccctgtagtgctccccgccagggtgactccccgccaacctcctctgtccatggcatttcccaggcaagaatactggagcacgttgccatttcctcctccaggggatcttcccgaccctgtgtctcctgcattgcaggcagattctttaccactgtgccacctgggaagcccagttagatctatagtcttgatcaaattcaggttaaagattttgacaaaaatacatcatagtttccaccaaggggcccataatgtctgtcatcccatctcgagccattattgatatttagggaaattttttgtaggtttaagaaattaatcctaaaaggtaattcagctcttggtagccaagaccctttctgagccaaatcagtttagaaggagacattgattcttcttagcctgctttatcatagccctgtggctattttacaatcagagaattttcttatttaacaacagtgcagtgctctcattaatttaaataattccatgtctatggaatgaaatttatttacaaaaggaacccatgaatggtgagctttgttgttttttttaaccaagagaaatgtcacctttgcagatctgccgtcattcgggcgtgtcagagagtcgctacctgtcaggtatcacctgcagaataagactgacttagttcaagatgtcgagatttccgggagcccagcgatgccttcatgttctcaggacttaacaggtacagg

SEQ ID NO: 64257 - DNA, 3030 bp, Bovine  19866880882584
tttcagttccattaggatggctttggcttcactaagttcatagccactctggcctccagacatttttttatcaattctgttaaaagagagggggaaaaaacccaataaaagaatatcagagtacaggctaaacagaccacgggaactgggtgtggggatgttgtggttagctgatgtttactgctggactcacacacagcagcttcagggtggtggtctctcctcctttctcatctgaccgcttcgagatgagacccctaccacccccgacctcatacccagcccactgccatcagcgtcgggctcaggcttcttgtttacagtctggttgggtggtcccaccgctggctgaactcaaacctcatcacacactgatcctggcaaaggtttggggctcgaggaactgattgaacaggaagacagaaatgccagtaaactgggcaagcccaggaaccttgggattcatcgctgccgtctaattttacgtgccgcgacgtctgtgcaaaacctagcacagggcacagtctggtgactgttaataaagggtggcgattttcgcttatactagtgagtatcctataatgcttggattgtttggttagtttcttgtttctttttaaatatatgaaaagtattctatttttatgacaattatgagtcaagataacattgcctgtcttgctgaatgagttaaaatctaggaacaagacgcaagggcagacgtgttcatttgtccgttgatgttgaatcaagagctcgcagtgagcttgccgactagtacttggtaagcagtgctcgcttactgaatgtccacacaattcccagggtcaccctacgtcagaggatttcaggtaactgagaaggggtcacaggacccaaccaaatgacctcattcttaaaaaaaaaaaaaaaaaaggttaaagttcttcatcatcacctatgctgcttgggactcattaggaagaacctgggctttacttcagaaacacactgccacccccctgtcccaccagccaacagtgctgtgacacacggtctcgggcatgtcctgtctaattcccagactctccggagataaggcacctattaaatcacagaaaactgtctctaagctaatttggtttaaaacatttactaatttgtatttatttcaatgtgaagggtacagtctgaaaaaaaaaattaactaacgtcatattatcttattcatgcttttaaagtttactcaaatgagggcggtttgtagataacttatttttacaagtagcactttagaaaatattttatggggctgaacaagtgattaaagtctgaaagaacctaggaaaataaaataaatctcatcataaatcagttctataacatagtatatacaaccgtgccactggatggaccaaagcagaaataacgcctctcttgctggtgtccatctacacataagctacactattgctgagggccaaagtccaacccgggaccacagtctcaaatgactaacacagagaatacaactacattcattcatccagcataaacgatggcaccgggtagaatgacaaccggggcttaaatcggtgcacattccacaaaattattccattttactgtgagtgtgaagttgcaaaatcctacagcgggattctgcttaaatttattcctgaaatatattttcggtcataaccccaagtaagattccctttagtatcaggaacgtgatttcttgaaaaatatggtctctgggtataatcaattatgattcaatcttctggtagtatggtggtaaacatttgaatgaaaacagctttattctgtctatagttaagatgcacgagaggcgtctaacgttagatatggtatctcttctgctcttggttcctcagattagaatcactgcaagagaaagcctgggtttctacaacaaatggctattgttttcttgtggaatgttattgacagattcttaaacatgccttggattcctataaaaattgcttgcaagcaaactgctttgaaacaatatatcattgtttcatcgatataacaaaaacagtaagtttggctaacctttaatcctggtggtgacatgagttataatttcttgtgtcttaaaagtatgtaacgtgtggctaaatgcttcctggtgtttctaccctgacgccctcctgtatgttgatggacaactgactaaacaacacatttagggtaagccaggtctgctcaggttctggggctgcgctgcaacctccacagaggttctctgaacagagctggacctgggaaccatgtgggggggtcttgggatggagaccagacacatgtatttttttttaagagctcctcagattattctaatatgtagtcaggttggagaaccaccagggtgggagcatctaaaagaatctcatggtcatgattacatgaggtgagtgtctgagatgaaagtcatgtggctggtgacggagagaagcgatgggggtcccgaaatacagctcttcaaccaaacacacagaacgatctgctcagatggcccggccagtgaacacgtgggatctttaacggggtgacaccttgctgcctcggatgctgtggaggcagacggaggaagggcgtaaacctgcctggagaggagcccctcgggaagccccggtgcatcctgcctcactgctggggccccatgtggggcagcaggagaggagaaggggactggaagggccgccggatgcctttcaagggacgatggcttcagccctccccgaggccgtgggctgcgtgaaccatcaccgtgtccctgcctcggagatcctggggtgggtgctgcaggagctggatgcctgggtgcacgtcggggcctgggaacagggcagggagccccagtcctccaatctgccctccatcatccacattctcctttgacctggctcagcctgggccccggggtccagcggacttcagcacaaagcaggaaagggcggagggaactcaggggcccggacacgcacttagcccatccacagacacccctgactggct

SEQ ID NO: 64258 - DNA, 4020 bp, Bovine  19866880882970
tggaagctgctctgggcgccttggtagaggtgggtgggagacaagcagtgttcagggaaggtggtctggccacagggtgacctagtgcggagggggtaggggcagtgatgggttattttgggtgcaagctgaaaactgatggcgttttcagcctcggcacttctgggtcatttttgacttcctcctctgacattccctgtttgtctccccggaagttcttcatgttcagggcacagccgactacccagggagcacgtgaaaaacagattccggagctgcattcccggggccgggagcgagcctgggaatctgcattttcagtttgcatcccaggctatcctagtgcaggggaattgaggaccacttttgagaaagctgacctggttagtagtcaggttgtatcaggtttggagcttctttcttctcttctgcctttttgatcagccccttctttctgttttccctgccactgtcctcctggccccctgcctttcctccccgctcactgttctcttccagaccctgctcccattggaacctcagggcaaccccaggcagtccgtccccttcacctggttccagggtctcctgtctctgtccgccactggccttgcaggcacggctctcttcctcttgctgagaaaactgccctgacctccctgctaagtaagtggtggcccctcgcccccatctttgcgaatctgcagcttctgttccccacactgcctagttatgggggatgtgtcagctgtcagcgtgtcagaggagcccaggctttgaatctggcagcgactctcacctccatttttcgtgctgcaaaaccggtcctgcagggtttcctgagataattcccggaaagagacttaagtttaatgcttagtacataggatgtgtttattccaatgttgtttcttcctctttttcttatgtgtcctgaatccccagctggaccaaaacaccctcaatagacaaaaaatgggctttccgttcccctctattctcagcgttgagcttagttggcttgataggtaataataatacagaaagcagtcacagtagtgacagtgggggtaacggtaacagcaaacgtataaagtatttgtgatgtgccagacgttgcatagagcgttactcattgcatcttctcagcagagctttgaggtaggtgctgttctgtacgcgcgatgaggaacgcggggcatggagaggctgcgggacctgcccaagggcacccagctgcccaggcttagaatttgaactcagaacgcctggctgcctccgctgtactcttaatagcactgaagtaagaaaaaagcccactttacatatgtaaaatatgttgaccatacacagaaatagagggatgcatacaatgaattcctatttaggccgcttcagtgatcatcatcatgtcctatcttactttatctgtatccccacccgctcctttgtctccactttgtattattttgagacaaatcctggacatacaccctccctgtaaatacttatgtgtaagtaagtaagtgttagttgctcagttgtgcccgacgctttgcgaccccatggactgcagcccaccaggctcctgtgtccatgagattttccaggcaaggatactggagtgggttgccatttccttctccagggaatcttcctaatccagggatcgaacccgggtctcctgtactgcaggcagattgtttaccgactgaactacaagggaagccttatgtacttataataattatgtatgtatctataaatgacggatttcttagtataatcacaatgcttttatcacacttaaaaatgttatcagttattccttaatctcttcagttttgtgtttaaatttctctgatgattgaattagcttttttttttttttttaacaattcattggttcacatcaggatccaaacaaaaaaatagcccatttttcgtgatgatttttaaagcagaatacccgaagatgcttacttactgagtttaattcagcagatatttatcacatgtctgtgtgttttgcaaggcacaatgcgagggtgatgaaagatattttctgggagctgtcaactggccgtggtgactgataggattcataaatggcagagggcattggcttgttttgcctctaaggttacaagcttggagtgagcgatgcaggagtagaagccttgacggagaaagggaaggtggaagaatgaaacaagcccaggaaaaatgtgatggctctggcttgtggattgtagttagagcttaaaatcatattctgtcctacatgtatatgtctgcattccattcttcttctctgactttccacttgattcttctttcagtggcaacttggaagtcatgatgctggctttgttttccttgaaaaaaatcttgatagaaatttaggggtgagcttcatgacgattgtgtctttgagtaaagtaaataaatgtgtgtgtgtgttgggggaggtggtaaatccacacatttcagtggcataatcccagtggtgacagattcaaggttttaggtatgtgcttttattgttccgtctgactctaatggaggggaaaatgtcttgtcaaaagagaaaagcattcagagaacgggaaacattaaattctgtgaaatatttctgttcgctttgagattattcgtccctttggtttgagggcctttctaacttcaaaagtgatttaccttgagtttgatggaatcgggctttaaaactaggctgagaatcatgtatatgctataaaaatctaccgctgaaacttgctgctacaaacatgtgtgtttcatcaagtagatttaagttggaacaggcataagaaagaaaacagtttgatttgggtgccaactgggagattagaatagcaatttgcttatttcagctgttttattcagtagcacttataaagttgactaatttcctccacaaatagtttgccaacttccattaagaaacaagagattttaggaataaacttttactcttttcctatccaaagaggtggttttcagtttttttttttttttttttaaacgatcaaaactatcacatttttctttggctagagaaattctatttgaattcctgtctgactcatttttcatactcattaaaagttatttataaaactgaatcctgaaactactggatttttggtgagacagttaatccaatgtgctttaaaaaaatttaagtatagttgatttataatttgtgttagcttgattcagttacatatacatgtttttttcagattgttttccattataggttattataagatactgaatagccctgtgttatatagtaagtcattgttgcttatctattgtatgtagagtagtttgtatatattaatctgatactcccactttatccctgcttcttctccttttggaaaccatgtctttcctacatctgtttcagttttgtatatagattgatgtgtattatatcttagattccacacatgagtgatgccatgtaatatttgcctttctttacctgacttagtgtgatcgactctagatccatccatgttgcacgaatggcaatatctcattcgtttatgtggctaaataacattccacacccccaaactacatcttcttaaaccaattgtctattgatgggtgcctgggttgttttcatggcttggttattgtaaatagtttttgcctgaacattggggtacctgtatctttttaaattaaaaatgttgtctttctggatatatgcccaggagtggggttgctgggtcatatggtagttctgtttttagcctttgaaggaccctccgtactgtctgtcctccacagaggctgcacccatttatattcccaccaacagggcaggagggttcccttctctccacaccctcttgtaaactgctgtgaattgaattgaacttcagatctgtaagttattttttaaatattaaaaatattaatctctatattccatattctctgcttgggatgagctgtagaagggcagagagaaaaaag

SEQ ID NO: 64259 - DNA, 716 bp, Bovine  19866880885696
gaggccgggcaccttcccggctccctgtccatcaatagcctttctgcgcgctcgcgatcgccgagccgcggtgccgccgtgcggggtgtcgaccggcagatgccgcatccttggcagccatggctcccgtcgccgccgcggccagtaagtaggagcatgcatgtgtaggggggggggggcacatgcgtgtcggcgcgcgcgcgcacacacacacacacacgcacacacgcacgcacaccaccccgagcctcggaaggaaggaggaagaccgacgaggcgctgcagttgcgaggacgactcgggctcttcgtgaattcggcaggagccggcctggcgcagctgctgactgcaaagcctgccccagatcgtgggcacacgcgcccccaaccccctcacccgagcctctggaatgaagactgcctcccgaggactgcaggggaggcagagccagcccgtgcccgggactgcgggccgcgcggccggtaggcccagggggacacgacttggacgctgtcatccccacgcctcgctctgagctgcccggtgccgagagggtctgccgccgccccctccggcttcccgggcgcccgatcccgggtcaaccccggaggccccggcttcctcatttgtttggggcttttgtgccgggggctcacagttggctaagcactccagcgctgaatcgggccattgtctgcgctcccattgcttccacg

SEQ ID NO: 64260 - DNA, 1387 bp, Bovine  19866881122116
ggtaggcttctctcatagctcagctggtaagaatccgcctgcaatacaggagaccccggttcgactgctggattgggaagatcccctggagaagggaaaggttacccactctagtgttctggcctggagaattccctggattggatagtccatggggtcgcaaagagtcggacactgagcgactttcactttcacttttcactttcaggagagtgtgattaaccttcagtgtactgggtaggagcctgccccacagggaggtccagtgatttagtcccagtcacgttaaggagctgggcagagcgggaacatgatcctcgatgatttacagttctggctcctcgctctgcctcctacggggcttgtatggtgcaagaggacactgactctgattccccttttattctgagctgcaaaacagacttcccgccataaaggaggaaggtaacacaggctcggtggctctccggacaaggaaggctttgttgtggcttctgttcatggcttccccgggagccgtatctcttatgacaactggcaggctcttctctcaccgctaggcactttacagctacagtgccgaaaaccccacaaatccccaactgcaggggacaggtggatgtcaagggcaggggtgtgtgtgcacgtcggagtgtgcactggggtgtccccgtatgtgtaaggagtggaggtggggttgcagagcaagcaggagacaggccagtggttctcaccgacctccatggccagaatgcaaggcacacagtggacacagtctctagccggggacagcaaacttcagagacaggaaagaaaagctcatgactcaggtgacctgcctgtacacagagctggtaaatgcagagatgaaaaagcatctgtattcaggggagtcagacccttctccaaagggcagagatgcacggtgcgctgtggctctttcctctctacggtctgatgccacggctgccactgggcaggagaaacacgatgggaacggacatgctgggtgtgaggatctgagtggggtgctgggggtgcaggctggcaccttctgctgggaagaggctttggggtgcgtgtacctgcttccccgcctgtctcaggagcttctggaagcgctcgtcgtccagcatgcccggcggcaggtccgtctcaccctgggccttcaggtcctcgagcttctgcctcaggcccctgagggcctgcagctcatcgttgaggcgactctgccgggtcaaggaggcctgcaggtccaactccaggtccagggaggtccgcacggggcactcgggcgctgccctccggaggaccggctggcacaccgcctgcggggttagagcacgacaggacagcccccgctgcagcggcggtccctggatgggag

SEQ ID NO: 64261 - DNA, 802 bp, Bovine  19866881125925
gtcagctgtaacaccaatcaaaaaatgaacactgggattctttcaaggtccacttacacacagatttttttttttcctaccaaattcatgccataatactacataatctgtggttaattgaatctgaggctgtggaaccttgaatacaagggccaactgtaaagttacacgtagattttcaacggcagagtggggagtgctgtcggcccccctaaccctcatggtgttcaagagccaacttcatttttctttttcaacatttcttacttagtcacacctgaaaatataagacatctccaggtttaaaaaaagaaatccaccagtgctttgtatcatgagtattgcatctttttttttccctaaaacaagcttgtctaataatcttcattatattagagggagcaaatatagattgaaacatttcattttctctctctctcttttttttcttgtttcctttcctttcacacaggcgggaactcagatcagcctggcggacctacccttttccagtggggttttcactctgtggtataacttgcttccttcaaagcaaatgccctgcaagaagaaagaagaggagactgaggactcggtatttcaaccaagccagccgctcgtggattccgtagacttggtgagtcaagtcttactgagacacttaggtctgcagcccctctgaaattaatctttgtgtaggctttgaggtagaggtcagggtcgtttcttttttttatccatgtgctagccaattgacccaggattatttgttaaaatacatctttccttaacgcactgcagt

SEQ ID NO: 64262 - DNA, 913 bp, Bovine  19866881250955
acccaccgttcaggttcatctctacccgtctcctccatgaatcttcctgtgccagccacgctagatagtccatcggctgtgctccaaaacctcctggatgctctacttcacgtcatcaccctgcacactgcttcactccttggaaaggcatctttgacttttctcttcctccccccatccttacccatcttgcaagtcccttaactgctgcctccttcctgaagcactggccagtggccactgtgcttccttgccatctttctcctgtatcagaaataaccatctttctttgttctcgtggtactctgtccctctttgccttgaatggctcagacgttggtgcaaagctgtgaggagaggatctgtaacttcttcagctttgtactgacctcagtgacaagcagagaggcttacacgttgtatttcataaatgtttgagacattgtatttcataaatgactgttgagttaattacattgaatgagggtaggtttaatacagtattgctatagactagcatttggactgggagtgtggaactggcagatgtaaactgttatacgtaggacagataaacaaccagctccaactgtatagcacagggcactctagtcgatagcctatggtaaaccataatggaaaagaacatttaaaaagaatgtctatatgtgtataattgagtcactttgccgtacagcaaaggttggcacaaaactgtaagtcaactaaacttcaattttagaaaaagaatgtgtctgtaaaaaaacagagcacgcaaaaatccttcttttcacagagctcatgttctccctgatggtagccctttccccattgtccagattctaggatgagctggcccctcccttgaagccattcctgactgtgtcagcccaggttctttctcccagatttt

SEQ ID NO: 64263 - DNA, 884 bp, Bovine  19866881308624
atgtgtgcgccaccaggaaggactctgaagtcagaatgattggccaaagacaaccccgggaaactaatcccatcaccataaaacccaagaccgcaaagccacgtggcagagcagttctcctggtaagttctccttaccctgctgctctctgcctgggtggcttcttccaataaagtgtcttgctttgtcagcacttggctccttggacagttcttttccaagtgttagacaagagcccgctcttggagccctagaggggggacacccccttcctacaacataattgctctcagattttcctatcagatgatgaaggagagttttaaaacctcagcaaatgacagtcaaatgaatttccttttctttctttgtttctctctttctctgtctctctctgcctctttcctttttctttcccttccttctttccttccttccctcttttccttcctctgtcttcctctctctctctctttcttcctttctttatctctgtagcgttattctttgccctccccagactgagagagctgacttgtcatctggacaggtcttagaggagttctgtgattttgctcctgagggtgagtaagaggatctctcctcgcaagggatctgaggcgtgagttcagccccgctctctgccttgcgtgacaggatgctgcgtgcatgcctgccggaatccaggacaccgtcccgcgccctccacttgtaaaatatgtatttcaaactctatgtatctttcagcttaagccttcgtcaaagctgtagccagcatgaagaacttccccggagggcctcgctctaacacttctctctcccacagagaaagtaacctgctgtcaccccactgttcatgctcagctggcagagtgaatctttat

SEQ ID NO: 64264 - DNA, 1497 bp, Bovine  19866881331725
tatgtgtttttaaaaatacttattgcctgtaaatggtcatcatcacctgagccttcagcaaactaattttttactggtggagggtcttgccttgaggttaatggctgcagactggtcaggacggtagttgctgaaggctggggtgactgtgacaatttcttaaaataagacagtagtgaagtttgccccactggttggtttttcctttcacttgaacacttagagggcactgtagggttatcgactggtctaatttcaatattgttgtgtctcagggaatagggaggccagaagagaggaagagagatgggggaacaccagttagtggagcagtcagaacacacacagtatttgtcaattgtttgctgtctgatatgggtgagagtcatgggaccccaaaacaattatagaataacatcaaagaagactgatcaccatcacacacacaacagaaatgaaaagtttgaaatattgggagaattaccaaaatttggtaattcttactttgtgagagacacaaagtgagcagtttttacctgataatgcttcatcaaggatgttctaaatagtcaggtgcttctagactctccaaaaccaaacccattctctagattcaaagctttcaaatgtctgccctgctctgactctggtgagggaaggttggcgtggcctactaggctgaagagagatgcccatccaaaagggactttacagaagtgatgactcaccatctataaaggacactttggagctcatttgcaaacttaacctcaaacaatttttgcagagatgtgtagctgacctgccaattatcattttggggagatggtgaagaacagggaggcctggcctgctgcagtccgtggggttgcagagtcagacacggctgggcgactgaacaacaacaacaatagttttcacaaatgatacttcttcattgcctggagattcgtatatgtatgacactggctgtagcagcagtaggagaggctgaataccacctttataatcctggggtgaatggtatgggcaagatggcaccctcaaagctgtttgaggctgcttgaactaattttgaagaacttattaaaaaaacattgtagcctagactatagaggcaagcgtggggggcagcctagcagctctcagacacaggcaacgaatcccctagaaactcaagtgctatgtgttcatgcttgttctgctaatgacatgatgacaccaagctgtcgtgtctgttcactccactgtacacacagatggtgtactgactgccagaatggtgagctgcaattatatatgtaaaagtgcctgaaatctggcaggcattctataaaccattaactaaatcagagaagagctacatgattccaatttggcttgtgcaaagaccaatataggacttcccaagtgactcgaagaatccacctgcttcatgtcccacctagggtatcaaaaaaaaaaaaaaaagaatccatctgccaatgcaggatgcaa

SEQ ID NO: 64265 - DNA, 1560 bp, Bovine  19866881415571
ctttgacccggccacatattaatagtgataaacacaatggggcattccagtgtctccaaaggatatatctcattactactgcgacactgaatacagtgtttgacagtcatatggaaggctgtggacatgacgatgaaacaattcatggagatggagggtgagcggtaacaacagtcctcacatttaaaatgtcacacttttttaaagagagctaatggagtgcaacctataaaaatctataaaacctataaaaaccgataaaatctcggaattttacaggccgaagaactgaaccaggggccctgctgttccgtgtcccgcatgcactccccttgggcccgcacctggacagcaccggacatgtcagacgtgctgggcggcctggagccctctgattcttacatcgtgtttatcaacaggttttcagcctcaactctggaatagcaggctttgcacaacaggattcttcatttgcaacatttggtctcacggcatactttaaatttctaccttgtttccttctctcaacgcactttgaagtgaaagtgttagtcgctcagtcttgtccaactctttgcaaccccacggaccgtagcccgccaggctcctctgtccatgagatttcccaggcgagaatactggagtgggttgccatttgcttctccaggggatcttcctgactaaagaattttggaaatgtggccgaacacgacttctgagtcagcactgaagacttgacagtggagatccccctttttttggcagggggagtggggtggtggcacaggttggacctttgttgctcagtgagctctttccctgaaagatctgaataaatggcccctgaagattcctgtatcttaacggtggagctgtgtcagcatgataatgctatttggctaaaagactccttacactggagagtaaaacttcttgtaactcaaatattctcgttcacagacaatcctcgtgcatccgataggtaactcagtaaatttatcgaagtagagggaatatagtttaaaaataaatatcaaaaataagtttgccacccaggttctaaccaaaggatatgaaaacaaaaggggtgcgatcaggagttgttctatagattctctaactgcatgacatttatgggttatctacatattcccgtaaagaaaattctacctaataagagagggcagatagctcctgagtgaagacagactcctcaggatgacctaccaggacagcacatttgaccctgagtacattattaaagcaacgcaaataagctttgttcaagaaatgatcccgttcatcaattccattatctgtactcctaatttagagataataaaatatattctgtggagagactggttcaacaattacatgaacatttctgtttacctgcccccatacaaaaaacgttcaatattatgcagtggtcaggttttgagtgagaacccactaacctctcaacatcccccttacaactatctctggagcacggtggttttccctctgtggaggtctaggggccaagagtgccccgtaagagcggaaacgggtgtg

SEQ ID NO: 64266 - DNA, 1052 bp, Bovine  19866881718209
atttacaaatcctgaagtaatttccccttaccttgtgcctttgttttaatatgtgtatctgtcttgtacattttgagctgatgtgtgtgtgtgaagtagaccttatatatctgctttcctttttttcagaaggggtagaagagccagccaaaaaacgagccatagaagggaaaaacaattctgcagttgagcaagatcgtctgaaaattcctgctaaaacatcaggtcagcaggagagcagctcaacctgttcgggttcctcttccaaatcacagagtagtgggaactcagctctgagctccagcaacccgagtcagaatagcagcgccacaagtgatggagagcgggcagttgccagccaaagcagcagcagcactgcctctcaggtgacagcggtagggtctggaaaagcttctgaaccagaagttccagataaacatggttcggcatcatttgtttcttcattgttgaaatccagtgtgaatagtcatgtaacccagtccactgattccagacaacaaagtggatcgccgaaaaagagtgctttggaaggctcgtccacctcagcctctcaaagcgtctcagagattgaggtgcccttattgggctcctcaggaagctcagaagtagagttgccactgttgtcttctaaacctagttcagagacagcttccagcgggttaacttctaaagccagttcagaggcaagtgtttcatcatcggtttctaaaaacagttcgtcatcaggcacatcttcactaacccccaagagcaacacctcagtgaacacaatgctgacttccaaaagcgcttcacaggtagctgcgtcactgttagcttccaagaacagctcccagaccagtggctctctggtctccaaaaacactgcaatagcaagtgtgtcccagctggcttctaagagtagttctcagaccagcacggcacagctgccttccaaaagtacttcacagtcgagtgagagttctgtcaagttctcttgttgcaagttaaccaacgaagatgtgaaacagaaacaaccttttttcaacaga

SEQ ID NO: 64267 - DNA, 1287 bp, Bovine  19866881142559
aaatttatgattgtagtttaattttattgctactgacccctttcttgaaaatgaactggcagatgccattagtaggttaattgatttaataatattcctatgaataagctagcacttctgacttgaatcgctttctcaattgattggtactctataatagtgttctgtaaaacatatagaaggagcaacaaggaactcagctttggattcttcagttaattcattaacgttttcaatttgctaagtgcatggcatttgttactaataattagacacatgcattgcttttacaaaggctctttaaaatgtagtcttgtaaaaatcaccctagaaaaaaagtatgttaatagtctagttgtgtgtttatttttcaaatgccagcaagtagcaccttccagggacttacaggatggaagaaatcagtatcagtcaaggtaagctgcagggcagtcttggttcaggaaaaggagaggaaaggggaatgtcacacagaagctgcaagacaggagctgccaccaatggctccagaggaatgaggagggccactctctgctaatttccagaagtgaaaaaatgtctccatttttcagaaaaaaacaaaaaaaaaaaaaaaaaaaagaagttttataaaataagattgctagtttagagggttaatgaatccattatttgtctgaaaaccaaccggtttctgactaaaatcaatatttatccagagcccaggctgaagttacctatcacctttatagaaaaattcctaagagtgggggattaatctaaagttttattataatcatccctattattaaagttgtattatttaatatttgtagtgaaatgttaaatgtttgacattattgtaaaggactgataatttcttctctttcagtttatgttgaagaaaatagtctgtctgtaatgtgttcctaattctttaatgttcttatttttttttacactcaatagttttatattctgtctaaatgaagtacaagatcattgattttttcagtttttgaaataaggcattaaatattaaatttatttatttatttttgactcaagaaaaacatttattattcttatgttttgacttgttctatagattcttttggatttttttttcttttttttcccttatctgttgtagagtttctgcaaagatgatagtactctcatctctattattctgattggtattgtttaaacgcaaaaatatttattagctgatctcaacataagaccagaaactataaaactcctagaggagagcataggcaaaacact

SEQ ID NO: 64268 - DNA, 978 bp, Bovine  19866881229666
accccacagaatgtataatagcaaaagtagaattgtaacataaactatgaactttgggtgattatgatgtgcctatgcataaattggagaaggcaatggcaacccactccagtacttttgcctggaaaatcccatggacggaggagcctggtgggctgcagtctatagggctgcgaagagtcggaaaggactgagcgacttcattttcactttcatgcactggagaaggaaatggcaactcactccagtgttcttgcctggagaataccaaggaagggggagcctggtgggctgccatctatggggtcacacagagtcggacaagactgaagtgacttagcagcagcagcagcagcatgcataaatcatcagttgtaacaaatgaaccactcttgatgaggatgtccataatgggggaggctatacatgtgtggagaggggggaatatgggaaatctctataccttcccttcgactttgctggaaatctaagacaactgtaaaaagtaaagcaattatagaaaatttacgtgttccttttagctctgtcctaaggtgaaacatttaatatcacacatgaaataaatacctatacaaggtactatataatattcttccaagttttcttgataatagtaaatttgaatcaccctaaaagaacgaatattcataaagaaaatagaaatacagcctcaatttggcagtctgtcacatgtgaaatgaaacttctgaaaagacaggaaaataatagttattgaagcacaaacaaatatgacaccatctatgcaaactacaaatgacagctacttagccatttcactgcttatttttcttactgatcatctttaaagaaattcatatggaatatgcattatatagaaagttaagcaataaagtgattttgttaaaagtctttaacatcatgaaatgaaacctctaaaaaaaaaaaaaaaagaaacctctatcacatttaaataag

SEQ ID NO: 64269 - DNA, 1204 bp, Bovine  19866880397420
tcctctcaccagggccccacctcctggcagctggcggtccccatgatgggtgtcatctgtgggcaccagctcattcacctgcccatccctgcatgcctgcacggctctttttctgtttttaggccacaccgagcagcttgcaggacttcagtgaaagtgcctaaccactggaccaccagggaattccctcttttcactgtctattctccccttggatgacctcaatcacacctatgcttcaacttagaggaggaaatcagctttactgagtagtctgtgcatgaataccaggtgctttattgtctccagtgtggcaggacttgtctggggttcagcttgtgttatctctgacttttcacaaccaagtcgctactactgtttctcttctatagatgatgattctgagctgcaggcaggttaagtaacgcacccacctgagacagagctgggactaaagtctgctcccctgcctccaaagctggagttcttcctcctgtatcgcagtgacaatcgaacgcctcttctttataccattgaactcgagttgaacttagcagaacccttatagattctaaaaacagcagagtctgactttggggtttgaattgaactagaacaaaattttttttgctaactcattcatcagagacacatgccttactctgactttgaggctctgcatgctctgtaattcactgtgattctaaaaattacctctggctccccaggggctctattttagaatctggtgtcctgacaatacaggatgactttaaagtcagagcgggaggatttatttgagagatctctgctcataatagaaattagaaataggcataattgttggcattttcttctgccctgaaagatgacagttacagctcaatcttttctgtgtttaggctctgggacactctagactgccgctgtaacatgggaataatggagctgagaaaatagaatgtggacagttggcagtgcttggtgatttgggtcctaaaactttggcgagcctttggtagagactgcaaatactactttgcagatctgaattactgggggctgaggggggagcccacagggagaatgcctccatcagtctcccatcacatactctgttggaaagcagagtgctcgatggctcttcaacacccgcatacagagcactggaccttctaagagagcagggaaccaagaccctaac

SEQ ID NO: 64270 - DNA, 2807 bp, Bovine  19866880485113
tctagggtgtggtctctaataaatttcattctccctttcttcctccctttccttctctactatctctttccccctttttttccctccctatcaccccctctttgtctctatttttctcctccttctgtcctctaaatagatatgacttgcctgtgcaatgaaacactgttgaaactgagctatcattggaagttcatttatctaaacgcccactagattgtgaggtccttgagatctcaaataatgtcatgctccatgggtgcccaataagtgtttattaagtaagtaaatgaaattgtacctagtaactatgtgagctgagaaacagtaatagaaatagtggtctacaagaaatgtacccaatttacccaagagttggaaaaatgtaggtagtgtgcccaaaaacaccaagaccatgtggaactcagcgtccaccctacaaaaattttaagaaggaaaatgatcttggtgtttatgcccacctaaattaagcataattaatgagataaactacaacaaaagttttctcttaaggcactccaaagcaaagtcagaccaaataatgtttaattgcctgggtgttttattcaaacaacgtcattaacaccacttgaattgcaacttctgggatcataaactttatgtatacctgtcatcaaagtccttgaggggctcctagtttaaatgcgtttcactacacaatgattatatgatattaaagaaaggaatgagttacttttcagttgctgaaggataaaaaaggttgttggtgtgagatgagcaatttatgtatcatgatcaaagagatgcttggctctttgagaatattttatatgtaaatgtaatctcccttcaacacatgtttaagttatgtggcattccactgttaatgctatcagaatcctaatggttctcaaaaaacacaattgtttcaggaccccaattcaaactctacgtgaaatactgatttttaaaaatctgtcagaattgacagccctcacatcctggaaacataaattagacaatttggcttgaagatgaggccagggaggaacgtttctctcatgttattgatggatgtcccaatctgtcttcagattaagcagatacgcttccagtttattcatacagcacatttcacacctcctctgtgtcgtaagtttcaccttcttcttacaacatattgtatcaaaatgcatcactgaaattggttctgttataaactgtttaaaaatgacaaattctaaaattggattagtactgggcactattcataccaaaagatgttgatgaaagatttccatttattgttgcaattactttacaggaaaataaactactatcaggtatgatttttctgtgttaatctcacttccttttgaaagatttggatccctcctccctttaaaagctcattatgattttgcaaaatatatttagtccataatccatttgatatttacaattcaatcacttttaagtattcttagcagttttgtgacaccaattattctaatacaattcaggacagatgttggctaaagtgtcaaaaatttttttcctttgaaaacataagttattatcatttcaaatgtgcccctgagattctttccagaacattcaattctgtgtatattcggttggcaatgctgatccatcatcagtaggaaatgcactgaattattctgctcgctgtgaagaagggtctgtaattaggcatttttgctctctcaaaatcttgtctttgccaaagatgttcagggagcgtagctttctctcagcaatgctacccgaacaatgcagtaactaaattcatcactgaggtcacattggtaccatgctaataacctgagttaccaaatcaagacactttctattttggacactcttctcacaggtgccatcaacagacacccagttaaactggctcggagagaattgtttaaaaaacagttcaaaacagagaactgacgggctcttgggatagctattcagtctgagggcctgaattcactggctccacacagaatgtcagggcaggtgcctcaccctctaatgtcccagcaccgactttctctgacttcattcacgggcaggacttgttcacagtagggtcccagctacaggaggcttacacacaccaattagccacacaggtagaaagagagtgtctctttccagattcctgggcaagactttcatacgtccatctttgaactgattacagagcccgtgggatggacaggacacccttaccggccagggacaggtgagtttcagcaggtgggggtgagtccctcatgaactacgaactgagaacaaaagaagggttgttcccccaaaggaagggtctgtgtgcctgcccaggagacagaggagtagggctgggcccgctggaatgacagccatgcactctgtcctccatggatggcagacgaggaagaccccacgtccttcggggaccctcaagttggtaccaaagaaagcacagcgaagtcccccaacagcagaaagcacacgtggctctccgtgaggatgcaggttctccttccctaagtaattacagaaacgactgagagagtggctgactcttctagccccatttccttgccggtttcataaaattccctggactaggcatcggacataagaggcttcaacagtgatgctcccactgaaacgcccctcagtttaaggttttccagacttaatacacttggggtccactcatttgacctcttaactgagcacgggcataggcagaataataatccgagtggcccagtataattctatccttagaaaaa

SEQ ID NO: 64271 - DNA, 865 bp, Bovine  19866880498973
aggtgaaccttgtgtgtatgtaggttgccttctttgttcacttaatatatcacaagattgtctttatgttacactgttgtatgtggaaacaacagtgccaggtagaaggcaggtgtataatgaataaatgtgtgtgtgtacgcacgctcagtcgtgtccaactctttgcaaccctgtggactatagccctccaggctcctctgtccatgggattctccaggcaagaagactggagtgggttgccatttcctcctccagaggaatcttcctaatccagcaattgaacccatgtctcctgcattggcaggcagattctttaccactgagcctcctgggaagccctgtaataaataaataggttatggaagatatattgatgttttgattccatcaaaaccaagctattaacttttgagttttgcagtgaccttcaatcttccacacagggctttgggttcaggtagcgcacaggaaacatctgggagtctgcagacagaaactctaagtacagctcttcaatcacaattaatgtcgtattgcatacaatttcttgacagcatttattgtaaccagattccgtggctatggctgccattactcctgccttttttctctattcagaaagcatcttctctatagggccagaattaggtaagtgtcagcagcctagggttgcatgctattgtgtttgtgctggtttttttttttttttttttttctgttggtaattactgaacagaggatgagatggttggatggcattatcgattcaatgacatgactttgagcaaactccgggaaatggtaaaggatagcgaaacctggagtgcctgcagtccatggggtcgcaaagagtcagatatta

SEQ ID NO: 64272 - DNA, 2141 bp, Bovine  19866880501194
ccccaggcctcattttattttgagaatctcatttgctatggacactgggcataataaccaattttattttacagctgagcacatctcggatacattatgtttttctcaaaactgtgcttgcacattaagcagttgcattttgacctcatccatctcctcctggtatcttatcatatgtatccaggaccaacaaactgacaccatcattctgcctgggggtttctttaggcaaatccaaaagtttactagtagcatttcctatcttccaggttattagagacaacagttgtgtacactgttggggcactgcataatgccacatgccattacccacatcgctgatgaagttttctcactgcttttctaagccccactaacagttggtttgccactaatccagcttctactgaaagttttctcatcactgtctcctctttttccagggcaggatagtttattcaggtggtaaccttgagtgatggattagtatctccccagggataaggagcaggcttgcttactgcttgctctaaaagcagtggattccccaagctcagtgtttctcagctgcattccaaacccactgtgtagagagcgctcatctgggctgtatcgcatcacccacacaggacccaagggcaacgagaactgaagcaaatatgctgatgtgcatgctgcttgctcttccatgaataataaagtcccacatctcagccccgggaatctttgtctactgccagcactcagaaaacagtcacaggctcgataattcgcttgtaagtaggaaaaaccaaatctcagatctaatagtctccatctccaggaggcattctcagtttaattttcaataaaacttaagttaacactaccaaaggctggccatgacctgaaaagaagtctcattttccaaagataaaagggggagtgaaaagaatttttttttcaaagttaagaactatatcacaattcagaactgaaagcaaatcctgttgacatctctgtacccatgttactttgtgtcttcagagctggcctggcctcagatcaaaagacaatattacagcattgttgaaaattgtgtattctcttcaagaaaatgttctcttttaggccatttatcaatccagcaacagaaaaattccaacaactggccagcttcaatgatttacataatttctaaacaaacatagtcatcttttaagtactttttcgaaaacaatttcttggccacaccatgcggcatgtgggatcttagttccccaatcagtgatcaaatccacatgcccttcattgggtttggagtgtgaagttttaaccgctgaaacaccagggaagtcccacgtaagtctttaactctgtgatccccaaatatgtctgtcttgtaaagcaataagtcaaaggaagaacaggggtatcagaagtgggaaaaaaagatcaatatcattcatacaagaaagacaaatactgcatggcatcactcagatgtgaaattttaaaaattcaaattcatagaaacagagagtagattggtggtaccaggggttggggggttgggagaaatggggagatgctggtcaaatggtacaaaactccagttgtaagatgaatagatcttaagaattagatttgaggatataatgtgcaacctggtgactatagttaaccaaagtgtattgcatacttgaatgaacttacttacaaagcagaaacagactcacagactttgagaacaagcttatggttgccagggggaaggatagcagggaggggatagttagagagtttgggatgggcgtgtacacactgctatatttgaaatggatcaccaacaaggacctactgtacagcacagggaactctgctcaatgttatgtggcagcctggatgggaggggagtttgggggagaatgactacatgtatatgtagggctgaatccctttgctgttcacttgaaactatcacaacgttgtttgttaatcggcgatatcccagtacaaaataaaaagtttaaaaaagtgtattgtatacttgaaagtttgctaaaagagtaagtgttctcaccacaagagaaaaaaagacttaaaaaaaactatgtgaggtgttagacgtggtaactaatactattgaggcaatcatttca

SEQ ID NO: 64273 - DNA, 1804 bp, Bovine  19866880655840
aattttcatctggcagccttagcagcatgtatatttcactggcaaccactgagagattgattatacaaatggaaaatggctataccatatataaatagagaaccctggctgataagctgtaacaaccgggcctaggacaccaagcccttagctacaataaacaattcaggaagcccgcctgctggaagtcagacttgcaggaagacaactgttatctttagtaacaatccaggaagccaataataccccctgtaacaatcaaccccacagggccaggacctgctcagtacctgacagctcccttagattctgtccctgcctccgattcagaacgaacaagtcaaatacatacccctaaccatcacacaggatgccgactgctcttgggcctcctccagccttcccagggcagccaccaccaacagggcacatctgaagccttcccttttctccactacacccctttcccactcccttgcctgcctttgtgtctctgctaaaacggaagtgagagtggctgattccctggttgtagcaagctctgcatagtctttgcttttcccatttggttggtctttatttccacactgcagatggcaggcctgttcaaaaagactttctggatgtacgcaaagcaggaatctcttcagtgtcacttcttcaaaaccaataattaaactaggtcaataatggctcatcaaagactcagaaagtcaggtcagccctgtggcttctgtcatccaccttctataaaatcggtgtcaggggccatccagggcccatactcactgagccatgagtctaacgaccctgacagggcatagtgggcagaacacagggccaggatgcagagacccagagctcccaagactccgtgatgtcatccaaggaatgccacctccaaggtcatgccctctgacagacacagtgtgtatgggatgtagctgtcactgtggctaaccacccaacgccctacaggttcttagggtggagggctgtgagagtcaagccactgggcagggatgagaatagacctgtctaaagctggctttggatttggccccttgcagggtcccaacttggaaggtccctatttggagagtctgtgagcacaggagacacattctgaggacatgggctggcaaagggtagcctctggcctccatctgggggtcggggttgagtctggggaggggagactgcaggcagcctggcctctctaccttgctaccgaggtggcactggcgatggacaagtccttcttcaaggagtgctctgctcggttccggagtcgcctcaaggctttgggtgatgggtacccaggagaacaacagaggatccaaggtgaggagggaccaggtggcacccccagctaccccactgtcagcacctgaatccacaggcctgtctgcccctacctgtctgggagcgttctttgtcacactgaagggttgaggactttgagtcaggaaacctgaaaccaaaggaaaggatgtgagcttttccccaatgaccaagaggatggctcaggccaggcactgggcaccatcctggttagcccacaatgccacatgaatctgcccaatcgtgagctccacttcagaggaggaagctgaggctctgaggggagaaagaagcccctgcacaaggtcacagctgttagggtgggctcacatggggactggcccctgaaggcttgggccccactgttcacacccgggccactcactgcaggatcctcttgaccacctccacagctgggtcttcaatcatggacttccccatgcggcttggctgggcaaag

SEQ ID NO: 64274 - DNA, 1364 bp, Bovine  19866880695910
gggatatgtgtatacatagagtctgattcatcttattatacagcagaaacacaacattgtgaagcaactatactccactaatgaaaagacttaaacatgcttatttgtaccagctatatttgtaatagccaaatacttgaaattcaaatatttatcaaacggtgactggatcaacaaactgtggcatatccctacagtgcagtgaatgtgaatgaagtgcagtgaaagtcgctcagtcatgtccgactctgtgatcccatggactatatacagtccatggaattctccaggccagaatactggagtgggtagccattcccttctccagggggtcttcccaacccaggaattgaactgtggtctcccgtgttgcaggtggattctttacaagctgagccactagggaagcctagtttgttgttccttatcaataaggagctccttatcaattaataaggagcaacaaaatattgataaatatgacaacatggaagaatttcaaaatcactatgctctagtctgggaaggctacatactgtatgatttcatttttatagaattctagaaaatgcaaactgatctctattgacagaaagcagcatggtggttacctggcgatgagagggggaggagaggatgaagctggcttaggtgtatgaggaaacttttggggataataagatttccttatcttaattgtggtgatggtttttttggtgtgtgcataagctgaagctcatggaatggcattgcttattaaatatatgcagcttatgatacatcaactgcacctcaataaagctgttatgaaaccagcattcataaagcagaaggcagagcaggatgttcagtgtttcctgatgctcctggaaatttcatcaagtcgactgttacctggactgcctacatgcaagtatggctctatttgggtgtagaagaatagctaattagagcccaggtttcctgtttgggagacttctgaacatgcaatgtgtttatttcagatgggctaagtatttccacatcaccttcctgtacccagtcctcaggagaaactgacagtaactttggagttaagttccttattcaaataccaggggatcaggtgtgaggcagcttagagctcttaattttaatcttatttctcccccaaatgaaatatataccctgtgttgatgctttggaacattgagaagaacacagatggtaaattgaatttgggggaggaggaatggtctatataactcctaaatggcaacttcaaaacactagatggctccctctaatggggttttagattggagttaaaaataaggctcctcatcagaattattgagaaagatgacaatcatttttcaagcgat

SEQ ID NO: 64275 - DNA, 877 bp, Bovine  19866880726777
gtaactatactccaataaaaattaaagaaaaaaaaaaggcttgaactcatagataatacaattctgtgcctttggagctgaactgagataaatccttgaccgtgaatgcaaacacgaagtgcatcagtgtgttcactggagcatcatttgtaacagcagacaattcagtacaatctaagtatcccaccctttacagcaaaggctgtaagcgatggtatatccattcaatggaatagtatgaaactgtgaaaaggaaggaagtagactctatgtaccgaaaaggaaagatctcaggatataggtgtagtgtgtgggtggagtatagggcactgtgttgcttcttcacatgatcatatttcaaaaatatgtgtttgtgtgcacatacacacagacttttacaggaaggatacacaagactctggtgctggtggctcctggagggagagggagagagaggtggcctgcactgcgcactctgtggacctgctaatcatgagcacacattactttcaaagacagatcatcaagggcttcctgggtactttttctggtgtacactttcgtcaggcccagaaaggtcccaattatttccctctcttaagtcgaacagatggtaaaatagcaacgtctcatggacatcacctaccgtgatcttcttgtggtcgggaaactcgaggccaaaatagtctccttccacgaggttgaggtggttgcacacggcatccagcagcactttcccgggggctctttgctgggaacaaacagagcagttgttacggcctctgagacaggcagctacggaaacaaaccacggctcccaccgcaggaggcccctcatgcctgggtctgtaagagctccccacccaccaccccacaa

SEQ ID NO: 64276 - DNA, 813 bp, Bovine  19866880780188
tttatgggctccctcataaatgccccggcctagtctgcctttccagtgttctgaggaagaaactgctaggctcacattgctccccagcagaggaggtgcaactattttcttcatgaggacgtgctttgatgtcgtccttgcagagggaagggaaacagaaggaggaggaagcggggagggagatcagctccgagcaggaggctgaaggcacacaccggagttgaggatgacgtgtgactggctatgattttgacatcaatcaatagattgtcactggcctcttggtgacagctgctctattcactctgcacctccccccagccccaaacagaactcagtgtggggctctgaatggcagttcattaactgagcaccccccaggctctgtactcaatgagatactgttccagctcctacagagtccatcctctgaaggggaagagaaatggacattgacgaccacctgaaaaaaaaagccacacagttctattgaccagacaaatataaatccgtacacactcatacacgcaaacacagttctagtgaccagacaaatataaatgcgtacacattcatacactcacttttctgccccagctcccacttcccgctactggagaattagaaaagtatgtccagacctttgggcagatgagccccgagccccacaggcccggggttctgctcatcacagctatccagagaggccctgttcactgcacacattttacatctagaatccaagggaagaggatctggggtttattctggattccaaagagtattacggtagcatctctggatattttgata

SEQ ID NO: 64277 - DNA, 1592 bp, Bovine  19866880803688
tggcctagtggttaggattctgggctttcctgctgtaacctgtttgatccctggttggggaacggagattttacaagcagccaaagaaaaaaatcaaaatggtaaattttatgtgcatatgtgttgtgctgagcttagtcgctcagttgtgtccaacactttgcgaccccatggactgtagccaatcaggctcctctgtccatgggattctccaggcaagaagattggagtggattgccgtgccctcctccaggggatcttcccgacccaggaattgaacccaggtctcccacactgcaggcagattcttcactatctgagcctcctggatattttaccataattaaaacatgtttaaactgaaatgtaacctctctaaagtaataaaattgtgactaacagaaaaaaaaatgcaataatgatatatgaaaacaaagcctgtaagtaactaggaaagcgatgagctcagctcaaagtgtggctaaaagataggagagagagattcaacacagcactgttgaaagatggtagcaaaagaaaaagaaattaaaaagcttcttcatgatttactccctctaaggacagtttgttccatgaactgattacatggactaatttttttcctcacaacagttttatgaggtaaagtggaaagatatattttctgaagaaataaactgttcttaaatgatacattctggtcatccatcagaatacaccaattccactgatactatctgtgtagatctttgggggccaggcctcccttctagtgactgttgaagtaagattcaaagtggcaagcttccaggagaggagatactttgaggagaaggacttttctagctcctaataagggtgttcttgttcagttgctgagtcttgatcaactctttgcacctccatggactgcagcacaccaggcttccctgtctttcaccatctcccaaagtttgttcaaactcatgtcgattgagtcggtgatgccatccagccatctcatcctctgtcacccccttctgctcttaccttcaatctttcccagcatcagggtcttttccaatgagttggctctacacattggtagccaaagtattggagcttcagcatcagtccttccaatgaatattcagggttgatttgctttaggattgactagtttgatctccttgctgtccaaggaacactcaagagtcttctccggcaccacagttcaaaaccatcaattcttcatcagtcagcctcaggtggatataaggtgcaagaaattgtttgatcatcaaacattcatcaaccaaaacctccatccttctggcaggaagtgggttgagatattagttggtctataaatccaatgaagttccaggtgtgatgacttgcattaatgcacagagctggctagggtaaccattaatccactgtgcctttatatcatgatttatttttcattatctttgcccactgtctcaaatcctgagacttcccttggtctgctataccaagttacaactattacctcacttactctccaggtctatatgaagtactttatgaaataagtccgcagaattcatcgctgttattactgttgt

SEQ ID NO: 64278 - DNA, 1845 bp, Bovine  19866880841160
tggggaactgtgcagcgctgtgtcgctgtttagcgaatgggagggttatcatgaggtgacaggatgcgctgtggcgcagaagctcccggaagcatggggtctgggtgctttactcacgttaaacacagctgcctttgtgcgtaatgaggacagagactcaagtctcagagaaccgttaacagtgaacacctctgaatcccagttaagggcctttcagtttatacatttcagatttgaactttttaaaatatgtcaagcacaatcactttgtaatataaaacacaaaaatgacaatttttcttattgaaaaaaattacatggttcaaggctagtgaccaagtatttgttaaattataaaaacaaatactgacatggcttcccctctgatttgtacaaggcattttattttttttaaataaaagatattagatgaaggaaaattaaaccaaatacactaatatttcataaacactgcaaatactggtacgttaaatttgaacttaggtatttctgactagggagtaaaacaatttttcctagaattaaaaactttttcctatatactgaagctaataattctgaggagggagaatagagcaataggggcagtatcgaggaaaaaacattctttaccgttaagactgagtgcttctaaagatgactaagtagtattttatcaatatgagaagtaggttaaacagagaatataaaaaggcaaagactgactttcagacacagtctaagtcaagctccactattccagcatttcaaagaggtaatagcttacggttctgaagcatctgcataatgtgttctttgatcattggcaggacgagctttccaccgagtccacaagccatccggtctagagcactctcaccagcaaccgcattgctacacagagaacaatataattgacatacggaaacacgtaaaaacaggacactgcacggacgtgtttttaaaccgacactgaagaagaatagctcaagtagtattttctaatatatgtactgaagttttgggttaaaacccctagaatttaaaaagtggcggggggtgtggataaaatttttatcatgcctcatcaatagtttaaaagtcttatgtctgaatatgatctttcacgacttccctctgtccccactcactggttaaaacttagcttctgacactctgaagactcagagggatcagcagtgtttaggagcgcctctgaatcacatttcctggaaatatagtcttcaaacttatcagaacacagaaaacagaaaagggtgctgagcctgtatgtgattttctctaaactgggagcttattcatcttttaaaggggtgcaatctgccctataaaatattatgtgtaagtgaaactcaattacagttttttcactgaaaatcgaaggaatttgggcattaatgcctttgcacatttattgttttagaacctcaagattagcagttgccacgtacatgacctctaactgctctgtgaaggtaagaccagaaagacaacactatgaccttgaaaacaggctcttaagacttagcctgaccttgaaaatgtatttatgtcctacttactcagagataaaatcttatttatctagttcagaaaaaaatagcttcttaacatcacatacaccttagtgccttttacagggcaaattaaaagccaggtagcaacacatcacagtaactgaaccaggacaaggaaactcgaccagagccccgtctcctcttcagccctatttaggtgtttccagtcaaggattattttcatatacttctatagggtattcaggccaaaagtcagttatttttaagacaggatcaagcttcaaaa

SEQ ID NO: 64279 - DNA, 3803 bp, Bovine  19866880842672
ttccaaaaacaagggagaccgaacgtatgtgaaagcgttagtggctccgtcatgtccaactctaccaccccttgaactgtaacctgcgaggctccctctgtccgcaggatttcccagggaagaatactggagtgagtagcgttcccttttccaggggatcttcccaacccagggatcaaacccaggtggagtctcctgcattgccagcagattctttagcatctgagccaccaggaaagcccacaggaagaccaaggcaagcggtaaagcgcatccaaggaggaggcctgttcacagaatgggggccgccaagtcctcaggggaggtgtgagctttccagcagttgtgatatactgggtcctctgtgctcttgtgaatttcttctacctggcatgataagaacataaacatttgtaatacaagacctttttgacaagggtcattctctgacccttttatttaggaaagaggacttctgctttttttttgcttggggaatactgcgttaaaaagaactttcgatctagccagtctaactttttccttatgttgagagtgcgattttaataaaagaaatttctactccccaccacgttctccacccaagttacagtcctttgatgagacctaaattgtttgacagttgaaatgattgataccacagcatctcaggggaggaaggaaggtaaccagatgaatgtctaccaaagatcacagaagtcctgtgcttatacctgtctttgagcattagagaaggaaaagaccaaaggaagcctggcgcaggaccattttttagtgacggtttccagtggtggtatttaaaaaatttccagtgggaaatgaaccctttagttacccgcctctgtcctttcagtgacatatgtgatgtttgacagctccttcccgggtttcttctggaagtcttcaaaattaagcagggtttataggctgtgttgactttcttgaaaacctgatttttggtgattatagttttcaagcctttgagtgtcaggtaggcactgataaaagagagacgagtgtgtgtgtttgtgtgtagtaaatagtatattacttgaagtgtacctgtgaaatgtacccatccaaacatgggggctatccattcacttaatggaaaagctttgacactggggaaaagaaaatgagcttaaaccaaaccagaactgagggaggtggttctttaaaatgtcatctcaagtcaccttgaagctattatgctaaaatctggcactaaacatattttggatacttcggttctaaaaaagttttctgtaatgccattttgggggtttgtacatgatttttttttttatgttatctgttaatactttaagttgtgaaatatggcatatttgcaaatgaagctataaaacgagcacatgtaatttaataaataatgacacaaacatccaagcttatagtacaaccttcctggtatgggccctcccccattgcttcactctctctcccagaaataatcacagcctggatttcctgttaatcattcctttgcttctctctatggtttggcgcacatgtgtgagattctaaacaatagcgtgtttgagtcgtaaattactcatttcatgtctgtctgcccagttaactctgagaagaggaattgtgtggattctggtctctggtctgttcctagcctcaagcatggcccttagcacatggcaggggtttaataggcatttatggattaaattaatgaatagagatgttttattcttgtaaaaaaaatagtttctcatatatggctaagatacataaatgtgtatttgaataaccataaaagatagagaatatcgaaaggttttatgtgaacatgagttttacacggacggctgtcagaggatcagtcccacatgcccatttactaactagaaaagtgacgaaactagaaaagctctcaaacagataagagcgtcactcaatgtcatttagccagtggtggccaaagtggggccagaatgtgcatctgctcccgctggcccaggagtctgtgaactgggtcacggggcaccctctcagtggttttgttcaagagagaagtggctttcttcaatttaatagcaacctcacccctggggaaagaggcgaacacaactgcagaaaaattcctcaaattcagtacattagagtgttcatgtaatattcctggtcaactaagaaagcagactagattggaatcatcaaatatgtatatgtagttttagtaatgttaatagtctgtatactattattaatagaaaactcggaaagtttaaagagcgactttattgtggggtgagtttttcgaaatacttgctgaaacagataggtgcttgatgaaagagagaagagtgtgtgttttcatttgtagtaaataatacattacttgaaatatagctatgaaatttactgatccaaacatggaggctatccatcgactgaatggaaaactttgacactttgaagaaaaaaaaatatgagattaaaccaaaaccgaaactgaggttgttggtctttaacatgtcatctcaagtcacctcaaagctattatgataaaatctggctctatatatgtcttggatactttaggttctaaagtagcattctataatgctgattttgggggtttgtacatgcttttttttttcttacgtagtctgttaaaacttgaaattgtgaaatatggcatatttgcaaaagagctatatataaaatgagtacatatagtttgacgaataggaacacagacatccaagttaagaacacagccctcctggtatggcccctcccacattggtctgtccaagctccttgattattcagtgtgagaatgacaaggctaaaagaagatgagtgcgtgcggcatcactcaagaactgcagatgtcagatgtggcccttatccagttgacatcagatggtcttcagtagatttcggtataaggcttgtgacctgagtttttgcttgttttccaaaagatggcatttaccaagggcagggtctgggttttggtgtttggagattcttctgacctgcctcccaccgccccaaccctccacacacacacatacactcgcatggtgattttgtcacgtaactttgacatgaacccaaagttgagccattagtgcccagcaaatgggcaagagaggtgtgatagcagctggcaggctggctggatcccttgggtaccactgaaagctcagtgcttctgtgttcacaggttgctttagaatgtgccctccaaaaataccagccatctctgtactttaaacacttctgaagacttttatccttcataactggcccacttagtcgtctgtgccttctaagggtctgacattgtgtgtaagtcggtgttaaaggaagtgtctggtattggggtttaaattatctattaagcccactctcatattcaagtctatgactctctgagccctggtgataatttatacttcagaggaagctcataactgcctcagagtctcagggtattatttttagaacctttccaaatagcttgacaccaacattttccaactggattttggcaagcgtcgatccccgggattttaaagtagctctttatcaaaataaaaccagctacttggttatgagtaggtagaattccaaaggctggcacagataactgcgagtgtggagtgtgatgaattaagagctgcatgttgatctaggaggcaacaaaagcgattttgaagccgagtttgttctttgttacttgcaaagaaacgtaagtttccaagcttggaaaggggcttagggaaaaa

SEQ ID NO: 64280 - DNA, 1587 bp, Bovine  19866880849244
tatggcaggcagtctcctgcactgcagatgaattctttattgactgagccaccagggaagccccttactctcccttacttgtctctaaaatttgttccttacactcagccccacagaccataccaagaggcatctgtgaattctcccctaaccagtcttagagcaatcctataactggctggtctttctgcctccctcagatctccccctttcaacccacccttccccaagaccactcactgatggatgggtggatggatggcttgattgatccattcagtgtctacccaatatcttccctattccaggcaatttattacgtaataggaacacataggtgtttgaagccaactcaatccctgcccttagggagcttaaaggtttagggggaagaacctgacatttaagtagtaagcagcccaatcaagaatgatgagagcattgtagctgtgtttatgcatacctgagcgtgtcattcttcactggtttttcttcgtctttgggataaaacccaaactccttagcctgtacacaaggcccttcatgaaccaaccaggagaattaataggcttacagatcccccaggctcgctgcacttcttgggtttcctgtctgtgcttcttgggaaatggcttgtgcgtcttggtcccttgtttcttgagcaaacttcattgtggacctcgagctgtgactgtgactgcttgggagcctttcccactttcctttgtgtgcgtgtctccctcttgtgctcctgtggcctctctgtgtctcctcgctgatcgtttcacctatagaatttattttctcctccagtagattctgagacccttgaggatggaaatgatgtcttctatccttggaatctaacatgacatctagtgtgtaacagatgcttgataagtctaacggtaagagctgcctaccagtggaatcattgtcccaaagtgggtagcaccatctggtttccataagtgtcagactttataaacccctttcagagatctgacgaatgaaacctcagtattcggtgagatattcaaacttcatgccatttaaattctctgattctgaattgttgtccattatgtaattatttatctctgccaagctcccaaatgtcttaattgggcccatcatatgttatgaattctatttctgggtgttgtaggaattgctgtcttaatgttattttgtttttccgtacatgagccatttgactcagtgggatgatattttataactcattaatgtttgtgatcctgtgtacccaaatattcaggattagttgtcagctaccactggaattgatcccatggaccattagaatgtacttttatgctgtaattatcctatgccaagaattaagcaccatgcagccagtgacaggcgggaaccacatgcttggcctggtaaatgtacatggtggcgagtaaatccaactggatctttctttctccaaagaaagaactttaatgtttctttggctaacttaatttaactctgagttaaattaagcacagcacttaattaaattaagcacagcataggaaattctaagagattttcctcctagaaaatgggaagcaa

SEQ ID NO: 64281 - DNA, 1611 bp, Bovine  19866880975434
tgaggacatcattaaggaatacttcagaagccatcgtggagatgcgttaacctgttcttgcctctgaagtaacctgttctccatcatgctatttaatcttctcccttggaaatgactgctctgaaattttcctgatgaaaaagatgaaactagtcagattcactgttagggttctttccattaaacttgactggaactcatttcccagtttacttttgaaatgcctgtaagtctttttgaacttcaaatttattttagaaaccattctgtagtatctaaataaaatttatgtaaaggaactgttcttaaatgtatggtttacatgggaagaaactgcaaaagctaatcagatttcctcctactggatttaaaaggcagttgattttagtgcatgatcattgtataaggaaggacctaataacagaatttggtattgggggaagggtatgggaaaatatatgagtgcttgagtgattttctattacaattttaatttataatggttttcttctcttatttcagtaatcacccaattgtccttggcccaaacaataccaatctgcccaaaatattcagtataatcgcagaaggagaaatgcatgaggcaattaaacatgatgatccttgtgccaaacgtctggccaatgtagttcgccaagtacaggtaagctgatttagttaaattgggaaagaagaactaaaatggttttggggttttttgtttagttttttctgtattttttctattagaggaagagagtagaaattcaacaagctaaggaaatttcacttttatattatcttgtcatcaagcctcaaatagattatacttaatataatctatccatatattctcattatctattaaaactgaaacctttgtcttaaatctgagattagcacatactcattatgttatttttctgtatatatgtgaaaacagaaaggcgagacgttaatcgtagtaactgtcagctaccaatgttttataatcaagttttcctccctaagtggatgtgtgtagataacttgaacaggtcatcaaaagtgtagctttatcaatgtacaaatgagaaagcttactgtgagtgaaacatacttcatagaaatgaaaagatgtcttgcttgtacaatggtgttcatcaagctaatctactggaaagagtactttgctgttacagtctgcctaatgatggttatgagggtactgcccagtaaccgttttgccaaatctaaacatgtgacgttgttctttcctagacttctggaggactggtggactgaatgcatagcgcagctcagtcccgagcagcaggcagccatacaggagctcctgaactctgcctgaagggccttactaccaccaccagataactaactccaaataaacgtttacccttttgtttaggtttctttgttttgtttttgagcaaaagagaacggtagagttgtgtgtaggccattcttctgcaaagccacaacagcagaacgagaagccctgggcttcaggatggtgtgtaagtggatttccccccacccgactactgaggaagtcccgtgagccctgcagtaacactgaagagtatttttctattggtgtgacccacccat

SEQ ID NO: 64282 - DNA, 1898 bp, Bovine  19866881016256
gcctactttggcccctgatgtgaataactgactcattggaaaagacctgatgctgggaaagattgaaggcaggaggagaaggggacgaccaaagatgagatggttggatggcatcactgactcaatggacatgagtttgagtaagctccaggagttggtgatggacagggaggcgtgctgcagtccatggggtcgcaaacttctgctcatggttcatgggccagaactgaggacatggcctagcttcaggagagactgggaaatagaaaagatcttctgaatatttggtgagcagaaactgtctcttccattcttggctcctttgtgccacctcatctacaaaatgataggattaaactgggtaattcttcagggccctgttatacttgtaaatatctaagaggctatgactaaccacatggccatgatttcagagtaagtattcaaacttgtccttgaagtatagttctacttttaaaggaagtagattagcattatctccactcactcactttattgtcctaaattgaatagtctcactccttttactagaaaaacaattccttatttttagagaaagaaatagacaaattagaaagaagtatttctctgagctaaacttctttcaaaacaaattcttcagttggaagaatttaagaaaattgttatcatttattgtcctaactacttctcacgcagatgatgaaaaagatctaccatatgtacaaacaactcatttttcaccaagaaaaacacttatttgacttcctatattaaaggattagagagttatttctaaattagtgctgaattctcaggaagtaagcaattttaaatgaaagatacaagagagggaaaattcaagcttgcttcttttttgtttcaagatacactcatgaaaatgtgcaaataaagacttgaaattccaccctcgttctctgataattaagatttctggcagcttggtaaaggactgtgagcatctattctttgatgatagcctatcacctgccttggtatgaaagtgaaaagtgaaagtgaaagtcactcagctgtgtccgactctttgcgaccccatggacctattcagttcatggaattctccaggccagaatactggagtgggtagcctttcccttctccagggcatcttatcagcccaggtatcgaacccaggtctcccacattgcaggcagattcattaccagcttagccacaagggaagtggccagtcatatcagtctaatatataggccagtgaaactccagtactttggccacctcatgcgaagagtttactcattggaaaagactctgatggtgggagggattgggggcaggaggagaaggggacgatagcagatgagatggctggacggcatctctgactcgatggacgtgagtctcagtgaactccaggagttggtgatggccagggaggcctggcatgctgaattcatggggtcgcaaagagtcggacacgactgagtgactgaactgaactgaactcaactgaattctttaggtcattcagatctatgcaacatctgtcgtctttttttgttctatggagagacagaaacatttctgaaattcctcttttggagaatcatttatttaatgaggacaaccaaaccaattaacttccagacctgttctttcattttggatgtttagcagagttggttttgatttaacatattatctgtagttttgaaaattccacaaattctctgttactctggaatagggcgtttctcattgttggttcccgtgactggtggttttaaaacattcttcagttgcttagtcatctccaactcttcgcagttttaaatcatggatgaaagttgtttgactctcttcctgcttaagaggtagggtgtgtgcctcccctt

SEQ ID NO: 64283 - DNA, 1000 bp, Bovine  19866881148603
tggagagcatttgagtgggttctagtaataaagatacttgtaacagtttcaagcacagaaacagagaggaaagattgatttgtccagggttgtatagcctggttgtacagaccgggtttaatatatgttctcttccttttcccaatgccctgaacgtgctcttgtcaaggagataggtgtatctcatcaaagcacattttgccatgtccaccgaaaggttgatgtgtttatgtaatggaatgctgtgaagtaattcaagtgaaatccatgtgtcttgagaaaaaagcaagttgccgaagggtatatgtaccatttattatatagaaaataaaacctttgaatactgctatatgttatacacagagaaaactgtagttcaagtgtaaaaaagaaaaaaagtttgataatgagaaacactgattttattacggtcttacttctgatgagggaggaagaaaacgtaacaggacttggaaattttgatttttcgccttaatatgtttacttcttaaaaaagaacaaaacgtaaagccagggagatgagaaaggtgaaaagagaacaagccacatgtggggagcacaggcaaataagttttttgttttagtatgtcctttgtgttttacctcttacaattcttgtgggtgacattgacaaaatcatagcatcatggtctttgggtatgaagtagttcttttctttagttccgcagatgttagccatgatggttgaccttgaagaggatgaggactgggcaaatgcggatgaactggaagatgatgactttgataggtaatcacataccccgaactctgtacggagcttccctggtgggacagagcgaggccagctggcggtgagagcttagggttacagggtctgtctctgccccacgtggtggtctacaaacctgaggttaagcttttaaatttgaaacgtgggacattttggctttctccattgtgtgttttcctatatcaaattttgtagatatttatttct

SEQ ID NO: 64284 - DNA, 783 bp, Bovine  19866881252624
aatgttgctttcctcctctcgaagcacaacaacttgatggggtgactgaccttgaatggtgatgcttggttctaaatttctctgtaaatgtcttccctgatttttcggtcgtaaaattgaggttttcttgtctttggcctcaaagaaatggaaagaaatggaatctggaagattaactgcacctagaacaaccaagatgacgctggtcagaccaaccattgctgaccaatctcaagatgaccgtcagggaggactgggctgtttctgcatgtaactccctctctgtctataaaatctcttgcccactgattgagaatcagcctttggacaggcgtctgtcctccccgccagaggccggcatccaaaagaaagcagagtttccattccaccaacctggaccctattgtcttttgagcggcaagcagctggatcccactttcagttgcatatccactgtgcaaatatcagaggccactgtgaccttgccaggctcagcccagacaccctgtctcatttttatttcacccccgagtcttacagactttcccagcatgggggtctgtcttcattagggaaggcccctcaagggaagaccagtcattctttacagagtggtcacactggctggcaccttcctgagacgaacgctgtgtgcaacctgctctgcttgggtgtgctcggcaaaacgtaaggaggagggatcgagcctctcccttgactatagataacaaatgaaaagagcttcagctgttggcaagctgagtgaagacaatcagagattat

SEQ ID NO: 64285 - DNA, 1297 bp, Bovine  19866881297373
cttccctggtggctcagatggtaaagactcttcctgcaatctgggaggacctgggttcgatccctgggtcgggaaaacccttggaaaaggaaatggcaacccactccagtattcttgtctggagaatcccatggacagaggagcctggtgggctacagtccatgggatggcaaagagtcgggcacaactgagcaactaagactttatactgtaaagactttccatgtttggctgctatttcaagagttttctgtgatctaaacagtcctcattagatcggatcctccacaaagcactctgaggacaacatatcttgaaagaaatctacaaccttgggcaaagcagagcttcaaacaaggtccccccacaaaaaaaaaaaaaatgatcatgggtttaaccatggttgaatctcatctgatgggaatccagaaagtcctcagggagaaaaagaagctttagagataggcctaaaaggaggagaactatttcaacaggtggagatggggtgtgaatataaaatgttcatgtaagcttctcaaacagtcacacctttaaattttcccctgaaatgtgctgggcttaattaattcagtctaaacccctcatttgcctcttctctctctgcttaagatacagcgaaatgggaacaccgtgttcctgcttcctcccactggctcctggaagcagaatgctcggaaaggtactgagagggtgagtcgaagactctattcgtacctcgtggccctggctgtggcactgcagctcatcagactcagaaaaaagcgctccacaagtgtgatgtttttgcaccgaaaataggtttaagccaagttaagttttgcgacactgctcaggcaggacactcatatttagatgagtccaaaaggcatcatttatcaactgcagctcacggtgccttaaccacaggtctcagacagcagctgggctgaggcacatcttcctctgtattcagtttcccagcaaggtcagcacagggcctgacacagacaacagagcccgcactggagctgcccgggagacccgtccttccgccctgaccctggctcctttcatctggatgagccaggagaggcgaaacaatgccagtgttttctgtgtgctcattaattaactctgcaattaagacactgtcatcaacaatcgaacagatgccaagggcccttcttatttcctttgaaatcaagatagctttggaacgacatcttgtctagaacacaccaccaggtctacaaacacacgcactgcgcactctcctctaatgcaccataaggacacc

SEQ ID NO: 64286 - DNA, 2423 bp, Bovine  19866881360727
aagaagttcctgagaaggtaagtactgagtctgcagacactgaaaaactccaggaagaggggtggtgattgaaaagcctgtgtgatttcgtctcacaggtgattgcagcactgctgcagaccatggaagaccagggcaatcagcgtgtccaggcccacgctgccgccgctctcatcaacttcacagaggactgtcccaagtcactgcttattccatacttagacagcttggtgaagcatctgcattccatcatggtccttaaacttcaagaggtaagtttcactgtcttttaagctgtctgtttggctggtatagtggaaatcggagggaatggtgattctgaaagagacttctcaggaaacgttagcagtttctgccactttgattttaaaaaggtgaaagagaaggaagcaaaaagtgctgaccactctcttaaccagaatgacagacatagagaagacgtgaaaaaagaatatcctttttgtattattaaacatgttgaattcttaaaataaggcctggccatccaaatagaagatggtttatagtttacagcttaagtaagaggcaacctaaaaacaagtgaataataatcagtgcagcagcagaaaaagacaggatgcaggtaagacaggcaaaaacagaaacctggtttgttatcaagtagaatgaaatgaaatttctgctataaaataaaaaggacgcacaaaataaaagccttttaattcgaatattcagcaaacataaagttactgtcagattgctataaaaatttttctaaacactcagcgtctgtactttggctcatgatgaactggtaacagttggtaaaccgcacttcacctagccctggtctaaaggagagcagagaggaagacgggaaattacaaggtcccagaaggcagagaaggggtctgaagcagaggatgggcactcagtgaactacgatagcaagctaagagcatgatacaggaaggtgagtgtagtacgtgaagacagggaggtagtcgagttgagggcaggtcagttaggtcagttagttaaatcagaaatagatgggtcagataggacgttcgagtagatttggctgaaggatggctctatataacccagctccccgctggggacccgtgtgtgaggtgcagactgaaggaaggggctgctgagatgggataggggaagagggtcgtgtgtgtgagaagagctgtgcggaggcagggtagccaaggaagaaagactttcctgtgggatcacaggctggtcatgacgttaaccacagagcagatgcgagatgccaaaggaaggagtgagctcaccttgcagagcagtgtggggactcgaggtacaagtagaaagagctctgccgagagtggctgtggttgatgagggggtggagggtccggagcagttgccggctcaattatttctatgaacccacaaggaattacagaataacattgccaggtgctgacatggcctgaccgcaagtacccaggaagaattttcctcggcaggtcagagaacactggattgttggtgcagggggaaggctgatctcacctgttgcaccagggtggagaaagagggcacctctcaggggtgtcctcagtggtatttttctggggagaaatagaaaataaaggaatgggccataaagggaactttctccacgacctaatcggacagcacaagatataaaattaagtagtggaaataaatgaagaacaatgagtaaaattaagcttgctggatacaaaaatttaagggagttcacatttatgctcgagaattagccgtgactttgagataaagtggacacaagtgaggagcgctgtgctgacaggagagaacacctcacagatagttcagcgggggctcttcagtttgcgctgagacctagtctccactctggctgctgtagggtgggctcagcgtgcagtctcagtgcagccctcgggaactggccgggagtgcttgccccatcttctcctctgtggggctgatgttctgttgtcttccttccagttgatccagaaaggcaccaagttagttttggaacaagttgtgacgtctattgcatcagttgcagatactgcagaagaaaaatttgtcccctactatgacttattcatgccgtcactgaagcacattgtcgagaatgcagttcaaaaggaactcagacttctcagaggaaaaactattgagtgcatcagcctcattggtctggctgttgggaaggaaaaggtaagtgacttgtcaacaatgtgttgggtttgttgtgtgtcatctggctttgggggcatcgagggtaccagaggatttttttctttctgataagaggttttctaaagatttagttgttttccatcatcttattcttgaattactttaattttatatataaattatcagcttcatttttt

SEQ ID NO: 64287 - DNA, 1309 bp, Bovine  19866881376572
cttccttccttcctttctttcattcctttcctgcaatgcctgctctatgactgaaaacaaaaaacacaaatggttaagacattatcatgtcctagaagttctcaaggtgggcatacagttataatccaaggcagaattggccatttgagcagtttgttaaagtaacaaagaaagacacgtcacttcaaatcgaccctatgccagggcctcttatttctaaaaactcctgactgctctttcactcatagaagataaaagtgggctaagaacatggcatttgataacttaggactgatacttggttcacggttttaggctgtaagttctgcctcttacagaaagtagacccactccatgggcttgagacgatggctgtggtttgcatttttgatcattaaaagcagaaaggaggggttactgagtgtcctgctgatgctctggcctaagagtgacagacactgaaacatccagcagagatggaaaccccgtgcgctacaggactggcctctcaagttctgatagttagtgaaaactcgggtcaaatctccttttcatttgcacagaacggagaacctcatttcaccttaactgagttatttgcttcattctcttagggtcttattaggctatgccctcaggccttatttttgagttgataaattggcaagtttggccctaaaatggattatgggccaggaaggtgggaaccggcttctggctcgttgtgcattttattttctattgataggcctgttatggcgcacaggctctcgggtttcctgagaaatggagccattttgtaaacaaaacgctgtcattttaagccattagaatgcattatatggggcataatggccaaaggagtgcgatggggagtcaatgagacacagactggtgaaatctccggctttctgactgccttgggacttgactgccataatgaactcagccttctcattaccctttgtgttaaaaaaaaaaaaaaaaacaaaagcatagatgtgctttccttcttcgagtcgaggtggatttagcagtactgactctagcttgctatttcagggactctagttgtttttggagtcacataattttctcttgggtttccctggtggaggagcggtaaagaatctgcctgccaagggaggagacctgggttcgctcctgggtctggaagatccctggaggaggaaatggcaacccactccagtattcctgcctgggaaatcccatggacataggaggctaccaggttacagtccacggcaaagagttggccatgactgagcacacacacgcacagaatctt

SEQ ID NO: 64288 - DNA, 667 bp, Bovine  19866881379357
ctaaatgtgttgtgtgtgatttaagagcttccttgtatttaaccaggctcttacttccaaatgtgaatgttaaagaaggaaaaaataactttatcatgctattggcataatattatactttttttggattgaattcatttttattctatgggaaaatatctgatgtataatgtatagaggaaagtaatacatcattgaaaacatgaatatgtgtactttaatggtgaacagtatattagaactttacatatcttatttcagctgaggctccatagtcaataggacactaatattaaaaggcacatgaattattctgtaaaagtatactctctgtatcatgacaaaagtaaataaaatcaacaaatctttattgaacattgacaatatgtttttttaaaaatgcaaggtgctgatttgggacagaatattggaaaacttcttcaagatgcttattagaagagatagatattttctagttaattataaatgaacacagaattaagtaatgattttaacaaaagtacaagcaaattgctacttaggagtttggcaaaaggaataattagtgctgacaaaggggactgatgcagtcccaaggaaacaatgcggtcccaaagggattgatgaaggattcgctgaaaggggagcattgaccttgattttgaga

SEQ ID NO: 64289 - DNA, 817 bp, Bovine  19866881665378
accattggaggcgacaccagcctctcctgctcgaccatggagcctgcagggtgtgcggtgtgaacctccagggaagcagcagattgtccttcagagccaagcggcgattgtcagctgatatctctgagtcacctttgggtccagttactgcagtcttcaccatcgtcctcagtcccctccaggcacctgcaacttcaggcgtcgtggcccagttgatccacagggcgacctccttcgaaagctatgatggcattgtcacttgagttgacagaagcaactatggtcaacgttaaaagtaatcacgggacagaaaccggaagaattcctgtgaccgcttaaccattaaaatattttgtcttctttaaaaaaaatagatgagtcaaggagaaatattttcctaccagagtactgaatttcaggaactgagatagtgcttctaaccaatgtatcacatcaaggaagtaatagcagctgacctgccgacagcattccagggagagattctttgctcagctgacacacttctgtttttcaaagttgatgcttaattgtagatgttatcctaatttgtgacacagaactaactcacgcaccagtctctgatagagccagagtcagcacaggttgggtgaaaatacagcctgatgttagaatgtcatcacctgctttgcccagaaagtggagactctcacaagggtttgagtcaaattaaaaccccagacccacccctctgttcaccaagcagggatggtctttgttactttactgaacaagaaggaagcaactgtgatgggaaaagattgcctagccttactaa

SEQ ID NO: 64290 - DNA, 4983 bp, Bovine  19866880195804
ttgtctgaaaattgattttatttttatatgtcaactaaattagatgtcaactaaattaactggagcataaaatatgccagcaggatatatttacaaatacacacagcaaaatggtgtgcaagtaacaagaatccgatttaaagtcataagcacagaaagactccccgcgatgaggcccaagccgtccataatcctctctgtgttgcaggtcgtttgtgcacgacaagcctgttcacagtaacacatgtcatgagcaaggtggctggaagcgttttctttctcattatagttcacggctggggtgatttctttcttaaggttctcatctgcattggaaagcttgggttgcttaattcctcccaggtgagcagtgtgtcgccagacatcacattcacggaccctgatcccaaggttaaggttggctcaccacctccatggagagatgactcccacaccgaagtctgcagccctgatccctctttacagctagagcagtgtaccctgcagcctgctgagggccgtcctggatatcccaaaggtacctcaaacctatactatacatatatgtatatgtacatatatatgtatatgtatatatatatatacttatacagagacaactcatgacctcctctccagccttctcttttctgttattccagctcatccctcccatttatccaacaggtaaccctgatacctatttcctacttgccgctgatccaatcccctcaaagtcctggccattgtactttctaaatctccctggagcctgtctgcctttctccatctccatcactgccccactggtccaaaggaccaccatttccagcctggaccaattcaagatggtgtatcttcatttaccctcaccaaagctcttcactgaggatactgagaaatttcctaacaaggtcacgacgccctcccctggccagtgctcacctgcctccccgaccccatctctcatcttgagctcctggggcttctgtcccagaggcccaccaccgttctgggcctctctcgactgatacctttgcctggccttttccggctgcctggaattttcttctctccccttgttgccaagttaccttctcctgactttcccaactgggtcaatccatagttgcaaattcacgtttggggggaacatatttgaaagtaaactgtctttgctcacctctgtgttcccagcatgccacctgtacataaaaccatggaatgattcactcacctctgggccagaggagtgcccactctggcttccctccggcagggagacaggtccatctggagctccagggagcctgccctaatggtttaaagcctgctttagggcccacacaggctgcttcccagacctggctcccagaggacctgctgttttcacccctgtgcccaaggggtggccagagggcctctgtgcaagggtcagatgacagcatgttttaatagattccaaggggtggctgttccagaaaaaacatctacttctacttcattgactatgctaaagcctttgactatgtcaggatcacaacaaacggtggaaaattcttcaagagaagggaatatcagaccagcttacctgtctcctgagaaacctgtatgcaggttaagaagcaacagttagaaccagacatggaacaatggactggttcaaaattgggaaaggaatacatcaaagcctgtatattgtcgccatgtttatttaactttcatgcagagtacatcatgagaaatgtcgggctggatgaagcacaagctggaatcaagattgctgggagaaatatcaataacctcaggtatgcagatgacaccatccttatggcagaaagtaaagatcctcttgatgaagatgaaagaggagagtgaaaaggttggcttaaaattcaacattcaaaaaactaagaccatggtatccagtcccatcactttggggcaaacagatggggaaacgatggaaacagtgagagactattttcttggtctctaaaatcactgcaacctagatgtccatcagcagataaatggataagaaagctttggtacatatacacaatggagtattactcagccattaaaaaagaatacatttgaatcagttctaatgaggtgaatgaaactggagcctattatatagagtgaagtaagccagaaagagaaacaccaatacagtatgctgctgctgctaagtcacttactaacgcatatatacggaatttagaaagatggtaacgataaccctgtatgcgagacagcaaaagagacacagatgtatagaacagtcttttggactctgtgggagagggagagggtaggatgatttgggagaatggcattgaaacatgtataatatcatatatgaaacgaatctccagtccaggttcgatgcatgatacaggatgcttggggctggtgcactgggatgacccagagggatggtatggggagggaggttggagaggggttccaggatggggaacatgtgtatacccctggtggattcatgttgatgtatgacaaaaccaatacaatattgtaaagtaattagcctccaattaaaataaattagtttatattaaaaaaaaataaatttccagcctccagaactatgagaaaataaatatctgtggtttaggtctaaaaaaaaacaaacaaaaaacaaaacaaaaagattctgcaattactgaaatgttggttccaaacttcacagaaaaaggaaagagacagaagcacagaggtttgtactatttaatgataaagcaaactcactagacacctctgtagattcttcccctcagctcctttctgttgcttccagctggttctcagaataagctacgtgtacccagttaaatttccacttaaaagtaaggtaaagccactttcctgtttgcttttaagaactgaataagggagagagaatcagctgaggagacgatggtgcaccccaggcttggaaggagcctgagtcatccctacgcttgggcacagggtgctctgctggaatcctgtgcccctgcagactcctcctggctcaggagcaaggcagctccaagccagacccatcttttctgcatggaggcaaaagtgaaaacacccaggctaatgtagttatcagaccattcatcacatctgaaaaaggaaagaaagaatgtagcaaaattaaatattttccattttaaaagttttctccacttttaattataaaaataacatttgttataacaaatgttggaaatttccccaaagtacagtaaaaaaattaaaatttctataatctcaacttatgctagctcactgttaaaatactcccttccaggcttttacatatacattaaaaagatgggatgatattttaacctcatttcctcacttaatagaacatgaatatatgtccatataaatgttaatcattagatataaaacataattttgatggctgcatagtattccaccttgtaatgatatccttagttatttaacttatgtcttatttttgtacatgtgactcgttcccaattttttttattcttatgggctcctaactgatgaacagccttctagctacatatatgggcccattcaagagtatttcctctggtgtgggttaattggcatatgtagttatgagcccgcccaagattatttcttttggaagaagtggaattggggcttaactggtacatgtagttcaaatacttttgatattttgcctgggaagtatgcatcagtttatacccccactagcagcctcggttcaatatagtcgctcagtcatgtctgactctttgcaaccccatgaaccgcagcacgccaggcctccctgtccatcattaactcctggagaccacccaaacccatgtccattgtgtccgtgatgccatccaaccatctcatcctccatcgtctccttctcctcctgccctcaatctttcccagcatcagggtcttttcaaatgagtcagctctttgcatcaggtggccaaagtattggaatttcagcttcagcatcagtccatccaatgaacattcaggactgatctcctttaagatggactggttggatctccttgcagtccaagggactctcaagagtcttctccaacaccacagtttaaaagcatcaattcttcgatactcagctttcttcacagtccaactctcacatccatacatgaccactggaaaaaccatagccttgactagacggacctttgttggcaaagtaatgtctctgcttttgaatatgctatccaggttggtcataactttccttccaaggagtaagcgtcttttaatttcatggctgcaatcaccatctacaatgattttggatcccaaaaaaataaagtctgacactatttccactgtttccccatctatttcccatgaagtgatgggaccagataccatgatcttagtttttacatccccataacttattgattttataactggaattttgtacttttcaccaatttcacacacacacaccccgactaatcccccctcttttctagcaactgcttctccgaatatataagtctgggttttgtttagttttgcatgtttgtttctaaattccacatacagggtttctctggtggctcagtggtaaagaacccacctgccaatgcaggagacacaggtttgatctctgggttgggaagatcccctggagaaccccctccagtattcctgcctgggaaatcccatgaaaagaggacctggtgggctatagagtcagacactacttaatgactgagcacacacaaagaatataaacaaatataagctgtatctctggtctcaaaaggagtttaatatagttgttgagaacaggcctacatgtatagagtataccttcaaaaaaattgggacaatccaatatttgttgatccagatacagtataaatatcatatgtgtaacacagacaaataaatgtctgtgctaaaactgctaaaaatggacca

SEQ ID NO: 64291 - DNA, 1140 bp, Bovine  19866881021855
aagtgttgctgtgcaggttttctcgaactgtcttttctctgttttatagaagtatgaaatgataaagacagaagaaattcccaatttggaaaactctaatttttctactaaagtcataaaagacattgcacaaaatattttatcatttttaaaatctaattgtaccaaggaaggacatacctattggctatttaaaggtaagctaatgtttcagtgagtaatcattgatttgattggcaactgtaaaatgaggtttatttggttttttgttttgttttcttcccagcaagtggcagtgatatagtgaagctctacgatctcactactctttgtgaagaaactgaagacaaataccaaaatccattcacaatgccagtggctattcttttatataagtgagtgctttaagtagttaagatgaagaagtagccttatttaaaagttttaagtatatggcctccctatctatgccaaggttttaaataccttttagatgttcatagtttaaaaaatgtgtatgtatatacatctatatactgttgcaaaataaataggaaaagggaaaagagcaggggtgtaaaacgcaatgttttgttgtttcttatgcctttattctgctggaaggaaagaagagcatgcctagacttgagtctggagaaaatgatgaatgggcagtaaagttgatataaactccttttagggttgcttgcaacatgatgatgaagaagaatcaaaataagaaacactacgggacagttcgaaccctgcttctgaattgtgttaaattgctggacaaaagcagacatcctcaagtaagattaatatacgccctctaaaagaattttggcattctgatagagaatggttgcctagacattaacgccacctaatgcatagtctgtaactgcctgatctggtttgctaaccagtcaccacatgttgtgcctaatctgaactgagatgtgctttaaatggaaaacacacactgaattttgaagagtctgtgtgtgtgcacatgtgtacacgttacatattgaaatattttgtgtttattgaatcaaatatattaaaattgatttcgccagattttgttccataaatttagaactcacataattttaacaaagtagtgccattttt

SEQ ID NO: 64292 - DNA, 858 bp, Bovine  19866881022820
tactgtggccatttcaactggtgcaggaaggagggaagtgaaaaaaaaaaaaaaaaaactagaaaaaggaaaggatgccaaaataagcaggtgaaagcaaactggaacacgattctaaaggaacataattctcgttacctgagacgtaagctgactgctggatatcggccgcctccaaagataggcatgttggagccaactaacatgtgtatgtcttcaaacgtccacaaaatattccgaacaaaatcatttttaagaccctttgatttgaaataaaatagaaagattatataataaacaggggatctgtaatctccccccatgagccacaaaaagactagaagaaggaaaagacaaagaaaagataaatgaagccacagtgcgagaagatcacagagatgcttaggaagagatttttaggatcaagtggatttttttttcccctataaattccaatttaagactagctcttagatgacgaagtagactggggatgtggtgtctcgacttggaccccacagagagcatacctgactgttctccccgtcattgaataaaggagtcaggttttgttctttaggcgctgaggccacatgccccactatgtatgagggttcaagaggctcacttccctgtgaaaagtgcaaggacaggagtgattctgctgtcataacttcttacagatggcctactgttaaagagtatcacccacacatcaaggcatacagctcaaacttggtcttgtaaattacagctgatatgaatcattacctctcctcacggggtgcatacttcagttcctaattgtcagtcactataataagctaaccattgagatcttacttaaatcaagactaa

SEQ ID NO: 64293 - DNA, 802 bp, Bovine  19866881376389
ccgccatgtcagcatgtggacatcagcagacccctcaaagcccccgacgccccttggccgagttccccgcagcgagggctcccacccctgcaccaggctcctcgtgtgccctgcgtccctgccagacccctgccggccaaccctgcactcaggcaggcccaggtacgcctgcagctcttaacctgatggaggtgcttggaatccggaccccgctacttgccagcatctgaacttggacaagttgcttaagttctcggtgcctatataaaacagttaattcagctcctgagatggggaaatgagaccatccacggaaagcgtttagtacagtgttgggtgcatagctgtggtgcagtatagtttagctattctgagggatattttttagtttatttttggttgtactaggtcttcgttgctacacgtgggctttctctatttgcagtgtgcgggcttctcgctgtgatggcttctcttatggcagagcatgggccccagggcatgggctcagtagttgtaaccacaggcttagttgctctaaggcatgcggaatcttctcggaccagggatcacacctttgtcccctgcgtcggcaggcggattcttaaccactggactgccagggacgacctcttaggaatatttttatctcttctattcagaatagtgagggtgcccattcagcttgtcatctataccaacagtctccaagctttttgacaccagggtctggtttcatggaagacagcttttccatggctgaggggtggggaggaggtttccaaatattcaagctcataca

SEQ ID NO: 64294 - DNA, 1200 bp, Bovine  19866881558176
accatgaacgtgaaccattttacagagaatgcatgatagctcttaaagcttaaaccagtactttgtttaaaattgaaatatagttgatttgcagtgttatgttagtttctgctgtacagcaaagtgattcagttatgcaatatgtatgctttttttatataattttcgttatggtttatcacaagacattgactatcgttccctgtgctatacagtagagccttgttgtttatccggtctatttatcatgttttgcatgtgctaatcccaaactcccaatccgtcccgccccatccacactccgccttggcaaccacaagtctgttctgtagttaagccggtacacctaccctggaaaggaacaacagccaagatagggattgaacacatctgaagggggattcaaggtgatatttattgaggattccactgtaagaaaagcaaaaaaaaaaaaaaaggttttcttgaagattgtaaagaaaatatgatttattggagatatcccttgcttccatgctctaatatcaagcctccatatataatgcaagttttatactagcatagaaaagggaaaggagcagtcagatttactgttatgtatgagcatgaataatttttatttttattgctttcctacttcagatcaagttgaagtttttcccttttgaccacaggctcttgtttggtttgcagagagtatagcagaggtacatgaaatgtcatatatttattgtgtacgtttgtgatgggatgtaacataattgaagtagtaattcaaaagttatggttaggaattttaaataaatttaaagtcagagtttagtaattaacttctaagagttaagcagttgtgtgataatctgtgggtagactcatttagcgaccaagaagggactcactcaggccccttaagaaagtctctgacaaaccaaagggaagataattttagtaaacaattcagaaggagaaatgtgaactcattatgaacttgtaagggtgagtcctgggtagtgtagaacctgtcacgatctttctctaaatagtgccatacgattttacgttatgcataggaatcttagaagagtccatttctgtcctccacagcctttgtcttattctggtttgcttctgtatatcccattaacctcccaacgcatttctataatgtttactttaggaagatatgtattttagcttccc

SEQ ID NO: 64295 - DNA, 883 bp, Bovine  19866881615247
tgttgctgtcatctgtgtgaattccgggtcagctttgattggtgtgtttttctctttattgtgggattctattttcctacctcgtggtttttattggatgccagacatagtccgtctcactgcgttgggatattggacatttcacattcatagaagtattctcaagcttgccctgggctgcaggatgatcctttcaggggttgatttcaggattatgtaggtggcactggaactgcgcttatggggtagggggtggtgggggagcgtagttattatttcctccccagagccccatgaaccgtgaggctttgcagcctggctggtgggaacgggcctgtggtagactgcatgggtgcaccaggcacggatcctgtccctcctggccgggagtggtttctcctatgggccctgctgactgagcgaggggccctcgtccatctgagtcctcctgcagagctctctcaggaagtctgaccttcgagctctggccacccgagtctccagggaccctcagcaccaactccatgatgcagggaacctggcagctcccccagttcccctcctaccatcacgcctggaaactgagggcagtaaagcttcctgcgtgatgacccctctcaggaatcactgtcattcactgcctggtggtctctgtctctcagactgttgtttcacatattttgcttatcatttggttgttgtgtgtgggagggaaaatccagtacctgttaccccatcttggtggtacgagactttctaattgttgattttgtcttccccagcaccagagagcctgatgcaggctttggaagacttagattacctggcagcactggacaatgatggaaacctatctgaattcggaatcatcatgtcagagttc

SEQ ID NO: 64296 - DNA, 1018 bp, Bovine  19866880394603
gtattatctgcatatctgaggttattgatatttctctgggcaatcttgattccagcttgagcttcatccagcctgatcttttgcataatgtactctgcatatactagatactttgttttcctttaaaagtcatgtatttgtagagaaaaggcatgcacacactagaaacaaccaagaatgaagcattaatattaatccagtagtaatagcacaagggtaattagaaagacgagctcttaaatttaagaaagacaaatacttctggcaaactatagtaggttatttttgaagactaaaaaaatcttgataatttttgtctcacttttcatattcaacctcctatgaatgtacagaaaattctaaagcttgtcctaaaacatttagggtatctgaactcatcccaggcactaattattctgaattaaatatatcaacatttgtatatttggtatctgttattattacataaatatttagcacatctgcaaatatatcaacatatctatgttttgtatctgttattatcataaatatttaagaattaatatttaaccaataaatataaaagtaagttaataattactgttaatgatctattagaaacaaaacattctcgtgttaaagtgaaattttcattataaactgattgtatatgattattttggtgataaataagtttttgcaatttctagaagccaaggctctggattattcatgtggcattcttacttggaaatgcttcccacgtctgtggtaaaatctgatattatgaatggttcaattgatttctaagctcctagaaaacttttaaagggtaacatttaataacatataaaatttaatctcaccaaataaactggtattaagtataaaggaaaaatgtgtcaagttactcagcagtatataaggttacatgcttcagactacctgctttgtttattaaaacttccttgtcacatgcaatagctgtcaaaaatctcataacaggtatcagaacggctgtatttaaacaagacag

SEQ ID NO: 64297 - DNA, 2704 bp, Bovine  19866880485304
aattcctaatgccctctacttttacttcctctgactgactatcaggtatcagtcagatatcagttgagacaactgactatctgggaataaaaagtcaaagacgttatttatttctcttttgctaaaaaaaattgacatttcccattattctataaaagaagccttgtttatggtgcccatgctagagaacattgaaataaaatggtgagagaaacagagtatttagagaagagagtcaagaaagttcttttataattcatcaagatgaattctgaaagtttcttgcattttatttgtccttaactaaacttagcattaaatacaataactaaaacactattttattaagggtaattgattttggaataaagcaaatatgattttgaagctacctggtttccacaatatagacgtcagatgtccaaaagaaagtcaattttgcttctttgaaccttgttttctttatcaataatattggttaccagaggcgagagagaaaggggaaggggcaagatcaaggtagaggatgaagagatacaaactactatgtataaataaacaagctacaaggatatattgtacagcacaggaaataaagccaatattttataataacttaaatggagtataatctgaaaaattgttgaatcattcctcattatctgtgagggttttgctgctgttgttcagttgctcagttatgtctgaatctttgcaaccccatgaactgcagcatgccaggcttccctgtccttcactgtctcctggaatttgctcaaactcacatccattgagtcgatgatgctatccaatcatctcagcctctgttgccctcttctcctgccctcaatctttcccagcattagggtcttttccaatgaggtgactctttgcatcaggtggccaaagtattggagcttcagcttcaggatcagtccttgcaatcaatattcaggactgatttcctttaggatggactggttggatctccttgcagtccaagggactctcaagaatcttctccagcatgacaatttgaaagcatttattctttagcactcaggcttatttatggtccattttagacaagttatttaatcttatgtatcttaactttcatcatccataaatgggtctaatgttaggagttactttgtagagctatcatgcctgacacataacaaattctcagtaaactagtaactcattggcttgaattcaagctcgtcatcttccagatggggaagctgatccagaggatgaactgagttggcagagcaaggactgtgtgtgtgtgtgtgtgtgtgtgtatgttatttgctcagtcatgtccaactctttgtgaccccatagactgtagcctaccaggctcctctgtccatggaattatccaggcaagaatactggagtgaattgccgctcctttctccaggggatcttcccaacccaggaaatgcacctgggtctcctgcattgcagacagattctttactgtctgaactatcagggcatcttctactacagttctcatttcctgattctctggacccaagatggccaccaaagagtttcagggtgaacccttcccacagaggaaagggaattctgctgtaactacgagggaagaattatctgatctataaattaacatacatcacgtctgattttgaggcatctacaaatccagaataggcaaatctttgaaaaagacgttttgttttgttttgccttggcatctttcctgcttgataattaagaaaattgaagtgaaaattgaactatgttgatcataaaaattacatgtagcaacataaatttcaaaaagaagatactttttttttttttcaaaaagaagacatttatgcttcctgtaactactcaatatattctgctttttctgtcaatggagtatcaggttctagataaacaattccacggagatttgtaggggggaggacaatactacttaattttaatcttttccccaaaagcaatgcattataaaatatggtttagagtttaaactgatataaaccttgttaacagtcaggaggaaaaaaaaccccggtctatgtcagaccatatgttctgttgttttcttaatttggaaaatacagagagtgctagttcttcatgttcagcaagcatgtacagaccattctttctagctacaccatcattccttttaaaaaaacagaacatgctccatgaataggcctttccatagggcctcaattttatttttccagagtttggagaagcgttatccatcaagttccctccaccgttgagaataatgctgtttttgtcacacacggggtctattttgagctcaaatatgcacaccgactgtagactataggcatgcagaactgtcagcacaatgccccattacaagctgtccctatagcaagatgacttcatttttgcaggctgttctgcttactacattctccttggcttcacagttcaacgtagtcaaacaaggtgatggcatttttaaggctccagattttattggtcttcaaattaaggtaggtggccaggtgctattttagagcttcatcggggcaacctcatgataaatttgagtacatcgaaactataagggggcacttattttatactggaaacataaatactggtttatgaaaacggctgctgtaacaggaagtgacttcatatatcattacttgaaataaga

SEQ ID NO: 64298 - DNA, 2255 bp, Bovine  19866880533102
tgattacttataagtcgacactttactagtgttttctcatatttggtaacttaaatccttagcaagagtgggaactgagtctttcagaaaacactcctacaagatttgtattgcttcagatgatactctttgtttgaacaatgcagactctgttccactttggaaagaaggcaaatttcgaaaacactgacgggaattctcttctgatgttctttcatatatgtcagtattcttgtccactgatcctaagtaataacttttaaatgagtaacaaccaaatcaacaagagaagttatttactattgtggtttattgcgagtcacaaactaccttttgtatctgtccctagtctcatgtcttcttccatcatccaagaaaccatggcaggctatcttgttagcttgcaaatagagtaaaaaaaaaaaaatcacaaattctacatctttatattgatatagatatatggtatcttatataaagcagaagatgtctaaatagataatcttcaatcttttcaatttctggaagggaaaactttctggaaatatttttttgtgtgtatgacgtggtttagacttatttggcagtgaaaaagaagaactgactttgtcttggatcctgggagaaaacacacgatctggtcatattgggttagcaatgaaaggagacacaagagtccagagaaccaaattcacacgagaaaacttgacttcctttgagtcaaactaacagtgaagcaaccacttcatgtatctattcaaaacttgaattattctctttaaatctgcttctaaaattctattctagtgaatatttttaaatactaaactgtaaaaactatccttttagctttgtattcagaatagattgatcttgagagggtcaggtcactcagtgaagaaggactaagcaaatgaaaatagatgcagagatgagggagcagaaatatttggggaaagttagtcaagctcagaaacagaccaaaggatctaaggagtatcttgaaatgctttagcaaggtctgcctgtatccagagctctgccaagacaattcttaagacccagggggaatccacccccatttagtctgagttttgggtactgtccttttagaaaccccatgaaagttccctgatgaacacataaatgtcttaattgtgaaatctcttcttatcaaaatttatccatctatttttctgctggctttgccttgtacttttacattttgttaatataccatttactgatttttggtctgaatttcgttaaaattcaattacttttgttctgttttattttttttcagtctctccataccccttccatgtttgtctataatatctgttcgttggcagtcatctaagattagacctgcattgaggtatttctggcaagcatttttcaaagacagctctacataaaaagcagtagacgagtaaaattattgttggctctttgcctgagaaaaatatacagagttgtccacaaataccaactcagatcttgtaatatttctgtcaaatgaggtgtgaagtagtcacagatatatatcaactaacagagagagactttgggtattttattttaccaaaaacattagaatacttatggtctgaatcgcgaaacactgaaatgtctgaatctatgtattaacgatgtccttttcacaaactgcaggagaagcttcaaggttaaaaatggatctgtgttaataatcaagtattaatgacatagtaacatttttacaattgaatatcatgtttataattttaagtgttttagaagatgggaacttaaaattatctcaacccaatcatcctattcaagaaaaataggctatttttgaatatatgtaccaaaacatcttctataaaatccacataaggcaacacttttctttttttcttttctccccagctttattgcaatatgatacacaacattatgacttgatgtatctgtgcatataccagggctttcctggtagctcagctgataaagaatccacctgcaatgcaggagaccctggttcgattcctgggttggggaagatcccctggagaagggataggctaccactgacatgaaacaacagactggttccaaattgggaaagcagtatgtcaagactgtatattgtgaccatgcttatttaacttatatgcagagtacatcatgcaaaatgccaggctggatgaagcacaagctgggaatcaagattgccaggagaaataccaataacctcagatatgcag

SEQ ID NO: 64299 - DNA, 1124 bp, Bovine  19866880668913
tttctgtgaacttgttaatataaggtagtatattaaaatccccccaggaatcaattagttcatagaagtaagtattcctctttttaaagtgcagttatctcccaaagaattgtatttttattgtttagccagccatgtaaaatatttataaatatttttaatgctttatacaaaaaaaattaaatattttttctacccgattagtactcaaagtgctgcttggaccagcaacatcaaatatcttcaggaagcttattagaaatacagactcttaggttctgcacaaacctattgaacaaaatgtgcgtttcatcaaaacctcagctgattcagacacacatttgacaagttatatctactttctaaaaatgaatataagtactttaaaatgtgctgtcattatcataaggtgaagaaagaaaatatcatatagaatgtgttcatgtaaatatgtaacaaagtattacacttctctttgagtcagtaatataactctttaatatttttgattgatttatgctggaaattttctctttgaaatgatcagaatatatttaaaattataagttacaagtaagagattttaaattattttatgcattgttaaaagcaagatgaatgagagaaaaattgaagcaagtttgaagacacccgcactcctttgcacttaaaatttgttataccacaagagggtgctgatgcttttgatttgcaatttcaaaaattcacatgtacatgaaatgattttcataaagaaaagaatgaatatgtttcaatgtcattctcccaaatctctccaccctcaggtatacctgtggcggattcatttcgatatttggcaaaactaatacaatattgtaaagtttaaaaataaaataaaatttaaaaaaaaaatccaaaaaataaaaaaaaagaatgaatatatgtaatctataagtaaacctcacacaggatgaaagggtgtagagtattgttattattattattaaaatggaagcctgggttgtgaattacatgtgctatacaagattcttttatgtaaaataatttttaaaacttccttcatatttctacttttttgaattttccgcaaagtttaaagaaaactatttaacataaaatca

SEQ ID NO: 64300 - DNA, 3174 bp, Bovine  19866880736891
actggatgaacaacctgctaggaggacttcctttgtagtccagtggcaaagaaattgccttccaatgtaggggacatgggttccattcctggtccaggaactaccgtcccatatgttttggggcaactgggcccacagagcacaacgagagatcctgaggctacaactagagagaactgtgtgccacagcgaagacctagtgtagcaaaaaaaattttttttatttttttaaaacttaaaaaactgctagcattagggcctataagcaattagtatgtgaatttaccacactctctctcaagggcgttattttgagttagcaaattatgtaattaatgcagggacaccttatcagaatgaattaatatttgtagtctagatcaagaataaaaatatcatctggtatggtatagcatgtaattattaggtttatggtcaaagttcattagcaagcaacaaatgatacagtgctcataggaacttctcaacatataggaccttatttatttaacataaggtcctttttatgttggaacataaaaattatattaaatagtgttcataattagtttagaaacaaaataataagtctaagcatgatgtatcacctgcagtggctgaaatcatgctactgtaacataatggtacctaatagggtaagtagtcattccgtaactaaactattttgatgagaaatgctttctcattattgagagggataaactgtatgaatgctttaggcagagacacaccccaggggaattaaaattaaatacacttttaaatggtggttaaaattatgagctctgcaagattttgtatgattttcatatttgaaaaaaaattacatattttacccatcatcctacaaaaattaataatttatctaatcccagccttttagattaaccagccttccttgctttgcccatgtctatactgttaacagtgtgcttgagttgcctcatttattttttagtcaatattgctgttattgtcatttttaatttccaggcctaatttttattttattaaaaatttatttttaattttttggctgcactgagcagcatgcgggatgttagttccccagggatataacccacaccccctgtagtggaaacagagtcctaaccactggaccaccagggaagtccctgactcatttctatttccagttctattcctgaacatctctagttagctctgccgatctgttaaaggcctcccccggcatgcgtgaatgtgtgtgtgctcagtcacgtctgactctttgcggcttcacggactataacctgctaggctcctctggcatgggattctcccggcaaaaatactggagtaggttgccatttcctcctccagaggatcttcccgacacagggattgaacctacttctcttgcatctcctgcattggcaggcagattctttaccactagcaccaccccctacccttcaaatctgattgttgatggtcctcctcagacactgtgtctatatttctgtgttgatcacaaggtgtccttacttctcttagagccgtgaccaagctttcaggcataccagaccagtccgcttatctaaccctgcctgacattagtccacatgcctggaatttcagtcatttttaaaataaagagacttgtttgcaacctctatctgccaaccctttgctgctgctcctgctgctgctgctaagtcgcttcagtcgtgtccaactctatgcaaccccatagacggcagcccaccaggctcctccgtccctgggattctccaggcaagaacactggagtgggttgccatttctttctccaatccatgaaagtgaaaagtgaaagtgaagttgctcagtcgtgtccaactcttagcgtccccatggactgcagcctaccaggctcctccatccatgggattttccaggcaagagtactggagtggggtgccattgccctttagagggtgacaaaaatttcaggaaaaagtcagggtttttttttgttgttttttttttgtgaatacaatataatatcttgaatttgtgacaggtgaaaaccgaggaaaatatagatgtactctgatgcacaaatcagactttgaatagcatttgggtttaaatctgttagaaacactagtattttcttccagactaaaaggagaaaaccactcccagatgtcttaatttttctgactaacagagaagctttcacaatttatgtaatgataggttcaattaacacaagtcttgtgattcatttgcaatctaagtgaacaagtttcagcccagaaatttttacaaatgtttgtggttattgtgtatttggctgttgatggtcaaagaaattaaacaggaactgatagttaacaaaaaatatctcaggaagtttcttgcacttttcagttaacaatagaagataaaaaagatatgtaattttgaatttacacaaacattttcactaacttaaccctggccaagtcactttgtttattgatctcatgtaatcaagtaaaataaacattctgtaacttactcttttattaaaatgggaaaattcattacaccttttaaattccatgacatttttttaatgagatactaacataattatttttaaagttgtgtgcattctcagtcgctcagttatgtccaactctttgcgatcccatggcatgtagcctgccaggctcctctgtccatggaatttcccaggcaagaatactggagtgggttgccatttcctcctccaggggaatcttccccacccagggatcctccccacccagggatcaaacccacatctcctacatttagcaggcaggttctttactactgagccacctgggaagcccccttttaaacttagattattctaataaaagttccagcatataatttcttatatctgccattttgttcttattaattatgaatttgggtaagctgtactgctccgatatcctgagaaagaatactgaactcatactggaacatgcatgtagaaacacagaaccaatagcagcatggcctcaacatccttcttccacttttcaaccagaatttgtcccagaaaagtgaattatgttttgctcttaattctttctttccttttaaggaaatagtgtagccatctatactataacaaaaaaagtattcgtaaatatttcattaaaacat

SEQ ID NO: 64301 - DNA, 1347 bp, Bovine  19866880754015
tagtcataaattagttcatttttctcgatagtcaccctgtgattcaaaagatgcatggaaagttatgtgtgagtgctaagtctcttcagtcgtgtccgactcttttcaactctgtaaactgtggcgctccaggctcctctgtccatgagattctcaaagcaagaatacgggactgggttgccatgccctcttgcaggtaatcttcccgacctagggagctatcacttgggatcgaacctgcattggcaggcgggttctttaccactagcaccacctggctatctttaaaaacaaatgactgcttttgagctttctaacgtgaaaaacaataagtatggttgttgttctgccgctaagtcgtatcagactctgtgatcccatggactgcagcacgtcaggctcccctgtcctccactctctcccagaatttgctcaaattcatgtccattgagttggtgatgttatctaaccatctcatcctctgccaccgccttctccttttaccttcttttaaaatctaacgttgatatcatgcacacatttcacttgtaaggaaagttagacataagaagtatcactgcttgatttcaacttgctgtgttgataattctatcaagtttctcagccatatggtctgtagcttctttccacactccatagctccagacttgcccttctaactgcctaccaaacatccatacagatgtcttgacgataactccatctcagcaagtgtgaaaccaaagatacgatctcttcctatattccctaaaagtggtaatatggagaaacctgcaaggatgtgtaatcattcactacaatctctcaaatctttctctgaaattaccttgtgatacatttctctctcttgctacttctttgccccgggccctcagcagctaatacacacaccatgaaggatgtaggcttcttcctgcctcgtctccttatttccagttttcactttgccacatggctgtgggcaagtgcaacagatgtattccttcaaaatccaattttccaaaagccaattccacataaggatcaatttgtcaaatagtcaattaaccaagtttgtcgaattatacaaaaatcttctcttgagactggtgctttgagtgatgtctcaggggtgctcaggactgtcatttgcagaaaaaagaaaaaaagtctagtagtcagtaaatatcagtgaatgctcaccctgtactagacacacttttaagaaagtgagcttatagtaaagaagaaagacttaattcctatcttgagttatcaggaaagcaattttataaatttaggaaattgtttgtttcaggaaatacagccacaattatctctataaaa

SEQ ID NO: 64302 - DNA, 1886 bp, Bovine  19866880851778
tgccctaatggtgtaatgggctctaatgtacccttatctttacaaaatcctttctttgtaaaaaaagaaaatagtagaaccattaagaaaattaaacgtgagaaatgagggggagctgatacaaaggatctgacagctttgaatgtctatcgctttgcatcaccctatatggttttcctaagtattgtgttcaaaaaataactcttaatacaagtttcaaaatctactttagatagaacaaatacttgatcttcaatttctcatatgagaattggttggtacatgttttattatgctttcttacattctattcctatttaacacatccttatatataaaattaattacatagtacttaattaataatatattatatattggggctttccaggtgactcagtgataaaagcatctctctgccaatgttggagttgcaggagacatgagttcaatccctaggtcagcaagatccattagagcgggaaatggcaaccccctactatagtcttgcctgggaaatcccatggacagaggagcctggtgggctacagttcatggggttgcaaagagtcggacacaactgagtgactaagcacgtatgcatattatatattaatattatcagtatattaattaatggcatatagtttcatatatggagaaggcaatggcaccccactccagtactcttgcctggaaaatcccatgggcggaggagcctggtgggctgcagtccatggggtcgctaaaagtcggccacgactgagcgacttcactttcactttcatgagcattggagaaggaaatgggcaacccactccagtgttcttgcctggagaatcccagggacagaggagcctgatgggctgccgtctatggggttgcacagagttggacacgactgaagtgacttagcagcagtagcagcagtttcatatataaatatatatttgtctcctattttctgtagtttgcattatgtatttgcacttttttatgctagatattgcatatctactctatttataaaatacatatatatgtatttgtgtttgcatgtgtgtatgtcgtaaagagttcgaagtgactctgaagtgacttagcacccacacacatgtatacattctccccacccctattttctgtagcatgtgttcttataagccaccatgcataatctgggggtagaggtagttatgagttagttaattaagtaaaccaaaatctacattaaatcacagcccaagtatgtaacacctttctcttcagtagatccgttaagctttgggagggaaagcaagggaagagaaagaccatgtgcattcaaaccagagcacaactgatgaaagggtaaagggcaaataaattttgattttaatgttacttaaccctttcagtgcccccagagaaggtagacagagttgaacaaaaggatactgctggaaaccctgcagagctgaccacacaatagctctgagggtagcagaatgaatgacttgcaaagagatcacaggctactaaggccattggcccaggaggggttaaacaactttatctgatcttcaactcttactgaacaattaacgacctacagtctggagaagttaaaagctagaagtgaagccagggctcctcaagactccagctggcattaaatgacaaggaagaattcaggggccagacaaagccgttattatgagccaccaccaagaaagaaaataaaattttttaaaaggggggtgtgtgtgtgtgggaggggtgggggagaatggaaaacagaacttaggagcaactttatgcttggtttttaagtaaattaaacctgaattgttaatcttcttgcctttgttgttaaacttgtttgataaaatttcaattccagaata

SEQ ID NO: 64303 - DNA, 1713 bp, Bovine  19866881010603
tgtttatattctgtgataagtcaccaaacgtatttcttcttttagactgttaagccaaaagatgaatcatcctaaaatctttatgccttattgccttttctactggtgcagacatttgtatttggtgttgtctttcttaagaattttaagagcattgttataagaatgaaagaaggtctttatcttgtctattaaaatctcttcaagggctccatatacttgacattttctcagccaatcttgttttccagggcatgaaattacttatcagcaaatttccgtgtaggctctccaaatcctaataaacaaagccctttaacattgactcatttgaaaaccgtttattacacaagttgtatttattacagaaggttatgagaaaaacaaacttaaattacgcttcctgcctcagaacgaacttaaaacctagaagtatatcaagcttatgcatagtgctaacagaaactttattcaattagtaactgtcacctgttagttaaaggtaaaggtgtgtgttcagtcgtgtctgactctttgtgactctgtggactgtacccccctggactcctctgtccgtgaaattttccaggcaagaacactggaatgggttgccatttcctactccaggggatcttcctgacccagggatcgaacccacgtctcttgagtctcctgtattggcaggcaatttccttactgctgagccaccagagaagccctattatgggtacataaataaagcatggcatagaggagaccaaattttgttgctgtactcacacatcttatattcttctgtgttctattgaaatatggagaatgttactctcatggagaagaagtagggtcataaaatacccactttgggagcctttctgtttgatataaatcaagctggctcacctggctgagacttcaacctccagacacagtggtttcagatttctaagggatcttctcagggatcccttctaagggatcatttcctaaactttacccccttgctctacctctgatctctcctaagtagatggaacttgctgggttttgctggaacttcatttcctccttagaaaaatgtacaactttctcaagaagaattgcttggaggctgcccatggttccttccctcatgctaattccacatccagtaacaatgtctcagatattgtgatgtgcgcatcactggtaatattccctcagttgccatctgtgggtgtatagaaccctgctaaactcttagtgctctttggtacaatgtaatattactggtaatttgggaatttcagtctgcctcataattctgctgctcatcacaaattactttcaattacttccaatcttatggaatggaaatcacaaagaaaggcacttgaaccatctgactaaggcaggacaacatactgtcacttccagggctgtggcatggaaaaatctgatcatgtcagagagggagagggatcgactatatacagaactcagccatctaacagatgttccagggccacatacaaaagagggggtggtctcccatcagataggcatgtgaggcagctttccatttcaggaccatgagggagcggtctctgattaaaggaaggaatggctgaggagggaacaaaagctttggcagtttttcaaaagggtggtttggctccccacacaatcccatttttcaacctgttagaaatcagcactttaaggagacttccc

SEQ ID NO: 64304 - DNA, 1963 bp, Bovine  19866881108065
tatatagaccaatgacccaaagctctcagaatgacctgatgacctcaggatcatggacagcttctgcacaagatattgcatcaaaacctttgtttaattactattttgttttccatctgcttacctaaaatcaatcttcttgtaatttctataaattcctggtcatcactcaccccttaatggcccttcttcttttattcccttcatactaaaattgttagagcataattcttataccaatctcagatttcctgaacagcagccttcaaacttactgattgctggatatgctattcctcaccagatgcctgtgatacaaaccagggataattccagtctcaacaaatgagataaaagagaattacagtcaatggcatttcacttgaacctatgtggacaaatggcccaaaacaaatcagctcatgactgtttatgttgctctcttatagaaagagaacaaattatcacagtctagtgggtagagctcaggtaatcctaaatttgaatttagaatttcctaaaagcacaagccttggaagaaaagttacgaccaacctagacagcatattaaaaagcagagacattactttgccaacaaaggtccatctagtcaaggctatagtttttccagcagtcatgtatggatgtgagagtcagactataaagaaagctgagcaccgaagaattaatgcttttgaactgtggtgttggagaagactcttgagagtctcttggactgcaaggagatccaactagtccatcctaaagatcagtcctgaatattcattggaaggactgatgctgaagctgaaactgcaaatactttggccacctgatacaaagaactgactcattagaaaagaccctgatgctgggaaagattgaaggcgggaggagaagaggacgacagaggatgagatggttggatggcatcaccgactcaatggacacgagtttgagtaaactccaggagttggtgatggacagagaggcctggcgtgctgcagtttatggggttgcaaagagtcggacacaactgagcgactgaactgaactgaaaaggccgaggcaattacttactgtgtggaatagactaatggagatacaaatgtgtaaaggagctaatgcaaggtcttggtttcaattttatgccaggaataacttcttttttcctggatagccatgttttcctatcagatactgcttcctctgtaaccaggaaggctagttttacttgtctcaaaccagtagatcgtgcactttagcaacagtattccaaaacttttctgtgcacagatatttaattctataaatcatctaaccaggaaattataattcagatgggagctccaaaacaaagttccccttgattattcaggcactttacctgggggaattactgattcattgtttacacaaacaatcaaagcagtgcttccaaaaacagggatcacataaacaaaaggttatacgacacagatcattttaattccggcggacgttataaatagctcagtcagtaaagaatatgcctgcaatttgggagacccaggtttgcttcctgggtcaggaagattctctggagaagagaatggcaatccactccactattcttgcctggagaatcccatggacagagaagcctggtgggctacagaccatggaattgcaaagagtcagactcaactgagcagttaatacacacacacacacactctacacggattatagatcagtctcaattccttggcaagaggcaagaatagagacggacaatctctgtcactgaattctatccagagtccgagatgcttttatgcagccactctctcatgagatgctcaccgtgataatacaatattgaaaagattgactatggaaacaagggaacatcatggaagcagtaaagaccctggatcttgagtcttggcttttggccaacttcttgcaagggagagaatga

SEQ ID NO: 64305 - DNA, 2010 bp, Bovine  19866881164570
aatactattcaatcagtatgtagagacagcaatgattttttttccctagttctattagtgtactgaaattcaataaaacacatattttgtctttgtctatatgaataacaggttgtatgtatggtagaaaggatctataagatggatcaaaaacaagttaagaaaacttgggttttaatctcttacgaaaatttattataagcattcttatttcttataatgaatcaaatgtggcttgtggaagactgaagaagaatgaaaaatgttgaaaggtggtatatgaagaattgaagtcagcgggagctatgacagggaaattcaattgacctttaaatgccatttgtggatagtatctatcatgcctacaacctacattactataactgctttaaaatccacaagaactttgtgaccttctataacaaactcaaaatgccacaaggctgacacaacaggaaggacacaggctctgatgactgacgtctcctgtgcatggtgcggtcgtggtctgattcgcacggtcctccacttcaggaggtgtccaagactggatccgctcttgctctcttggtcatttcccaccacctgcaccagtacacagatcctggggtctgctgtgctacttcagacttacccattacacctcagtctgtgaaacaagttcccattctgccttttaggcgtatagggtttccactgttagtaactatccaaatactaattggggaaattacagaacacttcactttaaaataattagtggttttagcatctatttttttgtttctttaaaatgcctttgtacaaaatcaaacaataaggaaatatataaagaaaaaaatgaaagattcctcccaccttaattctgctcccctaagctaatcatggacagtagtttggtttgacacatagagataaaaatagatatgtaaatatttacagttcataaaattcatagttttgaccacatttttttcaataactagaagacatacataatatatgttacttgtttttaaaagctaatattttaatatatttccctatatatttctgctgaaccaccaatatgaccaactgaatgtcacaaaaggctctctgccatttcaaatacagaaatactagataaagtatgacaaaataagataaagactcaggtatggctagaatgttagaactatcacactagaaaattaacacaaccacaattaatgtgctaagggctctaatggattaaaaaaaaagcaagcaagaatagaggggcaatttaggaagagatgaaattctaagaaagaatcaaaaagaaatgctagagatcaaaaccttaacaaaacaaagagctgatgggctcattagtagattagacatggctgaggaaacatctctgagcttgagaatgctgccgctgctgctgctgctgctgctgctaagtcgcttcagtcgtgtctgactctgtgcgaccccatagacagcagcccaccaggctcctccgtccctgggattctccaggcaagaacactggagtgggttgccatttcctttccaatgcatgaaagggaaaagggaaagagaagtcactcagtcatgtccgactcttagcgaccccatggactgcagcccaccaggctcctccgaccatgggattttccaggcaagagtactggagtgggctgccagtaccttctctggagcttgagaatatgtcagtagaaacttccaaaacagagaagcaaagagaaaaaaaaatctagaacagaatatccaataactgtgaaacaaccacgaaagcataacatatacatactggaaagagaaaaaagaaagaaacaaaagaaacatttgaagaaatagtaacagagaatttctcccaaatgaatgtcagccaccaaaccacagacacagaaagctcagagaacaacaagtaggataaatgacaaagaaaacctacacttaagcacattatatggaaactacacaaaatcaaaacattttttaaagtcttgaatgaag

SEQ ID NO: 64306 - DNA, 1364 bp, Bovine  19866881231609
ctctaaaggagagagtgagataaaggagttggcaagattagttggcataagtggaatattctagataaaggagaagtatgcacacaaataacccaactccttcttccttacctctcttcctcccttcctcctttctcttctgtcaaacaactacttactaatcaaacaccacacacaaaggattctttcaagtcctgggagtcattcagagattaatattcttctttcaatgtgtttatgatctagtcaatgaatagtaaatataactcgggtaaaaagcattaaaaaacatataaaatattcttgaagcatggacatattcccttgacattctagttatatttttctggggaaaaaagcagttctttcaatcaagaagtgtggacggataatttcagtgccaaagtggatcaggctgactcactttatgctgctctagttttctaacttcagtctcagaattccttcacggagagtaattgtgtacacaccttgcaggtatttctcattggcgctattaggagggaagtccatctgttttaccagtccaagttatttttgcatactttatatgcaaagatgttatacagaggtaccagaaatggacataatgacagttaaatatggttactagaggtagtcctctaaggtcagtgccacactgtaaaagttcagatggagtagaggaaagcatgaaaatcccagtctttctttttcacatgttgtgctgtagacatatcattaagtgcatcttcttttgttttctttatctcttacaggtctgtgaagcaggcagaagaagttacaagtggtccttaaagaaatggcaattaatcaaatccttatgtatagttctaattttatttactacgtgtaatcatttaaagaatggttatttttataatatcaataataaacaagtactcttgtaaccagggggtgcctaagtgtgtaatcaacaaaacactaaccctggcaaaggattctggggtggtcaggctgcctgctgccttttgacatggttagtgtcctgggtttagattactttatacctagttattaagattactatttgatacattaaatattgcctgattcaaataactttgcttaaaatttttctgtattttaacttgtctagggttttctacttcttatatttttataatattttctcattttttagattaataaacatacttatccgcacgtgccaagataagccatttaggtctctataggagttagctatcatgtcatcaactgccatatatattttttgtgcagcagcaagaggcatgttctccaccactgccccttcctctgattatcctccctagtcctaccaaaacaaataattgata

SEQ ID NO: 64307 - DNA, 807 bp, Bovine  19866881314251
ggaaggagagctcaaggaaagccgctaggagattttggagggctagtgtttggtataatcaggttattatcaggtattattcaggtttggtattatctgcttgtgagagctaaattttttttagaaagtagggtaggtattttgactcccttcaatactcactgtgtgtgtcatgttatattgcattgatacttaaataaatgaagtttctatccttaaaactttttcagacgagtgaggaaatggacatgtaattgaatactttacattgcctggtgagtgatgtaacagaagcatgtgcaaatttctaggggaaattacaaattacattgtctaaaaaaaaaatctaacaggtatatagaggaaaacaaattactgaaagtgatttatcttcagaaaactgctaggagctatcatataatacttagtgaagactagataaaaggatatctgaaaaataaatgcctgtactttatttaaatttcaaaataaaaattgctatgatatgtaacttcagagtctgcattatccttaattagataagtttgctgtttacttcttaataggaaaaacctttatgccctacattttgttcagatcagatcaggcgctcagtcgtgtccgactctttgcgaccccatgaatcacagcacgccaggcctccctgtccatcaccaactcctggagttcactcagactcacgtccatcgagtcagtgatgccatccagccatctcatcctttgtcgtccccttctcctcctgccctcaatccctcccagtgtcagagtcttttccaagagtcaact

SEQ ID NO: 64308 - DNA, 3077 bp, Bovine  19866881429208
ttttagatcttcctatgggtgggtttttcttgtctttggttctcagtttgaatatgatctcagtcaagtcaaagtatccacacaattactttctatctcatcactagatttggattatctgcttagcactttttaaatacctggtaacttcttgcttattaacttagtggtgtgttgcttctttcttccttatgcccccagaacagaatcctgtctgacttcttactatagtaagaattcttcaatgtgtctaccctgtcctaggcactctattgagaactaggattcagtggtcaacaagatccagttcctgccttctcaaagggctagaacttagtgagagagacaaatgaacatgtaattaggacacagtgtgaatgctatggtagcacaaccatagggtgcagatgtccttttcataagtcaaaattgatagtctagagtctgtcgtcttgtcaacgcgattgggaacatacttccctaagcgcattgctatgcttagttgctcatttgggtctgactctttgcaaatctatagactgtagcccaccaggctcatctgtacatgggaattttcaggcaagaatattggagtgggttgccatgtctacctctaagagatcttctgacccagggatcgaacccatgtctctggcactgtaagtggattctttatcactaagccacctgggaagcctctcttcattgtagagtctggggataatcagtttctgcatcaattggttagaaatgtacaatctgagactccaccccacacccaccacacccagcctgcaggttaacaaggtaactttctttggtctagaagacctcagtcttctaaacttgtagatctcactatacactcatttataaacatgataactgagaagtctccgaatctgtttttagatctggttgttaacactttcacccagagaactgctctttttctaccatctatcatttattgtctttaaaccagattgctgtacgtggccaatattttttttcacagtttcaaagagtatttattttaaaacaagctttcctgtggaaacatgtaggtagctttatgaaattttaaataaaatattcccagcatcttcttttcatgtgtaaacatcctcacatttatatacataccattgaatatgcagagaaataattaaatccataaattaggaaatagtgaataaggtaaaggaatattatacccacgttacgatataaagttttaggtttaaaacacactttatgctcagacagtaaagaatcttcctgcaatgcaagaggttcaatccctgggtcaagaagatcccctggagaggggagtgactaccaactcctgcattcttgcctggagactcccatggacagaggagcctggtggactacaaaccatggggtcacaaagagtcagacaagactgagtgactcacacttccactttttcacaaaggaataaggtaaaggaatattatacacattctaagatataaagttttaagtttaaaatacgctttaagaaaattccagagagctctttggtaatgtgaagcaaactataatgttacaagtttttgtcttacattttctatttctcataaagttgtataacacattttatttctataggtctaaattaaaaaaaaattcactttgtgttttaatttgagcagctactctgtctctgttgctactactgcatgttgaaagcatcaatgaattctcaattctgaaatccccagaaacattatcctatccttcttgtttatttagctaattttattacaaaaatgttgcatagtttatgcacatatgcattggaaatgatttctataatcaagctcattaacatagcttcttacacagttgtcatttttttgtgtgagtgattagagcacatgaaacctacttttggcaaatttccagtattaagcacaatttctgtcctttatggtccagaagggagatttaaaaaatggttggctcaaaagagattaaggtgttcattaatatttcatcctcaataagagtcatgattcaaacaaaacctcttttctttttttcaagtcacaccccatgtggaaggtctatatacttatatacaccaattataaaaaaaatttaaccactgaggtgcaataaaaagacatgtcctgttttatccaaatctccttagattggcttctccaattacagatgagagtcaggaaggagcatctgggagtagatggctgtcatttctgagacatgcagagtgttagactctataaattttaattctgtgtctgaaggcaaaggaatatttatatttaaaaaagaaaacacctgaacaaatggttcaagcccattgacattaaaaaaaggatgttaaatattccagggaaaatgatcaataatgaggtagttgagtatactgaaagaaactgtgtctctgaagccttagggaagaaattgaaaccacatctaaaacccacagcaaaaaaaaaaaaaaaagttagctgggaaaagcacctggccccaacaatgctatgactgagctcataaaagcagagggcaattatgtagctagtaccctgtaaaatgtgtcagagcacatggaaaaacagagggatagccagcagcctggtacaaatcaaatggtaaagactgctaaaataagggagaactgagagcaagaaaggtgcacagatcaggccggggaaagttccctgatttcccatcaatccagccacatgcctcaaatgcttcagtaaactattttaagcacaagatgtacaagatactcccaggaggagagaggagaagtagggaactttcagaaagaaagccttaactaaccacagcgatggaagtggagtcatcgtaacatcttgattatctttatatgattgagtttcaaggtctccatcaagaggacagttttataatgaagaaatagttctgaaactacaccgtttatttagcccgctccttccctcatagtggagtcagcatagaagccgtgggtcataagctgtactttgggaattgaaatgacttcaggcagattataccaatcatcattatcg

SEQ ID NO: 64309 - DNA, 829 bp, Bovine  19866881501903
tgtgtcctgttgagcgttactttgaaagtagtctctgttctcctgatcctttttgtttttctctatttcagtgtaatcaatacgctcaatataaacagctaaatcttcaaacagatttgtgtgccttttgagagctacatttccaattacacactaaattaagcacatgattgaacacaaacactaacattttccaacaggtggtgaataagcgctttccattcatcagctcagcaacagcactctggccaaatcgtcactctgcttgagagtcctcctaacataccaacagtttataaccaatctaaaaacttacttctttaatggaaaaatttaggagaacgaagtgtctaattctaatccaagattacagagcagagcagaagttaatatttccatatgtgaagctaggaagtaataaagttgtatgtgttgcaaaatatatcaaagtctatctaaataaatttagtattgggattttggatgtttggaattaataattaatgcttgctctgccataagaaaactgtgtgtgaccctatggactatagcctgccaggctcctctgtccatgggattctcccggtaagtattctggagtgggttgccacaccctcctccagggcatcttcctgacccagggatcaaaccctcgtctctgaagtctcctgcattggcatgtggatcctttaccactagcaccacctgggaagcccaataaatacttcacagattggagaaagtactacgaagctttttttttctctatctatggaacatcagattcttgaggatcactttgcaggataaagaaatgcaagcattattc

SEQ ID NO: 64310 - DNA, 621 bp, Bovine  19866881718723
atgacaatagtgactgctctgccagtcttactaagaatagtcacaggaaaagtaagtagaggttctataggatctactgagtttagaaccactttccacatttgagcaaagtcatggccatttgttaatgaagcctacctaccaaatataatctagtacttaaatagatgagactataagaacagtacaataaaatagcctaagcacaatttgcatcaccgattcaatggacatgaacttgggcaaatgccgggagacggtgagggacagggaggcctgccatgctgcactccatggggtcacagagtcggacatgacttagtgactgaacaacagtttgcatgttctgcatgatctctgtttagagtaaaaagaagcgcagttctgaaaggcctccaggttcccacacagacagcaagccgccacaatcccttatcacactccctgcctgaatttggcataaagttagcagacttgaaaagctcaattaaagataaatagttcttaacaatgctgctacactccctgaattcacagaactaacgtaaatacgttcatatattacttgtttcaggagaggatattccgacatgacagccccggaacatcaactgctgacta

SEQ ID NO: 64311 - DNA, 849 bp, Bovine  19866880361146
actgtggtcctgtctccaagacctcagagaatgtagatctgggtcttctgctggtagcagtgggcaccactgtgggggagttgtttgctcactctattatccttctgcctctgcagatattgctgtggaactcctccagaaggcagcccccagtcctattcgccggctccagaagaaatatgtagcccacgtgtcccggtgagtccacaattgagagatacagagtgagagtgtttgggttctagagagaggggaacagttacctctaaagagaacttgtaaagaaacagggatgagcatcataagttacaagaaccaaaagatccttgcgtttaattcctaatgctttctgatacccagagaggcttgcatctctccgtgtgctatgatgctggctctggtatacattgagcggctccggcatagaaacccagactacctacagcatgtgtcatcctctgacttgttcctgatctccatggtaagatgcccccttccctttatctccctggtaagcctggagccaggtgtgagctctactgataccacctctggttcctctgcagatggtggccagtaagtacctctatgatgaaggggaggaagaagaggtcttcaatgatgaatggggagctgctgggggtgtggccgtgcccactctcaatgccctggagaggggcttcctgagtgccatggtgaatagctcttctctctcttgctctgttttcctgacctgcttttatgttcttttcatcctttgttttttatctcccagcttcttgtggtctcttcatttatctttctgtttgtcttctttatgtcttcccttattagcatcttcccctctag

SEQ ID NO: 64312 - DNA, 1098 bp, Bovine  19866880550496
cagccagagccttgggtgtcagcaagggccagtcccactcagctggggagggagaaggagccactttggggccagactcaagtctgaagcatccccctgcctgcaaaagcctgtgacacaagaagcctaaaggcctcattgtctttgaagataatgtcttgggacaaaacccatcaaactcagagtaaaaacccatccctttactgcgatctacaaagtccctttggtctgacccttacctctttctctagcctcatctacaaccacactcttcatcattcctttcactccagatacactggccttgtttcaggcctttgtacttgctgtgctgctggccaccacagggtctttgcatatgctgttctctccacctagaatgctcttgtctcttgcctttccctaataagctcctacttgtctctcacatctcagctcagcgatcacttcctcaagaatgcctttcttgggaaatctctggtagtccagtggttagggctccatctctcactgctgagggcccaggttcaatccctggacggggaactaagatcccacaagctgtgtggcatggtcaaaaagtaatataaataaataaaaataaataaaaaccattaaaaaaagaatgcctttcctaacctctccaataaagtcagattttttcccattgtaaaccttcatcatacaaggtacatgtcctttgctgtatttactacgtgcaattctacattcacttaggtaactattgaattagtatctgtattccctgacatattataagcttcctgaatgcaggctctgcattctaggagaaagcctacctggatgaggcagccaaaaccatggtgccttggtgggggcagacaactccccggggatgatgctgagacccagaagggcagagacaatccacacacaggccactgggatcagcacctgagggacaagactcagaaaagaacccctcccccagaaccttccaaccttcttaaaggggtaagcaacaaccaagtaggggccaagtgagcaatccatgccagccctcctaactccaactgcctctcgcccaaactcccacataccgagaggagcctgaag

SEQ ID NO: 64313 - DNA, 1560 bp, Bovine  19866880825744
cttttggaacatcgggtcacgaatggcagcgctgccgggggtacacctgtcatcagggaagcaccagtatcagctgggattgtagctgtcacatctgtggcaattccacttgaggggtgggcactgggctgcttcactgtcttctagtttagttggacccaagctttcccacggtgaaataagtcattataaattactttgaggacttccctgctggtcccggggctaggactccgtcctcctgatgcggggggcccaggtttcatccctggtcaggggaactggatcccacatgccacaacttaagagtttgcacgccacaactaaagatctcacatgctgcagcaaggattgaggattctgcttcccccagttaggattggagcagccaaataaatatttaaaaaataaatcactttgatttcttctttatattacaatgaggacattatatacagagttgtgatcacagttgtcatacatgacgaaggatgtacaaggcttgagaactactgtaattgcgatggttccaaatggcagtggtgaggaggcagtacagtctatcaaacttgccctggctatgctgggggggtttcctccccaccactcctatcctgggacaggagacccagatggagattcttgggagggggagggactcggaacttggttccccggttaatgggtgatggaatttgcacaagagctgggcaaaggtgaaagggcttcgtcctgccccaaatccctcatctcttcgctctgcttcattgacactcccgccccctccctgctccaggcagctaacttcacacaaactctgacctcttactctctctttctccctacttaactctggcccagggtggccaggacgagacagaaggcagggagcatgagccagtcaccccccaacgccatacagctccagtctgtgggttcccagggcaccctggctaccctgccacggccacccgatgtccaaaatccctcctctgactcttgggcctctctgtctgggcctcctccttggggcctcagctgtcttctggctctgcaggtaggaggcagaggtgcctgggtcgctgttggctgaagagggtgtttggagggtgtaggtgtggtggcatgagaaaccctctggaaatacgtatttctgcctaatcgcccgcagcatatcttggtgttggcttctctactctgcgcctcccacctgctcctgcttcaaagtctcccagcaggaggactctctttctcccctgcccagctcctggcttccagcctctttgcatgtggcgtgtctacctccctgcaaacttggatgggcagcaggtgagaggaattccctggagagaaggtgacagggtcccagcggggaggcgaggctcagggaggctagtcactgccccacgttaccagacctgctgttcctacaggctgcctcttgtccaggctccatccttacagtttcttatccccgccttggtgctgaccagtcagaaattacctctggctctccggacacctggaaactgtgagcacagagcaagggcacagggcgag

SEQ ID NO: 64314 - DNA, 1082 bp, Bovine  19866881176691
gccggctaggggcagcgctacctgaagtgtggccagaagcagctgcagcacatagggagcgacgcgagggccggctgcccaagacaccctgtcggcgccaccaggcccctccggacgtctgcagggaaaagccggcaccaaggccagagcccccagggccatcagaatcgagggcacgagcgtaaagaagaagcaggggctgagcccacccttcgcccagaccggacccgcgggtccctcggcctcacagaagttgcccacagtcaccatggcaatgcgtggtcaccgaccgagactgcggggactaagggacaaaagaactggagcggcggccgctcggggcggggcgcagaatcccgagtatctcgggtcatggatcctctgggcgctgagccgcgggggtcgccgggcagggtcgcacgtggacccggccacacccacccactcgcttcgcgcacgcgccgccgccacgcactcacgccgggcacgtacgctatctccgccgttcggccgctgctcgcggcaggtggccctccggccgggtccgagcccacgggagtgttcaacgtccgactccagcgactctcttcctcagcagccccgcccaccggggccgcccctggcccctactcaggtccccattggccgaaagtctccgaaggggcgaggagggggatggtgcacgcaaagggcaaaatagacgggcggagccggcatggtcacgtgctcagggcgggaaatctgaccgcacgtcctgctgaagtccttgacctccaaggaaccatggttcgggaagctgcccttctgctcgcccgctaggtcggtatatccaagtgatcgcatagaccagctttctcacggggcggacacgcagttcccagccacctgggtggttcacagactccccactcctcctgcccctccaaaccctgcccgctccggacaacaagccgcgacctagtcagtcccttctttattaaaggttgtcaagctgtacacggtcccccacccctttccgctgtaagttcggctgcgtagttcaaccgctcacccgcagcggacacgagctgggggaggggggg

SEQ ID NO: 64315 - DNA, 761 bp, Bovine  19866881305685
ctgccctactggtggggtgcccctccccagagcaatcatggtccagtgggtgacggtgcttgatgcagaaatttcggccacagcggtcgcaggtcagtttcatcatttcccgctgccggcagccagcgcgttcacacttattggtgaagatctgaggtggagtaggaaggattgtctctgctgagatctctgctcccttttcagtcctgtcctaacagctgtgcagagttccaggcgtttgtagtcccatgtgaccatggttgatccctctaacacttaccttacgtttttgttgagctggatctgagcgacagtctcggtcaatgtgctccccaacagcacggtcaggggactcccctctggccacaggtacaggcacgttacagagcgggcatacaggtacctggatatcctatagttagggagcaggggttcggtctgtggcctactcccagtccagccagatctctggtcctgagagaatccccctgaaagagcctggacatgccctccataaacgcaaaaggaaataatgttcccagcactgagcctcaagaagacaataaaggaggggaaatgtgaggcagagggcttccggagattttgcacgcatcctccacccgccccctttcatcctcagaccgccccctcaccttttggtaagcagatccacagtgatgctgggcgtaggccacatggtctgcgcagaagatgcccgaacaggcatcgcacttgagcggcagaaaatctgcaggaaatgg

SEQ ID NO: 64316 - DNA, 1169 bp, Bovine  19866881462955
aagtatagaaattctcatatacaaggccaaactgagacgtgacacaggaaagatacaaagcattgtgggagctcagacgagggaaagagtatagcttatactttgacttctgtccgtttcactatttctggcattacagaaacatcacagaaccatctgatgctctttttaagttaggagaattaaatgcccttggaaagaactgcaaaattcctagatgaaaaggctatgtctcctggggaaagaagatggaaataggcagaaatcaagtcctcaatcttcaaaatgtcacctgtgccttcactccacctgcaaatcccagagcaaggcctagcccctcgctctgtccactccgcaggtccattttcacaccaccagcataaatgtctccttctccaggggcttatcctttgttttcaaacacatatgtgttttcccatcttaaaaagggaggttgttggaccacttctagctctccagctagctctcattaccttctcactgtgaaacttcccagtgaaagttctatattcaccgtctccatcatatcaatcaacccttctttagctgcctagaatctgcagatgttgcccaagatcccgaacagcatgataatcttccttgggcagtcagtctggcctctctcctgtgcgtagcacagtggatcacctccccagtgataggaagagcaagggatttggaaaaaaaaaaaaacaaacaaattccatgacctgaagtgacctgcagtaaattacttagcctttgagcctctgcttctttaaaatgaggataatatcaccaacctcatgggtttgttgtaaggattaaaagttataccttagctaaagcacctatcactgtgtctagcacaggcagtatgtattagataactgctagttccccttccttagctaatttactcctctacccagattcccttcctatctcacccacatttccttcactggctcctacgaccttccaattacgtttgttccccaaattgagaaagattgttctcaatcactggacttttgttcttttgtccacgctgttcctagtaaaagatgcttccattctaatgccttcaaatgctgctcctttgtacaatattcccaaatctatttcttttatcaacctaagcttcaactctatttcttttttttttt

SEQ ID NO: 64317 - DNA, 1525 bp, Bovine  19866881652587
cccccaaggttgtactgatcagagctgcaaaggggtgcaggctgccagctcccgcccgctctgagcatccagctccgggctggacccccagtcggccacccggtgcacgggaggtatgacgcctcctacctctggcattgggagatgcaggtcctgggggcctcgggccgagcccagctttgctcccctttgacgtaggtgcctgcgtcttgacccccactgcaggccaggtgtggaaccctcacccgggttctgggaccctttctcccccaggcctaacccgcccccggcctctcagctccacgcccccacatcgtcctagagctcattggttgctaggatactgcgggccgttacgccggcgcggactgatgacgtatccaatgtttccggtctctggcgcttccctgcagctaaagccgggtgagtgcggtgttctggctggcccacccagaccgagacccggagtgggctcagcacgtggtgggtctgggcctatcacttcttcccggaactaccccgtgccctgcctctgcaacccagtaagggtgtgcgagtgaggggccgcctgaaggtgggccggggttggaggaagtggcctataagtcgccgcggggactgggccctttttaaggcacctgaccccagcctttttggagctggcgttgccagggcttattttctctaggttcggagacttgggcctgagcgctccacattggccctttagggggtctgctggattgtgccccgcccatgacctgccattcttttccttccagcatgatctgctggagccccagcaacttgcctgaaagagaccactcgacctggacgaaccctttggcagcttcaggccgtccttgaggaggatgactgagacactatgggccacgcgctttgcatctgctctcggggaactctcaccattgaccataagcgctatctcttcatccataaactgggggaggggtgagtgttctggaaatcatttagtcccaagaattgtggtgtttgaaggacagcagtcagcacaggataggagcacagagcctctaattcaccggacagagcccagctccttggtggtcaagaaagtggattgtggaaccagtcttcctagagtcaccatgtatggccttgataaaacctagttgctttatctgcttattagagctaattgtgcttcaatggcagggctgtgaggactaaatgagataattcgtgtcaagtgtctcccctattgcctgattcatagcacttgataaaggttggctgttatttatttaatatttattgaagccctgcattaagaccataggacctaggaagtgactgtgtccttgctcaatgttaataatcttcagacttctttttagagtcacaccttgggagggttgctagtaaatgggaaagacacccccccccccttcccctgcacttctccccagggaattcctctggatcccagcagtatgggagatgaccttggtccttcactgacccctttggcccacagtgggtt

SEQ ID NO: 64318 - DNA, 1516 bp, Bovine  19866880350231
ccgtaaatgatatagcaatccaaaggaaaagatcacctttttaaggtaaggaatggagaaaatgggagaaaaaaatttgaaaagaattttaagtcaaaccttttgatcacagagaggcaagtctggtgaactgaagttcctaacatttgttgtacactaccctgcactattaaatatttcaagtttgcataatgttttacatttgacatttataaaaataatccttaacgtagagctaagacaagtataaactaattgtgaacctcttaagaagaaaataaagagtgcctacatggaagaaatatgcagaaagttctcttaccttgaatataccaacccaatcttttggatgtggatggatatatggagttaaagtataatgacattctaagtgtgcattaggaagataactcttggccacattttgaaagatgacatgagcaaagttggaagtctgcaatggaacttcttgaaaggatgtcattgtgaatctgaaacaagtaaattatacatatttaatgataccaactaagaaaaaaccttgagaaaatatatagctttaaaagtaaattacatggatattctcagagaattattgaaaagacatacttcttaaatactggaactcctttagatatgattaaatataaaaacacaaactgggaagtaattaatttacaaaatgtttcagaaagttcaacgagttaaaaaaacttaaaaaccaaactttcacctctcctgcaaagcctagccctctgcttctcttgcaaaccaaaagcagtgtttctatgttgaacccctgaacttgcatcactttcctccctaatccaacctattgtatccctccacgttaggttctaggctcctgtaacctagagcctagtcaacctctgtgtcatgcattcctgacccacattcacgatccccaggttttctgaaccccggctacatattagaatcattaaggggtcttagacaatgactttttgggacctgggcactgcatgcaagttcgtgtacacacatttttttttaagcctcccaaagtggtggttcagaggttaaagcgtctgcctgcaacgtgggagacctgggttcaatccctgggttggaagatcccctggagaaggaaatggcaacccactccagtattcttgcctggtgaatcccacggatggaggagcctggtgggctacagtccacggggtcgcaaagagtcagacacgactgagcgacttcacttcacttcaaagtaatcttaatcctgtatacagccagcacagaggactactatttagactatgactcaaaccatcaatttaagtctccattagcagctctcacagattcccagacctgggctgtcttcttgggcttctggtacatacttgttcaaatctcacaaatgatgtaaaaatctcagttggtctacttgaaatagttcggcctactcgttcatctctacctacaacaattctaccctttcattctatcttgattccaggattattgtatc

SEQ ID NO: 64319 - DNA, 672 bp, Bovine  19866880362861
aaatcagttaaagaaaaatttaattctttgagttactactaaagttttaaataccattgaatcagaccaaggagaggcttactttagccttttaagataaaataatccaagtctctgatacagaagtcaatgccacaaagtacttctaagttttataataaaaaatagaaactgatcattttaaaagaactaaaaatcatcacaataatacaattctttaaaggaaagaacccatgaaaatgaattatctgaatcatgttaaaccaacttatttcaaaacattaaaaacaatattactgaggtaagactaaaattcaacaatgaataccgtacaaaatactactgtgtaatcaaatagcttatgagagcaccaaagacctcctatgatagctctttcccccaacacacacattacaaaccacggtaaattaagttatatgaaatttggtaaaagaatttgcttttggacagaaatagcaatgtttcagcccaaagcaaagtaaaattgccaagctataaacctctctaagaaaatgttttaatggaaatgccaagagacccttaaccataatggtgtggtgttaggtgccaaaacataaataaattttgtttttgtgctccctttaccctaaattagatacaggtcgagtggaaaaacagtagggtatccaa

SEQ ID NO: 64320 - DNA, 3878 bp, Bovine  19866880438064
agtctcctagaataaagctgtgtttaacaggtcccaacacactcccttttatactgatgacatcctacaccaacccctctacctgttaacaaagacaatacctggaggaactttcaacttaaccacaagtaagaggcaaacactttcaacagcaattttttttttttaacagataaacatttcagtttgtttccatttgttaaaaaatatatctaattttgtgataatacttaaatctaggtatctctttaaagttgggttaaaagtcaaaacatcttagaatgctcaggagtaactcagtaggaagtaatgacgggctagacttgaagtgatagaaatggaaaataaagagaagacatgaggacactggcctaaggaagttgatgggacccagtgaggggggcaatggatggagaggagataaagctgccccctaagatggatgagggcttcccaagtggcactagtggtaaagaatccgcctgccaatgcaggggtcataagagacacaggtttgatccctggtcagaacgattccctggaggagggcatggcaacccgctccagtagtcttccctggagaatcgcttgaacagaggagcctggcaggctgtagtccatagggtcgcgcagagtcagacacaactgaagggacttagcatgcacgcacaaggtggatgaactgtgcctctgacagacccagacaaagggtggggctcatcgtggccatgagtttgtacaggaaagctttgggcacagtactgggcataatgagttataaacaccaggggcatattcaaatgagaatgctagtaacagctggagagtagagatgctgaggactagacacacagataaaggaactgttgggtagagttgatggttgggttatgagaacctatgagttttctgaagagaaggtgtaaacaaaaccacctggaagtggatacagcaaaacacaaggaaatagagagaggacagagaaggtaggagaagagccagaacacatcatccctaccgctggccccctctaatgagcacctatcaactcgtcttgtctctaagtagtttattcttctgtatttaacatggggaacatagcactgccataaccacctataattattccctgttaacaaaagggaccaaaatcaaagttatcattaacaacatattcaaaatgtcagatgtgtcagatgtgcttcaaaggtatagaaatactttgattattaccatacctagtcacaactgaacaggaaatcctggtgtgagaaaatactgctgtattcctcaacattcccaacacaaataggggttcccaaaatcaatgccaagtttcctctagcaatcttcatgctgtatcttttaagccaatcttccaaatctcttctacttctcaccttcaaatgacaacatcagcacctcttaggagaatactcatttctgcatggaatgaatacaaatctttctaatcaaacttaagcctctgaaaacctcgtttggttctcagaaagattcgggcagatacttcaatcttgccagaacaaacatcatgtgaaagcaaatataaataagacccatgacaaaaaagaaaatcaactcaaggacaataaaatctgccattcacaagctaagagacatttatttgccattataaataccaccattccctaataatttggctcctaacactggctaaaggcagaaccatgaatggacagatgatttagcattagaaagtaaaccttcagtctcaagagatgtttgtctataatgtgaaggttatgttgtgaagactcatccattaaggtccaagttagacaaatatacaaactgtctaagggaggagatgagcaaactcccagtacccatctggggtcagttctcctccaagccatgggccttcctcatcactcatgtaaaagggacttgattttatgtgctcactctttgcaaggcaaagatgatggattttgcaactctgaggatacctgactttcccccaaaaaaaaaaaaaaaaaataaccctcacatcacaagacagatgaaaaaaaaaaaaaaaactctatgagttgttttccatttccactccattgtaaattgaggctgagcctgagatcacctcatgattcgtggacatatgtggaagtagataccaactcttaataatctctactgagattgtggtcattaatcctaaatcccagggaaccaaaactcatgaactagcttccagttcatccactggtttagtcattcccctgagtgggaggcaaagaccaagccaacttctcttctagcatcaaattccatctaagctaagggcaaaatttaaatctataaggagaaagcagaaagtgcttacatgactagtgtgctgaaatggaggaggaggacaagagaatccttaagatataagggttagattttccagttattggggtgggggaagaaataggccgtcacctctcataatgttcccaatgggtgtttcctttcagtcatgctgatttttttttttaaaggcacgaaaagatgaaaaacaatttcatctattagaatttagagaacatggtggcattttcaaacctaggataaaaccaagtttagatttcagaattttctttttctccagacttgtaaggcatgggctggggagaaaaggcagggagaggggctgtattgcacaaatatagaagcaacatattaacataactggaaatatacagctgttgcaagttttctcaacttgctatctcttatttttcacctggtgccacccacacgttgccactcacacctcccccagagagcaaccatgcccactagtagctgatacagcaagactgtaacgaaggcgaagcacctccctctctgtgctctctccccaagtaactggtggtgtcgggtaacatgatttccaggtacagaatataatcagattgagcagctgacttttctgagctgaggctgacctggccatgccctgttccatgactcctgttgagctgggatccaagatcttaagattgtagcttgtcccctgttcccatgtgttaaacagtcaacaccctctgggaatagattgcacttttcatcatttgggtaggaattctagaggatggaaatgtcctaatttgctattgctgcatcagcataatgagtcagatttaggtcctaggggagaataacaacacttagcacttatatactgtgcttttcatcttcagggtccttcactatgttaggctgtaatgttatatttctctcagcaagataaaggagttcatttctagtactttcaactcctcttacacacacacacacacacacacaactgttaccacatgaggaagctatctcctcctagagaggcactgttggagctcttttgtagaaaaagaaatcaaatgtgaaaggtcaattcatactttaaaaaaatcttttatttttgttttttccactaatgtggaacatgatatcaacatgcagattgtcagttactggtatctattcagtattactgcctgggttcccatacttaactctccatgtctcatagtcttctatgtcatctttgaccactgaggagaattgaagactgtcttggaggattctggaggactctgccaagttccatactcagacctcttctctgcctcatctccattcacccctgcccaggtcattccattgagtctcatgcatttaaacaccatctcccaggtggctcaatggtaaagaatctgcctgccagtgcaggagacatgggtttgatccctgagttgggaagattccctgggtcaggaagattccctggagaaggaaaaggcaacccattccagtattcttgtctgggaaatcccaggatagaggag

SEQ ID NO: 64321 - DNA, 758 bp, Bovine  19866880438710
ctatagagaatcaaccattccatatgcacagggcatggttctccctggagtggaatttactctttaattaaaagccagtaagtccagaggacgaataaatcccacagagtccaagtaaagtatttgactggcaaacttcctttcaagtcattcctaacatatacccaaagcctccgtcatattctctcccttctaacacccacctgtaggctcagatcagagacatataggatgtcccctgttctgtaagcatttctcgggcttttctctatactttcagtttgaccgagatagaaatgtgtgatctctgtgttctctgacagccacaaaccactgttgattcaggcatgcttgttgtagcatcatcagattctgccgaaaggcagtagacattaggaggagcaacacctaaaatctcacaagagcaaatagtgcttggactcttcaaccaatgttattaacagatttttctctgtaaaatgcacccgggtagctatagtctgtgaatgttagactcaattaggagaacggcactaatgaggtcaaagcagctcctctctcctgtgatcacagactgcacccctggccctggccagctgtctggcaatatgtgcttctggtcacaagggggtccatgggagggtgtgtgtgtgtgtgtgtgtgtgtgagtgtttgtatctgtgcacatccatcaccgttaatgggaaatcacccctaagttcacacccagttgagggacagatcaggcatgctgcctt

SEQ ID NO: 64322 - DNA, 2113 bp, Bovine  19866880450394
atttaaattttacggtgcaaaaaatcatttatgattcaggtttagcgaggggttctgactccacttagctggcttttagggaagtttgcaataaagaaggggacctggtgaaagagtctgccccaggaacaggtcccagggctctttaatgagagacatattggggctccaacttggagccaagttctgtttatcactaattgcaggggtgccttgcagatcttttctattatttcctgattatacccctgctctttttattatcttgccaaaattcaaacagtaataattgcatgatttatttataaccccttctattgtgccaatcactgtatttaatagatttttaaaacagtgatagcctttaccaaattaatggatgtcttttatcttccacagagaagccatgtattggtgaatctaatttggcattcttcagagtgtttctatgaccctccctccccagaatcttgtgtttttgatcatataaattagggctgattttggtgcacagagagagcttgcatgcaaggaagatgttttaggaaaggatgttaatgtatcctgtaggagtacatccacgttggggtctatgactcctgagtttctttgcaactcaattttcgtgatttctctgaaaactgagtttagagataaagatacatgaaaagcccattttatacaaatttagacatagtggggaaacctgacaccaaatgaattggaattgagattatgaactagtaatcataaaattcactaccattcatttatgggtccgtactatttgtcagacacagtgacagaagttttgtttgcattattccctgatcattacaacaacactatgagtgtttttaccttcatttaacataataagaagctaaagcttatttagtttactgaaagtgaccaagctcaaagttgcagatccagtatctgtacataggtctgtctgctggatggagaaggaagtggcaacccactccaggattcttgcctagagaatcccatggacagaggaacctagcgggctacagtccacagggttgcaaagattcggacacgactgagagactaacacacacacacacacacacacacacacagagtcagctggaaaattcctgtgcttcccattatttcagatcacctctattgcctctatcttcatccccttatggtacctgtgtgttttaacatacgtgctaatttactttaaaaaatgctcagtagaagctttgcaaagcatcatgctctgcttgatctgcacaaatacatgaaaaaatcttgagtgcacccacccactctaccctggtctttaaaaattctcctctaggcctccagtctcagccccaaattcttccatgttctgtagcagtggctgcagtaacacagctgaccctgaaatctcagggaaaaaaaaaaaggctgcttctctccacaatacatttatcaatgtcactgaggtcacacagtccccccccccccccccactgccctgcttaccaaaatacataattcccggtccaacccagacccaggacaatcttctcatctctagtgttgtaacatgctcctgctgtgggacatttccttccttgcctggtcctgatgacctttgttttcctggaataaaatgaacatttgctgagtggggctgtatttggaatttacgttagattctaatagagtaatacccgggggaatgactgcccccgaggagagagcactctaaagagaatgctgctgtgttctcttaggacattgctttggattgggcaatgggggttgctacaccattatttctggctgtgataggaattggggcagcaggatagagtaatttctgatacataggctgtggtcagtgttatatttatatttaaccgttggattttaaaagaaaactttgccatgaacctctctccaacttcaacttcctccactggaaatatttctattctgtcctcccgattcaatccagcaaacttttattgaaggcttaatatgtcccaggtgttgtactaggtgggccaggtgccaaggctatgttctagtaggggagccgctagtctaagggtctggggggtaggtttggctttcttgatgg

SEQ ID NO: 64323 - DNA, 4164 bp, Bovine  19866880460054
aaacacacacatatagaatctaggaaaccagtactggtgaacctatatacagggcaggaatagacatgcatacatgagaacagacttgtagacatagcggggaaagaagagggtgggatgaattgacaaagcagcactgaaacatacatatattaccataggtaaaatagataactagtgggaagttgctagataacacagggaagtcaacccggtactatgtgacatcttagggggttgggagggagactcaaaagggaggggataaatgtatacttacggctgattcacactgttgtatggcagaaaacaacccaacattgtaaagcaattaccctccagttaaaaataaattaaaaaagaaggaatgggctcaatttgctcctgtctgactgtggggactaagactccagagagtttaataggattcaggacttcaggagtcacttttacttgtgttgtgtgtttgcccagtctcgtccgattctttgtgacaccatggactgcaatccaccaggctcctctgtccatggaattttctaggccagaataccggagggggttgccatttccttctccaggggatcttcctgactcagggtagatcctgacctgctttggtgggtagagtctttaccactgagccaccggggaaacccttattttacctaagacccttattaaagaattcaacacagctcatgcattcaagaaatacaagtcagaaatagggtttaactttaaacatcgttaatgacaacatatacacaggaaaactcactccctatacccaatagttgagtttactctgagtggaagtcatataattgatggcaccttagaatcctccttgaatgccactcttaaaatccaagccaactcacagggtaaatgccttaagggaagcacctttggtgcctgaggaactaaaagaccttggctctgacctaaaactagtccacagtattgcaaactatatccaagagtgaagacattatggtcatgttttcatacactgtcatacagtgagctttttcagagcttcagcctcatttggcaactgatgcctcttggggaacaaaattacttccatcattaaaacttcatcaagtaataattttatgacagttgttaacagaaataattgtagtcaacaagtacagtgtgatcgatttgttcttgctatctcaagagagtcattatttagctctgatagaccaagtcaggatagtatttaatgaattgcaaactgcatatcaacgatccaggcgggtgtgttttaatttgctttaggtttagcacgttctgtaactgtactatatacgcaggtccgcttcaaaaatgagttctcacagaacagccaagtctaaatgatgatgtgtcatatggcatgcagatatttttctgctctcctctgcttcccttcctgacaccaagggtgggcgtggggctgttctaatgaaacataaaatgaaattctcttaaggtgggaaaaaaggagtgggtatgtgaataaatatgaaggcgtcccctctttcaaagtcagcaggaagtcccttcagccctcttcgacctgtctcagtagcacaggacaaactttccattagattaataccccccctttattattctaccaacaacagaataagacagaacctgctcaggcagattaatataatgattgaagggagaatatatggtgtaatacagagaggtctaaatgtaagtggaaaaaagcataaatgactattttaattaatttcctaatgtaaaacacagctgcagtaatgttggcaagtctcacccggctgctttaaatttgtgacatgaaatcatgccacttaattaagtcttaatgcacaaaaatatattttatttactttttatggaatataagcatttaaagctttctatttatttgtgtaaacgctttataaattacttgaaatactgaaaaaaatcagactattaatcggcagttacaatgtacccagtttcagtttcaataatgaaatgcctttttggtgggctcctgctgctatgtgaactagctctaggctattaaagtaatgagtccggacagagtcatccgatctcaggcttggtacaaaactcaaggaaaaggactttgcccacaattcttagtctgtttaccagactgactgttggagcattataaagtctctaggcttccccttcccccttctgggaagttttttttcttttgcttcttttccaagcatgagctagggaaacatggtattatggagccctctgcaggtcagaagttttgtaggcgcttaatcacaagatttttcttagagtggcagtaaaggggaaaccgtccaaactgtgcacattggagctcattgaaaagttgttcatctcaaagtcaggctgatgctgactctttcaaaagggcacttctgtcaactcatttaaggcatggagccttgaccgaaacgtttctgcaggcccctgagaacataataacgtactgcagagtattgggggcagaatcctcctcctcatcgtcacagttcttaacgatcatccatgaagaatacagggctctaaatagttcacttgaaaaaacgtaatttctagcacatctgggtttttaaggccagggagaagaaaccaggagttagttatacagacaaacatcatgatttcttcagccaagttttcattttaatgaatgaaatgtatacctagcaaaactcagtaaatttctcaagtgttttaggaaacttagtataattttttacagggcattttatattgttttaaactttttggatggagcagatataaatcactactcaaagaaatccatatgtaaagataaaataagaggaagtgcactgaagacagaacaaataaaacaagctctcgttttcattgagacagtacttctcgaaccacattttatgtgggttataaaatattctccaagtcagcaaaataagcaacaacttttaataggaaattttttcataacattttcaagtcagcaaaagtacagacaacttttaatagtgtttttttttttcccctcacaacagtcaagagagtattaatttaaatgaggaagcatttaaacaaaatatttccttctactgcattcactctgtgccaggtaactcatataccttctggagaacccagagatgcatgtttctatcaagtttcaaagtaggtaaggccgtctcctcacagcttctctccctggcaggaaaactacagtctaaacttgcctgggagctaggacaagaagaatgaatggggaatgatatgatgatgaaaagaaccggatattccataagttaaaatgtccttcctcaggacttgtaattgggttaacaggatctatctgaaagacctgtagggagttaagagaaggcagtactctggggcaaggactaaggaccaaggtcgcagttgtttgcagcaaacctctagatgattctcagaagtttctgggagactctgaggacagtctaactaacccaccatgcattctctggtcatcggactacctgcggctgttcccaagaatacatactcctcattggaggtttgtctcctctcctctactcagtggtgtagacaagctcagtgaaggataatgtcagcaaaggttttggttccagtacaacaactcttccaaacacagacccaaaatgaaaacgttggagttttgagctttgttgagctccgaaacaagtgctctcagcatgaactgtcaacagcctgagttaaaatagggcagctgctggctcctgtggaaccatctccacactccccagcccaacctcacagagctgaatgtcagacatgactttaccaggcctggaatccggctgccaggctcagcctccttccctgggcttatctcccaccgggaggctgtggctgacttgatggaactgcacgcttctcagcagatgctgggctgccagcaacaggagcaaggcctggcctggcgccgccgacatttacagtcatgcctcctgcccctgctccccggccccgaccccccagcaccggcctgcatgcagacttggcccactaggagaggacaggtgatgaggattaagtcgagcatatttgcatatcctcagcgtggggaaggaaattaacaccacagtacatatttag

SEQ ID NO: 64324 - DNA, 814 bp, Bovine  19866880464727
ttatataccatatgattccatttatacaatgtttttgaacaggtaaaattcatctaggatgaaagcaatctgaatgctggttaccttggtagaggtaagaggggaggaaggggacatgagggagcttttggggatgatagaaatgtctatcttgattcaggtgttattcacctggacactcatatatttgtcaagctcctagaattattcaattcatatatgtgcattttaccatctataaaatataccacaatgaaaacaaattcaaaaaaacatttcctggtgtcctgatggcctatctttcctcattcagcggcattggctggctggctggctgaggtgattgacaatgcaggtagttctagtgtagaggccgaagagcaaattgctatttgttgaagtgctatacatttagggttgcctacgtgccatgttattaatcactttactatgtgatacttgctctaaaatagagatgactcaaaagtacattatatcaataattgggggtattttcttcctccagaaatttttttaacaggaaaagtgcagaccaaattaatccctgcttcatttaaacagtcttcaaatggattactcttctttgtcctactcctcatgaattccttttgttctagaaaagagcaaatttaaaaatacagtagttgagctctgtgcctgtagtgtacttacatatagcgatgcatttctttcaaatacataatagtaaatcaaactgttaaggtgactttattaggcttgcctccaaccccgacctcttttatgcatgcagtggtctgtggtgtgggaggag

SEQ ID NO: 64325 - DNA, 1470 bp, Bovine  19866880485409
tgtggcttctttttcagaatgtaatgaatgaagatgccatccatagagaaaggctgcaaaggaaaggtagacctgggatggatgtctctatagctctagaaggctccacaccttacccattggagggattctaggaaatgtttatggactcacttgatgtaaatacatttcatggagaacaaccagaatttgccaagaaaaggtaccttgggtacctctatgaactcttgactacttttaaggataactgtgcccttcttggcgtaaatcacaacacaagaatgaaatcctcatgtggatatatcatgagaaaaaaaatttgtatcttcatcatgggagcagtttagttcaaacttggcaaccttcttcgtaaatgtttatgaaatccttttggtcaagaccaaaatagaaatcaaaacttattatcctttcccccgaaaccaaaagagtgacattatttaaagtttaagttttaaaccaacacaaagataaataaaaacttttaaagtcaagatggtaactgacgaccggtgcttcacattataaatagtagaaaggttcgtaggaactcatgcactttttttttaatggctcaagtctcaatctgacagataatgtaaaatagacaagatcttcccttctcccttccaaaaagtaggaaagccaaaacttgaaaggattaacagcccttgcttttatacagtgttgtccataagaagccacactcaccttggagatttacctgcacaaaagcatcattgcctttctcagaagggcactgccatatcttctgtggtttcataaagccctataattggagtagccaggctgaaattttccaagtctccccttttggcagtgaacctggctacagaaacatcttagttgtacaagacatttaaaactgtttatctcttactcctgtccacattgatttgtttgtattccatgcctgccttccacaagcctataaaatgtcgaccacactacagtcagggctgaggctgcattctatatctgtgtatttaaactgaacactccttttcagttctttaaaaactttatccaccctgtgccaactgcttaaagggctatcttgctccttctggtttgcttagatctgaatctgagatgcaaaacctccagagtccttgttcttgttctctgaattcatcagctcgcatgcttttataccctgatactttcgtggtcaagctatattattaattcctgctattttttaagtcttaaaagtcagagtgctctaaactatgtagaatctgaggttggtgctttgactgggaaggctgtgtttgactgcagacatctaagtttcagggaatatgtctgagtattacctagtttgaaccttccaccttattcctgtggtttgcttttcacttagaaatgaactgcagtcattactgaggtgaatgtataatctttaccttgctagcaagcttggttctg

SEQ ID NO: 64326 - DNA, 5247 bp, Bovine  19866880518487
gggaagctggtggtgctgctctctccctgccccgccccagagatggaccggcaaagtgactggcacgtagttgtcactcaaagagagtgggaacctgctcaaagtcctgtccttgtcgctctcggggtgggtcccccttgccaaccaagcgcaaatctgccccccacctcaagcgcccccaccggcctcctgttccttggggtcccacagggcagtcctgggctgggccagaacctcagactcgagcccaagccctgagtggaggcctgggcatcgggttctgactttcaaatgtggaggggttcggattgctgccctctgactcactccctcagggcccacccctgtctcaggagcccactcaccagggcaccttctggaactcagggaggctgctggtgaggctctgggagaggtcaggcagcagggggcagaccagcctcccaggaccaccaatcaggctctgcctggccctgccccaggcccgcccccaacccccatcagggctttccctcattcattccttcctttcccactatggcgtcctcaaaaccagtagggccctgccctgccaggtgctgggccttgggcctcgccaccctctgggttcacttctgagctcctctaggagccaggccctgggacggggcttctccagagcatcttactgactccacccagctatcctcggaggcagacctcactatcagccctattttgcaggtggggaaactgaggctctgggtcacaaagcagggggcacaactgggattcgagctgtgatctgtgggcttgcaatgtgcatcttcctggctgtccgtggcagctgctgcccagcgtgccgcgggcccagccccagccccagcccgaggggaaagggtgtgcacagctggacctcacagaaggccgaggcttgcaagcagctgacagtcccagggctgaggccatgaggtggtggtggcggcttagtcgctcagtcgtgtccagctctttgcgaccccgtggactgtagtctgccagactcctctgtccgtggcatgcattttccaggcaagaatactggagtgggttgccatttcctcctccagggcatcttcaccacccagggatcgaacccgtgtctcctggccggcagattctttaccactgaaccatcagggaagcctaaggccttggggtaccgaggacaatcgcagcacggcccaagccttccagcctccaccttggaaaacggtgcctccagaaggctgaggctcagagagggcagagcccccatcaaggtcacacagcacagcagtggcaaagacaggactagagcctgagtctccctcctctgctgtggtgggacagtcccaagcactcagggcagaccgcccccctccccaccccacccctctattcctgtcctcctgggttaccccagccagatcgccctccgtgtgtgccgacggctggctcccggccagacccagcactcctcctgttcagctggaccagcagactccagggaacgaaggggagacggggctcatcctccacagcatccacacagggaccccaagcccaggatggtgagccttccagcctagggcgccaccagcaggcaggcctccatcccagggcatcctgctcccccaggggccatgcgcagggcagaggaagacactcacctggggccaggtctggctgccccttccctctccctgcctgagccacgtctgactcccaggctgcctctgcggtcactgggaaaccggaacgctccaatgacacccaggagtgtgctggctggctccctcttgcttcagcggccgtgaatattcatgagttccctccctggggagagcaggtggcatatccctgtagtatccctgtacactgtgggtgctgccccggccctctgccccctgggtggttccccctgaccctctctggacctcagcagcccggcagctcctccatccaagggctcagcaaggtccccggcgtccttggcccaaggacactggcagccgcagagccctgcagagagcctgggactggcttgaaagccatgggagggacacgaaggcaggtgagcagggaaactaattgcttctccaatcacatctcatgttaagtctcaaagctgccctctgagtcaggtactaccgttagccactccccaggtaaagaaacccaggctcagagaggtgaattcacctgtccaaggtcacacaattagccatgagcagacagaaccagagtcaaaacacggacttgccaaactctaggtcttagagatgtccaaggcacgaccggagaccaaggttggtctaaaagctgggagagcccagagagccaggacctcaacctggatggtgccctggaggcaaagtacctgagcagggctggaggacgagtctgatgagacttcacctctctgagctccaggttcttcatcaaaaaggtacagaaatgtgcctctcctgcctccacccccggtgaggtggtggcacaggacacccctggatcagcctccagggatctgggctgatcagagatgcagatccttcccaaagtctctgtgggaacaggtaggtctaggggccctcaggctcagcccaggcactggaatctctcatccttgctcagcgttgctcatggacagagggtgcccagaaaagcctccccgctacaccccaccaaatccttccttcaacactgatgcccagagccccaccatggcccacgcatggggctttagggaccggagtatcgccatcaattgatcataatcactactgtgacggtcagtgatgccacagcgagcactttcataaaccgagcagctgccagtgcctccgaaggagcagcaggcatgtgaccctgtgtgctcagcgttctttcccccagagccccgcccagcttccacggaacaggggaagcccagagtcctcctctccctgggggctgagctgagtccagggccggcatcaaagagcagataccgaggtttaggagcgtggactctggaccagagtctagtcttgtgctcgggactcgccatgcatcacgcaccctcataacctttgcagggagccctctttatcccccactgtactgtagacgagaaagctgaggcgcaaggagaggaagtgacaagcccagagtcgggaggtaggggggcagatgtaagatcctcatccaggtgggagtggagcgcaagcttttgagcaagaagtgaaatcgtgagaggagtgggaatctagtaagaagagccaagttaatattttatttacacgcatatgtatcagtaacatagagttttggaaaaataaagcactgcaagtttgggaacttcctggtggtccagcggggaagaggatgcactcccagtgcagggggcccaggtccaacccccgtcagggaactcgatcccacgtgctatgaccaaagatcccatgtgccacagttaagacccggggcagccaagcaaacctttttattttaacctgaaattttcatatttctaaatattgttcttgtcctagtggattgaggccaagcataagggaaaatctactcattgcttctgctcttaatatttctacttggaatttgatcactgcattttctctttgacaacaacactgctctagtagccagtgtatgcagtgcattgtataatttgattcaattaatttggttgaactaattttcatactgttctttattagccagcctttagctggggttcgatgtccacaagcacttaccatgaaaaaacttcattttagaatggcgaatgatcaccccaataagagttttgttaggaaaattatttgagaatgatagaagatgcctaaggaaacttctgatccagtgactctcaaaggaacagactataaaataaattgggagagatagagggaaatttcagtgtagtataacctagacttctacttttttattatgtattcatttatatccagaaaaacaaagatgaaattccctctcgtcaacaccaattcattttatatgcaattttggttccagaaatgtacattttcctctcccataaaattagtctagaggctagacatgaaaacaagttactagtagccagtttttcagttataagtgacccacaacttaaaactcactgcaatagagacacaacagtccgaacagcttcctctctgccagcccttttattaaggcttcgtaaaaagtgaagggtatgcgtgcacgggtttagtgactcagtcgtgtccgactctctgtgacccttcggcctgtagcctgccaggctcttctgtccgtgggacttttcaggcgagaatactggagtgggttgccatttccctctccagcggatcttgccgacccaaggatcaaacccacaccttttctttctgctgcatcgcaggcggattctttaccaactgagctgtggtatagaaaatcgaaaaaccaacaagcgctgattcaaagcaaattcctcttttaatcacaacacggtaacaggtcaagagagtttaacatctgagacaagggcaactcaataaaacaatagcatcttgatgtagtaattaagaaatatgactccatggctgtcatggatatctcaagcactttggatctttttattgcttttataaaaaactccaatacaaacactactctgattggtgctatgtttggtaagcagttagcgtattaaaaagcagatatactagatatgctagataagcagatatgttggatagcatattgaaaagcagagacattactttgccaacaaaggtccgtctagtcaaggctatggtttttccagtggtcatgcatggatgtcagagttggactatacagaaagctgagcgccgaagaattgatgcttttgaactgtagtgttggagaagactcttgagagtcccttggactgcaaggagatccaaccagtccatcctaaaggagatcagtcctggatattcattggaaggactgacgttaaagctgaaatccaatactttggccacctgatgtaaagaactgacttgaaaagactgatttgaaaagaccctgatgctgggaaagattgaaggtgggaggagaaggggatgacagaggatgagatggttgggtggcatcaccgactcaatggacatgagtttgagtgaactctggcagttgatgatggacagggaggcctggcgtgctgcggtccatggggttgcaaagagtggacacgactgagtgactgga

SEQ ID NO: 64327 - DNA, 823 bp, Bovine  19866880528672
tggaagttctatgccagtgtccaacagtcttcttattttttcttcagtccacgctttatcagctaagtaccaagagctttcttttactctagggataaaaatgaaaaagatgagctaggagttcgccacttagtgtgcgtaagtgattttagtctaagccaatataacttaggtaggtcctgggctaaatgcagctggtaagatgccatagtcacagctttagaagatagagagggggaggaatcagggaccaaaggaaatgtcttaggatgctcagcatcatgtggggagctgagacgaggtgggcatggggtgggaaggcagagacacaaagggagatggtagaaagctgtttagagcgctgatagtcgaagaggcccttagtggtgatgtcccctccttacctggtcatggtgtctctccttgatcatggttatccaaacctaagtatttaaaacattccttctctttgtgttgacttttagacctagcttgaaatgcatgaagcacagagacagttcttttgcttcagggaaagccctgactcatattctaaacatattggacagattcttattaaagtgaaggtaaggtttcacttaccacagatggaagagacagccagatccagtgaatgaggtagtgggtttgattctctcaagctgtcactcacactagcaaaatgaaatatgctgtttacaaacatgctggtgcagagaaggccttcggcaggcacagcagaactacatatttcctttctctttaattcccaaacttaaaaaatacatgtgttctttgggactcttacaaagattgcccaata

SEQ ID NO: 64328 - DNA, 2999 bp, Bovine  19866880568901
ctgctgctgctgctaagtcacttcagtagtgtccgactctgtgcgaccccatagatggcagcccaccaggctcccccgtccctgggattctccaggcaagaacactggagtgggttgccatttccttctccagtgcatgaaagtgaaaagtgaaagtgaagtcgctcagtcgtgtccaactcttagcgaccctatggactgcagcccaccaggctcctgcatccacctgagagcttcctataactatgagccacgaatggctttcacatgtcaccacatattcatggttgtaaatttcttactgtgttaaaatttaatatttcctacaaacattcaaaaagttataaccattcaaattacatttgaacattgtttgtagggctgcccttgtaaacttcttgaatttagtgatatcaaaaggttatatttggagtatttataaaaatccactgttcagtgtttttcctagcattttgtttttcttataataatgtaatacaaagaaataaaattgattttttcccccactagtccctatacgtgttgccagatcatctctatgttaattcagtgtgttgaaatattatcatttactgtgttctcccatgatgtgaaacatgttggaggcaccaacagaaagcactgcaggccagattctatatccggtagaactttctaagtacatacttgggctctcctgccccagacctactgaatcagaatctccatggggtttgggttgagggaggaataaacacaccatcatgagtgtttctgtctctgtcagttctcctttattttgacttggcgactaaacaataacagttttaacacctcagtcactttgctctctgccagggacctgcagtgacttcactgcaagtgaatctggaacttggcacccgggacttgcagtgacttcattcaacctccgtgggagctctgtagcctttcctttcctcctccccaccttctctttcgtgaaagagtgtggcctctctctgcccacccacagcatccacagcatgctctcggcagaccttcctgaccactttgtccacagggctgctgcctcctgctccactctgagctccttgagggcaggatgttttccttgtccttcctcacacagagcctagtcacatggtgcacgctcagtaaacacagtactgaatgaatgaattcctcagggcagagcagctggagaagcaagtgctaagtattccctggtcctctgattggtgcagaggcaagggaatgagtggaccttgctaagagttccctttggtcttttccttgaaaggttggaccatttcaggcttggatgccctttgggtcctcaggcactgatgggagcacatgaaagtagtgttttatggcaggatctgaaccaggatatggctcattagagggaatggggaagtttgtttccagtgcgaagcagaaatagtggggcaagaggttatcaaagcggggccctcaggggagtaactcagcccttccattttaggtctaccataacccagtgagtcacctaaccaatgaataaattaatcaattaattaattagccaagtaattagttagttaactcatcagttaactagttatctaatcagttcacatttgtgtggttgcagtctccagacagcgtcagtgtatatttgtgcctcctgccaaccccaggagggtagttagctgggggcttctattttatagataggaaaggtgaaggcagatctgcatatctcctaagtggtgagtctgggagtgagcccaggcctctggacttctaattcagtgtccctttccctgtttccagcgtccatagtttcttcagggcctgttggtctcggcaagtgctctctcagctcagcagtgaaacccaggacccttcagagaaagctggagacagatattctttagagcaccagtttggatcaaaagcctactaggatttacaaatcagatttccttgctgtctttgaaaagtgtctttaatatgaaaagcttgtcatgcctgtcaaaagaagctcacgacaggtgaatagcaaagcattcggaaaatgagaatgaagggtttttatgagggagggaaggcatagcaacttaataattactgttgaaatagtcacagcaatgctgaagcttctccataatttaatctaacttaatactaaccgcctcctccctagtggcaatacataaattaattaatagtaggttggatttgaagctgtgcctttatatttaggccattattaacttgttctctgtgcctttcttacttggatgggtttgttctcagaaatgaaagtagcttctggttcttatttctgttgtgacttctaccagcatcaggattttgaaaacgtatgctattctatctagtttttactcccttcttgtaatgaatgcctgagtcctacagagaggttacatcaccttgctttgtagcgtgtgatagctgtggttccacagtgtgggtcttgcctctttagtttttctcctaagaggcaatttgttgttgttgtttagtcattcagtcatgtccgatcttttgtgaccctataggctgtagcccaccaggctcctctgtccatggaattctccaggcgagaatactggagtgggttgctacttccttctcctggggactttcctgtcacagggatcaaacctgcatctcctgaattggcaggcgggttttttttttttttatcactgagccaccctgggaagcccccaggaggcaattagtagaaagtggtgaagactctgggctctaagtgagataacctggagttgaattttggctctactacttactgattttgtgaccttgggcaaggtgtataacctacctgtgcctcagtctccccatcagtaacatgggtgataagtacatctacactatggggttgtcatgacaattaaataaattcctacctgtaaagttcttagaagaatgtccagtgtgttctcagaaccaatatatat

SEQ ID NO: 64329 - DNA, 1310 bp, Bovine  19866880569072
tggaaggaatgatgctaaagctgaaactcccaggtactttggccacctcatgcaaagagttgactcattggaaaggactctgatgctgggagggatttggggcaggaggagaaggggacgacagaggatgagatggctggatggcatcactgactcgatggacatgagtctgggtgaactccgggagttggtaatggacagggaggcctggcgtgctgcgattcttggagtcgcaaagagtcggacacgactgagcgactgaactgaactgaaaagagtgtcgtgatccacgaggcttccttgacagtgggcaactgaacacctatgggtgctcttaggttggatggctgagtcattaaacatggcagagacagcagtaccaagcccagggccggcttcacgagtggattacttcggcagtcgcacagcccgacactcaaaagggccttggcttgctttaatgctctgctccggctaattcaaaatagttttatctttgaacttgtattctgcaagtgacacccagtgagccagtggagcttgtgtgttggcaaagggaatacctgcattatgcctgtctacattccctctcttttcacatatatcattcacgatgccccatgagcacagaatgtcagtggactcatgaagcggtctaagcaagtacaaaggcactcatggaatgcaagcttctggcttccacggcgctttggtagaatgggtgcattaggagaagagaaataaaacaggttagtttctgcagtgtttccactgctctggtaagaataaatatacacacatgtacaagctgtaatgtatgaattgtataattttggttatttcacacatgaataaaatgctcttatatttgcatttgaacctggaattgcataatataaagatgaacggtaaaattcatgctaataatattaattgttaatttattttagcaagacatgaactagtaagctaaaacaccatgacaagtggagagagaagactgtcaaaaaagagcttgtatttcagtccctctcagggtatgtttaatgtttttaaataaatgtctctgcatttacattttgcactggaccccacaagtatattggaactgagacctggggatattcaatcacatcctcttgggataaggactgcaaagatcaatgaagtgcaatcaggctgctctgagaggggagaggacatcttcctttggaagctttcttttcttttgagtcatgtatcctctggggtgcttcttctcataagggactgaggcccacagaagtgaaggacctgcccaaggtcacaca

SEQ ID NO: 64330 - DNA, 1745 bp, Bovine  19866880711859
cataaagggaaatatttgttaccatccctccttaagatacactctgtgtcacaaatacaaagtgttaaagaagttcagtttctgcacaagtgacacatactcattattaaattattactgagcacctatctataagaccattgagctgggtgtttgtggtgttttattaatatctggaaactgaattcattcattctatactatccaatcagaaactaagtcaaccttaatacaagagtcatgctactattcactgcctatatacacatgggacatgtgtatattaatgtgcatattatatgtataagacatttgaatttaaaattcaaagagactagtaacttcagagtcactgaatactaaactactgaagtttatcttaaaaggcagctgactagcagctacttaaaaaatctagcccttttcttaaaaaaagaggtttttcataacaatgacacttctcaagaaatctacgctcatagtacataactaagctttccaagtaccatctctcccttaaaatgaatatatctttaaaaaatattcatatgcctataatttaaaattaaatccaaattaaaagtctgtaaacatttgcttttattacttgctacccaggtatactcactcttcaaacaagttttcagaaaggtttacaatatgaaaaaaaactctgggtgtgttatttacaaaattctacacccctttatttccccaaatcagtcagaacattttagtcctctaaaatagtggcaatgctgcagcttccatagagaacgtgattaagcctccaataaatttaagatgcaaataaaagaaatatatacttcctcatcttctatttctacagaacacatggatgtgggggtaccatgatgatttaatacagtagctggataatgagttgtaccttctgcaacaagcgaatcaccatttaatgctattatcaacagttcatgacccaccagcaagaaatgtcaacctgattaatctaaacactgctgacctcaataaaaaaaaggcgggggggaatttactcctgttattaacatctactgttctttagtatgaacttacagaaaacaaatctttagatgaaaacagtatttttagaaaatctggtatgcaaattttactaagtgaaagttgtcaagagttctgaaaaaggaagagctaaagacaatacttaaatatcaacatttgttacaactattgaactattgttttggaaatacctgactttataagttcaatatatgttattttaaatatttgctttattttcttagcattataaaccagggctacagtaagatgtcattttggttttaaagtttactgttaaactcttagtacttatacataagttcctaaattaaaccagagataagctcagaataatctaaagatacagatactggaatgcctatttcctcccatgagcataaggttcaagagagctggtacaaaatactcactttcttggttttatttcagtaatccacctgcaattcagcctgtttctgttttacacaatgtgaatttttgatgggatgtaaatttgaaagctttgaatttcagaagaatatttaatgctgttctttttctatggggcaaacaccctaccatcaggttttggaaaggctcattagatcataaattggacagctgagttttgcttaaaatttttttttcattacaatatgtcaggtttttaatatctacaacaaacaaacaaacaaatt

SEQ ID NO: 64331 - DNA, 1483 bp, Bovine  19866880812179
cagcaggtttcactgtatgggaatttttaaaaagagggaaggacctctgaaacgtgcaagttggtccttttcacaggcctaactatgagattcattaggcagttcacgtcttaaaagctgtttttgggaaagtaaattcttgcagtttcctgtactgattttgagggagtctttatagtcttttgagtcagcccattttaagaaagtgataatgtaaaagcaggggaaaaaaaggctcattttaaattttaataaaatagattctttcattaaaatatattaatgttctatttttatgaacccatatatgttaataaactcttcagaaaaaaattgtatgatacaagtattcaggtgccacaatattttgtcagaataaataaggttcagtgtacattctattgatttttatccttttaaaaaatgtgttcactgtacagagagatgtttaattcttagctttgattatttattaaaatgctttatgaaatgttactcaatttatattctcacctcttcctctgtggcttcttagtgtgtacagcctgattaagaaatgtgtatgttttcaaattaagtgtttgacctcccactttgatgttcctgcttttatatatacacacagaaacacaacacaaccctctccttccctatattttgaataacttgattgtaatgtgcgttgtactaaaactaaatacatacaaacaaaccttcagtattatcatgaaaactttgttttaaaaataaggaaaatttcatatttgaaacttgacaaaaggtgtgcatgacacttaacactgaatattttacttttaaacttgatacaacagtttgcttcttggctttgttgtatgctgatatttctacttatttaacatcaaaaagctgtagtggtttttctttatagattgtgcctgtgttctggaattgcctcctgctgtccatgaattgcttcttgtttttttttgttagaatttctcaccagggtttttgtgagctaagtagccaacattaagcgggggcaggggaagaatttgatacagtaggctggattagtaaaaattatactatttataattataattgagtcagccttctggctcagtatatcagttttacgtaataagaataagcacatgcaaatctcctgtaataatatgcatatgtaattacctacaatgactgtttttttatttatttctaaaatattaaatgacttattttgctgaaattctagaaatctactttttcactagaaaaatgatagaaaaaaaatccttactcttagggtgtgtgtaatttagtaatgaagcattaagattttggcttctttcatttcagttggaaatagtattggtgtaagtgagtgttgccatgggaacccccacatagatataaaaggcaagactgtctaactggaggaggaggggcgatgttctcgaataccactggcttaaatgatctattttatgtatatgtt

SEQ ID NO: 64332 - DNA, 1527 bp, Bovine  19866880812724
taaaattgcattttgacaataatgaagtgctgaagcaggttttgaggggaaaaataataagtaactgttaagagccatttcatttctcatagaaaactacataaatattgcttttaaggtttgctgacctgcaaacagaaacgctgtagtctgaaatgaaagtcatgtagacaaggtctctcagactcctgaatagaaatcagagggttttagggcgcaggctcagtcattagatttcccttctttctgtcttccttgagacactgaagtgggtatgaggaaggaaagacgttgggttctgggtagctgcccctcccagagtagtgaatagtgaagacatgtcctagcttcgtgcctgcagctcccacccctgaccactgcacgcggtgggaaaggttcttagatgcttcaatctaaggtggcaagcctggaaggcaggctcctcttttcccacattctatctctgcttcccctcagagtcttgactctaaggagtcctgtgtgtattgattgtaacagcagtggagggctggaggacgtgaaatttagatgaatgaagggagaggggtgaaaagtaaaaaagctttgggcctgagggggaatattctgtcataaatatcataaaatgaaaacatttgttgataaatgatttatgctggcagcttaaaaaccattttgaacagtggcagtgtcattcaaacaagtgtgatttcttaagagtcctactttaaaagatagtgttaatttggatggatgacatctgatatgttaaaatgtcagtattatttcatagctgtatttagttttaaatgtttgataaagggaaaagtgagtttcattttaccactaaaagatgaagataagatttgggattagatgggaaaatgcaggtgaaaaccttgaaacctctggctattatccacagtagtacaatggatggattaagaattcaaaaattcagagtatatttgagttggtgcttacattttaaggacagatgtccctttcttcccttaatgttactatctcaagggaagtctatgaaatggcagccaaaggaaacataattttttttcctcaaagtttgtggaaagcatggctagttgatttctaatgtcaactgtgctttcagtaggaaatttgcgggaagagaaagtaccaaactagacatatctgaaggatcaaaaagcaatcacttggttttaaagatctttgaacatcttgaagaagtgctgcttcaatttttaaaaagcaaaaactgagaatttgttgtttcatgtaactgaagagttggggagtggtctgaacctaagcatagttgaatgttgggtacagatgtaagcagattcatttctgtctgtgtcttggctcccctttccgcagcccagccctccctcccctcaaggtgcaaggtggccgcctgtagctccaggtgcagaagtgctttggatgtgaccaccctggagggtttccttccagctgtacctagtagtaaaaaacgctactgggttatgaaggaaatttgga

SEQ ID NO: 64333 - DNA, 1397 bp, Bovine  19866880939217
atacatgtgtttttacatgtatgtgtatatacaccacacatatgtgtacattatacatatgtgtatttatatgtgtgtatataatatattcattctctagatcactgtggatagtgaggattaccacatacatttttgagtattttctgtctatagtacttaagactgtacttcctgtttccaatgaattgaaatttatttggagaagtcagacatgtatagactgagataaatgatgaacgataatggggaccacagagactgattcagtgtgaagctcatgaattgcaagcaccagggcccctcacttgtacaatacatgttttaccatttctgcatatattgcttgggcccacctagacctttccaagggcctggggggaccctataccagtgtacacaggcatgcattcatggataacatcataatttgtaacttttgtaaggcataaaattttaattgcaggtaacttacccttttccactctgacttcccttctatgacgtttcttcttggctttggtgacattggagttaagagtgtttctgagatacagctgaggaagatttgaattgcagacacttttagtttgggttgagtggaatgtatttattcagctcacagttttctgtagttaagttattcctaggcctcctagggtaagactcactacccaggaatgccatccagtgttccagctcacctggggtctgtccacatggtagggatgagttagtattgcagcatgagtctataccatgacatctgctggtggaagcatggtttgaatatggtttggagccagaatcgagtctagaaaattcttctcctttattagatatataaaactgtaagtaaaagattcagttcttatttaagtatatttgatatggaagttctttctgttaagaatatacccaataatgcaaatacacgttcataactgcaccatgttttttaatgagaattttgtgtttcttcttcaattgaacacacatactcatacacacacacacacacacatcagtgacaacaaacattactgagtgttatcaaaacaaaaaatatttaaacttagacaattcactagaagatgtggaatgccctgaattcttatggctcacatgtgaaagaaataggtgtttacaaatttgacaacaatcctaaaaatttatatggcattaaaaaggacctatgaggctgaaagtaacttttctgaattatcaataattaaaaatacattttgatcacccatgtttgtggtttgtgttttatagaaatgctgttaatatgaatcattgtcatatgagaagtaatcagagtgtgcagcccaaaagaagtatttacagcagtgttgcagtgtttcagattcacatagtggattctttttctggat

SEQ ID NO: 64334 - DNA, 3019 bp, Bovine  19866880976571
atggacccggtggggaaaggaggggtagatgaatagaagattggggttgacatatatactgttgatagtatctataaaatagataactaatgagaacctactgtgagcacagggaactctactcagtactctgtgtgtgtgtgctcagttgttcagtcatatctgactctttgtgaccctgtggactgtatgtggccaggctcctctgcccatgggattctccaggcaagaatactggagtggcctgccatttcctcctccaggggatcttctctgacccagggaaggaacccacatctcctgcgtctcctgcattagcaggtggattctttaccactgagccacaggggaagccgactcaggttctgtggtgacataaatgggaaggaaatccaaaacaagaggggatatatgtatacatatagctgattcgctttgctgggcagcagaaactaacacaacattgtaaagcagctctgttgttgttgttcagtcgctaagtcatgtccaactctttgggacaccagcactgtagccctccaggatcctctgtccatgagatttcccacacaagaatgctggagtggcttgccatttccttctccaagggatcttgctgaccaaggatcaaacctgtgtctcctgcattggcaggcagattctttaccactgagccaccagggcagcctaaagcaattacactccactaaaaactaaaaatgaaaaagaatgatggtggccactggacagtgaagagggctggtattgaacaaataaagtgaaactggtcactttgcctctttcaaccaagagaccttggggcaaatattcttctgctggcatctctccaccagaggggaagctgtaccttaaaaaaaatgaaagaaagatgcctgccttgatgttcgcttagccctgccactgtgttcatggattaacataacacagggagcaattctctcctgctggcctactcctcagcacctgaagctattggccctgtttactgagcttgtttcaactccctttgatgccagagaaaatctaattagtgaagaatttgaaacaaggaattttggagagaacctcaaaacctcagcagagtgggaccatgacttccttgtgagaccctcactgtcaggggtcacttcctaatcttaaaagttaagaaagaaagtttatgcccagactgtgtgatggagctgggcctctttctgagcagaggattctagaaccacttattttgcaaatggaatctctcttcagacagactctatctgattctagactaggcttgcagagagaggaaattaccttatgcacctcagctgcaaagtcaattggaagagaaaaataggaatctttggaactgagttttacttaagaatgaaagtgggcctcaggagctaatgttctctaagtatgtgtgatggggtgaagaaaaaaaatgtttgccactttgctccgaatatccaaggcctgttcatggcagtggcaaaacaacctcgataaacaaaaccagacaaaagcccaacaatgggtgacatgttactttcctaattacttgattctgctccttcctcccccaaccccagccccttagagcagccaggccacctttccttgagggagccatacaagatgtccttgcacggctccaagggaaccttcagtgcagaccatcttccccgcctcctttcttcctcttgataggtccacccacagcttccttgttgttgtttttggttgatctgtttgtttttgggtcccccggccacacacgccccccctccccagctccaggaagctgtacacatactggagcatttggagctgacttggcaggataatgtgactgctggcagcttctaaaatatgacaccagtgaaaatatgaaccaaatgtttcttgtatgctagggtgtgaagtcttcatcatgctttgctctgagagcagagagcacgaaagaactagacagttttgggtcttgatcctggctgtgtctcttaattgctgggtggtatctttgaacacaattctttattataaaatagcagttgtcttacttgcttcataaaggtgccattggggtcaaacaaagtcatttattgagtccatttacatggcagagagtgtggtgaagtagcacctctactgaaacctgagttccttaaaggcgggaccatttcttactcccactgggctggatgtgtcgagtctgacccactgggcttggatcttgatgctgtcccttgctagctctgtgactttgggcaagttactaacctttcatctggaaagcatcaatcacaacagcacctgcctcagagagttctcctagaaactaaatagggttttatgcatagcccaaggcttggaagtcgctctgtgaatgtcagcaatggttacttgtaagcccagtgcctggcacatgtctgtcttttgaaatatagtaaacagtaagtcggagaaggcaatggcaacccactccagtactcttacccagaaaatcccatggatggaggagcctggtaggctgcagtccatggggttgctaagagttggacacgactgagcgacttcactttcagttttcactttcatgcattggagaaggaaatggcaacccactccagtgtttttgcctggagaatcccagggatgggggagcgtggtgggctgccatctatgggatcgcacagagttggacatgactgaagtgacttagcagcagcagcagcagacagtaagtgctcaacaaatgctggttccattttccataatctatcttcagcaagtctttcctttgacatctggcagattaccatggtgtatctcactgggattgatcccaagacaggaagatagggggttttccagagggagtttaatggtgaaggttctcttcatacgcatttgttatttcagccattataaacctacaaagggagaaataatggaccaactaactcagtgtcttagagcatttgtcccttcatatagccatttgtttcagctg

SEQ ID NO: 64335 - DNA, 1360 bp, Bovine  19866881016506
ttcggtactgtgagagccgtgctggcaagactaaatgcaccaccaaaccagaaatgaaggttaggagttgagggtatgagatcaaagtagaatcttaaaccccaaattaggcccttgaccagacttctttaacacacacaatatcctccaacttgagaaagacagtatattttcaaatgacctgttcttctttctgtgtaattaaaatgacatagtagaatggggctgggcttggtgtcacagtggggtttgaagcctacttgtactctcattagccacgtgtgtaaattcaagcaggacagtttacctttccctgttttgtcatctcctttgtaaggacaaccttatctttttctcatgctggtggttgtgaggatttagatgtgatgttgctgtacggagcctgtgtatctacactgaaagtttaatttcctttctcttcctcactcagaacttccagggaaagggaataaggggttggctggagtaatgttaagaatgaaaacggaatatcttagcgaaaactatcactcatgagtggcattttttttttcagcagcgaggtgatgaagaataggcctggagagtcatagtcctgagtggccactgtaagcagctgagaccatgtcaggacagagggctatgggagggtgtgagaggttgaccctgtcgtccccggattgtcacacccagagaaattcaaggctgtagctgcagtcactttctctgtggcctaggctttctttgcctccagatgcttggccgtcttataaaaaggaaccccaagttatgattcagttgggcacagttctttaggaaaagtagctggactgtggaatctctgccaagggctgcagagtgcttcgggtgccctgatatggtggtggccttgtagatgataaatctcttaaggacaaagtttctgttttatctaccatataatccctcaagttgcagattcaggaccttgaatgtcagatgaaagaaagtgagccctttaatctcttttggaagctgggtaaagattccatcaccacttcctaacaggcctctctgacctccactctagaccccctccccacccagagcactctctccactatatcagcagtacttgtccagtgatggaggattcatcttgtccctccccgtacagtatccattaactacttactgtttctcaccagctaacgttctcttgtgcctcggtatcttttagaagctcttggtgtctcaggcagctttatttactaaatttgtgctcagttactttttcatgaaaagcaagatattaaaatgtttagattataataagtgaaagatgaagactgattttaaattttaaaaatatatgcgaaga

SEQ ID NO: 64336 - DNA, 1284 bp, Bovine  19866881049709
tttctggagctctcttgcttttcgatgatccagcagatgttggcaatttgatctctggttcctctgccttttctaaacccagcttgaacatctggaatttcacggttaccaccatagatagtgcggtttttccagtagtctttaatctactttatcagcagggatattatctacagaccaccctttttccagaggatacggcttctgggtattttggcttttaggaagtaggggaatatgaggcaggggtcagctttcccaactggtgtgagcacaaggcctagtttcccattacactttgattctttgttcatcagtattaatccctaaagctcctggttcctgaaatcaacatttgcctctggagcagccaaagcttctggatttattactctgccttcaggttacaggcatatcctgttttattgcgctttgcttattgcacttctcagatagtatgggtttgttttttttttttaaacaaattgaaggtttttggcaaccctatgttgtcagatgatggttagcactttttttagcaataaagtattttttaattaaggtatgcacattattctttagacataatgctattgctcacttaacagactacaatatactataaacataacttttatatgcactggaaaaccaaacaattcatgtgactcactttattgcactggtctggaactgaaccagcaatatctcagagatacgcctgtattattaaattatttggtcactgaggatttctcttattttttgaagtatctgaaatgcatttaaaagtatgtttgttgtaatttatcctgcacctaggtgtcttattttaacatacctaattcactatactgccagaagaagcagatagatatgtaaaaaaagaaaacagaacatgtccttaaatgtcaaaggcatgattgatttccatgttatttttatgctgagatatctttaattcttttatgataataaaaaaggttttatctttaccattagcaccctgtgttacactaaaaatttacaacagaatgttgcttttatggcatctacttttacaagtgaaatccagaaattttatccaggtagagcagccaatcaagtttatgaatatttttcatgaaagtaatctaaaagaaaacattaggttttgggagtctctagattactttgtgtttttgtttggtttacaactcataaaatatatttactacacataaatcaaatacttacagaatatttcctacatagaaggaattcactcttggttcttcagaatat

SEQ ID NO: 64337 - DNA, 1472 bp, Bovine  19866881051796
cttggcagaaggcctggatgtataatgagatattcacatgtgtcagaactctgtctcccaagaatccggtgttatcttggaacacttgagttctatttattgaaatgatgacatgccattatgggggcattgatgcacacaaagccaggtgcaaggctctgtgaggggctgatggtaggagtgtctgttggaacattaactccagattttctaacttgtgtgtgctgaaaatatcagatccagtgtggagttaagagcaagtgaaaaagaaaaaagagcactttaaaagaaaaaaatgtcatgtcagcaatactagagaatttctgtatttgtaatccttgagtatggtttcatttatttttctctcatttctctagaatacataaagatgtcatgcactgaagtgaagtgtaaggtgttagaccccgtccacagggaagattattcttgatacctgccgaaaacctccacgtgtgctcggtttggcagaatgaatcatgaacgtgcttgtgtgtcgtccttaaaacagtttccccttgcatctgatccttcttgggactgcgttgttacttctggaagagagtccagatgcaaaataattggcattattctgttgttgtttgttttatttttaatgaaggaacaagaagccaagtttgaccaggatgaattgcaatattctcaaggagtgagtcactcaaataatgtgaaagctttttctctgtagcaacttgtgtagttctttctgattgattctccttcctcccacttcttgggtaatgaagcctcaatgtcatgatgtgaaaggaacatgacaagcttggtatgccgctgacaagcagaacctcacaattaagctgattaagtcttaagtcggtcagttttctgactttgatgttaaggtctttaataggatataattttataagttgctttttttccaaaggcactggagggtctgatgagggaatcctcttggaaaactcaaggctgagcttggtaagactgccttactctcccctctgccggtttcctgaatggagcaggcactgctgctgggctcaggtgtcccagaatgcagttttatccacttgaaaacccttatctgttcagctcaattagattaattaccttgctcttcaggattcacaatgctctgcagtttagctgcagtaagtaaatgttacttttgcaagtaagatctactgttactggcctctgaagggctatggtttctttgaaactcataaagaggagaacagtcattctagccaagatggaatataggttagtaaatctgtcttccaactgagttttctactggctgtgaggcatctgtgttgaaaagagggatataactctttgtcattcctgtttggtgcctctgaaagtaatttgggatatttcatcataaaacatactattttctgtatctcctggagttaatggagtattctgtatgctcttggttt

SEQ ID NO: 64338 - DNA, 2584 bp, Bovine  19866881055846
actggcttctttttctgcttcctcccctcctttctcagacttcatgagagggagatatagttggtatttgaatgccagttccatttcacttttaagtaatcagtgtatttcagtaagtctgctacctggagtctcaggtgccagataagaagcagtgctcacccaagagtttcaggtacttgaaaacggtgacattcatcagaggtgttagaactgatacattggagtacaaatgccaatatcacagttaaactgccagccagcatatatgttccttgatacagcagctgcttcctttgctcacttgtgcttccgtggtatgaaaacagtgagtttgtggtttgaaaacattgcagttctttaaatgctgccgaatgacagatggtggcaatattacgaagcaggtccgttttgctctggcgccatctatgtgtcatgatgcttgtagccacaagatgtcagtgtggtatcagtcctgggtgtctgcatgaaaactgcagccctaagcatttaagtccaaagaggaagacacagtccacgagcttggctcgccttgcccgtttccttgggctgcggtgttagtccacagactgcctttcctatgagttttcccggtacagttttccattggttcacacctcatcaggaggcttttcttagttctctctctaaatgtaaatactttcctacctcctacttatgcacgaataacctcagaaattccccccattttggtgtcatctcagcactttacagagtttgctaaaagatataagtaacagcatagttttctctctgtctcaggatggttttttttaagtagttaaggatggggggagaagtatctctagtcatggtactgttagggtttttttggttttttgtttgtttgtttttttttttttactttctcagcctctctttattttttggcaaaaacttaacctcgagaaaaaaaatcttgtgttaactgtgcaaaggacacaaaagagggaaagtagtgctcagggaagatcacagatatgtgggagccctgctgtgcttctgcagccttcacagagaaggaggtgtgtgatggccatttttctgatgaaggaagatgaaatatctttcccagggtcaattaactagtaaccaagtgctagaacctggatttgaacctgggtctatgagcttgtgccttcccaaagcctggtaacattactttgaaaaattttcattttattgagttactatactacataagtttcagttatacaacatagtgattcattatttttaaaaggcatactccattcatagttacggttggtaacattactcttgttcgactgtctgcatcataagaaaatgaggaggagcctgaagaacctgtgcccacattggtcagcaaatatctgttgggttctggctacgtggaaggtcccatgttgcgaataatatcaagacctattaaatacattctctgctctcaagaagcaaaacagagttaaggagagggatcaaaaaagacatgggcacgtaggtcagtagaaaaccatcagagaacggtggcatttcctgggagtgatggagggcaaagcagagggcagtgccatggtccagcccttccatgggctctttattatatcagccggaaataaatctgctaaatgaaaagagtattactgagggtggcctctaccttgactgtggttctaagatggaatttgagaaggggggctaatccaagcggccagaggttgccacccatgcatgcctttgcaacctagacgtggtaagattacacttaatcctctctttaggtggtctggtccaaggaagacaggtgaaagcaagacaggaggcatggtttggtgtggcagggctgtttccagtttcccagcccacggctcagatgtggagaacagacttgaagcttctggaaagatttggtaggggaaatagcagagtgcttctggcgtacaactttagaagtactgtgtccgtgtgaagaacttggcaaggaggaacagaggagccacagggatgactggacatttgaaaaataagacctgagaggagaggttagagaaacagaggttatgtaacctggagctcctcagcggtgactttggcagacttcttccagaacagggctcacagtatctcagcccagagagcagggactgaccctgtttgtccatacagagtgaagacagctccagctgagccacgaaaatttttgatttgatccatgaaaaagtctgccctctgcggctgctgtgaacacagaatatgtcatggaaggaagttgatagaattttattttttccctgttaaaagatacagtaaaaccttttattaattacggtgttggaaggcaggcttgacttgatattatggaatctgttgtattgacttctgttcttggtttgagagggacatgatcgacctggagaatatccggtttcatataacaatggatcatgtttgttataataatgggtctggagaggatgactacatcatttttctttgaatctgtaacactttggagagtgaaatagggtgctattaatagcatcctgaggcattaggcata

SEQ ID NO: 64339 - DNA, 769 bp, Bovine  19866881057735
tgctgtgggcatagatattcaagcttttgtgtggacatgtgttcagatctcttggacgtgtactgaggagtggagttgctgggtcataaggtttatgtttaattttttgaggaactgcccagactgtgttccaaagtgactatagcatttgacagtcccaccagcaatgtatgagggctcctacttcttcacatcctcatcaacactggctattgttggtcttttttttacagtcattctaatagatatgaagtggaatctcactgtggttttgatttgcatttccctgatagctagtgatgttgaacatcttttcatgtgcttattgtccatttgtacatcatctttgtaaaactgtttattcagattctttgcccatttttaaattggttatttgtctttttatgatgatacgtttttagatcacggaactgtgtcttctgtgctttcactgtgtaaaacagaggtagcacataggcataaattacaagcagaattacttttcttcctgcttgaaacatacatctatgttcaacttggtgtgtctgttgtttataggaactgatggcttttgtccttgtcagtaaatattagcacatcaaaacaatggctgttaagcctggcagggtgacaaactacagctgtatttcactctttgttctcaaggtcaaagttggtgctgccctttcggcatttctctttcacaaactctgaagacaaattcaaggccaaaccaaggacaatactacatcagcaaattcactcacca

SEQ ID NO: 64340 - DNA, 1491 bp, Bovine  19866881063199
ctttttttaaaacttttatataagaatttgtatgtcttgggatattttcaaagatgaagcaatgctaatttacattaagatccaatttgaggaattattttgtgaaatttaggaatggaattgcatatagttatatctgtatgtaaatatggtaaccattattttaaatgaactttattctccagcttgaacagattaaattctatagtacactcatgccatttctttaattgcattaattatttattacatactaccatgcatacagttctgttggtctgggaaaagttgattatagcagtttgtttcaagtcagttttacaccctgggctgacaacattatcacactttctcactgaaatgaaagagctgggctagtgctccagggcagttctcacagatgcggggttaaggtgcaaactgtgtttgaagtatatccaccccgtttgtggtgggatctggtttatacaagaaacatgtatttgcttcatgcatcttcttggaagttcttcattttggcggattatagagtggaagtgaaaagtgaaatggaagatatgtttaatgcaaaacttgtcatagatttcagacggccatgttaaacctgtaggatcattagtttcttctttaacatttttcatcttctgattaaaaaaaagtaaaaatcagctcctttccattagtagtagttttgttccgtatttttaaaattagaaagactacttagatattaagcatgggttccctttggacgctgtgccgtgcgagcatctggactggccaccctctctctttctgagcccgggcactcaaatcgaaagcagcttcctctgcgaatttctgcgttttctggtcgcagatgtgcccttccatgttgcccgtttttgtaaaccaagcatatttttgtcatcgcctccgagccctttaatcagctctaagtgttgtcacgggatgaaaggtccatctgtgggtctgtatgtgggtggcaaacggtaagtgaaagggtcagcagaaatattggcagattaggagctgggttaaaaatacttttacgcaaaacagtaacacttgtatattaatatatttattggaaaatcaaagcctttccaaatggtcccatgagaaagaaaagaagtgaaagtttcacggtaaacgtttgtttgggaagcggattaaagacgttttagaggacagtcgaggcaggatttttcagaagaatctgagtttagcaattaaattgtaacaccttcttgttgtgattgatggaggtgtctcagctaaaggtgtattatattttcatgcaggtggataaaagctgcagagaaacatgctgtgatctaaactcttctctgaacattttggggggctttcctgtactgtataaaaccctgtgcactagctccgagctgcatctagcgtgcagccttttgtaccacatcacataacccacgacatttcagatgcttctctacatacgggaggcgggaaaac

SEQ ID NO: 64341 - DNA, 1165 bp, Bovine  19866881067804
cttgagggcccattcttcactgttgtttgagatggaggaacacagtgctttgtgtgcctcgtgaccaaagaatttgaactggcagcaatcaagatttggggctaatcatcattaaagggtaatttcattgctgcccataattgatcttgtcttagacccattattgcagttcttttgtcacatgactaaaaaagaaaatgctcttggcaatgaacttttgaaagcaggtttcctacattcagttctttttcaactgactttataaatttccagtgtgcctttattagtgtagtgatttgcctgctttatattacatatttgaaataaaattgaaacagttcatcattgaagtgaatgttacaaaatcagcatctggtttgaataatgagttttttggtccacgttttgcttcattgaatgaggctaataaaactgcctttggttgttatgtgacttctccttcactttgggctcctttcagttcccagattggaggccactagggccttccaactttcagaaagttctttccttgttttaagggactctcagctactttttcatcaccaggaaggtagagttgatgatatacccccgccctgatcccaaaatcatggggttggggatatttcaggtatctttactattgaagctcttggagcaagggcaaagtgaaaaaagaggcctagagttggaaggatagaaaattagatgttggcatggcagcaacatactagccatactatttgggatcaggtgtctaggcacctgtccccagattttgtttctacctggaacttggatgcttgcagagagggaattgtacctgggtaatggtgatactccttggaggacacaaagccattcctgccacagctgctgataacacacatgtacagtcacacaacatgctcctgggaagtttcctgaaggtaaatacacttattttcttctttttaatttcttttgtttatcgaaggctaattgctttacagaattttgttgttttctgtcacacctcagcacgcatcagccataggtatacactactgatccacactgtaacacttacaaggcactttcaggttcagcatttgttctggctttggaaaaccacgtaaccattatccctcatgtactaatgaggaacctcttccaagaagta

SEQ ID NO: 64342 - DNA, 1732 bp, Bovine  19866881100200
gtactttgttacagaagccctaggaagctaatacagatggtaaggggaaaaaaaccaaaaaacaaaaaaaaaacaacttgacatctctagaagagatctctaaaggacaggaggcatggttctcctgcatccatgggttgaccatggggctttcctcaaaagattatattgtgtctttttcctgccacccattaaaagaaaaaaaccatttgaccttccaaaagcacgttcctgagtaaaactggcaaaaactctgaatggacagtcaaggtttcctgatcttgcccaagagagcggatattttattactctttcatgaccacaaggtatttcctaagctcattaagcacatttttcctgagcaagatcttgtcttaataaggccaccgacaccccattcctccagcctccgtcatcaggcaggataaaaggctgaagtgcgggtggagatgagaggaggctctggagagttccaactctgcttgtttattttgagacacacttgtgctccaacgtgggccatcacaattgtggtcaaagcattaggaatccgaagaacacaaacaaagctaactgtggcgaagggccagggtaaaggaagggccaggggtgaggttttcttcaacattgtacaaggagggcaattttgcatagccttttatatgataatcacagccctttcgttggtattgaactttgcagcaagaaggaaaaataaataaataaggctgactaatggcttgtttccccagaggcggctttttatgggatcatatgttttttcagcttttcagtcacagtttcctgcttggatgttaggagcccttgacattggctatggcttagtgcactctggacagcagcccaagccacctcagagcagctggagaggggtccagctggaccacagcaccttcccaggtcacagcaatggcgaacccggtccccttcgatgagctgcactcagtgccaggtctttcagcaccttccaggtcaagcatgaccctccttagccagttgtagtgaggcaaacaagggttgggtggatggggagcctgtgacaaacagtctggagacattcaaaagcaagaacagcaactctgaactgcttttgttcctgttccattcatagctgctccttcccaggatcagaaaggacttttagaattggaccgtcttgaatttttaaatctttgctctgcccactgagtgactaagagcaagtaactaactttctgagcttcctttcttaccagtaaaattataagttataaaacctgtcttatgggcctcttattaggataagagataatgtttggaagacacctggcagattgtaggtgccaagcaagaagtagctagtgctgtgatcaagtgacctaaaccctgcccctgctccaccatcaaagcaacttccctggcagattaccgtattgaaagacaatgcaaagtgtgctggagccgaaaataccctggagttgggctcagtaaacaaataagcaaaaaccatagtctttcaggctccccttctgcaggttttcactttatttcactacttttgagtgggaggaaattactctggaatgccttctgtttggctccccttctgagaaggccatagagcaagggaatcaggatgggagaagggagatagatggtttgtgcctttatttttgccactttggattgggtggcggagggactgaagaggttgattaaaatgcaccaccct

SEQ ID NO: 64343 - DNA, 1218 bp, Bovine  19866881117204
atagcaattatgtttattattgaaaagtccctatgctgttttagaataatgtttgatcattatgagaaagtataaaactttaaggactactgaagaattccttagacaggtgccctctgacaaaaggaagtgagatttgatagaatttttcagaaaaaaatcatgtcaaaggatcacctcccagtgtcacctgtggggagggaggcaggtgtccctgcaaacttggcctctctgcagcgctcaattgccctgaccagcctacctcatggaaaccccctgttcctggcttcatttgtcttcagcccattcaggctgctccaacaaaacaccatgaacttggtgacttatgaacaacaggaatttgtttctcatgatgatgagaaagtccaagatgacgatgtcggcagatctggtgtctgatgagaacctgattgctggttcacagacggccctctctgtggggctccaccctcatgacctaatcacctcctaagtaatactcttctctttggggctgggatttcaacatatgaatttggggcaaaaataagcattgagactgtagcatcgtggctgtcccacccttgattgttccttttgctcttatgcaggctccctttctgtttacctctggaatgtccttgtcctcgacgaccttcctgtgtgctctcctcactccacagttctttcctcccttgaggtcttcattcatatctgtacagtaatggccctcgaatctccttctctggctccacctgcccatcagatgtttatacttggtgactccccaggttccagcatgttcaagatcggaagcatcactcactccttcctctgcacctggtcaccatcctctggtcctctcctgggtgaaaggtacctctgtccacccagccaaccactggagctcctccctgagcctcacccctcacagctccaatcacagaggagccccagcatccattctggcttccaggcacagcaactatgcctggaactttggctccggtccccccaaatctactccctgctccacaaggcagccagggccagcttctcaaatgctaacatgatcacctcttcgcagctcaaaaccctctaatgccttccttggccctgaagaaaatcaaaactccttaaactcagttcaaaggccccccagtcccgaccagtgcccaggcctccaacctctcccagcttcagtactcttctccccta

SEQ ID NO: 64344 - DNA, 2008 bp, Bovine  19866881120908
cagacccaacccaagaagagcaagtaagcaaagcagaaatgtggtttcataccagagcatcttcttccagccaaatgtaatttacagcagagtgtttggctcatctgtcacaggagaattatacaccctcgccacttaccctgaaaataaatatgcactcctcattcaggtaaatgagatcgtttcagaaataaattgactccccccactaaaactcgctttctgcaaagaaaataaatgtttgagatgtttctcctgatgaagacgataccactgacataaatttaagaggctgattgtacggccctcgttcaaatgaaggccagcccaggagaagctagaggccatgagagccggaaacatcagataataactctgctaaatcaactctcagctcttatcagtatgcaaaaatctcccaggcagaaatggaggagaagaggtcaaaacatatgtctccactgacaatcatacatctggaaataaaaccaccttacaaaatgacactgattttctactagcccacacaaagctcctgaccacttcacaacagccttgtaaattaaagaaggtatgatttttccaatttagacattgggaaactgaggcagcgagcagttacccaagtgttcaaagactcacagccgatgacaggttgagttgggtgaaaaaagccagggggcccaggtgataattccagcattcattcaatccctctgctttcagagggagtacaacacacggtctctactcttaaggtgcatatgacttaattagaaaaataagacgattacacactaaatcaaacagtgcagttgaagaaaaatcaccaatgctaagcatataccctttgcaccctttccaactcaaaaccatactccttttctgaatttacggaattaacaaaaagattcttagtcaacacacagtttcaaacttaaagctgcacagtaagaaccagggccactggtcagaatatgtcatttgttaacttatttatgcccatatgattctcttgttcaatatttagttgatattgaacatcttgttcaagatcttgaatatcttgttcaaaactatgatagtcttaaatataattatttaccaatgaccagattaaaatgtctcacctttaagaaaaaagaatttaacatggtttaaaaaacaacagtctcaaatatgtagctcttaatatttttattagtgagttacaatgatctgtggagatactaatataaaactttgtaatttaaattttttaatttcataaaattttttggcattccctctccttggaacttaaacatttctaaatattttcaacagactttcaaattgctacattttaaagatttcatttagcatagggcaaaataaacataaagaagccccaaaacagcaaggcaacaaaagtcaccactaactaaatctgggtgttgaatttttggcatttgattgaaattccataaaaagaatgaagaattaatgatctaatagttgtcataattagcaattatattttcagaggctctaagaagaattaattagagcatacctttgaggtattattatctccattataaaacgaggagcggagatggagccgggatgaaccggttgcctctggccacaggcagaaaaagagagcgggctgacggatacctgaaattcctgagccccgaggcctccgcactaagcctgctcattctgagctggcatcaggaagttcattctctccatggcataaacaagaagctgtctttgctctctcatggactattcctctcgctagagctaccgacccccttcagtgctcccatgagaattcttttcagatttggtttccttggcgagctgccacctaaaagtgtagttgaataaagtgagataggtagaagtcctggatcttaaaaaaaaatttattacaggagaaggaaaagggaaacaggcagaaatatataaggaagattcatgtaactgaacatataacaagcagaagtaacattat

SEQ ID NO: 64345 - DNA, 1447 bp, Bovine  19866881139160
tgatggcatttggggaaagagactgcatttattctgctctgtaaaagtccctgagttgaattgtatactatgctggtaaggtaactgaaaggttgtgttagagcaaatggtgtcccatttgctctaactgtccccagttgcccttcccccagttttaaaaggagagcaagcatcagaaggtctttggtttggtgcagtccagtcatgattttgtctgatgtcactgaatcaggaggacagcatcccctcagagatctcagctcttactcacagggtcccacttgtatgatcaatagaaaggattcttaggggcatggccagagacttattactactgtttgttattcatcaattaatatgatctgtgcctattatatgctaagcattgtgttcaatactttacttacactgttttatttagtaggtgtaattattatctctattctgatgaagaaactgaagttcagtgagactgaaaatttacccaagatcacatagcttttaagtggcagagccagcattcactctctgtcgtgggtgcttcctttccttgtacagtattaggagcataaggaaagatttgtaaagcttccccagcgagatcaccattccgccttcttcagatgaagctatctgtacagccaaaatatcactgaagttttgaatccaaagatcttccttccatcaccttctaccaatacaagatgctttttagttctgtccccaatattttactgagtgcctacagaatcctaattttaagaggtcactgatttcaagaaatacaataaaagcatagtttatgtcatctaacaacacaaaaattaaggtgcagttggtattacagtctaagtgaaattgcaagtgatgttattaatagtcttaatagttgtgtttaaagatactctcctcttacctatgatcaatgtaatatcatgccactgcttaaatgcagtcactcaatgattaataagttcagtagtctttgtatgactgtttttggaattacagtcctaaatctgttctggaacagaaagagagtatagacatttgtgggattacaatctggtaactttcaggcccagggcgaatttacacacactggcattcatccctgcatgatatttcccagttatccaaaaaggcttttattcaggaaccatttgtggtcaggatgcattgtgatgcatcatttatgcagtgccttaagtgtttactgagtagcgtgtgcaagagacaaagctccagaaccctgactaaagccctaactaactagagacacatttactgttatgtaataaaatttcatcggtgagtagatattgtttaactcattcatttcctgagagttgaagttcagggtttcctttcacatttagataaccccaacatgctgcttactattttcccttccaatagatagtcatgccaaagaatatgttttgca

SEQ ID NO: 64346 - DNA, 2427 bp, Bovine  19866881243358
gatgagatggctggatggcatcctgacttgatggacgtgagtctgagtgaactccgggagttggtgatggacagggaggcctggcttgctgcgattcatggggtcgcaaagagtcggacacgactgagtgactgatctgatctgatctgatggctgattcactttgctatacagcagaaactaacacatggagaaggcaatggcaccccactccagtactcttgcctggaaaatcccatggacggaggagcctggtaggctgcagtccatgaggtcactaagagtcagacacgactgagcgacttcactttcacttttcactttcatgcattggagaaggaaatggcaacccactccagtgttcttgcctggagaatcccagggacgggggagcctggtgggaagccatctatggagtcgcatagagtcagacacgactgaagcggcttagcagcagcaggagcagcagaaactaacacaatattgtaaagcaactatactccgataaaaattttttttcaagacaaatgaaacttttggaggcagtacacatatttgttatcttgatcatggtgacaatttcataagtcaatgtgccaaatttatattatatcaaacttaccaaatgtaggcatgttttttttattttatgtcagttatacttgccaattaaaagagatctcaatgaagataaaaagaggtacaatttgaatctttcgtacataattattttagttttaacaaagaaatcaacaatatttgtgtttcaatcaatcacagcattcaatggcaaagggtttcacagaaactcagactaattcttttaatttacttcagtaggaaaaataaaaagctgaaaatacttctcaactggccttgttttgatgtcctgcttttccgtttgcgttaaatatgttgtgtctctccaatgatttctaaatgtaactccttgtcacactgcagctaataaacagaacatatgttcattcttatgttccggagataattattaaatgaacaattaatcttttgtttttgaggttaggagaggtaactactctaagagttcaggttctttttaaaatgaaattatctgttttctagtatgaagatcctaatgcttgttcatgcctggttatctgtagagtaaggatgaaaactctcattggaagcataatgctggaatacttggataggcagcgtaattttaaaccactaaatttgtggtaatctgttatagcagcaataggaaaccaatacagacaccgttcaaaagatgattgtaaagctgtcacactgtgggctttgaaagcaaatttgctgccttttcttcctctgttatgatatcatacgcttgtttccactagcagtaatgcacactggggttgccattgttaatcttgaaattgtactttgccagttaaagacatgagacctttggcctcttcttcattcctagggtgtccagtgggtggcctgtgatgtctccctgctaacgctagacgatatttcatcctatctaacaagcactctgctcagatggttgtctgtgcaagtgccacaaggaaagctcccatgggacccagaaaagtattcattttccaaagagaattaaaacccacattgatagcatataaaacaagaatgctttaaaatgtgaagagtgatgaggttatttcacccttaagttatatttctaggaaaaagcagaatttaaatcttaagagatctgtgtgcccaattgacacttcaaagaaagagaaatccagctaatgaaatgtaacctaacatccttccccagcttctgtattccccagattgctacccttttccaattaacttttccattcttctgctaattatctgatctagaagctttggagtgatatttttcctccctctgattcagcccttagaagacattctcatctcatcttcgttttctttggggaccctgtttctcagcattaatacgcatgcgcctaacacagctctgtatgcagcagctggctcacaggttggagcatgggattcgttctatccagtctgcatctctttctgcctgcacttccaacaccactcactccacactctacacagctccctgttgcttccacctgaagtgtaaatccttctacttagttttcaaggcctaactatccagctttgctccccatgcctctccacattccttccttctttcagacggccaggcaatttccatggattcataaaattcagtttcctcttttcttggtaactcagaagaaaggaacagaactgaatcagacgttgacccctttgacaaatatatagctttgtggggatgggggatggggagacaaatacaaaagctagttggggttttaggtactattgcaaatgagttctggagcacgccaagaggggctaaaagatcttcaggga

SEQ ID NO: 64347 - DNA, 1042 bp, Bovine  19866881301043
tctttgtgaggggcccaggtaagtgattcttagctgcagactctcagcgccaactaacatgtggtccaattttctaaatgtgagtgttgtttttttgcctagaacagaagcttcatcttttagtcattttgttttaatccagcccagaaaccagatctgtttccctgcttgctttcagaagcatgaatgcagggcctcatggaggacaagactcactccctcagcagatgcaaagccgcctgccccaggtacacacccaccaacccatctggtgggttttgagttcggaatcactcatagctacaaatagattctttcagaggacagtgtccattcgccattgtgattccacttgagttagtactttgaaatcccagcttggctctactaccttctagacaggtatatagtgactataatcagctgagatcccaaccaaaccccaaatgggaaaactaccccatgagaaagtctccagctgggaaaagctgcccttgtctcgactcttaaagagaagagattcgtaattattttagtgagtagcctcccagacaaataattcaatcgggctaattttcagctacagtcaggcatcctgatgggaaagcaggccaaacaagccatctgcacaatccgagtctgggttgcctggggagcatcagggctccattgtgtttggggccattttcagcttcttttcttagtcattttttaagtgcctcttcccatcccaccccatccctgcttttgtgtgcgttcgtgtggtatatgtgctcgatcgctcagttatgtccaactctttgaggccccacggactgtagcccaccagcctcctctgcccatgggatttttcaggcaagaatattggagcaggttgccatttcctactccaggggatcttcctgacccagggaccaaacgcacatctcttgcttctcctgcactggcagggagattctttaccactactgccgcctgggaagccccatctctgcttataacttctagatgcagtccatgcatagagtctcctagaatcaaa

SEQ ID NO: 64348 - DNA, 1177 bp, Bovine  19866881331076
ctggaaacttttacccgggcatgagaactatctattgacttctaaaatgccgtagtgtaatgaagacgaatataaaggaattctgtaagcagaatgtgaaatgtgttgggtaaaataccatgtctaagcacaatggtacccactccagtgttcttgcctggagaatcccagggacgggggagcctggtgggctgccgtctatggggtcgcaccgagtcagaagttagactgaagcgacttagcagcagcagcagcaagcacaacggtattagtttatgatgaattgtattaaaatagacaaaacacagttgatgggagggtggggtacagaggggccttgagaggtatggttatgatctgtttttgagcgtaggtggtgggcatgagtgtatgctttatttacataaatattttcataaactctattcactagactttccatcccaattctcaaaaactgtagtcaacatttgctgtttagggaggaaataccatttcataagtggttttgaatttcattatatgaattcataaaatgctagattaaacagggagaaaagaacaaagcttgaatattactaacttaagagaagtgttgaaggaatgtaacttttgaagtttccaaagtgaaactatcgaaagaagtcccctttcccttttatgagtaataaaattatgacataaacagacctttctcagtgatcttccttgtactgtgcctgttccctcttactgaattttcttgggcagaattgttcagtcatttgataaatgtatgctaagatgtgcttggcagcatgctagtaacgattatagggacttaagtcctttcttttcagctagtagctggggagacaagacctttaagcagccaagaaagtgttaaaaagctagatacctgtttgagaatccagagtacaaaaaagaatcagagtcctcatgaagccatgtatgttcggtggcacaaacaataaatactgccaacctgcagattaaggaagtcctctctagttgacagtggtggggggactttgagagcaggtgtactttctgaggattgagaggaccttccaggcagtcctgtagctgaaagcactgtagtgaggacagaggcttggcccagggaactttcaagagctagaagataattctatcatgtaggaacagggcagctgtt

SEQ ID NO: 64349 - DNA, 1685 bp, Bovine  19866881360101
tgtgcaaacctgaatcgatcattatggccaggagagggtaaagtttttgatttgaccaaccctacgcacattcggagaaggcaatggcaccccactccagtactcttgcctggaaaatcccatgggcggaggagcctggtaggctgcagtccatggggtctctaagagttggacacaactgagtgacttcccttttacttttcactttcatgcattggagaaggaaatggcaacccactccagtgttcttgcctggagaatcccagggacgggggagcctggtgggctgccatttatggggtcgcacaaagtcggacacgactgaagtgacttagcagcagtagcagcaatgaacattagtttccagaaacagaatggaatccgctcccctgaaccacacaactgaaaatgggagatgagaaatcatgggcagttgtcagatgagaagagaatagatagtgcacagataaataagcaaattctcattatacacagagaaagcatttccgccaaaactatacttattttttaatattttcctttccatttcttttaactgaatttaatttttgcaaaagcagttttcccttgaactgagctcaaatcaaatgctacatctagggtagttgaggaaatgtagcaataataactgaatcatttcaagttctgggatttctggaaatctatgctcttttggtgtttgggttttagctcaaataagacaagtttattcttcgttggggcatgaaataaggatttggagcccaatcagatcaagccaacagacgtgacttggacgccttatgttcaagatgccagagataaggcggtgcttgggcagccatgcctcctgctttgtccacctactccactattacttgtttcttgcctcctgacccccaggttttatacctgtgaaacattgtgcttttggggtgtgtatcatctgaatccccatttgcttagagaagctgctcaaaggcttgattttttttttttttaatggttttggattataatctgttgaccaaaactttcccctcagttgtcatgacaactttcatgttgcaagagctagatgttagcctagaggtttgacaagcagatgacttccagacagagaggctgatttagtacttttgggctgggacacagggcttttactgtacttgaaactagtttacataatttgtaaatcatttcagttcacaaaagttcacttctgaagtgaccatggagtatttggttatagcccaagttccttcaagggacccgatgtacacatttatattctttgagtttcaactagcagctgacaagttagcccatggatacgggggaagggaaagttacttgtcatattgaaattgttgttaataagttgggtgctactgaacttttgtctcctatcctatccttctatcctcaagttttgctggcttccaagaacaggaattgatcccactgctacccctctgccccgaagcctgacccttgtatgtgatagaatataattggaaaatcacaatttgctcagtgaaagtaaaatgctcctgttaaatttgggaacctttttttcccaaagactctgcttcatattctcactcaaatttgccttttaattattttacttcttcagtgagagtttgtatatttattctttaatgttgttatagtttgcgttg

SEQ ID NO: 64350 - DNA, 747 bp, Bovine  19866881469453
cttatggcttaagttacttttggcgacctcttctgttacccacggcaaaaatcattcctaggaaagtggcatgcattaatccaatataagggattttcaattctctatttcattttgattgtgtatacactttttaaattcttcactcaagagaaagaagttttaagagtgtgctcattacactgatagattggaagacagaagtctacaatgcttccactcccttcaggataaaatgtgcacgggcagttcagtacctgtttggacagtctggagaaggcctggtcagctccttcagctgtggctccatttcttgctgcccactcttggcatggcattgcaatgaagtccctttggcctggactggatctgaagaaccacgagcaatagtagtgaggatcatgaagtttttgtttttttaaagcatcttgaagttttaataaagcttcatgtttggaaaaaaatattacttacaacatgcttttcctttaagcaatttatgttaatataaaagtatcctaaagaaaaattagatacagcagtgggggcatgttatatttttctcaaacagatacggcacttttattagaatcctaatgaaatgtatacccataaaaagtgcgtttcctgccctctacccccacaagttaaatatggccgacagtcatgtgtagagaatacccgagccaactccactgaataacgtgtcgtctgaggtctgccatcacctgacaggataaagctaat

SEQ ID NO: 64351 - DNA, 1166 bp, Bovine  19866881477145
actctttgcgaccccatggactgcagcatgccaggcctccctgtcctcaccaactcctggagtttactccaagaaaaaagtttttccaagaaaaactgatagggcatgaaggactcaggatcagagatgtatgtttgggagcttcagtttattgacagtactggaagcactggggctaagatcattaagggaagacatggcctgcagcagggaatgaagggagcccaggaatgatggccagggccctcaaacatctaggggtaagcagaggagaaacaaccagccaagggcctgagaaggcaaggctactgagttaggaggaaaaccataggtctttggagtatgcaaatatttaggggggaatactagcacagatagttctgtggaaagtgatttccagatcctcaacttcttagtcactctctccaaaaagtcacctgcctgagaatgtgccaactgaaagtaaaatcttctccagccatttcctttcagtcacttgtctctctctcctttctctcccagatcttaaaacagagcagtacccagaaatgtaaaaatgtccagggcacagaaaagaaacaattagtaatactggtgtcagtgtgatgaagtcatgactgtaatatctagctcatcttgtgtgagccaagtgatgtccaatattttgctttcacagagttggagaacttaattggattgagaactgatggattattttaaaattttttgtgataaattactttgatttttggcatgtaagtcaggagttcaaagaattgcatacagttctaaaggaatattctatcaacttatttgtataaacaggtcttctcagagcataagtctttaaaagaataaacatagtaaagtaattgatgctgaattatgtttcattataacactaagttgtagtatctgtggaaatatgaactaattggaaaaaataagctctagtcaactcataagaatttatgtttataatacaattttcttttctaggttaatactttttcatcaaaacatgtaatatacaatgcttacattattttgatcaagtgtataaataaataattgtaaagataactgaatctaaaataaatgttttattttttagaactaatagtaataaaatttttaagttttttattatcaatttatatccataa

SEQ ID NO: 64352 - DNA, 798 bp, Bovine  19866881770311
gccctgtatgtgttaaggtccacagccaacaatggaggaggggggcagccaacacaggctctaagtcattaacttgtcccctgacccacttacccctcaccttctcagtcattatccattttgcctccccacctaaggaccaatgatatgaactggtaattaacataagatgataatgaccctttgagacacatatgtttcctgccatcagatgctccctctgcagcttgacccaaccctagatacccagatgcagcaaggttgcctgagatgtgagcatggtattagcagcccccaaggaagtcagaggtcctatttagcatcacatgaaagtcaatggtgctaggtgattagactgttaaatttgaatcattttgtaatgaaaaatttagttttggaattttgaataatttggtctctgtgtaaaatcgagaaggttctttttccttgttgctcccttttccagttcatcagcattattttatgtttgtataatgatgccatgagatgactccatgctttggtagtgcccatgctagcttgtgggattcctctggccatgtttctgaatcaatccttcaggaaatattaagtgattatgaaattggaatctggggagaagcaaaaagtcttgacaataatctgaccagaagcatcatttccaaacaaagaggtctccagtccatgggaaggtgtcccagggtgttacttttctgtaacagactcccctaagagagctagtttgccagttttcctaggaaaagaatgtgggatggacccaggtggggaaaggagggg

SEQ ID NO: 64353 - DNA, 1405 bp, Bovine  19866881819224
ctcataatattcttgtgagagagacatattaatcattaatcctgcaaacaaggaaggaaacccagggttcagaaagtgaaggagggacaatgaggaagaagaaaaagaaagaaatgtcccaagttgttgccagttctattctatggactgagatccaaggataaacaagaaataaatcagaaaagatgaaaatatgtctcccctaccccatgtccaatgcacactccattccaaaattaatttactgagatatatgtaagaagccaagccagtccctggaacacaacatacacaaaaatggtagtgtcctctcttctctgtatgtgcattgctgcaacagacaaagatatttgggatctgttcccaactctgaaagttcaggaattatcacataactagagttaggaggaatgctaaaagccattcccctaagaatatccagtataataactgtgtctttcattttaatttaaaattcagtaagtatgtttccatttccccgcaaggagataaataactggaaatgactgaacatagcacaaaacagacaagggaaaaggatggcagttttaactttgaaattcaccattcttgtcagttaaagtcagacctaaagcattaatttattctgaaacattaattaactggagctttttttgcatttaattttctctggcattttagaatctattctaagccccgtggaaatggcaggtctgatgttattaaagttagcctttcagaaagtcctcgaactgaagactccaacatattaaaaaatgctgagagtccagataatgcaaatctaaattattattaaagggtattctttacacatgaaaaaaatctttgattttattaaaactgaattcaacttttagaaaggcttccattttatacaccagttgggctcttcagactcctatgaaacatctaaagcccatttcatttcactcactccactcattcatttaagtatctattgtgtgccaattacaagacaggcaggtaattctgagcagggcaaccaaagtcctgttcttgtgcagcttatagcttagaatagaaaatgacgaacaacaaacagataagaaaaatatccatgagtgatgagaacagtaaagaaaacaaaaggataatatgagcaagagtgattgggaagaactctctaaggaggagcgtccatgtcaagccttaaaggatgagaagcgggacacacaaagatctagagataaacagctcagagggattggaaggtgtcattgggaaaggctgaggctgagctcagcagttttgaaggcaggaaggtgacagtgactgagccgcaaggcagggggatggtgtcccctggcccgagacagaaacagctgggcgaggaaccagtagagtgtgtgttgtctgtggg

SEQ ID NO: 64354 - DNA, 1118 bp, Bovine  19866880478662
actatttttgaaatacacacacctcacaaatcctagcatataattttatgaatttataaagatgggattatactgggacttccctgctgatccagtggctaagactctgcactctcaatgtatgcagcctaggtttgattcctcagggaactagatcccacatgctacaatgaagagttcacaagccacactaaagatcccacatgctgcaacaaaggcctagtgcagccaaataaataacttaaaaaaaaaaaaaagagattatactatatatgcatggttttacaacctaccttctaaatttgttgtatcttagccatagacacacatctacttaattttttaaaactacatatgatttcttcatatggctacagtatcttcttttctttctggctgcgacacatgcaatcttagtttcccccccagggactcagcccagcctcagcagtgaaagctcttgagtgctaaccactggattgccaggaaattcccagtatcatttattttagcaataccctactaatgaacatttgggtaggatccaaactttcacctttagaaacaaggctatagtgaataaccttgtactgtatctccagatccctcagtatatgtataatttcagtagattacatgtctagaagttgaattcctaggtcaaaaattacaaacatttaacattttaatagctattgtaaaattgtattataaaaagaagtttataaacaaatagcatatacacatatgactggagccacttatctgatcttataaaagtagttaaagtactacagaagacactcctgatggatgctcttaaagaagaatctgagatacttatgacttttgcatgtgcaaccctgccttttttgccaatcagttggaagccaagggagtgaattctgagtgaattctcgaaatccttgaagacccctacccagttctgtaaatacaggaggaagcacaaagatcatggcagaaggaggtaaattagaggtttgttaaaaggatcatccacgacagtttacagcttaaaaaaagattaagatggtatagccggatgctagggaaaaaaatgcagcctggctcctctgaaggaagaacttcgcatacaa

SEQ ID NO: 64355 - DNA, 692 bp, Bovine  19866881041689
gcttttgtcttcacgtctgatgctggagcttgaagtccacagagcaggcaattggaaggggaaaatggttgtcatgtggaggagagcaagactaagctagaacttcaacatgagctggagcccacaaggacctctgaagtccatgttggttcttattgcctcaaatgttgatggtgtgggcattctgcagaagccagagctctttgcacagaaccaaatgcacacacctggcccaggagtcagagaagctcaaggaagagtaaggggaaggtgaagcagttacacacatggcttctgcctcttgctgatgaggtgaggcagcaggtaaccagcaacatgtgtcagctacaaaatggctgctgcttcacttcccaccctccaaatctactacaagaaactcctggtggcccatgctaactggaaacataccagaaagggaattctgggaaatgcaattcagcccagcaaagttaatacatttcaaagccattgtacttactgtatagcttaatggttatggactcaggccctagaatcagactttccaggtttgaatcacacgcagttcctttatttcaagctgtgtgttcacgagtaagttacttagtttttctatgcttagtttctttgactacaaaatgaagatacagtagtagtacttataaaatttgtgtgaagtttaaatgaggtag

SEQ ID NO: 64356 - DNA, 1629 bp, Bovine  19866881062859
tctatacaaaatattttacttaggcctaggtgaccttttttaccataattttttttaatttactttattatggtaaaaacatctaacatgatatctacatacaacaaattttaaatgcttaatttattattgttgtctgtaggtagcgttgtacagcagatctctagagcttactcactcatcttgcttagctgaaactttatgccggttgatttgtaactcatttccccctcccccaccccggcaaccattgttccattcttcaattctatgaatttgacaattttaggtatctcatataagtggaatcatgcaatatttgtctgtgactggcttatttcactttacatggtaccctcaaggttcatccatattgttatatattgcagaatttccttctttgtaaagatgaatagtattccactggaaaaggcaatggcaccccactccagtactctcgcctggaaaatcccatggacagaggagcctggtgggctgcagtccatggggtcgctaagagtcggacactactgagtgacttcactttcactttccactttcatgcattgggagaaggaaatgggcaacccactccagtgttcttgcctagagaatctcagggacgggggagcctggtgggctgccgtctatggggtcgcacagagtcagacacgactgaagcgacttagcagcagcagtatatatgtgtgtgtgtgtgtatatatatgtgtgtgtatatatatatatatataggcttcccaggtggctcagttctggcctagagaatcccatggacagagaagcctggcaggctacagtccagaagggtgcaaagtcggacacgaccgaagcgactcagcatggacacacatgtatgtacacatgaactagtctaatatatatctaagtgacttgagataatgttgttcgccaagttctcattttgttaggggctagcactgtaccattctgcccagtggcccgggatgctcagagagctacctccaactgtacccttctgccttcttcaagtggtcatgacatttttagagccctgaagtctcttctggcgactgaagtccaattcttctgactcatcagggacccagctctgtcacatcacaaaggcaaccctctgaaaagtagtgttctgaagacagctttgccttcaggggtggggaagcaggaggtaaaagtggggtgaacagaattcaaatgccaacctctcccttgtccccaataacccatctggtccggagattagtggagatgctcactgtttaaaacaaacagccttcctggcttcacatgatcatctgtttatttgggtcatgtggggacagcagccaggggatgttaggcaaaagcaagggtttagaaaggaggcttttcctgggcttgttgctgcatgcaggagcctgaaaacggccagacagggtttctcatcaaccaaggttactctagttggggaatggacagtgggggtgagagataccatttaggtagtaagggggagggtaaaaggagaggaatgaatagggctgcttaatgttttagcccaacttcctgttgcaagagggtggaactcaggtagaagctggccattgttgtattccttcagggggaaag

SEQ ID NO: 64357 - DNA, 1959 bp, Bovine  19866881067655
gagtcttctccaacactacaattcaaaagcatcaattcttctgcgctcagctttctttatagtccaactctcacatccatacatgactcctgaaaaaaccatagccttgactagacggacctttgttggcaaagtaacgtctctgctttttaatatgctgtctaggttggtcataactttccttccaaggagtaagcgtcttttaatttcatggctggaatcaccatctgcagtgagttggagcccaaaaaaataaagtcagccactgtttccccatctatttgccatgaagtgacagggccggatgccatgaccttagttttctgaatgttgagctttaagccaactttttcactctcttctttcattttcatcaagaggctctttagttcttccctttctgcctcaagggtggtgtcatatgcatatctgaggttattgatatttctcccggcaatcttgattccagcttgtgcttctttaagcccagcatctctcatgatgtactctgcatataagttaaataagcagggtgacaatatacagccttgacgtactcctttcctgatttggaaccagtctgttgttccatgtcaagttctaactattgcttcctgacctgcatacaggtttcttaagaggcatgtcaggtggtctggtattcccatctctttcagaattttccacagtttattgtgatccacacagtcaaaggctgaagtggagttggcccatcttttttaaacacttgactgattgcaaaggagtaaaataagatattcttgttagaattaaaaattaagtttttatagatttatttatttttttgctacataatttgtcttgttgaacctgcttttgtactgcttttcattaaggaaggaatacaaaggcagtgttagccttcttttttattttttaatgtgaaaattgattgaggcaattgctgtgctattgactgaagcaaaactgtgttcatggttgcttgcccgtggattaactctcttttatcagcctccacaattgacaaaattaatatatatctacctctgatgcctaggagtagacctcattaatatcccgttaaataggcttaacatattttaatgagactttttactgctagcatatatttatgcagcaaacttccactcccgctgttttatggaaacttgtctttaaaagatcataaatccccacctaatgtaaagtcaatcacttttgaagttatttatcctcctgattttgttccagcattttgttgctgcaaagttacttcttcatctaacacttttcctgcctctcaaaatagttacattgacaccagttcttaagttaaatgtaaatatgtccatatctactcaagagaaataataacccatctgtgtgaaggcttgtatgtggatgtttattagcggcattgttcatgacagccaaaaaatagaaacagtccaaatggccatcaagtggtaagtgggtaaacaaaatgccaatgtagttattcatccagtacgtaaactgcaatgtggtcgtccatacaatggagtattatttggccataaaaagaaatgaagtactgatacatgctacaccatggataaacctcacaaatattgtgcaaagtgaaagaatccaggtgtaaagaccacatgtttctgattcatttgtgtgaaatgttcacaaaaggcaaatctctggagacagttacattagtggttgcccagagctgagggcagaaatgaggaatgacttgcaaatgggtacagggtttttttgagggtgatgggattggattgtggtgatggttgcatgactccgtgaatacacaagaaacgattgtgtctttataggtaaatttatagtatgtaaattactactcaggaagcctgctaaaattagtcacatttaaaatttaatatttgtaatatttattgtatttaaatatgttacctgttttca

SEQ ID NO: 64358 - DNA, 879 bp, Bovine  19866881151857
attatgtaagtccaaatccccggtaataaatatatacagacaatctctgctttgcatggcaaagcaggaccataaaatgactgtgaaagctgaaatcatgcatagcaatcttaatagtcagtgagaaaaagtatcattgttctgtgacctttaattagtttgattaaaacattaaaaactctactgtcagttataactctgtgtgttagttgctcagtcgtgtccaactctttgcaaccccatagactgtagcccatcaggctcttctgtccacaggattctcctggcaagaatactggagtgggtttccatgtctttctccaggggatcctcctgacccaaggatcaaaccctggtctcctgcactgcagacagattctttaccatctgagctagcagggaagcccattataactatttaggaaaatgaaaaaaatacaaggaaagttaacatttactcagtacactaatttaaaacactagaaacattgaaaattaagatgttttatttctttgtaaaagattatcagtgcttgccttctcatatagtttgtgatacaaagaggctcattttctatgacttggccaattgttatacccatttctaagtttggatcagcttcccacatgttatcctttgaatgttcgacatcatgaaataaccctgagacttcctttattgggaccacccagctaagctcctgccaaattaataacctacagaaactgtgtaagacaataaatgtttattgttctttaagctgttaagttttgggtaatttgtagagcagcatttgatgcttttgaactgcggtgctggagaagactcatgagagtcccttggacagcaagatcaaaccagttgatcctaaaggaaat

SEQ ID NO: 64359 - DNA, 1413 bp, Bovine  19866881306729
ctcagctcgtgcttgagctccgccagccgctgctgcgtggcaatcttctcccgcgccagccgctccatctcatgctcatattctttctctttcctcttcagggactggagaacagggcaagtaacagcagggcaccctgagcaggagccacagagcccatggtgccaccaacatctccttcacccaccctcacctgcgcatcgggggcccaggctgccagggagctgcgggaaaccacacctgcctctcggtccatggctccacctaaggaggcccagcatctggggacaggctgtgagctcacaagcaggtgcagattcaggccagtccctcccctacccctacatgattctgtcctgaggggctctgttgcctcttgccccatccaccctcctgggagtatctccttccattctgctgagaaggggagaaagggtaggagacttcttaggcagtgcccaaggcctgcaccgccattcacaccatcctgccgctatggatgcggataccacgagctaccctccatggaacccgttcctcaaggatccccagacgatcctgccctttgtcccttcattattcactcgtctccttaacttcaacgctcttgcaggacggccagcagattctgagacccctacctcacctccttgaccacctccatctcctcctgaacagctgctgacttgcgcacatcctccccacggtgcccacctgcaccgcctcgcacgccactctattcccacactccccaggccccgggatgtggccttccttcccctcctggacctgagcagcctcagccactgagaaacagctcttaggaggacagcacctcggcctccatctgagccgccctggagaagcccctccccgcttgacgctgaggccatcccgtcactcagaacactggagggcgctccttgtctgccatccgatctccccttccacgcctccagggccacgggccacctctcctctcggggctgaccctcccggggcacactcccccatgagaagggtctccggtttcccttcgtccgatgcttctaagcagctctggaaggccagctcctattctgttcctcaactcccttctgcaccgtctttccttgttttctgtgacctcctgtctgaaactttattaaactaacacatcttaaatcccacaggcctccccgtggccagcttttccttggcccaggcatgtcatgaccgcagggttcaacagacgatgtggacaatcctgacctcccgagcttctagtcgccgaggctttccagtcctggccaggtgtaggcccccatgtggtctccctccttaccccttcaggtctcgtccactggagctcctccacagcccagccccctctcacgtcctccgggtacaccagcctgctctcaggcttgctcg

SEQ ID NO: 64360 - DNA, 673 bp, Bovine  19866881339102
tctgtggctcgcacggtcaggggtgcagccagcacgtcttgggcacgttatgtcagggtggcactggaatgtctgtttttcacacacacaaaaggtcaatcatcattggaggatgcagttctaccagctttttatttcttaaataagtggccaatttgattgagaaagtgacaaagcagcagtgaacctctaaaccaattaataaattcctctacttacaatccaaaccagtaacctcatcattgtacttatcccaggcaaggcacagggttagacagcagacagagaaaacacaggaaacaggaagaaagggcatcaacagggcagtgtcaaacaacagtgcaggaaacctctgcaaatctgcttccggattgtggatggatcactctccccctccctcattattcaaacagggctcgttacacttggatccagttgaggaccatccctgagatttcgacgttcgctgcttcggaagtggaggatgtctggtaactcaactaagcagcaggctgtggcgctctcccaacaaggatgacttggtttacagtgacagcttctcctcgtgtgtcggaagtcactgcaggctgcacagaaaacccagcgacagcggctttgtttcctcctaaatcggtaccattttttttcctttattgttcgtatctaggagtga

SEQ ID NO: 64361 - DNA, 1651 bp, Bovine  19866880865480
tgccttctcctagttgtcagtcaccaatggagttttttaaaagacttgtaaaacactgaaggaaatgacttattaaagtctgatttttacttttgttcaaggaacagtggattcaaataaattattatgcttttgcttgtatatagccttgattctttgtcttgtagagtaaaaatcttacataaattcacattatagaattagatttttttgatcccttttccccactgggcatcatggagagctaccaaaaaaggactcttgctctcacatggctatttacttttcaggcttgaaatttttactttattgcattgtgaattctccttgtatattgctgtattaaaaaaaaaaaaaaaaaaacataaaccaaatggtagaatttaaaaacaccgttttataactcccaaatgaaacaactgattcagataccagttagcactaggcaagactgctagataaaagttaccagataaaactaccaagaattctgttgtagaaaccctgcttaggaaaggtggtcgcggcccagagagaagcaggtctgcagagcagcacggatagctgcagggcacagtgaggcctggggagtggggtcggaacagtcatccaagccttgtagatcttgaagatgaaagacaaatgtttatatccattgactttggctacagatactctgacctgccagtgccactctttaggatgtcattctggctaaataaaggcagaagcagtctaaatatacagcactggggaatttaaaatgacatcagtgacatgaagtccatgcagtgattcaccttccaactattaaaaaagaactatgacaaaattttccgacttcaagctatgtctcatggcctattattttatacaaaagaaagaaaagaagagcatttcctgcaaaccaaaactatgatgaagtattacctcacaaagatcagaatggccatcattaaaacatctataaataataaatgttggagaggatgtggagaaaaaggaacactcctacgctgttggtgggagtgaaaattgctgtagccattatgaagaacaatatggaggttccataaaaaactaaaaatagagctacaatatgacccagcataaccacacttgggcttatatctggaaaaatgctaattctgaaagatacatgcaccccagtgttcattgcagcaccgtatacaataggcaagacacagaagcacctgaatgtccatcagcagatgaatggatagagaagatggagtagttatatacaatggaatattagatgaccacgaaaaaagaatgaaataatgtcatttgcagcaacatggatgaacctagagattatcattctaagtgaagtaagccagagaaagacaaatatcattcgatattgcttatacatagaatcaaaaaaatgatataaatgaactaatttacaaaacataaatagacctacaggcatagaaaacaaacttatggttacctaaaaggaaagggaggggaggactaaattaagagtttgggagtaacatatatactctgctgctgctgctgctgctaagtcacttcagtcgggtctgactctgtgcgaccccatagacggcagcccaccaggttcccccgtccctgggattctccaggcaagaacactaga

SEQ ID NO: 64362 - DNA, 2141 bp, Bovine  19866881046365
ggtgagttgggacgagaaggggagccagactttagctaaggactaagaaagcagtatttataagaataccagcatcaaatataagaaacaggagttaatgaaacaaaaatgccacttgcaataataaaatgcatgttgatcttaaccaagcatatgctactatactttccacattcatccaagcctttattttttttaaattaacaagcttttatagtatgttttattttattgaataaaagcatccagtattccattttacgtctttacttttaaagcccattattgcattcaaaccaaaccatcttcccttgtgtgttctgtatttcttggtactgtctttactaacttgccacatgataagggcttccggctattcattattctttttcctaaaccacctttgcacacatgattttcaattagtatcaaaaagctaagactgaggtataatataaaggatagtgatatatgctttttaattctaagctatcctgatatcttctcttttgctgttttcttttctttctattacacttcctttacagtactgccagctttttgcttaaatggagggaaaaagtgatagtttgcccagctattcctcttctgtgccactgcacaaactaccatagggtaagtgcaaggaactttagcaaggaggaaacagatattgaaggaaagttgttattctttagtcgctaagccgtatccgactcttttgccaccccatggactgtagcccatcaggcttctctgtttatgggttttcccagacaagaatactggaatgcattgccatgccctcctccaggggatcttccctacccagggatcaaactcacatcttctgcattggcaggtggattctttagcactgagccaccggcaaggccatgaagggaagttaaacagttctaattctctcatcatcacctcttccagttgttttcagccgtgtagcatagtggaaattccatttgctagtctgccaatttttttaatgtgccctatttttctagatgccagcgagatctgttccagcctgtgatggtgtaccagggcaagatttgcacagcacaatttatgaagttattcaccacatccctgcccaacagcaagatcatccagagtaagtacgaacttgcttttgatgatgctacattgagagggctcaggattcagcccctgctgtccccagagtttactgaaaggttcagaagaaaaaatacattaaaaacagaaattatggctcccgtacatgtggacacactgtcccacctgaaaatagctctaagaaataaaacaggcaaacgtacaagtatcttctggggccaagtacttgggccagtggaccagacccagagctctagaatctaacatttccccaaatgaatccacttcgggagaagaaagaggtcgttaggccagttctcaagccatcttggttatcttgctgattttccagtggctgtagggtttttagaagaggaaatggcaacccactccagtattcctgcctggataatcccatggacagagaatagcaggctacatacagtccatgggggccgcagagagtcagacacgacttcagcgactaagcacacacgtagtggttttagaggcagtatcactacaaagggtgtgttcatgttcagtcgctcagccgtgtccgactctgcgactccgtggactgtagcccaccaggctcctctgtccatggaattttccaggcaagaatactggagtggggtaccatttcaccctccaggggatcttcctgacccagggatcgaacccatgtctcttgcatctcctacattgtcaggcagatcactacaaataggaccaggggtaaaaaaaaaaaaccctgcaaaatgtgcccaacactgtccccatcaaatgcccacctctcacagattcaaagcagtctactctcaagtgaacggaaccaccatgtgaaggactgggctcactccaagaaaagcccggaaactgctcatccagttaacctgggggctggcaccaggcagtcaccttcccttcccataggtggaaaaactaatgccaacagccttttggaataatgaaatgaacttcctttttttgagggctgtaactgccttcaggcataactg

SEQ ID NO: 64363 - DNA, 1659 bp, Bovine  19866881354583
aggagcctgccgtggtacagcccatggggcagcagaaagtcagacacgactgagtacgcacacatagacatatttggaagaatgattccttctagtgcactctctgagttcaggtaggggccagatttgacacccgagacgattattttttacttttaaagacagagcagaagattcctcaacttcacttgattgagaatggactgatgttgaagctgaaactccaatgctttggccacatgatgcgaagagctgactcatttgaaaagaccctggtgctgggaaagattgagggcaggaggagaaggggacaacagaggatgggatggttggatggcatcaccgactcaacggacatgagtttgggtgaactccgcgagttggtgatggacaaggaggcctggcgtgctgcagttcatggggtcgcaaagagtcagacacaattgagcgactgaactgaacgtgcttcccaggtggctcagtaggaaagaacccgcctgccaatgcgggagactctagagactctggttcaatccctgagtcacgaagatcctctgaaggaggaaatggcaacccactcccagtattcttgcctggagaatcccatggacagaggagccttgtggacttcagtctgcaggattgcaaagagttggacatgactgaagcaactgagcatgcacgcatatccctaatgtagaaactgaacagctgatcatcgaatactaacacacacgtttttagctttcaatcacccaacttgaagttaagagaggagcagtggcttggatgggggatgcccttctacactcctatttctatgattctgtttttagagcccatcactgtgaagtttaagaacatgaagaacaagaggtctgttcccaggctgtacctccacggcctgggaatcatatagaactcgaagctcagctctgtcacctaccagcttctgggcaatgtaattaaccttcctgagcctcagtttctttctttggaaatggttgtaatcatcctaccttgcaggcctgttgtaaggactgttttaagaatagatgaaacctgaagaattgattaaaaaccttgttcctagcaggtgctccatcatgatcgtatttaatccgacctcctaaaataacccagaaagctagtggagcccagtggagataagaacacctattgctttacttctaggtcaggcctctttacattacaaaaggctttttgtgagtcttttaacacaataactttgggtctattaagactttacctgactttgcaatgctgctgcctcctcccttgttgagatctactttgtagctcaggagagacttgtaggcacaaattccaggatgtgaagggttattccccacgtgaagattgtgggcagtttattccttcatcctcaactggaaagggtcacgctagaggaaatgggattacatttcaccaggaaggaattagattagaggggaagaagaacttcctgactgatgatttccttccctgcagtctttaaaaatagaatagttccccatttgtcagtgtttaagatgcaggaagttagaatagatagcttctcgagatctttttcaatgttagcattactgctgtcacagggctgtattgctaagaggaatgtacaaatacgaattgacg

SEQ ID NO: 64364 - DNA, 1062 bp, Bovine  19866881391151
ttattattgtaagtattatatacttaagtatatattgtaagtattatatacttcttattgtgtaacttcttagaggctttcaaggacaacttgacagggcctatcaaaccttgaatagactatctttgactcagaaatcccttttgtagaaacctgcccctactaataatcgtactaagtggataaatatgagtgggctatgatttcactatagcatggtttggaataggagcaaattggagacactttacatgtctacgggtaggggaatggttacataattaaggcacatctacattaacaaatattgtgcagctgttgaaagtataaaattacgtgtctctgagatagttgtgtgtgaaagaaacaggctacagaacaatatgatcccagttctgtaaaaataactccctcccttctctctcggtttctctccttcctttttttttttttttttgtaaatgcatagaaaacgccctgatggatacacatcaaactattatcagtggttaccacctggagagaggtgggtggagagacggcaagtgagaactttcatctttttaaagcgagaaaatgcagaaaggaaaacagtcaaggaagacaaaatgatattaggttagccattaaacaaagtcaagggctattgataatgttctaagccataccctttgagctgttttgcagatactgaaacccccaccaggtggaagaagttactaccacatgtaaaatagcgggaggcagggagctcagctaagtgctctgtgatgacctagggggtggaatgggggttgacgggtggaagggaggctccagaggaaggggatatttgtatgctgctgctgctgctaagttgcttcagtcgtgtccaactcttagcgaccccatggactgcagcccaccaggctgctccgtccatgggactctccaggcaagaacactggagtgggttgccattttccttctccaatgcatgaaaatggaaagtgaaagtgaagtcgctcagtcgtgtccgactcttagcgaccccatggactgcagcccaccaggctcctccat

SEQ ID NO: 64365 - DNA, 3113 bp, Bovine  19866880348299
tttttctggaactctcttgcttttctgatgatccacagatgttgacaatttgatctctggttcctctgccttttctaaatccagcttgaacatctggaagttcacggttcatgtactgttgaagcctggcttggagaattttgagcattacttcactagcgtgtgagatgagtgcaattgtgtggtagtttgagcattctttgacattgcctttctttgggattggaatgaaaactgaccttttccagtcctgtggccactgctgagttttccaaatttgctggcatattgagttaaatttctttttcagagcactgcctagctaatataagtaaggtattgatcaacagaactctacaccactgacaccatagattgtttccttaggtttgaaagcacaaaaaaagaattgtactttaaatacaaaaaaagggggggggaaatgtcttttttctttgtttgagtcattttcaaattcatttattcagagtgcccttcagttaagagcttgatgtaacaatgagactgatgaaaggaacgaaagaagaaatctatgcattcaaatgagtattatcattcaagaatgttatctggcaattatacatttattcttcagtaactccattctcaattattttgggagcatttccattgggaactatcttttctgtggttctgtttggcaagaggtgcacaagttagaacatcactgatacatatgtatcacctgccatgataaagatgttggcttggaagggaattttcagttaagtctttaccttatggatgagaaaacagagattcagaaaatctgaatctcttgacagagacacttgacagagtcacagagctttcattcacttaaaagtcaatgagagaatgagaaaaagtatttgaatcaccacttcactgaattattcaacatatgtaactctttcttattggattccctcattcattcattctacaaatatttactgagtgcctagtatgtgcccatcactgctgaggatgttgcagtgaacaaaacagacaaagaactgcacatcttcatggagttcacactccaaggattcaataaaatttaaatccctgattcccttttccattgaaaggtcgctattttaacaattctaagaaaccacttgattagcatcaaagatgttgaacaaatgctctgttgacataatttgatgagtgtaggaattacaaatatgagtcaacttcactgattacaaagacagaagaaagtagtgtacaatcaacttttttagaaaagaattaaaccccatgaaaaaacaatgttccaacatgacatccagattcaccagccatgtctcctgaaacagaggagaagactgttaggaataagagaaaagaaaactaagcatttttaaaggctttctatatagggtaagaaaacatgaaacttttggcaagcatgaaacttttggcagctcgcagaatgaaaccactcgctgcctgcaagtgtttatcccacagctgttggaaatgaaggatgtcaaaatacacaaaagtaagactccaggcacagatatcaaagaagcaaaattccagggcatgcctggaatcaaagtggacaatagatgggactcacgaggagacacaggaacgagaggccttggaccatgaagaccagcggatcttgatatcacaaccagaatgcggccctgtgttcatctctcctgtaccatcacggaaaactatccagaccttcagaaatccattttaataggataccaggatacaagaagggcttcccaggtgccacagtgggaaagaacccacttgccaatgcaggagactcaagagacagggggttgatctctgggtcgggaagatcccctggagaaggaaatggcaacccattattcttgcctggaaaatcctacagacagagaagccaagcaggctacagtctaggggattgcaaagagtcgggcatgactaagcatgcgcacacgcacggaaggatacaaggccggtggctgttagttcattctgtacagggtgcacttatttactcagtggtgagatcatgaaaacttggtcagtacttccttttttctttccgtgttttcttctttttaaatgaaatatcatatttactgcaccaatagaaattgttattcttaaaagccaaacgatgatcttattttgggctttcctgatggctcagcaggtaaagaatccacctgtaatgcaggagacacaggtttgatccctgggttgggaagatcccttggaggaggaaattgcaatccactccagtattcttgcctgaaaaatcccatggacagaggagcttggtggactacagtccaaagggtcccaaagagtcggacacggctgagtaactaagcacaagcacagatccttttttttttttttttttctgggagacacacactgcctgctgtaccctgtccaccgcccccagccctcagccccaggtgctctgctactggaaaaggtcagagcagccatgtgggggacatagagaataccctgccctggccaactgactacaggtgcctgaccattctcggcacccagaaagctcccaagcctgggagcacctcagcaggcaccccgcccctcgtggttccatgggttaacatctaggatggtccctcggggaacaagggttatgctatgctatgctaagtcacttcagtcgtgtccgactctgtgcgaccccatagacagcagcccaccaggctcccccgtccctgggattcttcaggcaagaacactggagtgggttgccattgccttctccaatgcatgaaagtgaaaagtgaaagtgaagtcgctcagtcgtgtctgactcttatcgaccccatggactgcagcctactaggctcctccatccatgggattttccaggcaagagtactagagtggggtgccattgccttctccgacaggatcctattttataaagaaaaacatttgtgtttggagaaactaaaacatttgtattttgagaagtcaacgttctaaaagttcctacattcctctttggtttaagtgagaatatcacattcaagtcacaaagaagcggctcattcactaacagggtaaaaaga

SEQ ID NO: 64366 - DNA, 2885 bp, Bovine  19866880374663
ataagagtagcttgatttgattacttcaatttggttcttgctatagaattaaaggtaaagccaagcttttggaagttttacaggataataaccaaagcaggaatagtaaattaagacgaactctggtttcaacctgcacatctttattacttctaatgaacagggagatgtatacaggctcggagagtaaaacccattgataatctccttagcattctggataatttatcagtttctttcccacactgaggactctaagcccgtctaatattcgttaaggtttcttggcagcttctccataaaagaagcgattttctttctcataaaagcaatgtagttttgttcacttgcttcccaaaatgctgatcgacatttccagtagcacttggccattttgagtcacagaagcatttctttaaaaatgatgttatactcacagaagagtggacttcccaggtggcactagtggtaaagaacctgcctgccaatgcaggagacggaagagaagcaagttctatccctggattgggaagatcccctggaggagggcatggcaacccactgcagtattcttgcctggagaattccatggacagaggagcttggagggctatagtccacagggtcgcaaagagttggacacgactgaagcgacttagcatgcaggaatgcacaaaagatttgcaaaaatagtccagagggtcctgtatgcttcatactcagtttccctttagcatttgacataatcttagaacgattatcaaaatttaaaaaattaatctccgcatgatattattctctaaggtacagaacttatcatatcatctgtttttcacttacgtccttcttcagtcccaaggtctggttcagggtaccacgttacatttaatcatcgtgtcttcctagccttctccaatctatggtagttccatactctttccttgatttcgtgacctcaacccttttgaagagtaccagtcagtcattttatagaatgcccctattttagtctgggcggctctaacaaagtaccataaattgggtggtttacacaacagacctctatttctcacacagatctggaggctagaagttcttggtgaggacccacttctggttaaaagtcacccaccttcctcttatatcctcatatgttgagagggatatcatctctttcatagcccttcttagagggcaccaatctcatgagggcaccaccctcatgacctaatcacctcaaaggtcccacctccaaatgccatcacatggggggctagggcttcgatgtatcaccgtcagttcagttcagtcactcagttgtgtctgactctttgcaactctatggactgcagcacgccaggcctccctgtccatcaccaactcctggagtttgctcaaactcatgtccattgagtcagtgatgccatccaaccatctcatcctttgccgtccccttcttatacagccttcaatctttcccagcatcagggtcttttccagtgagtcagttcttcacatcaggtggacaaagtattggagttttagctttagcatcagtccttccaatgaatattcagggctgatttcctttaaggatggactggttggatgtccttgcagtccatgggactctcaagtgtcttctccaacaccacagttcaacagcatcaattcttcagtgctcagctttctttatagtccaactctcacatccatacatgacaactggaaaaaccatagctctgactagatggacctttgttggcaaagtaatgtctctgctttttaatatgctatgtaggttggtcataacttttcttccaaggagcaagcgtcttttaatttcatggctgcagttaccatctgcagtgattttggagccaagaaaaataaagtcagccactgtttccactgtttccccatctacatcaacatcagggagacacaaacattcaatccgtagcatgcctccatttgagtttgtatgatgtgctctcatgattagattggggttacgcataattgggagggaaactcacggtgactgatgtgtccttctcagcttgccgtgtccacccagatgacctggctaaggtgctatctgtcaggttcttcactgtaaacttacgacttcttcctttgtgattattaaatactttgagactatgtaaataacccatttctgcttaaacattcacagcagtgctttctgtcctccaaagcaataaactcagctaaatgtcaaaatgatgccagtgggaactttgggctctgtggagggcacaggagcctcatagctattcactcctcctggaaacccaacattccaggaaagggctaattgagttcatgacttcctccaccagttgtctggtaactggacactgtgatttggggttttctgagctaggagtggaaacttgcttcctattgtagcatgacttagttttctccccagagtcacagctgtgtttgatgtgacttaagaataaaatatgattaaataatacaaatgaacttatttacaaaacagaagcagactcacagacttagagaacgaacttctgcttggctgggaaaggatgggaggaagggataattagggagtttgggatagacatgtacacactgctgtatttaaaatggaaaaccaacaagtacctactgtatggcatagggaactctgctctatgttatgtggcagcctgcatgggaggtgagtttgggggagaatggatacatgtaaatgtatggttgagtccctttgctgttcacctgaaactatcataacattgttaactggatgaactataatataaaataaaaagaacttaagaaaataataacatacaatttccaggggagggaaagatgtagcctaagta

SEQ ID NO: 64367 - DNA, 1454 bp, Bovine  19866880576851
aaaataatagacacacatatatatgcatgacagaatcactttgctgtgcacttgaaacactgtaaatcaactatgcttcaatttttaaaaaagaatgtcccctctaaatgcccactgacagatgaatgggtaaaaagatgtggtgcacatatacaatggaatattggtggcggtggtttaatcactaagtcgtgaccgactcttgcgacagcatggactgtagcctgccaggctcctctgtccatgggatttctgacaaaaacactggagtgggttcccatttctctcttcaggggaatcttccagacccaggggttgaacctgtgtctcctgcattggcaggtggattctttactgccaagccacctgggacgccggggaagcgggtgagacccggcggggaaaactctggacccctttgcaggcccacagagaggactctggctgcatgaaagcacctgcctccttctgaaaaaggattaggtgcgacaaagtgcttgagccctcagctcttttgaaaagaaactcagtcttaagtgttaagctcggattctgggaaaccaggcccatggcctccgcagctgctcacagctcccgcgggtggatttgcactggcccttggggtgggggtgggggcagaccagatgttttaaggggattagtggctgaaagaaaagtccagtcttcctgtgtgtcacccactgttcaggggcaatttttccatctagtgccaccagaattggagggaatggaaagcaatagtttgcaactcctgattgcatccaataccccaagcaccaagtgtcctatctgattaaccctcatgaagaccacattacctctgttaacagctgaattgtgtcccccaaattcctgggttgaaatcctaaccctccaggacctcagaatgtgactgtatttggacatagggcctttaaagatgtaattaagctaagatgaggtcattagggtgggtccctaatccactgtggctggtgtccttgtagggaagggaattaggacaaggacgtacgcagaagtaagacgacaggacacgaggaacaggcaggcggctataagccaaggcgagaggcctcggaagaagccagccctgcagacaccttcatcttggacttctagctttcaggactgtggggcaatgaatttctgtggtttaagtcattcagtcggacagatgattctaatgcatagtgtagtttgagaatcagttcagtagagaaagtgctcacagggcacatctcctgatggagaacgattttcatatgtgaaacatcatttatgtgaagtcacttgacagccctgtccctcctccatgactggtatggtctggagtctgtgaagggacatcaggaactcaagagggcctctgctggccttcagagcctcctgccagagtcaggttcatctcatcacaggggcagagccaccacagg

SEQ ID NO: 64368 - DNA, 1148 bp, Bovine  19866880668221
acactgaaggaaaggaaaccttccctttttcaagcagtgatttttgctgcttgaaatggggttgtactctccactttcaaacgaaaatgctgacattgttttccagaacaattgcaccatccagaccaagggacccacaaaagtgtcaattcactgcatgttagctttttctttttttttaatatatgaaactaatcataacaagtggttgctgtgaaaacagcaggctccctaaggctgcccttccaatgacccataccctgacctggacagaccaccttctttccaagagaggagaagttttgttcctagatcagatgaaactctggctttacccctggtgaccaggaggattaatcagacgccagtaaaacagccgacagacacactaaaccaacagacaataatgagcacacacaccaggaaacgtccgtccaagaggtccacttgatccttgtctttgccttaagatgtaatacctgctccgtggcttggctctccgtactccataaagggaacacttgtaagctgagaagctgccagtttttaggatcaatatggtactcacaagagctggttaggaaacaatgccagggacagaatttgcagtgggggcttgtgagggattaggctgtttcctcaagatttacgtcccagtgcacagccggtgctgaaacctgcacggcccaccctgtggctccagatgaggtgaatggaggtctctttgggttttggttttttcaaagtaaaatcttcccagtgtgcaaacaggaaccactaacactgaaccacatgcagatgcagagaaaaagtgaaagtcagcaaaaggaaaacaaatttctgacattttacttgggaggttcctgtaagagtctcggagaagctgtcaggcttgggatatctgcagcagtgtaagggtcagaacttaaatttcaaagccaatttcttcttcgccttcctgccttcttcactcagcaactgtttgggttctgttttcacttttcttctttcattctgttctctagggcaaagcagaaagcaaatgaaatctcatttgtgctgagaacttacatcaaattggttttatttccaagtgattcccctccaattttattttaaaacatgtttaaaagaaacttagattttat

SEQ ID NO: 64369 - DNA, 930 bp, Bovine  19866880882851
ggcctctaagtaaactcgactgccattcaaaagatttgctctgacacttaacaagtggtgcgggaagaaaggaaaatctgttgtcaggtttggggtgtttatcagcccccctcgagacacttgacctaatgctttgccccccctaatccgctgatctgcatgccacggctttgcgagcctcagcccccaactgccgggccaaattgcctgcaacgcttgtcccagcatccagccccctgggtacattgtgtgcggctcacctactccgcgcctcccctcccagcccccctctcgcgggtccccttaaatttaattctgctcacaaattgtgaaataagttgtttgggctggatttgtcgagtgaattgtcccactaatgaaacagtctgttcattatacagtcgtaggacggaagatttagcgctcccataccccgggacccgggcaggttaccgtttttagacggacagttgacaaaagaatgaatagctctctcctgtcaaatcaggcttacaaacagcttggcatacaaacagttactacttgtatgcatgcggatttagggtccccacctgctaatgccccagatttgtaagtacaaattggttagtcttcaaactgtttgcaaaaggaagaaaatgaccaaaaattagtttgttttagccttttcccctcccctcccctccctgctcctgcaagtgaaacattaaaaaagagagagagacagacagaagaaaaggataaaatagtatgtaatagtctcgtggaatattgttggctttttttacttaaggcatcgaatgaagctggatcattgtttggtaggaaatatttttgtgctgctcaggcatcctgcttctcagcaagcagctgaaaatctaatagaattaattgaagacctgtgatgttaaaagatggaggggaggagat

SEQ ID NO: 64370 - DNA, 1581 bp, Bovine  19866880487197
tctctaggtcggaagattcccctggaggaggaaatggcaacctacttcagtattcttgcctggaaaattccatggacagagaagcctggcaggctacagtccatggggtcacaaagagttggacatgactaacactttcattaagacttagtttcctcaaacataaaatgagaataatatcaggagatggtggtgagattaaatggttcttgctttcagccttaaccaccctagcaacagataacatggctccatttttggactcatgcaaatttttagatcttgtatgatattggtcaagactttagaagcactaagaagtaaaaagcttatcgtttttcctgtatgtacttatttatgcaactccatgtgagatattcagtgttctttcttctccctgtatattaccatttcctttcccacatttgagccatttgtgcgggtccaggtagagcagagaggaagaagagggaagcagaagcaaccgaaaaaatcttttttaggagcctacgtcttaagagacttgagttaatttccagagaggctaaaaggggacactttggccagagccgtagggagagagcccagaaccaggaggagggtcccccggcctgaagaatggcagacgccccgggagacagcagaagcctggcagggcagcaaaggagatggtttggggataccctttggctgtgacagtgaccatgaggaggtaccaggaaaacatcagacttaaagaatggggacctgtggatggggcaagtgcctatgtcagaagtgatatgggaattgtttcatgaggaccaaaataccatcctcctactatgcattattgcactaagatctcagaaataagatgtaattcctcgaagaagtgatatttttcgccatgagcctgatggaaaaggggctccgaaatgagacacgtttataaaaaacaaagctctgtgtctcccccggccccttaggagtctgggcgctgaaagaagacccagcctgtggatctgatgcctggagccccgagggggacgggctgcgcatgctctctgcgcactggcagcttggcgcttagcctctgcgcatgctctctgagtcccgcccgccccttgcctctgcgcctctgcacctagtgctgccgtctccccaggccccctctgttctgtgattacttcccttccttggctttctctgcggggtggagcctcgttttatgacccctgtaaaacgctaggagctgttgacttcttcctctgggtttctgagatacctgcagcagctgggaagagagcagtgaggaaggaaagagcaggccaaccttcccaggttcccccagcccctcaccccagccctcagcagggagatgtggcctgatcccaagacttggcaaggcagccacacacatttgcagagtgacaaaaggagaggaggggcctaagaggaaaacagctttcacatgtgtaaatgcctggaaaagttttttggattcattattctactctgggtgattttcaagagcaacagagcttggggcctaagattccaggaggtgactcaagtggcccagcagatacgcagatgctt

SEQ ID NO: 64371 - DNA, 873 bp, Bovine  19866880842154
gaaaacaatgattattggcaaataactctccccatgtttcttaacagtctagaaagatcataatgagtcactttctacatcgatgttcccaaattgcttagtgccatatccaggcacactgattaaagtatgggaaaatggaatggctgcatctagttcctgattcttaccaaaagcagcacatttcagacacgtgacatttcatttcatccttacagtctcaatttcagcaggtactaatgactgtttttaccatttatttcactttgacaatgtccttgtttcaaccttgatattacttaataaaaaagaaacctgtcagctgagctaaaaagctgattaaaaatgcacctaatttgcctgaactcgttaataaagaacacaggaaaaggcacttattatcttcagtttacacaaatactactcaggccaatatttaagacacaccaacatctcccaaagtgttgtctagatagaaagtcattaaaactccaactgtagaaagattttttcatccttaagaatgttttttattaagtagaagaatgaaaggaaatctttaaaagacaataataaatatgtcaagctgtaattcacacacttacttatcatcagcaaggcttgcaacgtgcagtccatcatgactaaatgatacagatcgtacccatctgtcatttgctcctccagcaaatattggagtgggtgggggaaacaggtgcctgaagtaaaagacatgttttagggcaagtgagagtcacctcaagaaacaaaactaccttgtacatcagtctttgaatagtttagagtggccttcatgaacacaattgagaagacggagcagatccactttaaataagtacttaaacctaatta

SEQ ID NO: 64372 - DNA, 1406 bp, Bovine  19866880878988
caagagtactggagtggggtgccattgccttctcctaggcaactgctaatctgcttcctgtcttcatgaatttgtctattctgaacatttcatataaatggaatcctgtaatatgcagttttatgatgtcttcaaggttcacctatattgcagcatgaatcactactttattggaggtggccctgcaacaaaagaagccaccacaatgagaagaccttgcaccgcaccaaagacccagagcagccaaaaattaccaaaactaaacaaaacaaaacaaaaacaaggggtactgatgagaagggagattgggaattatggtagcttcgtggaggagacgatgtttaagttgatcttgaagaataagtatgagcctgtcaggtcatagaagaagagctaatagtatgtgcaagatcatagaggcataacagagcagagtgacctcctcccatgcctttagagtgaatggctttgggaggtgaatccataaattcctgtaaaggaattccagcacacctttaggttcagagtggatgtgttgagcaaaaggacagggctagggaagagagttcacccccaaggcaggatggggctgtctaagagttcagccttattccttagttctgaaggcacgcacgggactggatccagcccacacacaaacctttagaaggagcatcattctacctcctgtcaaaaagccagggagagggactgtaactgaagagagggtggttatggcaccaaaaagggggttggtgagggtgggagggagggagggaactcagacgacacacggacacacggtatttgttccacactcctgtttgtccttccagcttgcctagtggctacagacttgtaatgagtaactaaatcagtgatgtcaaagcttaactcttggtgtaaaacaggtactcctcttcagtcctaagtgccaaaacacatcccattgcccctggacccttgaccctctgtaagcttccaggcggccaatcagatttttccagaagttccaggcgaaccgccagctggtcgtgaattgaacccctgcgcccatttccgaattcgacctgctggcctaggtgtgcattgcagtgtcagagtctggtgtgttggtcaagaagccttctgctgtaagtcactaagagctcaactcaaaatggcttaaacaataacaaaaagtatattcacagaagaaggattttggaggtcaggtggtgtcagaattggtgaacttaacagcaaaattgggtcatcaagggcctcagctcttgccactcatcctcaatgtactggcctctcccctgtcaatgtaataggtcagctccccttatggtcctgatagggctgctgcagctccatgcttcacactacagacatcatgactgctgctgctgctgctaagt

SEQ ID NO: 64373 - DNA, 2138 bp, Bovine  19866880051355
gactctgatgctgagagggattgggggcaggaggagaaggggatgacagaggatgagatggctggatggcatcactgactcgatggacatgagtctgagtgaactccgggagttggtgatggacagggaggcctggcgtgctgcgattcatggggtcgcaaagagtcggacacgacttagcgacttaactgaactgaactgaactgaatgaggccatactatgtaagtcaaccagacctccagagagtaaggcaactgctagatcaagaaaaagacatctttaatgcttgagggttttatgttcttagtagactggatggctatagtctcacttgaaaaaatatgtgtgaacttctctgaaaaacaaaatgctttaccactatttttgtcttgataaactgtcgacccacctcccaccttcatccttaggcaacggctcctcttcaccattattattttagtgcagtgaccaatatgtgtgccatctgcaactttgtggatgagttgaggcacgaaaagaatagcagaccatttctcttcattgtgtagaagaaatatagctctggtcagcatttgatacatgattatttgtttctctccattctccctgcaaataagtagtcaagatagaaatgctaattttttggagatgatgtttatcaatattattttgaaaacatgaaatggcaccctcccacagtggaaagaaggcagtaagtagattgattcattgagatacttaaaatcctcttggtgtgggggtgttagttgcttaatcatgtccgactctttgcaaccccatagactgtagcccaccaggcccctccatccatggaattttccaggcaagagtagtggagtgggttgccatttccttctccacctcgtggtgtaactaagtacaaaatgtggaatccaaatgtaaagacaaagagaagatgttatattgcttttaggaatcagagtttcaacattccatgtgctgataatttttttaaataaatagattatttatctccagtaacaagagctaatcaaaagtaagatagtatagaagatcgcttcctcttagctcttgaggccctctagttctttaaattgtcatatagtgacataaaaggctaaaatgtctccaccaaaagctattagttaaacagcccttagcagacctgttgcctcccttggccctgaagcacagaaattaagttctgcaactgaagacaatttgcattaagagtaaacagaaataggagagagagtatgaaggaggtatatagtagaggacaaaaagtaagaatcatactcaattgatgttcccatccaataaagggaacagagtactgtatcaggtcctctgagagatatagaaatgcaaaggcatttggaaagaaagagaacaagggggcctagatctctgatagtgaaacagagaagagtctacaggttcttgcagagggactcacaagagaagaggagagtggaaaattctaagagaatgaggttaccagactgcaaagtatacccccaaagacattcataaacattcatatacacatgaatgtgggcttctctggtggctcagtggtaaagaaacacctgcaatgcaggaaatacaggagattcaggtttgatccctgggttgggaagatcccctggaggaggacatggcaagccattccagtattcttgctgggaatatcccatggacagagaatcctggcaggctacagtccatgcagttgcagagttggacacaattgaagtgactgagcatgcacacatgagcatgtaggtacctcctcaccactcacacacacacacacacacatatacatatacacaataacagattcctgggggaaaaagaatctgatggcaattttgaactccagctgctcacacttagcatagagttattttcagggtggccaaatcctgtaaccagtactgattcccacttggacatttggagatctggaaatcagtggtgacaagataatctatagcattgaccaggaaagggtatcctgtgactagggcaacaaatagaagaaagagcctgctttaaactctgaggtttctacatatctttgtggtgctctgtttgtgtctggaatgtgggagagtaggaagataaa

SEQ ID NO: 64374 - DNA, 2166 bp, Bovine  19866880103324
gtcgtcccagtgcaccagccccaagcatccagtatcgtgcatcgaacctggactggcaactcgtttcatacatgatattttacatgtatcaatgccattctctcaaatcttcccaccctctccctctcccacagagtccataagactgttctatacatcagtgtctcttttgctgtctcgtacacaggttattgttaccatctttctaaattccatatatatgcgttagtatactgtattggtgtttttccttctggcttacttcactctgtataataggctccagtttcatccacctcattagaactgattcaaatgtattctttttaatggctgagtaatactccattgtgtatatgtaccatagctttcttatccattcatctgctgatggacatctacgttgcttccatgtcctggctattataaacagtgctgcgatgaacattggggtacacgtgtctctttcccttctggtttcctcagtgtgtatgcccagcagtgggattgctggatcataaggcagttctattttcagttttgagaggcaatagcctttacagctgcatctcagacatgcaaagggttctaatcatttactcttgtagaagactggcctatcctgagagatgtcttaggctcttatgaaggacccatatatctgttcatctttgagcgcacatttcacatttctgtttttctgtccagaacaatgctgtccttacttgcctgttgtgtcttaactgttttcattgccatgtaaatatttcatgatttggaatatcgccacttgcaatcatgtcatctttaagaaatttgagcatgctacaagtacacattatcttcagttgtgatgagttgattaattactggatactagttagccaaagatagaagtcatttttatgctattaatcatttttcccacaaactctatagtagttgtcaaaaaggaaaattatataaacattgtatccattaatatcatcttagtttttgaagaatgtctcatgattcttcaaggatgacatactataatttaagaacaatttagatctattaatgtctagcttttaaaaaggaagtagatgtagcgtgtgcaactcaaaaggaaatcattttgacattagtagggagatctatataagatttgagtatttttggatcagaagataatctacttagatatgtgccttgtattatataaataatctaaggcaggagagaagagtctgtgtaggctggaatctatgagctagaatagagccaggtttttagccttattacccttgggcttctgttatccttgggcttctcttgtggctcagctggtaaagaatccgcctgcaatgcagaagacctgggtttaatccctgggttgggagaccccctggagaagggaaaggctactcactccagtattctggcctggagaattgcatggactgtatagtccatgcgggtcacaaagagttggatatgatgaagtgactttcagtttgattacccttacgtcaatcttgtacagcttaatattgcatgatttagctatcttttgtgaagtaggaaaatgaattacatttattcaccagccactatgggatggccatcatgagtcacaaactaggtgaggcattgaggacataaatataaataagataaattcatacccttcaggagcacagatgacaaatgaaggtcgacagggttctaaacattgtaaaggcaaagggcagccctggaagccagtccagactccttctccaatcagatcagttgctcagtcatgtctgcctctttgcaaccccatgaattgcagcatgccaggcctccctgtccatcaccaactcctggagttcactgagactcacgcccattgagtcagttatgccatccagccatctcatcctctgtcatccccttctcctcctgcccccaatccctcccagcatcagagtcttttccaatgagtcaactcttcgcatgaggtggccaaagtactggagtttcagctttagcatcattccttccaaagaaatcccagggctgatcttcagaatggactggttggatctccttgcagtccaagggactctcaagagttttctccaacaccacagttcaaaagcatcaattcttcggcgctcagccttcttcacagtccaa

SEQ ID NO: 64375 - DNA, 4873 bp, Bovine  19866880476194
tgatgggaccggatgcctgatctcagtttcctgaatgttgagctttaagccactttttcactctcctctttcactttcatcaagaggcttttgagttcctcttcactttctgccataagggtggtattatctgcctgtctgaagttgttgatatttctcccagcaatcttgatttcagcttgtgcttcttccacgctgagctggaagctgagctcagcgtttctcatgatgtactctgcataaaagttaaataagcagggtgacaatatccagacttgatatactccttttcctgtttggaaccaatctgttgttccaggtccagttctaactgttgcttcctgacctgcatacacgtttctcaggaggtaggtcaggtggtctggtattcccatctctttcagaattttccacagtttattgtgatccacacagtcaaaggcttttgcatagtcaataaagcagaaatagatgtttttctggaactctcttgctcttttgatgatccaacgaatgttggcaatttgacctctggttcctctgccttttctaaaaccagcttgaacatctggaagttcatggttcacaaactgctaaagcctggcttggagaattttgagcattactttactagcatgtgagatgagtgcaattgtgcggtagtttgagcattctttggcattgcctttctttgggattggaatgaaaactgaccttttccagtcctgtggccactgctgagtttatttttaggaaaaaaaaaaaatcattggacttccctagccaccctagtggctcagtggtaaagaagccatctctcaatgcaggagatgcaggttcagtccttgggttgggaagattccctggaggaggaaatcacaacccacggtattctttcttacttgggaaacctatggacagaggagcctggtgggctacagtctatggtgtcacaaagagtaggacatgactgagcaactaaacaacaacaacaaacactcagtaggtgtcaaggtgctcccagggctgttccacgactgctaaaacagtcacagactatcagagggctaaagggatacgttcatcactcctccaaaaatatccaaacacttgaatccaagagacttaagaataagctcagacacctctccatctattaactttcccatactttcaaaaatagaaaaggtatttaaatcaagtgcctaaagaagtcctagttagcctatattccttgaggtagaagatggtggtcaataatttgcaagcctgggttttactcttttagctccggatttgaaaagtcactaaggtaaagtaagttaagtgagtgtggtggacacagtttaagatgatggcccacagaagacccttatccttaaatgattccttccccctgtatgaagtgggacaccacctccatgatatgttctacaaagagattttgtagctatcatttagcttactcatcagctgacttggttatattaaaaggagattttttccaagtaggcataacctaatcatttgatttctttaagaacaaagcattgtctctgtcccttaacagaagagaaaggcagagagattcaagacaagaaaggaattcaacatgacggaggttccccattaatgagagggagggcttggggcaaggacctgagaatggcctctgggagctgagagtaaatgctggccaacatccagcaacttggacttcagtcctacagttgcaggaaactggattccttgaacatgaactgacttggaagcagatttttcctcagagcttccgatccatcccggcgtaccttggtttcagccttaggtgatcctgagcagagaactcagttaagaccacttagacttctagtttgaggaactatgagataataaacagacttgtttaaactgataaataaatggcgatttgttacacagcaggagaaaatggacgcagcaaaccaattcaagtggcagatgaagacaacaggaaaatcaaatttttctttccttccataagctattcagttgtctcaggaaaggtgcagctatgttgactaacatgaggcccaacatgccccaagccatcctttttgtgacatggacagtgtccactgctaactcatgaatgccattgtcttcaaaactttatatttcaactatcacaactgccatttggtgctgataccatcattatcttcattttctaaatgaggatattgagatttaggatcattaaacaacctgtcagagatcacagtgagaaatgggggctgggaggggacagaatttaaggatggaaaaccaggcagtctaacctggagtgtacataaccaactatctagaagacctctggagaactttgattaaagctgtcagaacttctcctgtctcagtccatgatggcttgacaatatcagatagacatggcacatgtctctgacctaaaagcagaaccataagtgaagaacattattggaccttatacaccagagtcagggactggattttacatattcttctctgtgtgtacacaagagggacagatgtatgtttagatgtttcgggatggggcaaacaccaggcaaaacagtgaaagtgtcattctgccacactatgtctatccacattaagtactttaacttaatgaatggacgtggccttgccattgtgaaagatacaccaaatactgaagctacactcaagcgtagaacaggtctcagcggttaaaaatagtctccagattttcagaaagttctccaaagtgtgtcaggataaatagtaagaaatgatcaggcccacaaatgagtctgccattcattttggcagtaccagaaaatgtacacccacaaacgggattgataggataagtaacttagaaatattagacagatttaaaaagaaggaaacagtaatgctgatgatgatattaaacatttgaacattgtttagacattgattcataaaaacccagacaatggttatgaatggatgcactcaaataaatactatttctttttttaaaaagtcacatattcacagagtcagctggttactatggaatcacatatgatgtcataaatttgacattctaaatgcaaacctaaactgagcaacagaaacaacaggaaatggagctggggagaagaaaacctacataacaacaaaagaatatcagtagttagagaaatgagtcaaacatctctgaaacagaaaaagaaggtcagtgaattgaatgtcctagaatcttgccaaaggactgaggaaacatagatgtcagcccatccttttctcgggggcaatgctttgcagcaatcaaatttcagaggatgaccacacatagaaacaaaaggagaggtaaagaatatggagagtggaggaaaaggagctgaaagcatgtggtgtaagtccatccaataatcagcattcattgagcagatgctcatacgcaagtggtaagaggtgaaacacagttgctatctttgaagaatgcacagcctagtaggaaagagaatacataaacaaagttcaatttggcgctcagtaaaagtgtgtacacaagacacaggcaacacggaggaatgtttaacactgggaacttctcccaggtcatgctgagcttagctctgaagaacactgaggggaaaaggaggttttaagaaaataagggtggtatacagacaaatacaagtcatttggcataaatagaacagagataagatgtagagtggagggtatacaagttacaggtagacaggatacagcatgagtctgtctctctaaccaagcgaatgaagaatgcacctgaaaataaagcatcagtagatttatattttataaatatcataaataaatcgagtagatagacctagaagttgagaggatttgaggccataaaatctggttaaaagctgtattttaagattacatgtccataatgatctaaaggcctagaacaaggcaatggtaaaagaaatggagaagagggactggattcaaatatcttttggagttagaagtggtgggattttatggtggtggtggtggtgtgtgtgtgtttgggggcacggtgacaaaaagattttaggattagttctaggaatgcacagctatgccattctcttcagacacagactcaatcactcaactcgagatttttcgtgagtgcaagacacagagcataaagagattaacagactgcccttgaaaacctcaacttatgctggaagttgagctccttaaacagataaataatattaatcttgactgcattatagttactgaattggcaggaagcaatagaaatactggtccaggaaaatagtatttcctgcaattgaaaatgaaaaaaaaaattgaatagatgtccatgaaataagttatcatcttgtgttttcctgcatggccttccctattagtttattgataagaaacctcttttcactcttgatgctatgaatagttagataatacggatagaatacatgcctattgattgatttctataggattaaggtctttgattttaaaaatctattattgatgaggctcagatctacagaaaattggtttatggaaaaaaaaaaaaaaaaaagagagagaagtttcaattctacatggcaaatgaaaaagttccataagaagcaaccttctgagtaatggggaaaaaaatgttctgtgtaagcaactccacacttaattctaagtgctactgacctccgggaaattatcccaaagcatttcccccgttatcatttttcaaatgataaatgcatcatgtttcgaaatctattgggctttcttggggctcagtcggtaaagaatccatctgaaatgcaggagaatgtcctgtaaagcaagagacccaggt

SEQ ID NO: 64376 - DNA, 1184 bp, Bovine  19866880494414
gatgagggaaagccccttacattaagtaaggaatgaaaagacttcccttttgacagtctaaattttaggactttaatctggagggatgcagaaggatatgatcaaactgcagaactctaactgtatagatctcctaagttggggaccctttgaagcttgaaagcttttcatataggaaaaaagaactgtgaattctaaaatcataatagaggtcaaaggtgcttgttgggtctacctcctgttagtctccttttctgttattgtgagacttggtatatctgattcatggtggtgtttctggtatttgtataactgtaatttttgtcttaatgttctttgatttattcatgatgttctctccagtcttaatttgtatccctgatgctctctatttcttggcccagttgtaaggaaacaacttgaagttgctccatctgcatggtgccttttacctttagaaaaccagagtaaagcaatcctgacttacccctgggagtgaacagtgctgacctgtcttctgctgtagttccactcttgagctcacattggttgtctcactttggtttaaaaatctcaattagaaaagcagtctagcttaccagttaagaatagggccactgtgtcaatctcatcttcagatttttgtttgccactgaggaaccctgtaataccggacatatcacctaactttagtgctttcgtttgcttatagaattgttaagagtagatgatgataacatgaaaagcacaagtcaggcacctcataagcattcaagttgtcatcgtctttttttctctcagttgttgaaaactcatagaggcattttttagaattttagtagtttgtgggaatttttctttttttttaatttcattttaggcacgtttaaggcctgtgttcctaattctgccgttctctttttgccatttgaaggaagagccctagactggatgtgttgatcaataatgcttggggtcttccagtgcccttatatgaagactgaagatggatttgagatgcagtttggcgtgaaccatctgggacacttcctactcaccaaccttctccttggactcctcaaaagttcagctcccagcagaattgtggtcgtttcctctaaactttacaaatatggagacatcaactttgaagacttgaacagtgaacagagctataataaaag

SEQ ID NO: 64377 - DNA, 1707 bp, Bovine  19866880621702
ccccaaggaaactggaacagatcttaaacatctaggagtcatggagtgggaggcctttcactccccagaattatgccagttataggcaggggccagttgccatgccaagcaaaatggatactcttgatatcattgagctagtcagtaccaagttaatggaactgctttgaaacctgtgaactggacccctgaccacatccatggagggcttctacatgacagctccactcaagatacaccccaatgggcccatgcaacagtgttccagaatgctttcaatgactgaaaactaactagttgagtcttatgttaaatagctttaggggcttcccagatggtgcagtggtaaagaccccgcctgccaatgcaggggatgtaagagacttgggttcaatccctgggtcaggaggatcccctggagtaggaaatggcaacccactccaggattcttgccttggaaatcccaaggacagaggagcttggcgggttacagtccatggggtcacaaagagtcagacacaactgagcatgcatattcattaaacagttttgggtttctgttgagtttgttgtgtaattctctcagtaactccttgatgtgtatttgttattcctgtttaactgatcaagcaattgaggctaagagaaataaagaaaagggctaatggcctcagagtcagaaggtagttgagcaggaattagaaccccaagctgtccactgcaaaaccaatgtgatctcctccttatcttgtcattcaaaaggctctatcaccatgatccttggagttaaaccagcaattcttcccagttccaaatgaggagactccgagtccctccttgttctgaaaaatgctgagtgggacagtgcctgtgctcagcatatgaacaactccagtagatccagagccatctttccccaaagccctcaggatatcagtgcatgtggaacccttcacaggaacttgggcttcttatgggaatctgctgcaagagtagaaaaggaggaaggactaggggattagaatcagaaagaatgttgcccacattctcacttgcatgatagttagagttaaaggggataacagatgcacttctaagtgttactgagagaattatggccacggttatcaaatacctaaacgaaatttggtacacaggaagtgctcaatatatagaagctatttcctaccacagaggagaattcaggcaggttgctggatttattggatcattctctctacatctgcgagattccaagggagctgatgtaaccagggagatggcctagttagttctaggaaaacctacgatgaaacttaacttttctcttaaactttagcagagctaagaggattaattcttccaaagtttgaagaagagcaaaaagctgaattcaggttccagttgtcatgcagacaagtagaatctccttaccacacgtcctccagtacatatacgcacagaggtgtatggcactggcgaacgcactccctcaaggactcatgcacacacactgacatatacacacgaaaagcctctcccactttaagcctgagtgccctccttgatccctgcaccctgttcttaagcccctgggctgggccaaaggaaaagaaactgctgtttcaagcctgttgaagtctaactcatcaaaatagttcaggttaccccctgcagcactttacaaggcattttaagcattttttt

SEQ ID NO: 64378 - DNA, 1303 bp, Bovine  19866880714596
atttcctaaccgtaattgcctcccaaagtccccatctccaataccatcatgttgggagtttgggcttcaacataagacattttggataacataattcagtccatcgcagtttgtttgttcagcttcatctctggtccacagattttggctgccttagtcattctcagctcttttgtttcctcttcatctcagtgagaccactatgatccacttgagtttcctctcactgcattgtgtcctagtatccaactggacaatcacatgtgaatcacagcattgtacttcctgttgtgtattctctgaaaatagtcatttcatatatttttgtttttatagtttttatagtgcttacagcaagagttcacattcagttgtattaactgggcaggaattagaagccaaaactatggatttttgaacgtagggaatcaaactttccctggaaagaatggaaccagtgagtctgaggaatggtgtagtgtaaaatttgggtaaagtagaaattaaaaagaaagatgtaagaactcacagttttagagatgcagcagttattagaggtgacatggtgagagacgctaacttcctctccatatttcctttacagccacatggtaagaaagtggaaaaaataccagtcagctaagtggtactactgtacatacatatttacatattcatttactaagcaatatggacaaattcagaattataaggtttacctgtggctaggatgagatcctagggaacaatttaatcttgggagaagacataaaaatgagtagaatagaactttgggagtagaagtaagataccctagttaatacagttgatggtttttaacaggaatattctaggtacaaataccctactatatttataaacttttatatcctcacagtcatcagattacatcctattgagggaaataaatcagtctatccatctattcctctgtcaatgcctcataaaatagccagtttacatcttagacataagaaaacacaaaagtccgtggagtattttccttcccaaaatgttccagacaattacaagttatatgttttggaattgcctgccatattatcaaaggatcccagctacccaggcataagccagaaaggtgatattacttagtgagtcagacagaatggatttcaaatcctgctctgtatccgaatagctcagtgaccttgggcatgtcgctaactaggacaaagaaagattctgattcaagatatatggagggaaaatggacaggaatagtggccgactggctatatatagagaaagagtcaaaaatgat

SEQ ID NO: 64379 - DNA, 1351 bp, Bovine  19866880742138
tttctacatatccattatatttgaacaatgtattgtcataatgtctaatcaatttagactctaggaactggttccaaggtttcacattgaattaatttacaaaatttgcactgactcaatttccccttccttctacattccattatcactggactaaagtaatcaaactactattttgtaatagtaatcctaattttttacaaacacagctaatataagtaaacagagaacatttgcaaacagatatcaggacactgttatttgtataaaatctagcccagaaaatattggattttctttggtataagatgaactacagaatttattattttaagaacccttccaatttgaaatagcacagcctacatttctaggatgccagatatcaattgccttgaattccataaaaatggatttttatccatttctctcatagttctatgattcaagaagttattaataagacacaaaaatgtactgttgcactttactgttcaagcacaagttagaaaacatttttaaaaaagcatttcacttaatggtgcttatcattctacaaaaccagctcatttagccacagtccttcctaaaaacaacggacactcttgcatatatatgcattttcctatctccgtcggagtgtcacagtagacctctttaaacagcaaacaggacttgtatctagcgttagctttatttaaacattgggagtattggtattactgacatcagtctcttccttgaagtccccattctccataactaactgtacaatgtattttctcagatttacttacccaaaggcaagggaaatataattggctttctggtgacagtaagcaactcttctcagtaaaagcccatgtattaaaatcgtatggactggttcactactaggcatcatgtggatgtttcaggagagtttcctaaatcagtcagtggtgcgagcaggctgtagtcaaaggacattttggctaaatatttgctcctaatattgctaaatattaggcatttcttgactttcactagaaatcaggcatgttttattacactggaaattcacccatggatggtatagctgtagtggtaactgaagtgattcccatcgtgttaatactgctagcactaggtgttaccgtttataaaatgatgactttcactaagcacttcacatgtgatatctcatttaatcctccgaaccactagaaaattataatcattacccccattttactgataaggaaacagagttttaaacttcagggccaaatacctaataagtaatagatctgcctcttaaatccaggtctggtgaattctacagtcgatttccccccagttctttactata

SEQ ID NO: 64380 - DNA, 896 bp, Bovine  19866881048008
tgattatttataagaaaaaattatctcttccatttcttatttttgcacgtaaagatttaactattaactagatatttaagtgatttatttactttggtaacaggccagacaaaaatatttaaattctactcttggaagtaagaattatctaatcattcacaagctcttataataaaacatttatcatgagtcattaatccattaggacttattttccatcccatccttccactagcaccttgctttgaacatagtcaagtttggctgcaatttttccttttatcatatatcatagttacaggatgggatgcaccaaagctggattccaaaaaccctgcactctacttgaacttggcctacagaaactcaaccactgactctagggctgagacttatccagcctcaaggcctgagatcatgcttggatcatgggctaccaaaagtttagggttaggagacagcaggaaaaattaaaaagtctaggagcaacattatctcacagagatttaaaatttttaaattcacagggcaccattttggtagtcttaagggtagggctaagaaagcgctctttgcataaactcttctcacctgcaaccctgttcacaatcccatgtctactttacactcttctggtctggtgtgggtgtgttagtcactcagtcgtgcccgactctttgcgaccaattgactatagcccaccaggctcctctgtccatggaattctccaagcaagaatattggagtgggtagccattcccttctccaggagatcttcccaatcctgctatcaaactgattctcctgcactgcaggcagattccttaccctctgaaccaccagggaagcccttaatagaaagctacattttctcaaaaattactaatagagaacga

SEQ ID NO: 64381 - DNA, 1855 bp, Bovine  19866881073369
gggcatgattttaatagagaaagtaatcttggaatttgcactaaaatgtatagcacttctagctctgatcccctatacagcttatacaaatatgatacaataacatcataaccaggcagaaacaaatgacacctctgctagttgtaagtagaaagtagttatggagcatagtggaatcattggatgaaaccacaaacctattctaaagactcacatttaaaaaatagacaaaatgctcactttggcagcacttgtgctaaaattggaacaatacagagacaattaacatggcctctgtgcaaggataacatgagaactctggaagcagcctatatgtttcacaataaaaaataatcatcagatgatcaaaaaaggcaggttttatgaatcaaaaacaaaaatagacaaaccctaagagggttagcctgatcttatgtctacctcacagaaataattctagtaaaccacaacatcacccatctttcaataaacatttgctgaggtcctttgtatgagaggctgaaaatactgaaatgaatggcataaccctgccttaaaggagccacaatctctcagggaagagtcttcggagcttgaattggacacctaagggatccgttccctccagacccccgatgcccaccttgcctggccctcctcacacacgtccgtgtttgtaacctgcaggcactgcagcatgtcaactgtagactccgtgagctgtatcctgacgaacaggacttatttgatattgtactgatgactaataaccatgcccaagtgggagtgcggcttataaacagcgtcaatcactacggtaagtaaaataaataccgtgtggaggaacagcttgctgctctggaagagagaagccatgttattttgctcgccgtggcctaactaatgcagcctctttgatactgacacccccttctgcgtgagaatgtttatttgcctatgtcagaacaagagaggccatgttcatttttaacttcagcccagagtcgggcccaaagctctggacttaacttgtcaagtgtgaatttcaaagtcttaatcccaggccctgcaatatatttctctgttttacgtttttcacttctgaacttgacttcaaggagccgtcagcctagggctttctctgtgtgatcagacttcttgctcaccacagatacatgttaaaggttttaaggtttttacctttcctttccactcttaacatctgactctccccggctgcttgccccatacatcaaattcatacccatgccagcaaaactgtctttattcctttacagggaaaatttgtttgacactagactcttcatgacatctccatcagtgtgttagagagtttcaagggaggtccccatttttcctcttatgaatttacctgacttatgtggagacctttagcctatttgctaagtgacatgtccagtcttacgggtatgtccaagaaaaaataagatttaaatttggtaaaacgattatcctttaattaaaaataaataaacttaatttaaaaatacttttattactaaatacaaaattactttctagacagtccgtgtcaattcatactttcatccatagtgtatgtaagtgcctattttacagacttctcaccagcatctagtgtttttttttaaaactttggttgattcagaaggcatttaaaggtctattaatttttagtctgataatgacctcatttaaaatttcaagtcaagagagacaatttcagaccttttgttcttcagttttagggaaatagtttaaaccctatcactactgactattacactgtattgttactaagaaaatatggaaatggtacttaaaaatagagcca

SEQ ID NO: 64382 - DNA, 1079 bp, Bovine  19866881206466
ttaatctgcgtttaatgggtggttggttgtaggactagtctgtccagagcattccaatccaggaaaatatgtctgggtgcacacacagtttgataaatagtttttaatgttatgagtcagaggaaaatgtgaagtctaacattatatgttccctttctttctttttctttttcttccagttttgttgagatataactgacatacagcaccatatatatttaaagtgtgaaacataatggacataatgatttgacttacatatatcatgcaatgattactaagtttagtgaatatccatcatcttacatggacacaaagcaataaaacaaatttcctcatgatgagaacactaagggtttactgtcttaacattttgcattattaattatgtttatcatgttgtgcgtgatatccctggtatttgtcttataactgaaagtttataccctcatctcttccttctagtgattaatatatgtttctttttatctctaagaaggaaatctagaatgggacagggtacagggtggaagcagatgttggtcaccagctatgactctccaaaactaaacctgagtggtccagcatgtgtagaagtaaaactacaagccgtcggttgaatattgcctgtcttccatgtctttgtgaaagcgttcaactccatttgtggatcaatggtgctatacttaagtctggcccaacttttgcatcttagagtcagtcattaaatataaaattttcatttgtcttttcataatacttttattatctggatcacttttcctaaacatctcattttcttttttaaaaaattagtttctgttgctgtgctggatcttcattgtatcatgcaggatcttcgatctttgttgcagcatgcagactcttcactgtggcatgtgggatctaattctctgaccaaggattgaacccacggcccctgtattgggagtcttagccactggaccaccaggggaagtctcctcaatgtggagactcttatcatgtttccctttcttctctcctccttctaccttcctctctgttctccctatgaaaaaatttcagagcaaataata

SEQ ID NO: 64383 - DNA, 2462 bp, Bovine  19866881241745
ctcaatattcttgcttggagaatcccatggacagaggattctggtgggctatggttcatagggtcacaaagagttggacacgactgaagtaactttgttgttgttgtttgttgaataagactggagtccagtctttcttctccactttgattttctatagttttattgtgttgactggggttgggagggaattcagggggcagggattagaaatgggaaagcatatatttctcatggcatcagattaagtaaatgtaaaattcagttgggtcatgcctgcagtcaaataccaatggactaaagtgcaaaaactaccaagatgttgtgcctgttcttttaggtcccccattatgtttatatgattcatagccaattgacaagggatgtgttttataaaccaaatgtagaaacttagacattctcagtaaatatgaccctctaagaaaaccccaggagacctccaaacagggcagtgtttacaaaagacaccatagatgcctagccctttatcttctggaaggaaggtgtataaggggcaactatttctgaacactcgagtacattcccttgacagcatatgctaagagatttccttaaacgtactgttattcttccagaccatttgaatattgtaatattcttatccagctgaataatgccacttaaggagaaaagagaggaggcctttgagctgaggctagatgcaccacagtcattttctaggccagccctttgtaagttggcaattgaagaaccatcaatctatatgtgcaaagttggtgaagaattcaatccattcagtgcttagatgcctcattaacatttctaggctttaccaaaataacttttaaaagtaatccatgtccagttttagaggaaaaaagtgataatgttcgtcaatgagccatgtccaactttttgtgaccccatggactgtagcccaccaggctcctctgtccatggaattctccaggcaagaatactggaatggattgccatgcccttttccagggggatctttccaatgcagggatcgaacccgtatctcctgcaaggcaggcaaattctttcctgctaagccctgggaatataaagggcacctcaaaacatttccaacatttttgctctttggtgttgggattaacactacaaattttagaggcataacattttcactaacgctagttcaggattcaggacaaactgcaagaacaagttccctagggaagtcctaaagatccatttttggaagagaatgtctgtgtttatatttccagtttataaaacatttaccaatcacttggcctcagatcatgtttacagaggagaaaaacacccagaaaacaaataaactgcttcttgcacagtgtggatcaacaaagcttagctctccccaacagaagggcacgagatttccttgcctgatagaaaccccccatcgaggggtttctgtggaacatcccattcttataaccaaaggtttagttcagattgcttccggtcagatttgctgacagctgactgaaatttgacctaaaatgttctcagtgagtaggtccacttactaatcaacaaaccccaggtagtctctctctagggcagcatcctggaccgtgcagacaatttcctgagtctgttctccagggggaggttcgggttaaatggagacttgaatcagcacttccgattttgatgcagtttctcaagtggagcatggcctcaggacaccagtttatctgtcttgtcactggagaatggcctttgaaaaccagtttatctgttttggtttgtaggtcctagggaacagatcactggaagatgcactaactggttcctttcagcctttgggtggtcacgaaaaaacatcacgaagcaaaatcaaggccatgaatattgcttttaaacctggtgagaaagagatccttggctaatgagaccaaaatgatgaatgtaagaaaggaagtttgaaggaagatctgtgagaaccacctgcagagggatctgagtcatacccaggaaaatatgaggatgcctgctccctgggtagttcctgggtctttaatgtcagacggagcagctctgaccttttcattaactagaattagctttctgagctcctaaaatgcagccagcagtaactctccaaataaatttcaaagagtcatgctttgtgaaaacctatcaccttcctgagtcattaggaaaatgttgtgtgtctactgtgccaaatgtagtgtttcatgagagcccacagttctgcagcatttgagaacaaatctcttctctagtcattgctgctgggcatgtagttaattttaagcaaacgctatttagaaccaaatcaagcacaagtgactcatatgaaatggggatccaagaaatattaatgaaatgaattcatcaattaaaataattttctgatgcaaaaagagcagtcatgtgtaagtgatgtagggtggtca

SEQ ID NO: 64384 - DNA, 3086 bp, Bovine  19866881285099
tatactctgatgtagagggatggggagttgctccttgaataaccgattctggaggttttaagaaaaacgctgaccttctttagtcccttctctgcatgcacagaagtaaacccagcatgcctcagtctgacatggcccatcagtcataaaaaaaagtgacactgaaatcagcgatgggggcggtgcagcagcagtgtccctccaacccccacccctcctgttcttgggcctgtgctctgagctgcatacaaatccacagctccgctttcctttcttggccctgggccccttctttccggcactctgtttcaaaaacatcacaagccacgcaggtggtttttgttgcaccacagctcgtattcttgacagatcttacatctgcacattaatactccttgatgtctccagcctgaaactttcccagacacactggcctaagagcctcagaacccatgcatgagggggactaactacacaggaattccttactgggtctcagggctgggggccatcgtgtttttaaacaagagaagcttcatgatcacttagctctgaacttcaaggcacttaacgacattagaaacccaccttctctttagagtgatgagtactttagccagaaccctggggtaaatccaagttactataatcatgagttatcaccattgccacaattgcaatcgcacaattaatgtttttgaatgaatacatgaacaagagtaataatatttaactttttgttgagtccctcccatatttaaggcactagattatcgcacacagcctctattgctctaaactactacataaggtagatactaatttatatacctagataagaaaggtaactaactaagaaaataaatattaataaataatctggtcaaagcaacaaggttggatttatagcagaataatgatttaaacacagagcataggctcccaaacccaggctagctaattccatttaatcatcctgagtctacataaaaagcaggggatgcgagtgtgacaaagagactaaggaacctgaaaataaactgtccagaaattgatttctgtcctcgggtttgtctttgaagaagccactggcatgcctcactggtcaggagaatcatttattcccatttcactagcatgcagtgaaacagaatgagatgcgtggtttggactgagtgaaaaagaagtttcccagattcaacaagaaataaagattggaaaaaaaaaaaaaagattcatctcccaggaaaggctggaaagaagagaacagaatcatccctgaggatattgaatagatgagtagactaggactattaataaatcagaacttcagagctagcagccaatacaaagaaacagtgttagaagttgtctttgagtgtccatctcctcccttccttctgaaataacatgaactgtgagtaataccatagacattatctacaatgacttcaaaatgttgtttctttacatccgtaatttttttttttaattctgatgttcaccctgagaaatttggcagttataaaatttgtcaggagagaggaagggggtcaacacagggttcaagccatctggtggggactgaaatcaagctgaagaagagttagcaggggcagagggagccttgctgattgtttgctgaagaaaagtgacagagagcgtgagccacagggcttctcagaaggggaggttggagggctgcctgggtcccaagtgcatgactaacccatgacttatggaaagcctgacaggtctgaccttgcaatgatgaagaatcacactgcaactgaccacagttgggcttcatctcatgccccaggcttcgtctcaggcactgaggaggacctccatcattctcccagtatggtttgggtatgaaacatatctgtgggtgtcaactgcagggacaggtctgggaacattctcaaaacatacatcttaaatctcttccacttgattatctagcttttaattccatccactgagcgtgtaatgtagatggctgagaaaaagaaatcagagggagatttgactctgggaagtttaacattctaaagcacactatcaggaaactgaacttgatttctctgaaattaattgaaggtgccaaaggagagaaaggatcaagctaacatataccaactattagctaaattcaagacttctattaatttattttcacattttaacagattatattaataataatgttagtattaacagtattaatattaccattattaatgttagttgaatttcttgttggacattcagtgaaaagctgatatgctcaaagaagaaggtatgaactatacaggttggttgagacaacacatttaagattgctatttctgttgttgctgttcagtcgctaagttgtgtccagctcttttcgaccccatggactgcagcatcaggcttccctgtgcttcactatctcgcagtgtttgctcaaattcatgtccattgagtcggtgatgctctctaaccatttcatcctctgtcgcccccttcttttttgccttcagtctttcccagaatcagagccttttccaataacttggctcttctcatcaggtccccaaagtattggagcttcagcttcagcatcagttcttccaatgaatattcagcgttgatttcctttagaattggctggtttgatctccttgcagttcaagggactctccaagagttatctccagcaccacaattcaaaaccatcaattctttggcactcaggcttctttatggtccaattctcacatccatacacttaatactccccctattttattggaaggacttcccaggtggtgctaatggtaaagaaccctcctacaaatgcaggagaagcctgggacaagagttttaactcctgggtcgggaagatcccctggagaagaaaatggcaaccgactctagtattcttgcctgggaaatcccatggacagaggagactggtggactacagtacatagcatcacaaagagtcagacatgactgaagctacatagcatgcattttactggaagtttcaatctaattaaaaatagagaaatgaatttcactatgttatagta

SEQ ID NO: 64385 - DNA, 1000 bp, Bovine  19866881285269
aatgaggaaaggtctgcatttgttgtactttgcaatgtttggactgatctgaatgaaatttccaatggctaatttcatttctaatccttccatgagccagaaaactccacctgtgagggaacagtttttcactgcctttcttttgaaaagggcaaggaccccatttcctgtcaacaagagctgcagtaacaggtgggaattggtttcttctatgacagtggaggttgcttggggaggaggcccaggactcaggcttctgcaaaagttcttggcttggggttaaaccagaatgtacaaagcaagacccgcatgtctcctgatagatatctgagctgggggctctgaggcacaggacagtttactaagaaggtagaattatgtaatcctgtcactcaacagggcttctttccaggtcaaggtatcctgggactaaacagtacacatagcaacaaaacaaactgaacctgtacactctttgcattgttcagtggagcacactccctgtgtcgatcataaatcaacagaagtgcagtggagtggtgcctcatttatttaccatcgctggggaatggactatttattatagataaatattccaaataactgaagcccatgactttaaatgccaaaactttaaaaaatgttaactgtgtatgatgaaaatcctctaaacatttcctactgtcttaaagaatgtacttagaatatactttgaccttagaaatgtttggaaggaaaaaaaatggaagaaggaatggacagacacgccggtagatctgaggtcttaatgctaatgactaatcaggagcaatgaaggtttctagacttagtcttctttttattttgagaggtgttattggtggactgaagctgtagtttggatgttgctggggagaaactgaagccttatgtggagcaggcagcagcaggagaatgctgatgctgctgatatatatgtatatacatatataaccaaaatactatatagatacagtgtaca

SEQ ID NO: 64386 - DNA, 1086 bp, Bovine  19866881332638
ggggactgggagccagatttacaaattctcaagtggagctctcttttttcacctgcaagatatatgttaagctcaagccctgcagtctggggtcaaatggatgccaaaataataatacatatatgtggaacacatttcttttgctgtaaaaacaacattagagtgagaaggcccattagacagtttctattctagcttcctttttttctacatgtgaggaaactgagacaacagagctcaaaatagaggtcaagggtccttatccttgttcagtagctaagtcgtttcccactctttgtgaccccatggactgaagcacagcaggcttccctgtccttcactatctcccggagtttgctcaaactcatgtccattgagtcagtggttctatctaaccatctaagcatgtcaccttctcccgctcccttctccttggccttcaatcttttccagtgtcaggatctttttccaatgagttagctcttggcatcaggtggccaaggtactagaggttcagcttcagcatcagtccttccaataaatattgagggttgattttctttaagattgacaagtttgatctccttgctgtccaagggactctcaagagtcttctccaactccacaattcaaaagcatcaattctttggtgctcaaccttctttatgatccaactcccatatctctgtatgactactagaaagaccatagctttaactatatggacctttgttggcaaagtaatgtctctgctttttaatatgctgtctagcaagggtcttttaatttcatggctgcagtcactgtccgcagtgattttggaacacaagaaaacaaaatctgctgttgctgtcactgtttttccccttctatttgccatgaaggggtggggaccagatgccatgatcttagttttttgaatggtgactttgaagccagctttttccaatctcctctctcaccctcatcaagaggctctttagttctgcctatccttggccttatccttgccagttgctttttactttgacatttaaatgtctgtatcagttacatgttattatgcagcacactgcccccaaatca

SEQ ID NO: 64387 - DNA, 1166 bp, Bovine  19866881510909
atggagcccagatcaaagtaaatgaaagtggtgtctgtttaggagttttaatggtcagctgggaatttcctctctagttacttcctagtaaacagagatttcactgatgtgaaatgacaggaattgcagggtatggtctggcttaacagatttctccaagagaacctacatccccggcgcctgagaccaaaatacataattaatttttgcccatgcatgtgggaatcatgcagcttgtcataaaagaggctactggcatccttacactttgaggatatttgtttcactcgaaaaacagaggaagaagctattcctacaattgtgttgatcttctttcagaggagggaaaattgagccttagggtgagaaggagaaggttcagaagaatatcagatgggtctgagataattatgtttacatggttaagaggtgtcagagtggcattactcatgagactgatctgaacagaatgttgcaaatcactttcaagattttttttggacttccccatatttttggaggttggagtcaggattactggctttggtaattaatcctccccagcctgcattctttgctactgagcatagcagtgattcaggggcccaacctgctaaatcaagataatgtttgacctctgggagcagaagcattttcctcactgagccggagaaactaaacccaggagcacagttggtaaaatcaagagagctcatatttgaagaggaaacttagaatctccatttggggcattttgagtgtattttagaatataatataaaaaattataaattcaaaagacaaagttaattttgttctatgtatgagtatagggcccttaaagagctgtgatatcttcaagggaaccactgatttctacaaacgtttatcacagctgatctgtcatgactgtgtgtttgttggtgtgttttcctagtgttagtttcacaagagcatacattggtatcacaggtatgcatgaaagaacttggttgattttgtttcactggagctaagatgtttgaaatcattttatccaatagaccatgggtgtctttgtgttactttgcaattagctataatgcctttagacaacttctctgactcaagtgagattgtgggacaaaattatcggtatgtttttgtcaaaaaggaaaataggatca

SEQ ID NO: 64388 - DNA, 962 bp, Bovine  19866881608559
gttatagataacaaaagtgacataacccatgtgcctaagaagcctctgtcaaaaggcatgagatgttttctctgggtatatcacatttcatttggcaagaatctctcctagagtgtctggaaaaagacacaggaaggtcctgaatgtactctttaataggagacccacagagagtagtttagtcaatggtatagcaaatagaaatatttagaaatgaaaaagatcacccaagcccagtcttttcaatgtcccttggaccattcccagccactggggggacccatgttgtcttaactatggaacttcagatgacaaatatgttcttccagtgacttgctcatccacgtagtatgttcattgaggaggggacccagtcaggaaagttacctgtgttaatattctgttttaatcctttcgcagctgggtggtgaaagcgaacttcatctctgtctgaatctcagttttcttatctgtaaaatggaagtaacaaccccttatatatggtcattgtgaactttaaaggaaaaaataaaagccacaagaaaaataatacctggttagtacccaataattattcacttttataattttaatcacatatcatcaaatcaaggataccaacaaaaaataacttaatcatcagatttaatgataacatttttgacatttgggggtatggtttaaatgtgctattttaattacttttaaaactaattaccattggcatacattagtcaatattgtacatgttgtatttgtctttaggttcagcattaatatttgagactaatactgaaaatatagaatctaaagtttttttttttttttttttaattgcaaatcaatttggccattagggattacagagaacatcatggtgacggtctatcttttttcagctcatgtttgttatcttgacatagcacctttaagactgacggtataatttgaggtttgtcagg

SEQ ID NO: 64389 - DNA, 1829 bp, Bovine  19866880119920
gtcagatcagatcagtcgctcagtcatgtccaactctttgcgaccccatgaatcgcagcacgccagaccttccctgtccattaccaactcccggagttcactgagactcacgtccatcgagtcagtgatgccatccagccatctcatcctctgtcgtccttctcctcttgcccccaatccctcccagcatcagtgtcttttccagtgagtcaactcttcgcatgaggtggccaaagtactggagtttcagctttagcatcattccttccaaagaaatcccagggctgatctccttcagaatggactggttggatctccttgcggtccaagggactctcaaaagagtcttctccaacaccacagttcaaaagcatcaattcttcagcgctcagccttcttcacagtccaactctcacatccataggtgaccacaagaagaaccatagccttgactagacaaacctttgttggcaaagtaatgtctttgcttttgaatatgctatctaggttggttataactttccttccaaattcatacaatttctctgtagttagctttataaagcatgaatgcatgaaaccgttattggttatcctgctactcattaagttttttaaaagctttctagaaagctttgaaaaattatgttaagagtaatgaaccaaaataattttcacttttacaagttccaaatgatactctttcctgttacaaacatttgtagaaagcatagaatgttatctaaactggcaaaaaaattaaaaccttgaaagaattataggcatgtttcaaaatgttatcaaatgatgaatttattttactagagcgtttgagacagattgaatgtgtttgttttgccccaaaggtgtcttggaatataacacatcaggaagtcaatactgagccatatggtccttttgaggcacaacaggtgagtcagaactgtattaaactgttgaaagttttaattttcattactttaaatgggaattatgaacttagaactattttgaagcaagttattccatataaaacatcacagaataagccttgttatttagtcaccaagtcatgtctgattctctttgaccccatggctcctctgtccatggaatttcaggcaagcatactggaatgggttgccatttcctcctccagaggatcttctccactcagggattgaacctgcatctcccgcattggcaggcagattctttactgctgagccaccagggaagtagaataagctttagaacataacaaaaaaattattttatttttattgttcagatttggaaaaaaagaggcaacgttttttttttatcttaacagctttattgttttaacgggtataatgagcttgtatttataaataaaagcttattcacatgaataatacagaaattataaaaatcttaaacactttaaggatgattcaattagaaaatttattaatataagtactgtgtgatagatctttaagggaaaagtcattggatcaactccatagatgctgaaaaggtattgcataaaattcaagtttttttcttgacttaaaactcataatcaaatgagaatagctgaatacttctcagcatgcttttatctttcccttttaagccaaaccccatcatcctgcttaaatattgtatatcatcattaatatttattattatcctgcagatattggttgataaaagtagataagagaaaaaaataaaattttaaaggtggacgtgtaaaatatcattatttatagaggccaagactgtgtccctgtaaaatccaaaagatcaatcaaaacccaataccaaaatgtaagagaatt

SEQ ID NO: 64390 - DNA, 1477 bp, Bovine  19866880364942
caagaatactggagtgggttgccatgccctcatccaagggatcttcctgacctagggatcaaaccagcatctcttacgtctcctgcattggcaggcagattcttttccactattgtcatctgggaaactttaatctctccatttccaaaataaatatttgagatagatcattatctctatcaacacattctgctggccatatcaactcacatgcagaactgtacatccttgggcccagctagagccttggctttatctctagacaggctaaatgcgaggaggtaatgtaatctaagtgactagtctgtggtttcagggtggtattgaacaattcaaaacttcatgcaaagtagcgaaataacagtgactaccacagtagtaatgagaacatattaacatggaggttatcaaatgcttcctaagtactgtgctggtacttgacacagttttttcagtaatccctcacagcgagtcagatgcagtggtatccactcctttttacagatgtggaaacaggctacgagtggttatgtgacctggggcaccagccgtgaccgctggagccagtgtttctcgcacagcaggtgaattctcatagtcttgaccatcgcatatttgagctccctgagttaaggaaaaacaatttgcccaaaacttaaaaccctacacaagtgtcctgaattgaatagacaacgaatacagacatcctattacatgttcatccatggattgagtagtttaaatttggaacatactttactaataacttaccttctgtttatctgaaattcacatttatctagacattccgtgtttttagtatatgtattgccaaagtgagcatggacattctgtatttttctttgcaaaatctggcaaccctagttggaagaaaatgaaagtataacccttttggggagaaagtattagtatacatctgggcttccctggtggctcagaaggtaaagaatctgcctgcaatgcaggagacctgggttcgatccctgggttgggaagatcccctggagaagggaatggctacccactccagtattcttgcctggataattccatggacaaactagcctagtgggctacagtccatggggtcacaaagagtcagacacaactgagcgactacccctttccctttcaaacaattgattttagagtagagggggagcctggtaagtcatccattcatgttcctacctttgcctgagctggtactttccatgggatggaatttgggattttgagtagcatctttttcctgacctaggttgtgggtgtgaagtgtgctggggggtggggtggatggggaagggggacatcaaagaaaactttattctttctgagcctcctaagattatcaaaataagccatactctggaaaaactcatgccaacctagaataagggggcacatttttctaccaggtggctttaggtgagggagctggcagagctgaacagca

SEQ ID NO: 64391 - DNA, 1938 bp, Bovine  19866880434008
ctcattagtcataagcccttcccagatcagatcagatcagatcagtcgctcagtcatgtccgactctttgcgaccccatgaatcgcagcacaccaggcctccctgtccatcaccaagtcccggagttcattgagactcacgtccatcgagtcagtgatgccatccagccatctcatcctctgtcgtcctcttctcctcctgcccccaatccctcccagcatcagagtcttttccaatgagtcaactcttcacatgaggtggccaaagtactggagtttcagctttagtatcattccttccaaagaaatcccagggctgatctccttcaggatggacttccaggtccccccatttaattggaggaactgagggtgggatgtttcatttcaacatttctgtggttcagggccagtaatttcagtaggaaggtccactgtgaagtcctcaaactgccttgattacttctcggcgagtgagccttgcctctgatggcttatgacaaacctagcatctttactgattccaatgagtaaactagatttacttacctcaagtggcttgaaattctttctggtgatcagcaaaagtggaggcagctccccacgcccttgttggcgatgcagcgtcacactaaaatgttagttgctcggttgtgtccgactctttgtgaccccatggactgtagcctgccaggctcctgtgtccatgaaattccccaggtaagaatactagaataggttgtcattcccttcttcaggggattttcctgacccagggattgaacccaggtctcctgtggattctttactatctgagccaccagggaagccccaaaatgtcacatgtcaatgagttgacagttacagcacctgctgggagcgttgcactgagctgggggactgcccaggaagaactaatgggccttgtggagcctcgccatgggaagagcttggtagagcgcacgctcacttaagacggaaatgctcagcattttaaatgttcagttcagtcactcagtcgtgtccgactctgtgaccccatgaatcgcagcacaccaggcctccctgtccatcaccaactcccggagttcactcaaactcatgtccatcgagttggttatgccatccagccatctcatcctctgtcgtccccttctcctcctgtccccaatccctccacttacctggcagattggagcattctgtgtcttggtgtaatgaagcatcatgttggcatagcaaaaaggaaaccgccctcctgacaggaattcggtctcagcggaagcccatggtccggtgcggggcgtcgcctgggagtggacgtgtgtgtctgtatgggtgtgcagccttgtttctgatgggaagtcaagaccaaactgcccattttatcgcttaattccacctgatggtttcctgaaacgactgttggagagcaaatccttccctgtttgcaggatcttttattttttaacttgtggtttttctccccccaacttttgctttggaaacatggaaatgatttgtgcagaattattttgatgaagagtaaagaactgaaagggtggagtaaatcagtcaccagatcattactgcagccaaaacccactggagccaaaagctgctggctcatccggaactttgctctgggcctggtgggcataaactggaaccttggcaataaacttctggacactaggtcaccccatgccagggtctctggaatccagatttaatactacacatgcttccttgttctgaaaggagaaagcatgacattaaatgctaggaaaatctgttccatcctcaatgtggaaatattgatgctagacacagaatatggagaaggaggctgtgggcagtttatctgcctggctcctggccaaccagcatgcacctcattctctatggtggtgctttaacttttatatcgagaagatca

SEQ ID NO: 64392 - DNA, 2398 bp, Bovine  19866880434880
agatacacattaggcaacaatgacccatgaaaattaagatcacagtgggtcctacttttgtgttaaaaaaggaatctgtgcatatgtgatattttatatagttgcaatattttagaaattttggcacagattttaagttgaaatcttactagatatatacaccattagaatacataagaaaacttcagagacctccctggtggtcccgcaggtaagacttcaccttgcaatgcagaaagcgcaggttctatccctggtcggggactaagatcccataccccttgtggccaagagacaaaaacatgaaacagaagcaatattacaacacattcaataaagacactaaaaaatggttgatgtcaaaaaaaaaaaactttaacctttaatcatataacttcgattttcttctctttaaaaatgaccataatataaaactgtaagcactagaggtaataaaacaccaagcaggggctcaataaatggtatgattattatcctaagtatatatacagcttaataaacagcaggaactggcaggacaaaaatgtcatgtcctagcacactaggttactgtcagaccaccacctgcaaaactctaaatccctcctgagccccaaacagaggagaggttcctgctctcctttactttttcctatctgctcttatttccatccaccttgagttctagtcaattatttccagtcttatttctctcttccttttcattcatcccaacacaatgtcttcaagacagtgttgtgagatggaggtccagtggccatgggtgtcttcagcaaaacacctcctggattgttcacgccacaggcaggaagcatacaatgggtgagtgagggcagaaaggactcaccccagatgccagcagaagcagcctataagcgggtgggggctgggaaggagttagagtcaggcacccatgagcctgagaggtgacagccccggggagaaggcatccattgagagcttacaccagagggtgtgtgtccagaaagatgacaggccgtctcaaggaaaacccacaaaggagacccaaggcatgatcatgccattttcagattcaacaaaaagataatgaagaggaggatgcaatgaggaggaatggaagggaaggaataaaatctgggacatgtggacagtggatttagcagaaagaaaggaattagcagaactagtcactgactggcaggaaggaggcaggaggaggggaaaggacccacaggctggagtgttcatctgagattttctttttttttcatccaggaaataaatacaaaccaccggtttgggacacgttactgagtttgaagtgccttcagaatactcagggtgagacgtccaggagaactcagtgatagaaatgagctgatttgggcagcaagaagctgtggggctggactagatgacctagggagagacctgagcgctgctgcccagtaacataccacaagccagagacacagcttaaacacaggtagcgctttttttttggctgtatcatgcagcatgtacgatcttagttcccgaactagggacctaagtgcccctacagtggaagcatggagtcttaaccactgaaccaccagggaagtccccaaatatagatatataaatagatatacagatatatgtatgtatgtatttggatatatatgtatttggctgcacagaatcttagttccctaaccagggatccaacctgggccccagcagtaaaagcactgggtccaaaccactggactaccagtgtccctactaatatatttttatctaacccaaaataggacttccctgatagctcagttgataaagaatctgcctgcaatgcaggagacctgggttcgatctctgggttggggaagattccctggagaaggaaatggcaacccacttcagtattcttgcctggagaattccagggacagaggagcccggtgggctacagcccatggggtcacaaagagtcagaccagactgagcaacttgacactttcactttcaacccgaaatatccaaaaagaaagcaaatcaggcaagccaagaaagagcactcatgtaaaataacaaattcagttttgataatggttgacaaatgacaaacacggtactcacagtttccgaagaggatgccggtgtctgtaaattctcaccttgcacccaaatgctctctgtcacaaaggcgatgtgctctgcttcaagtataaaaggagataccaggaacagggcccatttgtttaagtcatcaatggactggatggagggaaagaaacacaattcaatagaggattcagtagacttcaaaaacaactgtcccttatattaacatctaggacgtcctcgcctttgtaattccaggtggcatatacattaaggccatccgatg

SEQ ID NO: 64393 - DNA, 3337 bp, Bovine  19866880495917
gtcttatgactaaatgaggagtcacactgagctaagcttttcctgcactgaccccactctgtataccatggtccttaatgtgcattagagtctcctggccagaatttaaaagaagtacttatattttctacttattaaatgctgcaatattagatcgcatttctaggaaaatattggcttgcccaatataaaatatctaccaaccccaccaggctttagtatggggaccattggccttcgcaggtggcgcaatggtaaagaatccgcctgctgacgcaagagactttagagacacgggttgggaagatcccctggaacaggaaatggcagcccactccagtattctcgcctggaaaattccagggacagaggagcctggtgggctatagtccatggggtcgcaaagagtcagacgcgactgggccactgggcactaacatcacaagcacaaatgtgatcattaaaataaataccgatcttggctataagaaatgagtcaactaaaagcaacccaatcctgatgttcaataataccacctcagatttgaacaatacttgacactttgcaaactgtttctatattagatcttcctaatagcttgcccgggtaggtggggctacaatcacctccattttgcagtggaacaacttgcagtgaggagagacatagacaggcctcaaagccagtgagaaattctaactttggccacatggttctgtacaatggccatcggcaggcctcagccatgccggaaatggggcaacaagagattgcttttaataccaaagaaagtcagtgtgatggccacttggggaaatatgaagttgggaaagataaaaagatgcctccaaattttaaaggaaaaaaaaaatccaatctcgatgaaccttcacgactccatcatcaataaaagcaacactcggggatcccccggacctgtgtcaggcccaggcctgtgtctggcctcatctcaggccgtgcagacatctgggcccggctgcgggttctatgtttatgggaggcgggtgaggacatgaccacctaggccccggggcgggttaagcagcctgattgaacgtcgctgctaattaagggcccctgtcatctggcaggaccgccggggtaccttctgcacttgttcatgaccacagcacctcactcagaaattaactcttgatgagtgcagacaggggcccagctggtcctccgagtcctgccaagcagataaatgaaatgtaatcaggatgctgctgactgccaagagaagaggggctctgcgtgacctcttggtgaaacccagagtctactttcagcgtgacttaattctctgcactagagacacttaatgcagccaggaatggtgtgaataggcccgtggccacagggagggcactgggaagtccatcctcgaatgtccactttattaagtctaagctaaaagaataaagaggcagtgcaggagaatctaattttcaattggcagatactttctctaggagagaggtgctattttcttcatgactcttcacaggtctggggacgatggtggcttgttacagtttgcaaactgtagaatcatttcgctcgggtttaaaatgttgaacactcatttttctagcacttgtggaggaacgcttgcccctaagttctgtttaaaaagaggaaagtagtggttattactgcctgggccttccagacacagaaactagatagagagagacattctggcttgtacagcaaagctgcagctcggggcaggagactagaatccaggagtctcgcacctcggttttggacactctggtcagagcgttcgccaccactttatttcagaaagtcaacgtgtagcaggtgatgatggggaagggcgtggggccaggagactggacagcgagcagggtcgcagcctcactgcaccggcccctggagaacgactccacgggtggctcctgcatgtgacatactccttgagaagggacgagaaaggcaggctgcagaccatggctccagaccacaaggaagatgcgtctctctatgacttccgaaaggcacggagacggcctccaaagaaaaggatgaaatgacggcaagagtcatcttttgctaacacatctaaaaagtggtgactgggccggaagcaaagggaaaatgaagaaatgggcaggaaaggcatttgatgccctgataaaacattttaaaaaactaaaaaggtgttggggagaaactgtaacaactcccaaaggactaaaggtggaggtggggtaaggtgggaggagtcaggaaaggtactcaattgcttgagagaatgtcatggtttcctactggcgcacagcaaagcaaccccacactgagcagcccaagggcttctcaggtggcactagtggtaaagaagcggtctgccaatgcaggagataagagatgtgggtttgatccctaggtcgggaagatcccctggagaaaggcatggcaacccacttcagtaatcttgccatggacagaggggcctggtgggctacagttcacagggttgcaaagagtcggtcggacacaactgaagtgactagcatacatgaacagcttaaaactacacacagcaaccgtctcctagtttctgggaatcaagagtctgggagtggctcagttggctacttttagctcaatagccccaggtgtcagctagggaatggtcatcgcaaggcttgactggggagggttcccttccaagctcactttcatgggcgccgggaggtctcagcttcccatgaaagcgaacaatctttttctgccatgtgggcctccccatcggactagtcactgcccattagcttgctcctcccttagtgacaactccaaaagacagagagggtgagaaaaagctagcaggacagaagtcacggtcttttttgtaacgtaacctcagaagtgatgttccattactttgtcatattcggtttgttaaatgcgagccatgaggtccagcccacactcaagtagtggggcttacagaagagcatgaagacccgaaggcagatcactgggatcatcccaaaggcagcttaccaaagagattccttactccttggataaacctagagaggcactcttccacagtgagcctctacagctcagtcactctgctgtgtccagctctttttgaccccatggactgcagcgctctccagactatatgattaggctatgccaggagaaatctcaataacctcagatatgcagatgacaccacacttatggcagaaagcgaagaactaaacctcttgatgaaagtgaaagaggaaagtgaaaatgttggcttaaaactcaacattcagaaaacta

SEQ ID NO: 64394 - DNA, 1698 bp, Bovine  19866880499011
cggagttgtgcagacctaaggcaggcaggaaggctgctttggcgagagagctggtctttgtcaggtaccttaggtctgtcgataagtcgttggatcattcagtctgtcattcagactgttttaagtgctgttgtccagttttgccagttttgtcagccaggctcccagtgagttttgtgtaaattaccagactctgtgttcagttcttctttgtaccagaaaggctcgagtcatttctcccggcacctcccattcctgacgtgtctggttttgtctcgttttagagggccttgctccccaaatttctcatcagaggacatctcaactcgaccaactgtgtgatcacacagccactgacgggagagctggtggtggagagctcagaggccgccatcaaaagcatcgagctgcagcttgtgcgcgtggagacgtgcggtaaggccccctgaccctccgctgcccccggcccacagccacgagctcgcctctcatctccagggtcctgcagggccagcgggacagcaggggactctcctgttgatgcaccttctctgagtcactggctgctgcctcagcctgaacggacgtgcgctgtgtcctgaccccacgatgccctctccctgctccaggctgtgcagaaggctacgcccgcgatgccacagagattcagaacattcagatcgccgacggggacgtgtgtcggggcctctccatccccatctacatggtcttcccccggctattcacctgcccgacgctagagaccaccaacttcaaagtgggtacgtgcgtgccctcagggtgcccctgggagggggtggatctgctggtctgctgatctcaggtgcagcgcggagcacccagccctttggttgctgcacaaaaatgcgtgcagagcagctgggtggcgcccagggttgaacttgcttcgtcccccaggagacagcgtgggctgctcacgtgacaacatgctctctgaaggacactaacttggccagggaccagccagccaagctcgtggggaggtcggatcagccctctgatgggctggtatttgatggggacacaagacctgtgacagcccagtgaacagtcatcttcccaagggctgaggctccggcagctgagggggagtcagtggttttctgtgatcgcacgacagatacttggaccacaagatctgagtcgcgttaagacgcacttttcaatcctgctttttctcccttcaccttgtattgtggttgaatctgcagatagagaactgcagttgtggtgaaattgccaaataaggggcagcctgtaaattccgtgtggatgtgtgactgggtgggagcctccctgaccttggttgttcgagagtcagctgcacctttgatttttaagttaaggaggaggagcttatctgtcgatttttcaacttggttttgctacgtaaactttaagaaacatccaaaaattgttcttttctgctacactatgcattaggtacctgtactgtctgcaccttatttctgtcagaccttacaaagcgtctgtgtagcatttaatgtagcgcccacgattcctccatagaaataacgccctcagcccatcagccaagacactggtggtgcttttgtcctggtggctcctgttttgtgtgcttgggggcttgtgcagcgaccaccccttcagcgagggggtcccgcgggaaggagg

SEQ ID NO: 64395 - DNA, 3149 bp, Bovine  19866880572654
atggaaacagtgacagactttaatttcttgggctccaaaatcactgcagatggtgactgcagccatgaaattaaaagacgcttactccttggaagaaaagttaagaccaacctagacagcatattaaaaagcagagacattagtttgccaacaaagatccatccagtcaaagctatggtttttccagtagtcatgtatggatgtgagagttggactataaagaaagcagagtgccaaagaattgatgcttttgaactgtggtgttggagaagactcttgagagtcccttggactgcaagcagatctcaccagtccatcataaaggaaatcagtcctgaatattcattggaaggactggggctgaagctgaaactccaatactttggccacctgatgcaaagaactgactcattgaaaaagaccctgatgctgggaaagattgaaggcaggaggagaaggggatgacagaggatgaaatggttggatggcctcaccgactcaatggacatgagtttgagcaaactccgggagttggtgatggacagggaagcctggcgtgctgcagtctgtggggtcacaaagagtcagacacgactgagcaactgaactgagctgactcaactgtcagctatttatattatacttggtattataaggaacttgagatgctttaacgtgtatgggaggatgtgcataggttatatatgcaaatactatgccattttatacaaaggacttgagcatcctccattttggctcaggggaggaggctggcgcagctacctgcagataccaagggacaagggtgtgtgtgacatgtccaaagttagctggaagcggcaagctctcctcgaacccctgctcagctcagcatccccgagccatctgcactgacaggtggatttgtttttgactcagctctgcccccatctctgctgggttcgggtggcctgtgggcggagctcagttcctggccagctttgcgtctcatagaccgcgggcacagagctgtcactttctttcaaaccatcaacctgtttgcggaggaactgcctggctgggccttggactgttcctgacctctatctggggttgcagaggctgtgtccagtgaggcccagaaagcaaagctcaaggcagctccctcttctgaggccttctaaggggtcacacggtgaaggacagggggattcttctctgcttacaggtaactggagagcacaggtcagtcttggaaagggagtccccatctttggttgaaagaacctgacctcacggttggtgaggatgcggttgaatgggatgatggatggcaccttgtccagcacagggatcactgaaggagaggttctgtcacccctttgtggagagggctgtggtgggcacccacaggctaagtgctggtttgggggctgggacctttgggatcccagcactgatgatgtcgttatccacggcaggcccatcttgggggaagagactcctttcccacctgcctttggcttaggtggggtgagaaagccgggaccagcccagctgcgtacctgagtggaccacagtgtcagcaacagacatttcgacacaatccagtgtttgctaattgctctcgtgtactctggacacaggaagatttaaccttttggatgagatagataccagtaactttccagctgagaagccagggattatctgataagtgacaaccaaaaacttatgtcttaaactataaagaggtcaaaagaatggaacgtgggttctcagcaggaatctgcacaaaagtctgtgtaatcaaacctatggttttcctggtggtcctatacagaagtgagagctggacaataaagaaggctgagtgccaaagaattgatgcttctgaattgtgctggagaagactcttgagagtcccttagacagcaaggagatcaaaccagtcaatcctaaaggaaatcaaccctgaatattcattggaaggactgatgctgaagctccaatactttggccacctgatgagaagagctgactcattggaatagactgatgctcggaaagattgagggcaggaggaaaaggagatgacagatgatgagatggttagatagcatcatggactcagtggatatgaatttgggcaagctctgggagatagtgaaggacaataaatcctgtcatgctgcagtctatgagtgcaaagagttgcacacaacctagcaactgaacaacaacagcagtgctcactattcacaatagccaagaggtggctattcacaataacccggatgctcataggcgggtaaatggataagcaaagagtggactagccaaatgatggaatatttcttagccttaaaaaggaatgaaattctgatatatgctaccacgtggatgaaccttgaagacattatgctaagtgaaataatccagtcacaacaggtcactgttatatgattcagctaacttataaggtctgagtagcacagtaaagaatctacctgcaatgcaggagacctgggtttgatccctgggttgggaagatcccctggagaaggaaatggcaatgcactctagtaatcttgtctggggaattccatggacagaggaacctggtgggctacagtccatagggttgccagagttggacacaacttagcaactaaaccaccaccaaagtagtgagagtcaagttggattcagaagcatccctcttctagctacttctgacaaactaatgccaaatccagatcctggccacctggcaggaagaaccactccttctcaggggatttaaggtcatgagcattttctgcagcaaatgcttcctttctcatgggctcatcgtggttataccactctgcctgagtgggcaggcctggcattgcaggaggaggaggtgtgcagccgtgaagccaactgcaggcctctgcgggcgggtagcatcaggtggggctagagaaggctgccaggtcatccacctgccgacccggcctccctggactcctcctaattgctaccccttgcctcagacaatcccgtgatgccaggtgtctcacctcgggctgcttcgtgccttgtaatttactaagtgctctcgcacagactgttactgaatcacgcagacacctctaagaggcagctgctatcatcgccaggca

SEQ ID NO: 64396 - DNA, 1721 bp, Bovine  19866880715118
tcaaggttcttgctttctcaaaatgattaagagcttctaaaaatctaaagtcagaattacgaagaaggtattaaagatgagacatgaatttccactccccacaaggcacagagatttcaagcttaccaggaagagtacatttgacaaatcactgcacagaaatattcatggtaacccatattttcttcaaaaaaccaagacattatcactctttgttacaaaagtaatataaattaaacacaaatgtaccaggacactggttttactatggtaggtgcacactagttttaagctgtaatttattttttaaagttttccacaattaacacagaaaattgaacaaatttggttgttccatttttatttaatttactaatctaattaaaggaggtccttgtagtgcaacatcatagatccatttcaactaattaatcataaacagggaaatttttttttaacttgattcatttaaaatggctataataaaatctctctgctataaaactgttaaagagcgtgtgtattctggacatctttcttcagctataaagcagttgattattttaacacaacaaatgtgtatgtaaacttgttttactataaatgtgatatgttttagtgccaatttacagttaaaaaaaaataccaatagattcccaaagttcattcaaccaaagaatattagaataatgaattataaggttctcccagtctctattcttcttgttagactacagaagcaaaaggtttcctgttcttcaatcttgaaaccatcttccaattgaagaagtcatttttacctttgcacagatgacttcacctacagaaaagctagaccaccatccaccgtaagacggttataaacagcaagactttaaaccagagactacacattacaacagcaaaaatccagctagcttattggtcactggatgccgaactgtattatttagaaattaaaatttaaaagcctttccacaacattgtaaatcaattatacttcaataaaatttttaaaaattttaaatgactttcaaaatggtaaaagacttcttcacttatcacaacctccatgatgttacatatttgttattttcctagatctagtgaatatgtacatgtggtcactgcattaaacgggtgtgtcctaaacaacttatgctaaaccttcaaattaattgcatttgttattaccgtggagatgactgcaaaatcctcactacctctgattctttatcagtttcagaatcagtccttccaatgaatattcagggttgaattttcctttaggattgactggtttgatctcctcaccgtccaagggactctcaagggtcttctccagaacaattcaaaagcatcaattctttggcactcagccttctttacagtccatctcttggatccatgcatgactactggaaaaatcatagctttgactatacggacctttgtcagcaaagtgtctttgcttaatacactgtctaggttgtcataggtctcctttcaaggtgcaagcatcttttaatttcatggttgcagtcaccgtctgcagtgattttggagcctaagaaaataaaatctgtcactgctttcacttttccccttctatttgccatgaagtgatgggactggatgccacgaccttccttagttttttttttaaagttgagctttaagccagctttctcactctcctctttcaccctcattaagaggct

SEQ ID NO: 64397 - DNA, 1458 bp, Bovine  19866880733788
cctgatcaaagcgttctccctgagttaccgcactgggtggaccccggttccccacccactccttctctggctgcccaagcctttccttcattcccttccaagccctcacacacaaatctccaccttactattacaaatgcagacatccccccaagaaaacgggcttcccatgtggctcagtggcaaagaatccacctgccaacgcaggagacgtgggttcaatccctgcgttgggaagatctcttggagaaggaaatggctacccactctaggattcttgcctgggaaatcccatggatgcaggagcctggcaggctacagtccatgggggtctcacagtcggagacgactgaggtgactaaacaacctgaggaaacaccctccgccttactgagcggacatcagctctctgggcacggacggtagagcgtcctcgccccgggtgagagcgaggtcagtccactctaaataaacagccatttggtggtggttaataaattaatttttaaagaaaggtcaccacggggaatggaatgccttgtgcccctcccagtcgcctcagaggccccgactccccccagtgggtggggctttcacgtttacccataattcctccgcccaggctggggccggggagcttccctttaacatggcggccagtctgccacgtttccatgctcaggtctaaaaaacatcacccccggaaattatacagtttgggggagagccccacgtctcacacaattaccataaaacaatgagatcagttcagaccccaaaaaataactctgaagatgagaaatcggggagaaaactaaccgcttgtgaacctcaaagcctgaacactcggttggctgtggaaatgagtcccacacagaccccacctctcccagacccactcctactgtgttgttggctcacctcagacgtgaaccccacggggaaactggatgtgtctcgccataatcccaactctcatttactgtcattgtccaaacactttttaaaggcatggaaggtaaaatgaaaccagagctaatggcggaaagcccactcccctgcaatcaactcactgtaatttttaaaacaataacacatccaatatcttgtaaaagcctgtagtgaaaaagaatctgacaaagaatatatataaaagcgttatcactttgctgtcacctgaaacttaacattgtgagcccctatacttcaattaaaacaaacacacacaacataacgttctgagggattctcttaagattccagcggtcattgtccaactttaaacaaccgcacagggaaagcactagattcagcagcagcgtgctcttctagctctcattttgttagaaattacttctttagagttgtattcctgttcatttatgcagccagaccatttccaaggacttaagcaccagaggtcacagctacaattaaggccccatctcatctcagaaa

SEQ ID NO: 64398 - DNA, 2843 bp, Bovine  19866880746758
acagtgcttcctgtgctcctaaggagcaggcagttacacgaagtggtggctagaaggcggaaatggacttagctagcctgccttctcaggtcaccaccactgccctcggtgtttatgtcaacgactctgggtccccaagtgaggtgctgcagactgaagtcaggggaggaggcagacaagaggatgtgaagctaccagcaagtcagagaacttggggggctccaactaaagaatttgttctgaaaccattttcaggcacaattcagcaagttcatgtcccggtataccctcattctgtaccttaaagtctggatcagttatatatatctggattttggaatatccatggcacttctgatagcaacaagtggcatccggcactggagggaacctgcattcttcaacaaatttctctaacagcatctacaacaaaagtaaacaaaaatgatatgacaacactaattcatcaatcaaattctttcaataatctcttgccattaaaatattttcagcacacaaaggaccaaatgccttttagccaagaaactacatacaacttataaagtttttcctcctggagagaggctgatacagagacatgctgagaaaagaatggaagaaaaggactgaacaaaaaattttcagaatttcagactgaatcaaaaccttagcctttgttgtaatcctcaaacctcattttacaatacatacctcttaaaaacctcctttaagcattcagaggcgcctaatgaggtagaattagccttaggactccactttctgcccagggtcacttcacctgggacatcctcccacccctactgacattcctcctcctccctgaaccccggaacttgtgcttgcccatcccctgaagagttacaccactgccaccgaagtccccgacactcatgccaggcttcccaggatggttcactgttatcagtatcaatagttccaatgcctccatcccagtccagaataaagagaggaaaatccaacagtccctctgttttatttcttctaacagttttgttcacatataattcatgtaccatacaattcatgcacttaaagtgtatagttcagtggtttgttagtatattcggagtcatgtaaccatcaccatagcctaaatttaaaacattttcaccactcaacaagaaatcccatacccatgagtaatccctcatctttcctcagtcccctatcccctgacaaccactaatatactatctgccttcaaatatagattttcctattgtgagcacttcattggaggtccagttgttaacactctgtgtgattccattgcagggggcacaggttcgatccctggttgggcaactaagatcccacatgctacatggtgtagcccccaaagaaaaaagtcctactgtggagattccagataaacagaatcacacagtatctggcatttcgtacctggattctttcactcagtgtaacattttcaaggttcatctatgttgtagcatgtatcattacttcactcctttttatggccaaatgtgttacatggatacaccacattttatttaaccattcatcagctaatagcctttgagttctttccactttttgactatttttaataatgctactatgaacatttatgtttaagttttcgggagaacttatgtgttcctgtctctgagtatatttaggactgaaactgctcagccatttggtaactctatctttaaccaatgaagaactgccagattggtttccaaagcagctccaccattttaaattttatagcaatgtatgggggttctgatttctccacatccttgccaacacttgtattgtctttttgattacagccaccctaatgggtgtgaaatggtaccctgttctcatttgcatttctctgatggctaattgttgaaaacactttgcacatttatcatctatttatacaagctgttggcagatactcctatgcagatctttcagctacttttagagtaagagttgatgcctgtgcttgtaaaagctttagttaaaagcaagttctgagtatacatcagggctcaccacaagttacagcctatcccagtcaagttacatgatttagtctttctagaactggcaaagcaccccatgattctggatatgagaccaatttatactttttaggtcttcagtgtcaataactacagaaattataaggaaacaatcatgtgaaatccttctctaagtacaaccagcacacaacagtgcactctagccagaatgcctggattcaagtcccagctccaccatttccgagctgtttaatcttgaactcatcactgcggctgctgccaagtcacttcagtcatgtccgactctgtgcaaccctatagatggcagcccaccaggctcccccgtccccgggattctccaggcaagaacactggagtgggttgccatttccttctccagtgcatgaaagtgaaaagtgaaaggaagttgctcagttgtgtccgactcttagcgaccccaggcaagagtactggagtggggtgccattgccttctccggaactcatcactaaatctgtctaaacataatcttcctcatctgtcaaacgggaataatcacagtgctcatcacatagggttgctagaagaggtacaggtaatgataaatggaaggtgtatgattggcaaataggaaataccaaataaatgttggtgactccaccagtttttaaaggggaaatgaaggagctgaggacagagtgtcatcttatacttaagtcaagagcacaggagtgcagatgagcttttatggttagtaagaagctctacagaaataattacctttatctt

SEQ ID NO: 64399 - DNA, 803 bp, Bovine  19866880812594
acaccgtgtctctggcctgatatttacaatccctccagcaagcaaaatgcaattggcacctgccccagtagccaggattaatagcggagagcattgtggttttgttattaagttactctcggcaattagtaaatttattgttctaattgttttcacatggctgctccaccacacatgtcttacttcgaggatgtccttacagtcttgcccccatcatcatatttcaatgtgatcactgcccatctccgcaaactgtccaatcccatcaaaagctgatttgcagtcgggtcagagggaaggaggagtaagagttcattccaaagtccaaggcatatttggataaaacccggagaaattttgttttggcttattgagcgtctgcgactgcactcccagatggaggggctggggaggggatggccatctgtggttgatgcttgggtgttggtgctcagtcggtcagtcatgtcagactcggtgacccacatggactgtagtccgcctggctcctctgtccgtgagatttcccaagcaagaatattggagtgggtagccatgccctcctccaggggatcttccccacccagggactgaaccccggtcttccacattgtgggcagattctttactgtctgagccaccagggaagccccagggattgattgcacaggaaaagtccaaattcttcccagcttcaaattcgttactctttctaaatcgcaacttccggtccctcttaatcctccaatggaatcgtcagatagtggggggcaggggtgacttcctggggcctgggagaaaga

SEQ ID NO: 64400 - DNA, 1327 bp, Bovine  19866880844667
cttattattactctagttctaattgtaggtaacagtgctctgtcctaacacattccaatcaggcctcataattactcaagtcaatttaataacactgagctacagtgtacccagcacaaagttcaactaaaatttctgaaaacaaaagcctgggaaactactttctaagatatatttaatataaaaaaaattttttaacatcttatttcaacattataactctcaagtcaaaatcagacattttttgaaacattctcataaaaatgtaataaactaattcaaacgcagtaggtaataaccaacatttatgttaaaagtttacgagacctcattttctatattttaagttgttctataaaaaagattttattaataagtggtaaataattttattgcaacaaaactataattatgcctccagccaaacatattcatttccaaggcaaagtagtacctaaaacttaacactgaagaattttagaagatgatggggacagaataagattatagaacaaaaacctgaactttgggatcagagagacctaacttcttatttaggttctactacttaacagacgaaagcagtatcatttaacctctcaaagtttactcatttctaaaataggatcacagcagctaccttgcagggctattataaagaaaagagcacacagaaagtgtcagaaacaagtccaacaacagacgcccaatacatgatactggtcgtctaatttcaccataaaatctagcctataattaaaggcttccaaaacaacaaagagaaccacctctactcatgtaatacagcccagcatctaataaatatcaggaaaacctgtcttcatatttaagcttaatttctaacacccaggtcaagagtacaaagtatgccctctactcagcagaaatggcaaataatcagtcaccatcaactgaagagtcaagtacttcctgtttcaagatccctataaaaacactatggtttttcctgtgttcatgtatggatttgagagttggactgtgaagaaagctgagtgccgaagaattgatgcttttgaactgtggtgttgggagaagactcttgagagtcccttggactgcaaggagatccaaccagtccattctgaaggagatcagccctgggatttctttggagggaatgatgctgaagctgaaactccagtactttggccaccccatgtgaagagttgactcattggaaaagactctgatgctgggagggattgggggcaagaggagaaggggacgacagaggatgagatggctggatggcatcactgactcgatggatgtgagtctgagtgaa

SEQ ID NO: 64401 - DNA, 789 bp, Bovine  19866880874726
ggatacatagggtatgcatacaacatgaatgttgtacgggaggaaccagcacaacattgcaaagcaattatcctccaaataaaaaatttttaattaaagaaacagaagtcagcaaaggagaaaaacagaatttgaacacagaaaaaaaaaaaatttgtgtttctaacaaagttctcaggtcaggctgaggctgggaggtctccctttgaaaatgatagttaccaagaatgttccccaatttaagatttgcctgatgcctcacaatcagattcggtttaaacacacactggggcaggaaagccttcagtgatgcagtgtccttcccagcgcgtcccacctggaggcacgggattgcccgtttgtccccattcttggtgacgctcactcaaggtggtatcccccaggtttatccatcagtcaaagaggattacccagacctgtgtttattttcttgctttaagatgttaaactattgccttagtaaagggattttaagaggatgcagacaagccagcactgacctgtgtacccagtacttatagtagagaggaagaacgccgttgggcccctggtcctgaaacacgtcaatcagcttctccagcacggtcaccgttcgggcgatgagacagtcggctctcaggggctgtagctgtgccccgtgttccttattgtattctgtgatgagatcattgatgcatatggtagggttgctgttcgtcacgttaaatccacagcctgaacggagagaaacgaggacaaggtgagcagctcaacctactagacatcaca

SEQ ID NO: 64402 - DNA, 1227 bp, Bovine  19866880910740
tggactggctcccctgtctatgggatttccaggcaggaatactggaaagtataaatggcaatagactaacagacagagcacaccctgtgcacacacacaagttctggggagcagcgaagatccctttcttgaacgcacttaacttactgctgtgtttaaataactacatcactccccattccttatacctattaagagttccagggattttagcataattatggcattttggaaactaaaaagcaaaaccagttttatccctctgccaggtgacagtgttgtctggggactgatgcttctcccggtgaaagcagttaaattagagctcttcacacgggaggggagaggctgctccgtgggccccataaaattggaagcgaaaaccctgcgtgtgtgcgtgtgtgtgtgtgtgagtgcacgcacacgcgcatgcatcctcctttggagaaagctcacaccctttgtcaagttctcaaaggtgtcctcggccccagaaaggtctggaaccggagctcgaggtcgtccgcggggggcagcctctgcacgggcgggtccggctaaccgtccctcgggactcctgtccccttgtgcttgcagtgctggtgaagggccaggtcaccaccaagtactaccggctgctgtccaagctgggcggctgggtgtgggtgcagagctacgccaccgtcgtgcacaacagccgctcgtcccggccgcactgcatcgtgagtgtcaattatgtcctcacgtaagtcagacgtatttgtttctctccttgctctctccttcccaccgccctaccccccgccaccccatcctgcatccaatcggtcctatacgctccatctctccctccctgtctctttctggaactgttcatttgtctcctgctctgttctattggacagtctggttgtctgggaggttctgaacgatttttgtgtcagcatcgagggcagcggtgggaacatgctcctgccctggacacagcggccccgggtgcggggatgtgagcggcagagggcgagcaggcgatgccaccctatcttgaacacgacagaaagggggtgcacatcccagaccgagaatacaaagataacactctctgggaccactaacattcgggccatcatgcttgctcctcccactttttccatgtctgcctatacagcctgtcgtaaatggtaatgaatatttactgcctttaagtcctcagaagttaagttcagt

SEQ ID NO: 64403 - DNA, 756 bp, Bovine  19866880911768
tgcctacctcacaagaaactaggaagttagctaagcccaaaaaacacgaagatgaagacgaagctgagagcaaacccttaccccgcacaggtaacagccaccacccgccagggctcggggcacctgaatgaagtgtgaggcctcggccgcgttcaggggtctctctgcctgggagtttctctgggggaggcaaagtccctctggccgtcctgcccccagggtagagagtcggcctgggggacacaggccaagctgatggccaggtgagtgagtcagatcttggagacagaagactccctcagagaggctgatcagagtccatgcagtcggggctcaggactctggggccccatgtttccagagcgtttttgtctggaatggaaacacttccatctctttttttaaaaaaggcttttgcaagctctccgaaggtgcaagtggcttgtgttgtcacttgggggtgaggcgatctctttccacgcggggtgggggtagtagggggttccccggagggctgtcggccggccgcctgtcccatgtgggaccgcgccagtggccctgggacaccggcaggcaccatggggtgggcaggcagcttgccgccggccgcctgccccggcaggcccttcatctatcttctttgcttggcagcagtacggctcgttccaaatggacaaactggagtgcggccagctcggaagctggagggccagcccccctgcccacggcccagctcccccagaacagcagctccat

SEQ ID NO: 64404 - DNA, 2129 bp, Bovine  19866880943923
ttttttatttcctatattttttaaattatatagttaagaatcggcccaattgttccctgccacacacataaacaaatcgatgtacttgagtcgcagtcatcagtgcctatctatagctcacttgaaagacattctagaatatgtcttaagacattataagatgtaattaggacacttctggaatacgtctgacttaacattagttaactataagacaaatcttaaatttcagtatgccaattatatagtaaaaactttttcctttttgtttctctatgttttgccagtggtaaaatctcatcatttaacaaaagaacaggtgggaaaataattattgtgttcaacagactttgctttgattcattttaaaaggcaattcatctttctttctcagatctggaaactaaattaagataagtactccagcattgactaaaatgtgaacttggaaattatccagtaaattatttccatgtagtcattcagaatggtcagggaggaaatgaaagtgtatcattagaacaaaaaattagaaagcattgaaactacaggatatataattaagtccgatgcagagtattttcaaataagtttctaaatattatttaatagaagcaatgtctcagaaagtatttgcctttagaaactatgatttgtatagttctagataaatataaaacggagaaggcaatggcaccccactccagtactcttgcctggaaaatcccatggatggaggagcctggtaggcccgcagtccatgggctctgtaggagtcggacgcgactgagcgacttcactttcacttttcactttcatgcattggagaaggaaatggcaacccactccagtgttcttgcctggagaatcccagggatggcagagcctggtgggctgccctctctggggtcgcacagagtcggacacgactgaagcgacttagcagcagcagcagcagcgtctcttgttatgcttaagaaatatggatggtgctcagtgacaagcatctgtgaactcgtgagcacagcagggctggaaggaattggaaacacaggggtctcctccagagcagctcatgccttcaaacacagtttaatatattcaaaatgggagcaaatgatgacagtatgcagatgccaaagtactaacaacctttgacacaaattactgaaatcgacagcttccctggtggctcaatggtcaagaatctgcctgctgaagacacaagctggatcaggaagatccccttggaggaggaaatgacaacccactccagtatttcttgtgtatgaaatcccatggccagagaagcctggcgggctatatagtccatggggttgcaaagagttggacacaagtaaatgcatgtgcgctgaaatcgacttcacagtttctgtgccacacacactgccaagcatatagtacatacttcacacacatacgaagaatgactatggatgtttctaaccgaagctaggaaatttgggaccgtgattcctttatggctcaataaacaaattattatttcatgagagacaaacgtctgaaagtcccacatggttcaagccctttctttcacagaatgagacatgctgccttgggtagtaataactggtgagcgaaccctggaacaaatgagggcatggttcttgccattcatctctcccccagcctgggataatgccctgtgcagagcaaatacctaataaatctaaatgcatgtctaatgaatgagtggataaatattcattaaaaattaactcgacagttaatttaggtcactcactggaaaaaagaaaaacaggaaaactagaaaagtatctttttaatttaaaaggttaattaaggacaaggttttaaaaaaatattttggtggcttaagtaaactgagcacaactggggttcaaaacagctgcaattagtaactctgaaaacattccattatgttccacaaattagaaaaagggggaaaactgcctgattcgcttcatgattctagaataatctcagttctaagtaagtaagcaagaaaaaaaaaaaggaggccctcttcacttataaacattgatgtgaaaattctaaatgagatgctggctaaccaaattcaatggtgcatcttatgtataata

SEQ ID NO: 64405 - DNA, 934 bp, Bovine  19866881053418
ctaacaccgtgctcttctctgtggttttttaagtaaaaataagtattaatttaatatggaacaaaatgcctactgcaaaataaaaagagccgaatgaaatggcaacaaccatgtcagccaaagatacatgcaaaaagtagtcacaccctgaaggtcgagagaaattgaccgacgtcgacaaagaagaaaccacaactcctggatggctgtcacccatggctggtgaatatttttagtgtcgggcaatataaaacccagaggaccacgcagcaggggacccaaggctcccaggcatgacggccaccaccaggtgacaaaatccagagacaaccgcttgattacttaataactgtgtggaaatggaaaggggtcggttatctgcaaaaaccctacaaaaacaaacaaaaaatgattgcctgggcccacttcacagagggagtgtctcagctaccagcagtgttgttactatttgcaaatgggaaacacacatttcttgttaattctaccccacatgatgctgattcattctgataaccctggtctcagaaatactcaccttaaaagttacatgtaattactacactctcccatgccccccaccacaatctgcactctaaggatgagagctgcgagggaagcccctgtccccatccgggccttcggctcagcagactgcatgatacatgactcctggctaatgagtattttcagagcttttccgaattgagtgcgtgctgaaaagcacactgcttattctactttggcctttctttctatcatttatttcatgttccagccatagttttgagtaaaaggtgttcggacttgcctcagaggacaaaagaatagtacactggatgtcagaaagtcagtttccaggcagctcaaggttgccctcatggaaatggtggaggaagcagagggtgaatgaagg

SEQ ID NO: 64406 - DNA, 1469 bp, Bovine  19866881072180
ctgcctctcacatgccccagtgaccgagggctgttcttccttttcagcgctcagcaagtccgcctgggaagcgctgagggaccacaggcgtggatagctggcctggatgactccgggttccttctggtccaccaggaagacggtgatgtggtcacggtgcatcccgacggcaactccttcgacatgctgagaaacctcatcgtccccaaacagcagtagtcccggctggggactgacgggacagactgaagggcagaactgaggcgggaggcttccccttggatttctgtcgcctttcctagcccgtggagccggaaaaactaaatcagagttgttgatgatttttttccctccaattaacctgttcattcttaaattttgttcagggtagagggtcgatcactgaaaagatttagttcaggtaaagacctgccatagatatgagatttgttctcccctcttgaaattggatgtgtgttaattggcaaaaaaaaaaaagtttttacatggaaacagcaatggaataattcacgttttcccagtagaggagatctttgtgcgtgctcagtcacgtccgactctttgcaaccccacggactgtagctcaccaggctcctctgtccgtgggattctccaggcaaggatactggagtgggttgccatgccctcctccaggggatcttcccggcccaggtattgcctctcttgcatatcctgcaatggcaggtggattatttgccactagccacctgggaagcccagtgaagatctttatccgtagactattaaaaaaatttttttaaaagctttcaggccctggtcattggtgagttaggagtatggtaacactgtttacaagaatccagggagatgttttcctataggaacatacactggtccttagtcatcattttttgtttgtttagtgaagaaaagagaaggtaggtttctaagccttattctcagcctggtggtttgtggtccaatagcagtgtctacatggctacagaggcaccctcgcagctctggctgtaatgacctcgtagaaggaatcagttcattactttgacattaattaatgagctttcctaactttaaattgatggactattctgccgtgatgggatcaagttcaagatccttaaagcattgattaggtaattgcttggatgtgagggtgggtgatttggctccaacagctggagatgaagtctccctctcataccacatgcaaaggaggatttggagctttaagccagctgcgggcttgctttgaaatatagagcattcctgcaggactgtatagacgtacacagtatagacgtacatggcattttattgctaagtcacagttttttgcccccttttcacattgccaaaaaaagttattgctattgcataccgtcagttaagagcgcgcgcgcgcacgtgtgtgtgtgtgtgtgtgtgtgtgtaagtcttaaaagaag

SEQ ID NO: 64407 - DNA, 1076 bp, Bovine  19866881073724
gcttgagttcggcttttaaaatggtttttatttaaaagaatacaaacttccctttgggggaagggtagaaatgtgcactgtatctccagcaaaagagtcaacataaacttttttttcccccaagaaaaggaaagcgggggtgggggggaaaccctcactctgagaatttcctcagctccattctacctgtttaactcacagggggaaggttttcctctgcattcccaggaaatgagcaggcatagctctcggtgcctgctaagtcgcttcagtcgtgtctgcctctttgcgaccccatggactgtagcccgccaggctcctctgtccctgggattctccaggcaagaatcctggagtgggttgccgcgcccttctctaggggatcttcccaacccagggatcgaacctgtggtctcctgcactggcaggcgggttctttcccactagtgccacctgggaagccccctagctctcagtaggacttgttaaagtcaaaaatcagacccgtcagtgcagccgccaggatgtctctgaaatactttctgggcgtgagggtagtagcagggcggaggtgacagtgaggtggtactctgttcagagggtgggttccagagcacccctgcgctgagaagagggaccacgctcagaaagcgcttcctcctctgtctggctcggggaacggagtggagcgttagacacagtgagaaaagtagaatacttaaaggccaaaacacccagagcgcctctctgtgaccctggcgggcagagcctcgtggtgcccaggtgcggtgagggggagcccttggctggctaagaagagcctggccacccggggcaagggccgggccgggccaacaggcacagggcatgccagcgagcaggcagcccccttgtctgggtgccaagcccacttccatctcacatgaaatacagctccagaggtatttctcttggacaccatgaataacccattgagatcggctctgcttatacgctgctgggctccaagaataaagcgtccttttcttgcgtggaaaatccaaagaaggaagctttgtccacgcggggagataaca

SEQ ID NO: 64408 - DNA, 1215 bp, Bovine  19866881129090
aaactggtgtgaaatatcttgctcaatcatatagaatgacagtttatagatgaaaacttcctctctattttggatgagtaaggaaaaatctattttttcataacaagagctggtttgggggaaaatcctgtgttaatatgaataaaagtcatgggatgtggttaaatgcttgcagaggccgttttcaactcagcgagattgaacaaactattgatttagtgaaatctacaagcttaagttaccatgactataaattcctaaaccgtttcccaggaggcattatctctctcatttcaactcaccaaatttcattagaatccattaaaaatgcagtagatcaacatgtttaaaatgaagtgattgaatttcatttaataaaataccctggtgcctctgcataggtttttttttttttttcctgacaagataggtgtatagattggctatgttgttttcatttttcaggggataggtgactaaaaaaatctgccatacaagaaaaatattagaaaagcaaaaaacaaaactcataggttatatggttattttcaaaagtgttagatgatgattaggtagctactagtttgagtgttctctaggaaagctttatgtaagagaggctctgggttgcactgtttccccactaagatatgctgaagtcgtaacccctgcgtccctgtgctcagtcacttcagtcgtgtctgactcggtgactccatggactgtaaccgctgggctcctctgtccatgggatttcccaggcaagaatactggagtgggttgccatgccctcctccaggggatcttcctgtcccagggatagagcttgcatcttctgcatcttctgcattgcaggcggcttctttacctactgaacctcctgggaagccccataatccctaagacctcagaatgtgaccttattgggaaatagggccgttacagatctaacttttagttacaatgaggacctatggggtagggtagacctttaaaccagtaagactggtgtctttatgggaagatgaagaaacacggatgacaccatctgaagatgaaggcagagattggagtgatgatgctgctacaagccaaggacagccaaggatgaccagcagccgtcagaaaggaggagagaggcctggagcagatccttccttgtggcctgcagaaggggccagctggctgcttgagtttggacttcggcctctagaa

SEQ ID NO: 64409 - DNA, 1204 bp, Bovine  19866881145954
ctttaaaatgcttcagaacaagccagactaacaagcaccccccacacatgcactttttgaattaaaatagtataaaatctaaattcctatttcccctgaatatagcagaggagactcggtaaatctgatctctgtaatactccagccaaggaggaaaaactctgatgacctgatattctatctgtcaaagtgaaggaaatgacacagagcttttaatcaatatttatgtaacactcaccaaaagctgtacttgctgaagtaaaatataacctctctctctttaaacaccttttacttgttattcggataggaagttattctttcagaattagctacatctgtcaacccggcattcctggctgccacatataaagtccctaccatttcccaccttctcaataaccttctctttagcttagattttatttatttttgacaactccctggggtttcctgacaggagaaatctttaagacggaagcaatattgttttcacattcagagctacactatttttttattggtgttttcaactcaggagaagacaatgggacaaatccatgccaaatgcagtgagtttttttattattattattaataataataatttactttaaaccttaatgttccaaatcaacatttactttaaaccttaatgttccaactttcttgtctcttttgtcagtttaagaggcgcccagcgtgtgctcaaatgtgttttcgttggatcggcgtaggttagatctctttggcaggaaagcgtgggtgaagcagatgagaattcatcagagtctctctgtgcacagctccatgcccttactactgttgtttcgttcagttcagttcagttcagttcagtcgctcagttgtgtccgactctctgcgaccccatgaatcacagcacaccaggcctccctgtccatctttttcgttatattgccataaattgatcagaatgaatctgtcccctttctgcctctgatcatggcttacaatccattatcaaagacagcatcagcgactcaatggacatgaatttgagtcaactctgggagacagtggaagacagaggagcctggcgtgctgcagtccgtagggtcacaataaacagctggacatgacttagcaacttaacagcaactatcaaagatggggttttgagccttagtcctggctgaaaaacacagattatctcctcctgcct

SEQ ID NO: 64410 - DNA, 1257 bp, Bovine  19866881210198
atatttttcttttgatattttgatattcaaaatattctgcaaatatattgtttaaaaaaatgaacgtgggcatttcttagaattcaagatagattacttcaaggtcatcttatttttttccatatctacattttataatcctatatttcatatatgaaattttttccagcctgaaacgaagactccctactcgctcctcaattttgaatgcaaagaatcggagattgagtaatcaagtatttgaaaattctcatcaagatgatgatgatgatgaagatgtcatcatcttagaagaaaacagcactcccaagcctgcaggagatgatgatactgaagtgaaattgcagcagagccccatggagcagagtggtgtggaagtggagcctgtgggtgacagtgaaccttgtggccagactggctccacaggtacttcgacatcccagtgtgatcagggaactaccacagccacccagactgaagtgccaagtttagtcgttaaaaaggaagagactgttgaagattcgatagatgtaagaaatgacacagccgcactgccagcctgtgtggaaactgaaggaaagacacatgaaacccagggaacctttgataaatctgctagtgacgctagttgcaagttaaatgaactaagaaatgagctgcttctcgttacccaagaaaaagaaaattataaaagacagtgccacatgttcactgaacaaatcaacgtgttacagcagaggatactggaaatgaataacaaatacgtgaagaaggaaacttgccatcagtctactgaaactgatgctgtatttttactggaaagtattaacggtaaacctgaaagtccagaccatgtggtgtctcagtatcgtcaagccttggaagaaatcgaaaggctgaaaaagcagtgtagtgctttgcaacatgtaaaggctgaatgcagtcagtgttccagtagtgagagtaaaagtgaggtggacgaaatggttgtgcagcttgatgacgtatttagacagctggacaaatgcagtgttgagagggaccagtataaaagcgaggtgagttctatccctcagcgtaaggagaggtgtaggtgtccaggggcatcccagccttaactccccagttgctatattgcaataaatcgcttcataatatttccatttctcgactacctgctaatccactggttctcgactgggagtggtcctgatgtgggcatcggaaatgcataaggtcattgggttctttcagcat

SEQ ID NO: 64411 - DNA, 872 bp, Bovine  19866881214311
gcacttcgggacagcacagcttggagctggtgcaggtttcttggaatggggaggagggagatctaaatttagacctttctatcacaccaaataaacataaattgaaccagagggctcaaaagaattaggcagaatgcctttgcacctaacttctgaaaaatggagaaagaaaagtttgaaaacagaatggtatttattcactcaaatcccaaggtatttgccaaaaaccatgacacttgtttgacacaaaaatacatgttacgaagaggaagactttctctttgaaatatcctgctgcagaggcccgggtcatcaacaccaactgctcaactgtgaaggctcccgtggccaggctgagggctggcccaacttcaagggacagaggatgtgtctgtggcctctagcttggactgtcctcatggttgtttcccgtctgctacacctgctcttgcattcacctgcacgctcccaaggcagggcccccaccagagtaagaagggatcttctaggtttcagcaggggagctgcggcagggctgagggatggggaagcaaagctgctgcgggggaggtggactcagggcctctgcccctgcaggcccgggctccacagtgacctgagtcttctctcctggatgacagccaaaggggagaccacccgggatggggtctgtgtgggcaggggcagcacacacccacaggactgagagtgaggacccccagccaacacagctgaggggagaagctctttcagcctaaagcatttcaaaagggctacgtgtcaaagtcccctgatcaccatggcaactgtgacatgagaagcgttcactaggcaggctgcttctcctacacaagactcctccttcacagatg

SEQ ID NO: 64412 - DNA, 756 bp, Bovine  19866881217766
cctttggtgatcagggttttacagtgatcacggggctcatgtttagcgcgtcatgacccgaaggttaggtttcttgctctcacttgataagatgggagtgcctaacccgggggaccggctctggagctgtagtgtctctcttctctgccctttcttttaaaggagagatgtttgctctgttcctgccgggcgctgaagaagcaggtgtgtttgtgcaggtctttagggcatctttaaagcaaataggtttgataaaatctttttttcctcttcccttcattctcctgttactcctattgatccaggtctttccacgggcacagagtacgctggccgtgtttgtacagctctgcagagagatagtcgtggaagcctgctgtatagaaactgaccctgtgacggtgaaccggagcccagggggtggccagctacttcctcccctttgagagtttctggcatttggcagattttctcttaaactcctttccccagcgtggcctggttcctttgttgccttatttggagtgcataccagctattgtggagtaataaaacaggaggagaaatcaattccctcctgggccctttatggagccttcaagctcactggggtcgggccctgcacttttcagactcaggtatgttttttggcacgttaaggactgatgtgagtgggctgtgtgtgaagtgctaagttgactgatgttaaaagtgggcttccttggtgtctcagacagtaaagaacccacattccag

SEQ ID NO: 64413 - DNA, 1737 bp, Bovine  19866881220174
atttcagtcgaagcctgactttttccccccaacacttgaattatgggctgaggagataatttgaatttgggggtcctctctgtcatttttttggtaccaaagtctgaaagcaaggatggccacatttactaattcaaaagcaaaaataaatgaataaactctgccaaatgaagtagacttactccaatatgtgcttttaaaaaagtttaataaagggctttgaactgggatgggtttattaacacataaagaatcatttttatactctcagataattcagttatttagatagtgtagattaaaaaaaacaaaacactttgctacgaattatcacacaattatggcaaacctaggagtttatatttcctaggagctgctaacatagattttaacccccaaattaaggtgaaagagtcattacttaaagaaaaattattattgagagtaactgaaacttctgggaacacagagggcatagtgtaaatataagctattatcacccttattcatcagaaaacctttttaaaaggttactcttgactagtgggtaaaattttatcaacacttttatctctggtgatttaaaaaatcttgaggcctattttaagttttcatgtttgatatatttgtctgagttgttaccactaataaaaataatccaaaaggtgcaaacatttttttaaagagaagttgggtgtttgacattattttcaataccttattttactatttaagaagacataaaaaaatacactttgtgattcggcctaggtttccttctgcagagttaatcgtgaacaggaggtagatttgaggggaaagtttgttgttgcttatttaaacagttcaccatgaaacactccccagacgtcgccgggaaagtgtttttgtagctggaggctgacactgggatagtcccgccaggagatcagaaaaaaatcagccaggctcagagacggtcagtttgacttacttgaaatggacacttctctgggcaacatacagacaaaaggcatctctacagctttcttggaaaacggtagcgtgtaactccctcccctttcaaaattatgatatacaaacttttatgtctgcgttatgactgagaggaaatatagtttaaattgtgattctgattagatttccatttgtggcgtttatcatgaacacgagctgtatatgttacctagccagtattttggtcatttttaattatcgtgttcaaaaacaatcatttttatttcccatatgaaaagagaaaaatgacagaaggatataggatgccagacagaacagcctgatgggatgaactggaatgccctggtatgtacactggtagagccttttgatgtgtcaggacatttcccatgactaagtatccctaatatgtgcccaccaaaggatgctaattgaagtgcagttctagctgtgatactgcttggctttgtgtagctccctatagtttataaatcacacaagatgggcctttggtatgattttcaccgtgattctaaagaagcggtacagtaggcgttgctttcttatttaaattatggttcagagagattaactgccaacccttatcagacaatgaaaaccatacaactaaatgcatatccttttttgctttggctgctagggagctcagatctgaatttaatgttcagttaaagtgattctaaccagtttaaagtatatttggccaatcattttaaaagtatgtgaaatgggtggggg

SEQ ID NO: 64414 - DNA, 1369 bp, Bovine  19866881290135
cagcctgctggcatgagccaaaatgcgggaaaacgagaaggtacctctgaaacacgcttagaaggaaaatcattccaagtcataaaaaagatacagagaccggtagttgcctttctgagcaccaaagcatccagtgttaccttaaaaataataaaaattggaatgactttggcaagggtctcatttgaaaagaccctgatgctgggaaagattgaaggcaggagaagaagcggatgacagagggtgagatggctggatggcatcactgacttgatggacatgaatttgagtaaactccgggagctggtggtggacagggaggcctggcatgctgcagtccgtggggtcacaaaagtcggacatgaatgactgactgaactgaactggcaagtgtaaagatgcgggcatgctagcagcctcagacggactttctgaattcctgttatcattgagagaggtcccactgggaaaagggaactgatggtatgtcgaccctgtatgtgggcacccggggctctgggttggtcgcatccgtggccacacccagttgacctgctgcagaacccagcctcctaaaagggtcacaaatgacatctgctggaagtcaatgccccagcggccctggctctgtgcttctagaaatggccatgattgaattggatgaagactcacacctaagccaaaaaaaaatcaatcctacttttggccgaactagtctttattgacttagagagtaaattcgaatcacagcaggagacagaaacaaagctcctttctgacccagaaaggccccctgcatctcctggagtgcctgtcctggggtgcccgccatcctgggagcagcaccctgaagccgtggtcttcgccctggaaggcagtcttcttgctccccctctccactcggagctggaccgcctcctgctgtgggggcttctgactggttctgggactgatgctgttcccgaggcatgtcctttttacctcctgggctttgggggagcggaggcccacctgtctggtctcatctctaagtagaatcacttggttgcctcgctgccccggggccggttgacacgagacacgccaagcctgggccagggcctgtggaccagcaggagcgcctcccgcgacggccagatgggcacgtactctgctgtgttgagagggaggcgttgaattgtctcaagttcgtgccgcggggagagccccattccagctgacctgtgggggacagggaccggcagcacccactgtggtctcacatcttccttccccagcctcctgctttcctgaagaccctcaggggtgacaggaaactgagggtgaagggacggggaccgtcagcacccgctgcggtctcacatcttcc

SEQ ID NO: 64415 - DNA, 716 bp, Bovine  19866881378867
tgaaatctaggaaccaatctgatcactgaataacccctaacctaaatctgagactgagtctggcagttaattgagtgaatagaacactgcaccttagtttattcaagaaaatagaagctgcctgctgccctggttagtagttcagatgaaataaagtttataaagtatttgatattttgtaaaccactccagtatcctctcctggaacacccccatgcacagaggagcctggtgggctgcagtccatggggtcacaaagagtcgggcacagctgagcgactaacactttcactttcaaaggaatacacaactgtaaattgtggaaatgaatgtcagtcaagctcagtgttttcagcgctaggcagtctggggtatggaactactgtactccctgggaggaaatgtgacatctagttatgtctgccaggtgaatgcaaacacgtctctgtcttattatgtgttgtggatgtgaaagtgtgtatgtagacatttttaagatgtgaattaaaaattgttttaaaactccagggttttatacggatcagctgttgccagtattgtaaaatagaatttcacatgaactgctggaagaagttaaaaacaacaaccttcaatgataaaattgacaaggtaagactaacaagattttctggattttttagtatgcttattgtatatgatttttcttccccgagaatcttcaagaaaagtcttaa

SEQ ID NO: 64416 - DNA, 1274 bp, Bovine  19866881577547
cagctgagtggctacagcaccagctgtggaaccgggtgcctgggtttgactgcccgttctgctctggacttgagcaaccaggtgagccgtctgggcctcactgacctcacctgcgcagtgggtccgtggcagcaacggcactgcacagggcccgtcacagagacacttcggtgtacaatcttattctcagagacggcttcaaataaacgtctcccagtaatcccgatctgcttttaaattctggacctgcaagggaccttcgagacaaagaagcctggcccccccattttccagatgcggaaacttgggtcagggggatgaagacattggacagacacagccttgtttcctggcagaactgttttagaacccaggcaccctgcctcttggcaccaaggtctcccgttcttgtgctgccttgcatttcctgaaacgaggaaaaacaagttggagctgtgggactctctcctgatttcggttcttccccctgttttagcctcagaaggggaaatggactccgagccccgtggacttcacgatcacacctgacaccttgcagaacgtcaaagaggtaacgtgctccgtagtcgcggcaccagggcgactttccttccttccatccttctctctctcggctgtgctgggatttcattgctctgtgcgggctttctctggttgcgtcccactgcccccagcgttgcagcgcccaggcttctcactgcaggggctttttggggagcgcagcctggtaggcttcctagttgcagcacgcgggctctgtagttgtgaggtaccggctgggtttcaaagactcggtgtgaaaaaagagaatttaaagcatcgtgtatgattgtaatatactgattgtatgtggaagagacagtattttcaatatactgaagaatttcacctgtttcctcttactttttttaatgtggctagtagaaaattttaaattacacgttcacttcttcacatttgtggcttacctcatgtttctattggacagtgtgttctaaactctgaattgacttcagggtaactgggaccccgccgtaggaaggagtgctaggcagtgtctctagctcttcagacccattcttcccaccacagcgtcactcccccacgaccgtattcctctgtccagagagaaaaggtccctaggtgtttagtccagcatggaagaaaagttgttctcttcacaaataaagttaatctcttcttggtttttcaaaactgcataattgggaacatttttaaattattttcttttt

SEQ ID NO: 64417 - DNA, 1924 bp, Bovine  19866881969920
ccttctccctttcaatccatatttagtaaagccatactgaaaatcgggtctgtttttttttttttttttcccccttgaagtgaacctgctaattctgtccatcaacctcttgtgtcttttcaactattcgtttttgtggagctttgaatctgtgaagcgatgtctacgtccagtctcatttaatttaactgtagagaccaaatgcttcagttgggaagttggtccccgttcctgtcatattctttgctgcttagaaataagaagagtttacctatgtatccagactgtatttgtttcttgtggctgctgcaaccgtgaccacaagctgggtggcttcaacaacagaaagttgctctctcccagtcctggaggccagaaggccctcatcagggtgtgtgcaggggcgcgcatcctccgaggttctagggggcgggattttgcatctgtcagcctctggtagttcctggtattctatggctggcagactcatcattccagtctctgacttcgttttcacgtgaccgtctcctctgtgtctgtctccttctcctctggttcaaaaggacatatgtcattggatctagagcccaccctgggaatctcacctcaagatccttaattacatctcccaagaccctttttccaagtaaggagatattcacacagtctgggtatcggggcatagacatacatttgtggggagggtgggccgtgattaacccacaccactgaaggaagaacagcttgtattactaagaagctgacagcaggaagggaggcggaacatccctggtcagcgtcctgggagggtgcgggcttgcttgcatcctgtcgctggtgcggggagcacttagacatgtcctcctctgcagctttgaaatgaaaactgcagcctcggttatactcatcaactaaaaatgggatgaaatgacctaaaaatagtcctaagtaatctctggctttaaaattggcccagattcccatgttacttagaaagtgtggaaagaaaaacttggaaaactatcaactgcctaaatggtcattacctaaggattatttcagattttggctttgtttcaggaaacatattcattttgttttcaatttatattttgttgctcttcccttaccccgaccccacacccctcagtgtgagaacttggttagctcagcctcatatcagggtttcgacgagggctgagcccatgaagacaaaagtggctttcattattgagcttgacacaaggttcgtgattgcagctgacttgcacatttctttaaaattatacttttatgaaaaaccaactcttccaacgtgtaaaaattaccactcatttcttcccatgtgactgctggggatcttgtatgttcttctatgaactaacgtttctgggaaagaattaaaaaaaaacaataacaagtatcattccatttctgctgataattttgtgtgtttgaggttacagagttgtgatactggcagccaggaggtaaattaaacattaatgctctcttgattaatagatttttttttttaaactgggatttataattcaccctcaacctcttttattctgtttgggctcttcctgacatagacttggccaagatgctgtcttttgtgttgcatttttaaatgtctgtaatttgtattggagttattttgagttgtgtactaaaggtttccatttaaaaggatcataagattataaaaatttgtaaaacatagtgcgtagtttttgtaatgcttcacagaacctttataaataactttttgaacaataagcagatcaaactccagtgctgagaacatcaaggtccattcagtttgtgtacatttatcactattcagcaaacatttttgatatagttcctgactggtacttaagaaaaaagtgatgagcactttccttaaacttactgc

SEQ ID NO: 64418 - DNA, 1973 bp, Bovine  19866880195876
ggttggaaatgacgagtgtattcccttcatttgcttttgtgtgtgtgtgtgtgtgtgtgtgtgcgtgtgtgtggttttaatatttttttaatttaaatttatttattttaattggaggttaatttggttttgccatatatcaacatgaatctgccgtgggtatacacgtgttccccatcctgaaccctcctaccatctccctccccgtaccatccctctgggtcatcccagtgcaccaaccccaagcatcctgtatcccgcatcgaacctggactggcaatttgtttcttatatgatattatacatgtttcaatgccattctcccaaatcatcccaccctctccctctcccacagagtccaaaagaatgttctatacatctgtgtctcttgctgtctcacatactgggttatctttaccatctttctaaattccatatatatgcgttagtatactgtattggtgttttcctttctggcttacttcactctgtataataggctccagtttcatccacctcattagaactgattcaaatgtattctttttaatggctgagtaatactccattgtgtatatgtaccacagctttcttatccattcatctgctgatggatgtctaggttgcttccatgtcctggctattataaacagtgctgcaatgaacatttggttttttattgataaaaatatactggttctttttagaatctagattgcagaaagctttataactcttgaaatttatgctgtataaaagacacttgaaagtatatggaaagacatccaaaataaggcaaataataatgggttactattgacatacttagtttcctcccatggcagcaatgataattatctgagtcacaagctacatttttttaagtgatgattttaacattaaagccctgaaacaaggtgtttttccaacattggataaatatttaaccaaagaaaagtgagcagtttaaaaccagtcatgtccaggtaacagatagcaagggccagagtaattctttaattgaatcacataaactacaaaaccatgcatcagtcagattcctcagtttatctagagtgatgcagactttgaacaaataggaaatttaatctgttatgtaagagcaccattttgtggccattaatgaactttttatgtttcttttggcagatggagatggaaacatggatcacttgctgccaggttgtgaagacaaaaactgccagaaaagtgtcatttacttagcaagatctggagcaaagcaggtatatctacttgttttttaatgtaagtaaggttacaatcttggaaaacaatttcagaggttagaaaagtatttgaagaatcagaaaagagaaaaaacaaaataagtttacttcctcattttaacttgttgttcagtcactaagtcgtgactgactctgcgattccatggactgcaacatgatgggctttcctgtccttcactgtctcctaagtttgttcatactcatgtccattgagtcagtgatgccatccaaccacgtcaattctctcctgcccccttctcctgcactcagtctttcccagtatcagggtcttttccaatgagttggctcttagcatcaggtagccaaagtattgcagtttcagcatcattccttccaatgaatattcacgactgatttcctttaggattgactggttggatttccttgcagtccaagggactgccaaaagtcttctctagcaccacagtttgaaagcatcatttctttggcatgcagccatctttgtggtccaactcttatcatacatgactactggaaaaaccatagctttgagtatactgcccttgttggcaaagtgatgtctctactttttaatattttgtataggtttgtcatagcttttcttccaaggaacaagtctcttttaatttcaggctaaagtcaccatccccaggatttggagcccaagaaaataaaatctgt

SEQ ID NO: 64419 - DNA, 1509 bp, Bovine  19866880637654
aatggagagttgcatctttggaaattcataacttaaagggcttatagatgtatgggattgtattgaaatgtatgtattataatggaagtgataaggaaatgttttttctattttagcatgtgtatttccagctttatgttgataacaacaaaaatatataaacatgagtacattatctgatgtatgtctcacatgttttttgacaaatgtgatggaaatggtgctacttctacctatattctgggtctaatttagcaggaaatgcagttttagaaatttcgtataggaatcgttcagcattgggtcccacatgttaaaagttaaggaaaaccttgaattctgtttagactcttctgccattaattagttgtgttacttataatatttatatcttgagtatgctgtggccatccatgagtaaattttccagatgatggaaggagtcattttgacttactccccatttgagctgtcatgacatgttctactgtgtaattcagaaatcactgatttatttttattactgaactcaagagttccagggtattgatcaacatatttagtaatctacttaccgttttttttttttttcccatctatagagtattattcatcagatcctaaattaccgctttcatttttcatgatcaaatgtttcagtttcctactagaagcagtaagtgagtcttggaagtgaaaactctgaagataaagcactctgttcttctggtagttatgcatgttttactctcttgcctatctgctacaccaaatataccactgtcctaagtacatacagcgtaccacagtgatagaaggggtatatataaaaagtgtactcgtttaggattgtttactgctctgtcatttttcccaagttatttccccaacatttaattctcacaatgacccctttctatgttccttttgatcattttacagataaacataaataaaacaagagacattgagattcttttctgaaaatgatggatcattcactaagttttgtgagacagctggatataaccatttgtaaaaaagaaaaaataaagtactgtaggatcattgttgtttaggcactacgtcctgtccaactccttggtggacagaccccatggactgcagcactccaggctttcctgtccttcactgtctctcagaatttgctcagactcatgtccattgagttgatgatgccatccaaccatctcatcttctgttaccctctactcctcctgtcctcagtctttccctgcatcaggatctcttccaatgagttggctctttgcatcagatagccatagtattggagcttcaacttcagtccttccagtgaatattcaatgttgatttccttcaggaatgactgatttgatctctttgctctccaagggattctcaagagtcttctccagtaacacaattcaaaaacatgagttctttggcactcaactttcttcatggtccaacgctcacatccctacatgactacaggaaaaatcatag

SEQ ID NO: 64420 - DNA, 2054 bp, Bovine  19866880711735
ccttgactagacggacctttgttggcaaagtaatgtctctgcttttgaatatgctatctaggttggtcataactttccttccaaggagtaagcgtcttttaatttcatggctgcagtcaccatctgcagtgattttggagcccagaaaaataaagtcagccactgtttccaccgtttccccatctatttggcatgaagtgatgggaccagatgccatgatcttagttttctgaatatcgagctttaagctaagtaaagtaattagcttccaattaaaataaattaattaaaaaaacacttgatatttagtagctgcccaataaattctattttttatctttcctaaaaatgtgtgtttaacaatactgctggtttggtatttaagactgattttacaaaagcaaacatggttgcttatcattttcccttattttgacataaactcatggaagttacttgattaagaaggctagtcatgataaaatacaattggatggaatcagattaaaacagaatctaccacttgttttaatctaagtctgttcatttttgtcagtaatcattgcagctctaaagaaattgtttctgagcgtttccatagaaactcttatcagacagcaaggagcgccatcattatatacaattagaagagatatttggtttatattgggtatgttatgggttcccttcatgtaggattgaattttgaggagcacttgtaaattgtttcctgcctgatctctgatctcttcttaccatgtcctgccctgacatcttagaagatttaggaaatggaagccatatgatattatttaactatcttggcatcaatcttattgaccttaaagctcattctctttctctgtcatttgttgttcagttgttcagtggtgtccgctgcgaccctatggactgcagcatgccaggcttccctgtccttcacaatctcctggcatttgttcaaagtcatgtccattgagtcgatggtgccatccaaccatctcatcctctgttgcgcccttctcctcctgccttcagtccttcccaggatcagggtcttttccaatgagttggctctttggaactacagcttcagcatcagtccttctaatggaatattcagggttgatttcctttagaattgactggtttggtctccttgctttccaagggactctcaagagtctacttcagcaccacattttgaaagcatcaattcttcagtgctcagccttccttatggtccaattttcacatccatacattactcctggaaaaaccatagctttgactatatggacctttgttggcaaagtgatgtctctgcttttgaatatgctctctaggtcatagcttttcttccaaggcaggcatcttttaataccatagctgcggtcattgtctgcagtgattttgcaggccaagaaaataaattctgtcagtttccattttttccccatctatttgccatgaagtggtggggccagatgccatgatctttgaatgttgagttttaagccagctttttcgccttcatcaagagcctctttagttcctccttgcttcctgccattagggtggtagaatgattattgcttgcatcttggaaatgttcactgctcttctctcactcactcatgtcaaattaactgtttagtggacctctctgatgttgtggaaattctgtaatagagttggccctctgttggctctacagtctgagaaagcagaaggccgacacagccatgctgttttatttaaggggcttgagcagccacggtttttggtgtcattggcaggggtgatgtggtcctggatccaatcactggtggataccaaaggacaatcttaattctggtcttagagatactggtaaatgataaaggtcttaaagaggagcttataacctgatggaactttttgcaaagttaaaggtgacttcagtgcttttgcatgcctgtagtctctaacaagtagttgtttcctacttaactttgctacctatagccatcacctcccattgtaccacctctctacttagtctgttctacaag

SEQ ID NO: 64421 - DNA, 1686 bp, Bovine  19866880801275
ttgtttttggtaatgttttgaagggattgggcttttcttttcccccgtgctaggttgaactctgagtcaaatctgatagccccaacattctgagaatggagatttcctaaggagttgctagtttagacaaatactgatagtgttatagggatgagaattttaatggggctccaaaggtcagtcttgtccactgactgtgaggctcctagctatttatggctgctgcaccatttagtagacaggggaggtgggatggaaacagttcacgttaaaatgccccagaccctgccgtcttaagaatcaggagttcctcctggatagacagtgctcagaacattctgtggctttggttaatttccagagttctgaaatagttaatattatttagccagcattttttttttgtttgcttattggtggggggaggggacagcaggttcatgaagtccttacactggcattccaaaaatcaatctctcctattataactcacttttaaagactgttatttacttgctaggtattttcaacataattaaacaaactatttaaatgacagggttacttaatatctaaatactataatctgctatggagtctgctaaacatctactaatgttacccagaaatatgaaatcattggaaagtatatatatctaattttttatataattcttatgttagtaagagaaaggtataatgaaaaggaacagtgaatttagggataactgttaataaagtttatgtatgtaaaactataaagcaatatagttaattgcaaggggtatggaattactttgccttgtagacttagctgattgaatgaaaatgcttaaaagagtgcttcaaatatagtaaacactgttaaagtaaatgttaaatatatacatatttcattatacttagcaaagactgacttaatagacatcaaactagacttataaactgtttctctataactacctcactgaaaagaaccaaataaaaacatttatcaatactctgttaagaagatcatagaacataaattccaaataaaactgtatatttcctaagaaaacttaaaaactattaaaaagaataatgaaaataaattatcaaaaaatctcaaaatgaagacatagttacattttagcatacttttaaaaaattttagcatacttttaatcatgtaattttctgcctaggcatgtgcatgaacaagtaaacacattaacacactttattattactgcccttcactcaatgttatttcataaatattctcatgttattaacattttttaaaaatagatgtgcggagagaaagattattggaacactgaaatcccattaaaagaaaaccaaaggtaacagttaaaagacagacaatacacaagcctttaaaaattatttttataaaagtgtatctatacagatgttataagaaacataacttcattgtttacatagtatcctcttattccataatttaaaattaacattttactgatggatattaaggatttctcctaatattcattattataaacaatgctttagtgaacatctctgcatcccaatatttgtctgcatccaaattattttcttaacattcctatacacggaatactagaggatggagcatttattgggtaaatcatttcaacaaatggtgttgggacatggggatgaatacatgtaagg

SEQ ID NO: 64422 - DNA, 946 bp, Bovine  19866880866683
ttggttgctgttcatgtacaaatggcacaaagccccagagtgtacccttactgctaaaatcctgtaggacaggaatccactgtggattaagagaaaaaaattagacattatagtcattttagaaaaaaaaaaatcaccatttgtaaaacaaatgatccacaaaaaatcctcaagatatgtatcatctttcttaagttgtatctctgtaaaatggcagagtactataatttactttgataagtaggtaactgacactctaaaaaaaataagtctaccttaaaatttatcagtagtcatctttccttgaactagcatatagaaccttaaaaagtttttcacagaatatggaatcttaggattgaaatgatattatcaaacatttagttgaactgtccatttaaaaacgtgtgttggggacttccctggtggttcagtggttaataatccaccctgcaatgcggggacactggtttaatccctggtctggaaagatcccacatgccgcagggcaactaagcctgtgagccacaactactgagcctgtatgctccagaacctgtgctctgcagcaagagaagccaacacgatgagaagcccatgcaccacaactagagaagtagggcccgttttctgcaaatagagaaagactgtgtgtagcaatggagacccaacgcagctcagaaaaagataaaattaaacaaatgaataaacagaatatgtgatgagtgaaagtataaacataaatgaatattttaaatttcgtaatatctaatactgatatcctttggaaggaccagtttaggaagaaaattagaacatgaccagagtctcccttgttctgctctgcctcttatacatgatgatgagtttagtcaccatactcagaaacaagcagctctgaggctttcccaacaatactagccctgacaagccgtcccagcccagg

SEQ ID NO: 64423 - DNA, 751 bp, Bovine  19866880934661
tttatggtgttatactatagaacagaaatcagtcttgtttaatgcaaagcatgcctggtattaatagatggcaaggatgtttatcaccctgttacttcccacctaaactctctctgctctaattgtttataaacagatagctactattccctggaagaaaagtccatggctttattattaacagtaaataatgaacacaggttcatttaagaaatgattattgtttttaaggccattatgaaattacttctaattaagcattttgatatacctgttgatttgagggtattcactttattacttttgtgtagtatcagaattttaaaatacatagttttctttgatttgtaggaatcactgagacattagtaacttaaggagatgaaagaaattatcatcaataatatggacagaacttgaaaaatcagaaaatcttagtcatgtgaaaaagttaaagatagttttttaatttaaaaaatgttaaaaaagcaacatattactattataaataatcaaaatttcatttaagtgaacaaaccttttcctgccaatgcaaaatgccaattatcgccaagatgaaaacacagacaccaatgagagcgatagcagtaagtagaacaatgttgcttggtgtaagatacagtttggcactccagctgtagatgaaaagagaagaattaaaattccacatttaacttaaaaataacaaaattctattgtgaccaaaaagcaaaagttcttattaattaat

SEQ ID NO: 64424 - DNA, 4010 bp, Bovine  19866881378610
ccttttaattgctcttcagaggcagcttgtctgggagtccatgttggactggaacatagtactgtgaaaaaatagcaaattctcactagaagtagagaagaataggacatgctacttgagactgcagttccgttcaatgagtatttgggagccaggtcctggttaggcatcaattcaaactatgaaatcaggataccttggatacactctcagagagtttctctataactttgatccaaaccaaagtactgttagtggagaaacatataataatgaaacagagaagagtaaagaccttttggaggaagctgatttatttagagccttgaccaatgggaatgcctttgacattggaatattcttcattgatggggaattatggggacatgattttgtttaaacttgctcttctttctatagttcccaatagtctacaagtgtgaccttcctgattttgacaaatgtactaaggttatattagatgttaagattggagaaatttaatgaagggtatatgtaaattttgcactgttggttttttagtgaggtaaaattcacatcacattattaaaggtaaccattattgcgtacagtttagtgatatttagaacatttacaatgttgtgcaaccatcacctggtttcaatggcttttcatctctccaaaagaaaaccctgtatccactgagcactcacgctgcctttcacatttacgcccgcacttagtaaccactaatctgctttctgtgtctagaatttttattacaggtatttcatataaacaaaatcataaaagatatgaccttttgagtttagtttctatcacatagcatgttttaaaagtccgtccatattgtaccatttatcagcactctggttgtttttatgactagatattattttcattgtatggctatgacagtttgtttatccattcatccattggtggatattcggtgctactgagatcattcatgtatcagtattggtttgaatacctctttttcaattcctacgggtatatacctagatatagaaatgcagagtcaaatggcaattcactgtctgactttttgaagaactgccaaacttttttccataactaaagcccattttgtagttccaccaccaatgtttaagagttcctatttcttttagcattttgattcatttgagttaatttttggaatatggtatgaggtaggagatctaaactcattcttttgtgtggctcaaaactttggaattaatatttttaaaagataattatcattctccacagtcttgggaaagtatcactcatgaaaatatcaagttacttttcttacacttaaagaattaaagatagtaataaatgtaagagctgaaactataaaaccctcagaaaaaagcatttggaaatggattcttatacctggtagtaaaagaaaaaagctacacaagttaaattggatgaattggatatatcaaaataaaaagattttatacagcataggacactgtcaagagactgaaaagacagtgtacagattgggagaaaatattggcaaatcatgcaccagataaagatctaggatctagtctacataaagaattcttatagctctaagcaataaattactcaatttaaaaataggcacagaatttgattagacatttctccagagagatacagctgtccagtaagcacatgaaaacatgctcaaaaataggcaaagaatttgattagacatttctccaaagatgtacaaatggccattaagcacatgaaaacatggtgaacatcactagacatcaggaaaataggaatcaaaaccataagaatctttcaggatacctataataagaggaagggatagtaataagtgtttacggtggaatggagatcttgcagcacccatacatggctagtgagaatgctggatgatgaagccactttggaaaatggtttgacagttcttcagaaagtatggagttgccatgtgactcaggaattctactcttaggtatactcagaaaaatcaaaaacatatgtgtatgtccacagaaaaacttgtacatgaatattcgtaacagcattcacttttactagcccagagaggaaacaagtcagatgccgatcaacatttacacacagtaacaaaaaaatgttttgaaattagattgtggtgatggctgcacatactacacatggtgaacatacactaaaaccactaaattgtgcacttcaaaggagtaaagtttagagtatataaaaaaactaagaataaataaaattttaaaatatctcgcttgcagaaatttttgttttaaagcagtactcatttgctgtttaccctaaggaaaaaaaaatttttttttttttttttttagaaatttatcatggcatcctgcattgaccactagaaacaaaatgcgaattccacattctcatgcattcattgatctgactgaagattttacagcaggtgagttgcacataaatgtaaaaatgtctttttggatgccaaaaactggtgagatatttgctgtgttcctagtaaacattttctgttgaattgaacattgaaaacaaaatgtgaaaagggtacaaggaagtcagtgatatcaggaaaatgtaaaaagtactggatataataaaatatacctgtagttcttttttgctgtttgttaatcatataaaaatttgaattattgactaataaatgctgtatatttaattatgagaaaaatgtttagcttatgtattaaaaattgcaaagattgattttaatttttattacaaaaaatgttgaacacagaaaagtaggcagaatagtatgatatacacatatttaatcatcacctagcttcaacaataatcagcatatggctaatcctgtttcatttgtataatcacccatgatcccctcccacctaaataaatttatcatttcaaacattttatcatttcatttataaatatttcgatctgtagtcatgtccatctgtttgcaacgacgtgggctgtagccgccaggctcctctgtccatggaattctccaggcaagaatactggagtgggtagccattctcttctacagaggatcttcttgacacagggatcaaacctggatctcctgcattgcagacagaccctttcctgtctgagccactaagacaggttgttaatttttaacaaccacaagatcattttcgaacttaaaaaaaaaaatgaacaaaattctcttaatttttgttgttcagtcactaagttctaagtcgctatgccttgagactccttacactgcagcagggcaggctcttctgtactccactgtcgtctcccagggtttggtcagattcatgtccatggagtcgatgatgccattcagccatctcattctctatcaccccctcctcttcccgccctcaatcttttccagcaccagggtcttttccagtgaatcagctctttgcatcaggtggccaaagtattggagctttagctttagcatcagtccttccaatgaatgttgaaggttgatttcctttaggattaactgatttgatctccttatagtccaagggtctctcaacagtcttcaccagaaccacagttcaacagcatcagttctttagcattcagccttctttatggtccaactctcacatccgtacaggactactgggaaaaccatagctttgactatgcagatgtttgtcggcaaagtgatgtctatgctttttaatatgctgtctagatttgtcatatctttctctccaaggagcaagagtcttttaattttgtggttgcattcaccatctgccctgattttgagcccaagaaaagaaaacctttactgcttccactttttccacttctatttgccatgaagtggtaggactggatgtgatgatattagttttttgaatgttgaatgttaagccagctgtttagctctcctttttcactctcatcaagagactctagttcctctaggatttttgctattagaggatatctgcata

SEQ ID NO: 64425 - DNA, 1531 bp, Bovine  19866880518329
tttggactctgtgggagaaggtgagggtgggatgatttgagagaatagcattgaaacatgtatattaccatagtgtgaaacagatgatcagtccaagttcaacgcatggaacagggcactcaaagccagtgcactggatcaacccagagggatgggatggggagggagctggtaggggggttcaggacaggggggacacatgtacatctatggctgattcatgtcgatgtatggcaaaacccaccacaatattataaagtaattagcctccaattaaaattaattaatttttaaaaagaacataaagaaactactcttagctcacgggttgcataaaaataaggtgataatttaaaatgtataaccaacaggacctactgtatagcacatggacctctgctcagtgttatgtggcagcctgggtgggaggggggtttgacagagaatggatatgtgtatatgtacgactgagtcccttggctggtcacctgaacctctcaccgcattgttaatcggccataccccagtgcaaaataaaagttcaaaaggaaaaaaaaaatagtgctaggtaagccttaaaaaaaaaataaggtgataggttcaatttggcttgtgatccatagtttgccaacccctactctagagcctaaaatcaaaacctgcagaaatgaagaaacttaagtttaaggatatggaagaaaaaaaaggaagacaaaaaaaaaaaaaaaaagaatatggaagaaccaggactgtgctctactttttcctgcttactcaagttcatgggttgtaccctaacgtaaagaaatgaaaataatgaaagctacaaggaggtaatttaattatatgtgggaaaggggcattttaaagccaagagccatggctgctatgaaacattcttaattaaagccaagtcagaatgcctggcattataactccacatgccttatctataatacaatacactctttctattagtaatgttctcttccctctgccacaaaattgtatactattactaactgcaaactctgcaaatattaagctaaagggtcataggggaggaattgatgttgttcagtcgctaagtcatgcccgaccctttgcaaccccatggacggcagcatgccaggcctccctttccctatctcccagagtttgcccaattcatgtccactgggagaggaaagcactaagttaaatttttacattacaatacttgttgtcccatcttggaattagtggatttaaaagaaagatttgctctaatcttctccattaatgaaaatttatgtataatttatatctaattaatatagcattactttgaagaggtgatgattgggcttttatatcatttaacatttattgaaggtagcccatgttccagaaaatattctaggctctgagtgcatggtctgtgcgtgcacgctaagtcacttcagtcgtgtctgactctttgctattctatggaccatagcccgccaggctcctctgtgcatgggattcttcaggcaagaatactgggagt

SEQ ID NO: 64426 - DNA, 1527 bp, Bovine  19866880811772
caatctgatacatgagcaatgatatctcagtgtattttcaatttgcatatttttataaaggttaaagtcatctgtacttggtcagcgctgtctgtctcccattttttaattggtttattgatcattttctcattgctttgtataagcattttaggtattacagaaatgagctcttggtgatacgaactgtgaatatttttccattgattattcatcttttgtttttgttttgtggtttaaataaattttgtatctagttgaatttatcagtcttttattatggcttttggcttatgagtcacaatagaaaggtctttctcatttcaaggttttaaaagaattctcccatgttttcttgcagaacttatagttgatccatttggaatttatcctgatatgagatataaatccaacttttctagatgaaattccagatgtcccaacacctagactatttgttgaatagtccctctcttcattggtgtgagatgcgcctttcgttgtctaataaatttccatatagacttggatatatttctggattttctattctgtttcagtcattgctgtgactgtttatgtgccagaacttgatttttgtgtataggtgtgtatattttatcattccattttcccctctattagtttggaattctgtttttagtgttcactttgtatgttacaagacagtttttatttacttttttatggctgtgcagggtcttggtggcttcccgggctttttcctagttgtgccgagctggaacgactctttagttgtggagtgtgctttctggggcacgtgggctcagtagttgcgagcacaggctcagtagttgtggcgcaggcgcttagttgctctgtggcattgtgggatcttccctgctgagggactgaactcatgcctcctacattggcaggtaaattccttacccctgagacaccaaggaaaccactggacagcttttaaattcatttccccacctactgacttaggtgcctctcttgtcatgtgttttaattctctttatagtattttttaatttatgaaatatttgtttatttgtaaaacttagtaagaaatgatcatgattgttttatgtagtcagtgtttatttaaatttaacatttttattgttcctcattatatcctgtattctctgactttccatcttggaccattttcctgctgcttctagagcctcctttagtgggagtctacttgtgacaaactcactattcattttacagaatatgccattattttgagcttcatttttgaaaggtattttcgataagaatagcatcataaggttgatttgcagcacactgaagatatcatcctactgttttctggcttccattgttggtgctgagaaggccgttgtctaactattaagctttttgatgataatactgcattttgcatgataatcataattgtttatagtctgtctaataatttcaaaattagaattctagagtcaaatttcaaaataattatttctagagttgcgtgggtttcgt

SEQ ID NO: 64427 - DNA, 1049 bp, Bovine  19866880882500
aaataactccacttgacccagagcttgtccccagctgatggtaggtaggtagatagctaggatggtaggcagggatgatagaaccaatgctagtccttggtctgttgctctttgccttgaaacactcataacactgaagcttgatccagatcccgctttttgagcagctgtagaaccagcagatggaaaatatgctcagaagttgttcaatgacctttttgaagactactctaatgctcttcgtccagtagaggatacagataaagtcctgaacgtcacactccagattacactttctcagattaaggatatggtgagtaacatagtgttgactcttctgaatggttcgaatgaaactaacagtgctttctaaagggaatgtcttacctgaatttgacagaaaatgagaacagacagctctgtgtgcaagctggagggagaagggaattccagaggaggaacactttctacaaaattaattgcactaaattacctgagtctttccatgaacattaacagtcttagaacatctcaagaaagttggttacgcattacatgttccatttctatgaaatgtgtaaagtcagcaagaccataaagacagaaagaggagttaggttgccaggagctgtgagaatgatgaggaaatagtgatttactgcttgattgtcatatgatttctctttgggaatgacaaaatgttctggaagcagagaatggggatggttgcatgacattgtgaataaactggaaaccgctgaattgcacactttaaatagttaaagtggtgagtttcatgcaatatgaattttatcctaatttttaaaagatgttttaagatgacatacattgatgctcatatgtgtttagttacacaaagttatgaaacttcaaaatcttttcttctgtacattggttgatgtttgctgactttttcataaaaaaataattcatcagttgatcaattttcagagaaatttgagcagttgacccatgcatgatgatttaaatatttgtccccttgatgttccaaacactaatcaagcagg

SEQ ID NO: 64428 - DNA, 1313 bp, Bovine  19866881390958
ataaaatgattcttccaacaagtagggagaaagcaaaagaaaagcacattaatccccccaattataactcccataacaatagtttgtgtatttcttaacaggcaaaggcaactccccaaagcacttgcttaatattttttaaggaaaggaaggaaaaagagggaaagaaattaatattttaaaggtcgtaactaattattgctggtctatgatagggtagaacaaggcaatttggtttcagtcaaaatggaaactattttgaacagtttgagagaagctgagcctatcaccaaacttgagaagtggactgaaaaagggtcagagtggtaaatatgaagagatgaactaaatgacctcttcaaaaaaatttctagatcccactcctgttctaaccccaaaaaggcccagagatgatgctgaagccatggttcctggagcccagtgtatacttgcggccagggcccacccccagcatggcagcctctgtgagaacaggaacgtggtaggactgaggagtctttggcctcacagagtctgtggcacccttcccagcaaggcagctgaagctgggcacacttcaggagacatggagtcttctgggaagaagagagtcagaaaggcagcagacattcctccacccctggaggtggggaagctgagaggaccttggggagaacaaaccaagcccactccaggggctgactggtgactgtctggtagagagggtcccgagaataaggtcatatggcttctcgaagcctcagtttcctcaagtgtagatggagggtatcggtgccaaacagctgcattcactgagagggttacgtggggtaacgtagatccagcgtctagaactaggcttgttgccaagcaagttgtcagcacatggtggctgttttatgacagccattatttttttatgaaacctggaaagaaataatacagggacagcagagtggaaaaacctgcaagacaatcctctggtacataaaataaacaaaagatctctttgtatggccttttcctccttctgggtaaaaccaaggagcagagatctgattctaaagttgcagtccatactgtctaaaaggaacatactgtaaccaagatcctctgcgtgtttactgagaaaatgaggatatttaaccccatgctgcagggtgagggtcacgtgctgagagccccacccctctactgttctcttgtgatcccggaagtcagagtcctcaggctgagtgatttggggcaatgtatacacgatactgagtgggaggactctggcttgagtgaagactggaaaattccccttttta

SEQ ID NO: 64429 - DNA, 750 bp, Bovine  19866881409513
tcccgccctttggtagcatctctttcctgctctgcttatcttgaattctgttctagtgcagtttctacagatgagcagggtagggtggtaggtaagagggcaggcttttgcaggaggcttcaaatgttggctctgccattttgttggttgtgtgacctttggcaagttactcaccatctctgggtctcaggtttttttgtttgttttttatctgtaaactggagatggcaatagtatttatcgcattgtgctgttctgagtactgaaggaatgaatctgagtagaaaacaataacagtgcctggtacaaaggaagaactatatgagcatttgctattgttattgttgtccttttttgttatgaaacaaataagggtgatatggtaggaaagggaatatttagggcgtactaaggcagaagtctagaaacttacttacacaggacctccctgcctcagagttctcacttacatctaaatcccctgctgacatttaagcctcttcccttttgttctgcccacaggagacatggagaacagctgatcaacatctcataataatcccctgaacacctgaagacagctgtgagcgcttaaagatttgctgaggctaatctgaacacaggtaattgatgatatgttcaaaggtgcataaacctgtattcggcacatgtgttgtgtattaatgggcacttcacaacttctcttcaccccttagaaactggagcgctgggtcttgtctgcacacaggg

SEQ ID NO: 64430 - DNA, 1756 bp, Bovine  19866880279714
catgctatagcatcactgtcggaaaaggcaatggcaccccactccagtacttttacctggaaaatccaatggacagaggagcctggtaggctgcagtccatggggttgctaagagtcggacacgactgagcgacttccctttcagttttcactttcatgcattggagaaggaaatggcaacccactccagtgttcttgcctggagaatcccagggacgggggagcctggtggctgccgtctatggggtcacacagagtcggacacgactgaagtgacttagcatagcatagcatagcatagcgtcataccttattgatctattataaagttggtgaacatttagattattttcagctgtttgctattacaaacaatgcagaaatggactcctttatgtatttcttcctttagttccagtatacaaagaaatggaattgctaaatggtaggaatataatatacctccactttaacagatattattgcctaaatgctctcagaagtagttgtaagaaatttgtgccgttactagccaatagcagcatatgaaattttgcaattgatttccatcctcaacaactggtattgttagaatttaaaattttaacaatctgttaagtatgaatatgtataatccctttgaattttaatcttcattttgcatactagatagattaagcttgtgtggtctataatttttttattgtgagcttatctatagcagggcttatgttttctgtgggaatgccgtgcaccctggtctctagaaagccattttgtctttgtgctgctaggaaggaatcccagggggttcacaggtcctaggctatgcaaatctaattttattattctctttttaaactttctacagaaagatttcagaaaatagtccagtttcattggatggatgtataagactgcatgatttggcttctgcacacttcaacttcagctagaagcttattaccttgattttatactctccttttatttctgttacgtgaaatgtctgatccatgcatcagagttcattagatctgtattcagtggagggaggagctattatgttttattcagtatttctgtgtgtgtgctttttttttttttttttttttctgggatggcagttctatgttaatgaagtctgccatgttgctagatttggaatttcagcatggaattcctttcatgagttcgtatttccctatccctctgcccctattttttatgattcatctacctttccccttatcctctaaaatccagctatgttgaactgcttgcaattctcccaaattcatatcactttgcttttgtatatgtagctaccttttcctagtcattgttaaggatcacatctgcctctacctccctggaaaaactctgagctcagaggttgggctggatggctttgctggacttccactgttatctggctctgcaactgactagatgtccatctatttcgcctactaactgtgaactcctgcaggcaatgacaatgtcttatctttcttttctttaggatggagcatagtggctgatacagagtaagtactcaattaattattttttgactaaatagatgcccagagggtgccttatttagtatatgtgaaaacatggttatgtgttaattatatgcaaggatgtatatataattgcaaacatatggttgtgtaactctggacacacatgcaagtgtgtgtgtgtctgagtatacgcatgtatgcagatatttgctctgctacttctg

SEQ ID NO: 64431 - DNA, 971 bp, Bovine  19866880404776
agaaaagctgagttctgcctttcccaggacttgagtcttcatctttctgcacacccaggtaggtggagagaggacactttggaattctgaaacatcctcatgaagcccaggacgagtttaatgtgactttgagtaaccaatgtcaactctctcaaccttgggcatttcaaccttgggtgtgaaatgtggacaatacctctaactcactgtgtttttccaagaattaaattaggtaaattatttaaagaaactacagagaaccccacccaaagtagatgtttgaaaatgttcattccccactgtttccctttctccctcaaaaggaacattgtgacatgtttacaagtcaagcaaaagttatacatttgaggtgaagacttctgtgagtttgacaacatatgttgccatgtaactattaccacaatgaggtatagaatggagccaccacccctaaaagttccatcatgcccctttccagacaaccacttgtccctacctccagcccctacaaatactcatcctatttctgaacctatagtgctgctttttattgtgacctcttttaaaaacatatatccccaaagcaaatcattctctcaagtttttctttcacatcctacttaaaaatagctcagctctgacagctcagctttcttccaggaaaattcttcattaaaataaatgaattccatgtgcatattaaaaagacattctgcttagtattccttctatttatagtcagagttcaaccagtaggggccccacaggcctgtcagggtcctctggagctcacattctcccctccctgcccccacccagctgcagacctggctccaggcccaggtggcacaactgagtcagagtgcagaaaggggcttggggggagcttttccctatgagctgtgctcctcggctttaggtgaaaattcaggacaccctaaaattcccatgaggaatgtatagcatatagt

SEQ ID NO: 64432 - DNA, 3722 bp, Bovine  19866880518686
tgtaaagttcttgaaaagaagcagggggatttatgactaggtgtaggactggggaaaggcttggagaatatttatgggtaacttcaaggaattccagtgactgtactttcacctgattttgtaccctcaagtttctgctttggcaatttcaagcctgcaaatgcttatggattgaaaaatattttgctttggctgtattctgttaacttctgaatttaggggtgggagagacactatatatatatttatttggacacatttatcatgctgtgtgtaagtatgtgaacatatgtttttattcttttagatttatctgtgactttcttgaggacaggacctttgctttaactatatctataccttcagacctaatataatctctggaaaataggaggctccccataaatgctctattgatgcatattgtttacttaacctttgttgagcacctttttatgctgagtcccatgctggcttctgaggagtcatgtagacagaaggagggagtggggaatttcaaaataaactatactttaaaacataaaagcatatattttaaaaggtgaagcataaagacagctacccttatgcattacggctgactcctgaacgacttggggcactgaccctctgtgcagttgaaagtccacatataacttatagtcagccctctgcacctacgcttcctccacatttgtggttctatattcatggattcaacctgcagaagatcttgttgtgtagtactgtagtattcaccattgaaaaaaaaatccgtaaaagtggccagtacagtgcaaatccatattgctcaaggatcaggtgtaatttcctttggcagccttccatagctagccctgcaggtccatgggggttcatcatttcatgtatttatctcaggtgtcttgcaaagattcagagaagccaataagtgtttattctcctttcaattgataaagaaagagattgatgtacatgtacaatacaggctgttggattggttggtcacaatggtgtaaacaccatcaatgaatcccaaaacagttttgggcacttatttccatgtaaattgtattacttaattctctgaaatgttttataggattggcagtataacacatagttttaaaatgctgttcctcttcctaaaagatctttcttccctttgctgtctgttaaatacacctgatctttcaggatccatctccagtgatatctcttctgtgattccttttcctccaatcccagccagattcataggcttcttcctttctgcttccataagaccttgcatatacatcgagcatggcactcaaacaattgaaatcctttctgcgtgttggaacatgagctcctcaaagcagcttccccatcatattcctcatcacatgaattgcacttaaatccacctggttgctcaatgtagaattttagaacttttcttgctgcattctctaccttttcattccatatcaatggccccaaagcctttgcatcttacccctagctaagctcctctcacctgtgctgcctttgcttcagttctccttaatctcatgtctcttcagactgtggcagcagcctcctaccaggtctcattgtttctagtctcatgggtcgtgtggcttccctggtcaggatagtccagtgcattcccatggcagctaagctaaaactcacagatcttcacatcacatctgggaccctgcgtggtctggcttctccccacctctccagccccatcctgtacccttgctcactgcacttgaaacagtttgacttctttgtcaaatgcttttctacctcaggctgctccctctgcctgggatgctctttctgtcactcttcaccaagtcagctgttgctcaatctttagatcttagctcaaatgttgctttcacagagtgggctttatgaagcttctggggtcctcatcagagaaatctactctttttctctatagcatcaatcagaacatgtatgcatgcatgcgtgtatatgtttgcttatgtctgtctcctccactgaaatgcagatttgttggggaagagatgtatccatttgttgctttttcactattatatgtcagaatttaaggcccgaaggtacactggacatttgctaagtatttataaaaatttaaatgaatgtatgaaaactgaattcttcatatgtgactatcacattggtactattgaatgggtcccttatttttgtttagagtgtttctccacggtaaaagtaagcaaagtatcttttgctaaatatctactggctgtcagtttcctttgagtcccaccttcctggcaccaaacagcatttggagggtgccaggagaaggcaatggcaccccactccagtactcttgtctggaaaatcccatgggtggaggagcctggtaggctgcagtccatggggtcgctatgagtccgacacgactgaacaacttgactttcacttttcactttcatgcattggagaaggaactggcaacccactccagtgttcttgcctggagaatcccagggacaggggagcctggttggctgccgtctatggagtcgcacagagttggacatgactgaagcgacttcgcagcagcagttgccccatttatgagaagcacccatccgaaaaccagagaaggcaatggcaacccactccagtactcttgcctggaaaatcccatggacggaggagcctggtaggctgcagtccatggggtcgctaagtgtcggacatgactgagcgacttcactttcacttttcactttcatgcactggagaaggaaatggcaacccactccagtgttcttctctggagaatcccaggggtggcagagcctggtgggctgccgtctatggggtcgcacagagttggacatgactgaagtgacttagcagcagcagcagcagtatcctaaaatgtccccctcttgctgtttgtctataagcagtccataccttcactcacttgcccctacaacccaagtgagaatgggtctgtttacttcagtgaggtctgttcagcaagccattttagccccatttcaggctgaggaaactgaggcaaacaaggtatgaagtgactcggctgaggtagagcaaggtcttgcacctgcctgttgaataagatagatgaaacaggcagggaaagtggagagaccaggtgtctggcccaggctggcagcaaggccactgcaggtaaccacacttaacctcctgcgcttgattcgaagtgccctggtggtctgagaagggagcccaaacacatccaccttggtgccagtagagaaattctcactctgaatatttcccaaagaacatttttattgaaagaaacacagccaaatgaaaagacacacagaggggtttcttattcatttccctgtgtgtgtgtgtgtgtgtgtgtgtgtgtgtatttttctcttttgtgttcctgagattatagttttattttgagattttagaataatttccctgtaacgcattcatcttcctgtcctaaggtagagtgactgttcacattttccagccagtcttaatgtagtagaaacaatcagaggtactgctgtgtatttaggtgctggaggagggagcagagctggagcaggtgggctgggctaataaacagagctggaaaacaggaaacaggagaggaatttccctgagttgccctatgctggagcttggccatgctctcctgtaaacctagcccagct

SEQ ID NO: 64433 - DNA, 2590 bp, Bovine  19866880563785
tcgtgtctgactctgtgcgaccccatagacagcagcccaccaggctccaccgtccctgggattctccaggcaagaacactggagtgggttgccacttccttctccattgcatgaaagtgaaaagtgaaagtgaagttgtagcaaccccatggactgcagcccaccaggctcctccacccatgggattttccaggcaagagtactggagtggggtgccattgccttctctgaagcaaagatcatatatgtgtcttatttcactttggaagcatgagacttgggagatgtgatttgggaattagacagaactgggttccatctgggttctggacattagctatgtggtcttcaagccatgggaggcttgaacctctctgaatttcaggaggttgctgagaggtttcaagggctagggtttttgctgttttatttttatttttatggatgaagaacccagcactcagaaaagcatcacttctctagttctccactttctctgtgtgtggcagattcatgtctgtctgatttcatagacttttggcaaagaacgcttagaatgtttcaacgacttgtcaaaaataccacagccagttgcgaggacctaaacctggtcctgctggtttcctagtccttgctctttccaccatacatgctgcctctccccatcactctggttccagctgcctgtcagagaagtttccttttacaagcggtcccaagttagcagacatgtcatcgggttgacaggacaagtgcctgcttgtccttgggggcggctctgacctttgctgcatcgctccattgccgggctattttgagtcttggaaatgtaaggaagatctatggtgggaagctgtgtgaccagtgtttcagaccgctgagatcccttgagaaagtcttgactcgatgcctgctgagtgcatacaaggatcctggctttgctggacagcagagggtccccttggtcttgaggagaaaacttagaaggagaaaaacctttccatggggcattctggaatgaagtcaaatgggaagaggagctagactgggctccaggagacctcactgctgtggaacgtggaaaaggaagcgggcgtcagactgctgggcttcggggagtaagacagggtgggctcggtgctagggtggcctcctccatggggagtcaagttcctgtggaagcggacgttcacttgccctcaggatctctcagggatgtctgggtgtgttgattcagactagaaaaacacgtccttggctgcaagctcccagtggctactaactgttttccacttctccaaccagggcaggcttactgttcaaggacctcagttttacagaccgtgactgtggagggaggccagccacacaatcccttgggcctgtggatgctttggtgaggtctggggccagtgaggttctgcaccagaaaacacagtgaagtcacttaattttttcccttatagaaagatgagaagttacataaacaggatttgatcccaatcagaagcgctttgttcatgatattaatcagtcaatagacacaatgcaccatgtgttggatgtgactcctggggatgcggatctagcagtgaagaagacgtagggccttcctcaagagcatcttgtgatgcagacagaaatctaatcaggcctggtcctgcagggcctcctgtcccgacctagctcacgttgtgtttagcggtgtggtgggaaactgctgatggttcccagcaggcgggtggcaaggtctctggccactctcaagggtgagattgagtgaaacaagtctggaagcgggagagcctaagatttcagaaacattcaggagtttccaaaagtgtgtcgatacaggcaacataagcctggatgcgtgtaaccgacaatcagctttaacaatgacctatgttgatttttcactgaacatcttatgaaatgtatttacagctcttttgagcttcctgaaattctcttttggcatcactggggtcttcccattagtctagtggtatggggctcagattctactatgagattcatagtgcctttcttcccaagtaggatctgggtgaggggttctaccatcatgaaggaggggaaacttgctgtcctttccaaatctccttgagatttctcctcagctctccttactcttttctgtccctgagtttggtggcttcactgacatataacttcagggggtgaggtcgatgactgtgtgaggccttccgggcacagctaaacctgtagaaaatccccagtggtttaagctgggaggagggaaccaacatgttgttagttgggaggtgatctcagtatctgtagctggcagagagtgtggagggtcaagttcactaggaagggtgaagatgtaaatggaaaatggtccacgaagtcagaatgtcaagaatagggagcaaggtggggtgagatgggaggaagagatgagaaatcctctaggacttagttcaccacaaacaggattgtgctgtgcgccccctttctgtggttctaggtactgaaggttctgatcctgaggctcaacagacccattcaaagcattgcagccaaatatcaatttaaaaggaac

SEQ ID NO: 64434 - DNA, 1330 bp, Bovine  19866880656878
ccatgggtccctgggcctgccccctgctgagatttcctgtccagtccccaagttcctccagtagtggggctttgctctggtcagaccacctcctagaactgagtcccgtgtcaaccctaaggcctccagctggggcaggagatgagcacagagcggccccaccagtgggtgagaacagaaatatgcaaagtcacctgaaggacctggaaggactcccaggcaggagaggctgaaaacccccatgacctccgaaggaagctgagtcatgccgctggggagctggccaaccgtgaagtgaaatgaagtgaaagtcgctcagtgttgtccaactctttgggaccccatggactaaagagtccatggaattctccaggccagaatactggaatgggcagcctttcccttctccgggggatcttccccactcagggatcgaacccaggtctccctctttgcgggtggattctttaccagctgagccgtaagggaagcccaataatactggagtgggtagcctaacccttctccagcagatcttcctgacccaagaatcgaaccagggtctcctgcactgcaggcagattctttaccagctgagctatcagggaagaagcgtgaagaagctatcagggaagaagccggccaaccatattaactcacaaaaagagaaggtcagaaagtcaaactgagggactctgcctatggagaagactgagccaagcagtgcatagacttcacagccctgctggaaggaccgtccccaccacatgataaataattgagaggtcttatcaagatgtcattaaatatttcatgcatctatttctccttgtttctagttcattcatatcacacaaccttgcatacagggttgagttttcccagtaggtctgctctcagggaaagcatgaatttgttattgccaatgggagcattccatcgcggtagccttgaattagtgagttactaaagaaataactgggtttctgagacctcctccaatctcacagcagagtctacccctgagtcacagacaggctgccagaaaccccacaaagtagtctaagtctaaaagcccccagggtgatggagagttcaccaaaggggtggatgacaaattgtgagaccttttggtggccaagccacggggttcactggtaggacgtacgttttccaagaagagcactctttcctacatgtgaaattccacttcttcctgttcctcctgaagctgccacccacaggagtgcatttctgtactcccttctgtctgcccctattgagctgctggcccaccctgtccccagagacctcactggccgggggaggt

SEQ ID NO: 64435 - DNA, 1744 bp, Bovine  19866880658690
cacctgatgcaaagaactgactcattggaaaagaccctgatgcttggaaaggttgaaggcaggagcagaaggggacaacagaggataagatggttggatggcatcactgactcgatggacatgagtttgagtaagctctgggagttgatgaagggcagggaagcttcgcatgctgcagtccatggggtcacaaagagttggatacgactgagcaacagaactgaacctgatactattagagcaaaggtgtgatagggaagcttttggcttcagataaaaataaatattgactacagaatggctaaggaagatagactagaaagagatgattttgcataaccaaggaaataaagatttgtactgtccccaggataagtaaccggtgttagacattttagaggatgtctctgtatggtgcataatctcctaaagaacaattgataccagtttggttctaaagtttcaagcaattgtatatggtcagggaaattagaagtctgcttaagtagtaataacacccgagatatcaaaagtgacactttggcataataaagtgccagagaagttgggcaatgcaattcagagcaggctagatgatggacccattggctctaagtcaggtagtttttaaaagcaattcaattattactattgtttgtaaaatgtcattcgtaattgttcttaaattaaccacatagaaaacaatatatgggtctatttgataatgtaatttggttactctccaagaaatccactttaaggaataatactaggactgtcactgataaataaaccacatttgattgttctaataaagttggaggacaaaaatcacttgaacagctttccttatggaatgtcatttaacatggcctatttatgtctgaatctattcactggtattggcttgtgttttaaggaatcttaatttaataaagtcaaacccaaccaaaatgagaatgttatataaaattccccaaatttcatcaagttctcatcccacagattgtcctggtttatttcctgctgttagtgcctctgagagttcttctcaaaataaccatggctatttgtattttctatggttaaattgggtgagggaagggagagggagatgatttgtttaaaatttttgcacagaaatgtgccccagatttaataagcatcagagttctgattgctgagtggtctactccatttgaaaaagtcaccttttcataatttttcttgctaattatatgagaaattttaatttccttttcattcattgattcattcaaactttaatacttgaaatacttattgagaatctattagagggcacatattaacaatatgaggagaagggaattgcaccccactccagtactcttgcctggaaaatcccatggatggagaggcctggtaggctgcagtccatggggtcattaagagtcagactgagcaacttcactttcacttttcactttcatgcattggagagggaaatgacaacccactccagtattcttgcctggagaatcccagggacgggggagcctggtgagctgccgtctatggggtcgcacagagtcggacacgattgaagcaacttagcagcagcagcagcagcaataacaatatgatgctaatatgacataaagaaaagtcatcattgagtcaataaatcagaacacaaggaaataacacaatgttaatttattgaacacagaaaaataatgtgaagcagaaagcataaaaagat

SEQ ID NO: 64436 - DNA, 1609 bp, Bovine  19866880758238
gagcgcataattgctttgttctagggtccattccatggcatgaaaaacagcaacaatctgtaacaaacagcgtaacttccctgtagtgtccctgcccagggaccttcagacccataacaaaacagtgtgggctaggttctttcagccatgtgatcctggttctttggtattgcccaatctggcttgggagacatttccacacattcatcatgaatgttcttgctttctcttctgctgttattcatctaataccttcctaaagacccccacttcgtttcgaaaaatccacacttctcagccttaaagccattttgttgttgctgacactagtccattgctcagaccctaatgcctcattttttcttgttatgtaggagattttcttacaatgctggaagatgccctaggagataaaaagctcaaaaggatctagtttctattaaaagcaagtctataggattagaagcttcttaatgcacaattatgaaatgtatatcaccaaatgtagtcacccatatcttctttcttattcctcctttccagttattactctgcttaatgtttccacagggaagagcagcttctgaatctttaaggaaactctcagttgatgtgtctgaagtataatcacgataccatcccacatgtctacatctctttgagggatatatcacatcctataaaccagctctgcaaagcctcattaatgacacagagcattggaggatattaaaagggaccctgcctggcagatagaacaaagtatctgtcggccatggtgactcatggtatatccatccaagctagggggggtgtttcagaggtcactaaagtgagcacactaacacttaaacccataaagttgataaaatagtggataacaatgcaaaatctcatatgctaggaggacttcaaggttagggactgggcttgagtcctagcagtggttcttcaactattaagagttgaaatatgctccatgaatgttctacaacattgtagaaatttcagaaagagaaacaagacagcaacatccagtctaatatcatagcttccttatctttattttgataataacacatcttattatgcttgtaaactcacaggagacattgaataatatttacctaatttttcttagggaaaaaacctaataatgtatgataaacctgaattcagtttaaattttatttgttcatcctgtgcctcacactagagatgtgtttctcaaagtcattttaatcttaattagcttagtattctcagcacctagcacaagaatttctatgtagtagacactaactaaatgcagcctttgttgaatgaatgttgaaaaagaaaccatttgtgacctcagcacttaacacaatgatctagtgtgcaaacattttttgagtagctgaattaagtatacaaaatattgcacaactcagagatctgactacaaaacatagtaagattgagtcttcatgttacatagataagagtgggtctaactacaacaaagggagggaagtagaattttaacttggggaggaatcgggtagactacacacaattacagctactaaaagcaaaacctgggcatggggattcttttctcctcagt

SEQ ID NO: 64437 - DNA, 924 bp, Bovine  19866880820339
tagtgttgggagtagggagagagaaagcttctcctgaaagaattttgatgctacacaacacccttgttatcaaaaggttatatgaacaaattcagcatcagcaaaagcaaaatctgtttctctcaatagtaattttaagattgtctaggaagaatcatttaaaactatctctgcttgccatagcttgtaaaaaattcttctgtaaaattgtaatcctcttattgatgttttgtttttcaatttctctatgtaatatgtaattatttcaacctcttcccctttgtgtggtctattggtgggctagaattcagaagagtttctttctaagaactccaataggctcaagatagtgatctttcccctcaactcatattctctgacctaaatagttttattttttgaatgtgccccaaagatttgaatgggacaaagtattcaaaacatagcattcgcataaaatatttaatctcaaaaagaagcaggctttattccctcaaggaaaaagaaatctaatgccaaaatatgaattgtctttcatttctctgtttcttttctttcttttttttttgaaactgtttatatctagaaaaaggaataggatggccagagccattatatgaataattcgattctagtatgcttgaccaaaagattgaatgaccaaagcaaaactgaagatgttttaaaatatttttcacatttatttatttacagctgtgctgggtctttgttgctgtgtgtgtgctttctagtttcagcaaaaagttgctcctctcttgttgtggtgtaagggcttctcagtgcatgttgccttctcttgctgcagagcatgggctctagtgtgtggaggcttcagtagctgagactcacaggctccagagcacaggctcattatggtggcacatgggctcacccatcccatgg

SEQ ID NO: 64438 - DNA, 661 bp, Bovine  19866880848154
tatttgccacataaaatatgggtcactctctctttctgctcagaactgtaggccacgcctttcaaaatgcagtgaaaattttagaatatttgaaactggccctatatatatccttctaggtattcctaaagtaagcaaagaaggaaggagacccatataacagttgtataagatggtgtccagattcttgctaagaatacagaacaaatagccaccgcctttactcccacaccactcacctcaccccctttaaaaacaccaatggggtgatgcaattagctgaataaaaacacaacatatgaaaaactattagggtaatggatctctcactatctcaaatatagtgatggtttcacaggtatatatacatgtcaaaatgtgttaatttgtacactttaaatacatgcaatttacttcctgacaattatatctccttggaaggaaagttatgaccaacctagatagcatgttcaaaagcagaaacattcctttgccaacaaaggtccatctagtcaaggctatggtttttcctgtggtcatgtatggatgtgagagttggactgtgaagaaagctgagcaccgaagaattgatgcttttgaactgtggtatggagaagattcttgagagtcccttggactgcaaggagatccaaccagttca

SEQ ID NO: 64439 - DNA, 1496 bp, Bovine  19866880901851
aaaaactaattttttttgtatttatttcttcacagatttcaagttgttttagggagtaaagcagatatgttccttgttgttccattatgttctagaaaaagaggtaatttgcacatcagttatactttttcaaaaagtttatttaaaaaaaaataatgttgctataaattgatcagattctgagtatttgctagtggcagatactttgggggaattcttattccctttaattatggtttagacttctgctttgactctagaacttgagttgaaagcctctaagtaaacattagggtttattatcggagaaggcaatggcaacccactccagtactcttgcctggaaacccccatggatatacttttgactaatttgtcatgaagaaagaaatttgggggtaagtatgatgagtttaattttggactaaatttttacattttctctttcatgtcaagtgaagatatttagaaatcagatctatggtttcttgtgctcaagagtattgtgaactgcagctagaaacttaagaattaccaatgaagagttagagactgaatcagtaaatatgcatagcttgtcaagaagaatcacagaagagggtgtaggctggcatcccaccatggacactgactagctgagaggcagaggataaagaacttacaaaggagtgaaacctagaaaaatattatcagagctaaattcaatgcaagttttctcaaagaaagtaacatttggatgaataaaaagtactgtaacctcatttaatattagtaataccctatgaagtacagtgtttcataaccatttatggctattcttatcttccctcccactatttttcttccctcaagcagggggtaaatattcagccctgtagactgaggatgagaagctctccctgagtggaatattgcttgagatcatgtaatagggaccttctgaatctaattgactttgaaaattttatacaacacagattgtataataaaatagcagtaaaaactaatcagaaaactttgtgaggtgctctgccacacacactgttaaggccaaaataactattccgtgttttttccatggcttttataaagaaattcttggaaaatattgcaaactggctctgggctcctcacttatataactcatatttttatttcatttctctccatctgaggttggataactctgaggttagaattgtattgctctttatgtggtaagatggtttagtttttgaaattgcgctttactcatggctttggcagctagtgggttctagccttccttgaataatgaatctacagaaaggaattagactgatctttcatttgatcccaacacttcccaatagatgctgttttatatgaaagtgttaacactcaaaacaaagccaaattcagtcttctttggaagactataattgaaagatgtagaattttatgggcaaaataagttccttctttaaaaacattctttatggcagaaaaaggagata

SEQ ID NO: 64440 - DNA, 1642 bp, Bovine  19866880976306
agagggactgggggaggggtgaaatagggatatgtgattaaaagacataagctactattataaaataaataagcaacaagaatatattgtaaagcacagggaaataggatatagccattgttttgtaataattttaaaaggagtataatctataaaaatactgaatcagtaatactgcacacctgaaactaatataatattgtaaatgaacaatacttcaatttttaaaaaaaatagaaggtggtgatggctgcataacaatgtgaatatgctttatgccactgaactatacactttaaaatggttaaaatggtaaattttgttatgcatattttaccacagtattttttttttatcttttataaactcacatagtaatcacagaccagaaaaagaaataaattgttacctcatggaacaggagattagaagatcacgagagggaagatgggagatttttgctttgtattttgtaattttctgtactgtttggattctttaacctatgcacatattattttcatattttaaaataaaatatttttaaaaagtgagtatgcaaagggagtatttcagtccatgtttctgcttgacttgcattcaatttctcaaacactattttatagaagctgatttccaagaaaccttcaaagcccctttttattattatttttactagaagccattcccttggaatcagacactcatgtttttccgatggagcttgcatttgaagcctaggagggtgaatgtgtttggaagcctactcagcacagccctctgcctttgaactgcaatgttttcctgggctcctcacatatccctcctccaattggcttcccatccagcacatccatcaagcagccagaatttatcgagttacccgtggaagtagccagcacctgctagagcatgcccatttaaaaaaggcttccaccagcaaagcagacctcaggaaaatccctgactacagctgctcatcacccatgctccaatcaacaggctacatgacgccaacatgaaggccaacaagaaaggccagctcatcttatagaatttaccagaaattgtagattccagttggagaattttagcatgtttgagctgcaagagacctcagaagtcttattaatattataaaaccattgcattggatagagaaggaaacaaagcctaaacatgcccaatcacaggcaataagttggaagcacagcccaggcccaaagtagacatagatatatcaggagacacgtcacactctagatgagtcttaagggagctcccaggatggtggcgtctcctgtgggggaggttgaggaacaggtggtggcagggggtcaggatggagtgaagaagcaggaaaggaacacatcagttaccttggcagagagagtaatagcgtgctaagtaagcctgaattctttgatgggcaatgaagtcattcacttgatggactgtttctctgttggttcttactttttaattcatttatgtgccacaccttactctatatgctatgttggatataaacttgaatcagacatgccccccatcctcaaggccaggtggtccccatggctgctaatagagacaactgcaatacagtgtgatgagcaggagaaaaagcactatttcctcaatt

SEQ ID NO: 64441 - DNA, 772 bp, Bovine  19866881007349
tgagtaacatgatgtgagcttaattcttttggaaaaacatgaaaaatggaatcttatcttttaaatggctgcttatcacatttttttcccccactaatgaaattcctatatggatgaaaccaatttgtaaagttaaactggggattcgggcactttggaggtggactaagagactctgagtgagctaaacagtcattctgagcctctcttttctctactgggagatgagggatagcagtgcttatatgattttaaaatgaccactcagggtcattagagggctcaatgcaaaaatggatgcaaagtgtcttctacattgttggcgcacatcagcagtggctattatcattggccagatatttttcacggtcttccttagtcttgacattcagtagctcacctttcacttctattttaccttttcctcatcttggtgaggtggcaatggggcttggtgttgaacttggaggtaggggaggaagtgtctttcaagcttaagaggagagcacgaaccaagacagaggtcctgtgtcatttggttggagtgtgtgtcaaggaggttcgggttgtgggaactccagaggttggacttagggacgtcatcttgtcctgtgtggtggggaaccattgacaaaccttgagcgtggccatgacatgctcatgcccaggaagtaaacaggtggatatatgtaagaggcacagaaggccaggagaccaatttggaggctgctgcctggtccaagcagaagagattgtgggccttcactttttg

SEQ ID NO: 64442 - DNA, 1505 bp, Bovine  19866881012180
ccgccttacacccctcagaggaaggacagggatattattctgccctgggcctggggggagaaggaggtcaagagaggtggaataccagtggttaccaaagtcaaggggagaagagatcagattgcacctgagtgaactcagagggctttattatggaggaaatcctgctggcaagtccggacaagacttctcttgtgggtttctgaatcagagacgagagagcaaaggcaatttttgtcacttaacaatgataacagctatcactcattgagtacttactgtgtagtgggtagtgtgctatgcctttacattttttcgtttaatttcacgaaggagatgtaagttggataatgacaatgtattgagaattcatgccatgcaggtatttaacatgtcttgcctttttaggtcttcacagcaacctcaaaaagtatgtgatttctatatgacagaagggaattaaaaaatcatggtcactttgtcgggtggtgttcagttgctaagtgaggtccaactctttgtgactccatggactcagtatgccaggcttccctctccttcactatctcctggagtttgctcaaattcatgtccattgattcagtgatgctatctaaccatctcatcctctgcttccttcttctccttttgtttcaatatttcacaacatcagggtcttttccaatgagttggctctttgcatgaggtgatgagagtattatataacaaaactgagatttgaatctaagacttatctgcctccagaggttatgctctctccatttagatctactggcatattattgcatccctctgaacctcagtttccccagttgtaaaatgggactaataatagctacataatgaggtataatgaggattctcggtgataatatccctggtaattcataaagatgttttagcaagatcacgagctttcaggcaacaaagtcttaagtctgaatagtatcttaatatttaagaactgtaatatcttacattagttatctaaacctcaacttcctaatttgtaaaatgggatgataatatctaccttacagatttcagttaagattaaatgaaaggatgtttgtgaaatgcctacttcaggagcttggcacatagcagtgtttactacaattggttttctcccttttcccctcctgtatcccactttcttcctgttaaactgtctctcaaccaataacaccattgtcttctcaaatgctaagtagaatcttagagttcttttatagacattcttattcttgtcattcacatttaacaactatcaatcatattcagtgcattatatcaggaatagaactttttcaagcaccacttgttaaagagattgtctttaatccattgtatatccttgcctcctttgtcaaagataaaggtgttcatatggtgcgtggatttatctctgggctttctattttgtttcattgatcaataatttctgtctttgtgccagtaccatactgtcttgatgactgtgg

SEQ ID NO: 64443 - DNA, 944 bp, Bovine  19866881015183
tcatttgtgtttcattacatgatttgcatacgggtgaaacaggtctgtactgtcctctggcttcatttccattgctcttgggagctctctgctaggcgtgagaaggaggcttttgtccttcctctgtccctgcccactctcttcctggaagtctgtctagatcgctgacatccacagggagaaactttttttcccttctcccatctcctccatagctcatacttgactctggttcacagagctggtgagtctacatggtacagaactgggaagttattcaactatattcaggacaaagaggagttattagttgacttttctcctccttgagaaggaaagaggtcttgctctctgtcactatcagggggagaaaaagaaattaccagtttgctcagcatttagacactgagcaaggggccttaaattacattccctacaattgttacaaccattctggtaggtagacaccattgtgcccattttacagttgaagagatcaaggccaaagaggccatgccacctgctcaaggtaacagtggatcatgattgacactgagtaagagcggcctcttttaggtccatgctctaaccacagaaccacctggctttccttagggaataagtgctctgcaagccaagtattggtcttctgtattggatttctgtctctggagaagcaatctgaggggactacacagatgtcatggactaaaggacaaactgaatgggacatttagaacttcaggctcctctagctcacctgtcacacctcttaagtgtgcatgtctgaaaacacagatgtatagctttcgtaagagctagagtagaggagtctctgacctgatcttaagttcagcagagcctgtgaattgactcagcatgcctcagagccctctcctctgacctccaaaccctcagtccaccccaatcagagaactcagcca

SEQ ID NO: 64444 - DNA, 2550 bp, Bovine  19866881113922
gaagtacatttgttaaggattgtagaaggtctaagactttcttcaacctccaaacgaatatacaggttactctgctgcagtttcatggatgctgacgaaagtcataagacccctgggtcagagacaaaggatgccattactcaaagtacaataaatagcatgatcttttgttttcattagctctgcttgactcctaaatccgttgagggtgatgtggcatgacccagatggtttgcttcacagctgagaaatcctgagccaggaaacctttatattttatattggacagcaaacaaacctgctctcctctctagaaagagacactctattttctcagattgtttactacataaatatccttgataatttagttcagaacaaaagatgtcagctcctctgctcaaaagatgtacagaaatgggagagactcatggacaactgtctcccctccaaacactgagtaactgtgcttccttttggaaaagaacaaacagacctataggcatttttaccagggtctcagaaagtggtcacatgggcttcctttgtggctcagctggtaaagaatccacctgcaatgcaggagacctggctttgatccctgggttgggaagttcccctggagaagggaacggctacccacttcagtgttctggcctggagaattccatgagctgtataatccatggggttgcaaagagtcggacgtgactgagcgacttccactttcagaaattagtcaactcagttaatttcataactccctctggtttcttaagactctgttgccactatgtttaagcttctgtagggctttccagcatataaatcctatattaatgcttttttccttctaaataggcagcatgagattccagccactgtttcaggtctgagtgttaattgtatctcagagcaatcagctcctgaaccagtgttttttcttgtgtacatagagaaaaatgatcttctccatatatttggaatggtgggcagcaacaagctttctcttagaaagagcagaggtatgtctgtggaagtacactgtgcccttcaaccatgccccagccccatttttgtctcttttctgctttttacaatggaagcttttagaatgtcacatctgtttccaatcacttccctttggtcttcactgtatgatcaacctcagcaacctgatttgtaaagggatccagactattttgcaagacaaccaacatatgttaaagaaaattgcccttttaatatccaattgcaaaacaaacaaacaaacatacaagaaatgttatctttagtgtttacactcaagacacaaagaatgaactgctcttttatgacaaagggtttactgcttgacttaaccacaaagatgtctaaagcaatatattatgccttttaaaaagaaaatatttttaaaattttgaaacactttatgcagagaaaataatctggcaaatacttattatctctcacaatgtttaaacacacatcttaacattttgacatatctgtttcagctctctctaagacaaacaaaaaagaaaaaaggaaagaaacatagctaaatccaacgctcttccttcctttttctaaaggtgtaacttctattgtgtatgttttaaaaataatcataattgatatattggcagtatgctagaggctttttacattcaacattatattttaggcatttatctctaaagatatatttaatctaatttatttattcattttaagtgatttaatattgtgttaaattgaactcttatcagattttctgggtttaaaatctgaacaccactattaactaagcacatgaaattgggcaatttatgtaatcttcaatttatatatcttcatttcctatatgtcatatgagaataacaatatcaatatcacttaattgtagtaaagattaaggaggtcatgaagttagtctatagaatggtattttagttccagagctgccataacaaaatactaaaaactatgtgcttaaacagtggaagtttattttctcacaattatggaagctggagagccttccaggtggctcaagtggtaaagaatccacctgccaatgcaggagatgcaggcaggagacatgggttttatccctaggttgggaagttaccccagagaaagaaatggcaacccactccagtactcttgcctggaaaattctatgggcagaggaacctagtgggctacaatccatggggtcacaaagaatcagccatgacttagcaactgagcacccacacatggaagctggaagtccaagaccaaggcgccggtaggtttggtttcttctgaggcaggaggctgtctttttgtgttgtcacatggtcttttctctgtgctcgtgtgttcctggtgtctcttcgtgtccaactttcttcttcctatagggacaccagtcagataagattaaggtccaaacttaacttagaccttgggcttccctggtggctcagatggtaaagaatccacctgtgatgtgggagatctgggttcgatccctggctggaaagatcccctggagacggg

SEQ ID NO: 64445 - DNA, 2586 bp, Bovine  19866881123357
ccagtctggcaagtttcttgtcacactaaatggtccccaaccttgtcactcactagaatctatcagctttgaaaagagatggctttttctctcttcttcatgcaagaagatgccaaaaacatttatttttgagcttggtcaaagagtccagcctactaagaggtatcagatgagaaaatgtttggactgttagtagaagcaatgaacaacttttataaattggagaaatgaagtcttagtttggttaaaagtacactggataccttatttcctattcaataaatggagcattttcatgggaataagccaaagcttttgtgaatagctccttactttttcccatctgttagaaacatttttcaaatataaattaaaaaataaatccctccaggaatttgtatgttctcctcctttactgttgggagttctatatcatgagtttatgtcatgaatcttagctgagtttatatttgataacgtccttagaatagagtcaatcatcaaataaaaacaaatctttcttgttttcaatcttactgtattgcaaatatttctcaacatccagcaaagaattttgagatttcaaatgttaactatttttaatcactttactattcctgacatgatatgtcaaagttccaaagttaaagtcttcttctgaatgttcatgacaaatctgatatttcatggggcaagctggctttgctgtgtgaatttggataattcatttagtctctaaactcttatcacattttaacttatgagggaaaaagaacaaggtcacttgaactgagaaatcacatccctaaaaaaaaaaaaaaaaagaaatcacatccctttgagtcctcaaaagttttgtcatgagcaattaagttttctgtagatatacatttgtaaaaatcatgaggaaattctgtttccttttgtgcagttacactaaaataattctttacactctcgtcacgtacatagtctatctaaactagctacagaattggaatgttatagtttggggaaactatagaaatgatatctgtattatttctggatgacttgcaaagataggaattttatgaacttcacttgaaaatactttcaagtgaagttaaatcatgaaaagtacacagtttagccaagtgaatttagcaatacttttttttttttcaggacttgatatcattatctctttttttcacttaaaaatttaattgtggcaaaataaacacaacataaaatttaccatcttaatcatttttaagtgtaccattcagtaaggttaaatatattcacactgttgtgcaactaatctccaaaatttttcatcctgcaaaactgaaagagatttaaaggtttattatttgtgttgaatggtaatagaaaccagttggcattctgctatttccatttttgcttctttaaaaattatcatcagctttctcatttctttatgttgtctgctatttactatgaaggcactgcattacacaacctgtttgaaatctttttatctgttctagtatggtaatcgtccacctgacaggctcataactacataatgtgaaggttatgaggttttcccaataagcaaatcacacaagaaataagtgtggcaagaacttggttcaggaattgattttcattgatagtatagtgaatactctaaacttatatcctgatagtgtaaaaacttcaccagatctctttctccttcacacacaaacacattcacacacagccaggtgcacacatgtatatgcacaaagtttgtcggcaaggaaacacttgagatatatcaaaccaagcatgttcaacttattttatttaaactaacctccttgagagaaggaaaaataaaaagtcccaggtaggcaaagaaaacggggagcagaaaaaaaattatgttagttctacaatgttataaaatacaaataatttcacattaaaaaaaagaaacaatagaacaacatagtctgggttatgtatgcatgaattcatttcgtcattcaacaaacagtcattgagtgcttactctatgccagggaatttagtagtatacaaagataatcaataatgctctgtcttagaaatgaacaatcagaaagcagagtgatgagcgacatgataaaggaaagccaggtactaaggaagccgcaaagaggaaagaatgtgtttcattttgtacttttatagatttaattagttattggacttttttctctcaccttccactctggctcccaaacaataatgtctctggtaagtagctgttcaaagagatattaaacttactcacatttgtgatggtattttagtatttacctctttttgtagctcagggatatgatttaactttataatctgtagtcatgatagagtgtgttaatattattgtatctctccagttccccttcccctacaatgggaggaatgtacttccccaggaacttgctttggccaaaggaacgtgggcaaatgtgacccacaccccatttttgcagaggtattaaatatacttgcatagtttggcaaggcctcttgaatttcttacctctgccaaaagaagagttgtcctcagatatccctaga

SEQ ID NO: 64446 - DNA, 2175 bp, Bovine  19866881218561
ccagcgtaatatatttgtgttagatgtatagaagaatcatttttcaagagataaaataaaccctcctgcaatgtcctgtattctctctttaatattatccatgcttctgttaatatgttatcagtttttacagttctggcccatatacgcctgacttctttgcccccattcacttattggttaaaccactcataagatgcttatcatttgttttcttgtatcagtagcctccccttgagaggtagtgtgataatctcgaggtccatcatgttgccccaagtggcgttatttcattcttttttatggctgagtaatattgcgtgtgtgtgtgtgtgtgtttcacatcttgtgtatttattcttctgtcagtggtcacttaggttgcttccataccctggccattgtaaataatgctgctatgaacactggagtgcaggtatctttttaaataagcatttttgtcttttctgatataaggccaggacaggaattgctggatcacacggtagttctatttttagtttttatcaggaacctccacactgttttccatagtggctgcaccaatctacatacccaccaacagtgtaagaggattcccttttctctacaccctctccatcatttatcatttgcagacctaaaattttttatttctttatttttttggctgccctgggtcttcactgctgcatgtaggcttgctgtagttacagagagtgggggctactctctagatgcaatgcacggacttctctttgcagtgacttctctttttaagaagcacaggctcgaggcacaagggctgtagtacttgtggctcgaggactccagatgtggcacaggggttacgttgccctgaggcatgtgggatcttccgggatcggggatcaaaccagcatcccctgcatgacaagccagattcttaaccactggatcaccagtgaagtccctgtagactttgatgatggtcattctgatcagtgtgaggttgatacttcaacgtggttttgatttgcatttctctaataattatatgttgagcatcttttcatgtgactgttggctatctgtgtgtcttgtgtggagaaatacaaagaatattcttctttggagaattctgtttagatcttctgcacattttttttggctgggttgttgggttttattttttttttcctatactgagttgtttatatattttggaaactaagcccttgtcgattgcattgtttacaaatactttctcccaatccttagggtatttttttgttttgttgataaatgctaatcattattattgtaaatttaattttctaaattttatatttctctttatttttagctacagataagcacataggaaactcatccacccatttttttaaccatccagtttatttccctagtacctaacatgtctgcaactggtgcgatttcgtgtgggtgtgggggaaaataaaatgtcaagcagttttatatgttatgcttgtaacccgctctatctttctgtgaggtagatagcagatacgaaaactgaggctctgaggatttaaataacttgctcgagatcacccagctgttaagtgtaaattaaatccatgtttgtttgactctttccattgtactgctggaaataaatgtgaataaatggatgagtgaatttgagaaggatctggaattgtattttgagctcctcctgtgtttatttaccactgtattcccagaacttcccacagtgactacttcatcggaagagctcaataaatatttattgttaaatgaatgaataaataaatgaagaaaaggacaaaggaacaaatcaaggaatgaatcggcaaaatgactgctcaaaaagtaattttcagccttcctatccagtctcctacatacagtatatgacatatttatgataaatgctcccattcggtacctagagaaagcggaggaagtaatacattaccaatttgctacacgtatgatttcagaccaatagtacacaatcacctttgattttattttatgaaatgaggaggtaatatgtctccagctgtgcaaccagaagcttcatttgtttggctatgggttcacttggaatgggcaaaggaattcaaataaaactgtatggtgtatcccaaacatatttttcctttctggttcaaggaactttgggaa

SEQ ID NO: 64447 - DNA, 1616 bp, Bovine  19866881359940
aaccctgattaattgactgtaatgtccccacggtgctcccctatgatttagagcatccttatcttgccttcctcttcctccccagatcccacctagagtgccctggcagggtctaattcactgcttcatcctcagcatggaccagtatctgacttatgctgggcatagtagattaggaatgagcattttctttagacatgcaaaaattgacttctatcttgtaatatacaagttgctttctatcattcctttgatgtaggagaacaactcagggctttggaaccaggtgtgtgtatgtgtgtgtgtgtgtgtgtgtgtgtgtgtgtgtgtgtgcgcgcgcgctcggctgtatctctttgtgacagtatggactatagcccaccaggctcttctgtccaaggggttttccagggaagaatactggagtgggttgccatttccttctcccagggagatcttcccgacccagggatcaaacccacatctcttgcatctcctgcgttggcagacagactctttaccactgcatcacctgggaagtccttggaaccaggcagatctggcttcaagtcccaacatgtttacttctcagttacaaccttgggcattacttagttagacctcctgaccctcagcccttccttgtgttagaatggtgatagtggtgccattcccacagaaagagtgactgttaggattgaacacaatggagaacaaagcactcaggactgcgctgagcacagggagcgctcaggaaatgttagtggttaggcaagagtgttattattcgagtagtttataacatctctcagcaacgtgcttagattttctttggctctgagtatgccatcctattgtttgggagtttaattcctcaccttgaccaatgctcaactcttttgccactttccacgtttgcttgttttgctgttgctggtattatctatttagaattgtggttttgtaaaccatttcttaaaatgctcctgtcctttaagagatagtatatcggggagagaacagcaggcagaagggagtaggggaggatgggaacagggctggaatctatttctcggcaaagccactcggccactctgggacttcttcccacatgtgccaattgagaagtaatggcaaaagtgagatcccttagtgcttaaatgcgctgtgtgtataaaccctctgctcttcaatcctgggacagtagatgctcttcagcagagagatgtacgttaagggcatctctccctgccctccctccagaacacacacaccactcgcaaatgcccagaggaaacctgcagttctgttgtttgaacatgttgttttccttaaccaagtggttgtttgcaaatgttttctgattgtaacagcagtgaggccgcctctcctagaggagattgagttctttctctttgaaagatactgtttactgaaataaattccacctcctccttggtttggcttttcctctgtaagcaatcaaagccaactggcagaaccggcaagcttgctcagtccattgcggcatctggctttcttttctttttctaagttgaagtgcaggctgtgttgtgagcctcacatttctttgcaaaggcaattagttttgtaag

SEQ ID NO: 64448 - DNA, 1386 bp, Bovine  19866881399391
atatgtttttctggaactctcttgcttttttgatgatccagcggcatgttggcaatttgatcctagataagaccccatcaaacagataaaataaatacaaggtggaatacatattttgatggctcacatttttttaaaaaaagagacagtgcgattgacacaccaatttctgaaagatggaaagcaaatggggtcaccgaagcatgaattgaagcataaagggtcagtccaaaacccagagagaagactacagtgagtgtgtgacctgatataacctgatggagcaggtttggggacaaaagagagggctatgggataaccataatgaggcaatcaagactagcctggggagggcctataatctggatggtggcaggggatggaggcaaagaagagttcaaagtaaattcatacttccaccttgaccagaagaaaaggaggaaaaatgcttctactcagagggaaaaaatgaaagtactgcagtgaactctttcattgtaggaactgtagatgttcaagcataaccagtctttatggacaataaagacaagtctgctattcatcaaaagctgctcatccacacagagttctccatctgccttccagtgtggagaaaaaggtctttggtgcaaatggacccactggattactgagagaaacaatgccagctactatgctgccaaataagagatttgtaaataaaagtaaatcaattttgatcaacatttgaggaaaactgatgagaaagacaaagcccaagattaaaaaatgcaaatagcagaccctgaaggaaatagaaataagcaagaactagaagaagatttttgaaataaatttaataaggaatctcagagaaacttgaaaagttattgttactatgagagacaggcagccaagcgttcttggaagtgtgcactattttgtccatattttttaaatgttatggatttgtcatggttaaagaccacattagtaatctggaagatgaagtcaaggaaatctcatggaacatgtaacaaaagtgaggagaaggaaaatatgagattttgcaaagaaaactaaaagttaaagtaaacagagaatagatccagaaggctcagttcagttcagttcagtcactcagtcgtgtctgactctgtgcgaccccatgaattgcagcacaccaggcctccctgtccatcaccaactcccggagttcacacagactcacatccatcgagtcagtgatgccatccagccatctcatcctctgtcgtccccttctcctcctgcccctaatccctcccagcatcagagtcttttccaatgagtcaactctttgcatgaggtggccaaagtactggagtttcagctttagcatcattccttccaaagaaatcccagggc

SEQ ID NO: 64449 - DNA, 786 bp, Bovine  19866881412979
ctggaaaaatggatcatctattaaaaaaaaaaaaagtggttaagaataaagcaatagattgcacactcagagcaggctactttttcaacttagtaaattgtgtttccttggtatgttgtttagaggaaactcggagcttcagctttcttttctataaaggacaaataataacacccatttttcaaggttgctgagagaatcagaaataatatctggaaaattcctagcatgaagagcaactatggcattattcctgatgggtgactggcagcatgattaccactttaattttgaatgatagcaatttaaatttagcatctaaagccactgccttcttcaaagaatggaatggtgtaattgccagccaacattgaagaaagcagacactgaggcagacactttgggggcaacagatgggccacatagtttaaatcagagccaggctcaaattacatggtagccactaaatgccttggggtgagagatgaccactctctcacctgtccttcccagcctctccctgcctcgttcaagagtagagcatccctttagaactgaattcacagaggagccaagatgaaatagactgttgacctctagctctcaccccatcttcaagcaccatgtctctaccctggtctctcatcacctaaaagcagctttgtcatatgactcctagctcaaagaacttgagtggatccctaatatctcccaaatgaagttcaaaatcaaggtcttgaatgaagttcataaagttaagggcttctaggatttctcactactgat

SEQ ID NO: 64450 - DNA, 1177 bp, Bovine  19866881420310
ctttccgttgaggttctgaacttgatatcttttctctttctgagttaaagagaggacttaggaaattctagagaggaggacgagttacataacagaaagatggcccctgatcattatttaaagagaaaagaaaaagaaatgattttctcactgtgtgattcaatgttatttactgctgtgaactatatgaagcaattctgtatgctactggcatcaaatgtgccatggtcaggagaccactgaacttttaccacactacttctattaactgagatatccacactttgaaatttctctcaatattgatccaaccctcatttgtactcaagatcatggcacccagagagcatgcagcagttacctcctttaagggagccattctgaacagggtctaatgtatcccctcatgtttgggtagaccacaggctacacagcataaaagagaaagattaggcaactgagatttcagccttttacaaaatatagttcaagatggggcatcttcaaagcttattttaaaaaataatttttcatcatttgggagaccatcacatgaccataaatgaaattataaaacttcagtgatcctgagagaatcatgtcctagagtccaggaagatgagtctacaagatgggtcaaagctacagaggagggactttggcccaactgaagaaggaaagaaacaaacctaccaaacttggcattcagcaaagggagagggaaaagcaacaagtgccttttgaaggaaaaacagatggaaggaaaattaagcaaagttaaaaaatatcattgtggtctgttcacaaaaaccaacagagctgtggtttctctggagccagaactttgaaaggtaaggaaaatagagatcatattacagggtactcaagggtttaatgtgcacagcaaggattctaatgaaggtctggctaattccctctctgtctcagggatgagcaaggggactgagaggtacctacacctatagcaacatgtattaacccaaatggaatgatttactgttaccatgtttgagctggctttgagtgcaggagaggaaaaaaaagatgaaggaaaacaagcttacccataaaaagaaattgtagacctctatgtcccaacaagtaaaaatgttaacattgctttttttatagcccaataaatgttctttcataaaaa

SEQ ID NO: 64451 - DNA, 978 bp, Bovine  19866882156849
taggatattatattgtagttggaacattaggtgtgtgtggggggaagaggggtggagaaggcaaaagaagtagactatgttaaggaattttcactttatcctgagagcactggagagtttaaaggggtggttagatttgggcttttggaagatcactttagttgttgtggagagagtcattctggggaggtgtaccaaaggtggggagacaaataaggagattattgcaaaaatccaggtgagagagaagtctaggaactggcacaaggaatgtacctggttttctccaaataatttaaagcctcagagatgacaaaacgtcattcttgctaaaatcttcctctccatcttaatatttcagtggatgccactcatttcaggccatgattctgtggactttctgaaatcagatgaaaatgttctcctggggtctttctcagctacttagccttccacagtaactccccatttttcaatagattttcattttcctcttttgcagttcctatcacctcaccagttattacttgacctttcatcttctgagcctgactcacatgcagacagcttccttggaattttagctggcagttatgatcgaaagttccctgctgcttccttaaaataaagggatcagaacacaaaatcttccctgctctttacggaagaatgataaaataagtgttgggggaggtggtaatgggaagaccatacctgctcctggtttccatctgtacacactcaaagtccctctcagtgagaaatcctacaggctgtggaattttgtatctaagtatatttttttaatttgaaattccatgtggacccagttgcatgtggccagaacttttgcaagaaaggattggaaccttttattttgcagtgtcattgcttgtaaaggaaggaccttgattatttaaaaaatttttgagatagtagaaaggaaattggacttatcagaaacctgagttggaaatt

SEQ ID NO: 64452 - DNA, 1913 bp, Bovine  19866880502746
cttgtggaacgcctgagcttctatgatgaaataaaaggtttttactttgggatattttgagtctacaaattttcaaaattatattttatggtttctcctggtttgattaaaagtaaagtgtgggtgttgaggagtaggcgctggcaaaaagaaagaacaacagcaaacaaacaagggaacaaaaaagccactttgatgaagcatcgtcagtgagctcgatgaagcatgtttcatcccggtgccaaatgatgctcactaaaatcgcagcaatttttgatgcactcgccaatgtttgtgttatttttactttaaagatgtaacagattgctccaaaataaataatttaagcctcatgtttcaaatgagtccaagcgctgtgtctttcacttctgcacccaacagaggctcctctcgtgtctatgccacactccactgggagggctgttttcttgctttgtttttcaaagcggagtctgtttttcaccattctgttccaaacatcaggggttctgtcatcattcggcacttgaagcgataactcctctttatccgggaaaaatgggaacaaactccatggcgtctggattcgtgatccggtgggaggagggcttggaaaggcttcggagagaactctgggctgagaacataacccaagcccacgggaatctacagtgtgcacactgattcttttctagacgtcgagccacgagcaatgggtcaggttttacacacgatggtctcagtttaacttaaaatagcttcagacttggccaattactttcacttgagatggcccatcgtcaatcagtattggacttcttactgggttgtttgcttttatggtataatctaagagaaaagaaacatctatgatttaaaaaaaaataattataaaaaaccaagaatgtatgctgttctctgctccctaaatgagcgtgaatggcttataaattcagaaaataaagatgacatgtaaaaacaccagagcaataaaccgacagccttgtgtcttcgttcatgcaggtcgccactgtgaggtccatcagatgaccgggaactacatgtgggaccccgacaccaacaagtcatttgacttaggtatcaacagagacagccggttgcccctttggtggaacggatcagaacctctgtgggtcactctgaccaaggccaagaggaaggtctacatgtactactggccaggtgagtgtgctgacttccaggccactccagcctcccaaacctcaaagtacagtgacatctctgaggacaagcatgcacggggaggtgtttaaagaccaagccagggtttgaaaaactgggatctttgttcaaaaaacaccttatggaagtgttcctttatattttgctgcatgtagatgtgtttgaagaccaagccaggctttggaaaagtgggatctttgttcaaaaaatggcttatggaagtgttcctctgtattttgttgccctgtggcatgtgggatcttagttcccagatcagggatcaaacctgtgtccccagcattggcaggcagattcttaaccaccagggaactctcctttatattttggtttgaacagtagcatcagaccagacactatgccatctcttaccatccttggttcagcaatatttctgcagtatagcatgcattttcatgggcaaaagtttggacacccaggagagataagtaatagggtgcttatttgctttacagaagaatttagagtaccagttctatagattttgagatctcctacaatactgaaaagagagttcaaagctcttgcaactttttgttgtgcattaaatgaagcctctgtattaatagtctgcctgcagatcgtaggtcagtgagaaactgaaggacttaacttacttcaatgagggagataagcagtcatgtagactg

SEQ ID NO: 64453 - DNA, 3354 bp, Bovine  19866880518860
tccttttgggaaatcaagagatgaaagaggaataagatgacacatagagcttggtggagatgttgaggggggtagaaagggggccattgagaaagccagagaggaaggggccctcagcaaggtggcaaatccggtagcttttgttgtcaagaagggagagttacaggtcttcctgttggatgtcagagtgtggggctgagggaaagagacttgcagaaaggtgctttgggagagtggagttttatctgtgaccttggataatagcgagtgtttatttaattatagatgacaggtgcatattcattgtatttaatctttccatcatccctgtgggaatggtgtgggttctattattgtcctcagtttacagctgtccacaacatcctaagagaccgctgaagaggctaaagccctgtaactagtgaaagatttgaactccaggctcatgtgactccaaagccagactgtctcatcgtcaccctctccgggagctgagagttcgcttccacgagtggagtggcagccagactgcaggcttttccgagccacagtgagggggctgtggtgggaaggcaggtgcacagtcaagagtttagctctcaagggaatgtgacacctcaagtcacaagcaagcgagtttcttcccagaaaggataaactctttggaatttgtaaaagagatgctacaaggaaagaggataaacattctacccaacagggcggtcctggtccttcctggggacgggggacggggggcaggggggcggggggcgggtgtcagcgtttcatacatctggtcaaccctgctgtttgtgatttttttttttccccccaagaactgagctatacagtgaggtaatgtctttaaagtcacggatatcatggtgggaatttgctgggtgggactgtggcttccctaaggtttacagggcattcgtgattgagtccaagcagcacatgcattgataagaatactctgcatgccttggagcagccacttgaaatttttcaaagcagagtcatatccatctcacatgatcttctgctcccgtcttctgttctttccatccttatacccccgtctccagtgtggtttccccaggagttgcgtgtggcttttttggtctgattctgttgctgtcgtagatagcaatagcttctcttctcttgaagagaagcgctctcatcaaaccactgaaagtcagtctgtaccccagcactggctgtcccagagctgttggtgctttcagaggttggagggctctggtgcacttgagtaaaccagaatcgagagccgagcttaggcagaggaattgattctcctagattcattagtatcaatatgtagactctcggaaggctttaacaggcaccatggatatgggctgctccacttgcctccacggagtcaaggggtcttcagctgggagtctggcccgtgtcaccggccgccccgccccacccctggggcaggatgctcaagtggccagggtccagggcaaaccctatatgagaaaaattcatccaccatgtgctctgagttcctgtccttgggctcatagttgaggcagagcttttcctccaaaagtataaaaggattcctcccttagagagaaggtcaggagctgacgcatgcacgccctccttcagagaaggaagagttggggtctccctagcacggagctttacttagatagtaatgcagcttccttatccaggggtcatcgggttgcagaggtaagcatttcaggaaggtaagccaggtgcaatggtgttacctcctccaaggaagaagtgggaaaaaagggaacactagaggagacattctaggcagaaatgtgctttttaagctctagctgattgaaaacatacacttgaaacgtgcacttgggagacgaacctgaccttggcattaaaagaaagcagacagggtagaatttaagctaagcaaaggaagggaaaaggaagtgttctcaattcttttttcttttcttcttcctagcaagaaccaattgagtcacctttggggcttagtaacggagtaagtgatctttctcctgagtatgcggtcctgacttcaactataaaaactgaagtggatagtacggtgaacatcataggtaaactgttttgacatctcatttctttatacacacaagtagcccctccggggtcgagaatttgtaaaacgtgacttaaaataacataggctgtgggaggagggcttggaactgtctcagaatgcaagttcaggccctcggatgtcagggctgaaaaatacaatcctttgaggatcagataaaggaactgaggtggatggacctcaagaaaataggtagatgaaaagagattccaccgcccgccccgccccccggctaatcaccggcagttctcagtctttgcatttttggttatgtggacaaatgtattatttatttaacttgggaacaaggagtgggggagactgtccccaccagtcctcacagcatctcctggatgacggaccctgccacagaggtggtgctcatctctcagaggcggaaacagaagtgtgtggccggagggcatgctgtgatcccgcggagagttctgagtaccttctgtgccgcagaagcagcgctgtgcacggggaaatagatcgggagcaaggcaggaccaattcctagtttcatggaactgcagataacaacagctttgccgtctatgttaaatgcgccagagggacagactggagagatgagatgatgctgctgggggaggaactgcagcagggggctggcagcagacctggccccatggaccccgatgcaggaacacacttggaggactagagggaaggccagtgcacctggggagggctcatgaggcccttcagaaaggaagtggggtgggcttatgggggcctttgcagaccctgggaaggaggttgggtttttttcctcagagtgctggagggtgtgtgtgtgtatgtgtttaagtttttaaaaattgaaatatagcagatactaaggctcacagatgttgcatatacatgcatcatgtaagccccaccccaggaggcttttaggcaggagggtgacaagcgtggattatatctcagtaaagtcccatcggggtgctgccgtgagtggatggtggggaccctttgtaagagtggagaccaagccttgaacttgtattctgactccagcccaggaatccagaacctctgtttctttgccctcaatacctttggtttcatttcattttgctccattttgtaaacaattagggcttctaacactggtgagaatgggaaagatgaagcagagctccaagagtcagtctcacatctgaggaccttcatttgtgggt

SEQ ID NO: 64454 - DNA, 1395 bp, Bovine  19866880586345
tgtctttatcaagtagtgaggtctaaacagcttagtagtactttctgtggtatccaacagatgtctctggccctcagaaacttaaaaataacccaccggtgcctctgtaggttcgcttgtcaccccaaagtgcttcagtacacaatttaagaatcatagttctaatcaaagaaacttagttctactctgatagaaatttaagtctttttttagagaaaaaatgcttggatcatagttacttacacaagttttatacacgtgaccattacagtggcaattactgaaggtatattttattttatttttttgaaggtatattttaatgtcaaagttttaaaacacagataattttgttagtaagacgaaacataaaattgctgctgggaatatagtttacggtatcatcataaagcacaaaataaaatctggtaatactattagaattatagatctaatacataaaaattatttcattagaaatgaaatgcttaggacttctctggtggtccagcagttaagagtccgcgctcccattgcagggggcctgggttcgatccctggtcagggttttagtcccacgtgccgtagctaagacccagtgcagccaattaaataaatatgtcttttcaaaagaaattaaatgatactaatactattgacaattacttttacagctatcattataaattcaaagataaaaaaatgaatccatcaggagacatataacaattattgaaccttattgttgagaaacttgtagctgcattttattgaatagcatctcagttctcgggataaagttttaaacagcaactggaagaacagctttatgtttaaaaatgttttatttttagagttgtcatggtgtaaaagttattcctacatatcaaagctgctggaaagaacccaagttttgtgcaagtttttcattaagtgtttcgtggtgtccctgctttaaccccaaacaagtgcacactcttcataagctgttgaatattggttcagctgataaattaagaaaatcccccttctttgaactcctaagccacagaacatgtgttacattgctaataagaaggattagacagatatgggccacccaaagtttctcctattcctggatcatctgcaatgagaaaatagcaatttaattgtgtttcttgcttatccaggtcaacagttagcaccaatacgaagatacccaactgtgtagagataaaacctagagcagcaggagacagtatctgaaaacacagggtctgaggaagctgggaaggggcagagctatagtttggaggaggaaatggcaccccactccagtactcttgcctggaaaatcccatggatggagaagcctggtgggtttctgtccatggggttgccaagagtcggaca

SEQ ID NO: 64455 - DNA, 1324 bp, Bovine  19866880632326
gactgcctcaaggtctccttgccgtttactaatccacttcctggctctgatacttttccgctgttttcctgaataatgcttgcttcctggcagctccctccaaggaccaccaagctgagcccgtgaaaatcacgcctctccaaacttcctagaacagaggtctcaccttctaagtgccgctcggcttgccaactctgatgggtcttgtaacaataacccctgcgagctgcattttgtgcaggtgttcggccgctgaatacgtgtctctggagagcttattaaaatagctaagccaattagctctcttagacacatgtaaccttttccagggagacacatcggaggcacaggagcttgtggggacaagtccttgggggaagctcggcctttgatctcagagaccctttcctgggtctgcctggcccacagggctgggaggactcttctgatctggggaccctggggctggggggactggcctgggcacaaggtgccataagggctggcccgtgatcaagggcagagagctgagatgagaagcacccatccaatagagaggattgtggaaactccactgagaatgactcactgggcataagaggtgactgataggaacccaagggcgggggcagcatgtgcctaaccctggctgggcagctgcttttggaaggcagtgaggaaacttcagcaaggcattgtgaggcccaaagtgggttgcaatctctgcctctgggagtccgatgggaaagtctctgtcccgggtcagggatcacacttctccccagcagacctaggtggggcgtgagggactcccccggcgccccccctcataccagccacgagcagcttctttgggcctcaggcacatgattcaagatcatggaaatcttgcaaatgactgcatgatcacaatgatgtcatgctccccccgggggcggagggggaaggcgtcttgactgctgcacacggggtgtccctaccagagcctcctccctgaacagtggtttcctggtatttggatccgagaaggcttccctggtggctcatatggtaaaggaaggaacttggggggacacgtttcagtctccagcagcgtctgtatccttatctggagtgtcagctgctgatcacaattacccatttcagactttgtctgtgtggtcagtcgttcaactgtgtccagtgctttgtgaccccatggactgtagcctgtcaggctcctctgttcatgggattcccaggcaagagttctggagtgggttgccatttccttctccaggggctcttcctcaccaagggatcaaacctgtatctcttgcatctc

SEQ ID NO: 64456 - DNA, 1844 bp, Bovine  19866880659967
tgtggaacctggtacacggcagagactcagtacctgtttgtggaatacgaagttaagaaattaattcataaatagagacagttggttcttgattacttgttgttattgttcagtcgctcagtcctgtccgactgtttgcagccccatggactgcagcacgccgggcttccctgtacttcattacctcccagagtttgctcaaacgcatgtccattgagtcaaggatgccatccaaccatctcaccctctgtcatccccttatcctcctaccctcaatctttcccagcatcaaggtctttttgacaaattgtttactttataggctaataaatcagtgactaagtacccagagaggaaagctaagtcaggcctttcacctgggctaattgttagtagccctagaagagatttcaacagagaaaaggtgttgaaaccaccagtggtcattgtcctggcccagttagcccccagctggagaccagggacgggcggacacttcagctgtccccggtccccactcagcttcaggggctgattcccatggcctctcctggacagtgtccccctcatgacaccgcactcagaaaggcggccaaatgtggccagaagctggtgaaaaattgtgagacgtggagctgcactgtggatcctccggactctcatctgcatggagagaaatgcagcaaatgcaggcttcagcttccaaaaaaaggcccatattggtctcccgaggaaagatttatttcaaaaaccggcaaaggatatgaaatgccaggctcaattctcaggcctgggattgagcggcagttaggccctgggcccaaaatacttggggaaatcaagacaagctggagagcacagctcctgagttttagcatcagctggagtggtttcctgcgggcctgaggtgctggaggtccaggatgcctgtgtcgggaactggaagctgcttgccttctggcagcgaccagggtcgtcgccgtaagccgtcggagggcacgggatgccctcctcaccctcggcgggcttcagcaagcatgatcttgagggaaaggagaagtagaaggaagctcacccgctgggcgccctgctccagctcttctctcgaggaattctgccgcctctgggccctgctgttcctgatctctggcatttcccaacttccagaacgaggctgtgcgtggcagtgggcttgccagggtgagagcagggcctggggcccaagacattaaatttggttttagaaagaggaggccctctaagacggagaaacagttggggggacttgttttcgcagcagtgtgataaacacacgtctgagggtctgtgaccaccactcccgagggctctgaggagtcaccccacaggaagcctcttgggagaagggtttaaaatgatgatgccacaaagcctgagacacggtgctttgtcccctagctcgaccttaaccctggcagcaaaaccccggagccagccaaaccgtgctcccttccacaagagtcccgactgaggcctctcccgagacatcaccgggtgccttttccagcctgagatgctgtgagcttattgcactgtggagggcaggggaagctcctgttacaaccctgtcctaggggaataaggtcgatttcatttgtattaggcccgtcacacaccttaggggttcacatgttacttactgattttaattggacttgatttcacctttgttccccagcaccctagacacggggtgagaggcctcatccagagagaaggaggggacacttcgggtccctgaccccacttctcagcaggaagtacactttcaggggctgacatgagggatggcggtcaagatgtgt

SEQ ID NO: 64457 - DNA, 727 bp, Bovine  19866880922318
ctccccatgacactctaaaccctgctgctttctgaagctcccctagagtagcagtactgctgcctgttttcctggttcaggggtcttcaaactgtaaggatttccaagagcaccattaaaggaatctctctgaagatcatcacctttcatatatagtgcaaagtctgttctgattaaaaatgcgtccctttcccactttatataagaaaggggtaccccttggtgatcaagaaccttactaaggtgcattgccctagtatttaaaagcctccaggcccaaacaaaggaacagttcaaaatattggagtaggtgtatagaaaggaatgcatgcagtgagtgataaaacaacaaaacctaaaaaaaaaccaagtaatttccaatgctgtcttttaaattatttaagaaaaacttaattgaattgtcagctgaagcagtatttaaaaatttatgatgatagatcactgtgtgaatgttagcattcaaagaagcagttcaaagaattaaatgacagactatttctatttccatctacttatttatgtaaactactttcttagcacttagacttaacaaataggaatagagtcaattctaaacttgtctgattctacagatccatcatattcatctgtgggtatacaaactgatttttaaaagatcccattcctttcattatgagaatgtgtttccaatggaaattgttaactttttatttttaaaaatcat

SEQ ID NO: 64458 - DNA, 1347 bp, Bovine  19866881272816
gctgcaaatgtgtggctgctctgtgtcatgcattgcaggcattattacatcgtttttttttttgtttgttttgtttttaaaggggttagtgctttagaatcaacttttctatttatctgttgagtaagagttttctgaagtgttcttggggattctggaagggcctcttcttgctgttctgccagcagtagcattttgcctttgcagaagaatcccaagaacagctgattcatgcagagagaaatgaaaatgtcattacccttttcaggacatttgcaagatgtgaaaagaaggattttagtgccaggctggcaggcagcaggggtttgctcggagcctggtgtttcagcctggcctttatttttttccattgttttcattgtctgaattctccagaaccctttgcggggaggcttattggatagagccaagataagtcatcactaccacttttctagaacccaggacacagcagaaacttatctgttactgaccatgggtagctaaaatctttcagtcaggaattccatagcttgctgctaggaaagacagcttcttggttgtattcctttttaaacttgatggtctccacaaaaaaaataggctgtttgcctgtttttcatgacagggtccctttgtttgaactattcaagtgaatttcagccttctctaaccactttcattcatttaggaaactggtatttggaggcagttgtttgctatttttttcctccctactgatcattgaaatagaatcccagtagtattacaaaaaccacattcattgttgcaactcggtcttctccgtggtctaaatatgatgttgagcaagaaaagggacagtttctttgagtggaggtacttgccctgtgggcttccctggtggctcagtggtaagtaatctgcctgtagttcaggagacatgggttcaaccggtggattgggaagagcccctggaggaggaaatggcaacccatgtcagtattcttgcctgggaaatcccatggacagaggaaccctgatggactgcagtccatggagtcactaaagagtcgaacatgacttaactactgagcacacacacttgcattatgttattagaagacaacatgaaattctagttggattcatgaaactttattctgggaagggatgtcccaaagcccaaccctgggaaactctagagaagagtcctttttatttttaaagattccggtgtgtgaatagggattatttattatgttgttggtggcttaataagagaaatcacagtagtactggggggaaggctggatgagaggatggagaagaaggcagaagacaaaagactgatttgtaataactgag

SEQ ID NO: 64459 - DNA, 1287 bp, Bovine  19866881423617
tgagtgtgtgtaggctagttgtgtccgactctttgtgacccatggaactgtagcctgccagacttctctgcccatggaattttccaggcaagaatattggagtgggttgccatttcctattccaggggatcttcctaaaccagggatcgaacacgtgtctcttgagtctcctgcattggcgagtggattgggccactgggaaagcccaaataatgtataaaaatccataaatcccctacctttacattttcatttctgtaattataaaaaagttataaagtgtgaaagtccccttccttgtgtccctccccctgctttttttaggagacctggccttcctccttgagatgatcatgatcacttattaatgtcacctctcttcttacaacctgctctcaacctttactacttagtacactatattattattggagaaggcaatggcaccccactccagtactcttgcctggaaaatcccatggacggaggagcctggtaggctgcagtccatggggttgctaagagtcgggcacgactaagcgacttcactttcacttttcacttcatgcattggagaaggaaatggcaacccactccagtgttcttgcctggagaatcccagggacgagggagcatggtgggctaccgtctatggggtcacacagagtcggacatgactgaagtgacttagaatagcatagcatagcatatactatattattagccacttttgtttaagattctggttttctgtcacctagccattccctggtttttcacctagtggacttatcatatttagccacaggaatggaacgtgcccagccagagaggctgccaggcccacacccctgcaggcatatcctcttgtgactggccctacttcagtagggcatctccccacccaacatctctcaacaggcctctgagatggataattgcacatcacacaaacattaattcataaaatgctgattaatgtttatgttggaggaggcaggcatattaagaacataagagtctacctagagaagcaagcatgtcatgcaagtcttccttgtcgatgaacccatccctgttctggtcgatcatgttgaaggcctccttgaactcctgaatctgggactggtcaaacatggcgaacacgttggaggtcgcacgctgggggcgcttcttggtcttggtctttgcctttttgctcgacatggtggcggtttaattctagaattgaaaagaaaagaacataaagcaaaactgaaggcataaagcacaaagtaaagaaaagga

SEQ ID NO: 64460 - DNA, 1030 bp, Bovine  19866881580851
aaaaaaaattttttttttttttaattggcttcttccttccactcaccttccagtctcccaccagtgtctgccattggtagagctcactgggaagccagctggctgggggatctgggaaatgtggtttgcaggcttccatcccctctatagagaaggacaaggaggtgggaatggaactgagagactatagaggaacagcagggtgctggtttcctccacacacacaggtgtttcccacagatgtgcatgtatctccagatgctttctactccggtctatctgaagcaaagagaacataggttgaatgtttcaaaacctctaacagaacattacctcaccacatttaaccatctgatgaccaaaccgctcttcttctcggccatttactcctttcttccttgggattggcaggaaatatgtcaatgctggtaataacttgcgtgtcacactcctctttgcaaaacaccagttgaatcattttggtttccttagaaacagggacactggggacctcgcatctagtcagcaacacaaccagtttccatgcccagtctattccacccgcacatcaatatgggtgaaccccagtgactggccatccctaccagggctgagagacaagtaatcttcaccaagcctctgtcctgggccaggcgccacgctgtgtgttcgcacacagaatccactgtagtcttcctaactactctgactgctaggggtgggtgcacccatttttcagagtaggaaaataaagtccaacattataaatgggacagtcagagaatctgaacccaggcctgacttactccaaagccaaattatttccataacacccgcagcctctagatctaccttgagataactcccaagcatgtaaagagcaggaagagggctgggcagaagaagacgagagctgaatgactggttgggacaggagtggcaacagagcaggggctgtgatcgtcaccactcgtcacagccgtctttccgcttgtgtcccctctccctgccagtatctctcagaggttga

SEQ ID NO: 64461 - DNA, 1828 bp, Bovine  19866880572250
cttcagtggaattaggttgtttccctgtcctagatacttttaatgatcctacagtgaacatgggggtgcacatgtctgtttgaattagtgttttcatttccttcagataaaagcccagatgtgggattactggatcatatgggagttctatttttaatttttccaacaacctcccactgtttcccatagtagccatatgaattttaccttcccagcacagtgtaaaagtgtaatgccttttatactctaaaggaactacaattatatatatatatatatatatatatatatatatatatatatatataaaatctccatgcttcagaatggatcctcatgatttaaaaaaaaaaatcatatgttttctttttcagaaaccactaagaatgtgtcttttaaaagcttatctactctggccattatatgtttaaacaacatatcatgcttgtatcaacaccagagtaacaaggagcttatcaccaataatttttttattattactccccaaaactgacttaaaattgcaaaacattaggggacttcattcaaatgagtattttctgaaattatattatcaaactatcataagtaaattaatgagtatattaatttagaaatcattagctcatatctcattttagctaatactgctaaacaaatcagagtatctgcaagaactttaattatttagttaaataggatctgaaactaaactcctcttctgcatgcgttggaaatagactgcagatgattacatttccatagacttcacaacatgagctgcttcgagtttgaaataagaatgttaaggttgccaagtattataaatgctgttattttggattatatagagttatgaaaatccaaatgttttacaaagttaaaaagtattctttttttgctcacttataactcaaaaatcactaaagtcattctgctgaaacacgccaagaaacccagcttcttgccatatgcctgcataatcttatcaaatctctgctattcacatgcacattcttacacacacacacatacaaacaagggatgccaaagactaaaaatatatgttttacagaagcttgaattgagaccatgacctcatttgaacacagaatgtggcctatttctagggctattttaagccagcattaacaaaattacatacgtgttttttacttggaacttcctggtacccgctgtcatttcatcccagtgattgaaataatctcatagatgcataacttatttctaaattttatttactgtgtacaacttgcttaatcagttaataatgttataaaataaaagcatgcaggaagcaccagataagcattagctataatataataatatatttagtatttaatagtaataactataattaaaacacatgtataaataattagatacgggctttaaattagtgtctaaagctcttaaactctattaataaattgcttattaaatctttttcctttgtgaaatttagcagttcaaacaatctgttctaaggctctgattgtccaaagtgcaaaatttcctatttggaattacccattgcgtaaccatgtaatcttcagcctccacttctaggtcttttcagatgatgataacaaggattgtgttctcccttgagacatgggactgagaagggaatttcaaatttggatattctgaaatgtttaaagaacacatagttcatgccaaagagtaattaaatactgctcctatatgtctatatgttgggaaaaaaaggagtgagcggaaaagtgcctcaaatatctctatactttgttccaggataacaatttttaggatataggaggtg

SEQ ID NO: 64462 - DNA, 1088 bp, Bovine  19866880613699
ttagaataatggtggtgggaatgaaattcaacctttatttccgtatttgctctcatagctggtcatgctttaggcaactttcactgtattcagacctgtcataggtgttagaaactgatagacctctgataggtactaattatttcttaagcatgagagtgaataaccatgtataatattccaacagagtaagaatttgaaagtttttatataaattttcaatattgatagtttaaaaagatacaagatcgaaataactgacctaactatagacacattgcatatgtatgcatataagtgcatatgtttatatatattttgcatacttatacagatatatatacaaacataagcacaagattttttctttttttctttttcaattgcaaatttttaaaaaaaatattacttcttgagtattccccataaaataatgaattagaatatctatcacaagagttatatacatccttcatcttgataaaataaacacatacaacattttgtagaaattagttaaggggaatgaagacaaacatcccatatgtcatccgattgtttaagattctccattcgtactcacataatagttatgaccgagagaaatctctcatgtttcccttttgtgagaatgataatcaagtgattactgccatctgtatgtgagccagactgtgttataacaaggtcaaaatttctgtgtggtaaagctttcaaagcacatttataattgagaaccactcttaacaatagtttttgaggagttactttgtgcccatgataatgaggtttgacctgtaatgccttttctgtttgcatatattgtgaaatgatcatcacaataagtctaattaacatctatcaccatatttagttactattctcttttcttgtgatgagaacttttaaggtctaccttcatagcatcttttaaaaatacagttcagcattattaactatagtcagtatgctgtagattatatcttcaggacttatttacattataactggaagtctgtgtcttttgatcctggtcatccattttgcccatccccaacccctgaaaccaccaatctgttctctgtata

SEQ ID NO: 64463 - DNA, 1342 bp, Bovine  19866880829678
ccgttgactaaatagtagtgatatagtcatattataattactcatctttattttattacacaagataaacaacaagctaaaccactaccagatgattattggctttgtgttttatttggttataatttgcaaatagatgtttaagtaaggttatttactctctcattgtttctctcccatcctcttcaccccattagtgatgggagggggttggccaaacacacacctcctgacacctgacattgagactgaaagaagggcaagcacagtgcagcaagccgcttgcagaggcatgtgtgctgacactggttgtagtaaccctcagatggaagaaaggaaaaaaaaagaaatctcttaacggagattgagagagcatttcaacatgtcttttgactgacgtgtttgcagatgtttaagtactttgagcggaactataatttatggaaacatgattttgcatctggttgatttaccttagaaacatcccattgaaatatgacatttgattttgatttttcaagaccacctcaaagacaaactggtttgtgttatctcctaatgctgttgacataaattatgtgctggtcgtgcctatttcagcaagtcttccttcagtaataccatgaattgtaaatgtgttactaaactagtggtaaactctgtgggaatggaccacacattttcaatgtggggtgatatcacccacaaaaagaaaaaaaaattggcttggagtgccaatttgatattgatattacaatgggtctgtaaacctcccaaggggccaccgtatatacatgatatacacatgaaattttatggttgaagattatgggcggggggagatatctatataaaaggctcttgacatggaagtgatatgtagaaaattaataagtttgagaaacaatggtataaaccagttgtatatggtttgaagacataaaattggttgaccaagaagtaattgatcaagcaaaagtaaaaacttggctaaaccagtaaaatttcaaatgaaatagtagtaatgctgcagtaaataatcaccttctagagagtttcctattggagtaggaaatggcaacccattccagtattcttgcctgggaaattccatggacagaggaacctggtgggctatatagtccatggggtcccaaagagtcagacatgactgagcatgcatgcacacacacacatacactgattttcctataggagttcttatgatataagagaacttaaaacaataacaattacaaaatttcagagtgtgctgttatcactacttatttttagattagtttaaaagaagtggagtaaattaaaagggcaaaattactgg

SEQ ID NO: 64464 - DNA, 865 bp, Bovine  19866880846339
aatattttaaaaaataaattattttttaaaaaagtagaagtcaggaatctccctaaatgaaatcatttgaatggaagtaaagttcttatcactaaaggagtaataaaaatttctcatttaataactagcagtagggatttatttctgtcatgagttagttttgatgaaggtctaaaagactaaagataggattcatgttagggattttaggtcatgaggtgagttaaaaagaaaaacaaacaatacccctaagaaggccatgattagaagatattttggagccaatcatacacagcaataatagtcataattttatagccaaatgttttgtaaacatctcaatgatcagctataccttttgtacagctataccttttacagacttttaaatttttctaagaaaatattttgaactataaaaaatataacaagaaaagtttgttttcaggtttctcctcaataacaattatttgtataaagtaaattgggtttttctttgagttgctcagcattttgtgctatgggttgtgctttgtgggccaaaatttataccaagtggaaatttgcctaataatcattctattgttttgcaggattccattataatcatagatttggaagataccttagatcaatttaagccattttccacatctttaaatttttaaaagagagactgtttgtaaaccagccaaaacatttgattcattcgtgtcttccagtttgaaattcttattcaaacctctttctctgaaatatagttgagaaagtaatagatgtagaagaaaaaatgagggaaaatgtttactctttgttttccaaattgttatgtacattaaggcaattcatggtttaactaaaaata

SEQ ID NO: 64465 - DNA, 1254 bp, Bovine  19866880864983
taacctactaccacttgcaggaacagggaaaagagcttaatcaatttgaaaccttttctcaaaaataatgctatgcagttgagaactacagatggggtggaggatattggtttatttgtaagaggactcagatctgaaaggccccagaaaccaccctgagagaggagtgcagagttctgcagtatctgtggcaagactctgaaggagacaggaaaatgctggctgtttaggaagaaaaatattgttgataatcatctaaaaatcacactttaatgcttaattggtgacttatttattcaacttgttgaataaatactttatgcaaagaagctgaaaggatgtatttaaatgaacagtgttgggataataagcaattgatattcagaatccacccccttccccacccattaaactctgtatctttctctcctgattgcttctttcctctcctgattgtttcttgcctctcaaaacaccaatcacattggaaaatttatggacaggattttcctgttttagtctgttacacaatttttgtccaattctaccatcctcaaatagcttttttttaaaacctctgcctgtgtgggatagcccaatatgtgcatgctcagttgtgtctgactctttgtcaccccatggactgtaacccacctggctcttctgcccataggatttttccaggcagtaatactggagtggattgccattttttctaccagaggattttccccatccagggatcgaaccctcgtctcctgtgtctcctgcattggcatgcggattctttaccactgagccacctatcacctctatgaacatatccactaccaaatttgtaagcagagaacagtcacacgcatatagatcaatggaaaatgcacccttgttaataagttggtaaaagtgttcattattatttttataataaatatattccagagaaataaagcaatcaagaaacgtacacccacctctccagaaggataactcttcaagtataacaacagtacatttcttggtgcgtagtaaaaaaaaaaaaaaaataggtactgtgtatgtgatctaaacatttctaatgccttaggagaacatttcttaggcatgaactcttcataaaagggttctacgatatctattttgagttcaagtgaactacttcaattgctttgcctcttataacagatgatctcaggagccagagataaaggacactccagatgatgatgagaattgataatattttgctcagga

SEQ ID NO: 64466 - DNA, 740 bp, Bovine  19866880882164
aagaataaagatagaatgggttacttcctaaatgtttattataacaacgggaaatgttataacagaagaaatggtgcaggcagtaaaattagaatctccaacagagtttcatgaatcttctataaactgaatgaaaaccagatcaatactgctatccaaattgtagcaacagtagaaagaaacaagtgattatataaaccactagaaacaagaaaaaaaaaatcatatatatactagttacagacattctaattgtcttcaaaaattgatttaagtgttggaggaaatggaggtaattggaaagccaacttttaattttgagctttaggctattatgggttttgtgttttggagtgctgcctgtaatgagtagctggctttttggaaacattaggttacctaggtttagtgccatctgatacaggaatgattgcagaacagcaaatgaaatttagagagctaatgtgcttcattccacttatttaccaaaatgaatttcactagatttgtatttgtaaccttcagttttatctttattttttattctgtgaacctttcatgattggggtcttctaagaataatagacttgtgcatttgaaagctttgtttttccaagaccttattttgaagtgataatccccccacttggcagctgttctactttatctgtcaaatagcccctagggtgctatgcattttcagtgtttggaaggtttatcttgaagataggtacagggaa

SEQ ID NO: 64467 - DNA, 582 bp, Bovine  19866881022390
tcacactactatgaaatgcattccacaaacaaaagaatcaagagagaaaatgatgaatggccttaggaatagtcatggtttataataaagattttatttaaaaagcgttaaaataaataatacatactctagaacatcactgttctgggaaatttattctctttagaatatgagttctagaaggcaaatcttacaactgctctgggggctttcattggctgatttacaatcctacaattgtgggtttttttttttttttttaaatctgtggtctgcagtctttttaacatacttctcaaaggtggatatgtggtggaatgcagaccccatcaacactgtggttttatttgctgttttgtcccctaactgctgataaaatagactgcttagaaatcccggaggaatatgattggggccagagttacattggctcataaaattcaaacagttcaatgcttttcttgttaattactgggccacaaccagaaatccgaatgatagcagagaaacacttctttaggataatgattgatttccataaagatgagtgctttaacaaatttcaatatgcagttgctgggg

SEQ ID NO: 64468 - DNA, 1004 bp, Bovine  19866881366582
actatgaagctacataattcaagaggtgaggaactctcagaacccaaccaccagagatttcccttaggaaaatatagggggtagattacttttacagaaaatacactcataaatgtaccttgatatagtgtaccttaattgtcgtcaaaacaaccaagaaggctgaccttgacatgtgaaactcattgatgtaggtatgtcagagaagtttgctttaaaattattatttttccagatacctccagttatctgattttaataccaaagaaactatctgcctactttattaaaaatgaataaaaaagtacatttgagtacatttagaaccagctagtaaaaagttttgagatgtacaatacactatcctttaaaagaaataggctttcatcccttgcatttatttctaacaccacataataagcaattatagtatttttttctgtatgtactgcacgtgatctgcttaaagttaataaatttgacaatgctttggtacaggtagttaaaattctagtgtgtgattaacatttcaccaattcatggttttttcttaatatcttagggaaagttactgcatcaaaatgaactttcttaaggctggaataatagcaggtaatacaatagtttgctgtcaagtctccaacccttcttcgattttaagccctgttttataagtgcgtctaatgaggtcaacaaccatcaaacagaacagaaatgtcaccatgggctaaatctgacaatttgctcattattcactgtcaagaatagtttatgaacttttcatgataattcctaatgagaatacccccaaaattgagcacaaaatgattagaataaatgaaactggtctatgtgacagactgatatattatacctccatgactttaccattttaagaaataacatatataaattttaaactaactcatttatcataatatctatgacctttggaattactatttttcataatctctgcttatttatgtcacagatttctttgt

SEQ ID NO: 64469 - DNA, 1343 bp, Bovine  19866881540378
cctctccctctcccacagagtccaaattttggtctgtattcttatcttttgactgtttaatcttggcctccatgtgtgtccgtctaaagtatgatttgccacatactttaggacactgggaatttataaactatcttttttctatgtctcatcagttggctttctattaggttctgccaataggaagcagtgttggtagatcagaaagtggaaggaaaagagaagctttctgattgtggtagagctagagttactgaaatagaattactaattaaaattactaattagaattctaattagaattacttggagtaggggcagcagtgaggtgctattggacttcagctttttttagatgtttcaatattgatcacccattggtgtgcccaggactaccagtatagcctcttctagtgtgtggtacctgatgcagcctggtaggctcctgctcagaggtattagcaacttaggtttcttatctgatatattatctcctcttcactttcattccttcagttctggtcacctttactttgatcactcagtcctctgtaacctgagtaaccactcagcctgtttgaacaacatagattgatttctatttccctgatgtcttagacatattacaagaaggcaacgatgagggaattagtaatttgtctaaaactcattttgccatacaaatgagtgaatgtgatataatgcagagcaaacagacattgtgtattttctgggcacagattcctttagtagtttgagctctcttgaagcaaaacaaaaattgaagtaaataatcacaaaacccatttaggtaacctgaaatagctgcctaaaatttcatgccctaaaattcatgcactttactctgttggatacatcttggcattttattttatacatgattctaacaagccctttttatctctttgttcagcccactgtaaactaccttggaataacaattttatatgggggtgttagaattactcttaaaagcacagtgaccaaaatgaaggtaaatcattgacagattaacaatagaggaaaaagaaatactcaaaaagagaaacatgaaaactcgtaaagtatcatacagaataaaaggtacagagacatatttatttaaagctttaaaaatgtctccaaatgtataaaattgtccatttttctgacattttcattaatacattaaactttatttcagcttttatattttaaaacatcaatatacagctgtgtaggaaaaattatataacagatattacttgttttaattaagtggaaaagtacagaagcatctctgatatctaaaggaaatactctaaaggaaatctcatttaggt

SEQ ID NO: 64470 - DNA, 1148 bp, Bovine  19866880463018
ttattaatcttttgaaccaaaacacaggctaatatggtctgttggctgtgttaatgagttctgaaaggcgaaacacactccctacagcgatacagggcggttcagcaagaacttagtcaattatctcagagctttagcctgttacctcaatcaatacattgcactaaggggggaaaaatgaaatataatgtgctgctacatgctacttcactttagacacttctgatgaaggtcattatattaacatgattcatgtgtgacctataatatgatttcagtgtcggctctggctaaaaggaaaagtacttaagttcctggaataacctgagtagaagctggatttgaagtagcttctgctgagtttttcctttcaattcgggagcttctggatgaaacaccagtctgctcaaagggaagaccttgtgctctacagctcatccaggaaaaaacctgggaggtcagagagacattacatggtgtggccgctcccatctcgtggccactcccctttcaggtctggaatctggaaggaagggcaagtctgagaacagggaaaggagggaaggtgtgtggtacccaggctcagtgaaggatgtgacagggagcacggccagcatgtggagggctcagcctggggaagggcagggtctgcaggagaatcctgggggccttgaacccggctgtagggtcagcaggtatttgcaaagcctttccgggctcaggagctcctatgacccctgagacagtctaaggagaaggaggacaggtgtctgcatcctctgtttccatgtaagaagattgagatctcaggagacagggacttggacaagggcaacgactgtaagacaaaatgactggctcttcagattcgtgaggaagtccttgaaattctcaaggagaatcctttaagcctgtaacgctaaggtataaatgtaaatgcacatgcagcccctttctttagggctgccccctccctgctcagaatttaccctgaatttcaatcagctgccacacatgcatgtgttgggtgtgtgaagtatgtatgcgtgtgtataagatgggaatgagaatagggcctcagaagcatttgaaagactcttttttttttttttttttatctattggcttctttccttctattctaatta

SEQ ID NO: 64471 - DNA, 1530 bp, Bovine  19866880491953
tcttgaatctaagttatgcattggtcatttcctctgcatatctgtttaatggttgttaaattaaattgctttctctcaagtggtgatttttatgtttttttttttttaaaccatcttttatttccactttgctccgtcaccctctggcctgactccagctccgcacgcctgtggtggaggctctgatgtaatatttaaacaacaaaggatgcatttatttgatccagggatgtgaggagtgccggctctgtttctggctgtgctgagctttggagtccagaactggagtgtgctcagcatgtctggctgcacgagggggtgaggaaggtgttcactcagagcacccctgccccagagcccccaacagcggcacggtactgcctcctccacggcttccgtcggcctgtggtcactgagcctgatgttgcgctctgggatgggcgcagcctcatcagcccagcccagccttcaggctggtatttccaccttcactttgctggggtttgtctgctttccacctgtgcccataaggctgggtttccagtctgctatctcagggtagatgggcctcccagtctcatccccaagaccttcctgcctgcatttctctgaactctgagtgtctgcccactcactcactcatttgacagatcctcattgagcagcatctctgtatcagatgtgaaattaggctttgggttatattctagtcgggagacaagggagaagctcttctataatgtgcagagagtggtaactgctaagagagaaacaactcagggtaagagacattggtgactgcggtcttgtatggggtggtggggaaggaggctttggggcagagccctgtggaagtgagggccacgttttgtgtgcattgaaggcaggccttctctcctgaggcagatttcattccccagggaacatttctctgtgtctggggacatctcagccttgggggagggatgtgtctcactggcatatggagggcagaggccagggacaagcctaaggatcctgcagtgaacagagcggccctgcatgcagagaaccatctggttcaaaatgtcaggctaccagggtcgggaaacctagtcggggaaggggaagagtagacaagaacagaggaaacagtggccacaaaagcagaagggaacccccttaggaacccctgaggtgggagcaggtttggagagcagcaagaagctggggtttgcagagaggagggtgctgggggcgagtggcaggaggtcagggagcggtgagggcacacagagctctgtagaaccttgcaaagattttggctgtgacagagcaaaggaggccacacaattgacccttgcagaggaggggcaagccctgacatccctctggctgcagaggagagcgtggcccctggcttgggcacaggctggagcagccaggattactgtggccatcttgctggaggtgctggtgcttggggccaggaagcagtgtggtgcttgtggtttgttgttagattgggtgcatattttgaagctagagtca

SEQ ID NO: 64472 - DNA, 1789 bp, Bovine  19866880498968
cctactgcttctcccttgctagtgttttccttcctccttctagggaggagtgttgtctagcagaggacagttccttgtactgtgggactgaccttcccgccccactcttgtgaaggccagaggcagcatctgggagaggtgaacagggaggagcactgagtagcactctttgctgagagccagtctgccagcagactgctctttgtgggtcccagatcttatcttatttcctctttgggtttgttgttttctcttttttcaaaaccctgcttattaaaatccaatttctttttcataataccaccaaaaatgcaattgcttgcatgtaaaaatcagtcaggcataattatttattaggagtgctgatcccctggaggaaggcatggcaacctactccagtattcttgcttgaagaattccgtggacagaggagtctggtgggctacagtccataggatcgcaaagagtcagacacgactgaagcatctgatcatgtacacactgtataataataatatacatatatcataacatatataataatagtgatgtatagtaatcaataaaatggggcttctctggtggctcagtgctaaggagtctgcctgccagtgcaggggggcgtgggtttgatccctaagttgggaatatcccctggagaaggaaatggcaaccctatccagtattcttgcctggggagatcccatggacagaggagcctggtgggctacaatccatggggttgcaaagagtcaaacatgactgaagcgactgagcacaaccagtaatttatgggggcaaaaagaagaaacagtcccaaaagtcatcagtgatgaagcaagttacattgtgatagaaacatggaaggaagacaagtcttcggtggcctgggcacaaactcccaggaaaatggtaaaaggaaaagccaaacatggaactctatgtcaagtgtgagctcaatgttgttttttaaaaatactctttataatgcatgattacagtacccagtgtacaattaaatatatagagtataaaatataagtaaatattacaaatataaaccagtcattatttcttggtggaaggattgtgaatacttgtgattacattattcatttctgaatgtgttattttttgtaataagcatttcaatttataatgagacaaactacctgtttcagacatttttcttaatctaccctgattatagcaaccgtcttacttcctttttgctcctacaaatttctagttcatttccactcatctccagcaacgatgatgactaacctcagtagatcataaaatctgggggctgctgatggtgaccatctgaggtcactgatgtgggacacagcttttcaaggttagcatcatgatctgggagaaaagaagggggtggagggtcctccttcaggcacaacagttcacacacacacacacacacacaatcaacaattacttctcaaaacacttacttagaagcaggagcgcattattaagaaaaatcaaaacttttcactaaatatactgaaaatactttactaaatacacaaaccaagagccggcaaagagctgcaccgagagaacagtcttaccaactattttaagtgctaccccaggacttccctggtggtccaacagttaagagtccacctgccaaagcagggcacacaggttccaccctgctctgggaagattccgtattaacgtgcagcagctgagtctgtgctcacacacactgagcccttgctccagagctgatgaggctcaactcctggggtgtgcaccc

SEQ ID NO: 64473 - DNA, 2682 bp, Bovine  19866880520706
caggccttgtttttgctgactgtgtagagcttctccatcttcgactgcaaagaatataatcaatctgattttagtagaaaggatttcatatttcccactcaaaggtaaggactgtttattcatttggtggagagtcttgagctggagaaagggatatttgcctacagtttcaaatagaatataatgcaaataatttaccaagtgcttttcccaatggcaaagaggaatatcttggcattttaattcatgtttaaatttggaagtgagttcagggaatgcattagtatttctatctttcaaaccaaggaatggaggtatttgtttctcaaagccccacactgggccagaattctggcaagaacagtataaattagtatcattacccttttagtcctgagaaccaccagcaaagttaagttgatgttcaatgacatcttttaaaggtaaaggggcagaagtggggaagaaacataagtgatggacaaagagatgaaaaattgaatatagactaaaacaaacaaacaaacaaactgtatttggccatgctagaatcatgtcaaatcatctgtcttccacattgaagtatttgtgttggggttgcccactgtgagagaagactgtcctgcctacagttttcttctcatcagactcgtttattactgaaaaaatgtccctttggtccagcagattaaaaaacctgattctgccttaactattaagcttctgactttgttggataaaaggaccaaccttctttattgccttctagaacaatacacttgatagctcttcctctgtaggagataaagggaattaaacttgatggaatacagatttccattttcaaaagaactttaagtttttcccacagtggtttttgtggctccgttgccagtctctgaacaattttgtaattcagtcataattctgtcaacagtaggctgaggaggatagtggctacagttgtcacatagccaggctggctatgtgacataaaagatgctcaaaagatttccagtagtgcatgatgggttctataaggatggaccaatgttcatggaaccactggctttatctcaacaatgtctatcttcacctcagaggctgttgctagggtaattaactacttagcattcagagaaaaattatacattaggttttatgtctgttcaaacttctgtatagtttaattttgaaaacacagccacaccattgatcagtcttagtggggaaagttacagttgacttgcaagggcaattttaaatacacatatttgcaaccagatatctactgttaaatgaacattttttgagtcattaactgctcacagctaaggaacaaatctcacaaaacacggataattccaccttatcctctcaaacaaattttattcatattctgctctaacaaatatagcatgaaggcaacagttgtttaagtttcttagtgtatggcacggatgaaaagaaacaaacatattcagaagcagtccagtactgaaatgctggtttaacaaaagaggcacgtattattctacttagcagtttataccagatctcagaagactttttttttcccttgcaagcaacagactacatttatttgcattaagtaaaaacatatcttgatcaagaaaattactttttttctgcttttcctttatatcacaaatgtcagggtaaggcaaatccttaatgaatcgtatgataaaaaccctattccccaagaaaatatattggacatattctgctaactttgttatttttcaaagcaaagctgacatgcaccacatacagagaaatgtcatttcaaatcgagtgcatcaagcagaactgtattaattcacaaagaggcttttcagtgtttcatagaaagatgtacaattagctgcgatgactaataggtgacccagtatcacagactgtgtttcagatgccttctttgtaagcttttgtgaaggaaggcttgtccatcacttgtgtagttaccagctagaggacagaccctttgtctctcctacaatgagtaactttttaaatagaactattatgtagaaagcccacctccatcctctgtatgcaaacaggacttaaataaggggctatttgcctcccactctccttcctataaacccttgagtcacctagcctggctagagtgtggttggaaactgacttccagaattcacgttcggagaatgaatcagtctggcaaattttccattgcacggtttgtacaatgacagcaccagtgagataaaggtttcctgtgttgtgggtatcttctatgtggccaaaagctagatttttaatgttttactattgaaatgaaaatcgcttcattgtttgttttaagcataaaatcttctagccaaacagcaactcaaaagcagaatgagggaaaaagtgaaaacacagtctaatcataaagtgaaatgtaaaccaattcgggagcagggtcgatggtctttactcctgactcaatttcctggatgcagagcccactttctttttctataattttcaggcagagagctccttcctctcattgatacccacccacattgaaaactggatgaatggctgtcattgacatcaaaaggaacaccaggacagacataattctgatccctactgttcctgccagagacattagatcttgtccgttaaaaaaaaagatcc

SEQ ID NO: 64474 - DNA, 1249 bp, Bovine  19866880703468
gtttatcgcagcagtaacttttaagtcccaacacagaagtttaactcaacaagacaatgggcattttataaagaaatactccagcaaaacagagaagagtctgatgaagccaacagtctccatcctttttatacctgaacagtaattagtcctaggatgcacacgttccccttacctaaccaacttgtttttaagaaaacacatgtacaaagattgagaaccaaaagccaataccttgattgaggtgtgtggcctccgtgatctgaacgccgttcacagagcactgggacccactcagggggatcagagtcaccgtccccccaacattctcaaagatgcagtgctcactctccaagtcgaggccgtgaagaactgagacgggaaaacaaaggaagaaaatatgtacattggtacctggtgcaatgattcccaaccttcctttattttctcagtttgaactgtgaggggaacacttatgtttagtgagaaaactgaactcaggagttcacagcatcaactgacagaacaagcttttgcatgtcactcagtgggtctggatctcacctgaaacaaaggatttcaccttcagggaaaaaacagctgagtaatgtgacttagctgattaccactgacacgctttgctcgagtctaaataacttcctcctccagtacccgaaggtcccagtaaaatggaagggacagatggccccatggttcaaagacttactgtgacctccactcttaccggcactgcattccaggagcacagaccaaaggtgaaaggtgaacgtgggagggcatgaatcttgggaggcccaagaagtctccagaaatcctgaggtgaacttgacctccacagacctctcagagagtgtggctgccaagggctacctactcccacccaaccaccctcctgctgacacgtggccaggcacagacacaaaccccggtcacacaaacctacacaatttcaggcgcagttcctggccagctgctcagaagcacaaaccaaacagcttccactatgctccacagacctgcactgtgaacagaactttttctgttcacagaaaacacgtgtgctgggcactcagcatcacgtacagcaaaccctaaggtcaacacgtaacttgtcaacacataacttaacggtgagaagaagaggcctgatgcctagtttcacccagagacttccaggaattggttcccagctctcccaagttcacaataaacggtaaatacgtgtaga

SEQ ID NO: 64475 - DNA, 1293 bp, Bovine  19866880787978
taagtaaacatacatgtttgtgtgtgtgcatgctgagtctcttcagtctgtcctactctttgcaccaaccttatgggctagcctaccaggcttctctctccatgggattctccaggcaagaatactggaatgggttgccacgccctcctccaagggatcttcctgagccaaggatccaacctgcgtctcctgtggctcctgcatcacaagcagattctttgccactaagtcaccagggaagccctaagtgaacataggttttgagcaaatacttgacactctcccctctgccctaaatgcataagtttttgatacgtggacactgggtattaaatataaccaattgcattttatgattttatacttatcatgagacatgttcttaatcaggaaacacatgggctaggagacctccatgttggcaggatgtgaaatagtcagccatgcaaccagaaaacttggttttatacaatagtttccatctggcatattgttctgttttaaaaataacgttctcaagtgaattcattctacatgagtcagtgacttttttgagtcaagaaaattagattgaaacctgtagtaaatggatccataaaaatactcattagtttctacaaacgcacactggcatttatgccaagcacttcctcacttctggttggtgtatcttgtactgtcctcgttaccgatctttctgggtaatggtgtatgtgactatgtccagagaccaaagtggaattcccatcatttgtgtgctttctctgtttgattctaattgtttttgtttcatgaacttgacttaaggcagccagaatatgattcccggcttctgctagcaacaaggacagagtctgggacctgtgagtagaaagaggcacatagacaggaaaggagatgtttgcttctgtgttcccctttgtctgtaaagcaaagagcaggtatagaagggaggaagatgttcccaagaaggaggagatctgacagtcccagagagtccaacatcatcaattagtgtgaacacagtatgcatcattttcgagcaaagaaaactgcttttgccaatcatttcagctcctctttatcacttccaagggtgtttgttttgacagttttttatttactctctctcttttttttccagtggtacatcagaaatatggccccatctggagacagtgcataacttgatgttttccgtggccgttccaatcaggagtaactacagctatcaggggagcactaaaaaatgtcaatagctataaaagtttcacaaacaagcattatgtcttc

SEQ ID NO: 64476 - DNA, 1391 bp, Bovine  19866881190263
acgcttactccttggaaggaaagttatgaccacctagatagcatattcaaaaacagagacattactttgccaacaaaggtccatctattcaaggctatggtttttcctgtggtcacgtaaggatgtaagagttggactgtgaagaaagctgagcgccgaagaattgatgcttttgaactgtggtgttggagaagactcttgagagtcccttggactgcaaggagatccaaccagtccattctgaaaatcagccctgggatttctttggaaggaatgatgctaaagctgaaactccagtactttggccaccttatgcgaaacgttgactcactggaaaagactctgatgctgggagggattgggggcaggaggaggaggggacgacagaggatgagatggcttgatggcatcactgacttgatggacatgagtctgagtgaactttgggagatggtgatggacagcgaggcctggcgtgctgcgattcatggggttgcaaagagtcggacactgaactgaactcagggtcaacacagatgagctttgggaaacaagatacattgtttcccctggacacatcctgttctggccacatggtgaaatgtgagatttccagagtctcatagccctaagacatgaattacagtggcttccatatgacagagcagactgcactatcatccagaaatacagtctctaacaggtttcctggagggaagtatagaaaccatggatgccccagcctcttccttctgtccactcgggataaactcagttggtgccatcttttcccgtgaacttttccagcttgggctcagactgggtgccccactcacagaatcagccctagacgttatcaggtacacaggccctcccattattcattctttgtcacttttaagcttcacagttgtagccatgttagttcttttattggttgggaaatatactggtgacaaaatcaagaggaaaaaaggcatctttctacagggcgatcctgtagaataaattggggatcaccttgagaaagcatggtttaagcacagtgccacagactgaaagagtggccacacttctgcagtccctccaatcaggaaatggagtccatttctctacccctttaatctttggttgtccgtgtgacatgttttagaaaatagaatattagcaaaggtgatccaaaatgaagattaaagagtacagattgagacttgtcttcctttggttgaaatcttaagaccatgatgtaaatgagtcctagcaagcctgatgaaaatgaagaaccacatagaggaaaacgtagtcacccagccaatagccaccaaaccatcagacatgtgagtgatgccagcttagatcagtcagctgtcataagacccacagatgcataa

SEQ ID NO: 64477 - DNA, 1449 bp, Bovine  19866881194351
caagcttgccagtcatcatgtcctaaggaacactagcccactcactgtccacgagaccttggatctcagctggtgtcgagatgcaaccctgccactttcccaagtgcctgacgcttgtcccatcgttatataaccatagagggggaaagaagaaaacggattaaacctagctcataaagcaagctggcagagaaagacaaacgcagtaccagtgttggtgcaatctggctccatgtgaatctggtattttgcactttggaaattcacaagtggtcaggtcagggtgcacggcaggccctggctcagttgggagagcctagagaaataattaagacacaaaaccaagaccccccagaaagctacaggactgtcacagcaaagtgctgagaatctgcccacctcaatcagggatttgcaaaatctgctccatcaaaacacatgaagctaaaagcctccagagaaatgctgacattgggaaatcactaaagtgtatccgctagaatctggtattaatagtaaatggccagggagcgaggctggctggcagaagccagggacggcaggctccaagcctcactgcattctcgctgggaagcgcagggcacaaactgagagcacgcctcctctgctttgcctttcctggggctggagctttgtccagcaatttcatttacataacatacttacactcattttcttaaacctcagacctatttctctgaagtcacagcttttgtgggttttgattgtttcatctgtcactgttgtgcctgagggaatcaccggggagcttggtaaagagaatggtttaagcagatggtttgaaaggaggctgtcctgaccctgatggtggctccagcaacaactcacggtaggtcttgccttgtcaccaggatggatttcaagcctctgcccgtgtcaagctgggctccaagaagccagcaggtggcttccgctgcagcccctaggaaggggtgggaggcaggaggaggacttcagggaggcagggagccttccagccccctgtaccggggcttcagttaagatcccaatagaccaaagggtctggaataactaaagaaaaagggccatgtcttcctcctaagggtaaggacaaacactgcggctccaagatggaagagcctatccatggcaagcagggcaggggacgaagcccccttgcagaacaccacatctggagacatgggcaaaccagttggctgccagtctcgctgagagtcttggcatcacacctacagggttagcagaaaaagcaccctccagtgtgcgcatttgttttgaggctctacctctaggaagcatggcaatagttaagaggtggtggaagagaaacactcctttaccatgaaaatagcgctggctcctagttcacaacctccaaagaagtatcagtaaatcatcgccaaatgagccggagagacctgtgtt

SEQ ID NO: 64478 - DNA, 1567 bp, Bovine  19866881956303
ctcagatcttactggtttaaacagaaatgatttctttatgatgcatacttatctcttgaaatctaggggtttattccacatcttcactcagacccagactggtcacagtagcaagagtgagagtacaaataaagaatcagttactgttaatcctagaagtgacgtgtcattttgctcacattgtcttaatccacaagccatataagttgatctaaattcaatgaggaattgaaaatagaataagtatttgtgaataattgtaaaactcatcagaagaagaataaaaacatcttcatttttaaactccatgctccttaagatattctgcatgaagacaaaagcatagaaagtagtaatatataatgatcccagaactcttgcctggaaaatctcatggatttgatccctgatcacagaactaagatccagctgcagagctggagaaggcaacggcaccccactccagtacttttgcctagaaaatcccatggacggaggagcctgataggctgcagtccatggggtcgctagagtcagatacgactgagcgacttcactttcacttttcactttcatgcattggagaaggaaatggcaacccactccagtgttcttgcttggagaaccccagggacgggggagcctggtgggctgccgtctatggggttgcccagagtcggacacgactgaagcgacttagcagcagcttagcttagcatgctgcagagcaactaagcccgcacaccgccactgctgagcccctgtgccacaacttgagagtctgtgcaccacagcgagagatcccacgtgatgcagtgaagatcccatgtgccgcaactaagacccaacccatgcatgctcagccgcttcagtcaggtccgactctctgcaaccccatggactgtagcctgccaggctcttctgtccataggattctccaggcaaggatactggaatgggctaccaagcccctctccaggggatcttcctgacctgggatcaaacctgagtctcttatgttccctgcattggcaggcaggttctttaccactagcgccaccttggaagacccaacacagccaaaaaaatacatacagaaataccacaacaatactgaaggcgcagcttgcaagtgaattcttttatgttaaaaaattattgttattttttcattctattggtaactagttaccacctattacaatgcagataaagtcaaatccccgctcagagaccccgtgtgctctgcagtagacctggacaatttagatgcattagcagttgtctgtttctttctccaagtgcttacccttcagtaaagcctcagggtaaaacccagaatatttcttagagagctaagctattttgccagtcaaattgatgatgacatcttttcttttcctgtgctgaaaatattcaaacatttcttgaacagcaggtatataggtgagtaatttgctagagaagttccagtgtctatttaaggagggaaaataaaaatagtaacataaaactattcacaataacacaataaaggcagtagcatataacttatttctttaagttt

SEQ ID NO: 64479 - DNA, 2485 bp, Bovine  19866880469087
tcttttaaaaaagttattaatacaactctcagtcttctttttaattgcattgctagacaagacttaggggtgtaatttagaaagaagcagtttatacatatcctcaagaagcagtttatacatatgtacatatacatatacaaaccaaaaggaaatctttctcatcatttgaaacaaatggtttgctaggttaaaagaatgacccacctggatatataactttagctttgatttttaataactctttcagggagttcatataatcatagaggtcttcaaatacagttgttccttcccctaggatgcaatctccagaaaacagagcattttcttcttctaagactagagccatatgatcatcagtgtggccaggtgtgtatacaactctagttcaaagaagaaatagtaacagttggaacttgtaggcttggaagaaattttgagacgtaaattattctctccttctttatggacaagacacaaataaatgatgtcaacacattttctgaaaagagtggcgtcttaactactggactgccaggaaatcccctacatgaaggtttatgaccataccaataataaaccagttaactaagtctaaataatttgttctacagagtacttgattgctcagccacatataggcaacactctctagtagtcatttttttctgttattactcctgtactttgaattgtatactttgaattactgcagatttcatgttgttttcttgtttaccattctacctcacaaggctatgaactctgaaaggcaggactcctgtctaattctaatctttatattctcaatgcttagcactcagtagtagctaatggagaaggcaatggcaccccactccagtactcttgcctggaaaatcccatggatggaggagcctggatggctgcagtccatggggtcgttgaggattggacacgactgagcgactttactttcagttttcactttcatgcattggagaaggaaatggcaccccactccagtgttcttgcctggagaatctcagggacggtggagcctggtgggctgctgtctatggggtcgctcagagtcagacacgactgaagcgacttagcagcagcagcagcaatgtcatgtttaatacgttgctgtgggttcgcccctcacctccagcaccacctcctggcagtgcctctgaaggagtgtgtgtttgtgttagtcactcttgcaagtcccactcttgcaagtacagggactgtagcccaccaggttcctccgtccatggggattctccaggctagaatactggagtgggtggccatgccctcctccaggggatcttcctgacccaggaatcaaactcgggtctcctgcactgcaggcagattctttatcgtctgagccacctgggaagcccacctctgaaggaggcttgccagataatacaggacccggattcaatttgaatttcgaataatcagtgaatccttttttagcataagtgtgtctcgactggcagacatttgggttgtttccagtgtggcgctattaagcataaaggtgtaagtcctcaggtggatgtgcttccatttctcttgggtcagtacctaccagtgggattgcatcccaaccagccaagaacaagcattccagctgctcacgtcttattaacactagtcgccctagtgggtgagaaatggtctctctctttggcttttggccagacccacctcctttcctagcctcacagccccattcaaggcttcagtcccttgatgcctggattctttagattcacatccaccctaacaatgcttctgtgtgtgtgtgtgtgtgtgtgtgtgtgcacactcagtctctcggtcagatccaactatttgtgaccccatggtccatagcccgccaggctcctctgtccatggggattctccaggcaagaacactggcgtgggttgccatttcctccttcaggggatcttcctgacccagggattgaacccacatttcctgcattggaggcagattctttaccactgagccaccagggaagcccatattgaagccgtaccccctcagaatgtgaccttacttgaaaatacggtcactgcaaatgtaaccagttaagatgagatcatttcgtgttagggtgggcctttaatccaatataacacgtgtccttaaaaaaaggggagaaatttgaacacagacatgcatttagcaaggataccatgtgtagattggaattatgctgccagaagccaaggaacttccagaagctgggagagagacctggaatggattctttccctcccccaaaacctgcagtggagaagagaatgactacccactccagtattctggcctggagaattccatggattgtagagtctaggggttgcaaagagtcggacacaactgagagactttcactttcactataacaccttcagagggagtgtcagcctgcagacacctttatttcagactctgggcctagaa

SEQ ID NO: 64480 - DNA, 1305 bp, Bovine  19866880491735
caccggggaaggccccaggaccagggctcaaagaggaagtttctgcgggtcaagaccctcatctccatgaaaaatgtctcgcttttaatacatttcttgtttaaacaaaccttagaggaccatttggtgccagattcttagaactggcgtacagtgaatttttttctttgctatttatgctacccagcctgtagactttaacttaacaaagaacgtttagtataaggtagcaatgtgaatgaatagttttttgtgtgcttactaaaaatgggggctccaaagaacaaatcaaaaatccattaggaataattctgcttacccagtgatggacagaaatcatgcagggaaatgggagggaattatgaaagaccttattctaaagaggcagcagtgtcaaatgtctgtcaaataactgttgaacgaaaatcagcccagacaactgctcagatgtaggaatgagccaccacacccagccctctgtgtctttccttctgtgtccaagtctctatgtttctgtcacacacacacacacacacacacacacacttcacaaataaaattcactcaatcagaaccatgtcagggcaaagctcctcttttggcttgatacgtaaactttccaataattactggtatgaaattctttagcagcaaagaacaaggtcattctctatgactcctttttgttctgaaggtaaaaacaaaggctctttaaaaatttttttttattggagtgtagttgatttacaacgttgttttagtttcaggtgttcagcaaagcgaatcgttatacatatacatatatccactctttttttagattcttttctgatataggctgttacagaatattgagtagagttccctgtgctgtactgaaggtccttactaattatctattttatatatagtagtatatatatgtcaatcccagtctcccaatttatctctcccctgcttatcttctggtaagtataagtttgttttctacatctttgactcaaattctgttttgtaaataagttcatttgtagcctttattgagattccacatataagcagtatcatatgatacttatctttctgtgtctgatttaagacatagtttctcacagtcacctaaggcccaacataatctagcagtcattaacccttccatcttttgtcatctgcttcctcccactctgtatttcaaccctaatggctttatttcagtccttcataagtgcgggactcactgccagtttaggacctttaaatgcctgaaaccctgtcttctctcactacaagctttttaaaattttt

SEQ ID NO: 64481 - DNA, 1834 bp, Bovine  19866880517846
tccctgtttgagttttctgagcctacagcaaatcccattggctatctatttgacatgtggtaatgtaaatttccatgttacttgcctaattataattttttggtatacttaatcattttttatttttttcagtgtctcctacagaggcagaaaaatgcatagcaagtattactacaatgtgagctcccctggaacaagcataaatgatttgaattaaagttcatttggattaaagcttattccaacaaaatcctaatggaaattagaatatgctttccattatatttatagatacatgaattttaccagtattgagaattttagcacacaaagaaccattttgtttactattctgttttctttttttacttagaaccctttccatttccccaaagttgagtacaataatgaatacatacaattttatatttgtatgctattgtgttattgaattattaaagcacatccaagtttttcttatcagaaaaataagaatacaactgacaactttttaaagctataattcataattatagcaacatcattttagagaaaggaggatcaatatggtccaggatgtatgaggaggtcccccaagcataacttggaatattctctgtaggaatacataaagcctcccttttatatgtagggattttagtgtgcagattaggagtgtctatctttttcttagcagttgttcaccaaaactcctatcagctcacttatgttaaatagagtgttgttagccttctcactaatccaattccctgcagatcttcagtatatatttgataccttgaattgtgctgttcttacacgttttcttctgtaaaacaaataaatacacatttaatatctaacaaagcacttgagcgcagtttaccaaacacttaaaaagcagtgtgtaataaaatctctgagtctcaagacaaagaggcatgcaaccatgttaacaatcatgtttttttcaatttttattttataaaagggtatagctgaattacaatgttgtcagtttcagctactcagcaaagtgacttagttatacatatgctgctgctgctgctaagtcgcttcaggcatgtccgactctgtgcgacggactctgtggactctgccccacagacggcagcccaccaggctcctccgtccctgggattctccaggcaaggacactggagtaggttgccatttccttctccaagttatacatatatgcatctattctttttcagattctttccccatatagattattacagagctttgagtagagttcctggtgctatacaatattcagtacccatcttgatctcaaagctagctgagactgtgaagtgctatttccaaattttttataaaaataagagtgactagaaaaacacaaaggcttttatgtagatctgaaagggtatgatagaataaaaatctctttgttaaggtgggaaaaaatagttaccatctcagaggtatgctgctataattcatcccaatttctgttgcctcttactgttaatttactcaagtgtttgtggctgtatggaagttggccttgtaaaaggctgaattatcacttaaaatgtgacttcatatattttacatgttttgtgactagacactacctattgcgttaaaaaactcccacggaatcctgagagaaaagaaattataggcaacggagagcaacagtatgtttatgtgaaagatggagatataattaagactgaaggtgccacacctaagggaagtcatcgtccttgagctggggaagcaggggtggggatctacgcctatgtgtttacaaaagcgggagaagggagattcatcacat

SEQ ID NO: 64482 - DNA, 1724 bp, Bovine  19866880587934
tttttgttggtagatgaaagataaggaatgtcaacataaattatttattcggtataagtatttttgctactaagtgtgttcttactgcttagtggtctgtggagtagaacgattcattttccagaatataaattatatgacacttctgtatttctattttatgtatgacttgtgataatacctttttctttgccaaaggagattttttcctttgatggatatatgaaaggaatttgttttatttacaatatggaagttattattgctctttttaaatagctggtaaaaagttcaaattgtgtgaaagagagtacaatgggagaagagtttcaattcctccacaggtccctaggcccttctttaaggggtttcttaaagtgtgaaagtgaaagtcattcagttgtgtcagactctttgtgaccccatagactatagagaccatggcattctccaggccagaatactgcagtgggtagcctttcccttctccaggggatcttcccaacccagggattgaacccaggtctcccacattgcaggtggattctttaccagctgagccacaagggaagcccaagaatgctggagtgggtagcctatcccttcgctagcggatgttcctgacccaggaattgaaccagggtctcctgcattgcaggcgggtttgcgaaagcccctaattttttaaatgggcattaaatagttgaacattttttccttacctatttttctatttaaagctcttttggagaaggcaatggcaccccactccagtactcttgcctggaaaatcccatggacggaggagcctggtgggctgcagtccatgcggtcaccaagagtcagacacgactgagcgacttcactttcacttttcactttcatgcattggagaaggaactggcaacccactccagtgttcttgcctggagaatcctagggatgggggagcttggtgggctgccatctatggggtcacacagagtcagacacaactgaagtgacttagcagcagcagagagaggtcatctggtaatgttcaaatttcctagggtgcaatatatatgaaacttgagagtctgggcccttcaatccctaaatatgtggggattttcctagatatgttactgttgttgatttctcattcaattttattttgatcagaaaacataatttgtatgattatagtcttctttaattacctgacttatttcatgtcccagcacagagtctaacttggtgaatattccatgggcatttgaaaagaatttgtaacttgcttttgttgagtgtccaactttttgagatcccatgggctgtagcccaccaggctcctctgtcagtgggatttcccaggcaagaatactggagtgggttgccatttccttctccaggggatcttcctgaccaagagattgaacacctcttcactgtgtgcggattctttaccactgtgagccacctgggaagccccttgttgagcatgctgctgctgctgctaagtcgcttcagtcgtgtccgactctgtgcgaccccagagacggcagcctaccaggctcccctgtccctgggattctccaggcaagaacactggagtgggttgccatttccttctccaatgcatgaaagtgaaaagtgaaatgaagtctctcagtcgtgcccgactcttagcaaccccatggactgcagccttccaggctcctccgtccagggatttttccagg

SEQ ID NO: 64483 - DNA, 1046 bp, Bovine  19866880654496
tgtctggaaaactgcttcctgttctgacgtctttaaatagctgttcattgcttaaagaatgtagaccctctatgatctggcctctacctacttgtccacattgggtacaccacccatcatgattcacatcctaagatcttgaagcttgtaacttgtttttaacattcttattttgaaaatgtctaaatcaaaagccctcttgacctatatggatctacaaagctggctcaatagtaaagaatcccctgtgatgcaggagatgcggagacacaggtttgatccttgggtcaggaagatcccccggagaaggaaatggcaaccccactccagtattcttgcctggagaatcccatggacagagaagccagtcaggctacagtccgttgggtcccaaaagagtcagacacgacttaatgactaaacaacaacaacaatgaaagccttttttaatatatagaccagaaaacgcagtctttatttgttttaaccaaacatttagtacctaaaatctattcatctctctctctctctttaaagtacactcttcttgaagcaaggacatgagacaaaatatgtttatattacccctacagtgccctgttaagtgctcaatatattttgacaaaatgctattgactattattttatagacttgcatgttctttctctttggaaatagaattataaaaccacagtatttcttacccgtgtaatttgatgggaggaaagacacaataaactataaattcaatttactgacttattatggaaattgagatattactaagtaacacagataccctctccagctttttcaaaagacagatacacaaaaatatagctattgctgaaatcagtttgtgacaggctttctcagtttacttagtggaattgtagcctgtaatcccccggtaaacaacaggattcccaaggaacaagtaaatctcttaaagaaattgatgaaactgtttttgttaaaaatttgaaactttacccaaaccatagaatttaatttcagaagggaaaaaaaggtacgtagaatcata

SEQ ID NO: 64484 - DNA, 685 bp, Bovine  19866880730992
aaatatggtgaaacacagtagtaagtcattcataatcagttcctcaagcaaaaattctttttaattatttgaacattggaaaaagagctcacagagaaatactgttcacagtggattccatataagcatttgatagttaattgtcactaccagagtaactaacaggtcccaatttaactggaatggggctttcccattatggtggctttttctgtatggaaatctattatgaagacttaaagtcctatactgtgaagatcaagagagttttctgtttttatttaaatggctattagagaaagttggtccaaatattccaagaaaagccaaactaatttaacaggagagtcaagaaaaggtttcaaggtatacatggatttgacatgccttttttggcctgagggatcttagttctctgaccaggatcgaacgcacatccctgcagtggcagtgtatagtcttaaccactggactgcctggaaagtcctggatttgagatgccttatggggaatggccatctgactagtaagacacacaagtacaagagaagcaaagtcaaggcaagaggcaggacagcctgtggtcaagttacctattggtgtaaccagtgggatgctagttgggaatagtagaacataagacagggaatgcatactgtgacattatagagggtgcaatatggga

SEQ ID NO: 64485 - DNA, 1326 bp, Bovine  19866880859374
ccccggttttaacctgttgtgcaattttctgtttacaggaagatattcctcgtcagctcgtctacatcggcctttacctctttcacattgctggagcttaccttttaaagtgagttgggatttttcttgggtgtgcttatggactgggcagatagtatgctactctgtcttaattcgtaattaatcttttcattttaaatgtgttcttctaacagcttgaatcatctaggacttgtgcttttggtgctacactattttgtcgagtttcttttccacatttcccgcctattttactttagtgacgaaaagtatcagaaagggtgagtctttcaaccattctgtttcttgtgtaattaaagtctgtgcttatgttggaaaggaccatgctattgccaaggtccatgctattgtcaattatgttgctttataagctactttaaataaaatgacactttttaacaattgaagttggtattttgttctctaaaatagtctttcttagcttgagagatagtctattggaactcatagttttgaaggttgatgagggtttactcagacatatgagaactcaaagttctcatacaacttttcctatcttgtttagtgcacattgttcttttggagaaggaataatgaggaaaagtgaactttcagaagaaattgaaatagtagattatagagccttaaagatacaaaaatattttcatgggaaaattaaacttggacagcattgaagtaatatgtattgtaaagagtcttggggggagaaaaagtgaaacgaggactctcatgagaattgaatacatggcctttgtttttattcagccttttccaaaattgttctatataccaggagttctgagaatcactaatagttgtcatacacatacacagaaaatcagctaaatgaaaaaaaacaaaatatttctttaactgaacttctagaacctgaaatatgctcatatgttatacaatctccaagaatgtgatataatatgaagcatttccctagcattttatttcagaatcctttttgcagaacttaagaaatgctgttttaatatgcatttacttaacaggaatctgttttctactagaatcttatctttgcaattttgtgaatctgactttgacttttttttcacagattttctctgtgggcagttctgtttgttttgggaagacttctgactttaattctctcggtactcactgttggctttggcctagcaagagcagagaaccagaagctggatttcagtactggaaacttcaatgtgttagctgttaggtagggtgatttaacacttttctcaccttgcc

SEQ ID NO: 64486 - DNA, 1008 bp, Bovine  19866880924203
ccccctgttctttagtgacctaccccgctttctcctccccttcaaagctaaacttcttgaaaccatttgagcttcctgtttctacttttgcactttgtgttcaccactttatgaaaccgatctctagtctatcagagaagcattaacttgggcccttggtgtgctaaattaagtgaaactaagtaaagtgaagtaagttatcgtttaaagagggatagaaggcaatggcacccgactccagtactcttgcctggaaaatcccatgggcagatgagcctggtgggctgcagtccatggggttgctaagagtcggacacgactgagcgatttcactttcacttttcactttcatgcattggagaaggaaatggcaacccaccccagtgttcttgcctggagaatcccagggacaggggagcctggtgggctgccgtctatggggtcgcacagagtcggacataactgaagtgacttagcagcagcagcagcagcagcagatgctccatctagagttccttaagcttctagaggtcagaaggtcacagtcctacccttagcaggacccaagagtggtatgagtgggtcaaagtcttttcattaccagtcagctctccctgccaatcttttctaatagtaaaaacagcatattataaatgtggtctatagtttcaatagcagtaacatttatactcaagaaaattatatcatttccaactattaaagcagtgattttgcttcctcatagaaatacaatttcttcctcacagtatgagtgcaattttatattcttaaaacttactgtaaatgatttgacaatagcatgtaaacagataaatggtatgacctgcttttttttattattattattgagctctgtgtttccatcagagccagtttcttcagtgagaatcatcactttctgaaagttcaaggtcatcctggtaagtaaaactcttggactgctcatatgaagtaagaaggatctgtcagacaaacaggttgccagcg

SEQ ID NO: 64487 - DNA, 1727 bp, Bovine  19866880943388
atatattttttagtcttgcattgctgaattatattaatatgcttatcaatatcaaaccatccttgcatttccaggataaattttagtaggatttgatatatgatatttttaatagtctgtcagatttaatttacattaataatcactatattaatgattaggcatttgcatttctaaaaggattacagtgcacgttagaaatattttcaaataaagagaattgtaagagaaattatttgttggttaaacctcagtaggcatgaaaatgctatcaataaaagcatctcctttgcaagcattctggtaagtgctaaagaatatagaagtttagaaaattagagagctaaaaagaacagcagaccaaatccactcatttcacactttaggaaggcagttgaccagagaggttgttaacttggtcagagaggttgttaagttaaggcagttgatgagagaggttgacttgtgcaagatcacagcctaacagtggcagcattgactgtacaaataagttgtaataagaaagttgtcgaggctgaaagagaaaattatctgaaaaacttactttatttccagtggaacataaattctaagggagaatgaaaagattgaccaagatttgtttctgaaacagtgaaggtttcacgaagaaatgatgtaagcattttaataaattaaagacatgactgtcgtctttaagggattcaaaatattatggggcttgatatacccttgtctttcagttccaactctctcactttctctgtatgtattcttggacagttctccccaacacacaccagggaagccttcctgccaagaatgggctaagtacattaccaacagggataaaagaaacacagaacaaatgaaagagactctgaggacagatatttcagaaagtctctaacttttagaactatctggaactatacccacacatatgaagggcccaggcaaagcaggggcttctcttgttcgctatgtgtgcaagttcaggtggattgtcttttaaggtctcaaacagggtcctgtgaaacctgatcagctttatgctgaagctattcacccacttcccttcctctcacctcatcagcacagtcagcaggagccttgcggagctgcccaacacatggtgcccaggcagcgcttgacctcacgtgtggccaagggctgacttttgaggactgcaacaataggactgaaaacatctgctttgcttggataagccagtgagaaactcagccaaactgactgtttggtgtcacatagcagaacaatcaggagatgactgatttttttttttctcctagccgctgtgttgacacgacctcagattctaatctaatggtacattttattgaaggcttgctataaagagcacactttaaatttttttcaaccattaagaggctgctatatttactgtttatttgaatctccaaacactctacagcagatagaacagttaatattatcctaatttaataaaagatagatgtggttaattcactccaagtctcatagctttttggttttttttttctgtcttttcccctttcttttgttttgttctgtttattcatatcttttaagtggtggagctagacctgactttaactgtctgtctctctcggtatgccacactgtcccagcttcattagcattattttctaaaaatgtatactataggagagaaagttgtacttgttagagttttgcagttt

SEQ ID NO: 64488 - DNA, 1536 bp, Bovine  19866880991733
aaaatatatgaatatattgattgatgataaaaaacattgacacaatttgttttttcttatttctaaattagcactataaagaatctttattgggaattccttggtggtccagtgtttaggaatcttttttcccagattcgaacctggaccaatctgtgttgccccatgttcagttcttgattagagagctaagataccacaagcctcatgaaattgccaaaaaaaagtaaaatgttaaaaaaaaaagaatacaaatattgtaaaaaaatttttaagccatagccagcttcatacttaatgaaactcacaaactctccatgtagtccacggtccttgcacctcctaaaactgttaaaactttttttatagatctgtgcattttcctagttaacttttatcagagactcaaagggacagagcataccaaaaatgcttcagaggcattacatttatatcaagaaaagaattcttgctattatcaatattattgactaaaattctgggatttctggctaatgcctttaggcaagaaacagaaccaaaaggcataactatcagaaatgagaaagattagatcactgttactggagaacaataagattgtattaatttttttgaatgccaaacatagaagcatgctcaagttatattagttacaacaattgattatgaacacacagaaagccaagaggagagtcagccacactgggtggcatgtgctcaggacaaaggaatataatcatctgatgacgagtgtccctgttctttaccctggagctccaccgtaaggtgattgatctgtttgtgctataattaactcactgacagaatctatatatctcttatttgtaaacaaacttgctctttccaagttcctgctcatcaggccaaactgaagtgtttgtaaatcctgatccgaggcaaccttccttttttttttttaacttttatgaaatcaatacattaacattttttttaatttattttttttatggctgtactgggtctttgctgctgtgttggctttcctgtagttacagccagcaggggctactcttagttgtggtacactggcttcccattgcagtggcttctctttttgcagaccatgggctctaggccacacgggcttctgtagttgaggctccctggctctacagcacaggctctatagttgtggcttacagacttggttgctctgtggcatgtggaatcttcccagatcagtgatagaacctgtctctcctgcattggaaggcagaatctctactactgagccaccagggaagccctcaatacattattattagagatcatttaaaagaaccatcgaaattgccaatgaaccatacttccctctaatatgagagaaatgtaaaggagaaatcttcaccctcactgttgttcagggaaacccacactattgttcaggatccataaaactggaataaatttctgggatgtgcggtaatactgaacacagctatctattaaccagatctgtgtctactcattacctgtcagtacttcacggga

SEQ ID NO: 64489 - DNA, 921 bp, Bovine  19866881001892
taggaatccagctttatttttttccccacgtggttagccagtgtttcacaccatttattgtccttccaaatggaactataacctttatcttacactagacattcatatttaagattatcgcagaagtcttaattcttttccatttatttctttcaccaactatttataacacgttttagtatactctttatatatattaatattttattttatgtatttatgaatatccccttttaactagatattatatatattccgtaagatacagaaaaaaaagtactgatattaggatacaattattcttatagtgggaaaattttgacacatattattttgagtatcccaacttaaatcattgaatgttcagatagtttcttatctttcagactctgaacatgatttaactcttaacattcagtgtatctttgtttatcatctcatgtgtcacctccagagcttgacacaaaagtcagcttactgattacaatgggagaccaactgtgatgagaccaagtgtgacagggatcccaataatgagtataaggggacagaagccaatctgtcaccaagggagatgcagtgacgaaattttggtggaaagtggccatgagagaggcccaatcctctaagtgtgtcaattatgggaaccacaggaacaaaactgtcaagtaatgcaaagggttgtttgattgtatcagaaggaaaaacacaaacctgacaaactggatcctgtatcccagtcaaactcaatagagcgaggagtaccaggccctcagtatcccagtcaaactcaacagagcgaggagtaccaggccctcaggcaagtactggacttgagttcattacagcatccaaggcattcttaacaaaaggaaaagctagttacatttaagtaaggctgctataaaaccacaaatgttt

SEQ ID NO: 64490 - DNA, 1168 bp, Bovine  19866881187056
gagatgtatcagataatgagctgtttacacaaaaaatcagtaatcttctttttccaaaaaaggtataatcaatccccattttgagatgacaaaatcaaggttcaggaaggtcaagtaccccaaactttcatagctgctaaatgtcatcactactgggatttggagtctgatctgtttggctccattactacactgtgagttgccataaagaaaacaaatgggtggagtggcggaggagagataaatcaagagtttgagattaacagatacatactactatatataaaatagataaacaagaatgacctatatagcacaggaaacagtattcaatatcttgtaataatctatagtggaaaagaatctgaaaaagaacacatatatatatatatatgactcatagataaatatgaatcactttgctgtacacctgaaactaacacaacagtgtaaattaaccatacttcaattttttaaaatgatgctaaaaggcaataaaatctataggaattccccggccatctggtggttaggattctgtgctttcactgctgagggatcagattcagtccctggtcagggaactaagatcccatgtactgcacagggcaggcaaaataaaattttaaacaataatagtaaagtctattttgtctggaaagaaaaacaaagcaactgggaaagcaggctaagtaggagcaagaagtcagcctgtgcaatccacacagtagagtgatgctctcgagtaataatctattcggtgagtaaacagatgccatccactgccaatcccggggtgcatcacttgcaccaaatcctgctgtcaacagcgcttccattgttctcaataagaacttatactgctttttcagttttctatattcacactgatttttacatgaaatttgcacattagcaatggaagcactgtgcatcaattccaaacaaagcacaaaaccaaggtctctctgagtcaaaagagattttggaagacagggtgagttaacacctgtctgggagagtttgcaaggctgtgcctggcaacagaggccagcagcagactttagcctaaggagggcaagtgtcccagctctcctggagttgtgcctccatttaattttgcttgaatttttgagatcaaatctgcccatatgtaaaaatgtcataa

SEQ ID NO: 64491 - DNA, 2486 bp, Bovine  19866880522313
acaggatgttaaaccttcatataccacaatcctgcagaccatggagagccactggagaaaatgaagcaggacattcaaagaatagaggccacaacaggagatcactaggtattttaggtgacagatagtgagtctctagccaaggaatgaaacagaaggctggaaagagataaatccctttttaatgtatgacaaaatgtggcagtttatttggtttgggaggaggtgaagcttgaagaagaagaagggttaatgttagagtgactgctgtgttctatgatgggcaaccagttgaatgatgatgctataatacatgtgacaaggaacacaagaaaaggaggtctgagggacatagaaaaggataggatcatggtgaaagtaacagttaaaacacactgaggctaacatatgagacagcctatatgaagttgtctagaggcagacctggattggaaatttaatttaaaattcacacattattagttgaaatcctttgtgtctataaaatcaccagggattggtaaagacaacatattaaagaatgaatggaagatgaagaaagggaaaaagttagtgtgaagtaaggaaaacataaaatttagaaatttatgaaaggcaaaaaatatttgaacactccaagttaagaaatgtaatttttttaacataaagatattttgatatatttatgcagcaaggaaggaagctaaagctctcaggcaaagtaaaaagtttaactggcatttgtttattatgtctttccttattagaatataagctatataagaggagagagactttaatccctgggcctgggacaaaatttgtctcatagagttgctctaaaaatatttgatgaatgaaaaatgagtgaatgaatggaaaatactctgtgttaattgagagtgaggaaaagcatgcactcttgcacaatgctgatataaactggtccaaccccatgtaggcaagatggaaataatctttaatataatcattctaaaaatttatcctgagataaataataaatatctaagaattttccatctgtgagaagtaaatatgtgcatcaatacagataaattatgtacatctttaagtgaacacagaagctgtttatattctgatatgaaaaggtttccaaaacatattttaaggtcacaaaccagagtgtagaaaagtaaggatagtatgttactatttctgtaacataaagaacatttatgaacacacttgcttatttgtacatagaataactctggaaggatacacgagcaactggtaactgctgtaatgaaaacagaagtattttctcctttaactattgctgaagattgaaatagaaactacaattgttgatagccccaaacagtggtcatccacaaatttctttgtgatcggtaacactcccacagcttagaagaaagcaacagagagaatctatcctttagtctgttactttgtttgttatcaagtacttaggtattggcactatgtagagacatccttcagaacccatgtgctacctttcttattcaaatacttacataatgtgtacactattgaacatgtctttgctccaatatttttgaaggaaatacaaaaaccgatggtgacaactgtggttgtcttcagggaatacaaatgtatgtctagtgaaacagggtttggaaagagattctaaaatttttacttattcttaaatatttattacctgttttataaaagaatatgataaaaaactaaacaatctaaaaacaaatttattgagcacattagcttgtgtcaaatactttcctaagtactttgtctgtgtggtgttatttgagaccaggaggaatgagataaacgaaagggaaaagtctgtagctagtgaacatgtgagcttgtatgtattgggggagggggtggaaatggcagagacttggaggttttcatgtgttatagattctgttttttctttgaataagagactgtcatctgttgagtgggaggaggcagggatcatgaagactaagatgaacatttggcatagttgctatagagaataggaacggaggtgatcaaaggcagataaaagaattttgtgtattgtttaaagttgcataggcatcaatctttattgcagtgctatttttcttcagaaatgctcagtggctctggtataagagtgggaaatgaacatttttagattatatatcttgttgtgagagaatgataaagtagcaagggagcagggagttgggaatactaggtagaaaagttcttgtttagttgcctcagttgtgtcccactcctggagactccaaggactaaagccaacaggcttctctgtccatggaattccccaggcaagaatattactgctaagtcgcttcagtcgtgtctgactctgtgtgagcccatagacgaaagcccaccaggctcccccatccctgggattctccaggcaagaacactggagtgggttgccatttccttcttcaatgcat

SEQ ID NO: 64492 - DNA, 2303 bp, Bovine  19866880583067
ttcttgcagtttgaggtctggaaatcctgaggtcctgacactgacagatttggtggttgatgtaggctctcctccaggttgcagactgctgtgtcctcctcacatggtgaggagagacctagggatataactctttatatgaagagagctgaagttctctttgtttgatgttcaacattagtgactcatgtttctacatatgggttttctaaaccacataagattctgcatgagtcccaacatttgtggataggagcaggggttcttactgtgcccatcctatgcttttccttcaaaaatattacaaacacgcctataaaaaaaatactgattcctccctgggcatgatacttgctgacatagaaattcagcatttgcattgtgtgtaaggaatttggtgggcaagttttatatactattgaatatcaaggaagttctggaattttacatgaagcagaatcttatgatttttgccctatgttttcagttcaggaccatgtctctctccaataatttaaaacattagatgtagatagaagcttaacctaaagtttttaatgaaagtgacactttgtcacattcttatattttctaccttacattaaaaatgcatgtaaattagctctgaaagaagggtgcatagaaatgcctttgctctctttgacctaaagcctctgaaatgattgatgcttcaatattgtgagaattcatagccttgattttatttgtaacaattgaagtcacatgatcatttcagaattattcatatttctggtatacagattatatgatatttatagttctaatttaataacaaacacacagtttccacactgcaaatggctattaaaatcacgagaatcatggaaattagatttatttgggcttcagcagctgcctgaattccacaagataaatgccaggttatttttttattgccagaccccatacttaggggaaccatgaaaatcttggaatttcctaaatagctgtcacaaagatacagttcaatttagactctaaaaaatgcattattatgcagtttcctcattcccacccccaaacactgccctgccttcctttccctccaacccctagtattcctgccatgatgctcagattttattggcttcatatttgacataaaattctgaaaatcatatgactaacttcatcattaaaagtcatagctgaattttatcatcttaatagtgttttattacctgggctagattttgggggctacactctttgggggctacaccgatggctcagctggtaaagaatccgtctccagtacgggagacctgggttcaattcctgggttgggaagatcccctggagaagggaaaggctacccactccagtattctggcctgaagaattccatgaactatatagtccatggggtcgcaaagagtcagacacgactgagagcgttcaagctgcatctgtgagtaaatatttatgaatcacttgttatgagttcaaaactgtccttagattggtaggcatacaataaactctcaagcattgtttctgccttcagaggactgatagtggctcatgtagatgaacaacttagaagaaagatttagaaacaattcttagaagattactgtggatagatgagctttaagtgatagtgcttgttactagtttagtacattgacaagaggcctatagaccaaggaattagagatacactgatgactactagtgagttgtggaagtcaaaggagacagatgaccctggaattgagttcatggtacagacataaatttatctgaataatgactttatgagtagattttggatctctttgagtttttagagatttagataacatctaatagaaattccctgtgaaagtatatgcatgtgagtatgtatgcaaatataaaaatactatctatcattttctaccatcacctatctattcacaaacataaataggcaaaaacatatatagatatcccattaaatagccttactgatcctaatccaaaacttaaaaatatctggagagatttctcaagaaatgtatctattaattgtccatttttcagatttatgtccatatagtcacaaagtggctccttttccctgaagattttcattctttattcatgttatttatttctgtggaatgtaagatacatgtcagcctcatttagatattctatacatcattagtaagaaatcacagtccgcattccctcttcttttttataaactctgactttcgatttatttttgacactattgtatttttcagggatttcttcagagaatctcagat

SEQ ID NO: 64493 - DNA, 2076 bp, Bovine  19866880610290
tggactgcaaggagatccaaccagtccatcctaaaggagatcagtcctgagtgttcattggaaggactgatgttgaagctgcaactccaatactttggccacctgatgggaagacgtgactcagttgaaaagacctgatcctgggaaagattgaaggtgggaggagaaggtgataacagaggatgagatggttagatggcatcagtgactcaatggagatgagattgagtagaggctgggagttggtgatgtactgcgaaggcctggcgtgctgtggcccatggggtctcgaagagtcggacaacgacctgagcgagtaaactgaactgaacttatagtccatggagtcacaaagagtcagacacaaatgagtgacgctcattttcactttcaatagaggtggggattagtggattttcagcaaggatctggtgccagttctggcaacttagtcacccaaacaccttgctctgaaattgattcaaagtcctcagaatttatcaatagggcagggagatactgagtccattaactgctgggtgaagcaggacttgtatgaaaaggttatccagcactgtagccaggatctcatgtcggttgacatgcaagcagagacaggaaagagcaaagaaaaatgccgatgcgacagactacttaaatctggaaaaaaagtaagagaatctcctttccacattgctctccatttccctgagtagccctcatgtggaataaagtcacttgtactaatggtcccctttcattaagctggcttatttcaatttctttctttctttttttttttttagtaaatggacatgtccttcataaattaagaatactccagttaacatgaatttgcacgaactctttgaattagtggcatctgtttctatgcaaataatatgctacattatatgatctttaaaaagatgttccaaaagctgtttaatagatatttcctattatttttggaactattcacttatttgttcatatatatatatatatatatatatatatatatatatatatatataaataaaatgaacttcagcccaaaggagtaatgtcaaatcattacataggagagtgaaaatgctaagattgaactggatcatataaaaccaaaggaagacttaggagaggctgccatttcattctgggccttctgtataagataaaaacacattttgatcatgtgctgccttcttaaaagtaaagtcaatagacatattctaagcataccagataataatgctatctttaggagaataagtggcaacattccctatgagtaatataagaaaagcaagcattttgaggatatgacaagcacagaattaacacaaatgtcaaggactatactgacaaaacagttattttagatgacttgtgcaatagaaaattagccaggagagatcaaagcaacgaatatccatgtgtccatgagttgtgaatatccatgtgtccatgagttgttattaaagttagtgccaaaaggttaatgacttaagtctttccctacccaggttaaagccctgttagttcctctgcatctcagatgaccttacaccttctttactaaaataccttttaaggacttcatattatgtctttccctttcctaaacagagtagaacaccaagagagttatcagaactgttgcataattaactcctaaatcaatctttcttccacttttgtgagctctttccttctaaaggagaagattgattgctaaatatggtgtttgatttctactgcatgttaaacttaagctttgatagaaaaataatggtctgtcacatggacatcttttgcaatgtaattttatcattgtattgacaagtgacatctgacaaaaagtggtaaatgccttaattttaagttgatgactcaactgactcaacccaaatggcaaaaaaacccaatttcattaggttactaagaataaaataaatagttattgattaattagattatgttagtgctttttaaaactcataaaatgatgactctgatttgacagggcttagaaaacctttcaaatacaataattcctatacattttattat

SEQ ID NO: 64494 - DNA, 1340 bp, Bovine  19866880941290
ggtgtgatgcatatcaagcagatatgccatccagcattcccatctgcactcagtaccaccaaggggccattgggacaactttatagttaaccgaggggtatggaggtggtgcttggaaacaggacctaagttaggatttaggaatggataactagtgtctggggaccaggaatatgtcagtgaaggtcttcattattgtttggaaactaatggggcagaacccatctgtcctaatgattattacaaagcccttgacaacagagaagtgatttgccacacagtatagtcctaggtagtgtcagtggagggacaggctgaaatgaacagacccaaggagacgttacttacgctgacagccgtacagctgattatatgtcaaaatctgttgtttgcattcccatcagcataggatggaaatgttggtttcctcacattttggacaatgttattacagagtgtaagtgaaaataataaaattaaatttcagtgtatcaattttatagtttaggttgggatgatttagcagaacataggaaagcaagaaaatgtgtcatacgtaaaccgaattaaggatgttgagttatgttactaatgtatgcaacttgagttttgtttaacactctctgccaaaatacactttattccctataatttaaaatgtgtatatatatatatatatatatatataagagcttattatgtacagtatatatataatagtactttatataatagtatattatataatatatgtaataatatatatatataatagcttattatgtacagttaattccactgttttgggtgcaataaaatagattttggaaaaaaaaattttttttaatgtgactggaagccaacatcccacttgagaaggcagatcacccagtggtccatgctttcccgtctcaccatgtgaagaatggaggctccatattcaagtcagaccaactgaacagagcatacctgtctgaaggatatgagaataagaatcagctccttaaaccacaagattgttgacaaggaggttaccaccgttgtgatcaagatacataatgtggagtattaaagttaagtattgactgtgtggttcatttttatatttatctcaaaactatatggaatagttttgcactgtatatatagtttcaggcaactatattgcttgtttgttgcagtttaggtgctaagtcatgtccgactcttttgcaacccctctctgcccatgggacttcccaggcaagaatactggagtgggttgccatttccttctccaggggatctgcccaacccagggatcataaacacatctcctgtattgacaggcaggttctttg

SEQ ID NO: 64495 - DNA, 1016 bp, Bovine  19866880949032
actgacaacttttgtatatttcctggtattctggtggaaacttatcattttatgacatatgggaatagataatatggttgaagataatgtagtctattttaagaatttaacatcggtttactgaaaggcttttatgattcaaaagaagaaaagcaaagaatattacaatgaagatatgcatgctgtttattctgggttttttttttagctacatattgatctttcagagacttttaaactatatcagttaaaataaggaaaaaatatgtctttattaagcatggatgggctactacatcaggtatcaaagatatacctgtatgtgtcctattcttttaatatttttaaatactgttattcagtgtagattcctaaacaaattgaccaagaattttaggactgatgataatttattaggattcttgaaaattattagatgtgttataccatctattccttacaaatgtgaaaggtgtattcttggaattgttcaaaagaagacataggccagtgtaaggaaaaggttggaatattcaacagcagacttgaacaatcctggagaaaatgctatgtgatatcctatcaagcctttccaacaacaacaacaacagagacataattcttacccagacaagatcataagatatttgaaggctgttgtactatgaggtggtggtggttgtttagtcgctaagtcatgtccaactattttgtgacctcatggactgtggcctgccagactcctctgtccacaggatttcccaggcaagaatacttggagtgggttgtcattttcttttccagaggatcttcccaacctagggttcaaacctgcacctcctgtttggcaggtggattctttaatatttagtcaactgggaagccccatactttgaggagagaatagtaaacaagtttatctattagccagctcagataaacaggaagcaactatttcaaggaatgtgttgtaaagcgttttgaggccactcccagatcttagcaaggatacacag

SEQ ID NO: 64496 - DNA, 1501 bp, Bovine  19866880964004
atgttagtcatagtccaaagtgctaattattactaaaatttctttggaactttgcaactttgctataagaacacatgagtacacctacagagtctaaatttcatttgttctgttcatagaaggaaattttactcctaccatcttggagggttaatagccaatatttcaaatgaaatatttcaattattgctataagtttaggagcattcatttaaatgttgaatttctcacttataaatgattaatgattaaaggcttaaaataaaatgaattttgttaaaaataagaatattatgaaaagaacagaaaaaggatataatcaattaaaaaccatgccctttattattgtttagaacttaaaatgataagcaaaattctaggacaagagagagactttgtcataattttaaggtcaagagagtcttagaatttcagggaggggtatttcactctaaacaaagtctgtatgatacccctgcaatttctaattatagaatgaaaaattccttgattgctactgattgatgtacaaaacaataaggttcccagtgaattttcagaagaaattcaactctcttgcttgcacacatggtaggtggcagtcttttcctattgcaatttctaattaatgtttaaagccatctgagccagaagaaccctattctttggtcatactgtgaatatctaagttctccagaatctattcaggcaaatttgaagtcttttatttgatccttaagccccttcatgatgtatttcctgcataagactttcttacttccaatacttgaagagaaatgggaagtaccaattaggatattattttctattgattaaaacaacggattattaaagtatcatgcatttatttggaaaatgaatcatatttcattttgtaacattttctaataaaaacttgcatttgaaagcataatatgattacaaactggaaagggacattgattggacagaggttcttaaagtctacaaagttctgggcttcggggcattgaaggcttctgaaattgtaagatactttatgttgatgaacatgttcctaactagaggattcagacagaaaagacaagatggaacaatgacttgagagtttgtggtccaagcaacagacagagtggaatattccattgactgggaaagtaggatttcaggtgattctgagactttcaagtggagctgggaggtgtagatcaagtgtttagttttgtgtggattaactttgaaatgcctgttagataggttgagtcagtcagaactcactggacccaggaaggtaagaaaagcgagcaaacaaacaaacaagcaaatgcagtgttgaggtaagtaactatgctaaaaggaaatgctacagaaatccaggaacacggttatcctgagggtttgtctccagttctgtgcacaggctaatctagtctttctcccaggaacattaaaggcaaaaatatcaattttacctttgagaaagaaaccatttatttccata

SEQ ID NO: 64497 - DNA, 1150 bp, Bovine  19866881242828
attacttcatttgccattcccccctttgtctgtgagtagaaatatttgaaaagtagaggattaggaaatagttaagggttaatggaatcatcctgatttgagatatttgtgatacaaagctttaaatagatttttcacttttgtttgtactttccaatgtaatgttttagtaaaaacggatagcaaaattccttttgtagtatcagataatgtcttcaagggaaatattgaagaattgtctcttatagaaggatttttaaatttatacatttaaaatgacaatattaattaaataagataatcaaaaattgatttatctttgtttataatttgtttttctgaagattatttgaagggatatcagaaaaaataatagaactcagataaatatcttttaattataaaatcaagggcatagaagatttaaatttatcttttatagaagactttttaagaaataatctaaactagtaaaaaaaaataatgctaaaggcattaatagtagtttatttcaagaagttctataagcttattttccgataagcaaaaggttaggcattactcaaatgtggtaagttacagaatactaaaatgttacctgtcatcatggcaatatttcagtatgttgtcatgatgagaaaactattctcttggatttggaaaagattaatattgctagctacttgccaagtactatattttaaaatatcctatttcattcttaaaatggtaaacattatcctatttttcaaatacacaaagatacaggaatgttatgtgtatgtgtcaactagtataatgcatttggtacaaaatctgcattactgaaatctaatcattttagatacagactgcaaagggtgttctgtcaagtgaaaaacatgaatcaagcaatatgaaggcagtgtgtaacctactaaattatccatttgaggttatgttcttgattttctttaagcaaaatttcttgaattagacatgaaatgtaatcaacgggtctcttaatgtgtcagtggttttccataaagttcttccctttgtttgcacagctgctttctagagacctgtatatcacatttcccttacattattgtcattgctgttttaaacctagtgaccatttccaggaagaaagttgcttgcacaaatg

SEQ ID NO: 64498 - DNA, 931 bp, Bovine  19866881486708
ttgctttctaacaagttattatgtactctctctgctttaatcttcagattttttttttagaattgctttaaacttgtaatatttctgctaaaaagcatgagtgaccactcactaacagagagcaaccaaactgactgtagactttttctaacattcaaaatcagtcacagtaatgaccaatttctcttttaatctcttctgcattctaagtagctgccaaactcattgttattttatgagcatgtcccactaaatacttccaggatgcagtctgaaatcttgatcttgccaccacttgaagtatgctcttccatatcttgtgctcaaatgttgtttctttgatattcgttgtggataaattctttataaaactttcctgatttttctcaaccagatgcagtttttcctttgagttatcataaaaatataaacaacttccatgccaatctttttcttttctattatagtgtcattttttagtttcactttttagattgtaaacattttaaagcaagaaatagtgtatcatttcctgtatgttctatatagtacatctcaatgccttatacaaaattaaaattctgtaaatacttattagattgagagtaatgtgtcattgatacataaaaaaaactgtgtactctgaatcacatgactgggaaagaatatttacaatttacctaaaggtgcaccttagaacaaaagggaatgtattattgttttcaaattattttgcttgatggtagattaaaaggtagcatataaccatgatggttcaaatgaaatgaaatcttctcagaagcatggttcttttgttttcaaatccctgtataaatatggtagataaacttatgaaattgctttggctcactgaacttgtgaagtggactaattaggagatgtatacatttagtatttaattagtataatg

SEQ ID NO: 64499 - DNA, 1601 bp, Bovine  19866881554357
gagcctccatgaggaggtccattagagactggggaggggctgggcttgcccagtggagcttctcaactgcacaggtgcctgagcaaatccagagcacctggccctcagactctcagagcgacgtccttctgaactggagggggagtatctcaaagaaaccctgctaaaaaggacttagctctggtctccccaggcttcctgactttgtgagtgagaagtagtttccaggatgaacctcagatttcacctctagccatcttcctctagaggaagggaaagggcaggtttttttttcttgtgctctggtccaacgaagatacagtagatgagagatggacaagacggaggggaggaggtgaaagataggaccccatggcgaggaaggtagaaaagtgggcctaatggccagcccccccaccacagctgatactagtgggggatccttgagggtctacctgttccccaaggacaaacttggcatggcaggagcctcagatcacttctcctggctgggatttacaccctctacaccaagtccctgcccttggttctgctgttattgtaaggattgaggtagttagttacttctaccagagtatccatcacctgtggttactcaaaacacatgctcccaaggcgctttcagttgttacatttaaggagaaaaatatctttcttttgtcctatcagattcttttgtcctgttagatccaaccgtattgaggcaccagtaatggcaccatcagactgttccccaaggaggtgcgtagggccagggtcggggttggggtttcggccctcaccctctaaatccaacttaagtcatcaggcctcctccctctcccatgccaaataaagaagccttgtgaacccaaaggaaaactgaagttttcaggtgatgttactctaagtctaaatataagggaaatgttctgcatttaaatcatcatatatttggaagggtaatagttttatgatccctggcgttgatgcagagtttttgcaacgtaccttcaattactgggtcaggctgtgctgctttccatctgtctgttgtctgcaaacatgcaaacagttgcatggtttcaatgtcaaagccactaggatctccccatgaacacattaggggaaagaaaggatgagagagggaggaaagggttgacctgaggcacagcttccgtgaatgaggaagttcacgtggaccatctggggctctgtgaggtcccaccaaagtactggtggttcccagttgggcaccgttgaaaactaaccgatgcctctcctccctggacaggatcatttttactatctgagcagaatcttgccggtgagactacacatgaaaaccgttttctcaaacaagctactatggcagtcttcagattgcctttactgtccagttacccaaacatgtgtttgaaattactgtttcattccttggggataggacaaattgttcactgtagattagatacttaaaacacattcgttttacctgagtcacatctttatggaaactttcccaggattgaatttgcaagaatccgtgactggcatttatcatagttattaagcataataaatccaaaccaatacaagtt

SEQ ID NO: 64500 - DNA, 942 bp, Bovine  19866880522390
ttataatcataaaaactgaaattatagagcctgcaatatttacagatcaatcttaaaacgtaaacatttagtaacacaaattaaaagtagagaaaacagataattttaattaaacattaatacacttaataaaactacgtttacactgataatacttaacatataatagaaatacttaaagtgttcagtgtttcaatttttagtagcaagatacagagaaaagaagtaattgtctaatattaacttactgttggagctacattactctgaagttactatttatggagttacagtctataactactcaaagaactgggagctaatataattcaccatcttttaaaaatattactaataagatattggtgaatcctgtgctaaagatactgaaggctcttccaaaaatgagatctatgttggttgagtataccgagtcatataaaactagaatagttgagttagtctcttattctaacttctttttaagactgatcttatcaaaagaaaagtacacaatacctctcttaattctctcagatagagatattctttggaataaaaataagtatttttttgtgtgtgtgcacatgtgcagttgctcagtggtatccaactcttttgtgaccactgtggactatagccagccaggctcctctgtccatgggattctccaggcaagaatactggagtgggttgccatttcctcctccaagggatcttcctcgcccagggatcaaacccatgtttcctgcattggcaggtggattcttcatcactgtgccacctggggagcccaaacattttattagcagtgtaaaattaaagatcttgatagctattatggaaatagtatattgaaaaggactcaaaaactactggactgtacaaccaaaaaagcgataaattcattcaactaagaacagtgtttactgacatctactg

SEQ ID NO: 64501 - DNA, 1400 bp, Bovine  19866880535658
attattcatcatggattgggaatgttctggtgaatgtatcagtgacatgagggttaccaaatagcccttcaggaaagggagtgagaataaggaggatagaaataagaggaagtgtgtctctaataatccttcatgttttaggaacctagatgtataggcaaaaacaaatgaatggaaacttaaaaaatggttttataagcaccttagtttgcttgtgtgtcacacaaagaggctggaatacgcaggaccaggaggatcttgaaaatctgcagttctaaatacagtagcttgaattttttaattcagggcaatatggtaaactaactatattaaactaattaaatattaaaggcattaatctggtgaaacaaatgagtttttcttttattctatgggtgaatttctaaattgaattataggatcaattgctactccacctggaacatacagatgtagttaaaccacagattctgttttttttttcctgctgaatttagtggccctgcagtgactatgtcagagctggacatttattgaaaattaaagactctggaaaatcaatccttacctcaaagtggtaataaatcacactttctaaaaagagtgttgctgcatcccaaagagatttacttaagaatgcactatcagtacctaacctaatacttcaaaaagtttgatacctaaatgaaattattaaatgtatattagcctttccatgattaatattatttgcctgagaggcttgaaggtgatgcactcacatattcactacggaaggtaatgagcaaatagcgtattgaaatttaccatgtgctcatttctgctgttatacagcagaaaatagcataaatgaactcatgtctttatattgaactaaggtatgtgaaatgcttcacctcttgatttcaataagtttcttattctctcgttagacattaaacacccaggacattttcttttctttttcattttccacttctttgcaatagaatttccgtaacatacttgtctctttcagagaaggcaatggcaacccactccagtactcttgcttggagaatccagtggacggaggagcctggtagactacagtccatgaggtcgctaagagtcggacatgactgagtgacttcactttcacttttcaccttcatgcattggagaaggaaatggcaactcactccagtgttcttgcttggagaatcccagggacagaggagcctgttggactgccgtctatggggtcgcacagagtcggacacgactcatgcgacttagcagcagcagcagcagcttgtctctttaaccattgttttttttattacaaattgtgatatgtgggggcttccctggtgatccagtggttgagacttcaccttccagcgcagggggtacaggtt

SEQ ID NO: 64502 - DNA, 1017 bp, Bovine  19866880549043
atgaaatatggctcctctttatgcttgatgtacctgattaaattactccagcactcttacttatacagttatcagtaagttgaatctacacacctagcctacttgacatcccccacaaaccacacccccaccagccccaatcatcaatgctggctcgccggccttggccacatagaaatcttgtagaaccatgtgacatttctatattgtgagttcttccagcaataccagcgtaccctgattctgctttctatttcccttctgttgaagagaaagaggtggagaagtgaatatgggtacttatgtgtttctcagtctgtttggtgttgaggacatttgctagatgggagagagcaagtcaaggcaaactatgtaagcaagtgatttttgaagacaaatttccacatctacacttgactcaattatagtttaaggtcatttttctcccacacaagatggaaatatacaaactcctttcatccttggaaggtaggaatatgagcctgtaggagccaggagacagcttccagtaatatgtataatggaaggtctgtgaatctcaggacacagatgttcacagaagaaatttgaagtagtacccataggaactaccaagaaaatagccttactcttcttatttcccttttgtctactgactaacctgctaaacactaccaaaccatttagcggtaaaccaaatgagatagtgttggcccctctatgcccctgctgctgcttccacaggtctttgtacagttagcagatgttcatatagatcattagacttctttcactgtttagattgtgtaactggagatgtaacttctaagcaatttccttttgcagttttctcaaccttactgggactttaacatcaaaacacaagctgtagaaaatcaaacagagcaggatttacatgttctggaatcaagactattgctcctgttttatttacttcactcataggactttgatgagggatgttttgatgagtatctctcgaacagttggaacatt

SEQ ID NO: 64503 - DNA, 849 bp, Bovine  19866880633563
tgaatgaaacttgcaaaacagactgagtgctacaactgtgaaaataaaccagagtatcaaagcatctgttctcacgtagatgtgcttaggtaagatgtagacagctgaatggtataattgttatcataaatttcatactccattgtccttctgccagtgtaattattgttaaaataattagaagtgtcctaagtggatgttcactgccaaggtaaggaactagttagattcatgataggcttttaaattttaatcacctcatttcttcaaacaaatgtttcttacctgtttatataaaaagaacatataaaaggtaaacaaagagcaatgaagaggatgaagttataaggtacataattatattcatgcaagagcctccaaaattattgatgcagcaaggataaaacataactttagaagttctagtaggaacatatggtaaacagtttgcagaaattgcagaacataataagcatatgggtttattccatatgatctgaagcaattttaggggcagagaatatcatatcaaagagtatgctcttttaagtatcaaaatagagcaatgttaaatattgttggcctggatcctatggtggtggtggtggtataagagtgtgtgagagtgtgttaaagagaaagagactataaaaataactgagaacttaattaaaataaaatatattcattataaacatttaattggacacttaggaattgattatgtcaaagctcattggcagttagagagcatggctttgattttactaattttaattttctccatcaaaaatagccagtaatgctgagcagaaatgataactcttatttaaaaatatttaaaaattt

SEQ ID NO: 64504 - DNA, 1500 bp, Bovine  19866880802939
aatctacagcaacgctggggagaagagctttgaccgacttctgcgcaagctccgagagcggcttcccaaggccagagtggtggtgtgcttctgcgaagggatgactgtccggggcctcctgagcgccatgcggcgccttggcgtcgtgggcgagttctcactcatcggaaggtaaatttccatctctttctccctctctctctctctctctctctctctctctctctaacacacacacacaacttgctctaattgaactggactccctgactccaaaacagtgagatgtgctttggtcctgaatctcactgagagtgaggctattgctgttttcatgataaagaagagcagagcagtggatgacaagatgatgagagtgtttcagaaaaaagcgggaaattgttgctggaatgttttgtcgtggtaaactgttcttttcatttgcttctgggcttctacctctcctcctccccaaaccacatgtcttatattcctaagcatagatatcttaatgaggtcttggtggatgaagggtagtagtgaagatggaaatatatattcaggtctgaaatgtagaagaccagctgaatgcaggtgtggacatgtaaccaaactctggtacttggtcatttaatctcttacatatatgggatggcaaatagtggtgctgtcagcatgtgatttctggaattgcaggtggtgggttagtctgtgttctttctataccatgtgtagttgtgagggaatagattttcaatatcatcatatttttcataggatctttaacctaacaggtatcttgtttaatttgccttcttctaatatgaatacatgacggaactgatgaatttttccaaggaacctactaaacgtaccagaatgaaagcttcctctgatctctgactctgctgctgctgctaagtcgcttcagtcgtgtccgactccgtgcgaccccatagacggcagcccaccaggctcctctgtccctgggagtctccaggcaagaacactggagtgggttgccatgtccttctccagtgcatgaaagtgaaaagtgaaagtgaagtcactcagtcgtgtcagactcttagcgaccccatggactgcagcccaccagactcctccgcctatgggattttccaggcaggagtactggagtggggtgccattgccttctctgaattatattcctagatttacacaaaagcagcaatttcaagtatatactgacataatctctcttctttcctcaaatagtaaaaaaacatccactttcctcaaatagtaaaaatatcccccactggtaactgagaattctgaatttctctgtatcctgttttcaataatctctgtgtacattatatatatataactattttatacctcattcttatcaattacagagttaaatgaaaatattctaggtatgtgctgtgcttagatgctcagtcatgtcaaactctttgtgaccccatggactgtagcccgccaggctcttca

SEQ ID NO: 64505 - DNA, 1864 bp, Bovine  19866880972331
atacctttctgagtttccatttttcatctataaaaaatgttgtttagaaaatccccatcttgtagaattgtgaagatcacatgagaagcaattagatgtgaaagtgctttacaaaacataaagcactatatgtcagtgagataacatgctaatcaatcacttacctcattgcaacatgaggaatagaagtacaaattgaataaagcaggttgttgtatattgtatgctgcagatgtaagtcttggagatttggaattaacttccaaattctcttctgtcattcccgcttcccttcatttaaagtgtttaattagtcattggttacatggagccaaacttggcatcttagaggaaaaaaaattgtctgttccttgaaggaccttaaactattccattggatttattctttaaaaatagttgtgtcctatctccatttttttcccttctctctggacttctttcagtttttctacattaactttagaattgagtaccttgggtgactgtaatgtcactacattgttatttagagaaaacattattatcttcttttctcttaatctcacataatacaccgtgttctgaatttctacctcaatttctagcctcaatatctgcaatttaaaatggtggcatgatatttgagaactggatgtactaaagtttccttcattttaagcattcaggatatttctgatctattttgtttttcctcaaacatatacagtagtgtgctgctctttagaagacttcttgaaaagccctgatttgccgcatttgctgattcctgttgtgtattctcccactgtatctgacatcaagccaatgattttatgtcactgaacttggagttgggaagagatgcccaactggatctcatgaggcagtatgagcagctcctgtccatacctacatagtgtgatgaggaacatattaataaacttgggtttcccaggtggctcagtggtaaagaatccgcctgctaatgcaggagacacaggtttgatcccttagtctggaagatcccctggagaaggaaatagcaaaccactctagtattcttgcctgggaaattgcatggacagaggaacctggcagactgtagtccatggggttgcaaagagttggatccgactgagcatgcatgcagtgatgcagtgattaataaacttggaatagaaagttctaagtagtgtcttatcactaacttattgtcgataaaccatacttaatgtttgtatggtgttttatgcagtgaatactaaatatattcattatatgtctatccatataataattctacattttaataaaaagaaaataaatagatcattagattttaagattaacttcacctggtttttctttagttagagaagctatttatactcaccaatctcaatcttttctaatctaacatccattatatgtttaaaatatttcaaagcttaccttggtcatattctatcatctatttgctcatgatgcggttcttacttcatctcagagtgtacactattgagagaattttgcagagaaggtattttggtgtcatagtttctgagatgttatataacagggagtcccccaaacctctgaatgttgcttcattgttctttggtagacattgttgcaggagaaaaatctatggaactttcaatttgatttattttgaaggtgagctttttttttttttttccccagccaggatttttagcattcttgatttttgagacaacaataaaacttaccagtatgtatttagattgccaaagttctcatcccattttgcaaatcctctcagtttccaagtctcccacttagttctgctttttgttctctctttgggataatttcttctgtc

SEQ ID NO: 64506 - DNA, 982 bp, Bovine  19866880973754
tttctgattcctcccacaagacagtgaactcctcaaaggcagacagaggtgcctgattttcctctgattcttcaggtgattatccagaaaggtttattcaaagaaatgaaacatcaggtatcttctatgggtccggtctattgatgcaactaagtgcctggagactgtctcctggttcagctttgcgtgtatgtagacagcatttttcttctataagaatgagcctcatttccctcaaaacatctcagtctcataatgagaagcaggtgttcttctcatttcttagatggataaattacaaaacaaagaggtgaacagacggcaaaggaaaagcaggcagctgctgaagcaggagtggattcttttttattgtgtgtccctatccagcaggtcttgcatgctgatttccttgtgaaatctgctccagtaaagcagccatttgccagagtggaagctgtgtctcttctgcaaaggacccacattcagtcgtcaggttcaggtctcactgccaagaggaagtttatttcagggcaaacctgaatttctggcaaccaaggctctgccatagagagtgtcattaattctgggcagtttatgttcagctggattagccccaaagcagcacaagctttaatgatatcatgctcataaaacaaccaacctaaggtagaagcccagtaattgcctggatatgttctgatggcttttccagaaccatctccatccttcttcaccctgctttgggccccaggagactaatccttatgaattgcaactgagtttcttatcctctggcttaaccactgtgatcactagcagaaaatcagagaacaggagagagagattcattcccagctcccttcctgccaggctgcagtggagcccctcgctctattcctctaactgggatgcagcttctttgttgttcagttgctaagtcgtgtctgactctttgtgaccacgtggactacagatgccagcc

SEQ ID NO: 64507 - DNA, 1113 bp, Bovine  19866881001664
ttatatatatatatatatttgtttaaaagaacctgtatcttttaatgaaataaactgaaatattaacagatgaaatgatataatatgtggggttattgttgctgttcagtcactcagttgtgtccgattctttgcgaccctatggactgtacccaccaggctcctatgtccatggggttttccaggcaagaatactggagtaggttgccatttccttctccatgaggggttactacttcaaaataattcagaatatgggagaagcaagagtaagaaataatattggctatgaactgatatttccaaaataaaaagtttaaaaaagtttgttggataaaaaagtgggagaaatacggaagagctattcatcactaattaaaataaatctatataggaaaaaggagaaatggttagcacttcacttcctagggtcctgtaaaaatctcatctagtgcccatccctttaaagacaatgataaagcagtgacacaaatgattctcataaatagattacttttacaaaaacactagatgacatttcattttattatttattttgtggagtaaagaaaataagtataactaggaagctgagattagtcacacgttagtctcccacttttataaacttgctttctgtccctaacattcatgattaaatggtatagtttctttcatgtattagcacaattcccatctgatcaggttacaaaagcaattcttagttggaaaggcatgtaaaaaaaatttcttggtttttaaaaattccatcaaggcagcctttactctagttggaaaaaccagctcaaacttttatggatgagggaactcataaatgaatttctctaggtgtcaattttgaaggatgtcttagaaaataattttgttcacagtaacacacttattctatcccatgctttcaatatgatttgtttactgaccgatttcctccaccctaactctctcatctaatccctctgatcaatttgcctttctttaagtatcttatacttgccactagcaggggtgcttttgaaatgctcctgttgtagcatccagttgacagcctctctttggtatggtctcaacacaggcgtcagcgcaggatgctgg

SEQ ID NO: 64508 - DNA, 699 bp, Bovine  19866881017134
cctggtttgaatcctggaccccagatgaggagatagccttaagtattttctctagacttctttcctcctgtgcagaatgtgcagaatgggggtcataccatgcacctcaaaggattgttgtgattactgaattatgtgtattgatgaacaaagttcctggaacaaataaaaatccaaggaatggtgcctagtgtgattctctctgtttctctaaagttgtagaatctaaaactggacctaggctttttcattgactcaagagctttagattcctttatttctgtgttcctatttataaaactcaagctcgtgactgtttctttaacagcagttttttgctctccactcatggtcaccttgttccaagttgtccctagatcattttttctgtcattggtgcaaaaaaaagcagttccttttccattttatttttggactattggtgtttacacaatgcattcaaaagtctgtgtttgtctatattgagtctctctgtcactgaatcttctttaagtttcagatacttaacctattttagagttttatgtaatacaccagtttgttgtttctctaactcaaattcttcatgatatggagaaagaagctaagagaagggaaaatgtaagtggtataaaaatataaaggacatcatcattcttggagaaaagcagcatttttccatttcagttgtcacatggg

SEQ ID NO: 64509 - DNA, 1038 bp, Bovine  19866881033089
ctaagagaattgtatcatatatttttattttcataagaccttattctaaaaagtatcatttgttttaccattattcataagcttcatggcaaaaaaaaaaagcttagagagaaaaactgtcaatgttctagacatcaaaacatcatctcacccttgactttatttaaaagcttcaaagaatgcagttctgctctttggaaatttaaaagagaaagaaatttagataatctcttttgatattttccatttaaaatatttatatgtatacttatgtggagggctgaattaacaacacaaatgcagcaatgtagttagcacaagtaaggccctgttagtactctatatcttcttggactgtcaagttcaagagctcagaagttaaatgtagtttaattactgtcacaagtgggatactgtaagggtttaagctgccagagggagtcatcaaacaacagtacaattctagtggctcaaagtatcctatacaatttactatgtatgggtttagttttttgacaagaccttggcactatgaaaaagacaggactacagggcatgatctgtgccttcaagaagttccaatttgagctgggaaacaaaagttaaatctcacttaaaacaattaaagactagataaatcaaaggaataaaagtgcttttgatttcatggctttccttctgtcttaccggtggattttacttgatgtttctgtcaaaaagaagtatggagcttgaagacttaaggagatgaaaagaacatttcatcaaataacggtttgtctttaacctattaaagttttattctgtctattgattatttctgcagctaagtagatagttaaaaatcaaacagattttttaaatgtatgttgaagttaaagccagcatacctattcgtcatctgaaggtgaccgtctatgaagaaaatgagggaaaagaacaaaaagggccaccaattcaggggagagctgaattggctcagttttggagttgcatgaaacccaagaggcatctctaattccaaacagcaatttaaaa

SEQ ID NO: 64510 - DNA, 822 bp, Bovine  19866881128240
attatcttccacaatgagctctctttagcttttcaaagacatatggattccattaatatttatactgtcatttataaagaacaattcatttaacaactttctcttcataattattataccttttaaagaaggtacaatgactagactataataaaagcagatgaaactgagctattcattataatatctgttttcttttcactacttagtgaaaaaaaaagattttttatagtgaaaaaaaatatttttatgtctttcccagaccaatatggataaaatatccatattcaataagctatgcaaatataagccaaatatggaaatacccattctttgccacttgatggcactaaacaaattaacaactagacaaattgtactggttcgatactgccaaactaattttttccaaaaaaacacatgtagaaatgaaaaatgtatgggatgatcaggaaaaaaatctttctttctcagaaaactgaacctaaaacacttctatatatatatatgtatgtgtgtgtagatacacacacacatatatatttcatgtatatagtacacaaaattgaaataacatgtttttaacaccataatcagtgaggaccttaaaatatacactgtatatcatatatatgtatattcgcatgtaatatgtgaatccctttagagtttaatattaattttagatttcatttagaagtcatatctgtactatctggtctctaatattagaagagtttaaattatataagttaaatatgtaatgttacttttaaaaatgtagattatttaatatactactagaattaaactagaaactaa

SEQ ID NO: 64511 - DNA, 766 bp, Bovine  19866881139318
aacaaagcatccaatctagtcttatgtctagatcttcacacatatttatttgaatcatattttataaagagacatcaatttttgtttcactgctggtcagtagtgtaaaagatacaaaagctgatttaggctatttttagtctagtttttatttttaacacactatataagtacaattggttaactagtgtctggtcaaaatatgttgatgccagagtatgtatttagtaaaaaaaattctataaaaaggattcttcatgtctagaaccagaagagctcttacagtaattcactgtaatttacctcctcaaagtaccacaggcctatataaccctccagagggagaggctgcagttctaaacagtgaccacttccattgtcctaatgctacccttgtcctacttctatgcttataaacatggcactatttttaccttgaataatgcatggcttggtggcctgcaatattaaaatagaagtccgtcgtgtgcttcatctcattggtgtgcccagtggccctcgatccagtgtcctattgggagacaataaacaccatccaccaagttgttttcattgtaagtacagcaacggtcgtggtgaggcccgttgcctagaacaagaaatgacaaacaaagcaattacatcaatgctttgcttcaacagtcatagagttgctgatgcaaaattaatagcaagacaaaaataaatacaaagctgcataatctacacatctcagtataaacaaaaatagactaagttggtgatg

SEQ ID NO: 64512 - DNA, 888 bp, Bovine  19866881156147
ggatcaaacccaggtctcctgcactgtaggcagattctttaccatccgagccatcagacaaagtttatcgatctctataatgtaaagaaaacattgtgtatttcacaagaggtatatatgaattgctgtggggctcccctggtagctcagacagtaaagaatttgcctgcaatgcaggagacctgccttcaatccctgggttggaaagataatcctggagaatggaacgaatgcccactccagtattcttgcctggagaagtccatggacagaggagcctggcaggctacagtccttggggtcgcaagagtcagacatgactgagcgacttaaccaccacaaccaccactttgcactttaggaagatttttctagttctgctcttcactgactgaaatgagaaaaagttaaagaatgagaggatcgaaagaaagcttgctagaatagtaaactaataatgatagtgatgaaaatggaggtaaacagatatcaaagatcacaaagactctataagagactggtactcttgatcttatgtaatattattctctcacttggaatcttctttctagttctgaacaacctgccttttcttttagcaccatgacaatggaggaactgctgacatccctgcagaagaagtgtggcactgaatgtgaagaggcgcatcggcagctagtctgtgccctcaatggcttagcaggcatccacatcattaaaggtagaaggtgatgctttgttatctttgattcttctaaatacttataatgtaaatcaaaattataattatagttataatgtaaatcacagtctccccagaaagacactttaacacagtattaatcataatttaaataggtccaacttaatgggagagcagttatacag

SEQ ID NO: 64513 - DNA, 1001 bp, Bovine  19866881177253
actattaagaggagggtccggatggggaacacatgtatacctgtggtggattcattttgatatttggcaaaactaatacaattatgtaaggtttaaaaataaaataaaattaattaataaaaaaagatgtatataatgcacctttaataataattatcaggtgaaaacaacctgtatctatttactaatgttatgagtaaggtgagtgaagtcactcagtcatgtccaactctttgcgactccatgggctatagcctaccaggttcctctgtccactgaattttccaggcaagagtactggagtgggttgccatttccttctccagggaatcatcctgatccagggatcgaacccaggtctcctgtattggtaggcagcttctttaccactagctccactccaattaagaagaagcccatcctgtcagtatttatcatacagagaaccaggaggctaagcacatgtcttcagggaatatttgttatgcaaacccttttccaaataaacacaaccagcttgtgtgcttgtgtaaatctgcagtgacacatgtacttccctaccaccagtccccccggtctgcacttgaaggggatgtgcctgttgtcagtaagaagtctctttccagcttctaccccagctcagaatgaaccagcatttggaaaggtttggcactgagttagaaaaatcacatggcctttacgggaccattttctttgccgcagcgatggtcccagatgatgttgcaagaattcatcaacaaacaaacagaatatgtgacaggttttcctgttgtccaaagatcctatattttcatgaccagtgaatacagaatccaaactaataatattgtcacttagtgggaaggtgaaatcactctgactcccaggagtttagtgcctttttaataacactagtctcagagttattagtgaaaaggggattttatgattcatttttctgtggtgcgttaactgttacaggccactagggtatcattaaa

SEQ ID NO: 64514 - DNA, 1039 bp, Bovine  19866881214780
tattttaatatctaggaatgtataaattcttaaatattgtttaaaattacttttagttcttcttaaaactgttttcatacatgcttaatttcccgatcacaaaaaattgataacatacctttaaattagaaaaaaattgagtgtgcatgtgtgcacccatacacgcatatgttaatgtgtgttgcatcctcacatatagtccaacggacttctagctctgtcttttattgaccaaagcttatatttgactttaaattgcttatttttatcttttttatagatcagaaataagaacagactgtgcatatcgttattttagattttgatacattattttaagtggaaattgaaaataatttctatcatatacacctgccttctaaattatccacatttctaagtgattttaggattctgagttcactgtacccttacttttaaattttcattagtaccttttttaaacttcctgagtgtgggtaaagggaatttctaaaaacctaaatgtttagctagaagttaagagagcttaagaaagaatgaatgtttctatactacttttttcacatgtctttccctcctctcttgtataaagtttgggttatacattgtgtccttatttcataaaagatacatttccctaaaaagaaaaagcattctattctttacttaccattcagttcagatcaaacttgaccaaggacataggttggagatccttgctttggttcaaagctgaaaatatgcacttttaagatctcttcctaccatgtgattctgatatagatatgagaacccctggtgtcatgaaagaaaattgctatgggttgatttgttgaaatacaaattcatagcaggtaaaaggagaaggaaggtaggtagtgctgagactaaagcaaagacatatccttctgaagcaagagtggggcttttctgactctcagagacaaggaaatttggctgaaccccagccttgagtgtttgagagcccttctcaccaagtcagtaacttctgacatatttttttccttgcattttc

SEQ ID NO: 64515 - DNA, 1257 bp, Bovine  19866881244792
cagtagatgaagaagcaaaaattataaataagcaatgaaaacaaaataagtaaaagtgggtaatagtatatgaaaaaaatcactgaatctcagtaattatgaagatagtacagttaaaataagatgctattttttcatgatactatttatttatcagattgtcagaatttcaaagattcatgatgttcattattggaaaggcacaaatacattcacttttggtaagagtagttcaaattttagtggacagtctggcattagctttcaaattttttcaaggtaaatatcacatatcacatttattgcacaatatatagcaagagttaagtaaaagaactttaaaacaatgatactatccattaagaacttactattgaaatctcaatgtctataaaattttcatggacattgttgaaatctaataagattatcctgtctttttaaaaagaaaacgttcttgtttcctgttccataatactaaattaccaaattaaagtttttgcctcttcttttaactaccttcagtggcctcatacagtccagtaaaacccaaatggaagattgaacacatgacaaaatcctcagctccctggactttggaagcatatcatggctcagacaagaggcactaactgataataaggggaagactgcagctggcaagtgaatggctcatctgtctgcagcagagggtgcaaggaaggaagtcagatgccgcttactcacaacaaaggcaggttcagaaatctatgaggtacatagacattaccagccaactctttcagccaaaggcactaaaaaggcatcataaaatggtgttacaagggaagcaactcaattgctagggtctatctttggactccgatcacagaaaatggttttactcttttatcaaaacacaagcagactaaatgagcaagaatattctatgcattcaaataagaaaattcttggttttcagtctagtaaaggctttagacatactctatccaaactcttcaggctacagcaaggaaattgggccaagtaaaatggctcaccaataggcaggaagcttctttgtgttagaattggaacagtctgccttattcctaagttactgcttgtatctcttttattttttggacagtttgaaagaattctcattgaccaacttaatagcaacaagcaattaaacatgtatgtttttataatttttttaaaggcatagtttaaatgcttctatgacatactgtttcaattgtttattcatatttt

SEQ ID NO: 64516 - DNA, 1105 bp, Bovine  19866881262251
tttccctgggggctcagagggtaaagaattcacctgcaatgcaggagacccaagttcaatccctgggtcaggaagataccctggagaagagaatggctacccactcctgtattcttgcctggagaatcccacggacagaagagcctggcaggttacagtcaatggggtcacaaaaagtcagataggactgagtgactaatactctcactttcacaggctgaaaatatcaagactggttaaagctcaccagtcttgagtcatgtgctgaatggatgcttgggagaacttgagttattgccatggcttctctgcagcccatttcaatagtagggctcctcagtaaatttttgttttgttttgtttgttatcatcaaagcttcttattccctgattctaaattttgtggtaaataggctcaacattatcaattctgaaaatccaatagaatacatttctaattcaatcctttgtctcttggaacacatgtttaaatagtgctcctagcagtttgagatttgctttggaattttgttttaaaggtatatgtcctctcttctcacaccttcatgaagtttagtacagaaaactggtttaagcatgggtgatttgactattatggattcaaaaggacataaaaacctaacacagtggttttgaaatacaagccaattgatcttcatttttcataaaatatgtaaatataatttataaaatttgatgtccacaagctgtatgaagatttgcagaggacagtaatgagcaccttcaacaccgtacatctaaattaaatatgacattaatggaagccacttaatgcagatcagctctgctctgatggccattttaattggattgctgctgctgtgaatggaaaagctgctgacaatgttagaaaaactgggcttacagtacagtaccacctatggagatgttgaatttgaatttgtatgtataatcagtcaaatccactcatcacgtccctctttcagaagtgcaatttgattccgtgcttggccaaacacacactggctcattgtcagttctatgccttatgttcgatcacaaaagtctttttcctgacccaaacttcatatctgcctgcctg

SEQ ID NO: 64517 - DNA, 1462 bp, Bovine  19866881271036
tggcagaataaccttttcctaaaggtgaaaattagcattattttttgtccacaggaaagaaaaaattaggaaaactataggaatggtgacatcaacgtaggaacataagcttttgtttatttctcatcacactaagagatacagctcttgaattgtggcaccctattcttagccatatagacacggaaccatttcaaagacagagaaaacagattttgctgaggttcttcacaaaatccagcttaagaatttaggagcaaaaagaaaaatgaacacatttcctaagatggataattgtgctacatttaccttatttaatattttgtgggcaatctgatgtgaaattaaaatgtgatctggcttttaaataatgggtgaagaaaaagtctgtcagtcctataatttagatctcattagtgagaaagcaagagaaacattaaaatcaacctccagtaagctccaagcttcattagcatgtacagctccttccactgaaaatttgttctctggtgtcaggtgttaagttattaatgtcaaatttctaccccaaaagggtgcttgtaacagatttcagtcaaggctgaataactgcttaaagacaaattctaatttagtgagtgaggctaattaacttcttcaataaaaaataattttattattgcttatgggtcatagacggcagagtatagagagcatatgtgaattttgtgcagttagtctcttagactttttggatgtgcaatggagtttttagccacatgaagcaaacattttttacatatgttcttttattttctatatcataaaatgccatataagtaaattaattgtgaaggtctgttatgggttgaatcacatttctcccacattcctatgttgaagtccttaaccccgtgcaccttaaagtgtaatggtatttggagataggttctctacaagaagtaatcaagttaaagtgaagccacgagagaaggctaattcaataggaatgttgtcataagaagagaaagtttggtcacatacatgtatggagagaagatgatgtgaagatagaatgaggtttcgatctacagccctccagagcaaatcaatcttatagacacattgatcccatacttttagtctccagaactgtgagacaatatatgtttggcatccaagccctctggttggtggcactttgttgttggcagccccaggaaatgaatacagggtctaaaattcaaaggtaaaatatatacaattaaccagactcttcaaatatccatatatcaggtgcacataaagttaagtattttaatagatatttttcaacttttcatcctgatgttcagaattctacaaacacaactaacattttggttatggtgccaaattattctcttacacacaatactgcccaccctccctcctttattccgggtccttcagtccatcacttgagcacttataacatggcaga

SEQ ID NO: 64518 - DNA, 910 bp, Bovine  19866881303271
ctgtaaaagtgagaatttctgcagaattgcttgagggctggggaagagctggaggaaactgttcctaggaaatttaatagtttacactgtagtttaacccacagtattgacattcgccaaaagtttgcctttggacactttgcatttgctttctcttgtgcatgagctgtataatccttaaaaattatttggtacttggaatcattgttctgtatgaaaagttcatgtatatttgaacaagatggtagtttttatgtgatgtagatctaagtaaactctacttaggtactttaatcagcatttctgccacatagagtgctcaccatacaagctctggtaactgacagctttttatcagagaccaaatggtaatgggaaaatgctagaggaaaaacttttattcagacttcattgtatgtctttattctgtcttctttgcccagtctgtgacctgaactgaattaataagtcatgcctgttagcacagtggttctcatctggaggatggcgtggtctagggaatgtatcagtcagctggggcattttcattctacccatacatgaatttcctttcctctttgaaaggacacattgcagcctcctgctaataagagccccatactagaagacagcccattgaatatgatgttcagtatctagtgtgataactattctgtaagggaaaatgcatctgacctgaagcctgggcttgagagctgttttcataagtaaacgcaatcctgcatttttcttgtgtctctcttctcattctctcccatcaggctgcagaaatggctcagcgcttgagtgggattaaccgctggtgcatcagtggcactccagtacagagaggacggaaggtaatggatggtttcctcacatatcgcattatttaaaaactaaaattttt

SEQ ID NO: 64519 - DNA, 1194 bp, Bovine  19866881315869
cagacccaggtgagcagacacctcgcggcgggcaaacccacccactatggcagaaaaaagtcccaatctatgggatttttcttctcgtcccagaggcatcctcgattatttatttcttctagtcctgcctccccgggaagcctcggaacccatggatgcctgggctgtctttcttcttttgcctgcctcaccttctgtgtgtatgctttctccctgcctgttcccttagctcctttctcgtccgactctcaccttgaaaaagggagccggagagggacgagagataaagagagccaacttcagccccgcaggcggctgagatttggcgcctctgtccccgaagcggtagggtttgaatataccttcaggagcactagctgcgaggcgaagagaatgaggatggaggggtgtaggggaagcgaggagggatgtgtgtgtgtgtgtgtgtgtgtgtgtgtgtgtgtgtgtgtgtgtgtgtgtgtgtgtgaagaacgcagggagcggggtcgaaagagagaagtcgagggttggcagaggtgggggtgggggttaaagaattgcaactcgctggtcagcaaccggctctgcgggagattgtctcggcagcttgaccaagcactgtccagggttctgaaggctgcagggctcagctgccgccgcgggaacaacccggaagctcccctgtgttccctttctagcaactatgcaaagccaaaggtcctgatgtagggaagtgcagggacccctccattccctccctccctccctcataggtcgcaggaaactagttacccgaccggtacccttctcctcctcccccaaagtctacagtaagatgacttctgggggatgggggcgatgtaccaaaatccgacatgtggagactttaccaggcgttgccttagtaactaatatggatttcctcaagctggcaaatttatatttactatttgggtagtatgttagggtctcttcagcccctcaaagttaaagtagaaggtgcactcctggttcgagtttatttggaagtagcgcttccaccttcataatgaaagagtttccaaatttcttctggggaaaaaagttgatcttttcaaacctggaaagttctctaaggtcggaagccctagctcctccttctcccgcttccctcctccccctggagtctttaagcctggggtatttggggacctg

SEQ ID NO: 64520 - DNA, 1108 bp, Bovine  19866881613967
cttagtttgtggtatggtaaaaaaaaaaaaaaaaatgcataggatgtagaattattattactagcagcagcagcatcattataatattatagtatcttgcagtgtttctgcttcatactgtattaagcacttatttattttctagtttaatactatattaacagtatagattagagttattattgtctttatttcatagactttatagaaatttgaggatatagagttcaggaatatagcacagaagctgtcagtatttccaacaaattacagattttgtgacttggtttttcttctttttgcctcttaagatcttgcttttcattctaagctccttcttttttatttctccctacttccccaaatattctaactcaatatgctctaagtcagttaaaaattctgaacatagaaaatccaagggaacctctgtgatattgcaactgaaaaatataatagtttataattctaccctaacctttcatctcaaaataatagtaccttcagaaaatacagcatggccattctttgcctataatcacattgtgcaagctggcaatgttctacttgccaagattcctttctatttaaaacagatttgtaatatcactctatttcttaagtgcaacaagacacatgaagttgaaaggcttacctcaacatttaccctccctgtacttctgcccctcactttctgatacttttgagagtaaagtatctattactcatcagaaacaccatgcttcagtgaattacagcaggtaaattgacaataccagttggatttataaggtaaataaacagaatcctaataaattgatactctcatttcaatgacaacgcttctgaccttaacatcttcctttcatgaatgaaatacactcttgcatcccaaaccatcatcctgcttttgtaacttgcctccaacccatttttgatgaacctttgaaatctatgttttctctgaaaccctctgtagtagaagaaacaatattttaaatgcctggagccatccatgaactgttaacctttatgtgatgttccatttcttctttgttctatgaaaccaaatttaaagtacaaagaagtgaatgaagtcaggagaaaa

SEQ ID NO: 64521 - DNA, 1067 bp, Bovine  19866881629836
ctgatgctttggttttttcatgtgtaatataatcaaatgataagcaatgtatttggaataataaagaccaagccatgggccagtcactgagacaatcaaagaaatgcgtagtagtagcaatctcatgcctgactctccctgtgaggagaggcactatatgaaattgacaaatacgtttctcatcttctttctctctggggagctgtgagtattcaaatgacagagtccctgtgttttatgtgtgcacatttaccttttctcttggaaaacagagcaaaacagaatttgcaaacgataatttcagatacattatgatttcaagtagcactattagctgaggtaataataataaataatacccttcaataaaagaatatcattcagcaacttttccaggtttaactttgaggcttaaaagaaataatgttgaaaaaaatataatagtttgcaatagattaaataggtctgccacaattggaataaaatcatcattgttagtgcttaaaatatgtgacagtttttgaaaatggagctcgctttctttgctttatctgcttttcattatagtgagcagatgacaataaaggctattaaatggtactatgtttgattttggtctacagtaccaatgaagagaacttcttcttatctttttaaatattttatttaaataaagtaattattgccagtgtaaaatgaaaaaaaaaaagacattacttcatataatctttttttggacaaaatgagaaactctggcccattagtaatcataatgcatgaaaacctcacatgcacttggagaaaaggctttgagcagataaacagtgacattcagctattgaaagcagaaatttactgaagctagatgacagaaaatacaagaagaacccatttttctctatgaatctctttgttttagatcagctgtaatatctacagtcagctttcttgtctccatctatctctatccatactctttgtttcattgcatcaattatttatgccttaaattataggtcttctttcttcttttctcttggcttaaagaataacttcaagcgcaaatg

SEQ ID NO: 64522 - DNA, 1160 bp, Bovine  19866881707237
aaaagtctgttttgctggattcattccgtttaatatctccaaagagaagtttactacctggattctggagatcttgagcagagtgtagcaaataggtgagctttggaggggtataaagatggcctagtgatgactaaattctgtactgagtaattggagtgtaaagagttcattcccttatcttatctctctgggtcttgcttacctgctaataatggaactgagttcatataggtatttctgagtcttacatgtgcttcctcctgatgaggtcacctgcctgggatatctacttcttttactcctctctttctctgcctcacctcttctgggctctactgatgtatcctaaggataccgtaatcacaacaagcacctgtgcttctaaggacacttccctgtacaatagtcactgccagtaaagcttggaaccctggagatgtcaaagctatggcatacagtgcttttctgattttctgggctgtataccatgagggtctatcaaagtggcttttactctcatatattagagaatttggtggaaaacagccttttcccattctttgttcacagctctctcccttccttgggagagatatgaatccagatatgagtccagagggagctgagctggcaataaagacgagaagtaacactacggcatacctagttagcctttccttcagaagcttgattctcccaattcctgtatgatgaattctaacccaaatactcccctgttcctcatgccaatgacatttgattagcttggttccctaatttttgcagacatgtccagaagggttccagtttaacaccaagttgcaacttctagctacatttgtagtgctgtcaaatatatctccttcccatataaggggctttaacttaccaaatactaaactcctttgaggtcaggagccactatttagtttctttcacaatacatggtctaattttggatgctgctgatttcagagaagacattgtgtagatggcgatgggcctcttttaatagagatgaaagtaagtaattatggtgtagactgcagcaagatacatttagttaagaaaaaaataacagaaattcctaaatggagatttatgttcctttgcctccccttgactcctcttttctcttacatgtcacatccaacaca

SEQ ID NO: 64523 - DNA, 3493 bp, Bovine  19866880523562
tgcaaatcgaaccctaggaattgcccaaaaagagattaagggaaggccaataaaacgtccaaaactacagcccgccccaccttcatatttgtctgcctagtttccctccccaccatttccttctcctgaactatgtgcagaatcctcaaattgaaaccaccatgccaaccagactccaaacacttcctggttcatgaactgcataccatgtccctttccaatcctggggtctgctgctgtgctcagttgcgtcagtcatatctgaatcttggtgagcccgtggactgcagcccaccaggctctctgtccatgggattctccaggcaggaaggaagtgccatctgggtgcatttcaaaggacttcccaaatccaaggatcctatggagagagtctccaagaactcaaacttatcttggatacctaatctttcctgacgtgtatcagaccactttttggtggggccagaaaatgcaagcccttgccttaaagtggctaacaagcttgaccctgaaaggaatttaaaaattagtgaaccagaaaagtttaaaacaaaagaaaatatgttggcaaatcaagtgaccctgatgttttggatgagttagagtccctgagaagagtgtttcaggtaggagaatactggaggtcagggagttgccaagatgcctccgggtgcctctgtgtcgatggcaatagtggataggaaagtcgaagcaaccacagccaggaagagaaatgtaaccaaggatcagatctctcaagaaagaaggtgtgaatacaactgtgagtgcatccagagtggttggggagccaggagttgacatatttcagtcatgccttgagacaacccacagccatgcagcagagattgtacagtgtcccataaaccccctcttttatgtattattgtcttttaagtctgttaacaagtgcgttgctacatgcatgctcagtgtgtccagctctttgtgaccctgtgactatagcccaccagacttctctgtccatgacattttccaggcaaaagtactggagtgggttaccatttcctcctccagaggatctgcccgacacaggttcaaacccgtgcctcctacgtctcctgcattggcggaaagtttcttcaccactggtgccacctgagaagcccctgggaacatatacttttttttttttttggtaacatatacttaacgtaaaacttaacattttggccattctaggtgtaccgttcagttgtgtggagcacattcacgttgccctgcagccatcaccaccatccctctgcagaagtcttttcatacttccaactgaaatgtcattagacaacaaggccccagccccctgcccagtccctgatgaccaccgtcctagtttctgtctctgtgcattttgactgtcctagggccttcaagaaagtggatgataccatatttgtcttttgtgaatcgtttatttcacttagtgtggtatctccgaggttcacctgggttgtagactgtgtcacattcgcctcttttccaaggctgaattgtacagcccattgtacagagggactgcattttgcttctgtttccattcgtctatggatacttgggttgctttcccttttagctgttgtgaataaggcttccatgaacatgggatatctctttgagctcctacctttaattgtctggggtatttacccagaagtggaatacctggatccttttatgtattttcaaagtcattagccagacatcaccttgaagaggaagacagagtggatttagtgtgattgcagttggatccgggtggtgctgggggcatcatctgtgacataagtgtcatcctatgcccaacacagacttgttcccgaacaaataaaccacctgtgctcaagccctaatctcaggttcttctttaggataaccccaaaggaagaagacagtcaaaatctccacctgttcatatgagtgggtaagaattgccagaattgtctctatatcaagagccaaaaaatcagctttgatttcagtttgtggatttaccaaccttccagaatttagagcttctgaggatttttcaatagagctctgagggattattacacagaagacactgtgctttcatcaccattgtgttgataaggaaaggcaacagaaacatgcaaagaaatctaacaaatgaaagacatgcatgtgcacttatcaccaaccaaagaaaagtagatagctcaatatttaatgctcatggcgaccaggttttacagctgtttctgaattcatgatgcagatgtaaccttgagatttccctaaatcatacacttataaaatgtacagagtcattagggtgttttttgttaggctgtaaatgctcaccagttgatatttcacacctaattagcttggttttttcagagtttgtagaaacctccaagcagtcacacatgctagaagacttactttattatgtgcatttacattttgaaatgaaaaggtcatatgataaaaatggtggatcttaataagctgtgcttaatttcatattttatcaccatttgaaacatccccaagagtgaacaccaaaggactgtcttaatgtttataattcctatggtttacattttaaattacagtgattcatttcattttagacaacttatttgtcaaaatgtatttgttgaaaccctgacccccaagattgtctgtgtttggagataggatatttagggagataattaaggttaaatgaaggcaaaggcatgcatgctaagtcgcttcagtcatgtctgactctttgtgaccgtatggactgcatcccaccaagctcctctgtgcatgggattctccaggcaagaatactggagtgggttgccatgctctcctccacaggatcttcccaacccaggcattgaaactgcttgtcttatttctcctgcattggcaggcggactctagcaccccctgggaagccccaagggcgtaagaggagggtcttagtctgttggggccggtgtccttgtaagaagaaaaagagacaccacaggtctctcgttctctcttcaagcacacagagaagccatgtgaaaacacagcaagaagaaacgtctgcaagccagggaggacgttctctcctgggggccaaccccactgccgctgtggtctcagacccccagtctccagaaccaggagagaatggaaggctgtcgatcaagccacgcagcccatcacggcggcctgaactggcaagcttcactcttgcagtgtgtgtccctgggcacaggcagtgtcacccaagtctgcacacgcccaaagcaccaggacagtagcgtcgatgcggccggttgccggggaagccctgtgtcctgcattcagaccttttcaggaaatgtttgtggagcctgcagaggtgtgagctccacattttggagatgaccagtcagggacctcactgttttgctcccagggagctcgagtgtgtgactcacgttttctcaacacgcccatgaca

SEQ ID NO: 64524 - DNA, 679 bp, Bovine  19866880803438
tcctctctgcgtgcgtgttgtgtgctcactctctcagtacgtgtctgactctttgtgcctcgccaggctcctctgtccatgagattctccaggcaagaacactggagtgagttgccattcccttctccaggggatctcctccaaatagggatcaaaccggcatctcttgcgtctcctacactggcaggcgggctctttacgattgcaccatccgcagtcagtgaattacattcctgtcctctctgcactttgttttgttttttgcctggaatgattctgcaataaattaatcataatctgttgtaaatcttttcataaaatgggagagatacatggtaacctgaagaatctatagaaaattacgtttatccatccttctcagggttcattagatacttagtttttggcttttaagaaaggtttcttcatccaataaagacattaacataatctcattgcatttattgctcccaaggataaactaacaggggaggaaagcctccctggcagatgctccataatagacgtcgctgccaagagaagacgcataaatgctttcatcacgattccagggcagaagcagctcggaaaggctggttgctgttctccccaaagtcaaagattggaagagtttgtggcggctgtttatcgaccatttttctccctgactcctcactgt

SEQ ID NO: 64525 - DNA, 1087 bp, Bovine  19866880945975
aggagcctggagggctacagtccacggctgaacaagcacgcacgttactcctggagcacgactgttctagtaagtttcctctttcttcaaatattttggagacttttgccattttctgttcacgtactctgagtagacctcatgactactatccactctgtaggatgctcacctggtacatttcacctgcactctatctgatttattgttatcatatttcagaatgtggagtaggtggatgaacacaggaagcggctgatcatttgtgtggtctccagtccgctgagcaaagccagagaacgttggtcagaaagaaacaacaggggcagatggagggcattggctaaggaatgtctaattctttgatattaaatgagcaacttgaaatatacatcgattacaaattaacgtgcatttcgatgataatttccgacccactggctgatatcgctaccatccacctgagatattgctacccctgtggtgtacatgtttgtttaaaactagtttcttctccttcctgtcaaaagtcagtaaaagggatgggaggagtgggtgggtgaagcgtaaagtgtgatgaaatgccaacatttggttttaactgccaaggcccccagattggcctcagaaaagcaaattaaacccactccaggaatcactgcatattaaggagaaactgcagcctccgggggccaacgtgatccagtctgtgacaatgcagggctttaaggctcttgcgtaggaaagaacaaggcttggggttttccaaggcaggatgtgtgggttgaatggctttttatttgattttttcttaatttcctgactatgcaggcaacagttgtgagccctgagggtcggggatgggaggagcagagccgcagttgggtcctgatgcactcagacaactacagaagggggaggtcgttttgtcagactgagctggatctgtgtctaggagcgaggcatggaagggtcagttccatgctcagggcagaggccacttgacacgttacgtccaggtggctggaaaatgctttccgttttcaggcagggcaggccctccactgggaggcctttgttctgcagt

SEQ ID NO: 64526 - DNA, 3642 bp, Bovine  19866881044517
ctgtagagctgatttttatgtacagtctcctccctgacttgttcaaggaaataaatttaaaaacaaatgacacagaaagattgaatagagggggatggatatagaaattgcagttcaagcaaattctaacttgaaagcagtcatataacacaaagggcttcccttgtatttcagttggtaaagaatctgcctgcaatgcaggggtcctgggttcgatccctgggttgggaagatcccctggaggaggaaatggcaacccactccagtattcttgcttggagaatcccatggacacaggagcctggcactatggggtcacaagagttggacacgacttagcaattaaaccaactgtataatgcaaaagaataattcatgcctaggaatgaatttgcctggattaaaaggaactgtttagaatggtcagcagtacagttcatcaagaagatcctgctcttgtgaccttcaggcataaaagtgcactaggtgaagtgcctgggcattctaggggaaagagccacatctgacttcacgaaagacttcagtgtgtttgttagaaacagagagtaaaagcaaacaaatgggagatggaatgggaataatgactgcaggatgggtgatttacattgactctcaaagcccggggattctgtaaactacttgtcaaacatgcctaaaagctgactactaaataaaaagctgcaatctgagattaggttatagatatttcaaaagatattaataaaaacctctcctacctccttcctgaaaaactggtaaccgaacacacataataaactgctcttggataacagaaaagataaaagctgaaatactaagcagttttggaaattaacaaaaataaggcagcattttggagaaggcaatggcactccactccagtactcttgcctggaaaatccaatgggacggaggagcctggtgggctgcagtccatggggtctcgaagagcgggacacgactgaacgacttcactttcacttctcattttcatgcactggagaaggaaatggcaacccactcccagtattcttgcctggagaatcccagggacggggggagcctggtgggctgccgtttatggggtcgcacagagtcagacacaactgaagtgacttagcagcagtggaaaggcagcatttattaaaatctttgagatattgccagtattcagtgagtggatccatggttgtaagcgatgttgtgaggatatgtgaggatagacacagggcagcctcggaggaagggtcccggagacacaccctgtgtgccaagtggcttcggtcacatacgactccttgtgaccccatggactgtagctcgccaggctcctctgtctgtggaattctccaggcaggaatactggagtgggttggcttgccctttttcaggggatattcctaagacagggatcgaacccagagtctctttaggtctcctacattcacaggtaaattctttaccgctagcagtacctggtaagccatgctaggacgcaggaattaccgtaaatgaagcgagaattccagaaaatgaatgacttaagaaggtagcaaaatacaacagaaacccaaggaaaataggaggaaggaactgatgaagaaggaaacataaatgaatgaaataggaaacagagcagttaacttagggccgttgaaatgaacagctggatctctgcagtgctggtgaagctgaccaagaaaggaaggcagaaaagcttcgtagcaccaggactgaggacgctgtcaaactacatcttgagaatttctgaatttcacaaatttcagattttatcatgtttgtaaaatggactgttttgtaggaaaacacactcagattgacatagagcagttgttggaatatcctgaacagagaaataactcgtaagaaagttaaaaattaaagataatactatggaagctctggatggcttgcaggtgagcagatcttcagtgaaaacctgatgtctttattattgtttttgctttaggactgctcctgtcttgttcttctgactagcagaaccgtgtgccaaaactaactgtgtgcgtgaaaatgcgcacacgtgtcttcagcacttagaactgtcacttagcagtgaagctgtgaaaatactaaaactgtaagaactcacatctgttagtaatatagaatatggacaaagtatgactgaggatttatctcaggactaccacaacagctggttaagagggacatgatagggtcatctcaattcagcatccattcctcattaaaaaaaaagacgagatagtaataggaaaaagcacttcgcacttgagaaacgtgaagcactgagagcctagtcgttgcatcagagacgaggcgagcctgctcctccacccttctgtgtctgctggggacctgagccatgcgcccgagtggactcacagcgcaggagctgtcagattgctgtcattggaaatgagggcactgacgaggtggagaaaggaagatagcagtgttggagctcgggcgagcgctggtgcttacagtgaggacgcacggtgggtcttcactagtctgtcagaacagatggcataagaacagtccgttctcaggtggccgcagatcggttagacacccagggaagtacctgaaggcagcgtgcctgcctctgtgaagacagctctaaaaccactgaacatgcacacaaatgctgtgttcctggatgtaaacagtgaaggcatagagatgggaattttacccccatgtatgtataaatatatattcttaagactggatggggaaggcttatcagaagcaatagacccgtaataacaatttaatcctgagccagggtcatgctagcacagatactaaaatatagttacaaggttgttgtgattaaggatgcgtgccattcatgtggacactgacaagtcagtggagtaggcaagtctagaaacgctgtcctcggagatgcctggcgtttgataaaggaggcgtctatcacagggtcaggggaaggcgtgtggttcagccgaaaggttttcacgaccaagtcccgaaagtgccaggatgcaggctgttttctgcttgctggtatcggatagttctcgtgtcagactggaagtaatgaaggcgcttagctggaataggcatagctctggttaatagcctctgtaagaacagagaaggaactttcttgtgtattttttttcaggttccttgtttgctgctttgggtatttgtaataagcagagatcctggtcaggtcatttaagcaaagggtgtccatggtatttggaagcaggctttgggtgggttaactacagtgtagataaactacttgatcatagaactttgcagcttgaatatggatgcacctcaccagcgactggctaatgtgggtcaggagaggctggaaatgcccacatttcccaagttctgtacgtttgcccagtttgtcctggtcctttttctgtggaattaatttattcattatggaattctactatagatgtagtttgccattaaatagggctgtcctgttccaaaatttgtgattccttggagatattttagtttagaagattgatctttttaacttctctagaactggattaaagatttcagtgttttcaagaaatgattctgttt

SEQ ID NO: 64527 - DNA, 821 bp, Bovine  19866881081980
ggacgtccttggtggcgtggcgatcaggggggccagcagtgggggcagcgggggccccacctcctgccggatcttgctcagtgtgtccacgcagcagtctgcgggtgtggacgtgtcggcagtggccaggatggtttgcgtgtgacttctttggggtcttccatgacctctgtcccctgagaacgacggagagacttcgcgctcaatggtctcaacgcggcctgatgccggagtcctgactggcttgttggactggtctctgtttgaaacctttgatcgattcttatttttgcccagtggctccagtttcgagttacagtaagtgtgatcgaacggagcagcctgtgacctcgaagttctgatcatatatctcggagctgatcctcacgctgggtttaacgggtctgtttcgcaaacgacttttatcaaagttaccactctgcccgctgcttgagatatcctcctgggttccagccgcactgcggccacatgggggctcctgaagaggtgagccggggcgaccagcctctggagacctctccacgggaggaaccaaaaggaaaccagctgccagctcttccgaatgggtggaaaggggggcggcctccggggcgtcacacaggatcacctggcccagctccggcatgagcgtcaccccgttgatgatggtccagttgtcccctttctcaatgactaggttctgatccttgttgatgagcacattgatgacctcagaggtcaccgtggagatctgacattggagcctcacctctccaggccccgcccccgggtcagcgttggggaccgagggctcttcgggt

SEQ ID NO: 64528 - DNA, 1565 bp, Bovine  19866881226041
ccagaagacacagggtctcttccaccatactgcttgaccgaagctatctcaagcctgccctgacttgaggggagaggacacagtctcagtccctttaatggggcaaaagtcaaagaagttgggaccttttttcttttgcccacaaggacctgagcaccaaggcatagcagatagaggagatgtcactcctaagagtgtccatgatcagagactttaggaattaataacatagaagaccctcaccctctgcctggaggggactagctcagcctccagataagcagagggtctctcatttccaggagagttaaggaataggacgggtcatagcccctgttggatagtttaaaaacatttctatttaatggtgaaaggaattacatcacattcttgatttctgtgttcatttgtagaagctctatttgctcttttactaacctttgaaaatttataagcggaaattaaaatccatgtcacgagtcccaagctaaattggtttattatcaaatgctcattatatatgatcctagaaaggtttcaggaaatggacttgaatacattatagactgggtttgttcatacccacctcctcatccaggaaaaagaaaaccacagagagtcagagttaatccataaaactgagagagacgctctttttggtttcttaaatttgaaagtaaagtttatatacttataaaaattcattcagtaatcatgctgaatgtttacctccatgtctcctgactcaatggtctcccattgtattttctctgtgtctctccaatggcgagtatcatatcctgtcttggattttagttatttatacattaatctaatgggcttccctggaggctcagtggtaaagagtacacctgcaatttaggagccgcaggagatgtaggttcaatccctgggatgggaagatcccctggaggagggcatggccacccattccagtgttcttgcctgaatcctatggacagaggaacctggcaggctgaagcccataggatcacaaagagtcggacatgactgaagtgacttagcacgtacacatgcgtacattaatctaacacatactagattatgttctagtatattctatgcatttagcatgtgactcaaatatatacccttaatttagtttaactgctcttttccagccttgtttttgggcatgcacagaaattagcagtcaggattttcaatctcttttatatttcctttcatgttggggcatcagcttcagttgacctttatttatttatttaattgaagggtaattgctttacagaattttctgtcaaacgtcaaacataaatgaaccctacagttgacatttgaataacatgggggttggggcatcggcccccaagtgcagtaaacaattcacatataactttgcagttggccctctgtatatacagttctacatcagtgaattcagccaaccgtgggttgtgtagtactgcagtccatatttactgaaaaaaaatctgtgtataagttcaaatactatttcatttgcaaagaagttcatactcagatcattcataagttttatc

SEQ ID NO: 64529 - DNA, 1878 bp, Bovine  19866881380068
taagatacacaaagtccccttatcccagtgacaggaaataagcagatcttactttaccaaagataaacctttataggaaaattactttaggtacctttttctcttctaattcagcttttaaaaatcccagttcttcctgacatttctgtagaggagatattttctgaagcatctgctccacttggtgatgcaaagtactattctctctaaaaatggacaaagcattaacgttattatgagaagtatctatgatgaattattaaatatatctactggtgagtttcaatttttttttctaaaaacaaaaaagaaaataagaatctctttttaaacacattctatttattttggtatttttaaataccaaaattatttacatatcactttttatttctttgacatgactctatttctaataaaagtacatcaaaagccatctgagaagcaaacaccacaggctctcaatccactggagaacataagaatactgggactgtctatcaagtgatgtggcttttccaataaaaaactcatcaccactgatttaaattaaacgacaggcaactttttgattcattttataactacactttgccttcttctaattggtaagtgtaatcagtagcattgtatacaacactactaaattctaagtaagattattttaaattgtttaaaatatacacagtgaaccacattaaactgtcaattcagagacaataactgatagcaataagcttcaattcaagccacatggtcagtaaaagtaactgaaaagccaaaccctaggctgtaatttaagacctcagtaagaattcatttagacaatttaacaggaaggaaaatgtacatcttttattatgagcactcaaaaaagcctacatgatgggtcaatgctttgtggcactttgctgaatttgtgtagaaatccagttcagtaaatgtctaccctgcattgactgtgaaaacaggtagcttaccttcttgcaaactgcagctgtaaaactggttaaagaaaactgtgaccactttatctacaggtaccaggtagcgggtctgaagataaaactccctttaaaactgtaataatctgtgttcaatatacatacaggtgatcataatttctagaaaacaacattcaaagttccacctataacatatgataaaaagcttttcactgagctactcctaatttacagcattacagtaagtcgaaatatatatttctctaaattaaaagattcttgattaattgtatgattaatatgaaactccagacaaaagcaaagacaaaggaataaacaactaacaaaaacgaccctgaatccctgcatgtcctgcctttcctttctcagagtccagagcacagttccagcaaacaagcgttctgtacttactaaaatcgtatacatatatgtatctatatgtttaatgaatacagttggctcagatggtaaagaattagcctgcaatgtgggagatctgagaaaagaaatacaggcagaacataaaatctgaaaaacctttcacttttacaatctgcacaatttgataacatcatttcccatcatgctgccagtaaaatattaccgaagacagcagtttcatctttaagtttcatttctgtagaaccctactctcatatcacaatatagaaatgcctatgggtcataacatgtctgtatcctcctctattagaacataaacttctaatggagtatatgtttttcatcctaaattactgcagtctttgcaagatagacaaattcacaaaaatttctgatgaaataaaatatactctctgtcctatagaaagagaaactgataaacaagaagatggccagaatgacacaaaagagtacagaaaagaaactaagc

SEQ ID NO: 64530 - DNA, 2025 bp, Bovine  19866881576430
agtggatttgaggcagctggggctgtggcctcacgggggccacctcttactcaggtgtaggcggccttgctgcgcacatgtggcattgtttaaatatgttcttgctttgtaatttactcacttaatcagacatgaaggtttattatcttgttttctttctcatagatctcccagagtctgagaaattgactttgttcattgcaaacatgtggcatgatgtatttatctctcagtcggtgattaataaggcgatgcagttggtagccaggcagcgcgccaagggagaagttctgaactgtttgcgtgccttcctcaattgggagaaggtgaggtttctttttattttgtgcaataatgtacacatagaccttatataaatgttttatttggttttgtgttcgtgagcattttagagctattattcttcatattagatccttcagaataccattttaaaatgtctaagcttgtgcattttgttcattaagtatgtccactgagcagagtttatcttgggtactaatttgccgctggtgaaatccatacgcgtgcttaacatatgtaggggccccgagaagatgcagaccgctgcttctacacgtggtacttaggtgagaaaattgagatcccaactccttcctttgatgatttttctgaatgtaatctgtgttcttcttcccaattgatgaaatttgtagtttttggagtattatgtgctttcttttattttctttagtgactgatgtgttaatataatatgtagattggtgttcttttcatagattttctctaatgagaatccctgggtgctgaattgatagtgatacactataagaagaggtattgaagaggcactgaagtcagtgacaggttgattttcactctgttctgccttttttaggactgtattactgtcctttttagaaggaggctggctcacgcctgtggatggtgcttgtgtgccatcatgctttccttttcagcgctttctggtgttactgtcaactagacttcagtttccttagaaaagggaagggcttggtggataaaaagttaggcaagtcttaaacagcgggtctgcagtcagccctccatcagcccacttccacagtctagagtgtgttgtgtgaggtcccatctgattgtgctcccttggcggctagcagagccctccagggtgcgtcccgccctctgtggttacctgtgcaccctcccctgctgaatcctcccgcttgtgccctgggggtctcctcctccagccttcagggtgaagctagataggatagggtggtaaaagccatgattaacgaagaagggagaattttaataagtgtattttatctgtatcatatcaaataaaaatataaactcaaagttattttaaaaagagagagaaatacctgggggggaaataccattatagtctaagacgtccatattctcttacagaactccacaggtgtgatactcaaaagtaagtagagagatagcacaatcaacaacaaaaaagtaaactggatgaaggctatttttcgtgtctgtgacatttgcaaaagcagtcatagatttggccacacaagaaccttaatttttaaaaagtaaatattctacactcaaaattgtctggtaatgatttggtaaaattagacataaataattgtataaaaatttcccagagattgagatgcacagtctctggacagtctgtgaacaaacagaaactcaaagtaaaatcgcagtatctggaaccctgcattagcagagacctctcgtttttggaagactcacactcactgcggtagtttaaatgtcttcagtattaaacacagaaacaaagttctttgataaccatcttgaaaattaaaaatttgagaaggaatctagggaagaaagaatgtgataaaggaacagtagtaaagttgagaatgaaaaaaaaaccactgcctttaaaaaaatgctaataaaacagataactcagttcagagactataaaaagagcaaagcaaaaaatattcaagatttcag

SEQ ID NO: 64531 - DNA, 1049 bp, Bovine  19866881594807
acctggagattgggtccaacccgaagaatgtccgggcgtgccagaagggagttggggattaggtaatagggaggggaaggggctagtccaggactggactctctgtccatctgtggtcaccaacagtcatggttggctgaggtcgatgtggaggcaaggccagagctgtcaaataacgtctctacttgaacacagaccacataggcgtggggtgtcagagcagaaactgactttcaagctagtctaggagtcacagggtcaaccagttgcccaaggtcacagagaatgcgatctgtctccaagctcccttcctttcaagcagcctttttcctacttttaaaaaatatttatttatttggccccacctggttttacttgtggcactctggttcttttttttattttacttttttaattttggcacatgggatatttagctttggcacgtggaacctagttccccaaccagggactgaccccaggccccctgcactgggagggcagagtctcagccactggacaaccagggaaatccccctattgtttcttttgttgccacagtgtggacaggtgagcctgatgcaagggccgtgctggctgcgcctctacacacttcacagctgcctcccatcaatctcggctggggctgtggcacagttttgtggttgttggaaactttacattccagggtctcctagaagaaaagaacaactcatttgcagcacctgagcacagtgaacaggcgattagccaaacactcttgtgtctgagcagatgtgtgcgggaggatctgcttaatgctccctggacccctcctttgcctccccagtctgtcagctcagaagctgccctgttcttttctgagtgcatctgcatggctctctaggttagcccaggggtggaaacctggtcatctaggaaatgctgagtctttcctgagggtttctgagcaggaattccccaggctggaggctgaagcacaggagccaagggcactctgggtgccaggtttcctgccttcggaggagcaggctggctcccagggccca

SEQ ID NO: 64532 - DNA, 2303 bp, Bovine  19866880408376
ccttgggacaaatggagttcttctggaagccattctgggagtccctttctggcctgctagctccagagtttgcttcatggtgactcagttccgtccagccctgtcccgccatgactttccttctagggcagaatcagtgaccccctctcccttgctgagatgctgcttgtgtagggatgagcagaactgtcaggtgagaccacggagcacagagccgtgtgtatggatgagagggctgtgcatgttcctgccagatgtctacccagcgggggtcttgtggaggagactgcctctggacagaattccggatatgctgaggaggcaaacattgtgatttacggcaacctactccagtattcttgcctggaaaatccaatggacagaggaggctggcaggctaaagtccataggatcgcagagtcagacacgactgaggcgacttagcaggcactcatgcatgaatagagttgcccatgcatggcaagttctttggtgtgtgcaccttgattaacgtcatggcaaatcaggggtgcagccccttgaatgatcccttgggatcttgtctggggtgtctgcttagttctggaaatactggcttggcttggctacactttgcccacttttgtgactcagcacttcctggccagctgatgctcgtgactgcagaatgaccaagaactgctcgctcagctaccttcactttcacttttttaaaggttgatggcctctaaaccaagataatggacaaatttttatactcagtaatatgatgttcccttctagagtgctttctcaagagagcagtcttacatgtgacttcagctaagcagcttgtggggggtgtgctgtttagccacacctgtcttcctcatcttttcagtgtgcttgagactgcctgttaaaccacgttcactagactcattgcttccctttcttcgtgaaaataaaaccaattccttccttccatttgatgaagacatcgtttttaccgtttactaaaaatcttccttctgtcttgaattattggtctttgggtaagagctagaaagaagcatgctaactcaaaaacctcttcttgattgatttggtttttataatgtcataaagtgtgatagaaggtcttatttgtgtccttggagaaatttatttgtgcctcccttgatgctgtgagctactcttgaggtattgagcagaaggatggtgaaattctgggagaagaaaaaggaatgcagaagagaatggaacaaggacagttaggtccaggagtcctgtcttatcagttcagaaatgaactcaagacttgactctgggagctcgtatgtattggtgatttttaagtcatgaactttcaggtatggttttgagtatttttaaaaaatatttgtttggctgcactgagtcttagttgcagaatacaaactctttacttgcagcatgtgggatctagttccctggccagtgatggaaccctggccccctgaattgggaacatggagccttagctgctgaaccaccagggaagtccctggttttgagtattttctgaatttcgggtttctttggaaattattctttctgttcagtcttttcccctcattaaaactggatttgcatctgcatcaaattttatgttttagcttaccttattcaatcctgtgggtgaattcattttaccctataagtcaagatgttaaaactttggcatggagactacataaaaattccctcgtattcctgtttcaagcagatcctgaatgtacctagaccacaacctactatgatgagtagtaatcttaatgcacgatattttctcatttgtaaaatagggttgctgagaggatggggtgaggttaggcatatgcctgacacacctctcaggtagctctctcatgatcatgttcccactcagcagcccctattgagcccagctcagctattacaatgagggacgttctgaccaggctgtctgtcctgtggcctcaggcggcccttgaggcacatccatggtggagaataattgtcccttagaaggcagtggcaacccactccagcactcttgcctggaaaatcccatggacggaggagcctgataggctgcagtccatggggtcgctaagagttggacacgactgagcgacttcactttcacttttcactttcacacattggagaaggaaatggcaacccactccagtgttcttgcctggagaatcccagggacgggggagccttggtgggctgccgtctatggggtcgcacagagtcagccacgaagtgacttagcagcagcagcagcagcctct

SEQ ID NO: 64533 - DNA, 783 bp, Bovine  19866880814894
ttttagaatactgatacttgggccccatttcccagagatttcttttcaccctaggcattgggattttttaatagctaccccaggagatttcagaggaatcagaaacaaagtttgagattcaccagtctctaaaggaatactatcaatctgttcttctttaccttgatccccacaagccatttttgtcactacaaaaaacatgtccatgtgtcttaaattgtacttatgaataaacattgaaatttttataagcccacaaagggtcacaaacacagtgggcaatcgatcaatatttcttagctagactgaagcatctttcacacaattcaaaaaatattttttgtggcaagacttgtcgcaaagtatataaataatttttgctgtaggaagctgggtgaggtttgctggcgtatgattcttgctttctaaatgataagcaccttgaagacatcatccacatcctaaaatctttcaaattcctgagtgtctgtctggctcagtgccgggcaaattagaggcggtgaacaaacacttattcaactcacttggatttacgattgtctctaagcccatgggaacagagaccttagcagaatatgctaagtgattcattgtggagtctgaggtatacgtttcctcgtgttgtgggaatgtgcattgtttaattcttctaaattccttagagtaaatgagagtattatggatgggactttataaatacaccatataactatttgttgagaaaaggagagaaatttctggtgccttaaaaaacctttcgac

SEQ ID NO: 64534 - DNA, 1668 bp, Bovine  19866880888656
cttaaacccctctggttcagattcaagtacattgtttatggtatctctttgaatttagcacctgctaaactttgaatttagtacctgctcttttctgctcttcgtgaccagagtccccactacagaatgaaccatgaactgaggacttccctggtagtccagtggttaagactctgtcttccagtgcaggaggcaggggttcaatccctggttggggaattaaggttccatatgcagtggggtatagtcaaattctttttaaaaaataaatatgtaaaaaaataagaaggaaccatgatcaggatgtatttgttgtttcctcatggccagattcaggttaagcattttggcaagggtatgcattcaacaggtgatatatgttccactaagtttgatcccttggttaacatggtcactgccagatctctctgtctaatctgtctatgattaggttgtctttggaagtgatcctttgagaccctctgaataccctgtttcccaacaaactttcgtctagtgattttatcttttaacttgaccaccttaaacaaacaaacaagcaaaaaaaaaaacccttctcaatgaaattcctggaactggaaacttaactaaatatcactttagaataggtaatttggataaatagattaaatcagacagccttgcaaatatgtttgcattgttatctggagcctctggatttttctagtcttgacctgataagaaaggacttaattgatgggcctgccgctttccatgtaacccctccagagacattctgtcctgagctgcagtactttttaatgtccatacaaagtgaatgtaaaccccttttaatgttgaagcagtgagtgggcgataatgtcatttttgctagctggcacaatttggggggcatcctcaaagctcagttgactctttgcagaaacctttaatctcctttttcaaaatcactatatgaagccgactttaaaaatgactgatgacttgccctggggcctaaactggatgagtcttggagttggtctgtgcctaccaatttgttcatgctttttagatttaagttacacaactatttttgtctcttctcgattggtactcttattttcatgcacaaaatatgtatgggtggggaaagtggtgtggagtagtgaaaagaatcaggaataagcatgctctgtgttctggattcagctttgccaccactagcgctgagcctcagtgttctcatctgtaaaagggaatagtaataattacgtgaataacactgaacattcattgagtgattcctgtgagtcagccaatagtctcagcactttatatatgtttaatatccaacaataatcctgtgaagttaatgcccctattcaccccattttacagatgaagaaatcaagtcacaaacttcaaagggctcaacaaagctaaaggaaaatagtatttatgaaagaactggtggtgtggggctgggatgggagaatgttatataaattcaagtgatcatgtcatctgtatgtaaatatctgcatcctcagaataattatttaaaaacccattatttacaaagaaaatattattatggaaagattacggaaataaatttgaaactctgccaaatttaatttgagacaaactaagcagtcgcatcagaaacctctttttccattt

SEQ ID NO: 64535 - DNA, 1555 bp, Bovine  19866880987069
ccagaaactgagtggtggcactggggccgggcacctgttgtcacgcaggctggcctgggggagagcaattagtttgtttggcaaaaccactggaatgttcctggtgggggcggaagctggggagtgggtggtgggtgtgctccccgggtgtgttgcctccttccgagcagatggggctgaaagaatttccagagggaggagggacagctccgcccggggaaggcccgaagggctgttttcctgtccagatggcccattcataaaacgcctcttcttccttctccacatggcaccggccctggcctagttttccccaccccaggggttcatttctctcaaggcggggaggaggagcaccgttggctgaagaagcacctggttctccaggccctaccggggcactctcagtgggcgcagatgctcaggaatggatggccggcctttgcggggcacgggttcggccgggaaccatcatctgccaagggtgtctggctagctccgggactgactcacacggtgccccagttcaggctccgagactctgtcccagggtgcttgtcacagcggcagctcacctgggggcccagggcgcttggggaccacgtgatggacttggcccggtttgtctggactttgccctccacccagcttcatccgcttactcaggggctgatcagtaaggttgcggggagacaggtggtctttgagggtcctttgcagggaagagctgcacccacacttttccttgccattcctcctgtgtgttccccctgacccccgacccgtgctccccttagcatctttttgccacgtctttctggcagtctcaaactgattgtctctctctattctggcatatttatagtgtgacttgttgaaacacatgaaaaatcccaactctgtggcttgtttttgctcaggggcagttgcctgatgggagagaagcagaggtccttagcctcaagctccttgttaaccccgaagggctcagcccttgagtaaatgaagaagggacatctctgctgaaggcatttcactgctgtgtcagggctgcacggggaaccggtgacagaactggacgtgcaacccaggaggacgctatctccccctgctgtcagaccagggtcctcggcagtggggtctgcacccagcctaaccccctcgactcttccaagacagtcttcctgtccacctacttgttatagctcgttagagctggttataggctccgacagacctcatgggagaaatttagatgtcttagttcatccttttattcagtactttgtatttaaggacaggaatccccaagctcaaatatatttttaaaggcagtattggttgaagcaggagtactctctgctaatcctgtctcccttcaggccactggcatgaagtgccagtgacactggaattattttcacagttgcctttaagccccataaagacaaactttggaaggtgatgctggcctcaagacggctgctgccactccatcagcctcatagcaggctgaggaagtcatcacagttctttcttaactttttattttgaa

SEQ ID NO: 64536 - DNA, 1394 bp, Bovine  19866881149494
gaaaactggcaggagaatggtgactcctggggagacaagtgagcaacttaacttcctaagtaattaaacagtaaatcaggcaagtccatcaggggacccatggtctctggtcagtgcctcacagagagggcttcttgcctttgttctcttttcttccttccttccttctttccacgctcccccctccacccccgcttttggtgtcatattttttgcaagacttttagaggtacttagctgtaggatattttctcagctgcagcactattgccctcttggactcgtagtccttgtttatgggtctgtcctgagcattgtaggattttagcagcaccactggcctctgtccagtagataccagtagggctcccaattctgaaacaaaatgtctacagtgtaccctgggggacattcacccccagttacgggcccctgcttatagcagaagacagcctgttcttcctgctgaaaaatgttgcagttacaacttgggatggtgaaatgatgagtcacttcactccatctcctcttgcttcacaaaagttttataaagagaggccagccaatcaggaggtttgtgggttgggagtcagtgtgaccacgctgtctgaggcggctgcattgctaagcgtcgttatggggtcctttgggggttcttcaggaccagacccagagtcaaaaacaagcaaataaacaaagcactctcatcaccgccacccacaaaaaataggaaagtaaaccagaactgaaggctttggaattttattaaaaatggcctcatgattagcaccagactccctccttcagaagcggtcttaggcatcctgtctgcgtagagctggcctgggcattgatatgtgaagaggctgagaacatgtggtataaacatcgactgatattgtttgccatttacactcagcatgtgtaatgccacaggaattgctcctggcggcatgtgactctgcttccagccgggtgtgcggtgcccggggtgctccttctctttcgctggccgccttgctggcgtccccccctcctctgcccccttcccagactccggagagtctaagcggacgcttgtcatgattggcatgcggaaagctggtagaatgtcatcggaattttctagggaggcacacgcgcaacacccaaaatgactcccggcttcggtggcctcaggtgagccttccatgccaggagccctggtctttttcagaaaggtaaggttgcatgacgtcatcctacctttccccagcccaagcgggaaatcaagggttgggtttttttttttagttctctagtccgggctgcactttagaccgtgttcttggcgctaagcatttgtgcatgagtatgcgatttgtgggatccccacccccttctgtttaaaaaag

SEQ ID NO: 64537 - DNA, 1729 bp, Bovine  19866881355976
tggtaacatactgttcacctcattcacccagtggaaactctgagctagagtgttcacgattagtgtgaagttacagtgccctctggttggtagtctgtcttttgaaaaatctgggtctttagccctccctttgccctttctagcactgaatcttgggaagtgatttctctgctaaaatgactttggtttgtccacacacaccagcacatgcacataccccagctctgtgcaactccagtgggaaagggagactgtggtttcatggtagctgtctttttgatgaatgtccccatgtccacccacagaggccgtgacattcctgccttccccacttgataatctgaaaatcttctgagccagatggcctttgctataggcctgctactctagaatgccacgcaggttctgggtttcaatccccagggccctccctggctcttatttgtaagagctggtgggcttgaagctgataaggcggggagctccctgaggtccgttcccagagtcaggaaagacacagtgctggaggcagggcagcagggcggagagagctggggtcagggtgcgcagagcttgacgcaactacatggtcttgtttgagctttcccctttcgtctactctcagatgcattttgctttttacggctccacactcttgcagtgtgttcccaaacgtgcccaactcttacctccatcttctgacctctgttggctaaagtgacacagggaagtgtagactttactctgtggtgagttgttcctgtgttagaagttttcatcctctcacccggtgggagatttttacactagagtctgataattcgtttactttaaagttgacagcttgggaagtttatggttgactttctggtcagaaggatttgtcagatattcggcctggattttggggactcttctagaagagccactgtcagcatccaaggtctagtctgtttggtggtccccagactctgaaagtgaaatgcagagatctctgaggggagagttttggatcttaattgcctgccttgggaacttcccaggtggtccagtggttaagaacgtgcctcgattcaatgcaggcaacacagattcgatttctggccggggaactaagatcccacatgctgcggagcagctaagtgcatgccccacaatgaatgatcctgcgtggtgtgatgaaggtctcccatgctgcaactaagacctgatgcagccaaataaataagtaaataaatattttaaaaattaaaaaacttgtatgtcaaaataatcctcataaagaaagaatcgcctgcctttggatcagtttcatcagttaacctatttgctatgtgtcctttggacaaagtgttctaacttctctgtacttcagtttttccatctgtaaaatgggaatggtaatagtcgtgccacctgtggtagttaggaggagtcatgagatgatatttaagtgcttataatattcagttcagttcagttgctcacttgtgtccgactctgtgaccccatgaaccgcagcatgcccaatatagcaatttttaatgtagaatatacctaggcactatgaacattttgtgcttaatgttgactcttcagttcagttcagttcatttccgtcgctcagtcgcgtccaactcttggcgaccccatgaatcgcagcatgccaggcctccctgtccatcaccaactccaggagttcacccagactcacgtccatcgagtcagt

SEQ ID NO: 64538 - DNA, 1565 bp, Bovine  19866881958187
cttcctggtgctctacagagaaaagcccttttaaggaggcagaggctctaattcctgagtccctttttcataacccaggttgggtcccttgatccccactcaccttgactctctcatctataaatacaagtaagactctcttacttgccttaaagcaagagactggctctgatacatttctgaaattcctgttggttctaataccaaggattttaatcaagggtagctatggcaagatcctgtcacccaacccccaagtgtcacagttcttagcccgtgaacagcaagggttgggttgtggtggccagctcccccaggctccagctggagctcccagccggtctcagatgactcaccttcagatcaaacaccttcttgtcgcagatgctacagacgtgcggcaggtggaggggggccacaccgtggaagtcattcagctcgtgcgcttgcaggggccgcagggacagcactgcctgctcctccttggcccgcctccgggctccgctgaagccctgtttgctgttgttgagccgacccccaaaggaaggagggggttctgtctggtgtgggctcctcagggtcatacagctcatagggctggccagggggagggggccacaggctgggggctgccgcaagatcaggcttgctctggccagagaacccatgggggctctcccactggctgtttggaccctgcagcaggggacccacctcgcctttcaaggccccagccggctcagccacaaatccacctgccacctgcgacccttgggcactgggtccatagaagtccttgggaaaggcagcctggccatcttgtcctgagtggctgtagtgcccttcgtaggtcacgctgcccgaggtagcagccgaggctggcaggaagccgggctgaccatcggtttcagaaccatatgcctggccagagctggctttgccatattcgtagaaccctgcagcagcgggcgcgggcccagtctttccaaggcccaggatgaccgctggctgggtgggggtctgaggcatgaaggggtgcatcaccatggcgttggggggctggctgggaaggctcaccgtgggccctgggcctcgcgtctggccagggggtgagaaggcgagtgcgttagagggaaagcgggtgctgggcacggtggccgcgtgttggggcaccccggtgtggccgtggggggcgctgatcatggacggatgccgcagctggttgaagagaggctgggacatggccactttggagaggacttggttgaggaccgtggcagccgcggtgttgttggtgacggctgtctgtgccagcttcaaccggtggagggtgagctgagcttgcagttgggccagctggaggctggcgggcgaaggaagcagcgggttcggattactgaccgagaacggggtcttgtccaggagcttggcggcactgtgaggagacaaagggctagatgtacggctgctttccacctggcaggcaacgggctgcttgtttgctgtctgtggtcccccctcccatacaaataagacctcccacacaggccccacatagatccagt

SEQ ID NO: 64539 - DNA, 2206 bp, Bovine  19866880186793
ctgatgcgaagaactgactcatgagaaaagaccctgatgctgggaaagattgaaggcaagaggagaaggggacgacagaggatgagatggttggatgggatcactgactcaatggacatgagtttgagcaagctcagggagttggtgatggccagggaagcctggtgtgctacagtccatggggtctcaaagagttggacatgactgagtgactgaactgaactgaactgtgctaattctccgacctgtttcgggtggcacgatgctatggtcttaaccctcttcgttgggacttgggtgttgtcccctgtagatgggtcaccccatctccagtctttaaacattccacaccactctctatagctgcactgtccaataaggtagccactggccgcctgtggctatggagcacttgctaggggactagtccaaattgagacgtcctcttgaaaatctgcaattgcaaatctggctcccattggactggtactggacagtgctggcctagagtctcccacatcaggccagcatcttgcctttctgctgcccacctgaccctgtaggcacatcaattttgcagttcctgctgaatgagaaggaagtataagctggagggaggagactagagttcaagtctgactctgacgcttgctgtgtgacattgggaaatctcctcccctctcagtgcttggtctcatttcatgatgaagactttggacttaatctctaactttccacagctgaaacttcctctcccacacacctctgaatttacccttttgtggtgggatgctgcctgccagctttgagctaagcattccctgctgccagcccctcctcttgccctgattcccagcattccggctgcttctgcatctttagggggccctgtttccatcaggggcctccctcctcactccacagggggttgaatcctggctcattccgcttggcttgttgtttacaaaatgagaggttgaccatgtttctcttttttggctaatatctgcaatttgccctcatttaactcacatatctcagctattagtttgctcaccttcaataattattgtcatgcacccttgggctcataaaccattgttccaagtggtgtgtcgcctattttaagaacttaatttgtttgtaatgtgcacatcagctgcatgatttgtttcttgcttgtaattaacttttaagctgatgccattcccccaccaaaactgaaactcaaggtaaagttggtaagattaattcatgctggctgcatccaaatcttccaacatcttcattggactcagcaagtttgggggaaatgatatttttttccctccactcccatctgttaccctgccgatcttggagccaatccatccattagcgagcttgagtgttggagttggaatctaacactctccagtgtttccagtgcctgtaccaggataagcaaactttccccccaaacccccttaaccctggaacttgaatgcatctcttccttcctgagagggtccctggactcaaggatgaatcatgaaaccccttactaagttgtataatacctctctgctttccctagttgtgattgctgatttccatggtcttctgcagtgacgtattcagcaatgccttggattcataatctgcactgttggaggcagtgattgggttggacagagccagctttattaatctttccatttaatgacacgacaccctatctgtggctcatgtgtgaaatctgaattccaggcagctttcctctgtgaccgagcaaattgagaaattaggctgtactagatccatgcttctcaaaccttagtgtacatgtgagtcgccgagagatcttgctaaaatacagattgtgatttagtaggtccagaatgggccctgagcgcgagtgtgctcaattgtgtctgactcttcacaacaccatgggtgtagcccaccaggctcctttgtccatggaaattgtcaggaaagaatactagagtgggttgccatttcctattgtcggggatcttcccgacccagggatcgaacctacgtcccttgcgtctcctgcattgacaaatgggccctaagaaactgcattttagcaagctcccgcagaagccaatgctgctagtctaggaccacactttgaggtgtgggtactagactgcacgcctcacgaagactggaactgtatctctgacacatgaacgct

SEQ ID NO: 64540 - DNA, 2578 bp, Bovine  19866880555722
tgtttttcctctgcttcccgcccccacctgtctcttccctaatctttctttccttaataatcgcacccaccatccacccagctgcttaagctgaagacctgggggctatccttggatttttccctcttgggaaaaggtggttgtgtgcagcttgcatggctgcttaagagcaggcttgggcctggaatgttttcttgtaaagagataacaagccatcacagcctgggctggatgcatctccttgcctgggcgtgtcttttcctgctctgggcttgatgtgaactgccttgttctgcttaagcctgtgtgttgtgttaatgcctgcaacccccccctgccccgcccccaccgctgctctatctgttcctggtgggatgggggtttggggcccatccactgcaaaatgaagtggggttcatgtggccatagcactgcgtggaccgcagggtgcatctcggaccctggggcaccgacatactttgagggacgggatctggtgtgttctcatttgtcttgctgcacacaagcgctggaccccacgagcttggtgtgtgtgttgtctattcccactgaccttgaatcatgcacggatctcttccctgggtgtcacttacctgtcttttaaccttgaccctactgccttacaccaccatggagcgggggaccattcctttctcgagttccccatactcagtctagtgcaatttataatcattctccttcaaatgtgtgcctcaaatgcttccttacctccacttccacccacacatctcccccctggacttctggattagccttctctctccctgcttccaccttcatccccctccaatccatccttcccactgtagccgggtcagtcttctctttgaaagctgtcaagagcttctcgtggcatctcagccagagtccaggtaccttctcaggatctgcatggccctgcctgtctcatccctttcccctctgccagatgagcgccaccagggtggccattctgaacacaccctgcgtgttccgagtctttgcgtattctgttccctctgcctggaaccggcaactcttcccctacctggagtaaaccctccgatttcaccattgcttcctgctgatcactgggtgtctgctcccctgtcctgtcctcagagaggccttccccaaccgccttgggggtgggtgagtctccagcagctgtgctttaccttcctggcaccgaccaggaatctggtttgtatactatggattgcctgagcctcctgcttggctgtgggcaccactagggcaggggtcctgccttttttctctgctgttcaatacccattgcccagatccagggtcatagcagacattcaatacaaactcgttcaaggatcgagtgaattagagaaaaaataagctttgggaacgcagagaacacagaggactgtgtacaagaggctgacgttcactgaagcaactattgtgtgcctcgcatttactctcacccacggatggctatcaaattcatctcgcagcccagagaaatgtgattcccctgctccaggtacacagtagcgaggttgcaccctgctcaagcttagcctagggtttcttgatcttggccttatgacgtttgggtcaaaataatttttcattgtgagatggagggggaggctgtcttgtgccttgtcgggcatttagcagtacccctggcctctaccctctcaatgctaggagcagcctccccaacttacgacaaccagaatgtgtccagacattgtcaactgtttcttgggggccaggccagcctccactcgaaaaccaccagtttagcctcccccgtgctcctccacgcctgtccccaccatccccgtcctctctgagagctgctgtttcttgtggactttccctaaccccctcatttccgacactcctccctgtgtatccctctgggaatgcctcaaacggatggtgaggttccgcgtgttgcaacaaacatttgcttttctgatttatttagcatcagccccgagttcagacgcttgtatcagtggcatggatgctcacaggctgtctagaaagtgtgcggcgtattttccccctttgtctacatcacatgtctgaatgtttagcgtgagataaaccagtatgtttatgaggagataacttgtcaaaacagactcgtggcttcaccgctggcacagcctggcctcctagcctttcttcattcagagacagaacgcgaatgtttcttgggtgttttatgtggatttaaagtaaaaatttatttcctgccttttttgatggagaaaaaagccctaaatacaagttcttttttttttttaacaaaagggacgaagagagaaaaaggtatagaaaagaggcatgtgttcattagagaaagaatccgagtgagttcctagtcaagggatccagttagaggtagggctccctttttggctcattcatccgcccatccatcccctcatccacccaaccataccctccattcatccatttatccacttgtccatctattcatccacctgcccatccattcatccatccatccatctacccattcatctatctactcatctat

SEQ ID NO: 64541 - DNA, 1177 bp, Bovine  19866880598196
gaagattatcctgggtgggcctgacctcatcaggtgagagctctaaaagcgggcttaggctttccctgggctcggggactggaagtaacagagagagtcagtctctttccccatctccccacctctccctccactgctggttttgaacaaggaaagctctatgaggtccacagcttcaaggacatgctgctaagtcatttcagtcgtgtccaactctgtgcgaccccatagacggcagcccaccaggctcccccgtccctgggattctccaggcaagaacactggagtgggttgccatttccttttccaatgcatgaaagtgaaaagtgaaagtgaagttgctcagtcatgtccgaccctcagcgaccccatggactgcaccttccaggctcctccatccatgggattttccaggcaagagtactggagtggggtgccattgccttctccatcaaggacatgagtcctgtcaataaccacatgatctcaggaagagaccctgagactcgatgagaccccaccccagctgacacctgaatggcggccttgtgagaccctgagccaagaatgcagctaagctgcacctggaatcctgacccacagaatctgtgaaataataaataggtgttagtcactcatccggggcaattcattacacagctaatatacaagccaagaaccaacaaatctctaaagaggtcaaggtgggaatgatgtcagtgttactcaaacgaggaaccggcactagacatttctgcacatgggcctccttcagtaataataaaacagaaaagacttcaaaacctaactggcccatttcctttacctgtcattctctttttgaaaattaaaggcttccatgggcacccagggttgacttgatcacagcatggttagataagcttccaagtgctaaggaaaagaggcctctggcagcataggaggaacaagttgctctatgagaaagaaaaaaaaaaatcttttcaaaggaaacgtttgcgtctcaaacccaaaaaacaacaacttcagccaagaagaaactcccactatctggcatttggagagctggaggagagatgatgcaaacgggaatttgttctgggtgtgcaaatctctgacaggtgtgcaagacgcaacaatccccacgttaattcccaccatcctggacaccagcttc

SEQ ID NO: 64542 - DNA, 1561 bp, Bovine  19866880632194
cttgggtcgccccctttttatatacctcactcttctgcacagcacttgtcacaagtgtaattcagcaacaactggtattatcaggttaagaattatctcccccgtctgaccataagccccatgacagttggtacctcgtgcatcctgcccccagcagcgtctccagcaacaagccggtattctccttatgtgtttgtcaaatgaataagcaactgcaggtgacgacagcaccattggaaccagatcccaacccacgtggctctgacaaatgagaggtcccaaggagggctgaaatcaaggctgcctcccaatatctgggtcacgtcaccaccatccgtggggtcacctcttcttctgtctgctcagcttcatcacctggtgtcttaaagccaaggggcccatactcggtctctcctgctcccagccaaccccgaggagcagtgtgggaaacggtgctcaagagagcggggcagaagagtctgggccacgtgaaatcagggtcccgaagaacatggatgtaactcagacaaatgtgtttagcatcttcattttccttccgagtaccacttactcatccggggcccaaatagtagttaagttttcttccccagggggacagactgcagaaaccagagaggtgggcagaggggagtttgaggggggcacaggatgagaagactggatgccacctctgctgcagagggcatgagggggcgcgtcggagagtggctaccttccagggcagctgcggcctcctgcaaggttatctggaatgtgacagggcaataaaagtgagtcatcgtcacccagccagagccaactcagccgcctggggctccgtgaagcgtgtccccagatgcaaagttactcaaattccggaatgagttttgccttaataaagggcataaaaatgtccgtgcccataaagaccggctgctgtgtagagccagtgtggctgacagagccagagtgatcagctgaagggcgccaactgaaatgagcctcatgctggagacagacagtgtcataccctttagagacatctgtcctcaggctcctaacccagctccctggctggctagctgtgtgaccttgggcaagagcatctcctctctgatcttcgggttccacacgcctaaatgatcaccaactgcccttcctactctgaaattcatgccacagctatgaaaagttctgtgcattattcctcccagggttgatatttgcattttaaccagaagtgtccactcactccagcagcctaccggagaagagtagaggcacacaatatagttgtccaggttcaaatcctggcctcatcaacaatgaccctctgtaactttagacaagttccttaacctctctgagcctctataccttcatgctaaggataatacaaccaacggaaaggcgaagaatcttcttcaaaatcctcagcccatcttgtgactggattccccaggatccaacatctctgtgctgaggtttctgggcccttctgtttgggacagaagccaaagcatcatgacaaccaccaccatctgctccacaaagcaccccc

SEQ ID NO: 64543 - DNA, 1183 bp, Bovine  19866880803817
aaaaaggtataatagaactatcacctctcttgatttaaacattatatttctagagatgtgggctttattttttttatgaaccctatcacttcttgggacctgctgagtatcttggtcaatgcaaaaaacaaatgaggaaataaacaaaaatcctgtgattgaggatcacaatttcaaatgcttgcagagtccatgcagttaacataaatgtgtgaatctgattacatgtgaggtaacagggagtgaggagggctgtagggaacctaaaaatgaatgccttgtccaaagacattaaaacttaagcatttaagaatactatgctggtgaaataaaatactgatgcatccatgagccagatcaggaggcagtccactggttcatgattcttacaaaaatcaatttcaagtgaattggaaagtcacatctccctcttcctgcaagaatgtatatccttaaacccttcagtgcattctgtagtatgggttcatcatttcaatctggaaaagacagttttgaattttacttccatcatccaacatcttaaatcatttcaattaaagcaaccagattattaacatcaaaatctatattccctcttgaatctaagcctcttccctaaaccaactggatttacaatcattaatttaaaaggataataaaataagaggaaaagaataagatcacaaggattcttcagtcaaatatctttggggctgccaggtggcctcaggctgtctcagaggcgcttaatccttgtcagaaagaaaatgagaaactatacatgtccacgggcttccctggtggctcagatgataaagaatacgtctgcaacgcagaagacccaggttcaatccctgggtcgggaccatcccctggagaaaggaatggctacccactgcagtatttcttgcctggagaattccatggacagaggagcctggtgggctacagtccatgggcttgcaaagagttgaacatgactgagtgactaacacacacacatatatgtctagacccaaagccctaagcccagtgcaaacatgtattccaattggtggagttatttaccataaaggtcacctctaacagtcactttcacactggccacatttaatcttcagtttgccaagataaaagctcatagcaacctaaaaactcaaagaaagcttctggttgtcccagt

SEQ ID NO: 64544 - DNA, 1318 bp, Bovine  19866880810250
tatcagttgcacagtctgactcacatgtggaacacgtgcattaaggaacaggcaggcatgggaagagatccttaagcacttctgtccctcttccaccaataaccggttctggctagacgctttgtcttcatgaaggcagagaatccttccaggcagagaagttctatttgtatttacagccgtcccccagttgtatttgaaaatggaagactgtgtagcttagggcccccctgggttcaccgtgcttacttttccttaatgcctcaattgtacttttaatcagaacaaatttcgagcattaatcctccgtggttgtgcctgccatttccagccactcaacacttttttcataaacaaagtgacagtttgattgaatgtggttttttaattaacttgccttcacttggagcaactttgggagcatatgtagggagcagaacttcagaagtgggagctcaggctgacttctgagaaacatctccaggcagttcgaggagaacaaaggaaaccagacaagtggaattaaccaggcgccaggaacagggcgacagcccccaactccgtccccgctccccgtcccctgtaataagtgtgcaaaggctcagcagttggtccagtcgtctcatggtgaactcagagcatgtgaaatctgagaaaattgccccccagtggctatttacatggttggcatttaaactgtttctggcatgtcactctctttcacagttgggacttcgcaaaaacaaaatgaaatgagaccactgttattctgcctgcaggcacaactcagagttttatgagcaagggtggcaatacaagatcttccaagatcttagatgtaacgggggagacaaagaaattcgtggggatggctccatacgagatgggaagtgacgagtgagtagtaccagcttggaaggtggagctggagctggaaactacattacaggctcttcagagggctgttggaatataacaggggacagtatgtcagaggacagcgtttgacctccttgaagtgggagttcccatgcagagagggtcccagcgttattgtctgggtaccatgcaaggctgcaggtggaggtgatggttttaagtggcattagctgagaagcccgtccctccctcggtgttctggtattctgtggtctagagatctagcctgataaatagctctgccgtggagaaatccatcacatcttcgcatgactcatctcgctgtggcaggcatggcgctcggcttccaagaatagcctagcctgagggatccaagctcggaatcccttccaactttcagggcttctgaagttcggcg

SEQ ID NO: 64545 - DNA, 1477 bp, Bovine  19866880845118
ttcttttctattgaataggtggagttggagccatctcaaagtaggtaattgatttttgtaatggttttgcaattacctgtaatgaggccctttataactctttaaggtcaaggaggaaatctttggtccagtggcacccggtgtggagaattttagaagcctctttgctttgatccagggctttcctggtggctcagaccgtaaagaatatgcctgcgatgcaggagaccctggttcagtccctgggttggggaggtcctctggagaagggaatgggaacccactctagttttcttgcctggagaatcccatggacagagaggcctggagggttgcagtctacgggattgcaaagagtcagatatgactgagtgactaacacttgctttggtccaaatttccataaatgggggcgattaagaaggaaagggcagcttgaggacctgagcacactgaccactcatctgttgtctccagttgtccccaggtttggctccgtagaaccaggatcttcctacagcggcagacttggtcagtccctgtccaggccctgaatttcagaacgatttcatgggccagaaggaaggacagaagttggctctgctggcccctctcttggcactgcagttccagtttggctggaggctgtgtcccctccctggtccctcacagatgtgatcacagtgggtgcagtctccaaggcacccagatgctgtatgtggtacgggtttctcgggaagtggcccgagtcctcctcctctaagatttccgacttcaaacgtctcctcaacaattattaatttaacgtgtgtttttaaatcactcccttttaaatttaagtacatttgctttaaaaaagcaacttggcatcagaaccataaatggaaaaccagtatcacttcctacaaatagaaagtaagtgcaaaaataaatacgacaaagaccaaacagtgcttttttatttctagctggagcctgctgcctgcctaaaggctctgagcctgaggcctgaactctgttaaaacgggagattagccagcgtcgtagagtgttcgggactttttgtgtgtgtgtgtgacgttttcaggaagggttgaaacagacttgcaagggagccacttttttaccatgtgatatgatgttatttaattttgtattcttgtaccaaccacctaaaaatcatcgcagttaacatcaccgttacagcgtcacatgtgggaaagagttctaatcttttctagtagatgcccttgcattttgtagattggttctttgtttccagactgaggggcctggcatgagagtgatgtacgagagaagttagttcaagggttagtagtggttgtagcaggactgtgcatggggtgctgacctgcaggggaagtacaagagatgtgggatatttggcaagaagagaatatagtgggcatgggttggaatagtagagctaaaatgcactatctcactgttgttcctg

SEQ ID NO: 64546 - DNA, 2109 bp, Bovine  19866880979038
aactttcctgtgaatccaacatttggcaattattgtcaaattttaatacacagttaccatttattaaagcatttttgcccacttacggttccttaatttacagaacaagggaacaagacagaaaggtattcattgcataatgtgtataaaggaaaataggagggagcatcatactaggtctaaaagttgggaattagctaaataagttactgtacatctgtacaacagaatatgatgccctagtttttaagaagaatgagctacgtttatgcaaacatggaaagaacttcatgatattatgttttttaaaaaaccaaacaaatagcaattatttatttggctacaccaggtctcagttgccgtacatgggatctttagttgcagaatacagattcgtttatgtgcagcatgtgggatctattttcctaccagggattgaacccaggccccccggattgggagtatagagtcctagccactggaccagggaagtcccagggtattgtgtcttgagtgataaacagaatggtaggataggcccattcatgtactaataaaagctctaaatttgtacgtgccctgtgaacagatatgtgtatatatgtgtgtaagtaggaaaaaagctgtaaagtcatggtaggaagcttagagtgggattgtaggtaagtttaattgcgaacatgcgtgagtgcatactaagttgcttcagctgtgtctgactctttgcaaccctagagactgtagcccaccaggctcctctccgtgggaatcatcaggcaagaatactggaatgggttgccatgccctcctccaggggatcttcccgacccagggatccaacctgggtctcctgtggctccagcactgcagatagattctttaccactgagccatcaggaaagcccttagatgcaaacaggggatttcaaattttactgtatagaatacgcttgtatatggtttgtgtttcataacaatgcatacagatagtcattgggtatattttaaaaaatcaaaatcatttaatgggtttgtggtgatgattttaaaatcagcccacaatttctagaatactcctccatttaaaaggtaaaatttaattcccctcccctcgatgctccaggctaagttgtactttcctgctgagaactggaatcaactatttttctcagaagctcaagcttcttggagtggaaaataacacatagactgaaccttgggggagttcactgccattagattggtcattatttcttggatttttcaatggggaaagttagaaatgcatatttcttttgctttcaaaagagaaaatggattatgaattcacagtgtataaaaaagttatttggatgacggtgctttcatggtgtgatgaatatgcagtttcccattcttctttttcttcagtctgctttttaaaaatttagttgctaaggacacatcatcaaataatttttttcttttggtaatgaatcttctattttagttagaaagaaacaattatcctctttttctaatatagttacttgtctctgaatcattcaaattaaattgagttgttgcataaccaaaattagtatctttttttggtctaactaaatattttttaaataatatttttgagacagagaagtaaaaagaacaaaaatattctataatctcagccctcagaagattaccactaatatttttaataaaaattatacatatacatgttaattgctcatgaattggaagacttgatattgttaagatgtcaattctctatacttgtctatgtatacaatacactcaaaatcaatatcactgcggttttcttatgtaaagtgacaagtggattctataatttatatggaaatgagaaggacttggaataggcaaaacaattctgaaaatgaagaacaaagttgggggatttatactcgctaaattagaggcctactataaagccacagtaatcaaaactatgggatattggcatgaggataattatataaatcaatagaaacaaacaatgagtccagaaatagacttgtacatgggtaaattgctttttggtaaatatgtcaagcaattcaaagaaggaaaagaacagtcttttcaaaa

SEQ ID NO: 64547 - DNA, 1354 bp, Bovine  19866881183750
accgcggccaccggctcccggagcgcacggcggcggtaaggccgggataggcggctgcctggcggcgggggcgcctgaggcgggcgcgccgctgtccgtggtgctgaaaccacgatctccgcccgttcccaggcgtctggtgcggctgaggaatcaattattcagatctctgctaccgcttcctcctcccccagtgcctcgcgctgggtacagcaatcccccttccacgcacaggcgcgccaacacacacacgcgcgcgcgcacacacacacacacgccacagaatctgttccaatgcctctctctgtgcctcgccacccccaaagaggaacccactcctctgatctcagggagccacaaacctaaaactaaacacgtctggacaccctccacttgcttctttcttgttttctaagttataccaaacaaaagtcgtcctgaagctgtcacttttaagctaccagcagggtcaagccagagagcatgggactcctgggtgtgtggggcctgactgacttggattctggtaactgggcttgaaacgcattgctgttaggacatttgccccctttacactccttccaacactgcttttttcccctcaggccctggaagaaacgagaccttaaagtgtaagaagttttgcaatcactgttctaaccctgagttctccacttaaccggcctggtgccacctccaggcccattattcatcttcttagttgacttgctagtcggaaaaatggggaagacagtaaaaaaaaaaaaaatcaacttctcagggttattttgaaaatgaggaaactccttggtaaaggagcccccaagatccagcatatagtacgtgctcaataagccacaaggggacctgggagagaagggaccccttccaggagtgcagatgtggccactgaaatagagacaggaatggaaccacagctcctggacacctatttgtttattattaagttggtggctgtatgctgagttatccagagttttatcacccacagagaaaggatgggagaaattctggagggtaagattgtggagtggtgtgacataaggcagaaaactgggaagtgttccgttcctgaagctgtaacttggctgagctggattgggcccatctcttgggtggagatgatcatttcttggacttcagcacaggttacaggaccctaatttggagaggtttggcttttttctattgaaataggacataaattatataaaataaaatgcatctttgaaggactcagtttaagtttcaaagtgatatgcatctgtgttagacgtatcacccaaaagaaggaagagaatattttcctcacccctagaaagtgcccttgtgt

SEQ ID NO: 64548 - DNA, 1597 bp, Bovine  19866881264233
ctgctgcacccaaaaccaattaaatcagaatttctggggtggggccaaggtggtctttttaaaaaatctcaatgtgtattcaaggggtgataagaccagctagatcagtggttctcagagtgtggatcacagatcaacagcatcagtattacctgggagcttgctaggactgtacactctcaggccctaccccagagctgttaaatcagacccttcatttttaaaaataattttatatatgtgtgtgtgtgtgcatgtgtgtgtgtgtgcatatacttccctggtggctcagcaataaagaatccacctgcaatgcaggagatgtgggttccaacgctgggttgggaagattccctggagaaggtaacgacaacccactccaatgttcttgcctgggaaatcccacgtgcagaggagcctggcgggctacagtccatggggtcgcaaagaatcagacacgaattagtgactaaacattttttatttttttggttgtgctgggtctttgttgctgcccgtgggttttctctagtcaccacgagcaggggctcctctctagtcgtggtgcatgggcctctcattgcattggcttctcttgttgcagagcatgggctctagagctcagactctatagctatggcacttcggcatagttgggattgtcccagaccaggggtcgaaccagtgtcccctgctttagccagtggattcctataaactgccatgagggaagtccaggccttgcattttatactaacaaggtccccacggagtccttgacaaaagtgtgagaagcacgaccgtgcagcataagaggaaaggttgccggctctgggtcagagtgcctgagtctgtggagcatcctcaccacctcatagctaccaggcttcggcaaatgacaacctctgggctcctccttttgactttctcccataccccacgggggaggcttgagccaggaaaccaggggcctggtgggaaaatccaggagaacccacagcctgtcttggaggaagagattcaggtggatcctgaaacattttggaggacctcctgaagaaaatgaagacgaaattccaaatataaaatcgggtgcattaaaagcatttaaagcattctgcccctctgtctctttaaatgaacacccttcatcccatcctacatcctgacttccagcctcagaagaaattgtctcggtgtgtgtataaatggatttacaatccttgcctcgtgaaaaaaaatgaacaaagcatccgtagtagctaaaaaaataatagacgcttcaggaggttcgagagagggattacagagagtcagcacttaattgaagctcctccgttgatgtcatgagagacctggaataacgctggaaaagccgggttttcagaaggagaaccaggcagctctccgaagaatcttaaaaacgggaacaaggatttctgtttgcagggctcttctggaagccggccctttcggaggaaggcaggcaggctatacttagaaagagatgcatggcgaagagcagttctgttactataaattcatttccaaaagccaaacatatgtgtgtgcacacacataaataccatatataggg

SEQ ID NO: 64549 - DNA, 1789 bp, Bovine  19866881316426
tgaacccaatttgccaacttctctttgcatccatgttttagactaaagctccatcttctggagaagaaatgacatataaccagagcttggcacattgactaacagtcaaacttgatttggaagtttctgagaagatgtctttcttcgtcatccaaatgatttctcattggcagctcatttttccctctttggaaagagtatcatcttggtggggcagtgaaacaagatgcatgctgttgatcacctcccctttctcaaagagagattcatggcttggtttcatctttctatttatggtttctgcagtgggagactgattggaataattctccttccctcggcttgttcttcctttgatccctcatatcattgaatcagcactgggtgttattttcttactctctggagaaatcaatttctctgcagcttttcctgtattttattcacggggtctattctgaaactccttgaatgcaaatattttaggaaatattatacattaacatcatatttttgagagattgaaagctagtcaattttttaaaaagattgatttacttacttctgtttttggttgtgctgggtctcggttgcattgggtcttcgttgctactttctctagttgtggtgagtgagggttactctttattccagcacgagggctcctcattgctgtggcttctcttgttgcagagtatgtcttagtttctgcacacaagctcagtatttgcagcttgctggctcagtagtggcagtgcactggcttaattgccctgtggcatgtgggatcttcccggaccagggagcgaacctgtgccccctgcattggcaggtggattcttaaccactagaccatcagggaagccccggttttttgttttcaaataatattaatttttaagtatagttttaggtttaaagaaaaactgtgaggatagcccataaaccctgcatttagtttctcctaatatcgtaaattagatagtatatttattacagctaatgaaccagtactgatgctttattatttattaaagtccacacattattcagattttcttagtttttacagtgtcttttttctgttccaggatcctgtattacatttaaagacatatatttatttatttggatgtgccaggtcttagttgaggcatgtgggataattattggtgtgggatatagttctctgaccagggacggaacctgggccccctgcattgggcacgatgagtcttagccactcgaccaccaggaaagtccccattgtacatgtaattgtcatgtcgccttcggctcctcttgactgacactttctcagattttctttgtttggatgacagttttgagaagtactagtcaggtatttcgtagaatgtccctctactgggatttgccttgtgtttctctcatgattagggttacggggcttgggggaagaagatcatagaggcaaagtgtcatttttaccacatcatggcttatcactgtggatgctgaccttgaagcagtgtttctcaggtgaagttgctcaggtaactttagagtcccccaccataaaggctgtctgtgaccttgggtggctgttttgggggggaaggaagagcacagagctttgctatctgtcgtgattggtgccgcatagcccggctcctcctggccccagcagagagaagcaggggggatgatggggttcgtttgattcaatctattttatgccactgtggggaaaggatgacctgggaacacgatatgaaaagatatgaaaagggagtcaggaagccagagt

SEQ ID NO: 64550 - DNA, 710 bp, Bovine  19866881778115
aatagtcctctcgtatagtggtgctgtctctccaacaaaagctttgaatgttctgttagggtttgggggtattttatgtgtgtgtctgtgttttcttatctccatttgatttctttttgcctgaaaccccacactgattttcaaggaaaggagaggtaaagtggactgacatccccaggcttttcttgctggaagattaggcgcatgtcctaggtttataattagcatccagaaaaatggattgagaggtatcagccagaaggagagaagaacggggcaaatcgcaggcctgaatgacccctgggattctggccaaaaccagggagcaatctttcctggaaccccaacatctgctattaatcagaaagcttcctggtaatttgagtcaacttaattaattagcgcatcctcttttatagctcttggagctttaatcctttgagacagcgaacagctctgagttgcttaacttacctagacgcttcttttatctgccacttcatgtggtagtttttagttcctcttctctccaaggtgtgcccactggaccctccagggagaaaaggctgatctggagagagtcaggagtggagatttatagggaggtggggagagggcatgtaaatgcctctgaaaaataaaatgagagtgggaagaagcaggatcgagcaagtgacgggctcagaccatgatgcacagatagtggaacg

SEQ ID NO: 64551 - DNA, 2455 bp, Bovine  19866880291816
tagttgctcagtcatgtctgactctttgtgacctcatggactgtagcccaccaggcacctctgtccatgggatttcccaggcaagaatactggagtgggttgccattcccttctccagggtatcttcctgacccaggcatcaaaccctggtgtcccacactgcagacagattctttactgcctgagccactagggaagccccaaagggagaagcatgattctcccaatagtaaggagagataactgagctcagttttactttctgctaagttcctgctaaggagaactcaacagtctgctattgtcctgaaagaagtctagtcaaatgctgactctggtagatgataggaaatgagctctcaagtgttgagaaaagttttgacagcctcccagcaacatgctccccacagagccaatctcaccaccaccctgaagctgccaacccagtgcctggggagattcccacggaagcagatggtgctgcctggagacgactgtctgaagcttgcatctgggctcctaagcactgcccagctgagcaccctgcagacagaatgcccagcagtgggcttcccactgcaatccattagtgccccagcacagcctattcttctttccttaaaaagggacttgttctccttgaaatcatatcagaaatacctgaccatgaatatgtgcaaggcaaattgtagcctttaaaatgactaatataaggatggaatactgttgataaagatggggtcacctatgtaatgaaagctggtagtaggagccagtatcattatattagtatgtagtattcggaaaggggggttttccatgttgtttctctccattaattaccttctgaccaaaacatatctctccttgatgaaactttagttgctgctgctgctgctaagtcacttcagtcgtgtccgactctgtgtgaccccatagatgtcagcccatgaggctcccctctccctgggattctccaggctagaacactggagtgggttgccatttccttctccaatgcatgaaagtgaaaagtgagagtgaagttgctcagtcgtgtccgactcttcgcgaccccatggactgcagcctaccaggctcctccgcccatgggattttccaggcaagagtactggagtgggttgccattgccttctccaaaaacaggattaagacaggagaaccctacatactctgtcctacttgaggtcaactgcatatttacatcatgagcaaagattatgagaacaaagtgacatctctgtcacattaacttggctccattttcattttgtagctttgtttgtatatattcttatttacttatttatggtatttaaaagctatggcatacagtatgcctaattttatattatatatttaaaaaatgagcatgccaacactcacttttcagaaaggaaaacatactaaaacacacacgtatttttaatgaaagttaaacaacagataacactatatatctggcaaacacctggaatgcaggtatctacatacctcctcagaatgacccagatgcccttgaccatcatttgagtgaagtgtacaatcaccaactcttataaaacagagatgataggaggtcaagtccccatgtttgaatatatacagcagaactactatcattttatcccagaaacattttaaagcaagtgacatcaatcaaccaacacaacagtaaaaaaaaaaaaaaaataaatctctgaaagttcccataagaaagctgatatcaagtaatgtggatgctgggtgaacctattgatacagacggattgccaaacgtatcacgatgtaatggaatgatttgacccactatgtagaatggttgaatctaagccaattaaattttgaaggacaaatgccaaaaaagaaaatgaaagctgatcttgagcccttttttctggtagcagtaagcgagtaggaccgattgcctgctgagatcatcgttgctacgtgatgagtgcagatagagagagcgcaccaggaaacatgtccagcaggcaggtcttacacccagaggggttcccagtaaatcctgagcaatgaaaatgttctaacaacagtggtctcctctcccaaggtgatttatttgaagggaataaatacctggagagagagctatattatttttgtaagtaaaatgataagggctgatcctgtgctcattatcaaatttaaactgctttagggctaagcactaactgtattaattaatgaattaagacatgggcagatattgacccatcactgcgggtgacagcatcattctctaccctaaaggcaaaacacacatcgtctcacaagtctctcctctgaggacacataccccagcatacctactgcaaatcatcatgagtcaagtcctccttgctgggtttatttatttatttattggccacacccaaaacatgctggatcttatttccctgaccaggga

SEQ ID NO: 64552 - DNA, 1732 bp, Bovine  19866880424099
gtgggctgcctctctggggtcgcacagaatcggacacgactgaagcgacttagcagcagcagcgggggaaaaagcaggttcgcttaaccacaaaggaagcaggcttgcttagctacaaaagcacgtaactctagaagtatgaggcatgccccaaaacagtaaaacaatggtggcgtgagactcacatactgcccagtgagctcagaaagttaatgatcccttagacatggtctctgcacacataaaatgcaataatttgtggacctagcttggcacacaaggacaagaaaactcccctggtcaacctggaagaggagctgatgatggaaacatgacgtttactcaagagagataaagaaggtcttctccacctccccggttatcctttgattataaacctgtagcccagtaagttctcatggcacagcatttctcacgtgcctgcttgtaagcctataccaataaatcatttcttagctaccactttgctctccctaaatttttctctgcactgagacataaagggttacataccagagatctttggagcccctacatgacaccaaatggtttcagagatggacttttagcattatccaattatagcaaaagaggacaaaaccaactctgacttctctggagtaatcaatcgattttggaaataattcaacatagatcaatattaaatgatgacatgatcatcatttaatgataccatggtatattttattcagtattttattactctctcctatggttttattattctatttaataaacacttatgtctaaacagttactttgccaggcatacttctaagcattttacaaatattatttcatttcctcctcataataaccttatgaaatagatgcaattgtcatcttcattttgcagcttgtgaatgctggcaggttacgtgccttgagtttctaaaagagtttaaaatgtgtgaaataaagatattcaaaaagactctagatttctctaaaagtgacattttaaaacacaaataagtaaacagtagtcctatcagcataaaacaggctcaggaatctggagacaaaagtataaaatagcccccccaaaaattctctaaaaggccaatccctaattattttaatgttacagactgcaactaaaatataggtgtgtgtgcatgcgtgttaagtcacttcagtcatgtccgactctttgagaccctgtggactgtagctccaccaggctcctctgtccatgagattctccaggcaagaatactggagtgggtggccatgcccttgtccaggggaatcttcctgacccagggagttagattcaaatgccagtggctttcaggctcacattccagttctcgccaccttctggagttcttactctctcactctctccttgtctttgttatctccttctctgtctcacttctctctgactccctcaaagaagtaattaccagaggactctcctccctctgataaactgagggggctaatgatgagattgcaggataggggtgcccactccgcaaggatttacttcaaaggcacagcacatcaaagggacttgccaggaagccctgagatcttgctgagctgggctggccccttctcctctcacctccttgctcaaacttccacttagggactacagtggaaggtatttcatagctagctccagacggctgccttgctctgcaccatccggggagagtgagagattcataccatgtgt

SEQ ID NO: 64553 - DNA, 1252 bp, Bovine  19866880429248
tggtataagagactaagtattgcagtttggcttatcctgtcccaagttcagtaaaatctagacatcataaataatgctatataaattaatcttgattgacctacaaaagtatttctgcaacttacgtcttctcaaattcagttccattctttaacaccattccattaagctttaacgtgtagtttaatgcttttttctcccaagtgtaaaatataagctaagaaataacatgcttaaagcagcatttttgatctggcagtcttcaattttgcagtcaggaatgtgttcaacaggccagagatgtacaattccctaagcaggtgaaaaaaacgtgattgtgagatgacagttttcataccattttcaatgcacattttgtgcatcatttttatgcatgggagtttgtttttatatattttttggagaaatttaaataagcatttctatgtttagcttccagttattgtaagatatatgaaataaaatatggaaattaaaggccaaggagatacttatctaagtgaaaagcattaagatttcaaggctgattatgaccttcacgaacttttgtcagtcttacgagtgtctgtctagtgatgaactcactctccacaatgggtcctgaataggactttgtgtttatgtgtaaagtgaataagttcattcatcaacagcttgttgctcatattgtttacaaatattttcttccattccataggccgtcttttgttgatggagagaaatgtaaaaactttaggaggatgatgtgagtgttaaatgacagaatacattactaacgtactttcaacaattttagacacccagccatcgctaaaaacacacaagtgaccgttccagtttttcttgtttacagaggacaatgcaatgagtagggaatcagtcatctagccaggtttgaaacccaggatcccatttcacagtaattttcaatcacaggatgctgagatatcaggtacccctaaaagtgtaatacatgtgattcatgtaatatcaacacatccatacagcatagacctagtacctaagccctcagattacatttagatgtggctctaagcattcagttccacaaagtaaagagtaactattgtatttgctcctaagatgatggtctaaggggcttccctgtggctcagcggtaaagaatgagaatttaccatgggattctggagaatcccaggacagtggagcctgggggctacagtccatagggtgcatagagtgggcacaa

SEQ ID NO: 64554 - DNA, 1475 bp, Bovine  19866880490097
gattgggagcagaggagaaggggtcgacagaggatgagatggctggatggcatcactgactcgattgacgtgagtctgagtaaactcagggagttggtgagggacagggaggcctggcgtgctgtgattcatggggtcgcaaagagtcggacacgactgagcgactgatctgatctgatctgctctgatctgatctgagcaactgagcacatgcacacatcccaggtattgggcaattatcttgattgctgcaactattgtgactatgttcataattatagtccaggtaaataattcgaagaaggctgaggatagaatgctggtaaatactgacactaaaggctaggcagtgacagagaataataaaatataaatggtcacaagtaagttgagaatcagcagaaatcatatcccaaagcagaggagaaatgttccaagaaggtggctgtggcaaaggaccaaatttcaatagtctgatggctgagaagagggagtaggagctaacattttagtgatcatggtttgcatttggggacagcattttcagtagaataatggaaatagaaatgatattagaggaggcatcagtgaatgttgatgagaaggtagaagctgcagagaactagctgctcttgaggattaatgggccttgaaggaagcaaatgggggactaactggaggggccaacaggacccaagaatcttcttatagacaaatggagaggaataataaagacagcaggattgatctactggagataaaacatccctgatgcaggaaagctggtgggaggggatgagctccaaaagctagggggcccttgggagggagggagcccaccgctaggcagaactggagggagggcttccatgttgatctgactctgcattgaagttttgtctactgtttggtaccatacatgcatccctattttggtaggggtaaataagtcagacctgatcactggatcactgggataatgccaccatgcacctgtaggttctgagctcgttcccagtatttggccacaatcagtagttccaggactactttataaaatagctgtggcttttctgaacttaggaacatttcagagtaatgtaaaaacatgacctgtttctacaggtcagctttatttgtatcttaatccagcatgagcaagagagcagagaatgaaacagagatgatgcagggccttatgtacatcgcaaccccaccttctcacccatcctcaggcaaatcttcctcagtgaatcctttcatcataataccaatcataataagctgtttaagcaattatcccacactctttctggagtataagatttcttaggagcacagaattctacccaagcatagtcacactgacgtcagtgttcagatcagatcagatcaggtcagtcactcagttgtgtccaactctttgcaactccatgaatagcagcatgccaggcctccctgtccatcaccaattc

SEQ ID NO: 64555 - DNA, 1194 bp, Bovine  19866880498373
ttctcaacatttgatttttaaggaaatgcatttaagtttctagtatataaagacttattttagtagtaaatcagcatagtttattctaattataaaaaattatgcctgaggtttaaagacaaatgttagatcgatatcataagttttatcaatgagcaaaagagtatataaagccaaaaaagtccaagtgaattgtgtgaataccagaaagtgcttgatataaagtcacctactggctctctgactcccagtacacaatgacacctactcaacttcaccgtctcgcttacatttgataaaacaactgtaacaaaagaggagtggtttcttgactcttggagaattcacagggaaataaaatatcagaccctaatctactgcagagagaaaaagaacataataatgagaacgaagtcaatttcacaataaactcatatgtctgtatggaatgaaattggtgattttaaaaagtgcaccatcacaaaataaattttacatgacagaaataaaggagcagaggaaataagaaatgtattaaaaatgcatcattacaccttacctcaagaatacattatagtatctactggtttaacattatgtgaaatttaaaaataaaaaagtgccttgggtatttctccttgaagaacaatcacaggtacttagatgataatgagactttgcaaaaccaatggaagccatgcattattacatgaacagtgttagtcatctcacagtcaggttctccaagaaacgactttcctgatgaaaggatgaccactgtccacatccctccatctcttggcttgtagaagaaacactaattagaaacactaaccacattaatgataacatggttggtcaaaaataatgtccttgatacgtttaataagaaacatactgaatttaaaaacttctcttggcagaatgtgctcaacatccatggattcattaacatgctctgcaacagtctggggccagaaaaatcaacagactcctctagctaacaccaattcttcatctgattcttattcatgattccagactttaataaagttcaacaaagtattccaaactacttcctctcccttctccactgtctctgaaattcttagtctttgctctcctcaatattccattctatctagaaaccaaaaaaggactaaaattgactgcagagctcagagaatgaactat

SEQ ID NO: 64556 - DNA, 2084 bp, Bovine  19866880583228
tcgctcagtcttgtctgactctttgcagccccatggactgcagcatgctaggcttccctgtccttcaccatcttctggagtttgttcaaactcatgttgattgagttggtgacgccatccaaccatcttatcctctgtcaccctcttttcctcctgccctcaatctttcccagcatcagggtcttggggatgcagatttcaccatgtggccggaccagagtgtgcaaagcctcctacctggggaagaactggtccattttcacccctcctgcttcagcttgtgacccagcacctgggagttaagtaggggcagaagcttgtgggatgagattacagaaagtaccttgctcccttcccttacataaaagagagcagctagaacactaaggcaggtctggagtatttttggttgcaccatgggatctcagttccccaaccaccacggattgaacccaggccatggcagtgaaagtgccgaatcccaaccactagaccagcagggaactttcaagtctggaatttggatatcttgaactggacattcttatgactgcatgtgccactgcattgtcttaaaatgatcagagtgaaccgattacccaagaataagcaactaaagaaaagagaataagcaataataataccttacaatagacttttcatccagaggcaaagaaggatcatatttactgaatgcagttaaaagggaccttggagacaaaaataaagatatgtaacatttgtaaaacaatgcagttatagaaatcagtctattggtaacaaaacaagaggggcttcccaggtggtacagtggtaaagaatctgtctgcgaatgcaagaaacttgtgtttgattcctggctcaggaagatgccctggaggagaaggcaaccactccagtattcttgcctggaaaattccacagacagaggagactggagggctacaatccatggggccacaaagagttgaacatgactgagcacacacaacataatgagaacacacagaaaataaccccccaaaagccaggcttgttctgtgatggtaactcctcaccaggttagtatcatatgtcctggctatcaagcatacttctggttcagcttcctgttttccttttggaagaatccagaggtgatgtccgcgtgtgctgctttttgatctctttacattgggagagtctgatattttcaaggccacactccacagcagtctgcaagtttgaacttgccatggaaccagatatgcaggcatctaaaaggcccacgctgcaagaacagcagctaaaaatcttctctctttccgaaagtagagtccagaccatttatcacagtcagaggcaatgcatgagatgactgtaacaaacaaatgaatgagtgcccgataaatcacagtagcttgattaatcaataaagatattgattttttaaaagtgatctttcgcatcccctccccaccctccaccaagggatttgcacaggccactgaaagataaatgtgtctcccattctttggggcttgtatttgacccagtgtaataggaattgatcattatctaaatgttgttttggctagaacgttgtaatttgctgtattacaatgtctaaagtgttgcttgtacaggtaccatcctctgtgattgcatctttttatcataaagactcatgcttctgatcaggaatccccctggagttctcttttcccagttatatgttgaagaacaagaaaaccaataacggaaattttcctgacttaccagaggctacatgtgtgaagactattgtttgccagaggctggtattttctatcagaaacttacaggaatgaataggccagatcctgtggtaagatgcccagtgctttatgtttttcccaaggaaggaaagattcttcgatccccagtaggaagcatggattcttctcataccactggtactggagatcatggttatggagaacatttgcatgcttttcttggtgggaggagatgggagccagtcccccatccctggcacattccagcttctttctatctcctctctgccccacactgaggagctctcagccacttacatcagggag

SEQ ID NO: 64557 - DNA, 3567 bp, Bovine  19866880626404
tgtttataaaaaatccccgagtgcttgttacacaatttgatttctaagcctcaccccagaccttctttatttctagtgaaagcatcttggaatgcgtgtttataagcatcccaaatatttcttctgatcaggcaacttggataaatatcgcttgtgacaaatggaagtcttttaaattcccctgtccttgtaggtcagggattctagttttcatttttaagtcatagtctgattgtgctctgattcaggctttgagaagtcataagaaaggtttactatatttcttctagatagatgaggaattaaacatagtggttctcagctgggaagggtagtggatttttattccccaggcagcgtttggtgatgtctggaggcaggtagcttagtgataaaaaatccacccgccaatgtgggagacgcaggtttgagctctgggtcggaaagatcctctggaggaggaaatggcaactctctccagtattcttgcctggaaaattccgtagacagaggagcccgggctataatccatggggttgcaaacagttagacacaaatgagcatgcatggcacagaggcattttggggtgttatactggggctgtgggtgctatctgtgtgcgtgtatgtgtgtgttacgtcacttcagttgtatctgactctttttgaccccttggattgtagcccaccaggctcctctgtccatgggattctctaggcacccacaatctacagtgaacaaaacctcctcccacaaagaattgtctcattgaaaatatccatagtgctaaggtcgagactctctggttaacccttaaggtctgtctgtattaattaaattaaattaaacttaatttaactaaagtcaattaaggcttaagttggggtataatatatatcttctttgatcaccatccatattaagatgtagaacatttctccataaaagagtaggtcaagtaaaagtaaagccgaacacttgctagactttgaggtaggtccacctcaaagcctttccctggtggctcagacggtaaagtgtctgcctgtactgcgggagacctgggtttgattcctgggtcgggaagatcccctggagaaggaaatggcaatccactccaacattcttgcttggaaaatcccatggatggaggagcctggtaggctgcagtccatggggttgcaaagagtgggacacgactgagcgacttcactttcatgttaatgataatggagtcttttttctattttttttttcttactaaatcatacttcaaagattcctttaaaatggaatcagaatgtaaaagcacttatgagttggtttgactgtcaagtcatcctaaagttttgcaatttttctcatttgcctttatggctgtttcttctgtacttgatttgatagcagttttttgtttcagtgacttgcctcagtcctgtaagacattttttttttttaggaaatttttatcagtttatattgtaattacttgaatatgattacagtagcagctattgaatagctgtatagtgagtacaaacaggactggggacaaacacaacagacttaaagatttaactaggggcacggagaagcttccctgcatggaagatgggcccctaaatactagttggccggagctgtgggcacatgggacttgcatgttttacagaggcactgaaggtaagggttaagtcattaacttatttacgggaaggttgattgagaaaggtccttcagttttcagtgagtcatgggtggatggagggagagaaaaccagatatttcaatctttttgattcactacatagaaaccgtctttactttctctaacttctctaaattagacaatgaaaatttaaatttggatttttcgccagttcatattttctgaaaagaatcagaagtagattaaaaaagtaactgtatatttaattaggaaaaacaggtgttcatgtttgcatttttcctagatagtacttaattttcaaagtagaaggaatagtttgggattagatagatgaatctgacaaatgtaaaagactatatttgagtacgttttcaatgtaattatgtaaagtaccttgcagatatatttcaaaagcaaaatatatcttttaaaggtgtgtacctttaggtcaaatcgttgtaaaccctgggaaaaaggaccagggacttgcagcctcttgtcaggtcttgcttgtctgtatttggagttagccttgtaccaacatgccagattccacccataaattctattgaaaagtggtctgccaatttgaagctgcttgttgcttaataaagtctagcagcttctttctatatgttttctgtagaagctgaatacatataccaagataaaagtctgtgtttaattttgtaaatgatagtatcttttacttaaaattcttcagttaaaagttggaagcaatttttgcatgaagttttaagtccacatgaacaatgtttttgtatattgtagaagtcttataaaaacttaaaatggaatatctatgctaacattggtatcaattttaaaaactagaaagtaccatattaaataatataagtagatagtttaagctacactttggaatagtagattatatacttaatcacaattgagatttattttatgatgcacttttagaaataactgtatttcacaaaatattccttttgtttttgtttttgcattatttattgctggcaattccaagtatcagaatccccttatgatttttctttcttttttttttttgatttttttcttgttcacatcattaaatgagcatcttttaaaacagaaaaaattttttcttcctagtggaagcataggcattactatatttataattaatattgttgcaagaaaattaaataacttggtttaaatatgtctaagtggaactcaattatttggcagtagttgggcaggaaaataggaattggtgcacaatccaaatctgagttttaattgtataatttattgtgttgaaaacaaaagttatgatatatgaaatgtattgcttattagagattcttagggaatttggatttgaataaccaacaaaatcttgtagccagcttaactctaagtatgcctctctatgcttaaggatacttggaaacaaaaactggtctacctaaaaatcttatttatattattcataaagaagtgtaatatcagatttaattaattcagaagtctttcactgtgactaatttttggcagatgcattggagatgtgaataataaaacttgtgcaagctggtaagagttttaatacatttgaaaataattttcttgaaattttgctttttttaatagagaagactgtaatttactagtaccagtattttcataattctcattttatgtgttcattaaacctgtgtgtattgaattgctacttttacatcatagtggtcacagttgccattcatttcttgtgccttttgcccttgttttttcttcattggtttgtgctgtcagatttgccatcttagctctagaggtgtacttcatttaatgcaataacaagaccctaagactctgcatgtat

SEQ ID NO: 64558 - DNA, 1243 bp, Bovine  19866880697370
atgaacaactttatgtcattcttaaaattgagaaatgctctggaacttgtaatttcatactattttgcctttttctctgtttctgttatcattttttcggtacatcattcctgaatagaagccagtttagattatgtatggagttgagtgggagagctaaatttgaaggtggaagtacaaattaaaattagtcatcgtcgggggaaatattgaaatggttcttttttctggtcttttgttttcacgcagtgatattgtgcctccatacatgtaatcagttcttctttatctaatatcatttgaaaatagacgatggttaagtaaattaaatttgttatggaaagggtcagaatgtagttactactctgtcctgtttacacttttttcccctttcttttaggttatcaagtattttgttcaaatgagttaaagtagtctgtttttcttttttatgctttctacatcatcatcattttttctccaatatcaaggctttggaaatggagatatattactcttattactttaaagtaagttcttacatggagtaggaaatggcaagccacaccagtattcttgcctagaaatttccatagacagaggagcttggtgagctacggtccatggggttgcaaagaatcagacacgattaattgagcacaagttcttgtattgaacttatattgaacttcgtcactttattcttccagacctgactagaagtaactcttctatttgaaaacatcttcaacaataaaaatagagttgaagttgtatttgaggatgggtttgtatttctgtttgtttgattttaaacctcagctttccaaaacaaacggttattttgagatttatttgtttttgtttgtagtcagtgagagtcttatttggagctactctcaaattgtaaaaaaaaaaaaaaaaaagaatttctgggacttgtctggtcagcttaactaagcttgagtttaatgtaatatatatataggtcattatattgatagggatttctgacatggagaattgtaaatggaagtgagaaaaaaagttgttgaaccagtaagagaaacaaatctctaaagaatgtccagaaatctgtgggtattttgatttattaggtgagcaaaatgaagacatttgcccttttccatggaacaagtagtcatattttgtatattttggtatctagcccatgtttcactttgacttctttgccaactgcacatggatactttgtaggaaa

SEQ ID NO: 64559 - DNA, 1918 bp, Bovine  19866880763132
aagagaaaaattgataagggctgaaataaaaacagaagacaaatatttaaagtcagtctcaacaataccacaaattgatttaaccatcataaaagataaataaaattttcaaataacaatatcataaatgagaaagtaagcagagctacagatctggcacattaactattgtaaacattattagcaatttcataacaataaatttgaaagcttaaataaaatagacaaatacctagaaaatattataaaaatgtctttagaaaagtaaacctacctgaagagtcctatattgattaaagcagttaaatatctctcagagataaacatatggttttgtaggtgaattctatggaactaaaggttaaaaatgcaatttctagaaacaattccagggaaaagaaaatgaggaagtactcactgtatctttcaaagaggctaataaaactctgattttgaaaatagataagtgctgtataaatatgtgtgtatggctgagtcccttgaccacatctgaaactaccacaacattgtttgttaatcagctataccccaatacaaaattaaaagctattaaaaaaaaaaatttataggtaaatctaagccagtagtagttttaagattctaaacaaaatatgagtaaatcaaattcaaatataaataaatacatatatatatatggcaggaaccatctgagtttaaattaaaacatgaatatttgatgcaacattagaaaatattttaatataattcaccaaattaagagattaatggaagattatctcaaatgcctcaatgaatttgtttaattgttataagtcactacacatttattattttttacaaaactttaataaactaaaaataagtagcatattgtttaagggtatacctacatacagttcataatgagattggaacccgtgacaaagatgcagtagggagacccgtttctcagctctgaggaccccaagatcaccagggtgtctggcctttggatgataaaccttagaatggctactaataactaagcccttactttgtgtctgctattttacatatattatttctaatcttgacagtgatcctagaaagcatatactttaatcccctttctaaagatgtagaaactgaactccctataagttaaataatatccccaagtcacacagatgataaattacactcagaatgttaatccagttgtaactgaatccagaacctgtggacttcctaactcttccatcacattcataaacacaaaaattcttaaaaacattgaaaaatcttttgatatttggcaaaactaatacaattatgtaaagtttaaaaataaaataaaattaaaaaaaaaaaacattgaaaaatcaatatctgtaaaaacagataaccagcaataaataaaacgagagtggatctgggttaaaagcatgtttgtttgttttttagaagtcacacagcttgcttttacttttaatcaaatctagattcgattttaaattggctttcaacaagactgaactaagtcactttacaggtctattttcttttctgttctccctgaagaccaacttggacctgacatactaatcagtgtctgaggattggcagaataaattttaggtatcagaggcttgatagcctttctcacgaacttctagtaggaaaaaattctctgtgctcagcgccaccaaggtaaaagcaagagacaattggctgtgctcccgctggttgaccctcctctcccctaaagactctcctactctctcctctttgagtaaagttctatttagagccacagcaaacatcggtttctattgaatgtcttcagaaattttcaaggtaaacctaaaatttagcagacctaatgcagttgggagaaggcaatggcaccccacttcagtactcctgccggaaaacc

SEQ ID NO: 64560 - DNA, 887 bp, Bovine  19866880837433
cccacccaggctccttccctgcagcccacccaggggagtttccaggcaagagtactggagtgggtcactagtgccttctccgcaagtggaggctaatacctctctattcccaacttgttgagagtttctatcatgaatggtcttggattttgtccaatgctttttctacatcaaataacatgaccatataatttgattagttttttttttttttgtcttcagagggaaaggaaaagaatcagagtctgcattgggttctgtgtgtttcagctggaaataacagtggtttattgcagttgcagtctgaacacgttagaaagtaaatattgtagatagccctgcaaatccaaagctgtaggaggtttagaaaaagatgggttttagcagcatgtgtaacaatgatgacagcactataagtctaatgttgcatttttctaactcccttaaacatgacattgggcatgagtcaatcatatgtttcaatctttagagaaaagaaaaaggtattttgtatccaaggtcttttctattaccctgtttgtactgtagaatcacgtaatgggtaggctgtgtagaaagtaatctagatttttattgtcaactgtttataatccaagttcacattcttaggaagataagacaataagacataaaacaaatggttagcaaaaattctccacagcctgacataaaatggacttttggggtccatttgtgctggaattaggcaatgcatgctagagaaagtatcttccagatcaacttcaggtcttgaaaaagttgcatagaaaggacttcatttacattctgtgttattcatcatcgttcattcaggcaacattcactggtccttctgggcggggcttgggctgggaagtggaaagaat

SEQ ID NO: 64561 - DNA, 1300 bp, Bovine  19866880866099
atttctgttctatatctttctcatccttgcttccgtacatgtggaaattctagaatatgcgaatatactgtgggtgtggaattaccaattttagtaaataaaaatacaaggcacccagttaaatttgaatttcaaataaatagtgaatgcatatttagcataaatatgaccccaaattattaatcatttatctggaattcacatttagctaggtgtcttatatcttatctgataaccctttctgggtggggggaaaatggaaagatttagaggcccaagacccgatcagttgattttatgactgtttcattctcgtgacataaaccctggactttcaacccatagcccccacttttatcacttaacttaggtctgcttgtctgttttaccttctcccccatctcacccttgctttcctcggagtcaccaaagctgccgtggtgtatcctcctgcttctcgctgggctgtaaggagtgaagatctgctggttttcttgattgtgctttttcctgcaggtgaaggttaccatcctggctgataatgaccccagctctcaattccactaccttattgaggtctccacgggccatagaagaagggcctcgacgacagccaacgtgagtgcaatgaaggttcttccctcactgctcggcgctctctgccatgcgagctgcactccgatacccttgctgacatcctggcacccagtcatccttcacacagatcctggagggtggtcgtcctggttctcaactctccatctaggccttctctgacgacccaatggttgagactccatgcttccactgaggggacgtgggttcaatccctggtcagggaactaagatcccatatgccatggggtgcagccaaaaaccttttaaaaattgtacatttgaagagccctttctgcttgtctaagaccccaggacctcatctcagtacagttttctctgtcttcatctttccccttagacataaatcaaaagactcatgttataacttgccgtatcttatcttttctttgtcctggtttaggtagtcatcaccctttatggatcagaggggcggagcgagccccaccacctttgtgactcccagaaggcagtctttgaatgcgggggactggatgtgttcctcctgggcactccatcctctctgggggaattacacagcctgcggctctggcatgacaattctggcaccagccctgcttggtaagtacccgaatcaggctggtgtgctgcttctctgcagcattctggggaaagacctgcacggcatcacagtaaataacta

SEQ ID NO: 64562 - DNA, 1006 bp, Bovine  19866880887983
tgaagttgaaactctttctttcctcccaccttcatccctaaaactgaaactgtattccatttgacaatcttccagtaatgtgacgcacacgtgactcagagcttttcatctgccatggctacagaatgagctctacctgactgtgacaactgtaaaaatggcacttgtgaaaataacaccaaatctggagataattagtgagcacaaatagataaacttgatgatttctgtacttacctatgtgagaaaaaactcttggaaatccaacagtttttgccctagcaactgtaacgctgattccaaacacgacaaatgagtaagtaccagctcgttaaaaataatttgttattaaatttcatacccctcccacacgctactaagaatagctaagtttcacttaaagagaaagggggaaaaagaaaaaaacatgcattcgaggacactggcacacagtcccccttagaaaatgaaaccgaacagcactgctgcgggagctgaaagcggggttttgtttctctctcaaccacagcctgtttgcaaatcttcatttctacttttgtggaatatgtttgctattatataaaactgatttcacaattgagactcacacatgcatatctccagatagatggtaacccagaaacagacaattcctgaatacagaatttagtgtccatgatgcacactctttttactaaatggagttatgagcttcaattatatcaaagaattatatcaaatgcattcaattatacaaaatatatatcaatactgacacttatcaattatagcagaggctagagctgggtatcagtacctagatagggtacctagataggtaacaatgccaggttagcataggctagagctgggtatcagaacctagatagggtacatagataggtaacaatggcaggttagcataggctagagctgggtatcagtacctagatagggtacctagataggtaacaatgccaggtagcagcaataatggaaacagtgg

SEQ ID NO: 64563 - DNA, 918 bp, Bovine  19866880904015
caaaaaaggggaggaaggatgcatttaaaatgtaaggaataaaagataaataaatcaaataaaatgtaaggaatatacatttaaatgggaaaaagatgatgcgaagccaattcaagtcaacaaatataacctactttattgttcctttactcaaaataggtattaaaaggttctgggggctatcatttctatcagaatgtaatctcttacaagcttaaaaataagacagtagccttgagaggcaagaatgaaggtcaagcatcttaaaggcaggattactcttgggcaaaagtgtttagaaagctgagcgtgtccgtattcttctgccccttctttctatgtcttgtcttcacatcctttggtgttggctccttagatgccatggccagggaaccctctctccaagcgacagtttccccctcactcctctccaggacctcatgccactagggtttttcctctctcccaaactcttttccctcctctgggccctactctctgatatgtattaatgaatgtcagtcacttattaagtacctaaaaaatctgttaatgtgatggctaggtaactgataaatttattggacagcaatgttttaacccttaaagatgaatacttaacaaatgtagtcagttataggcctggctagtggaggggaatatttttgaacaaaagcagtagttttcttctgaccctttttcctaagagagacaatgacacaaatctgttcaaataaattaatgttgcctttttgacgactgccccatatggcaggaagaggtttagatgccaactgacatgccccaccaatcccttcactgtgtatgtacacaagaggcagggaatggagtaaattcaattttgtgttattcaaggggggattcattgacctatatacctgctaatttgtgtaatat

SEQ ID NO: 64564 - DNA, 1812 bp, Bovine  19866880989033
tagtataaaattatgcttccctttgtaatttttttcctgttaatatagttccaagaaacttttgagttgagtctcttagattttgcagggtggtagatgccattagtactgccatggaacgagatgagagctacgagctaccctcaggaggtggaaacacagtttaagtattggacaaaactgggcttgagtctaacctgtgaagtcttgggaatgttacttcatctccctgagtcagtcttctgatctgtaaagccagagtgacagtgtctcttttgtaaagttgtcatgagggttaaatcaagtgagcattcctatgtggtgagctcaacacagctcggcccataaaatattcatataacagtggctattattgtttagtggaagatcattgaaggtcaacttcctctttttcctggagaagcaaatgaggtacatggaagttacatgacttttttgatatcttctggataatgaatgagagagcttggactagaaatcaggtttactaacatcaatatgtggctctttccaacagacaggtgttctcagaatttgtcattgagtataatcttcacaactttttccatatccacataaaacctagatatacttttcttactatttttatttaaaggtactctttttcacctacgtcaatttgtttagaaattgtgcatcattatcctaaataaaaattcagtatcacttttcatatcataaacaaaaggtaattgtagaattcggtgccacaaaataattttattataatttagctagatattgttagaagcaagtttaatgtcaaaaagataatagcttgagagagaaggttaaggagactagagcacctcatgacatcaaggaattggggccttggtcacaggaaacaagaaagcagaaaaacgcgaagttacctgtgtgcatgaagttgcttcagtcgtgtctgactctgtaataccctatggactatagcctactgggttctgtccatgggattcttcaggcaagaatactggaatgggtttccatgcccttctccaggggatcttcccaacccagagatcgaacccatatctcttatgtctcctgatttggcaggcagattctttatcactagcaccacctgggaagccttatggtacataagtgtaagagactggccatctgtactttgggttttagaacgtatcagtatgggcgaggtagggtacaaagacagattgtggaatgagtccttaaccagagtaaaatgtcatttctctttcggaaatgtctgaaaccatcatatgctactcatcagatttcctaaaaggatcttataaaacctgcctagtttattctactttcttccttggccatccatcccacttctctcacatcctaaggtggcttgatatcagctgtttctgttcctcttatgctaatgaatggaacctgcgtttttgtagcaagaaggcaatccattttcagtgacagcttgtaatgaactgagaggcttacactatcgaatgcatttctggtgggaacaatgggagtgcaatacatacatcagtcaaatagccaagaaaggccttttgcatgctggttagggatgtaaataatgtgtctacaggcagaacagatggtgtaaggcatgttggcaagaaaccttctcaccagaggttaagcttccagagttttcttagcaatgtgtgagtaattgttctctgtctcagtcaatattttaggaaagtaattagagaagtacccacttgagaatgtactatgtttctaaaagtgggaaagaagtaaaggaaatcatccatatga

SEQ ID NO: 64565 - DNA, 1195 bp, Bovine  19866881041929
tccccggctgggaggatggttgagtgaggtccatggagaactaaatagggaaattctttctcaaggtgctgctcagctccagatggaaattacgttaacagaatataagctcagtgttgaccaaacttctgatttctcaagagaaaatggaaatttggatttttacatatgagtccacattttaaagtattagcaagtattttaaacatttaagaatcctatctgggctaaacaaaacacatctgaagtttggcttcagagatctaaggacggccacttttgatcttgcgcataaatatttgttgagtggccaagtgcagtcattagatactgtgcgctctttgtcacatttccttttgaaatagtgaggagagttagaatgatttggaaggcagaatttataagtcagattcccagtagtgatgattccgcagttgaacttgtttgaggatgaattcacattatttccatccagcagtatacctcatatagcgtagaatctctggatttttctgagcacctatgaaatgagaaggaagaaaatttgctgtttgcaattctacatttgaagtagagacttatttgttcttgtttagtcgctaaatcatatctgactcttgcgaccccatggactggagcccgccaggctcctctgtccatgggatttaccaggcaagactactggagtgggttgccatttctttctccaggggatcttcccaacacagggattgaatctgcatctcctgcattggcaggcgggttctttaccactaagccatcgggaaaccccagagaattatttagttggactttaagattatggctaaatctcctaagtattttctacagttcctgaacaaaatatggaaggtagcctggagcagaagtcctgcaaacatccctaagtaaactagcctctgctttgtctctcttgcctgtcccttttctgaaatagacttgtctgttggttgaccatgtaacttattgtttaatgcaggacaatttttatgagaaaggaggcgtcgttaaacttacaccggcataacaactataaaactgggccatttagggcaaacaggaacataaatgaccatagataaatggaaaagtttgtgtttctgccaagtcactgaaatggaggatagggtttctgtatataaaatgagatgttttgcagcatatctactcacac

SEQ ID NO: 64566 - DNA, 2335 bp, Bovine  19866881049047
ctgtttctaatgcaggtgtgccagtggcctgaaataaggccacatcttaagccccaggacaaaaccagccagaatctcttaggacattaattacacttttcagagcaatgaaattttatactcccccaaagtagagaggacgaaaatggcaatttggcagtgttccccatggtgtggactcaataccctttccctctaatcccaaatcaatgatgtgctctggctctgactgggacaggcctgaggcactgtgccaaaggaatccagaaggttctgtctttgcaaatgtgaatcagtgttaatctgaggtctgatgacctcaattttaatcttggtcttgctattactcagtttttataaagcctcacttttcttatctacaaaagaatgtaataaagtattgaaaacatgtttctactttctgatttctgtctaccttatttctcctgctctctctttaaatagactttaagctctgaatttcacagaactgaccaggctttaaaaagtaaggtaggatataagcctctccatgcccttccttcatattcattgcaacaaaactgacattgctttcatttttctctactttaagcactgcagagagctatggatacccgatacaaagaaaaggcaagcatgagaagagtaaatttaagatctgagaaaagggtatgaacaaaatattcatagaagactaaatatttatgagcagacatgggaatatgttgatgctcagtggtaatcaagggaataccaatttgtaatatcacatttcaagcatcaaaataattttaaaaaataatgccatactttatgctgatgagaagggtgagatttatattgctcgtcagagtgtacatacatacagtctcagtcgctcagtcgtttccaactctttgctactctgtggaccgagcctgctggggtcctccatccatgacatttcccagacaagagtactagagtgggttgctattttcttctccagtgcatcttcatgacccagggataaaacccacatctcctttgtttcctgcattggcaggtggattcttcccaccgaggaagcctagtcagagtataaattgtgaaaaactttatatagaaaataatttagcaatatgtaccaagagccactgggcccactgcccccacccaactccttttaggatttattctaaaaaatccattcagaaaattgaataaatatttctgtaattatgtctaaaagcaacacaaatacctaacaacagagagttcaataaagtatagtataatgatgggatgtcacatgatacgatcatttaaaatgacttattaaagagttgttaatattaacagaacaaaataattatgtagtagagtctaccggaagtatgctgtgattttaattatgtaagtatattttatatacatactttagtgtgtgagatcattctgtcatctttgagattgcatccaagtactgaattttggactatttttttgaccataatggctactccatttcttctgagggattcctgcccgcagtagtagatataatggtcatctgggttaaattcacccattccagtccatttgagttccctgattcctagaatgtcgatgttcactcttgtcatctcctgtttgaccacttccaatttgccttgattcatggacctgacattccaggttcctatgcaatattgctctttacagcattggaccttgcttctatcaccagtcacatccacaactgggtattgtttttgctttggctccatcccttcattcgttctgaagttatttctccactgatctccagtagcatattgggcacctactgacctggggagttcttctttcagtatcctatcattttgccttttcatactgttcatgggagttctcaaggcaagaatactgaagtagtttgccattcccttctctggtggaccacattctgtcagacctctccaccatgatgtgcccatcttgggtggctccacacagcatggcttagtttcattgagttaggcaagtctgtggtctgtgtgattagattgactagttttctgtgattatggtttgtgtgtctgccctctgatgcctctcacaacacctaccatcttacttgggtttctcttaccttggacatggggtatctcttcacagctgctctagcaaagtgtagccactgctccttatattaagcacctattatatgccaggagctaatgaaagcacttggatacatcaataaaaaaaagtgaaaaaactccataccttaagggagcttattgtataatgtctctttttaatgaaacagggattctggatgtctctc

SEQ ID NO: 64567 - DNA, 1198 bp, Bovine  19866881132909
acacacacacacacacacacacacacaacttctgcttgaacacaatgaagtggttacacagttctctccattggctcccaaaacctcaccaaaatgacacacagaaatataaggcattaacccacaaaaagaaagggaattcaaaaagaggcaacagtagaaggaaattttgaatcaacatttggacattcaaagtaggaagggtggtaatcaaccaaacagaatggaggagattccaactgcaggacatgcaaagggcacagtgcagaatcaaagctgtcaagttcctccagaaaaagactcagagtctgcaggcaacaggtcctttgggtagggaaggtccacatacagaaactgacagaaaatctaggcagcagttagacagtgagaaactttccatttaaaagagatcaaaggaggtgctaatgctaaagaatccccaatgaggtagacttaagagactccagttggatccctgagttggtaagatcccctggaggaggaaatggcaacccactccaggtattcttgctaaaagaatcccacaagaacactgggattctggcaggttacaatccatgtggtcgaagagtcagatacgactgagcatctgagcacaaaactgcaagaaacagataatgcagggagtaaggggaaataaaactatgatatagcatcttcagagagctaggacactagaccgcagtcataataaagcaaaacaatgcaagaaaggaacagtcagaaaataagtgttgcagagatttcactgtcagtctcttcttccttagtaatgaaacctccaaattgttggaagcagttatgtgtccatctacatttttagactcttctacagataaaggtaactaataaaaagtagaaatatttaggtgagcttccaagaaaattctgttttatgacactagcagaacttcctatgggtcttccacatgatctccttaaggcacatcataaacttgtgctccaaaatgacccacccaaatgtaattttccccccaaatgctctagttgcacgaagatttaacatcatatcagccattacaagcacagagagggtggctgtacctaaactgtataatgaaaccttacttttaaatgatttggtaataatcaagaagccagaaactcatctggagtttattaagccaagaagattcatttccttacacaaaaagga

SEQ ID NO: 64568 - DNA, 638 bp, Bovine  19866881149777
ctcctttctcgggctcgcgcgtggggtcagacctcccgttcctcgtccgcggctccgcggggtccgagggccctcgccgccctctccggcgctgcagagccgctgcggccgccgctcgccgcgggcgggcacagggaggctgggcggggaaccggctgtgggcgggcgggagggggtgacttggggcggagctgattcctaccagggtgaccggctgtcacctggaaggtcggggtccctgggcttcggcgcgatcggtacccccggagggcctgcgaaaactacttcggtggaaaataacaaaaacgaaacgcggcctcgcgggggccgctcctcctccggtcgctgcagcccagctcgctgctcctcctcctactgttcccgtccctccctcgcttcttccttccttccaggctggctgcttctttaatccggctgccaccccgcctccggacgggcgggcgggcggagaccgttgtctctgaaagcttatctgagaagtcacctctttgcctctttttccggcccgcggtccccgaccgctcctccaacccgcccctcgggcagcagtcttgcgcccagcgccggccctgccccgaccaactcgtcctctctcgggtcgccgagatctccgtttt

SEQ ID NO: 64569 - DNA, 995 bp, Bovine  19866881195029
cttcttcaccttctgtaaacctagctatcaaagaaaaacagcattcttggcccctaagaataaaagattcagataaaaatgttttctaatgagcagtatgcttagtcttacttacaggaaaggccaaaattccaatcaaccttgctaaaattgcatgcctgctaacttgagctattttgagattttttttaaagttaaaccatgtccgagttacagaagaaatatgcacagttctcttgtgcatagaaacaaagcctgatctgttcattccaccttgttatttaaattctttgaaaaattagatgaatctgataatttatgaaaccaactttgaaattatattcgatgcagcctaatgcacttgtggagtgatgtgataataatagccaccacttcttgtgtgctggtctttatgtattattgatacatatgtaattctcacaaagagacaaaagaaaaaaaattgcatgaaagtactcctacttaagatgttaatagtttgcccaaaaccactcagaatcagagccaagaatcaaaccatgtctaacaccaaagtctgagctctgtttatgaagcaatgatatttagataattgttagtgatcctaataacgtctcattttaaaaatagtagaaccattgcattttatgccataacctcagtatcttgctgtccatcaaacattgtgagaacactgaaatttgaaattattagaaacggaatttagaaaggaaaagggtactaactggatattagaggggaaaaaaatctctcttaaaaaagttccatcagccgggatgttcagatctctctgctcctcctccaaggttcagctctgcatctgggctctagaatctcccttctcaaagtgaggtcctcagaccagcagcccaggtgctcgttagaaacagacagtttcagaatctgcactttaagaagatctaggttctcatatactcattaaagtatgaaactctctgctggatgatacatat

SEQ ID NO: 64570 - DNA, 1766 bp, Bovine  19866881283927
ttagatattggagtgtaagtgaaagattagccatttattaatgattgttggagttggatgatgtgtatatttgggttcattatgccattgtcctttttatttgtgtgaaaatttccatatagatttatattttattttaaaaattatgttttaaattttataaaattataaataatttataatttaaattatatataatttataattgtattatattttaaaatcatattttaaaaattgtattaaaatttttttactttaaatttaatttaatttttattttatattggagtatagttgatttacaatgttagtttcagatgtacagcaaagtgattcaggtatgtgtgtgtgtgtgtgtgtgtatgtatatatatatatgtgtgtgtatatatatatatatctctctctctccatcctttttcagattattttcccatataggttattacataatatggtgtagagttccctgtgctgtacaataggtaagttgggttttttactatcctgataatttaccttgttttattaaaaaattataaaacattagcattttgtctataaatatatttgttcttacttcaagatgggagaccaggatacaccatagagcaatttttatcatacagctggtgtaaatcatacatactaccataattaaagtatactttcagccagataatgtgttttttatattctgattagtgatacatgaattggtaagcagcttgttccataataggcagtaaaagatgcttgttttatgctaagaaatttctaaaagttgttttacatacaaatcatttggaaaaactaatttgactaaaactatttaaaacattttaaaagaaactgaccataagactgagggatatcttaagatgaacagaataaataatctaaacattaaaactctcccaagtcatggtaaacatttgaagacaggaatcataactctaatatatgtgaaacatgaataagattataaaacaataaaataaaatgatcatcttttaaagtgccttattataaattatgtaatcattaaaacatcaaacaacaaaactgaatattgaatgaatgaatggctaaataaacaaataggtggttttttctttagccctcagtttaagagtcacacatctaattgtccagcagaaatgcacttttgaactccataaatttttttcaatttgagagtcttttaaaaaattacaggccccaaaatactacatgtacattctcccatgccagtgattgactagagctgaatgaaactaccccctttgttcgctcaagataacttttctcagcttttaccttttctttgccttcgctgctgtttttctgcttttggcttcttgctcaatgaaagctaccatgtgcttcatttgctgtttctatcagcaccgcacaggcttgtggcaaacacagaattagcctaggaaataatgggctaatttgatgggccagatgaaagaaagggcagacagaaactcaacaaaggtctcagcttccttgctttataattctggattctgcatttgctatttttgagtttctctaatgctaatttatgttattctttcgtagcttctatacttttcttaatttcttttagtttgttttgaaatattagattttacagtttcacatttggtcagcatgtctttttgaagtgtttttgtcatggtttgtgaggactttattctgcgctttctcttttttctgagaaaatgctgcataaattgtccagttttttt

SEQ ID NO: 64571 - DNA, 789 bp, Bovine  19866881341382
tgtctttgggttgtgaggtgtcaaaggatgggctgtgtgagagagacattgaaaggaaggaacagttctcttagtgagaactgaagcgtctgttacttgaaaaggacaactcgaagataacacattctgaccctggaagcccaggctaatggctagtcctgttagtgaaatagggcaatcaaaaagttgattttttttgaggctctgctagagagtctatcaaattactacttagaataactatctcctgaccaaacttatattagtaggagtcttgttttcaggcaaatgggcaaagacaaagattagtaagctacactaaatattggctattccagaagactgtaaattgtattaccatcatcattgcagagctgggattttgtttctcaaattccctagactgaatttctgcctaaataaatagccatcagatgacattatggggcaatttatcatagggtgttatagataatcaatttacaaagcatttgggaaaattttcctggaagctgttttattggctactattagtgtcacatgtcaaccatctattattttggatttgcaacggcagctagtcttttataagaaatctaatcaatttggtgcacagaggcttattattgaggtaaaattcacacaacgaagattcttttattccaataagactacaccatggtttttaggttccatttagtgtagcaatatatagttacaattgtacataagcagggagagtgatttttgatcgataaactatgatggtttaatttaagagtatgttag

SEQ ID NO: 64572 - DNA, 971 bp, Bovine  19866881362571
cagttttgcaggaaggagaaacaggggtttatgagagtaagatttgatgtgtttactgaagtctccaaggcaatcaagggcaagaaggcagaaaattctgactgaagtgaatgcttttgaaaggaaggaagaatggatgccagtgtttagataaaagggaaggccttcaagtagatttcttttttttttttttcttattgtcataattcatacttagcttcctagtcaatacttgatctgctaaaccaaatgcacctaaaagtaaatgattagccctaataaaaattagtcactatgtaattactgaaaatacatgttcataacagtaaaggaagctacaaagttcttttaaaactctgtctatgctgagaaaatgtttgtttctttcagggtttcattttttcaaattgctaacaggcttgctagatttttgtggaacttttcatcaacaaagcaaggtttcaaatgattttgtgaacttctatagtttgctagaggatatatttctgattctgatttttttttctttttctgcttccaaattacattttcatccacattgtgtcactctgcagtttttcccccaaagcatgtgatgcatgaaccatttgtaaatatttattgaatagcttatgatcaacaaagaccgacaaataatcaatggccagttaaaagaaacacactgaaggcattttgaatgtatgtttattctgagagaatcacttggctttgggggaatacaaagtatatgaaatgtagattctacctctagatatggtctggaaaatagaaagcacccatgaaagtggtattgaaaatcatcatggaaattcaaagttggaagaacaccaccctgatgaggttttagaaaagtactctgaaaaggaggccattgaacttgaacttcttagaaagatgtggaaccagaggctaaggccatcgtgggccaagggtacatgtgaaagcacaag

SEQ ID NO: 64573 - DNA, 1012 bp, Bovine  19866881425961
aacacactagcagttttcactgcatgaagaattagaatttgaaaatgaagatggaagcagggagggtgtggggacagagaaatttagcacatgggggttcgcagtcaggaactgaaggaggcagatgtcagaatctagcctggccttgggtagtcaaggaaacagggatcataccctgtactctcgctcccattctgaaatcccctctactcactttgctgatggcaaaatcatatcctaatataccttcccatccaggttgccagaagtcaagagagaaacatagatttatgattttaaacttctgatgagaccttcaaacaaatgccttattccttctaagaggcttcctaatcctaaaattttcaatctgttgcttataagtaaaaaatttggaggcacagaatttaaaattccgcaatggagatgcaattgacatgtcctacctcttcctagtgtgattttcttcacaacatcttcacaggtgaagacaccgaggctcaatgacttaaattcaacttaaaaacccaatatatacagcactttgctttctaaagagaaaatgatagaacaacatttgttgaggtaaattgaactgtacatatataacagagtttgaaataaaaatcaatacagtagcatttgtttaacaagaatttatcaataaccacattaagatactagaagtttccactgcataaagaattagaatttgaaaatgaaggtggaagtagggagggtatggagaaaaaagaaatttagcacgtgggggtttgtagacttgaaagattttgaagaaacacacgaagaaaaaatacttttaaattatgttgactataatgttctcctctgtccgtgtgtgtatatatatatgtgaatatgtttatatttgaatatatttaaatatatttaaggacttatatagatacagacatataattttaataatgatgtaggattataaaaagaatttctagaatactaccttaatgaaaaaaaattccacattttt

SEQ ID NO: 64574 - DNA, 826 bp, Bovine  19866881437361
gggttctgcctcctggttgcaggtacccctctgggtctgctcctgcagcagacgaagttttcacaggccccccttctgcagcactagctggccaccagtacatggtgccttccaagcatggtcttccccccactccctaggagcgcttctctgtggatggccactggcttggcactttcccataagagtcttccctgaaacccccttggggagctttgcagagagctcgcccaggaagcctcagctatgccttctccaacgaagttggatttcagttctgagatgaggaggtaatggctgcaacagcttttcctgatttgttccttccctggtgctctcccttagccttcagtgggtgccccctatatctgcccttcttttattctcaacagttctttttaccctttactagtcaattcccattactctaattccctgttccagttaataaatgtctatattgcaagcatgcatgctcagtcccttcagacatgtctgactctttttgatcccatggaccatagcccaccaggttcctctgtccttggggcaagaatactggagtggtttgccatgccctcctccagggtatcttctggacccggggatcgaactgatgtctgcctgtgtctcctgcgtggcaggaagattctttactcactgagtcacctgggaagccccaaatgtttgtattacatggtccctattcaaattacttgtggtttgtgtctcctgactggaccctgatggatacactattcaataaatggtagctagggacttatcagttttgtgtgatctggagtttctataacatgggattccc

SEQ ID NO: 64575 - DNA, 1663 bp, Bovine  19866881561372
acaacaggaatactattcagccaaaaagaatgagattttcccatccgcaacagcatggatggacctagaaggtactatgtttagtgaaatgttggacagagaaaaacaaatactctatgttataacttatatgtggaatttaaaaaaataaaggaatgaatataacaaaacagaaatagattcacaagacaaactagtggttatcagtggggagtaggagagggaagggaggaggggcgggataggaataaggtattaaaagatacaaactatcatgtataaaataaataagctctaaggatatactgtacagcacatgaaatatgacaactattttaggataactttaaatggagtgtaatctctgatttcaaatcatgttgtacacctaaaacatgcatgcatgctcagttgctcagttgtgtacgactctttgcaacaccatggactgtagcccaccaggctcctctgtccatgggatttcccaggcaagagaactagagtagggtgccatttccaactccagggcatcttcccaactcaaggatcaaactcatgtttcttgcatctcctgcattggcaggatctttaccactgagccacttgagaagctccatacacttaaaacatactgtaaatcaaatataacaataaaaaacattaagattttttaaagttagtgttcaacctagaaaactttgagaaactacataaattcttgctaatatgtcattaagaactaagaaattatataggagaaacccagcaaggcaacaggcagaacactgcttaggaatatttaaaatatttaagatgatatacaagacaaatgtgagtacaaaatgcaaacagtataacaaaaaaaacagaacacttggtggttgttattggcatgacaaagcatcatctctatatactatccatttatagaactgtttccgattttttcttcatccttactgccaacatttcattcaggccctcttcaacatacatgggtagtacatttaatagacaggtccaaaatgacttttagtctattttttttctaatctcgtgcttcccaaacttattatgactcactcagggatcttaaaacactggttctgattcagtctcacaagttccccagataacattgatgtaaccacactttgaataacaaagatttcatgtactcaacaaacctattacttcaaaaaaaaaagggtcttttttttggttgtgtctggtctgagttgcagcaggcaggatcttttaccgcagcccaccagcttctaatcatggcacgcaggctcgggagttgggcacctgggtttagctgccttgtgccatgtgggatcatagttccctgaacagggattgaacccgtgtctcctccattgcaaggtggattcttaaccactggaccaccagagaagcccctattacttttctaagttgtaccatttatttaacgtatgtattgcaaaatcactactaccatagtgttagctaacacctgcatcaagttacttaacatttcctttaaaattaattttaattggtgtatagttggtttacaatgttgtattggctttgctgtacagcaaagtgaaccaattatacgcatacgtatatccttttttagccctttttttggctgcgctgtgcagcatccaag

SEQ ID NO: 64576 - DNA, 1188 bp, Bovine  19866881639695
cagtggcaggaagatttttttaccctgagccacctgggaagcccttggtgtagtgggttacagatccacaactcactcatttcacagatgaagtgaatggggccagaaagattgaccaaggtttctgaaagccacacagttggtgagtggcagagctaacttgttgtgctggccaccagttcaatgagataagattcattttaggcttgctctttgttttaacttgcatttatctttactagtttcaagggaaaatgattccattaaataatgactaaatccttctcttttaatatgttgagctgggtgtggcttcttgatgttttaacagacatgaaaattttatttaataattttgtctctccccttaggcaactctctgcctaggtcctttgaaattacaaaactaaattaccagcgggctcaagtccagcaagcatgatttagtttacaattctgatcttcgtacaacctgttcctgctgcataggccatttgagactttgttcataaaaaaattttctttcaaaacttgagcatcactgaactgtttaaaagattctgctttttaatgtaaaggctttacttagaaccagaatttgatcatatttattgtatgttttttctttgtcttcaacgaaatatagtcccttttgtttttaagtggtttctttctaaatacttggatgggttttgaggtgtgtgtggcttcatctgtttttatcactctgtacatatttgtcaactggatgaatgctattatgtttttataaaatatgtgaagaattgttttggctgtcagttcaatgcgtttacttccaatttaacttattttttttttttataacattcagaagcaaattgaatttgtgggaagactcctaatgaattagttttcctttttgaagtaagatttacttctgtaggggcttccctgtgtgactcagatggtaaagaatctgcctgcaatgcaggagacccgggttcaatccctgggttgggatgctcccctggagaagggaatggctacccactccagtattcttgtctggggaattccaaggatagaggatcctggcaggctacagttcatagggtcacaaagagttggacacaactgagcaactaacaccctttccccccaaatcatttgttcttttctgcttcttctgaggatcagttttagaac

SEQ ID NO: 64577 - DNA, 841 bp, Bovine  19866881748261
acagatgggaagacgctctatggtaatggtaactcagggtcaatgatggcacctgcctctgtcctcatagagtgggaatggggatttcatttattggctggcattaatgaccatgaaaagagttgagaagtggattctgacatgaacagactacaaattcaaggctggagctttgtttttggcaagaggaacagatttggaagaacccacaggcctaacagagctaatagagaaagcatgctgttgatccaatgattctccggcaggaaccaaatctgccttggccagtggcacattgaaggagccaacacaccattaggcagaggctcaagtaagcaggtggtttctgtcaatggatggcctacaagtggacaaaacagagtgcggggggaggaaaagaagatgataggggcacaaaaggtagaggtttaaggcagtctctatggatgtcttacggcaaaaggaggcagaaattgggagttcggcaattctcccatcctaagacaactgaatggaggcagtattccaactgagaggaaaagaagttctaagctcaatcaccaagactaagcaaaatctacttacagaatgcaataaagggccatagcaaaacaccagcaattcttaaagaccacttactcgggattcttcaaatccctgctgaagagtagtacctggtcttttgtgggtgagtggttaagaaggttgctggaatttagccccgtgaattctaggggattctgtaacagaaaagcagacagaaggtgtaggtgaaaggactgtgcgggattgggaaagaatgggtcctgatgaacctcattgccatcatttaaaattagga

SEQ ID NO: 64578 - DNA, 2513 bp, Bovine  19866880173264
gaccaaccaatgtttgttttttatttttttcccccctgcttctttaagatcaacagaccacacagtagagttgcatgtaaaagcagaaatttagatgttgtatcagccatgcaaatgttcatgggatattaagaacaatttaaagcattaaaaaaatattgaaacaattctccaaagcatcttttatacaaagaccatacatttccatttgataggcccacagtttatctaagaggaagcctctgacaaatcttattttcagaaaatatcaaacattgcattcagttttgctcattgactagtctctgacctttttatgctcttagcaaatggctagagtctccaccattttcaacatgactggttacatctgcgtctaggaaaactacaggaggcataatggcctagagcttttcaaaattttgttttcttttaagcatcagagggcttcccaagtggccctagtggtaaagaacccacttgccagtgcaggagacatgaaatgcgggttcaatccctgggttgggaagatgccctggaggaggacatggcaacccactccagtattcttgcctggagaatcccatggacagaggagcctggcaggctacagtccataggatcgcaaggagtcagacacaactgaatcgacttagcacacgtgtaagaatcagaagtgtttattcaaataaaatcttttctgaagcccattatttagagagaataaagaagctaggttgctctggttggagtaattgagggaggagcccctgagtcccttaactcctgacaattctctacacactcctcccctcaactcttaagtgtaactttgaggctcctccacattgtagaaactcaagaagggcttgtagttctcctgctaacactctattgcactgtggtcttgggtaagtcatttctcacctttatcaagtaaagaggttggcatagatatgttctaatttcctttaatcccatgattttagagtaagaatattactgtatttttaagaatattgttaaagcattcttcaatctcttttctgaagataacctaaggcatcatgatacaaactcaatattaacatgaattttttaactaaataaaggcaatgctatgaataattgccagatgaatgactaaccatctccttctatttatatctccaactacaatttcatttggagtctcatcaacaaacattctttgcataaatcgtgtctgcggttggtgacaagggctcttccttccaataaactcagaatgaatactgactgtacttaaataaagttactgctgttgatgtcatcctgattacactttaacgtgtatgttcatgtttcactcagggctgatttcaggcttgattccaatgtacattggtgaaattgctccaaccacactcaggggcgctatcggtgctcttcatcagctggccattgtcacgggcattcttattagtcaggtaaaaactcccatcccctccctcacccatcctctactttacccagcttctctccccctgactggccactcttactgtaaaacaacacagaggaaaagacagttccacaagtggtcttggaggtggcagtacagagacataggctttttagtagctcaaagttaaaatattactaatccacgcctcacttttcccctggaagctgtggtggagttggcactgaaggtgacctggtaagccaagtcttaactactggagctattccagaattacattattccatttagatttcaagggaaaaaaatttcaaaattttggctgcctgggtttccttttttctgagcatctttcctgctcagatttaaaatgcaaaggattgcagtagcagttcttgttcagttaccttattctttccttctctcctgtgttctcagagggagtcctcagaacctcaaacttatgactatccagaggataaactactttgcaatagggatcacaaaactagttctctcagagtaattgctttatttatgtaatccattctatttaagttctgggtaatcgtccaaagttatgcattatttttgctgttgttttagatatcaaatgtgtgcttaaaagtttggttgatttctatcctaaatgtcccataggagttaatgaaaacaaatctagctgaactctttgtaaaacagagtccctaattcatttaaggagagacatactagtaataatttccatcttaagcatacttgtgcatacttgaatcaaagtcaggagttactatcaaatagccaatgtgcttttccaacaaattgtttcagaaggcagctccaaagtgatatgtagttgatatgcttcctccctgccttttcagatcgttggccttgactttatcctgggcaatcacgagctatggcacatcctgcttggcctgtctgctgtgccagccattctccaatgtctgctgctcttcttctgtccagaaagccccagatacctttacatcaagctggatgaggaagccaaggcaaagaaaag

SEQ ID NO: 64579 - DNA, 2320 bp, Bovine  19866880356277
tggtgggtgtagagatctgaagagaagctggaaaataaacaatatccttacagtatcagagcagattttatggggtaacagatgctgtttggtgctgtcgttcatcaaactcccctcacatgtttcatgagtacactcctttttaggatcagctgaaatagcaaatggcctctgttgagactataaaaaggaacattaggggtacgtgttttattcttcattgtgttcataagaggacagtctcttgctagtcaaagagaaagagagactggaaatgaaggttatgactatttgtacagatcctaaaatatggaatgctatgaaaagccttaggaaggggtcagtctgtaaataagacagaaccgtactaagatcattcatctctggagggcaaagaagctagcgcattctgagtggagttgccagttgcagaagctctgaatgagccatttttgtccagcagcttgtcaggttcacgctgagctggtgttgtgagcaggactgagcacacctggtgtggactgtgaccagggagcgaaaggaatgtgaggctggattgccagcctgaactttaccagtcctcctctccaagcgataataagcctccagttatcagggcttcttgctcctttgaaccctgccttctaggctgtgttcatgagataagtcgtttagaattttagtttctgtacatcaagcatcatttcaactttaagtctttttccctctatcaacccaaaagaaagagaattgtctttctgtagtcaaataaaaagcagtcctttgttccctctgaaatactaattcaatgacattaaggctccaaaataactgataaattgtcatgcatgcatgctcagttgcttcagttgtgtccagctctttgcgaccccatgaactagagcctgccagtctcctctgtccatgggattctccaggcaagaatactggaatgggttgccatgccctccaacaggggatcttcccgaccgagggatcaaacccaagtcccctgcattgcaggtgcattctttacctgctgagccaccagggaagcccaataaatggtcagtggcttgcaaaacatgtgcttttcccttggaacttcttaaacattgtattttgtccaaagaaaggagatcttgtgaatacagctaacatttttctgcttacagagaaggtagggaggaaatgaacttagcggtaataattatttacctgcaatgaaaatcaaaagcattgcgggagaggggggatggagaatccctatctctgccatgtagaacaatcctgcttctttctattacatatctctaagtgaccagcacttaaagatgtgacacagactctgcagctctagattgaattgcattttgaaacgtttcgggatttggtgtatttattgtgctagagatggctttagttcacctctgttgtataataaaacatgccaagatgtggtggcttgaaacagtaactatttatgatttctcaccattctatggcttgacttcaacattgtcctgctggtctcacctgagctggcttacgcagctgcactgcagtgatgggtcagctgtaccttcttggggtttttcatccccagcttcttgactgtttggggattgcaggacagcctctcaagagggaaaagcccagtgcacaattggaggagaattgctttacaatgttgtgttagtttctgctgtgcaacagtatgaatcggctatatgtgtacatatgtcacctccctccctcccctgtccgtcatcacagaccacggagcagcttctcgctggctatgtgttttacacatggtagtgtctatattttagtgctactccttatttcagcctacccttccttcttccctcccccatgtccacatgacatgtccatcctctacatctgcatctctattcctaccctgaaatagtttcacctgcaccatttctctagattgcatacatacatgttaatatacaatattttttttctctttttgacttagttcactttgtataacagactctaggtccatccacatcggtacagatgatccaattttgttcctgtttatagctgagtcatattcccttgtatatatgtaccatatcttctttacctgttcatctgttgatggacatttaggttgcttccatgtcccggctgttgcaaatacagcacttttgaagcttttgtttccatcatctttgctaatgatgtgattcaccagtggtgaggggtggggggattactgtgataagacagagattgtcctattttctattggttctaataaagtccttatagatttttt

SEQ ID NO: 64580 - DNA, 1357 bp, Bovine  19866880375476
ctacagactctactgcttgcccattctgtagttatctgtttattgtctatttatttccacgccccacccctgcacctgctgacactaaaatgcaaactcagcataagcacagacttgcccattttgttcaaaggtatccccagagcagttcctggcaatgtcacagaagctccataaatatttgttgaatgaaaattagagatgtagatatctgtggagctttactgatgcctctaggattcactctactggttaaagcacttaagttggggactgaggtattagggctctgatgggtggtcttcagctaaaataaaaaaacatcagagctaagtaagccaggcacatcatgatttatagaccaccagatgcttcctggcagatccatttccttcctattatcataagcaatggagaacacctattgcttggagtgtgaatgaccaaaggctgttctttcagacgctgtgagcctttggatgggtaggagttcttaggaaacactagttagatgcatttaaggcaaagcaactgggagccctgttctctgggccccaccccttaatattcatttccagataagtgaatgtctcagtttgactggtagcaaagcacttttaagtttctgcagtaacatgaacagaaaagtatctgctcaaaaagagctttgagatcccagaatagagaacagatgaccccaaagcagacaaaatagagaacagataaccaagatcagacaaagggggatacagatgtgggagagtcaattaattgaagtggaaaatcccacttggggtttggtttcaactgcaaaacaccttgcttgttccattcgctgtaattctccatcccacccccacaagtgctgcagagaacttgcattttatccaaagtaaatattccaatagatgaaatccaagaagaccacatgagcactacagagctgagttctaatgggtttctcccatgccgggatctgacattttgtgatggaggaggagagttgagaaggtggaactgtatttttgaaataagcagtattctgtctctctaaattgatttttaatgtatctacacctccaacccagttgtgttaggctgaaaaataaaaattttcttttcaaatagtctccccctccaccacctgatataggaattgaggcctttttctagctggttgtatcctttttctactctatttgcacaattggatatgcaccttacccctgtcaataacctgcaagattttcatgttttttccttaaacttgatggacacctgagggagattgggtgactctgatgctctccctctcaagaaagtcatgtctaagccagaggggtcacccaaatcaaag

SEQ ID NO: 64581 - DNA, 856 bp, Bovine  19866880434940
ctgagtattattttatttgcctaatgtctttagaaactgctgtgttttttttaaactatagcaattcagtaaaataggagcttctatataagaaaataggctgaagagcccatgctttttcttgcagtctggttttatctgatacctgctgggcacagtatgccactgcctgaaagtagcccctaccctaaggaggagccagaatctcaccctttcccctagagcccttcctttcttgttttcagaaaatctgtcaaaacacttcaagcaaaaggcaaggtttcattttcctgataagtacgtggggcaataatgaaagcttgctcatttaataataagcattcaaaagacttggaattaataaagctgttcaaaattcctaggctgtttaaattgttatttttttaacttgaatttcatttcagttagatgggatttgccgagtgttttatagtcctatgtatttattgctttgacagaactactcactgacggacgttctctgtgggcaggagcccatttgtagttgaataaagactggcacagctgcccacaggaatactacacagctatctgaacaatgagatagtgtatatgttgaagttgggcagattccaagatacagtgtgaggtacacaaagcagcttacagtacgcatagtagagtctggttcgcccctacctgatggatggatggatgtggatggagaaattaaacttctttttttaaactttttatattgaagtataactgattgacagtgctgtgatagtttcaggtgggcggcaaagggactcagccatacatacacatgtatccgttctctcccaagactcccctcctgtccagcatgcca

SEQ ID NO: 64582 - DNA, 1465 bp, Bovine  19866880440378
ctctcgctctctctctctctctctctctctctctctctctcacacacacacactcactctaagtttgatttctccctacaaatgtccatgagtctgtgggccttgtaatgacctgtgtttgtgattttcatgtccacagcttatgcttgcaaatgactgcattttatgtgtctgtgtgtacctggcacactgtgtgctttgtacatttttagggaatgaattttagatgagaccttacattcaggcacagtgctgactcttttaagtaggactcaagcatgttagtctaggcaggactcagccatgttggtcttttgggggccaccattagggacttacctcatggatgatggaagaagcctttgattttaagataaaagaacaattggtagttatcaactggcagctgaaacctacctctaaaaagtatgcctggtggccaagaagctgactctcacaggaatccagccatgaccaccaaagatgtaataagtctctaacactaagtccttgattaaagagactgaaagaattcttgtgcctgacagcttgcttctctcacatgctaggaaaacccaaggactcaaaaatggaaaagaataacccagtggattactgtataggaagagcagaaaggggacttccctggtggtccagtggctaagactctgtgctcccaatgcaggggaccccgggttcgatccctggtcagggaactagatcccacatgctgcaactaagagtttgcatgccaaaactaaaatcccacccctgcatgccacaactgaagatcgtgtgtcctgcaactacgacctggtgcagccaacaaacaaaaagtagacgggaaacaaaccacctgcctaaccacatggccaaagaccaagaatctgcagaaacggaggccaagcctgaaaagtggtggccacaactgaagagcactcacttctagtgctttttagccaggcactctttatcatatggtagaatcactgttctgaactctgttgttgcctattcattgccctcaccctttacctcacgctctttgagagatctggtcaagatcaagtgcactcctgatgagccttgcacattttcttatcctccttaactacagccccaaaagtgttcatctgtggggcagggttgattgtcttgaaccatggaagaacacgaaaacctagggaaatgtcatgccctcccaccttctcctcctccctaaaacacataaacattttactgggaacaataatttccaggaggggaaggatgtgctgatttgtcagggatggggtaaagagggtaactagagtacagaggctcccagaattaatagcatttttctcctatgagttctgtggagctaaattgacatgcacttcagaaaacaagagagttgcactcggctcacaatggcggctgcaccatctggttcccaatgagttgtttttagctaaatgttccg

SEQ ID NO: 64583 - DNA, 3546 bp, Bovine  19866880498400
gtagctgacaaaattttctagtgacaatagtctcatgtatttatatttaatttgctattaaaatgaagtaaatatttttgaaaggagaaaaacagataaatgaaaggtgggggcagtgtctagacttgtacaggtattgggtagcttttcagctggtacctgagactcccagtgtgagtcactgaactgctattaaggtcactatatcagtccaaagggggcttccctgggggctcagcagtaaagaacccacctgccaatgcaggagatataagagtgatataaggaaatataagatttaatccttgggtcaggaagatcctctggagaaggaaatggcaacccactccagtattgttgcctgggaaatctcatggacagagaagtctggcaggctacagtctgtggggtcacaaagagtcggacatgacttagtgactaaacaacaacaatctgtccaagaagtcaaggtagtcacagccccaatgaccagggttacttcctcttccctgcacctgggggccataggttttcctttgggagggggtcaagaggtgccccaaggagagagagagagagattttgaggaattgtctcgtgtggttgtggatgcttggtgagtccagaatatgatgggggaggccggcaagctgggaagtcaggaaggagttagagtccaaagcctgagaaatccctcttgctcaggagatgtcaggtttttgttctatcagactttcaacggattggatgagacccatccacattctggaaggcaacccactttatttagtgtctactgattttaatacaaatctcatccaaacccatcacagaaatatccagattaatgtttaatcaaacgtctgggcactgtggcctgccaagttgagacatcacattaatcatcatagcatgtaaactttgaggaccttaagaagattgtcctgtgctgagactaagagggaaggacatggggcaggttgcttgtgccagttctatctatggcagccagtaaattagcctatatcctttattccttttctttcttttaaacttgcccattactgagtcaattcaatgactaatctttaggtgggttaggaggaactggtgcttgcctggtggctcagatggtaaagaatcaatgcaggaggcctgggttcgatccctgagtcgggaagatcccctggagaaggaaatggcaacccactctagtattcatgcctggagaagcccatggacagaagaatctggtgggctacagtccatagggtccttgagtcagacacagctaacacacacacaaaaggataagtagattctcctggctagctccatgatcatctagcaacactcagacactctcagatgataaacccaaatgcgcacagaggcctggggacctcttgaccccttcccaaaggcaaacctgtggcccccaggtgcagggaagaggaagtatccatggtcactggggctgtgactctctcgacttcttggccagattactgttggtctttaattgcaaagtcatgtccgactctttcaaagtgagtgcccctgctttttcttcctaagcacctgtttagtttctttcatggaaagtaaaccccacatgagcagataatgttttgttcgttgttgtgactagtgcctacaaagatgttcagtaaatactgcatttattgaatgttaaatcgataaatgtccccatgccagcctcagactattgcaagaaagtaactctttttgaacttctttcatttgttaaacattgagtgcctactatgtatcaggcactctcaagccgctgcagataacaagaagggcaaggtctcctccacattcatggaacttaaatgtggtgaggaaagtggaccatgatagactgtagcctatcaccttcctctgtccatgggcttttccaggcaagagtactggagtgggttgccatttccttctccagaggatcttcccaacccagggattgaacctgagtctcctgcattgtaggcagacacttaatcatctgagccacccaggggaagtccaagtaataaaatagtaacaagtaataagtttaaataacaaaataatttcaatatttgatattttaataattagatattttgactagacatttcaatttattaaatgtttaatttttaataaataatggcaaatcagatttcaagcatagatccatgaagaaaataaagcaaagtaacaggcctgagagtgagtggggggtaggttgtgcccaccttaagaagcctgcttggcgagcctcggtgagccctcaagggaatgtaaaggagccaagacaagcctggggtggagtgctgtatgcagagccacatcaagtgcagaggtgctgagactggaacatgttaatcaagtctgaggacagggtggctaagcccagagaaggagagcgtaaaaggctaggtcagtgtcagggaaggctatatcaactcagcctctcaggctgtgctgaccaacgtgggtttccttctaagggtgacagggaagtctttggagacttttaagcaaggggtattactttctggtgcatgaggcataagagctgtgggtttgatcctggatcaggaagagatccctggagaagggcatggcgactcactccagaaatcttgcctggagaatcccatggacagaggagtccacggggccacaaagagtcagacaccactgaagcgatttagcatgcatgcattactgtctggtttactttttaaatcaccattggcttctctgtcaaaaagaggctgtaggatgagactgggggcagggaaggcaggctgggcagtcacattcaggagagatactggtgggatggatcagagtgggatctgtggagagggtgagaagaggcaggctacaataaggacaaacttgactcaaaaatattaaaatacactggccttcttcagaatctaggacttcccaatattcttcccgcactcctgggttggcccagtttgaactcacttttttggttccccagagatgcctttgcacttctccatacctgatcctatcagagagggaggcagcatgctaaaggagtgagttgtcttttttccatttatagaaataaactctcatttcactcaaagtaaagatattatggggtttcccaggtggctcagcctgtaaagaacccgcctgccaatgcaaaagaagcagaagtgagttcgatccctgggtggggaagatcctctggagaagggaatggctacccactccagtattcttgcctgaagaatccccatggacagaggagcctgacaagctacagtccatggggtcacaaagagtcagacgtgactgagcaactgggcaggcaaagataatacagaataaaggaggagaagctcttttccacccttggaaaactctctccagttagagccactagtgctctatgagccactatgaagattaaattattcaagaagtaatcagaatatgacttgaagtgtttaaaaagtgaatcctaaaaaacaaacaaataaacaaagc

SEQ ID NO: 64584 - DNA, 2092 bp, Bovine  19866880529171
tggctttgatccctaggttgagaagatcccctggaggagggcatggcaacccactccagtattcttgcctggagaatccctatggacagaggagcctggtgggctacagtccatggggttgcaaagagtccgacatgactgagtggctaagcacagcaaagcacataagcaggcaaaaaataaaaaaacttttttttttttttttgagttctctgatacttgaagatgataaggtagctttgttaagatgaactgaaccaatgaccattaatatatccacattaaacactgccataaaacacaacaaagatacaaaagaaggttctgggacttctctggtgggccagtagttaagactccacgctctcaatgcagtggcagggtttgatcctgcatgctgtagaatgtagccagaagcaagccaaacaaatgaaggtctttagggaagaggcaaacagttacgatttccaaattatggaccaaggacttcagcagggctgggggtccagtagagggtccagcacccaagtgtatactgagcattgtttgcagactaaatgactcacatgcacaaggaattttttcaaatgatgtggctgataaaatgcagttatatttagaagcgttagtggactttttgtgctttttagcttcttaggtgattatgacgggaagtcatcatatttaaaatgattgggaaactcaggcttataaggtgactgggatccagttagctgatggagtggcttctgtcttacagcatgtccactctgtactggtactttggcctgtagaagtgctttgaattctgcccaagattaaccaattacctggataaagccagcaacagaaatctaaatatggacaccaggcgggccatctgctttgagcctgatgctggatgatgctcctccctctttcttccccttctatatttatcccatcaatttttgagatgggcagtacattcctatactaagaaaaaaaaaatgatctggactttcataagttctctagagtagttactgggcttccctggtggctcagtggtgaagaatttgcctgccaagcagaagatgcaggttcgatcctggggtcaggaagatcccttggaggaaggcatgacaacccactccagtattcttgcctgggaaatcctatggacagaggagcttggcaggttagagtccacggggtcacaaagagtcagacaggacctcgtgactaaaccacaacaatggacaattcttaccacattcaaaaaatttccactaagcagggaaatttcaaaaacaaaactaaagcgttccctatgctaccccaaatcttgtggggaccaacaaaaaggctgccaattactaactttaccaaactagaacatgcaatgaaatgaattatacatattatcatcagactctcaaatacatcttcttcattatatgagagcatgccacctgcaaaaagactgtctttagatgagctttatggaaaagtcactctgttagcttttgtcttggaccggtgataactttggcctgtcagattgatgggcctccaattattaatggctgtcctagtgaggaggaaggatgagaagaggggaaagcatcagattatcctgaaggctatactatttctttctgctccagtgatgcctcctagccctaaattcctcaatcttaactggcatctcttttgcaaaaggagtttagtaatacaggataacctgagatcctgcagcatgggcacagggctagaacattctgtcagaccataatgccgctggtccgtgtcgtcctgacgtcatctggtagagtaactttgaactttggaatctaagatgactattttttggctggaggtgacccttttaaaattgttgttgtcatggaacatgaacttagttgcttacagaaatataaaagcacatattcaagcggatgctattcaattttaaagaaaaccaacactctaaaatattgtcacataaattattgagaacttattttagaatcatttatggtgtcttttacaactgcaatttgtgatgcttagatcatctgcaatgactgatgcctcaggcattacttag

SEQ ID NO: 64585 - DNA, 2222 bp, Bovine  19866880624752
atgtgcccacagtgtgagcatatgtgaaaggtgagaggaccaggaaccactgcatgaatatgagcggggtgaagcttggcgaagtctcaagggggatttaccgagagagccaagaaaagggtgggtgtcacaggaaaggaataaaggcagattgtgctggctttacagccatgcctcaggctcctctcaagaacactattctaggcagtagagcagcttcatgtaatgaatgctggttccactttataaaagaaaagtaatttcattactagagcaacagtgatttaattactatctcagagcttctacttctacactgtctactgtggtatgcctacttgctcactagtttatatttacaaggtacagctcttaggttttacagggaccccagacacagaagaataaagcctgtaagagtcagtcttgggacccttcataaatttgcaggtgtaaacctcctggtgggaaccgaaaatggcctgatgcttttggaccgaagtgggcaaggcaaagtttataatctgatcaaccggaggcgatttcagcagatggatgtgctcgagggactgaatgtcctcgtgacaatatcaggtatgttgtgagatgaccaggtctgcacgggtgggaaaggtgatcgcctcacttctgaaggaatagtaagctctgctcgtcccaccagcaggtggcatggtgaattatgacagcgcagcgagtgacatcacccatattttctaactctggagattctgaccttccaagggaagtctctcacctctgcccaaaatctgaatcagacagagacgtgatagctctgtgcttatggggctttacctctactgggactcagcaaggatctttttaaggtgtctgcactccagtcaccactgtctgttctcagaaggagaatataaaaatgtaggcttctgggagtgagaaattttgtaagcagaaatttctctggtctcttttcttgtaagaactgctttagcttatagttcatggatgctttagtgagtgctgctggcccataggtgattgcgtctgcgaggagatttgaatataggaatcattattgctacactctgcagctttctggttcacaaaaagagccttaaaaaagatggagacagggacttccctggtgctccaaggttaagaattcatcttgcaaaaaaaaaaaaagaattcatcctgcattaatgtagaacagtccgtaaaaatactgaatctctatgctgtgcacctgaagccaatataagattgtaaatcaactatattttaatacaaataatacaattaatcaatgtggaaaaacaaatagaaaaaagaattcatcttgcattgcaggaaatttaggtttcaatccctggtcagggaactaagatcccatatgctgtggagcaactaagcccacgcactacaactactgagcccatgtgctgcaagtactgagcccacgtgctgcaagtactgagcccacatgccgcaactagagagtccgtgccccacaaccaaagatcccgcatgatgtgactaaaacccgacgcggcaagtaaataaataaaaaatatggagacaatagtgaaggccttactactcacaggttaaaaatgtaacctgaaagactctgtctgttgaaagttttcccttacagatggtgtttgaaggaatttgataaataatgcccctcttgccccctcccatcccttccggtatgaagccaactgtacccctgcacgttagaaccccctgaagagatctaggatgcccccagactagtgggtcagagtctgggatgtggcccgggtcacagaggctttggtggctactgatgtgtctccactgtgcagccaagctggagaaccagcttctgtttctcagagagacacattgggttcctcctgggttgagtctcaaatagggtttagctcttaagctgtgcttctgttttgagaagatgccttcacgagatgccacggttctctctgtcttttacctttcaactgaatgcttagtttcgtctctttttatcctccccaagcaaaggttaaccaagtaaattcttcctatattatcatttaattcaatatagtcctttatttgggctttgctagtggctcagatggtaaagaggagaaggcaatggcaacccactccagtactcttgcctggaaaatctcatgggcagaggagcctggtaggctgcagtccatgggggt

SEQ ID NO: 64586 - DNA, 3565 bp, Bovine  19866880650444
ttccaaggacatggcattcagactagtgtatctttaaaaaaaatctatagtatgtgttttaatgcccagttgctgtgtatttgacttcgaatgctaactgaactgcttctgttagttgtcttgataggcttcattctagtatctacattgagatacagacagaaattcatttttatgtgagcatttaaaggttgctctatttttgacaggtaatgtccagcatgtagcaataaaaatgcaagagccaggtttttattgtcctctgaaaggtcaagagaattataatgtgatgacagactcttccattgatgtataatggagtcagggatctttaacatggcccaaagaagaaaacattggacatcaaattttggggcatgtctgtttttattaaatgggctatgttcataagagaggcagccctcaacttagaaatgactcttttctaaaattcagattgactgtaggtaacatttccccagaaaatcagtgctacaaatcagggatcagtgaaatatttctgtaaagggccagataataaatagtttaggttttgtgagctctgtagtctttgttgcaactacttacctctgctattgtagtggaaagcagctctagataatatgtaaataaatgagtgtgtgactgtgttccgataaaactttatttataaaaacaggcgaagaaccagatttagtttgtcaatgcttgttacaaatgaccattcatttcccagaccagatcacagaaaattatttatattgttgtctttactttgtatgtatacaacaatactactttaaaattatttttttaatttaatgctagtatactcacaacaaaagttcaggacaagatggcttcactcgtgaatgctatgaaacatttaaagatgaattaataccagtccttctcaaactcttcccaaaaattacagaagagggaaaactttcaaactcattttccaaggcattaccctgaaaccaaaaccagacaaggacagcacaagaaaagaaaattacaaggcagtattcccaatgaacagagatgcagaaatcctcaacaaaatattagcaaactaaatttagcaatatcatacaccatggtcaacagggatttattccagagatgcaaggatggttcaacatctgcaaattaattaatgtactacatcacattaacaaaatgaaggatagaaatcatatgattatctcaatagatacagaaaaaactttcaacaaaattcaacatttatctgtgattaaaaaaactcaataaagtggatatagagggagcatatcttaacatcctaaagaccatatgacaagcccatagttaacatcatactcaatggtaaaaagctaaaagctagccctctaagatcaggaacaaaacaaagataccctaccttgtcactaagttttcaacatagtattagaaggtttagccagaaaagtaaataaaagactttcaagttggaaggaaaggaaactgccactatttgtggatgacattgattttatacatagaaagccctaaagacctcactaaaaactgttaaaactaataaatgaattcggtaatgtcataggacacaaaatcagtatatggaaatctgtcatgtttctacacactaataatgaactatcagaatgagaaattaagaaaacaacccaatttataatttatcaaaaggaataaaataccttggaataaattcaatcaagaaggtgaaagacttgtacactgaaaactataagataccaatgagaaaaattgaagaatacacaaataaaggaaaagatattctgtataagattagttgggtcatttccatggatttcctcattttggactcctctgccatgtttcattgtcactcttctgtcttctttctgacttgtagctttgcttgaatctcttactttcacagggccctttacattttaaaaaatgatgtgaatgtatgccatttttaatcttttaactctcattgtagtcatattgattgagagagagacaaccaacttgtgtggtcaaccagaagtcacaatactgttttctacacctgaagtttgaattgctttagacaatattttattctattgtctgtttgttatccgtatatggatatccatatctgtatatggcctaccaacttggctttcgtctgtgtgagaattaatcgaaactcaggattttaggaccatatttctatcctgcattgtaacattacctcttctacttctctcttcttaatccctcctcttatcttgtgtgatgcttggcagaaactcaggagactggagggagtagctctttattcttagtcagccaaaagctgtcagttgcttcttaggtgattctactccttccttgactcctatccctacaagcagcctaagagagagaatggatttatccataactttgacaataaattgtcttttgatacattagaggagcccacagttgattgtgtcttgcgttttggttctaaaatttccaaacatcccagattctctctaactctggagaattatagggaattggaatgaggatgtacatgtgtcttctgtgcttttccctttgctgagactctccctgcatgtttgctggccagtctccctctgagatctagggctctgggctacttatttcaccttgaaccagagcgaggcattgctggttatggagactgctaactcattcctctctcccattttctctctggccattatgaatgtacatgtctatgttctgcaagaagacagagagaaattgagggtctggggtgtctgagctcagctccttagtaagatttatgtcttattgatgttccagccttcttcatgaaagtttaaagtaaattaagctgttaattcacagattttcttactctaattttcctcctgagaaaacaaaacagcacagatagtttctgtggttcattgtcagttgtcagaaagtctctgtcattcctatgccaattttttagactctagtcacatttttttattacattaaatcgcattaaatagcaagtttttatttttaagtaacatatccaagtggtaagtttttaactcctagggtaaaaagttatttaaaagctatagacttctttttctttagctgaaggtaattttctaagcctttttataaactcagaaattgtgagacccaaggttcccataaggcttcccagatatagtcctggtagtggcctgtcacatggaattcgaggctccgtctaattccacttgaactcattactccctgtgtgaatgagggctggtcacttctctacatccacatcccttatttggataaagtgtccatgagagcactgcatatcatccccttctaaatgcttgtggattttccaggaagcttatccaaactggtcttcagaaacctggaatatatttgctgttatgagaaaacatctacatgatgacccatgtccagactgggatggtctttccagtccatccctctggacagaacacttctctctgaaatgagagaatctctttgagcactgagtaggctactatgtata

SEQ ID NO: 64587 - DNA, 2455 bp, Bovine  19866880653169
gcacaagcacaataaatatgtttttatttgaaaaatgtttaatccataaagaggagaaaaaaatttttttaaagaaaagcttttaatgaaagatgctgatacttgctactggtttagaaatataccaatctccaaaagcttctgggctgaagtcacctggagcaaaggtcaacccaggccatcaggggatcggatataggccatgagaggtcaatataaggccatactagtacattaaaaggaaaaagaactctcaaaattcccttatctttttctcaggatccctattacatacaatcattgggatcaaatgctggtggaatcaagtttcccataaaattctatgtaatcatggaatagcatatttgcgtaatgctttacagttttcaaagcactgccataaatactttattgatgaaaccggtgtatgaggaaggcaagcagttgtgatcattctcatttttagttaattatggataaaggactcatctaacatcacagaattcagtaagacatgggcatagaacccagcgctcagtccacttcactcactcactcattcatgcatttattcaactaattgggactatggattttgaaacaaacaaaacctagcctctggccccacggagtgtacagtttagtgaccaggtagaaagaaaaccctatatggtttataacacaagtgcaaaaagtatagcaggaagaatgcatgcaagtcttccagatgaggacaattcttaaatctaggtttcgatggagaaagaaatagctaggcctagaagggaatgaggggtaaagggagaaagacaagcaaaggtcatccaattctgttcaaagagaaaagtgagtgcaagtcctggcagaaacttaagagtatgaagtcagcaaagaccaatcttggccttgactgccttactctgtgggccaagctaaggacggccaacgtgctcagattcagatatatgctaatctccaaaaagctttctgggctgacctcacctcctatgtaataaagcatactggttcacatttcatttcttttaatactgtcatatcttggaagaatgactcaagccttgcatttgaatgattgttttttgttgcctatgtatgtatacacacatttcatacacccacatggatcatttatatctgtaatactatacagaatataagtatccacatacattatacaaaacatacataaaaccctataaaccttgcacacagagacatttgaataatgtgtatttctagactgaccccaagagatacgtttagatggaaaagggttacggagacaaccatctgtcctagatgattcagtcatttgcctgctgaggagaaactgaagggaggttgggcaagatgaattccaaagataccttagggctccatggtttaatgttttatgaacttatctgcatgaagcagtttctctaattttgataaataaaatcccatgaccctggtgaaataatctctctctgcctctcagcagaaagtgtagccacaaacagtgtgacctatagaaaagagcattgaatgagaagtcagggaacctaaatcctccccaaaccatccttctccacccccactcactacacctccaaacaggaagggggctgtatgaccttgggcagtggacttcacctctgaaggcttcagcttccagagcattaaatgaaaggtgtggttaggtgttccacagttctcttccagctctaaatctgtgaagccattcccttccctcaagacttagcttatctttagagctctaaaaatcaggactaataaaactggattcagatcacctcttttctaaccatcctctcttttctgacttcttaaaccatccaaatcttgcataatttaagtcatcaaggctgtcgcttggtgctctggtctaaatttgcattgttgctatttggggaaaatttagactgggtccaatctgggatcactgactgagaacaataaaggcttctccagacaggatctgcttttaatgcattgagcgcagagtttacaaaaagggcactgattgtgtacattaaagagccaccaaaacagcaagagactggtgaggctgcagcaaattctcctagatgccactgaccttggctgcatttcaggggtcaggcattccccaggaagttctcagcaggcaggccttcctgaggatttaggaacaaatgagacctctcatctatacatgagcccatctctccttatctaggaagacagaaaaagatggtctggcctctgatttgagattacctctgtagcctctggactcaactctggatctgcccagctcacctaccaccagacctccagaatgcaattgtccccacatctacatttaaatcctccagccagcagttccccatcttctgaacgagctgggaagctggagccctctctctttccacacctcctgcaggcagaa

SEQ ID NO: 64588 - DNA, 1099 bp, Bovine  19866880657363
catgggattctccaggcaagtatactggagtgggttaccatgctcttcctccagggaattctcccagtggcgggattgaacctgcattttctgcattgtaggaggattctttaccaactgagctatgagggaagcccctatatacgtgtatacatggcttacttttgcaaaggatgagtagttatcattgctccccacattgatttattatttgctattgacggtgtgtgtatagttattcgaatgctatcaataaattctgaagaaaatgagtaataggaaaaagaattcagaacatttgttgatgatttgaaatccccatttgtacttgatgtgtcacaacctctttccaactgattcaagaatcgtgggccgtttttcccacttgttctctatgtcacacacatcttagtcactatgttgttatttcgatggccacatccaaaatcttgctaccctaccaagttgaaaaaattatgcagatcttacttttgtcttaatccaagagctttgggttgttcgttatattcctgtgagtcattctgaaactcaggatgctgcttgggacctgaaattgcagtgatttaatactctattgttcttgttttttccacatggagaacagattctaatgtggatctaattgagttaatataataagtgcacttttcatgtgagcaaatccctggtgggctgctgctttctctttgaacatgaatcacaggttaggaaatctataaataccaaagcaaatttgcttctgcatctaaaggaggaaagataccttgtcaaatcttattttatgttcaaaattccttttcatatttaccttctaaatctttgaggagtagtagatttttcagtactttctccaagtagaaagtaagataagtaagcaaagcggacgacaaaataatgattatatgaaccagttttgagtctcatccaaatggtgttttcaaaacatcacacaggggtttgcatttcacattgatttttatgtttttacattaatggtttgctcgctcctgagtcttgcttgttcaaattgaatagacagcagtgacaggcaggaatgactctcatcttctaaaaatag

SEQ ID NO: 64589 - DNA, 2770 bp, Bovine  19866880668908
tgaggataggactctatttaatgagtactctgtcctagcacccagatcaatgctagatacctagaagatgttaaaagtatactttttgaatacatgaataatcatggggaagtaaacctcaaaattttatccccttgcctctaaggaataaagaaggaaacaaaatccactttcatttttgagctctttttatccttcactgaaaactacttctcattctctttgctgatacacagaaagcaactctgggctggcagttgggaacaaaggttgagtccccccaaccagactgtgtgtcctgtgacagctcctgcctgttagaaatctctgaacttgtaaatacctctgcttctcagatttcttcctgagcctccgatacagctataaacacacacttttgccttgtggctaaagtaaaagaacttaggatattttcacctaaaaatagcagcttgctcttcattaagtggcagtctactgcctgctcttacattcagtccttctcccagcaagaaatgtaacaaaggaagaggctggtggtcacaagccaggacattgcagggctcattaattacttggaaaatggtgcctgggttgcagccagaatcccaaacaaagaaaggaaatagctcctgctctccaattgacaagttgatgagtgaggtaagaatgaaaatcatttgggtaagttaaaaagggaagaaatcaaatggaagcagtagtttagttcaagaacaaggatgcaattaagacatattcccaaccccgagggggttgattcatatcagttgagaccatggaaatcattatctgctcctgtccatgagacaaattcattatctctaataaagggatagggaacaccaatttaggaaaagtgttgatggtgttggagttgagacctaagtacatgatatgtgtacaaatgagttattaatctcagtagcttctatattggttggatctgtatgacaactatgttgtaaattatacagaattaaatatttttactaaaatagtgtccataattttagcaaggccaagaatcttaaaccatcttagcaaatttgtttaatcaaatggggatagtttcaagtaggaatcagttaagaaaaatgagaatttcttaatgttgatgtcaaaagagatgattttaaaaaacacagtgaattaaataatagaattttggtgtgattatattttaaggcagtgttcacaaaacttagcctttggcttttataattctgagctgggcaaaatacaaggaagtctgatcatctaatacatccctaaaatgagtgagtgagcgagtgaagtcactcagtcgtttttgactctttgcaatcccgtggactgtagcctacaaggctcctctgtccatggaattttccaggcaagagtactggagtgggttgctgtttccttctccaggggttcttcccaacccagggatcgaacccaagtctcccacattgcaggcagacgctttaccatctgagccaccagagaagtccctgaaatgcggccgtaaataattcctttcttagatgtgatttacacggttttcagtactgaatggccataatatgttccctccataaaactactgctttataaaaaaaggaaaatgaaaacacaaagacaccaccactaccatcaccaccaccattatcaccacaaaacccctactttgaagtgagacattttttggctgtttcataacctgtaaggaatataaagaaaatgcaagaaatctttaaaatatactgatgtggaggaacccttcttagagatggggtaccagggcttgccgggcactgtctattttataaatctctagaaacagctctgttgacttcaggaattcctccattagggtcaaatgagacagtggattcaacagtacttgatgaaccagaatgaatatctgggatatttttggtgttaggtctctcctctattagactggaagcaccttaaggataaagactttctttgggttatagctatcaccagtgcctggtccatacatggatgaactcgttgaatgtctgtggaatgatcaccttgttttccaggcttttgtttccacataataccttaggatacctacctcatctgcacatccacttgtactgttttattaatttttttaagaattgaaggagaatttacataggatgaaatacactgttcttcagtatacactttaatgaggtttgacagattcatctacagtattataatagtaatatagtattactaattttctttatgctgacaattttactcaatttacaactatattaatagccatgaacttgtggttttataatctttgtaatgttgactgttatctagtcaatattaaaatcaatgcctattttttagaatagaaatattggtcttaatatcaccccagatgtcactcatctaagctatattgagtaacatttcacagagaggcttgtctacctcattgtgaaactgcaggcaccagttagtgggtggggaacgtttgcgtggagtgtggggttgcggcagatttaggctcctgaaatcaccttggcatagcctgaattaccaggtaagtgagtctgttgtctcaataatgtgacaattttgatacactggactattgagatgcctcaagtacttccatctgcctcttaaatagctttcttcatccatcttttatccatccatctatccttcttcaacttttgttctgccttagaagagtaggaaaccaggcttatttcgaatttgt

SEQ ID NO: 64590 - DNA, 2591 bp, Bovine  19866880709204
tcctcatttttgcagtttttgcatcttatcaagaaggcttggccttgtcctgtgatttaatcctgttgttacatttatatatgacacatagcatttcagtttgtacttagcattatccaaagaaataatactacatataggcctcttaaaaataacttaggcaaaagcaaatttaaaaaatacaagaaaaactcttatacccctacttagaaatatcaagtatgggtttaagtatttagacagcttaatattcccccttattcttacaattcccttgtcattatgggattgttgctgaaagtaagaaaatattatattccatttataaaattttttttattcaaaagaaaaaaattggaactatcttatatatgatagctctgtgtcctaacagtattgtcatgaatgctaactttaggtaacatttattgagtgccctctctgtaccaggcactctgcttagcactttatgtttaatcctcacagctctctgaggtaggtatattattgagtgcattttatttacaaagtgctatacactgaggtgatgaaaggcaagaaatgcaggtgatcttcctgaactcctcaatagactgagctccttgaggtgaggcattctcttactgtgtctcagagtgcatgacagtgctgatcctgtagaagggagcgtggaagaggaagtgagaggagatccctgcattggtgtcaggacagtggacaatactagatgtagcagatgaacggctggatcatgctccgagcaagttaagagaagatcacatttgtaaggatgtttgactatgaaaacgactccacagaaatgatagtgtactatgaaaattacccattcaaactcacatctaatttccctgggattaaatccaattaattagcgtcaatcttattatatattatgatgaatattgctgagaacctagcagtttttattatgttaagctagttcctttgttttagtatgaagctttaaccacttatttcatctgaatgtttcttttcaactcactagtatctttgcaaggaaaaaattatgaaagggaaacaatacatgctatttacatttctctgaggcagaaaacttcagggtctgaattttgagtatttgcggtcagtcagaaaaattaatcaaaacttaaaaggggtcttgtgggttctttatttaaactcttacttgttcagtcactaagtcatgtccaactctttgcaatcccacagactatagccaaccaggctcctctgtccatggggttctctaggcaagaatactggaggggaagctatttctttctctaggggatcttcctgactcagggattgaactagcatctcctgcactggcaggtagattctttaccactgagtcatcagggaaatcctaaacacttactgctgctgctgctgctaagtcacttcagtcgtgtccgactctgtgcgaccccatggacggcagcccaccaggctcccctgtccctgggattctccaggcaaaaacactggagtgggttgccatttccactttattctaaatgagatcaggaatagtgatttgaaatcatcacattcatcacctataaatatgttaaatttctttactggtgcaactttgggcttctcaaaggccaccagcatcctgaagaagacaggagctatgggatgagccattttcctgcttctgcccgactccaagtccctgcttttatttttttttttttaactgagttcacagtttagaaaaaaaggtctaccaaactatttaagctcacttggtatcctggaacagctaaggggacatagttgatcccaaactggctgaaaagaaacaaaaatcaaagtgagaagaaataatttcatgttgcttggaatgtcaaattacataaaggtaaacaactttggtcaaagaaaaaaaagaaaaaacaaaaacaaaaaaccctcaagtgttcagtatttttttttcccactcttaaaaagaacttttaaaaagagaaagtgcctttctcttccatacattaaagcaaatgtaaaaaggattgattcagtgctctactttgtgaggaaaagagcctggagatatttcagctccctgctaagcctttggtatccttcagaactctatttccatagttgcaaaattgactgagtgaaagtctgtttaatcatctgtgtatttccaatttgtctacataggtaaaagcacttagtgcttggcacataagtagtattcaataatgttagtaatcataatagaacagcttagatagctccatatactgccaaggcgaaaaaggaaacaccaaaaagaatgattgctttgtgtttgggaactcagtctttccaggaaaattaaataaggattttgatcaaggctgaaattcaatgtttttgaattttcagggactcaccctcaggatttccaaccctaccttttcaacctattttaaaacataatagttcagaaaatatttttttaacaaacagaacaatcttttgcttccaatttccagcgttagactgctgtatcttattttgaagtttgaggagataaacaaatgtttgatttatcactgtttgagtgt

SEQ ID NO: 64591 - DNA, 1634 bp, Bovine  19866880760289
acctagaactcaacacaactcaacacgcatttattaagtatctatggcgtgcacagcattgtacccagaaactgcttttgagaaataggtggtgagtttggagatctcggaggaacagcttttcccagggcccctggatacctctgggttcctaccagaatcaaaacagaaaagatgaaaaaaaaaaaaaaccaaaaaacccagaactttgaggaatccgataaaaaaattaaaagtcttccttttaagacagggcctaagcagttaatggctaaactactgaatgaagaattaatgtttttttatcaggccatatcagaacggaaaagcaagctgtttctaaaatatcggggacttctagcttacccgcagctgatgattcctcatcctcttcatcttcatcagtgggggatgtctggtataccctgggatccacaaagggggtgaaggaggctttggtgctgctccccaggccatactagtcaataagcaagaagattaagaagagcagataggtaaataccacagcaaccaacaacgctaacaatactctgcttgggctttaaaattagtaagtgaaagtgaaagtcgctcagttgtgtccaactctttgtgaccccataaactgtatagtccataaaattctccaggccagaatactggagtgggtagccttcaccttctccaggagatcttctcaacctagagattgaacccaggtctcccacactgcagccagattctttaccagctgagccacaggggaagcttactagagactcttcaaactatccaactgtatacaccctaactaccaagtcaaagtgtgtgcttctctctctagcttctcctggtattggttccttactaaccactagatcttggtaggagttcgtgaattatcagactgcaagagctgcagcgagcaaatgacattatgtgccacatgtggtaccttactatctggtaagatagctgtggagacagaaagattatcactctctcgaagtaaaagcaacctcccactgactaagtagtcttaagaaaagtagacaaattggcaatgagttaagtaagcacgtggacatagcagcacttcatcctggacactcgagccactcgactccctcctggcccatttgaggcctttcatgctggcctggtgatgcaggtggactggtgttgactcaagaagccttaaaatctgcaattcagagacaatttcttccagggaataaagatttttttccttctcatgatggtttccttaaaacaactcatacttatatgctttttgctctatctagggacctcatgaagatatgaggcttgcaggcaccttgacagcctacttaaaaaataaactgaggggcctggacagcactgttcaactatgaaatcagaaccagactaggaaacactaaactttcaaggcttcatgtcatgatattctacatttgacttttgtcaaaggagtttcaataaccatctctttgttttgtctcttattggcaaatccttttaacatcaccaacagatttccctttcttgtgtgattttgggagtctaggaagatgaatactttgagaatgtatatattttttatttttcataaacaaatcacttcaatctta

SEQ ID NO: 64592 - DNA, 914 bp, Bovine  19866880885123
cccactcccgagccctacgtcaacacacacacacacattttaatccagtaacaaagtgtataggagcagatgaggcagggttgtgagcaggaattacaaccatttcacctataaataaattagaagatgattttagtggatgaagttcctttaaactctgtagagaggccaatttactccccctctgctgagatcacagagaaactagaaattggttttagctttccctctgagagtgaagatgaacaccgattttccactcacaattaagattaaagcatagttaagatacctatctgaacatcttcaggaatgcaacccttctttgatacatgtcttgaggcaaaaaggtagataagacaagtttatgaaaagactttgtaaatccttatgatcaagcaacaagaatgttcacagaatatgcttggcacgatgtctgctccgatggtttccccaggttattggggcctctgtttatccttggtctgcacatgccattcatctgagacttaaaaattcctcctgaccacataagcagagccctcattgctcccagactgtgacaaagatgaagcaaggtagcgatacaggacagttcccaagcaacagttctctatctcaacaccactcactgtgaattcctttgcttggcacctccaagaagcagaaaatggattgttttcaagattgttcagggctgggccaactgagaattgaggcttgctcacagaaacagggcagggaagaaaagcccgtgtctcatttttctttttagaaactagcattcctgtcttcatggctgccagtttggcttagtttataaaaatcaaaatggatgattaaagggaaaaaaaaccaaatagctacaatttttagcagacaatagttaatatatgcaggttccaggcaggaag

SEQ ID NO: 64593 - DNA, 870 bp, Bovine  19866880986684
accaaagaggaaaacatatcagtgattttgaaaatacccttgctactgctgtgtttaaaaagaaatatgtgtcttattgaggaatctgtgactggcatttttcatgaactgatggacatctattcagccagggcactgccctactcaaaacacgtttttcctctcagcattcttaaggagctctgtgcactcgcaggatgccaaagataacatctagatcagcaatttctcataaatcattggaacacggaacatgaaacaagaagaagaaatcaggaattcaataataaatatggcaaggtgcacaaacaagagaattgaaaccagatgaaaaggagccgttcagaacagaaggtcaagaaacgcgtttcccccactccctcaaaggcttggagtaatccctctggttgttcttcccatccagcttactgctctgagttggttttggaatatttatgtggtggatttaaggccttaacatacaactggaaaattagtgttgtttatcttagcgtgcttgaagccccaggctgttatgaaatgaagaagaaaagagtgtttattgtactttagggaaaactgtgcccataagccttgaaataaactctagatatgtgtgtatacacatagctcagtttatacaacagatctttttaaaactcgaagttacatacgtgataataaagtaatgtgattggttctcttttaaaacaaaatgtcaggatttctcaggagccatcttaggaagataggcttatcttaacaccattggcattactaaatatgttatgggaatatctctttgagtcttgaaacactgcagttcagttttaaaaacagattctctggggcaagtcatcatcattgtca

SEQ ID NO: 64594 - DNA, 1493 bp, Bovine  19866881036643
aacagatttgtgaaaagacatgaaaagtaataagcaaaacaattcctttactgttatattgctttatattatatcacttcattattttcttcttttatttattttgaatatttcttttattaagtgagcaggaaaatacatggttgaacaaattgaaactacaagttgtgccctttacaagactgagtgaaacaaagattcatcagaaggcatgtgtcaatttcctacaacaaaacttcatgcaacaacattcaatggagctgaatatatacagatgttacaggctgcccagggaagcctcataactactgtcacttggaagaatgataaaaccaaaatgtcattaggctgtcattaggctttcttgaagctgcatttggcaggagataccttgaatgttgtttatttcttgttttagaaaaaaaaaaaaaaaagaattgttatcatgtttaaacatttaaaccaaaaaacaaaatttagaatcctcttcccacttctagcaactttgcacttactgcaatgccagtagcttaaaatggatcattatctgtataaatgtaagaatcttgaaatactatttttctcaggattctatatggcagcctctcttccaaccctgcagggcttcaacccttgacctgttaagatgattcatggagccaaatagtacagccaggtgctttccatccacagaagcctcccaagaaagaaaatccattgagtgtttcattttctacatgaaagcagacctatgcttttataatatagaatttggacacagcttttttgttttgatattgaaattaaaatggtcttataggcttataccttaataaaagaattccaaaactctgttattatttattttcattcattttttcatccaataaatacttactgattactatttgccaggcattcttgtaagtacaggagacaggccagtgaacaaactagatgttgataagctctatgaaaggcaataaagcagagactaaatggggaattgggaattatcttatataggtctctgataggataggaatatttgtgcagagacccaaaggtgggggaaagcacattgtacagatacatgaatggagggctttctagacagaggagacagccagggcaaagatctcgagacaggctcatgctttgagtgtttcctggataaagcaaggagggcagtatggctgagcaaagtgaactagggaaaaagtagatgaagtcagagaagtggtagcggtggttgaggatggagcaaagtgtaagtcagatttatgaggtccttataggccactgtaaggacactgatattctgagtaagatgggaagaccttgagctcttgagcagaaaagtggcataacctgtatattagtggatgttttaaaagtgtcatcttggacttccctggtggtccaatggttaaggatctgcctgccaaagcagggcacacaggttccatcccggtctggaagatcccacatgt

SEQ ID NO: 64595 - DNA, 1899 bp, Bovine  19866881041449
caggaccaaatgcaaaagataaatctaactttccaggacagagagaccacgttagacttgggagtacaactagaagctacttcaaaaagctaaatgtaactaaatgacctttatataaaatatatttccacatctggatttatgtggcttaaatgaagatatactccaagcaacattctcttaatatctacatatacttttgtgtattcaattaagtatgcttcttaaaaaactacttgtagggcttccctggtggctcagtggtacagaataagcctgccagtgcaggagacatgatccctggtccaggaagatcccacatgccgtggagcagctaagcctatgcaccacaaccattgagcctgtgctccagagcccgggagccacgactactgagcccagaggccacaacgactgaagcccaagcacttgagagcccgtcttctgcagcaagagaagccactgcaatgagaagcctgaacaccgcaactagagagtggcccgccttgttccaactagagaaaagcccaaggagcaatgaagatccaacacagccaaaaactaaataattaatttttaaaaaagattctacatcttaaaaaaaaactatttgtaagtaaaattatgttatgactcttttaggacaacttattaaaagaaacttttaagaatctttccagaaaagaaaggctacatccacatcattgttcataaaattatacctcattttatgaaatctaggaacaacaaaagctagagttacaaaaattaaaagatttaatatttaatgtaaagaaagtatttatcatagaatttttgatatagaaatctgttcctagggctataaaatttatattcatgtgtacagtattttaaaaatatacctattccataaaggttaaatataacctataatgtgaacaatcacttcctaacttatttctcttaaggttcacatatagttgaaatccggtttggcagttttattaagctttaatccttcagagctcagagtaacagcaggattggattagtgactcaggaaacccaggtgtctctgtcctggagggggtgccacctaatgtcatctgggttgcctagaaacccaatccttaaccgggtatggaggtttaattcttcagataaatcattccaagtccccaaagcatttatagcaacactctcacttgactattgcacagaaaagcttcagtgccacaaaacacaaagggctggaacaagaaaccaagtctcctgtctgcaaatccaatgtggtcgccatggccagctttgcagtctcccctcagggtgagaggggccacacttctgaatcaaccactaagagaagggcaccctttggaacaacagtgtttgcaacttagttagtgtatttctttcctctctaaagagctgagacctcttgccacttgttttttttcctcaggtacccaaaaaattagggctaattttggattttccaaacattctcatccttaactgagaatccttatcttgttatcatcctctcttgcaggagtgtacagtccacctcttattagtggacgaagctgtgagtcaccttccaaacgtgcattccacaggtgggaagcacagcacaagggaatggcactgtaaaagcaacagcattatacagagttgtttctccatattgacagcaaatcagaagtaattttctgcctaaatcagggcttaattcattagctcacattaattcacaagttcaatccaatttctcaaaatgcaataacacaatcttccaacctaattatcttcactgaaagtatttaaaagcatttgctgagacacctttctttcttgtgtcagacaggatcaacatcaagtgaacagctgggatagactacattctttctaattgca

SEQ ID NO: 64596 - DNA, 1227 bp, Bovine  19866881043856
tcggcatactggagctggcatgcacgttcgcatctttgaaagttcacacctgtatttgaatttctcttctttgtctccttagctaatatctgtcacatggcaaagtatgagcagggtcctaggggtgggcagtgagcagtgtaagagtcaggactgggcagagggaagatcagcaaaggctaagggaggaggagaaaccctcagtgaacgtttcaaggaaacagttccttctctgcagccagcctccgggactcaggagaacgtgtgatcaggttagactcagagcaggaggttttgaggctaggccaaaaaggagccctatctccagctcttagtgggtggagagggatgacgtgccaatgagaacccgaggagctaggagggcagtgcaagatgcacaaactaggcatagacagaaatagatgagtcgaggttaaaaagtgccaggactgatttttcaactgctacttattaatagtggtcttgggccactccatgaagtcagaattttaaagggaatagttcagagcagtgtgtcagacatgtagcccattaaaggccagcttttctaaaaagaaaatttattctcctatacatatgtagattaggttaagtacttagactgttgttttcacactcaaattctgagttcaaattctacttccaccgcttagttatgtgaactccacccctgttttctcatctttaaaataagaatgggggtataataataattactcttgtctggcatttttgcaaagattaaatgagataatgcatgtaaaatgcttactacaacttctggcacatagatgtactcaataaatataagctatgcgaagagctgattcattggaaaagaccctaatgctgggaaagattgagggcagaaggagaagggggcagcagagaataggatggttgaatagcatcattgactcaatggacatgagttggagcaaactccgtgagatagtaaagttacagggaagcctggcatgctgcagtctgtgggatcgcagagttggacacagtcatgcgactgaacaacgaacacttatttagaaaattatttattgacataactttacagtagtatttagggttactttctgagatcttgtgacttctttgcctctgaactctaagagtggataaagcatgttccttgggttgtttgctcattttgggagcacaaactctggactggaactcagaacttagcat

SEQ ID NO: 64597 - DNA, 934 bp, Bovine  19866881072094
ccacagacacaaacacacacacacacacacacacacacacacacacacacacactcccccaggagttccggtctgattggggaaaagcagagcacaaacacatccctttcacctgcttaagttcatccataaaactgaaatgtcacagccacaaagtcagaaagcacaggcagggctgagttaaaaccataaataaaggtgagtggcagaccggcatttcagagagcgctgagagggagtccgggcgcgaatagctgaaaagggggaaggggaggcagttgccatctacaagactggcacagcaagagctgcccccgtagagcggcaggttcggcttcgtggagccagccaggctcacaatgtcctcttgcaggctgatggaaaacgtgaggcgccagtgcctttattcacgctgttgttattctttttacagaaaaggacagtggggtctagagccttggcaccggggcttatgcacacacacacactcacacactcgagcctttcatttaatgctcttacaccggtctaagatgaaactggcataagctctaagggttttcggggggaggtctggctcccaccaaaggaggacacgtaccgcacaacctctgcggtgggggctaagcctagaacacctcggcagcccttgaatcaacacgagaatccaggttcccttcgcgtggcattcgcctgtctctgcccaccagccccagccccagtccacgcaccgagcccactcactctgacccaaaacactggaaagaaatcagaaagcatgttccgctcaccctcaaagcagagagatctatttcatccaagctgcgagccggggagtcgctcgccatgtcgacttcttcgcgggagagatggaccaaaaccaccccgaagctattcccttggaaattccaccttggtctatttcacttcgcgt

SEQ ID NO: 64598 - DNA, 1990 bp, Bovine  19866881104742
ctgtggacttgtgccctaatcgctggtatctctcaccagctctcccctgcccctgtgcgtccctggcacagggtttatctctgaggagatggtgcctctctagaagcagataaatttgcttctgggtgtgaacttagtcccttgaagttaagtttccaagtccatggatcgatagcagacattcacatacatcctattcttgctcactgaaaagcaaagtccaaaagtgattctgaaattgccagttaaaaaaaatctgcctaaatttcattttactatgtaagaatcttgttcatttctacaaattgtcccctttacctattcaaccctagtgttactttttccagcttgcatttcctgccttacttagctcacctcagtgtcccctgacatatagtatgctcaatctcagctttagtttttcactgattcctacctccttgaactgtcctttcccaataattatttttttcctaactctttaaggcccagctctggttcgctcattccaacagaccttccaggaattttttatcggggtctttctcttcactggtgcctgttggtcttcggtgtgatttgacatataaactgtgcaaaaataccttcatggtgtaactgccatacactgcctgagttgtgtgttggtggcaaggattcctttgaaccccattgtgctttataaagagctagatgtactccgtgactggctgatccctatgtagctgattgaacctatttttgttgttgttctagtatttcagaaaatgtaagtttcctttgctttggattgtccttttatccatgggttcatctcttctgtttgtcaggtcaaaaaaattccagtcgtttattgagagctgcttggtaaagaaccacagccagcgaccagcaacggaacaactgatgaagcatccatttatacgagaccagcctaatgagcgacaggtccgcattcagctcaaggaccatatcgacagaacaaagaagaagcgaggagagaaaggtgaggtgcacatttttattgcagcgagggaaacaaaagacccaagtgtcatgggctcttgatgtgtttggagggaccgaggggatttcagatagcctgcattgttcttcagtgtgaggactgcctcagagatcacagcctgtgggcatcaccaggggcaggctgctgaaatggaatctttcatgaaagaatagaactgcaagaaatattaccttttccaggcagtgaacaacaagtcgtgttgagtgattctatgaaaggggtttaatatgacaagtcattttcttaattcaaatgaatattcatgtttcaaaggcaaaatctgcagaagacaggcaaccttaaacacacacacacacacacacacatctatctgacattttttcagtactggcgctcttcaccatttaagtttttgtgctctgaggctcatttttaatttaggtatttggaagtcagaaggacttttattatagtcacaggaattttaaagaggttgccaggctactgtatagaacattgcattttcccctttgttttatagattcaaaaactcttttttcttatggctctacctgtggtcccaccctgtcttcactgcatcactggaaaaggcatgagtccaacttggggtcctgggactgcctgcaagttgtttgaatagagactcagaattccttaactagcatcctgaccaaggtgaactcacctggtctggggggttttatgacttagttgtgtagggcagtagggaaggttgaggatgggaaggaaagggggagaatgcagagaacagatgggtgagagctccctggtggtagcaggaaggggcagctggtggggctggcagtgaggtggaagttccggtctgatgaagcgagcgctgagcgtgggtgggtggagtagaggggaaggcaagaggccgatggtgggggtccatggtgatgtgcttgtctccacttcggtcctctccacctttctcct

SEQ ID NO: 64599 - DNA, 1147 bp, Bovine  19866881112897
ttagtgagatgatcaaattctgtattttcccccctgagtggtcacaatttgactttgtttgcagtaaggaagttggatgatgacagttgacacatcaataattgcactgtttcagaagtctgcagtgctcaaacgcttttaattataacttaggataattatcaaaagagaaattaatgtcatttttatgtagacccttcatattttaaggggagaggaaatactggacatccaagatgtccagtctctaactattgcacccaaagtgataaacatcagggggtaataatgctatggttctttctctagaatgacctgttcaaatcagtgtgacaaaaggaagacagcatctgttaatcatctctggtcactgagaccagttccacctttctgggcaagagtcacttccctccttaattccacatctgcaaaatgagataatagaatggcttcttctcagctgtataaatttaaaagatctcctcggcagtaaaaactatttaagtataaagccacatgttttaaaactttcctaggtgttccttgtggagaaggcagggcgacgctctctgttcctaattggaatgagtgggatgtttgtttgtgccatcttcatgtcggtgggacttgtgctcctggtgagtctggtgtctgcactgagatttttgggtacccaatgatagcatttctgagccccaggttaaacatctgagacttacttaacaaaataaagcaagaggaacagcatataaaacaaaagagaaatgtaaagaaaaagaattagcttcagggtttaaagactgaatatcagcaagtgaatggtgcttgtcacccagagatgcagggtgtataataaccaggtttcaatcctggctctgccacttggctgcttgtgtgaccttgaacaagtacctagacctttctaccactttacagggtgttccgcatcctgtctaccgagcttggtatgagtagaagcagaggtcactggatccttgctttgcttcttccacaggaagagtgactaggaggcagagaaaatccgaagccacaggatttcttatagctcaaaagatttaaggatgattcagactaggaaaaaaaaaaacttgtctacgactcattggaaaagaccctgatgctggga

SEQ ID NO: 64600 - DNA, 1068 bp, Bovine  19866881166418
tttaatttgtatttatctttttaatacacacattttaaatggattccaactcaggttgttattttaaaagcctgtgtttggaaagcgtagaatttagaaatctagaggacaaaaaaattatagggtcctcaatagatcaaacttatatacaacactggtgaacacaattttcaaggtgactggctgcggtcgtagtgttggaatgctttaaatattacggagccatttgattggtgactgagctcaaaatgtggctccaaataaccatgtcaaggtattgactttgtcctaaaggttccagcaaatctgaaaccacattagaaattggagtcctttaatttggagtcagagagtaactcattccagaacatttccccttatgttttccctggtgatggggtctagtgagaaaagccctctacacttccactgaaattatccatttaccacgcaaggagatttatatgccagcacgacacaatgtcaacttcagcagccaagtccatttttcattccaggcttccgtgaaagggctctttaaagtctacttgaaatattcagcaaggccataaaatgaaattctagaaatctgctttgcgaactagtcttccagttatagctttactgctcatcattatttcaaaggccttattcatcctaaaactacggttcctttctttcttacaaaaatgagatgccctttgcctttttggagagtaaagcttgtggttagtgttttctaatcaatcctggctaaagaacgggaatgacagatgatatgtgtttatgtttcagaaaggaagagtgggaagtgatagcaagtaaaagtagagcctgatgctgtggagaaactgaagtaaaataggtaacatttattggatgcttctaggcaattagcttgacttcacattccaggatgtctggctctaggtcagtgatcacaccatcgtgattatctgggtcgtgaagttcttttttgtacagttcttctgtgcattcttgccacctcttcttaatatcttctgcttctgttaggtctataccatttctgtcctttatcgagcccat

SEQ ID NO: 64601 - DNA, 1796 bp, Bovine  19866881336605
ttatgcatatactcaagtggaggcagtgttagaagcagagcagtgaaaagttcacaggtagcagctcaaccaatacctgtttttacagatgagaatactgaggctcagagaggttaagtaccttgcccaaggcacacagctggtttgtgacagacctgggaccagaactgggacctcagtctctcagctggtaaagaatccacctgcaatggaggagaccccagtttgattcctgggtcaggaaggtcccctgaagaagggataggctattgactccaatattcttgagcgtccctggtggctcagctggtaaagaatctactgcaatgcagaagacctgggttcgatccttgggttgggaagatcccctggaggaggacatggcaacccactccagtactcttgcctggggaaaccccgtggacagaggaacgtggagggctgcagtccatagggtcgcaaagagtcagacatgactgagagactaagcatatctcttaggctagggatgaaaacttcagcctgtagagattccaaggccaataactgaggttcatatttacattaacttagtcaaactaaatttgacttagatgaaataaggttgaaattatttgtttatgaaaagtagatacattctcaaagtgttcatcttcctaaactctaaatcgctcaagaaagggagaaatgggatattatctttcctccacagaaaggagtctgggaaaaaagccaaaataaaagcagactgttaggcagtgcttgtgcatgtccttgaccgagcaggttggatgaggtcatgctgcttggtcatgtttcacgaatgaatagtcctgtgaatcaccatagactctgctgctgctgctgctaagtcacttaagtcatgtccgactctgtgtgaccccagagacggtagcccaccaggctcccccgttcctgggattctccaggcacgaacactggagtgggttgccatttccttctccaatgcatgaaagtgaaaactgaaagtgaagttgctcagtcgtgtccgactcctagcgaccccatggactgcagcctaccaggctcctccgtccatgggattttccaggcaagagtactggaatgggttgctatttccttctccatagactctacatgtatttatatagcatatgcactgctgtttttgatgttgtccaaacgctgagtttttataatgcaccatttggattcgaaagttatagagcagatgaactttatttgttgcagggaaaagaacacagagcattctattaatattacagcttcatgcaccgtggacaggtttttcctatctgaatacctctttgggtaccagggaggattctgtgtggttggactctgcttaaaattctgctgcttccccagctctaagtgggaatgttggtacttgccacacctccttcacagacttctaaagattgaaggagaggatgtctgtgaaagtgctctgtttgggagggggaatcctaccttgtgaaggatgaaatggtttggattcataacaagaaggggaaatcttgaatcagattgggcttttgtggttttctcttcatgtgtttaggggttttgggatacaggttttatttttacataaaacctttttaaaaaatgaaaacttaaagacatttatccccccaaaagatgtttcttgtgttcatgtttgaggtttatatttacattaattagaggagcctggtgggctgcagtccatggggtcgctaagagtcggacacgactgagtgacttcactttcacttttcactttcaca

SEQ ID NO: 64602 - DNA, 879 bp, Bovine  19866881392269
aaaagatgttttgtgccaggaacaacagtggacatttatggcatctgaacagagtcatatctgcaaagatctgtgatacagcaattagagacttaagtagcaatataattaaagaagacattgtttcttgaagtataagactcgaacaattggagacagaaagatgaagaattcaagcacaatataaagaaataaaatattggagtgaggactgtgtctggcacactgattcaatccagcaaggggcacagagctgtatccctgaaatgatactgaaaggctttgagaatacaagactagatgaaatcatggcttccctagtaatttctctaatcatttctgattcacagtttcttctgcatcctagagagaaaagtttggggataatacagttttgtttgcatactgtttatatgatattgtttttgtttcatttgggggctttttttttttcttggtaaaaagcatttagtcaacatgaaaggttcaaagacacatctcataacccactacccagaaatcacatgttaatatttgagcatcactcagaatttctctaaggatacattgaagaatgagtagaaataattttacagcatttttgttatctagctatgtaagtattgtatgttatataattatatcattatatgtcaatataaatgttaccagatcttcttttaaaaagcataaccactaagtaatttgaaattaaagctagtgtgtgctctgggaaaccctgacattgggggctttgtttagagggtttgggggctctgtttttaactttgaaagtgaaagccgctcagtcgtgtccaactctgcgaccccacggactgtagcctgccaggctcttctgtccatggaattctgcaggca

SEQ ID NO: 64603 - DNA, 922 bp, Bovine  19866881447763
tggtaactgcatagaattacctgaaaggcttcttacccacccgccacccccacccctgccccagagcttccaattcccacctccagagtaggtcagagaggcaggacctgagatgatcctgaagctgctgaaacgaggatttcactttgagaaccactgttaaggcaattaacctatcaaccagctcttagaaaatcacaatgcacagggcagcatttactgagaatctaccagctgcagaatcctctagcatctactggataagccacactggtccttgctccaaacactcaaaattgccaacacaggacacacatgcaaggggacaatacacagacatgtgcccaaaacagcaagaagtcattactgcggtgagattcaagatgtttcatttctccagtgcgtttctttatgatgtatcctaccgtgcaatttaatgtatttttttttcagatggaaattactaaaccacaatgcatagccattctccctcacactaccccacttcattgcacttactaatgagaatttcatctgagaccagggcatgaaatgtagtgaaggagaccattttaaagcttatttatatcatgaatattttagggtctgtaaggaccagagcaatgatcaacacagtccttaatggtcagatatcaagcagaagcattgataaagtactgatataatctgactttgctatgaggttgaacaaacagacgcacaaaagcaatccaacggaaccccaatctaactcaccaattatcgtataggtttttaaagcctagcaagcattaactttaaatgcatacttttctcatgaccctgttctggatttaagtacatttatatccagattataatcagagagggtatttaattagataatgtttgcaagtacttgaagatataaagtgctctataa

SEQ ID NO: 64604 - DNA, 1615 bp, Bovine  19866881496937
cttccttagctgaacttaatgcttttgtttttaatgacacaacaggtatttcagggaactgtgtggtctcaggcctgctttcttctcagtaaaaacacagacttcaatctgtctggtagaaaaaaacgattggaaaagtgccagtcttcaagtgtttaatttctctgcattttcaattcgagcagatgctcccaaccagtacatatgcaagaatggctaaaggttgcaggaaaatggtaattaaaatcatcctcataaggtgattcatttgtgaatatgctaccactgactcaacaaccccacattaatttaatcaaggttaaccggaacacaggagaaaggcgggacttttaaaaaagagattggacagtggttgagtcctaaaaaagattggcccaaatcactaggcatcatgaagaagcacttttcctttgtaaagtctggaaaagggaagaactatcagacaaggatctacagttgcctgtttagtaatcctgccgctcttgggattctccagaaacagccagcctgtcctggcagcttgaatttaatgtacttcctggttaagcatacctccaaatgtactctagaatcaagaggggtaggtgtaaatgggacaggatctcagagagctgttagagttgagaaagaaaaagaaatggaagaaggcaagacaggggaaggagagcaggaaggagaaagaaataatggagagagggtaagagaatggaaaaaaggaagggttggaaggaaggaggcaaagaaggggttcctattctacagatctgctcattgttagatggatcatttacaaaggatcatggacatgaattttacacagtgaatataaaaataatgtaagctgcagaagtttctaggaattgtcatttcaccaccctttccagggcacaactgctcagaagacaaagaattcatagatattttgaaattctataaaattttacattagggtctaatacttagaaacattaaggaataacagcaacccagcatcaacccctcttgcttccttctaccttctcccaaagtaagggggaatgagttttgctgaggccatgctagatttgtgtcacctaagcacaaaaataggactgggcttttctttatttgaaatgcctgcttgggagttctcagccttcattattctgtcctccggctgatttagaatgcagccctgctctacacactttcagagttgccaagagtctaatccaagtgagttgtgaaatctggatgcttacatgggaaaatctgggtctaagctggaaaagggtacattttacacaaagggaactaaacagaaatttggaaaaaacaacctgaaaaacaccagagaatgccttgaaaacacttccttcccctggcctttgagaaaccagaagccatcgtcttccaagttgaaaaatcagtccagcttaagtgaaactgccttccttctgttctccagagcagatgattatcatatttgactattctcactcagagtctgttcagaacagcctggccagtgcaaaatccaaaaacatttcactctcagatagccgtttaaaatgcctctcataatgacaagactagacatggcaaatggcatttt

SEQ ID NO: 64605 - DNA, 1989 bp, Bovine  19866880432252
caagggtattctgatttctcaaatagtcaaggttgctcaaccttctctgaattcatcctgccaaaataattacttgtattacagagggtggtgttttttttttgtaacatggactcagagcaggttgaattaccttacctgtagtggggcttcagtacactttgaatcccaggtctttcccaaggggcatctccagggtcaggccactgggctctgtcattggccctggcttgttaaacaattttgttaatgaatgaaaaatagaaagaaaccagatgacccacagctgggatagttaatatgatacatgacatattcaagttcaaaatgatttatataggatggaatgccaggccaaaaccaacataatgaaattaaacagggatgaacttcaagtcctctgcttagctttggaatgtcaggcaccagggtaggacagacctggcttggaaatactcgtttgtttagtcaattccacgtatatttatcaggaccactgtgtgaaagatgctgtctgaaccctcaaagggagtctgatataaacatgatatctcaaaatgctaaaggtttggtagtgtttgggggaagggatatgcatatctatataaacccaaggtacacaatatgaagtgtcatgtaagtgacaagaccatggggctgggagactttctcagagacagatcatgctcagctggaggaggcttcatgggagaggttcacagtgtgcactgaaaaccaggaaaattctgtcttttctttttcagcaggtagctatagtgaaggagaaagaagtaacagtggtggtcagctaatgggacacgttgggggagtggggagctatgagtaccctaagtgacaagtgggcatatgtgtacactcatgtgcctgggtatgtgcccatgggagtggggagaggatgcaaccaggctgtgcacagaccagaaagacagtgttgataacgtgggctttcttcagtggtattgaaggtctttgaaaagtgggggattcctgggatcaaagaagcactggaggtctgttcatctggccccagggtgtaggatgaatggatgggagactggagaggccagaataccagttgagaggctaaaacacccgtgagacagggccttgagattggaaaagcaaagaaactgcagaataaactgaagcaaagattcacatatttggcatttgttgggaggctgccataggggtgggagttagaaagaaagtgatcagaagtgactgcattttcagaaagaagaattgtgctggtttgggaaggagagaggctgtgtttaggttgatgtcttctaggacattcccaaattggaaattcacaactggcggcgtggagaggcggtaggctgagacagcttcagtggtcttctgcacagattggtctctgcagctggcacagtgagaggccaaggcaaagcgaggagcaggccaaggacggcgcctgtgggtgtccctcgcgctcgaggagcccaggatggctaatgacagcaaagagccagttcatgtgcaaagtattgggagtcttagctaatcacaagcttcccataacctagtccttttttctttttttttaagaaaagactcaatcccaggctttatgtctgtatcccacaaatataggacttgaaattttttatcctgcccatgtgtcctcccgggactctgtgcggtcccatctcctttccccgagctctctctcagtccaggaacagaggccttgagggaatgggcctcagtgctttaggctgtaacctggaggtgcagatgtggtgcctgaggtacagagaaaagagggaaagggaacaggattattaatccattaggtaaaggtcctctaagtgctttcagtggcaatcaggttacaggtctcacatcagaaaatttatagacccatccacagcctcatgcggaaaggtctgaaagaagccttttcttattattatttttaaaatatataaagccacaatc

SEQ ID NO: 64606 - DNA, 1806 bp, Bovine  19866880892006
tgtgtgtatctttattcgttcctcttttgatgaacatttaggttgcttccagtcttggctatttgaaacaatgctgcagtgagtattaggctgtatgtatccttttgaaccatgtttttctttggttatatacccaggagtgggatttcagggtcatatggtagctctatttttagtttttcaaagaatttctgtactgttctccatagtggttgtaccagttgacattcccaccaacaggtaaggaggttcccttctctctacaccctctccagcatttgttgttcatggatgttttgatgagagccattttgactggtgtgaggtgatgtctcattatagttttgatttgcatttctctaatttccaggcaagagtactggagtggggtgccattgccttctccgaataattagtgaacatcttttcatgttcagcacaataagctttcaataagttatccgctttattattgttaagaaaatacaatacaaagactactattactaattcaaaaccaaactaattcaaaattctttagaaatggctttctaaagagagccatttgattagtggtagtaggtataaacagaatcactcggtatggggaggatgctgaacagagcgggcctgagcagcccagcaggtctggactcctgtgggactcttgacccttgaccctcagtcagtgactggaggggacactcccaaatatgaatcagtcccaggcccaaagggagcaggcagagggaagagcaggtggaagagagagatcaggccatctgcaagctgaatgtcaacaccccacccgggcctttcccagtcagctgttttgccctataaaacccaatagacttttcaagtaaagcaacttaactcagcctggtgttttcctttcttctctctgcttcaggacccttttggcctcatcccaatgagtcagtttctaaggcaggtagaacctttcttgtgctttgcatggggcctctttgatataccaaagattatggattcctgcctggaccatccctgggcagcaaggctggggaggacagccttagtgtctgaggacagctacagaaatgtgaaattcacagctacagctatgtgaaatccagatcagagcagagatgtggacttcacagcctgggcaggtaccattctatactgataggagacccatgccttccctgcctcagtggctccttgatgaaatgtgtctgaaagaagacagatatacccagggatgggaaatatgaaattataatgcattccttagctccaagtagaaactggaggctcagatttttaagtagtggattcatcagggaaggtctcattctttgccctctagttatactattccagtgaccttggctcagttcagtgaaccttaatgaaaatattcaagcctggtatgcccagagccaaccctggctgacacattgtttccatttttaccttgaggccctgttctatgtttatcaagccctcacagtgtcagcccattggtgttggtttactgatgcatcattcattcattcatttgacattatttattgcgcactgaatatggtaataggctagggggtggggacatgaataacacacggtttctgtgcttatggcagaaagaaacaagcttgcaaaactgtgggtatttgataagccttttgatgcactgtgtggatcacaacaactgtggaaaattcttaaagagatgggaataccaggccacctcacctgcctcctgagaaatctgtatgcaggtcaagaagcaacagttataacagcaggaacaacgga

SEQ ID NO: 64607 - DNA, 1817 bp, Bovine  19866880991260
tctctgagggcttcccccttttcttctctgggaggggtccagatccagaaggggcacctagcgctggtgaccagtgtgtaaactggtagcagagagagaagctgctccagatttcagttcccctgtcccttccttgcagctttgttatcttcagcgtctgtgctgctcagggagctgggatggccctgggggaagattgctatgttgggcctatgggaatcggatgttcgggatcttgccctttgctctatttcttagagtccacttaggaacaccaaaaaggccctttagcaacaagcagtttgtgggagatgaaattccacaaatccaaatgcatcaacccaactggggagagacaaagacagattgttacagggagcctgttaaacttcgcttggattccttttctcctcctcctctacctgatatacaggtgagagatggatcgactgataaaggtctccagaaaacgtgcgacttagaggtggagaggaagagagatgacagacggagaggtacttgagtttgcaacacttaagcgttgaaggcactgcctaaacagtctctgagggacggggaggaggggagtgggagaaccatttatccgtcagggagggtcctcattctccgcccaggaacgccgggaaaaccaggtatgcggcgaaagcaatttctttttaaatgaggagagacgggggtagagaggtacataaaagaagtaaatagaaaagaggggagataaaaagaatgagagaaccactgtgacctttagggcaagcgaaaagaaagaagagatgttaaaggagagagaggttgaggactgacaccgagcaaagacccgggtcctggaggaacttcacgagaaagaggggccacacgactgtcccatccccatgtttgggcagattaatggagtcgtggctccctcgcttgagtcctgccccgggaggggacagtatctgtttagatttgtgtctaaatttaaaccctgatcgccggcctccttccccagctccccaccctccccgcctcctctctctcccctcccctccctcctcctcctcctcctccttcctcgttctctagcgcggggctggggcggcccgcagtcagccctgcagccggcgagccgggcgtgcagccgctcacttgcgctgtgcccgccggagccgaacccggtccagacgggagcagagcgctgagcggggatcgagagcccgggacagagcgaacgcgcgctggcggcgctgagtcggcacctggaggacatggaggtaaagaagcccgcggcgcgcaagcagggtccgagcagggagcacgagcgaggctcagcgctgcggcactccggaggctagcccccggcctttcctaggggacccctccccggcaggcagggggtcggccgggaggacctcagggagaggggaggggcctttctagaggttcagctgttttgcttagggactcaaatgcttcagaaaaaaaaaaaaaagttaggtgctataaactttgtaaatggacaaatgtgtgagcaaaatttctgatttagaaatcagaagccgctggatctgcagagatgaatattgaaagagaaacagagctgttaccctgaggcacagcgtctatgggcttcccttttcgatgaaaattgagcttttaaaagtccggttgccctcttgcttctcaggtcccacttttgtctgtcacatctttcagaactttctggaaagctcccctcatgggcaaatggcactatttctgatcaaacttgagactttcctgtatgtccctgcatgcactggggtgtgctggctaca

SEQ ID NO: 64608 - DNA, 1165 bp, Bovine  19866881332165
ctctgccttgaccccaggacacagcttccgtcaccttctgggtagataaatgcatatcacctctcctgccaacacagtacaatgcgatggactccacacttgagttttgcggccattctgagctgcttctggtatcctcagtcctgtagggctttgctcccgctgcccctctgccccgaacctccctgctcttccctgttctcctgagagtagttttgtcatgaagtgaaagtgaagtcgctcagtcgtgtgtccgactctttgtgaccccatggactgcagcctcccaggctcctccatccatgggattttccaggcaagagtactggagtgggttgccatttccttctccaggggatcttcccgattcagggattgaacccgagtctcccgcattgcgggcggatgcttttaccctctaagccaccagggaatccccagttttgtcctacgggggcttttgctctccagccactagtccatttagggggccagggctgcacagccaagacgaaggggtggggcatggcagggccccttgtctgtcctgacccacccaactccctgtcaaccctctattctgagatcgctgggtcagcaaaaagaggctgagcctctgacaggcattctcccagttatcctggggctgccgtcagcccccagattcacccgtgcctgaggcgtgggcctcgggagttttccccgctccctggagagtctgccaccagcgccttttcccacagcaggctggtgccctgctatgaggtcccgggaggagtttttccccacccctgctcctatctctcttcactgtcccttcctcgtggaggcagtgatttccccccttatcatctggacaggagaggatatgagctgaaaaggaaccatgttccttttagttgaaacctctttaaagttgaaacctcaccatggccagattctggagtgtattttccagccaagaggcctaggtaaagatacaagcagttgtcagaatggaaccaggcctgccctccataaaaagagactgaccagttgctaccccagctgggagcacacgttttctaatgacaaaaactgtgaacaaattcagagctgatgaacaatgttttttgccccgtctttccaatttcactgccagttttgtcaaagtgtatttgtggac

SEQ ID NO: 64609 - DNA, 1190 bp, Bovine  19866880466075
agttctgagaacaagccagatatatctctgggaattgtaagaccccagaatgtcatgttaccaactctagtgcagaaatccttctgggaaattaacccaaccaggtttggtgagattcagcaattttcagcagttgacaaatatttgccttttatttcatgcgaacatttctagtaagagcatctcctctgtttggcacagagtaggtacgcaataaatatgtgtggaatgaatgaattttaactgttctttgtgttccaagttccttttccatgacttcatgattaagcgtctggcgcataataggcacaactgaaaatgcctgttggatgagtgtgcccttcaccatggtcaaagtagtaagattagggactttagaattggacttaacttgagtttaaagttgtgaacttgcaaagggcatgttccttaatctaaggctcaatttcatcatatgtagaatgggagaaataatacaaaattaatttcctacttcaaaggactatatgtagtgagaactatatgagtacaaataaaaacagttaaatatagtgtgtgactcagaaattaagttcaatacattttagttctttttcacttcattttcatttgtagtcacctcttctctattattacatccatgcaaaacaaaacaagatgaagtaataataatcacatcaaagcccatgatcgaattagaaaagtgtgtgcatatgcatgattcaccctgtgtgttccatggcctgataagatctggttatgttatacatgattatatatatacatgacatcttagacttttaagcctttaggaattaaaagcatatttttattttgtgagacttttgtaatctacatacatgttcttgaaggtgattcattagaattggataataatgatgtaagttattttaatagtgttaaatatgatgacatcactgagatccttccaggggaaatggtgtttgttttctaagagctgttcattgatcaaattattttcataacattcatggtagaggatgagggtgagaatgaagctggtgttaatagggaggaaatggaatgatctaagtatttaaaggtctgtcaagtcaaggctatggtttttccagtggtcatgtatggatgtgagagttggactgtgaagaaagctgagcgctgaagaattgatgcttttgaactgtggt

SEQ ID NO: 64610 - DNA, 1708 bp, Bovine  19866880534410
tcaggatgacattagcaagcttgccttgtttctgctttgcagaaagagtgatcacgggcttctatccttagcttgtgctgtgcccagatggagaagtcatggtttccatgcttgagctgtattgggccttatctggttgaccacaccttcttgcaagactcagtgaagaaggatcgtctgagtccaatctacagtcacacaaaacccttacactttctgtgttagtcactcactgcaggtaaagcaaggagaaggtttttgatgaaaagaaaaaaaaagagtggtttctcagtgctttgagttatatattgcctacacttcttttattcaagttctttatcttccatttgtctgagtttaccagtgactatttggcacgtgaacagtgggactaataaccttttcttgatagaacctactctacttttcactgcacagtggatgaatcaacatttttctgtgttgatggcactgttaagaaaccctaaacctggagctggagggaattctagtgtgttctttgagcttcctttgtcccctgagattgtgctctggcagctgcatactttgggacttttcatttgtatttatgactcagcctgactgcttcttgaagagagagcacaaatcattttgtcttgtattcctcttacctgtctttgtgcttgtttgagtggtggatgtatgagtgaattgattaagaataaattgattaataaatttagacctaatatttgatgttagtgttgtttataaatgacgttttaggtagatagcctaataatttgaagaaatttccttcatagaccttcagatgctaaataagagtgcttgtgataagtttaactttcctgcagctccagcttctctcctccatattacctatgctgcctgtatttgcctctctgccaagcctggagttcgtgggttgccattctgtcctggccaccataaaatccctgacatgtttaatggctgcaacccagctgtttatcttctcttccttgaaattctctccttcctcttcaaagttacacctttgacctgcttcttctcactgcttctttcagaggactctattctttcacctccccaaatactggtttttctaaagaatcagtctctttcttttctctcaatttcttttctctctttttagggaatcatctatcatccatcatctctaagcacacttgtgtctgttgccctgccatcattttatagtccacgtgtttatttgcttgttccacagtcctagttaggtgtcctagtacagttcagtcgtgtccaactctttgcgacctcatggacccagcatgctaggcctccctgtccatcaccaacccccggagttcacccaaactcatgtccattgagctggtgatgccatccaaccatctcatcctctgtcttccctttatcctcctgccctcaatctttcccagcatcagggtcttttcaaaagagtcaactctttgcatcaggtggccaaagtactggagtttcagcttcaacatcagtccttccaatgaacactcaggactgatctcctttaggatggactggttggattgccttgctgtccaagggactctcaagtgtcttctccaacaccatagttcaaaagcatcaattttttgtctctcggctttctttatagtccaactctcacatccggacatgaccactggaaaaactatagccttga

SEQ ID NO: 64611 - DNA, 1299 bp, Bovine  19866880719933
attcttttctgtggcttttttccctgataaaggcatttagaagaccagaataagaaaaaaatgaaaaatattgatcttctaaacactcatattggtttcagtcaccactatttggggtaagagagaacagggaggctacaatttgagtatactctggaattccaatgtaaaaagtcttcattccacatataaatttagactctgccttaattagtttctctaagaaattttattgagaaaccagccttctgtaatataacacacaaacactaatttttttcagtgtctactacatgcaagccacagtaaatggtatgtcaacatgacttttatagttagttttagttaattttatatttagtcttgaatctgacctatttttcacatgagtctgaccatgtatttatggccagtgtctcaggaagaattttcaatagacagaatcacagctccatagaatgttaaaagtgtatcagacctcagaaataacctagttcacttgccttattttacaagtgagaaaacagattccttgaaagatgaagtgacttgctcaaaaacacataacaattaagcagctgtaactgggaaattaactattcatacattcttattcttcttaaatcatccatagccattctttttttccccaattaattcattcactaaacagctgggaggggggggcgggtttccagtagtcacgcatggatgtgagagttggactataaagaaagctgagcacagaagaattgatgcttttgaactgtggtgttgaggaagatttttgagagtcccttggactgccaggagatccaaccagtcaatcctaaaggaaaacattcctgaatatttattggaaggactgatgttgaagctacagctccaatactttggccacctgatggaaagaactgactcattggaaaagaccctgatgctgggaaagattgaaggccaggagcagaagggtgtgacagaggataaaatggttcgatggtatcaccgacttgatgggcatgagtttgagcaagctccaggtgttggtgatggacagggaagcctggtgtgctgcagcccaattggtccaaaaagtcagacatgactgagcgactgaactgaactgtttttatatccaattggtacactatgtcaacgataatcctatatgtgagatagcaaaagaaacacagatgtatagaacagtcttttggactctgtgggagagggcgagggtgggaatgatttgggagaatggcattgaaacatgtataatatcatatgtgaaacgaatcatca

SEQ ID NO: 64612 - DNA, 628 bp, Bovine  19866880812772
ctggaaggcgtaagttacttggatcccttctgaagtgtgtaccttttcttctctcttccttcctcccttcatcttttttgcctgtgacattttgctcctcaccaagaaaggtaatgtggtttctttaagaaaatacttatagtaataaaaaatgactttaacagcaaaaactaataattgctaaggagccaattaaattctgaaagcgagatgaaactcttcttatttcccctggtgattttatgctttaaactcgcttccgtgttggaggaggaaaaaaaaaagagagagagagaaaatataatttcagaagctgacagaactcattgttcgagaaattttaaattcaaaaaagttaataaagcccaactataagatgaagggaatttgcatttcacagattaacaacatgtacagcaagaaaggcgatctgccttgccccaggtgataatttaagaaacctttgcatattttatttaaaactgggcccagtttggctgggtaataaaacagacagataatgattagaaggtcgcccctccagggcacacagcttgggccccagcaaataccaaacaatgaacccacaagcctggctggctgaagattagtctaattgcctgctgag

SEQ ID NO: 64613 - DNA, 1007 bp, Bovine  19866880854575
ctattctgaacctgcagcaatctggatttggccttccttatgtatccctcaccctgaattcttactccttatcatctaatcacagaagagtctttttgttgttagcttcttggaagcaaccaatggagaaattcttaatgcttcttttctttcctctgagccctcacttccctaattcaccaactgctcttcttttcatgttgcctaaagttccactgctcttttgctaaacatctttttctaagatactaatttacctagctctatgtcttattcacaaaggtctctacaatggcaccctactccagtactgttgcctggaaaatcccatggatggaggagcctggtaggctacagtccataggatcgctaagagtcagacatgactgagcgacttcactttcactttccactttcatgcattggagaaggaaatggcaacccactccagtggtcttgcctggagaatcccatggacggagaagcctggtgggctgcagtccatggggtcgcacagagttggacatgactgaagtgacttagcagcagcagcagcacgttttatgccgatctttgggtattctgtattgcaaggtatttcttagagagtttgtattttaaaaattttggtttttcccaaccagattgtgcatttctggagaaaacaactaccttaaattgaacaatgactagctttggcaacaacagtacaaatgagatgcatgtcaattagcatagctcttttctaccatagacattttgctgtagttaggtctatagtcttgaaatatgcacatactgtatttaaataaaacagaggcattaaacatatcctgtaatgcaaaccatgctaatacacaaattcagtgttaatactgtcatggctagtattatggagtgtgatctatggttctcctaataagctacctgatttttaaaaatggaattctttagtaatccttgctgacagttcaattccataggttttatttttacatacagttcaa

SEQ ID NO: 64614 - DNA, 2292 bp, Bovine  19866880889601
atggaggagcctggtgggctgcagtccatggcgtcgctaagagtcagacaccgactgaagtgacttagcagcagtagcagcagcaaccttagaaagaacaggagattcatcatcctttagtgtcataggtatatacactagaattatcttatttttattagtcccttcttctccagggaattgttcatggagacatttgttgcattgtagatgaggaaattgaggctcagaaagtccatttaacacatggtttattaaagttcaactctgtataaggctccacttggggcactgcacacattcagaatcttgtaagacaggggtcgcaaccacactggcgtttacgatgatattggagaaatgacctgtgtaaaaacaactttacagtaaaacatcctacatacctgaaactctgttgcttagcaagctcagctaccagaacacagtgatcaagtagtctgagcttaaactcatgacctaagcttacacacgtgatctataagccctttcttagagcctcattttagaagaaatctaaaagtcttggccctgatgtactagctgtccccagtagatgaaaagaataaatcagaagagatatttgagcctgctaggaagacctctgcagacaagatacaatttgacagcgatgaaatgttgacaacaacgatagctgtcaacaaggaggatacaaaatctattgaaattaacacaaggcaccggatgaaaaagcagagtctggggctacttagcatataagcaataagctcaacatataaacagaccctggtggtgcctcacaggatgataactgatcgtgactggtagagccttatgaggcagtcaacccacttggtagccagaggaacaacgtcgtatttggagtccttaaaaatacccattttctaaaatatttactcttgcgaaacatttctttccacagccatgtctaataatagaggtggtcctggagtgagaaacatttcttttgcagggacaataaagagttcagaaggggtatgagatcttgccttctaagacactcagtgttcgcctcatgcaagtgtggggagccactgtctctgtttagtgccctttgtgtccaggtggtgtgcatgcatgtgcacatgtgtgtgcttaccttccatgcagttatctgctttttccctctaaaaaaaccccacattggtattttcctcttcttggtgctctgggaatgaagaacctgtttttcccctcaggtgaaagtatctttaagttgttctgccctatctttgtttctgctctactttgatgaatgataaaattttaaaaaggctgatctgccttctgctattggaaaaaattataggtattccacacttgtctccataactgcagcatgagcagtaaacctgcactttcactgaacactgacaatctcattgttttgttcattttggtgcctgagcttgacgaagtggctttgattcgtaaggggtgggggagtgacaggaagaggcggccttgtagatgaaagccctttcaagcacaagaatgctgactggtgagggaggaaaaaaaaaggcagctggtttgagattttttaaaacatattttgccgaggagccagtgtgatgcaaatggcataccagagcatacacgtgtacactttttccagagacgtttacttcaaatactcaccacagatggtctctaatcaagaacagtcaggccagcccctgctggtgaggacacgacttccttcgggagcagaaggtttctttgtaaggcaggccccaaatcataaacatctgagagaacctgcagccagaggagctgctgccaccacgttcgtgatgaccctccgggtcccccaagccccagccctacaagcactgtcctgtagttctggcaacaggtcatgcttctgaaagggccagccactgctccagctccgtgggccattctcacagccctgctgtgctgggtgagctgtgtctgcggagcctacgttcagcaggcaacgcatcttctaggaggtccagcttctggaaaattacccatttatgactgagaaatcagaggggttcttataactcataaaaagtactgagaagagaggagatgatacaaataaacttgtttacaaaacagaaatagactcacagacatagtgaataaatttatcattaccaaaggggaaagggtagcagggataaattaggagactaggattaacgtatacacactactgtatagaaaacaggtaaccaacaaagacttgctgtatagcacgggaaactatactgg

SEQ ID NO: 64615 - DNA, 1476 bp, Bovine  19866881007271
acaggtagtgttcactcttgtatcctgctgtttcccgaagcgtctctcttctccccagtccaaggctatccattctttaggaagcaactgaagttcttccttctccccaaagccttaagccatccttctgggatactcctcctcccctgagctcttatcaccctcacagactccaccacacatcccagaatctgcattctgcagcctgctaggcaaacatcatggcgagactgcccttctctttacaagaggaagctgaatatcatgagaggtctggtgacatgtacagagtcatatggctcgtttctggcagaatcaagataaattcctgctacttagcatgtaatttcaaaacgtattttagcttgggttttacttactacagtggtattactcctgatccaaggaaactgaaagaaatctaaggcaagctacctatgcctccctataacacctgaaacacacacacacacacacacacaccccccacctcccttaccacaggacacaaggtaggaactcaataaatgcttgaaaattaatttgggcttattatcacaaaaagattaatcactgcaagacctgtgagcccctgttcacagtatctttgagtgatttggaaatgccttctcttaagatctttaaacaaagggagaaaattgtctggtttcaatgaactactgcctgaaggcaggggataggttggctttaggagtttcacttcatcactataatcctatgaagataagaaacaaggcagttgaaaaggagccacaatcacctgtaggctcgtgaagcctggccctgccacccgtcacgccttactcaacgcctttcctgtgggcagtactgttgcccagagaatgtccactgtatcccaacatccagggctcctcaaccaagtcgaaggctcagaataaaactgcaagtcacagtggttaagagatctgtttggggtttgagctttgtggcctctggcaatttacttaacctcctgagcctcggtttcccacttgggggtaataatctcccaaggttttatgaaagatgaactgaaataatacaaatgaagagcctgataagaacaagttctgggcatcatcagccacgagttcctatatgtgctccagagctgactcactttggagcagctggtcatttcagtttcacgatctctagaagagctctggagtgagttggtcaaatttatgatgggaaaggtatatttctgttggtgcaccaccacctacccgccagatgtcttgggtcccagacaaatagaggagagcattccaattcttgccagcagcttggggaagggctgtgatcagacactaactcttctgaaacataggctttcttctcttccatctctcaaaccttgcaggttcttcaaagggtttatactttcaggtagatcttattttgaatatcagtgttgaagttatactaatggattttttcccctttcttttt

SEQ ID NO: 64616 - DNA, 1232 bp, Bovine  19866881418582
ttgggggtgtcagaatgtgttataatttggattgaaatacgacagcctgtcaaaaaatttccacaactgataacatccccctgggttaatagacaaaattataagatggcataatttgtgtaatctaattcataaattccttgtcataaagtctcaggggtggtattttataaatattacagcactgctatataatacttgatcccttatgtttgaaatatctttacaaaatagtgagaagatgcatatcaattcagtttgataagagtttgtaggtaactgataatacatgacacacactcctagatgctgtgggggggggtacattagaggaataaaagttggctctcacttaaaaactcgctgtgtaaactatgtacacatcgaaaataactgaagatcattgcaaatcagtatactcaagtcctctataaaccaatgaactatgaaagctcatttggttctgtgatgcgataaaggctgaaggggtatttaagaactcaagatagatttgaaaaatggggagcaggacattctaggtggaaggaactttatgagcaaagtctccaagatcagaacaagaatttgatgtacacatttagctgttttatcacttaactactcactgtaggctagcctatttgtttgatcattatacagtttaaggttgtttttatagttatgtattgttccatttatgcctgcagtggattgttggcggacagacaagatgcataagaaggattgctgtgaaatataagtgaagaagtatggtaacaatgataataattaaaaaaaaattatctttcatgggctgaattatgtttttcccaaattcatatattggaagggaaaaaggagaggaagccatgaaatataagactgggtaaccttgggcaaacttatctgtgcctctgttcatctgtgtgtgtcttgtgtgtctgtgtgacatagacaaagagttcagtgctgtggggcagccaaagtaagggcacaaagctaatgaagacagtaataataggcacttttattgagtgtgtgctaggaatttcatgcattatctcatttagcaaatatgaataaccgttgttagtatcttagtttttacatataaaaaaatgaggctcagaaaggttaaattatgagcccatggccatgactagcaaggtgacaaagctgggcttctaaccctcacttttttgtgcttaaggaaactcattggccttaaaaaa

SEQ ID NO: 64617 - DNA, 1274 bp, Bovine  19866880360867
ggaaattgtatttttgggggtgtgtgcatgctcagttgtgtccgactctttgcagtcccatggactgcaggcccgccaaggctcctctgttcatgggattttccaggcaagaaataactggagtgggttgtggtttattttcaggaggggcattagttataaatcccacagttggtacatgccagctggcagtctttacagagattcaaaaagtacttgagaagacattctttttctttttgacattcatatatgttggacttgtgttaaacctagaagtagcaaccagaatcctttctagctcagttgtctatacaattaagtactcagtaggtgaaatttcatcaatgtgagtaacttcaaggaaagattatagttgatgcatctcaatgtcttctcactctggaactgcactcagcaattgttctgacagccgtcttacgattttcacacttgggttcttgacagtgttaagaattttattcacattcatactgagagatggcttacgtcccagcattttgtaattattttactttacctcctgcatcctggggtcatttgtgctgtgttcccccaagctgctcaggaatattgcaaatccagtagacttcatgctggtgaccctccgaatttaaggacttgagggataactgaaatcccagctgtcagtaactaagttcaaataagggactgggttagttagggcagaagcagatttatttgtcttctttctgtctgtggactaacaggggtcattcagtgaaattgtgctgtgctacactttcttcctctaaacaaaggttaataaaagtgccttttctctccctgcaacaaagtgatactgattaactagatgatgattgtgtaactcatgtaagtggtctggaaaaattcttaatgcaagtaaaaggcatgccaggagtttgttttctttagagcttagaaaagtagtcagaactatcaaggggtctattctgttcagttcagttcagctcagtcgtgtctgactctttgcaaccccatggatggcagcactccaggcctccctgtccatcaccaactcccagagtttactcaaactcatgtccattgagtcagtgatgccatccaaacatttaatcctctgtcgtccccttcagtctttcccagcatcaggatcttctcaaatgagtcagctcttcacatcagtggccaaattatttggagtttcagcttcaacatcagtccttccaatgaatattcaggactgatgtcctttaggatggttggat

SEQ ID NO: 64618 - DNA, 1577 bp, Bovine  19866880418278
attttatactttaaaaagatgaatttaatggtaagtgaattatatctcagtaaaactctaaaaaggcacttatgtttaataaactgggaatagaagaaaaacttatgaaaaacagaaggaaattgaacatagtaaaggatttttatcttgcacatgtaaccaggtgaaagtttcgttgcattcttattaactcatgcgttaaaaaaatggaaaaaaataatagaagtaaaataaaagtatattatatctattattatgaagccttgttctagatattataaccaagatgtatattgtaaatattctgacatgatatatatcatatttaaatgctgtgaaagagaaggacatattatattcagtgaagatggtttgattgtctagtgaaagtgttcatctctcagtcatatctgactctttgtgaccccatggactttatagctcagcagtatcttcatccatggaattctccaggcaagaatactggagtgggtggccattcccctctcctccctaaccagggaatgaacctgggtctcctgcactgcagcagattctttaccatctgagccaccagggaagcctatatagaatacataaaaattttatgaaacaaatagacttgaaagaattcaaaaaagaattctggatgaaaaggattaacaaagtcaacagctttcttatatgttatcaacaaacaaatataatgaaatgaaatgtaaaagagaactcaatcaaaataacagtctaaaaaataaaaatatttagagttaaattcatgtgatattggcaaagatgaagacaccttatatggatgtcagagatgggtaattgtaggaaattgaatgaaaacaattttgtgtatgcatatatgtacatttctctaagtagagaatctaaacagtccatcaaattctcaaatgagctaaagaaacaaaaaagtttatatatcattgtccataaagcagcagtatatagaatagtgtagtaaaaattcattgataaatgggtagtatagcttgatataaattggaaatgacagataaatggaatcataaagaaaatttaaaaaatatatatttggtgtatgataaataatacataaataattgatagatgatgaatttttaaacagcatttgagaaaagagataattatttagaaaaaaatgtagtcttcttttcccataaaccaaaatttcatattaaggactttatataaaaattaaatcttaaaatattagaagaaaatataggttaatttttatgtaggtgtaggtctttaagagaggcttacctggtgggtaagtggtaaagaagacttgtcatagaagactcgggtttgatctctgggtcagaaagatcccctggagaagggaatggcaacccactctagtattcttgcctggagaattccatggacagaggagcctggctggctacagtccatggtgtcgctaaagagttggacacgacttagcaactaagcagcaacgacataattgctttactatgttgtgttagtttcttctgtacaatgaagtgagtcagctatatgtatacatatagctgagtatt

SEQ ID NO: 64619 - DNA, 1941 bp, Bovine  19866880427112
agtgccgaagaatggatgcttttgaactgtggtgttggagaagactcttgagagtcctttggattgcaatgagatccaaccagtccatcttaaaggaaatcagtcctgaatattcattggaaagactgatgctgaagttgcaactccaacactttggccacctgatgtgaagaactgactcattataaaagaccctgatgctgagaaagatcaagggtgggaggagaaggggtcgacagaagatgagatggttggatggcatcaccaactcaatggacctgagtttgactaagctctgggagttggtgatggacagggaagcctggtgtgatgcagtctatggggtcgaaaagattcggatacaagtgactgaactgaactgaactgaactgattacagaaattatacatgcacaaataacttgtacaggttgcagtgccataaaaagacctttaacttagtaaagtcattaattttgcaactttcattcatttcttctctacaaaatttgcataccaccattagaacatgatgattccctaaagagaaaaatagaggaataaaataaggaaattttttaaaaatgctgacacagtctaatgagtttgactttagatattaagatatacttgacttgtacttttatttgcatttaggtcaaaatgttttctaatttctttttttgcttcttttctgacataccttataacagcatggtattgagtctccaaatatttagatattttctagagatataaagtttaagcaatagaaggggaaaaaaaaagatatactgaagtcagagaaggtattaacaatataaaatttttctatgactttgctaactggtctcaacagaaaaaccaatggagtaactatattagaattcactaccacagaagtttatagggaaataacaatcatgtattttatgtctttgaagagaataaatagtaatcataagtaatgatgaattcaatgacaaaatgcctgaaaagaagttgtactcttggtaattgtggggaagtcctaaaatggattatcttccacagacattaatcatcagtcatggtcatacagacatatataattttatatttaaactatatatataaattttatatttaaatttgtttatatataaataaatatatttataatatatatttataatattttagacagtaactaaggcagtcagagattggcaggagatgttccatcctgggggcttccctgggggctcaatggtaaagaatctatctaccagtgcaggagacgcagatttgatccctggattggcaagatcccctggagaagcaaatggcaacccactccagtattcttgcctgggaaatcccatggacagaagagcctggtgggctacagtccatggggtggcagtcagagaggacttagcgactaaacaacaacattacacacatggaagaatggcaatgctgacatgtcttttccctgaggatcttttctaagatgatcccagtggtatctgcttcctgctatccatgcctttgtgtaatctcctccccttgaaggtgggcttgatccagtgacaactgtcttctaacacaataaatatggtgaaagtaacagtgtcagttctgagactagatttcaaaagtctgccttccatattgctcacccttgcctgtggtcctcacaatggaagaggaaggaacctgaaggcaaggcactgatctctggtcaaatacagtgagaacttaaggtggctaacagccggatgagggagcctgggaacagatttcaccccagttgtgccttgagataactccatccctgcccctacatttgattgtagctttgcgagagaccctgagccagaagacccaattaacttgcatatgaatttctgttaaaatagatgcttttcataagaaatacttattaaattttagacag

SEQ ID NO: 64620 - DNA, 1145 bp, Bovine  19866880500246
tttttttgtctttactatgccctaagcaaacattacagaactgcagttttattttacaataaaaatttgagtcctggctttaacagaatcattctctgtatgtgtaatcattgttagtatgtgtaaccaaatagttagtaatcattcttagtatatgtaaaattatgtgtaatttgatataaatctatcttaagttatactaaacaaaaacaaacaaagatcctgagatctggatgttttacacactggcattaagaaagtatttatcttgcttggtctcttgggagcaggcagaaaagcaatcacaggtacttgtctaggtgtctttaataatattttgacctcaatgaggaaaatacctttctttttttcctttttagtagtgtgatctgtagcaattctttagttcagaaatctgagatgaaagtctggttcttatgtactgtaatagaaagaacttagaaaatctatcttatgctctcaaacagacagtccacagataccagagttcactgtcagaaatattgctttaacctacattttatatatatcttagtactagcaaaaatgatattctgtagcagtcaggttttcagtgattgtgatcatcaataggaaggaaaatattcaggtgtattgtcaaaaatcataaaatgaggctttgggacaaatgattttataaaatgaatgaagtaatgtaacaaatcaagtgtagctataaagaaagctctgcatgagatgattgagaaacactttaaagaaggggcaaagtctctcattttatttcattattagcagcacactcgtgttttgtaatttatttggctattagccagtctttgaaggattgtaattattcatttcaaatgtgtaagtgttggaaatgcttgagtagtttacactgacattctctcagaaggcttctgatataattgcctttcctatgtttatactatacgttacatactcatttatagaagcttctttggcactggataaaatgtttgaggtcagcattttgtttctttgttttaaacatatttatttggctatgccaggcttctaactgtgtcacaaagaattttcgatctttgttgccacatgcaggatctttagttgtaccatgtgaactcttagttgtgaca

SEQ ID NO: 64621 - DNA, 1036 bp, Bovine  19866880787088
tgagaaaactacaatttacttctattttactaatgttttaatatcattttacatctttatttacatgaaaaattggtatctcttaggcagaatgatattttaaaatacacagatgctgcaaataaaacatctcgtggctgttcaacagaaacataaggccactgaaatatattaatttttcagtacacatgtaaatgtggctaagcaaaaatttggcagaagaacaaatattctcacaaagaaaatacaacacagtaaaacataaacacaattaaatgagccaaattataccccatcaatggatgagagaggcgtgccattgactctgtctgcatggcaactatacagtcaattttctggattattagacaaaatatgcacaaaagcttttggatgattaactgtgtataatagaatcctattaatttagccaacattcattgaacacctatcatatttcatgcactatgataaccactggaactaccaagatgaaaagaggcacagtccacacacttagaagcctgacaccttaagtcttttctttactgtgtagctttagatgcattatagatcagcttacatttcttgaataccaagcaaagtctgatacaacatgattcgtcaaagttcagcaatgctcttgccttacacaagcatgtaaagacgaaattcactttacagtctacgacatttcagcaatatatagacattaaaaatatatttcattttaaaatgtcttgttcattcatttatttcgctcaaaaaatatttatcaagggcttattctgtgcaacattctgtaactggagacacagcaatgaaatatcagcatactccttgtttttcagaactgtaattgtatattattcttttcacaataacaaagctccttagagccttccatctggacagattatttctttgtttccctgctgttagagtctgcccttctcctgagaatatctacgcttcactcatctccactcaacttattggctcaatctttacttccttgtctacccaacaaggaagt

SEQ ID NO: 64622 - DNA, 1331 bp, Bovine  19866880797547
taggagattggtgctgttaagcgattttcttggaagaaagcatgaacataaaggaataaaagctgagatataaagataattctcctttttaatgtctccatttcaaaaaatattggtgatcttttagattttaagaaatagtgccatgtagaaaacagtcgaagtaattaaaagaggatcattacagagcagcatgagtagtttgctttattcactgatgatccaccaatttaaaaaatgctgaatagaaaagagatttaagtgtttacattctctaagctgatattattaacagctcagaattccatttatttaaatggatgcaataatcagtattaaagggatgagctgtttcatgattttcagggtttatctctttaaaagaaggatccatctgtatgttctaagattttaattatttgttccttgttaatttttaatttctatcttggataaagtcagattgactctttcaggtgtacattgtgtgttttgacaaatgcagagtgatgttcagttcagttcagttcaacagctcagtcgtgtccgactctgtgaccccattgcagcatcccaggcttccttatccatcaccaactcccagagcttgctcaaactcatgtccatcgagtcggtgatgtcattcaaccatctcatcctctttcatccccttctcttcctgccttcaatctttcccagcatcagggtcttttccaatgagtcagttcttcacatcaggtgtattgtctgtcccttggtagccaaatcatcctcccacccccacaataaaaccttgtcaactgctgaaatgttctctgtccttacgattttgcctttgctgtattatataaatgtaatcatacagaatataaacttttgaatttgggttctttcacttcaaataatgaattggagatttacctatattcctgttttttcccttttaatactgagtagtgttccattgtatagatatatcagtgatttgattattcattttcctattggaaacaaaagactctttttactttttttttttttcagttttcagtaaagctgctggaacattcacatgtagatttccatggtgagaaggtacaatcatagactttcactcaacccaggctcctttacttactgctgttgaaaatatttaacaggctaacaacagagtgtaaaggtgatcccttatatgtcaccatctcatccatcaaccacttgactatattagattatctgtccttagtgatgtacacattcatctttggtgaaatctgcatatattctgggtaggattgtctttttgcacttcggaccttaaccagtaatat

SEQ ID NO: 64623 - DNA, 1867 bp, Bovine  19866880826510
actttcactttcaaacacaaaataattaaagcaaatttaaaaatccttttaaaagaatagaattttctttacagaagtaagtagccttaggaaatatggagctgaccttgttattttattgttgagagaaatgaaatccagtgagattcaatgagctgttgagttatatacttcagaatggaaaatttgggccccaaatctggacctggtgcatcggatgttgctctttgaactatgttgaagttttattgttcactaaggaacgattggcaacagatcgaggtgatgaatatgaatatttatctttttaccagagagtaagggaaccaaaggatctgaggtgatatctctttttgacacttactgcttgtcattggaacttgtcctttgaataaggtatggggatggcaatatatagtttaaactttctgcctcttttttcagtcaattcagatgtagtcatctgcctttcctgctacacattgggtttggtggaaaagcatgtaggtttagtatgatatcaaccaaaattctaccaaaatgcttatgaacatttaccatgactaaaatgcatattaaaaatttaaaagaatagctgctgctgctactactaagttgcttcagtcgtgtccaactctgtgcgaccccagagatggcagcccaccaggctctcccgtccctgggattctccaggcaagaacactggagtgggttgcatttccttctccaatgcatgaaagtgaaaagtgaaagtgaagtcgctcagtcgtgtctgactcttagcgaccccatggactgcagtctaccaggctcctccgtccatgggattttccaggcaagagtgctggagtgggatgccattgccttctccaaaagaatagctaagaccatcctaaaatagaatacatttgtgtttcaatatttatttttcaaactaaattagtacaatgagagacaagtaatctaatagagtcaagagataggcatacacaggtacaatgactgttgctttatgataagaaagtataactgaaaaatagtgaggaaaggatgatttatctcaatgaatagtaatgggtcaactgtatatataaaaaaagagggggaaattcttaatcactgtttgacacaatagataatacccaattcctgattatatgtctaaatatgaatgggtaaagttctcatataatccttgaagatcataatggagattgttaatattataaaataggatataagtatcactaaaataagctatgagtaatattatttcattaaaattaagaaattctgtttatcaaaagacactactaagagagtgaaaagtcaagctattgagtaggtgaatacatttgcaacataaataatgctcaaaagtattttgtccagtgtatataaaaatcttgtacatattaataaaaattagacagataatccaacagaaaaattcatgagattgagtaagctcttcacaaaaaaagatatccaaatggccaataaaaataatagaaggtgctcaacctcattattcaacaggaaaatgcaacctctatagaacatcctatacattgtaataatgactaaatattaaaataatgttaatatcaagatcttacaatgatgtggaacaattccaattctgatgtgattattaatcattaaattgttttagaaaactactaagtagtgtcttctaaagtttacataaatatatactgctactgctgctgctaagtcgcttcagtcatgtccaactctgtgcgaccccatagacggcagcccaccaggctcccccgtccgtccctggggctctccaggcaagaacactggagtgggttgccatttccttctccaatatatgaaa

SEQ ID NO: 64624 - DNA, 1771 bp, Bovine  19866880857670
ctgaggcaggaaagattttatgactcagactcctttctttctgcccttcgtcctatctcacctgaagtggaacagaatgcctcagtacattttgtgacaacttatatagcttgatgggttagtttgctcactgagtactacagttgcaataattcatacttcgtattgtcctacaaacgtcctggccctgggctccgctacatataacactttttcacatgaacttccaaggccaaatctatcttcaggtattcaaaagcaaacccgaccaaaaataattaaacaaatatacatttgggattagagggtacataggagtctaccttttcagagaaaaacattgtcttaactgcgattacagtcaagttgcaagttgttacccagtcagtgccagctgtcacattgaaaagattttattttggtcctggatcatttccattcaaataaataaatcagcaaacacattttggtgattctatttttttttttttaagtaagcatgccataataccaccaaggttgcttagcaacgatagaatagtgagatggcaggactgaaaagcccaatagaataagcagttatatttacagtcttaacagtgagaagaattgtgctggtttggtcagcctatagacctatgaaatttatagcattcattgttgaaattgtggacaagttttacaacagtatccttagtcatcatgtccagttgtattatagctgaggaataccatctgctgacttcctccatagtcattcattatattcatctcaggctttttaaagatttcagtgagcagtttaatgttagatagtgcataaaaaagattcaagtagatttcccgtatccttttcaaacagttaccgttttatgaccatttgcagaatttgctttgtatttttttgtttttgtttcatgaattctttctcagttaatttaagtggaaaacaacgcatatgttttaacagatatggttgaagtttgtgtttatgtaaaatcaagaaataaaatatcccagctcagttgaagtaacaactgttaaattaagtattaaaataatttaatagataatatgtttaattatttttgatcagaaagtgatcccttatttacagtaagaaatacacatttggggctttataagaacagaatctaaatgctctatgagagtttggattgtgggtagctaatacattcactaattcattcattaaataattattgtatgctgttatatactgaactggatactaggggaagagaaataaattagacctttgctatccagaaactcacaccatatttagagttctaattttaatatattaaagggatgctaatgtagaggtacacctaagagtttgaaaatacagagaaagtaatagcctttggagacatccgcatagacctcagggagcagctgtcattgttctagatgttgggcagaaactgggtttcacaggaagagaaagaggaaagaatctgtcattgagtgtgtttggatagacagtgtggaggtttacacagaaacaggcatttttagggatagccagtgtgacctctaaagagtaaatccattccagctggtcttgtaaagaaattcattctgaaaaaaaattaaatgaaataatcaatatcaataatagatgtaaagggcttgacttttcccaaagctttgatacaactagtaggctttccttacaacccttatttgtccctcgctaacatcaccaaatactccaaacacacaaaatgattcatacaatatg

SEQ ID NO: 64625 - DNA, 719 bp, Bovine  19866880939965
ttatttcccttacaaataaaaaaggggttgtagcaatgaagtttttattaaaccaactattttttttcaatttattttttaattggaggtaaatttctttaccatgttgtattggtttctgccatacaatggcagtgatgcaaatcagccataagtatacatatatcccctccctcttgagcttctctcccaacccccattcccacctgtccagtcatcacagagcatcaggctggactccctgccttatatagcaacttccactagctatctgttctacacgtgatagtgtatataggtcagtgctacttcctccattcatcccactctctcctccattaccaaaatgaatgaagatagagggacattgtaacttcttacatatcatgcatgttgcattctggaaaaatcgctacttactttgtaagtttatggtaaaaaaaaaaacaaaaaacctaaaatattttaattcccgagagtaacaatttttagtatattttacttttgtgttagaaagagtcctgtttttccttaggagtaatcttttacataataaaatggccttcaggaattctaccaatgtcattcacagacacaaacaagtcttctttcagaatgagtcataactgtgacattgaaaactctttggcttatataagcatatttattgtattcattaaagtaaaattccattccctttgctctcagttccatagtcc

SEQ ID NO: 64626 - DNA, 1150 bp, Bovine  19866880956557
atggatgtcttctgagattgcggctgtactctggtggaaagtcaagtctgtccaaagtgaggttgcagttgacagcccaaggggtgggaagaattgggctaggaaaggagcttgtgtggacagagcagcatccatacctgccttaccacctttatcacactggtggcaggtccagcctagccccagaagcaggtatcagaccttgttggtgaggaggggcatgaaaatctgaagtgctctatgggaccattctttggcccttctctatgccactgctgtgtatgtcggagtctttgactcttcatctttcattataatttatagtgatcaaatgttccagggagaaatgatatattgaattatctgttaacattcagtgtagaacatttcataaactgtgggtcaagaatcactagcatcttggcagattgatgtggattatgctgtttcccctttcaccatttatctatctaagctgtggactttacaaagcagacactaaagtggagatttagtaattgccacattgcctgtgatttttcagataatggaaaagggaaaagtcatagaatgtaaagtaaggaaaagctctgtgacactttgattttttaatagttttgttctgaaaatcatgggtcattaaagtttgtagttaatactagaaaagagtctggctttcattatgaaagagataatttattcacatacagaacaaggttcattgattaggagtagtatgtggtgagttagaataaactttgcttccaaaactaagttcagcatttggaaaagtttgattgatacaggagaaacaaggtattatgttttaacctaatcacttaacaggttttttttaggcaaaattgagatgtgcagacaagatgattctaaagatgagtaaatttttagctttttatattaataccaaagtaacaggagatgtctacatatagaagttgcataagtaatcgacacatttctgtgaaatttattaatgacttaagatgcagaggcatacatgtaaaattgaccaacatttatctggaagtacaaaattaatagctaatatgatctggagtagaatcaggattcagaaaaatctttcaattcagttcagttcagttcagtcgctcagtcgtgtccgactctt

SEQ ID NO: 64627 - DNA, 1008 bp, Bovine  19866881084215
ttaatgtcagtattactagtggattcttggcaggaaagacatgaatttatttactttttttaagattatttttataatcaagaagttaaaagttaatgtaatatcctagagctatcatataattttttgaagaaactaaaatctataaaaaggaggacaagcaatcaacattgcaggtaagaatatactaatgaccttaaaagtgctctatcactctatcatgcacttgaaaggaaatactcggtgcacttaaaattttagtgttagttttacttgagataatgttttggttctatatatatttgtgtatgtttatgcatgtaccttttaagaagtataggttgtacatggttttgttgaagcatccaattgttgattggatggattgtattctctgcttttagtaatgtccatatccttcccactaatttcttgaacactcctttccttttcaagtgttgaaaataataatccttgcaacagtaatatttaatgagaggtgaaaagaagcaataggaaaacagtaactgttctcacaagttgttgggatctcaatgccaaaaacttatttaatctatccaatgtgacttataacttaaaagcagaaaaattgcttttaaatatgtttttcaccctgatatgtatacatgtgtgagtgcttgagcttttgtcttctttttttatccagctatctgcatccttgtttattaaacttcaatcatatttcagttccatcagtcagaaaattcatcggcatttgtgtgtaactccctgctattaccagtgacagctttttcccagtcactacccttggggattttttaccaattactccctctctagtagaggcaattttaaaatcactagaatcttttaaaatgaaacagttggcagtttcaggcagcagtagatttgaagtggggttgtggggaggttttccaggaatgctatcaatgcctggggcaatggtctcagagattaactagatcatagctgggattctgaaca

SEQ ID NO: 64628 - DNA, 1238 bp, Bovine  19866881142940
acacatacccacagtttttgagattttaaaatacatttacattgcctagaacttcactgactataaaatttatttaaaattgtgaagcatacaaagcttacttttaattcaggaatcttttttctttcccctccagtagctaatccacattttctaaccatgctcaacagtacaataggtccagtgtccaggccactgtagcagacagaccagctttgagtgcctgtttactagttctgattctctatgatcttagaaaagttacctatcttctcatcatcatatcaacagaacaaaacaagataaaaatatctaatttacaatcattttacatcttaagggagataatgaatggaaacatgtctgttataaaatcatcattaaacatatgtgaaatcctttatcttttggcactctttgggattttacattttaatcttgaaatttaagggcaaaattaaaagccttgccacatgtgaaaaatgcttcgggactcaggatgtaagcagatggaggaaatttggaaaagggagttaggagggtcttatctgggacttctaaatgcaatcataaagataattgtttattctgccatttcgggaaaccatatttatgtatctgatacaggttattcatattgcttccctgattggcacacgcacacatacaaccacacacacacacatatccatatacagataaaattgggagtggacaggattcaactatttgttttcagtcccactgaccagttttctgagattcctctaatttctttacagccttgagcaactgaggtagttgtattttctttcctggtttattactcatgttttatcacctgaaatacctctgggaaaaaaaacgagaggtagaaccttatttttggtagtatagtttccttccaactaaaatgaaacccattgctcaaatcccagagattgcataaacacagaaacttaatttcctgcaggcattcattcatttcagacctataacagtatagtgtaaagaagccatccagaaacttaccatgaccctcgaaaaagtcagcatgtttgatgtggaaaaagtactgccctttttatgaggtttcagttacttctactttatgctttttatttatacaattattcggtggaaagaaatggtagggaatttttaatcatggcaaaacatagtagtttttaaaagtagctttttcactgaaatggtaaggggcggatttatggggaaat

SEQ ID NO: 64629 - DNA, 1893 bp, Bovine  19866881218477
gaataatcatagtatgtaatttatatggtctatcttcaatgtttttctaatggaattattcaaattctagtacatgcagagaatatttatcacacaaaggaaaagtctaccagtacactattcaaacttatgaggctaaattcgctatattcactttgactgttcctgggtgaagagaataatacaatgaatcatactttcctccctctatttctccttttcacgttagatggttttgtcacgaaaagctgagatattggaaaataaattcagctctttcctgtactctgtatctcagagcagcacacatacatttttctagttcttaatttttatcccttcatgctgttcctaagctgccctttcccgtgataacttatgctaaagaaaactgcattatttagtgatattactcatggctaccatttactaaggacttgatatgtgaccagagttgataccattctagattattctttgcttgtttgcccagtgtaataaaaatccattaaataatacagaatctctgtttcagggaagaatggatatgaaaccagtgaaaattcaaattttttctatgataagcaccacagtaaaacaatacaatgaaatagggtagctattttattcctaaaatatagattatgattccactcactcttctgttattctgctgaaatacttttaaatggtgttataccaagacataaactctgctgagaatcatcagacatgtgtatactataaagaagtcacacacttcttgtttccataacctttatggctaagctcttttaatcaagcctataacatctattctctgttttatattgctaattgtcacaaacgtggtataacactcttacccatcagtttagggtttagaaattcatatgggaactctgggaaaatttagtgtcacagaattcattgatgaatttcaattttacacaatacacgtttaaaagtttacttatgagtaagtttgtgcctagcaataattagtctgtttgactgaatgataactgaattagctaattatttgaatatattaaactgccaagcttgagcatatattgatacaaataaatcattcttaagttttaaaatttatttaaatcaatgtctgcattatattgcttcccaggtggcgttagtggtaaagaacccaactgccaatgcaaaaaacgtaagagaagcctgccaatgcagagatgtggcttcgattcctggtttggaaagatcccctgggagaggtcatggcaacccactccagttttcttgcctggagaatcccatggactgaggaacctggtgggctacagtccacagggtcgcaaagaggcagacatgattgaagtgccttagcagcagaagcagttgcattaatttagttgacaactttgaaagacatagactatattgtaaaaatatttcgaactttattaagcaaacaatggaataaacttaaattctacctttaaataaatatattcattgcttactaaaaaataaacagttttgttaattagactcctctagttggtaaagaatccacctgcaacgcaggagaccctggttcgattcctaggtcgggaagatccactggagaagggataggctacccattccagtattcttgggctttccttgttgctcagctggttaagaatctgcctgcagtgcgagaggcctgggtttgattcctgggttgggaaggctacccactccagtattctggcctggagaatactgtattcttcatggactgtatagagaattttatggactatagagcccatggatctcaaggagtcgtacacaactgagcaacttgacattctttctttcaccctgaaactcaattcagttttacgtagacttgttatacca

SEQ ID NO: 64630 - DNA, 2410 bp, Bovine  19866881445037
tgcactggcaggctgattctttaccactagtgccacctgggaagcccatcaaaggcacaatatatttgtcaaaattctagataaatatcttatttctctggaagtacaggctaatccactactactgtgacacatttgttcagtcacttttctggtaagaagttgacttagtgactgtttactgtttcattctgcactgatacatcctcctttcctcctctccttttcatttgtgtgtgtataatacagtagagcataatttcggtttactaggaagtacaatgagcttcccaggggaaggtaatatattactttgacaaacatataaataagtgatgtaattatttgtcatgagctggtgaactcaccagttgagtgttagaaacaatttgaatagcataaaatttttgaatacagttcttgtattcatgattgcagctaaataaatgaatggattctgagtttggcatgttaccggaaacttaaattggggtagaattacctagttaaacttaatcattatgtcagtatttttatgactaatgacaattcagattctgaaacttagcatactttcagagaagttgcaatggctcatcaatctctgttgtgaagtattaattagtgattcgtagccatgatgtattgcctcttgtgaagaactgaggagtcagggggagagtgtgtagaataatttattctctttaaaaaatcaagtaaagaaagaatcaatatgggcagaatctaaaattagtattagaaaaataaaccagtttttctttttacattttatggagtgccttaaatttaacaaatgttaaaaatgaagtgtcagtttaccaaagtaagtacctaacctcatatcagagtagtttaaagtgactgaaacctgagaaatattcatccctgatggagatcttgtgaataaatgcaacttttttttttttaagatatgtatgggcccaacctcgtccaggtcatagccactgatcaaacatattacagttaataaaataatgtttcttttcggagacattatatttaaaggtaaagtgttctgtgaactttgcttattcactccaggtttttcaaaattcaatattaattgagatattgtctttggtgacaaagacaagaatgactaaatttcagctccaatgtcatctgctctagaaattattttttgatgtttcagtcatgttctaatatacctatcatacaaataatagttgactataattgcgtatttttttgttagctttttttttttttaattttactgaaatatagttatttttaaattgttaatattttccttgggacagggtggttttttacatctttgaatttctaggacatggcacagggcagtctagtaaaacttatttgaatgaattaaagcctgatagaagaaaatcacaataaaatatgtcattgttagatagagccttgtgcaaaatgctataggagctcaggaaggaaggttgcagcctcggtgggactggggtggggttggggtggagaaacatcataaagaaggttgaagttctggtttagtaagtggagttctcttgtgcaggagaagaggggaggaaggcaaatgtagagaagcattttataagcatgaattagttgtgtgtggctgaggattgagcgtgaggagagtgaaagaaagggaagatagttctggataagttgcctaggaacaaatagttaaagggtttttgtataccttgataaaaagtttaggctttattaaaaaaaaaagttgaaggataattgttgaagagatttaaggaacagttggtattatcatactgttaaggaatactgatttgctggagtatttaggacagaaaatattaattccttagaaggttgtttcaagtctcagtcaagaaatttggacagtttgaacttcagagagcctacaggaccagagacagcatattcatgaagttggttaagagattaactgagcggctatgactaaccaatttcaagttatgtttaaatttgtttaatttttgaccataggatcatagagaagatcaggcattcaagatgaaatgtaagggaaaagtttgtaaaatagttgatgctgatgaaataattaaataaaggaatactttgtatattcatcttttcttctgacatgaagagaaggttgatacaagagtatcataaattgtagagtttcttttcctttgctaagaaggcaatatatcacaaagataatgtgtgattattttgcattggatcaagttttattattttaaatcagatctctctttgaataaaatgtaattattttgatcattacacatttctgggccattatggacttcttgtacattttcaaaatactataaacaccaggactaagctcctgggggcagttttctcaaca

SEQ ID NO: 64631 - DNA, 1105 bp, Bovine  19866881503503
cacatgctttgaccacctgttaatttgagggggaaaagggagtgggagtggagagaagagtcacaggagcaagaagaagaaagaaaaagcctgagaagtactgcagtagagtctacattgataatggatgtggactgagataaatgtgatacttattttcataaaactttatctttttaaaactataaacaaatatgaactagaagttctttctcatttttatccatatttcagttgtttctcatttcccactttattcttaaaataatatccatgttcttagcaatattaagtatgaggtaaggggacccgttcaagatcctttctatgatgctgattgttgctattgttcagtcactcagacttgtccaactctttgcaacctaatggactgcagcatgccaggcttccctctctttactgtctcttgaagattgctcaaactcatgtccattgagttgatgattccattcaacaatctaatcctctgttgcctcattttccatctgccctcaatatttccaagcatcagggtcttttccaatgagtgagcccttcacatcgggtggttaaagtattggagcttcaactccagcatcagtacttccaatgaatattcacatttgatttcttttaggattgattggtttgatttccttgcagtccaagagactttcaagagtcttctcccaataccacaattcaacagcatcaattctttggcacttagccttctttatggtccaactctcacatctgtaatgactactggaaaaaccatagcttgactatatgtgccgatatcctataataaaggctaggatacagcatctactattacatattctctccttttcatttttttattcttcttccttttaaatatttattgttaaaatgcctctaagttatttttataacttgccacattgagtaagtctgcttaagatgaggcttgaaaggtgtagttattcttaatagttctcttgagccttattggtaaagtcagtattgactttcttttctgatgatgtaatgagagcttaatgaaatagaacaataatgataaaatatctaaattctccactatgtcagaagcagtcag

SEQ ID NO: 64632 - DNA, 1091 bp, Bovine  19866881799007
ttattgtttcaccagtagttttatgcatttattctttttgtttgtttgtttttagtttatattgtatctcctgcctcgtcttctcactagagccagctgttgagtcagcagtgtgtaggcaactcaaggaggacatgattactgagatttcttttatgttctcctccagggcagccacctgctttgtcattgcaaaaaaaaaaatgactcatgtggcagcctgacaaatacctggttgctcagcatagccttctgtgagacacacttgtagctcggctttaaaggagggttaaaatgaagattaagaaatcattgaaatatccctgcagagcccagctaaaaggcaaagagagaccttcacattataaataaaacattagcagagtcagagcagggcgttgggtttcttttatgattattatacctaaatgatgcaggaaaacaaagtaacaagataaaaatatatgtcaaagcagtatctgattccctgacgtactctctgacccaacagtcaaaatatttcagtcatgtttctttgtagtttaccctttgaaccagaaaagtttcagttaaatctgtgtcaaaaatcctagtttagttagcacacacagcgtaattaacctgaaacaaatcctcccttctcttctgtattaaaggctcacagagctggtttctctaccacctagaaatgatactggaaattgtcccatttaactatttctgggtaacacactacctccagactcaaataatttaagactcaaaataattattttatttgcttacgatttgtgggtgggaattcaggaatactctgattgggtggtttgtctctgatcctgggcactgacagctggctatctggggctggagaacacaattccataatgaccccatcattcagatgtctggtgccccaattttcattggtgtcttgttttctccacaaagcatatcctgggtctatccatgtggctgtgcttctcaccatacggtggtctcaggataggtggccctcttacccactggtttgctttctccagagtgagtgctgcaataagtctagctgaaagatacacacatgctcggtt

SEQ ID NO: 64633 - DNA, 1011 bp, Bovine  19866881900610
acctattctttcttgttcattttataatcccgagacagcaaacatggtcacttgagaataattaaaatttcaagttacttaatcccatgaggataaacatttttatcatctttatctcttaattgctaacaaatgttcttgaaaaaagcacaatgtgacacaactaatttgcatatactgaaaaggtagcgagtttttaaataagtcattattttgagcaaaacaaattactggcatgggttgtactcatgttgtctacacaaatacataacaaaattgttaagttttgtcagtgaatctgttcatgcctgtgatcaaaagctgtagcaacttgtcagactacttctctatttccactcccaaacaatgactttaatatctcttttggaaagactagaattaattaacttcataagtcaaccaggatccttattgctccattaaaaggttacatgaaccctttatcttatgtttgtaacttttttaaaaaagggactttgaagaaaaggacattaattactaaacacaacaaaactcaaagaagaaacttgtaaagaaaaaaaaaaaaactcttaatagaaatgctttgtcatgcactgactagtagttttgataaggattacctgtaatgagaaatttctacatagtctgaaatttaaatttatttgctgtttgattgcagctgtataaattcctccaagccccccacaacccccatgccctgccatccatgcctgcctagaatgcctgtgttacattctgaaagagtgtcactgaaattcttcaccttctactaatagataaacttatattgggagctggtgattttttttagcacagaaagtgaccctggaaatctattttctgatttacacataattaatttgcaccttaatgatgagtaacacagcatggcatctgctattttcagcagtatactggattagtctcatgactatcattaaatatttaataatgttatatgtttatatcaataaataaaaatttaat

SEQ ID NO: 64634 - DNA, 1820 bp, Bovine  19866881935272
ctattgttcccactcaaacttctcacttttcttctataaagtcccaaatgtataaaacatagcatttcttatacttttgtaccccacagtaggtaattaggtatgcatcctaaacaagtgttagaggttgaaagcaactgatacaatttggtaaaaccgtatctgcatatctataaaagggccttttattatagaactttattttcaaagcaggaataaggcattgttgttccaactgtgtctccagagtattttaattcttctatggttcttttattttcctttctggtttcctttgtaattgtctgcctcctctctggtggaggccaccagagactgaattagactgtttcattttgaaggggatccacactcaatttttaatagcagcttcttcagttcttgctagactgccagggatcttctcaggctattacaataccaccagcagtgacacatagcatgctctgcaggaatcagattttcctgctcagacaaatcagatttttctcccactttatgtaaaattttatgtttttctatgccatctttaaatatatgaaaacatattcatgaaataatgtcatgtgtaagcagaaaacgatagcctaatttgggctttaagtattcatctcacataacacagcaattttcagcagtcatctttgaatgacacatcgaggagtctcctttgtcagagatctttcattagtaaatactattccattgccacctgaactgtttcttgcacagtttgcatagacattgagtctctcttatgcattaatgaaaaacaagcatgagctattcataaagattaaccactggcagcatcaaatgcaaaaacaattttttcccctgctgttgatgtctataagagggtctgctatgggccaaaacacagaattgttcttaatgttgacaacaatgtagtgaactgacttctgaagaaacgggcaatgaaaagaagactcagagaagaaaatgatgaaacaacagctggtttctctgtggatgaaatctgtctcctccaagatactttttccgcccacagacatatatattattgtcattactgtaggctcataaaaaacttagcatccaagaggcttatgccattacatataacaaactacataaaaactgtgcacttctgtttactaccaacaagcagttaggggataaaatttatttaaaaaatgccattgaaaaatcatacattatgtggataggcatataatgaaagctgtatacatcgctacgtagaaaactgcactacattactgaaaacaatttaagaaggtataaatagttgatgttcctgcattgaagacacaattgtgtaaagatatcaagtcctcttaaactgacctttagataaatataactttcaactcaattttagaattttttaaaagaaactagcaagtttaatttaaaatgtatatgcaaaatgcaataggcctagactagacaataagatagtgaagaaaaagaacaacacttgaaaacttttctaaccagatatcaagatttcttataaaattttcactaaagcactgttgtaatgtcacaaggctatacagagccataatcagcatggaatgttcagaaactgactcacccatttatgaacactgggtttctgacaaaattggtcccataaaacagagggagaatgacagtcatttcaataaattaaactgagttaaacagtaattaaaaaaaataatcttgattcactcctcccataatccacaaaaacatcacctgcaggtggattatagattgatagatgacaggtaaaacactaaagactt

SEQ ID NO: 64635 - DNA, 767 bp, Bovine  19866882223868
agctgcatgctgggttcaattatttgactgtatctagatgtgagtcaagaaaataaaaccatatattttctgggagtatgttctcaattttataagccctccaatctcctcctatttttaagaacaaagaagaggcacgaagggaggtgtaagagcatttgacccaaatatcagatgtgtagagacctgtacctacgttttagaaagtaaaaagggtgatgttttaccgtaaacacagaagtcctgaaatacatcaatgctgcaaaatcagagtgagatggcagggccaaggtgacaggaaaactacacggtcttaacaaacttgtaagaggacattatctttcttttaaaatgctcagtttaaattagttcctcataaccgctgtagaaaaagcaggaaataatctttactcttcaaacaacttgataaaatctttaatctgtaggtaagcagagtgtgcaggtgtgtcaggaactccacttaaaagaagtagacaagaagcagagctacacagcccatctagacggggaaaaaaaaaaaatacctaaaactttgctttgtggagctgaataatacaacgagttgttataccaatcaaattacataagaaatagccaaatgtctgttttgtgctgtgtggagacagacactaacaatcaaagctagggagttttaatgaggagacttaattaagacacacatcatcttacgaaaacatgagtctttaattctgagaaaaatcactgccaaactcagttcagctggc

SEQ ID NO: 64636 - DNA, 1061 bp, Bovine  19866880418677
tcacaagtgcaggctgtggtgccagtctgtgtcatgtgctggggcctctgtcttccccaggttggtcacatgagagggtttgctctgtttgcagctgttttccaactctgccaagcccaggctgggaccataggcagtgaagagaggggtgggggtttttttctttttctttcccatagcatttgagtagctgtttggcagaatggaattgctaagcccatggacatagcacagttacccacagttctaacagagtggtacagagagctcaaatccattgtggaatgaggcagatatgaataaataaatgtggtgatattacccattccatggattgggggccatttgctgccccatgggtaaaataacattacctatttcacagggaaaaggaatgtgcctcacagatgagggtagcaggggaattaatcagagtgggattactcataaatcctgcatacatggtggctttggaggcgcagagaggctacctgtgtgctgtctaccattcgtctgtgataggctttgctttgacagttatgcagggcacacctgccactaacaacccactctcatgccttaaatttctgtagctagaatcaccttttaggttaagacattttctcctggaagcccctgttaacagggcactttgtttcctgggagccaggggtaatcatgtaggtctgtggacacttcttgggcttctttcagatgaacttttcagttctggcttcttgttggattttactgaggattgaaggtcctaagatctagaccagtggttcttaaacttgactgcacctaagaatcgcctgaggagcttttaaaaatcctgatgccaagccataccctcagaccattcaatcagagcctctggaggagggaccagacagtgctgtgatttttaagttccctcccctaaaatggtcccaaagtgtgaataagcaggaaaatcagtgatttacaccatttaaaaaaaattgaagtatagttgatatacagtgttgtattagtttcaggtgtacagcaaagtgatgcagtattttctttttcacatt

SEQ ID NO: 64637 - DNA, 1197 bp, Bovine  19866880478637
ggccctgggaaggatggcccatggtaggggctcccattcagagataagttgaaacctccccctacctgaagcagtggacagtaagaactgaaggcagcagcggggagggggccaacaggaagtgggagagcagggccaggacgggggtgagctaaaggaggcactcacctgaggtccaaaatttaagaaggtgctcccaaacccaatgatcaagataaattatatttaaatcaaaatgaatgcaaaaatatcctggataaaatatcacaactgtaaacaaagataggatcctataaagctggaattagagtgaggcaagtgaggtcaagtcctgctatccatggttagatcctgtcttttttttttttttttttggctctttggcctgtggagtcttagttctgcaaccagggattgaacccaggccccacgcagtggaagcttggaatcccaatcactggactgccagggaagtcactggattctgtctttactaaaatttttattttgttcactgtggatgtttttacattccttttgatttttaaaagtcactgctttaagatattttctgtggtaaaggcctcactgcctcaccctagtctggggcctggaagggaggagggaccctattaaaaacatcatcatgtgacaagtcactaggagacatgggttcactaaactgcagggattcctctcagctctgatagagccagattcagcttttacaagattctgcagcatgaagattgctcttggggagcagagatgccaggcacatacatgggccccctacacttgggggtgacagtgactcggaggtggcccccatctcttggcctctctcaggctggctgctaaggggagtggaggggaggggagcggagggggcgggcggggaagagggcggcagttttgcacggctgggagcaggaatggcagattagctgtaattgcctgaagctgagaggctgttgataaatgttactaataatcaaccttcagatctgacaccagctcaggctgggattactgttttgaatggaaatcgaacccaaaccagtaattaccccggtgagcgatgccagtctcactctggagcctgttctaggcagggaaaaggcacctgcatgtcagtgtcagccctttagatagggtattctgcaagtagccctttcccaagagcacaagccttgt

SEQ ID NO: 64638 - DNA, 745 bp, Bovine  19866880483400
acctatcggcaaggcttctgaagcattaaggaatgtgggatgtaaagggcatgtattagcactgacaacacttggctgcagagaggtttttgcgcttcacaggccaaaacatgactctaagtcataaatatatacaagccacactgcatagacagtggcaggaaaacaactgtctttctgaagaacagtgagactgtctattggaattgttagttcataaaaatccatttacaataagtcatttaaactgcacccgaaatacagattgagaggattttcatagccttctctatcagcaaacagcctcaggacccttttccttgtttgttattaaaaggtgactcagagcagaaagaggaagaaagcgcctgagaaacctctgccaaaataaagaaatcaagtactggtaaactgaaatcctctatagccttcttgtttttaaccaatggttgactcatcgctatttacatatacatgatggtaaattatttctctgtctgtaaaggaaagatagctggagcatgagccttagtgtgaattcctttatgagtgtttagacaaaatttatgaattataaggctcccttttacagaggaactaatcttaatgaatatggctgctttaagtctttcatttttatgttcctaagtgattaatgaatcattgaaacattcctggagctgatgcatggtgtgctaacattttgattataatcccaaaatggcaccttatccttgctgcctaa

SEQ ID NO: 64639 - DNA, 1382 bp, Bovine  19866880501697
acttccgggtcacgaggatggagtagtgcagtgggttgtgaatagcagtgtaacggtcataggacatggcggccaagatgaagcagttgttggttcctaagccaaagaagaaaaacatctgtgtggcacactcaggaatggaaatggacttactgtctgatagcaagtccaccaacatgcgagggatgactaccacagtggtacaggtttctgaaaaggagaggccacagaggaaaaagtacatgggagtgtgaaggttgtgactgagcttgacggccagcattacggatgtgtttgcggctaggatggtcacatgggagaagaaaaccatcacaaagaggagatcctgcaggtctgagaaactggaaaatccccacagaaggaaggtgctcactgtggtatgattgcccattctcttggtgtatgtagcaactctcctccaaaggtacagaggttcttggggttaagactctgataagactgctgaaagtactgatgcccttaatcatagacactgacaagacaactcttaacaaaaaagcctgagaaatggaagttaaatgtagttggcttaattctacgttaggacttagagtgatgaagaaaaagattctcataggagagtatatataaattccatagagtaggcccaaatatatattctaggagctccctaatttatcacccctttccagcttctacaatcagaatcttcaggaatgagagaaatatggaaaatgtttattttctcacttacaagagtatgaggaataaaggatataaaatgttttatgcgtggtctaattatagctcggcatagagaagtacttaacaatgttgactgaatcaatattaaagagaagtaaggaaaaacttttgaatagcttccaaacattcttggaaaataattctatccttagaggtgctctggaggaggcagtggctgcttggctgactattatgtcagtgaatggacttaagaatgagtggactttcaaatttatgccagtttgaaatgtatgctaattttctgtacataactatgagctgaagcagagttgttcaataattgtctgtcattcaggcaaatcatggaagcaaaatgatcatggagactattctaatcctggatggctcatctggttcatgatgttctgatcaattcttgagctttcaggaaaacttccaggataaagctaactgatgtactggtggacagggcttctttgcagcatagttcttataagaactcaactatctcacgttgtctttatcagttgttaaaatatctactatgtgtttgagattacagcatgaaggtaacatacagatgttccaaataatacggagcttggtttcaggcactgtttagggaatgaaag

SEQ ID NO: 64640 - DNA, 1685 bp, Bovine  19866880523686
tccgtccccgctttcccccagaagacctttaacaatgtctcaggagcaatttttggtggtcacaactagagggaacgttgcaaaacaattttgcagccaggatgccgcaaaatatcctacaatgtgcagaacagcctgaacacacagaacgttccagttcagaacatcagtagtgccaaggttgagaagccctgattcagacaagcctgccctgtcatgaatgttcaggaacctgtaagtcttttaatgggtgctgttttctaggctctgagaaaagactctcctttcttattttgcagcgaaattctgtggagagagactggcttcatcagttcttgttggctccaacgctataaggctgagcttcatctctgataacacagataatgccgttgggttcaatctcacctataaagctgttaaaccaaactaccttcctggtaaaactgtttactcttatcatacactatgctgaccttttgcagaagttgaggccccataggaattagatgatgggtagggaaaccaccaaggcccactgagctccacagcaaagaagagccctaggtcagtgagacacagggtacgggggctcttcgtgcagtcttgcaaatgcatgcttgtttcccacccacatgagccaagacagcttgatgacttctccagaaccagtgcacagacctcccccttcttgatggctctgcctgaagagccagttcaggcatctttcatgggggacacaagggtgagaacaaagaggtcccctctgtccacggtgatgccactgcttggaccttctcctttgtattgcagattctggctgcgactccttaacgatcctgtttgaagaaggcctcatacagagtcctcactatcctgaagactacagcaacatggccagctgcaactgggtctttcaagcccccaaacattatctagttaaggtacccttacttggctgtggatctccacagaatcgcttacatggacaccatgagggcagaggcttttatctgatgcatttcctgctgtattccttgtacctagaacctagcacctggcacacaaatctcttgataaatacttggtatcagaccggcgtattctgtcctgcaactacccacacttgccactagatggcaactgtgcgctttcagttcagttcagtcgctcagtcgtctccgactctttgccacctcataaactgcagcacagctgcttctctgtccatcaccaactcccggagctgactcaaacttgtgttcatcggtgatgccatccaattatctcgtcctctgtcacccccttctcctcttgccttcaatctttcccatcatcaggatcttttcaaatgtcagttcttcacaccaggtgaccagagtattgaagtttcagcttcagcatcagtccttctaaagaatattcaggactgatttccattaggattgactcgttggatctccttgcagtccaagggactctcaagagtcttctccaacaccacagttcaaaagcatcaattctttggcgctcagctttcttcacagtccaactctcacatccatacatgatcacgggaaaaaccatagccttgattagaccgacctttgttggcaaagtaatgtctctgcttttgaatatgctatctaggtggtcatagtttttcttcaaaggagcaagcgtct

SEQ ID NO: 64641 - DNA, 1126 bp, Bovine  19866880582989
ttcccagactggaaagtaggctttctcagttcagggtctaggctcttagcctcagctccactgctgactctgacgtttgggaaagagtggggtgggcaggaccaggcattgttcttcctggagcaatagtgaaaggagggctctgggccagaagcagacgaactccatttgcaggatggaaagggaatgttattgctgaattctgcagggagcggaaccagcagagccaggcagtggggggggcctcaaataccaggtggagttctgggtggtggccacagtggcttccagcagcggagccacagagcataatgtggagtgacccggggctgaatggggatgccattctggggaggcggaccggcccttgagatcactaggagcggagagagtgctccacagctgggcttagcctgctctccaaactagaggcatgggtgggcccaggagccggtggccttggcactttggaaaagtccgatctgaggggcaggctggccgggggtaggtggcaagagttgctgaggacttgggtgtggcctggcagaccactctgtggggtgtgggaagagctgaatgacctctggcagtcccttctggtcacccggactgtctggcttttccccagattaaagagctgagggttagtgtctggcagccgaatgagtcagactgggagccagccttcttcctgcattggcccgcccagggattcagcctgaccagcgtagggatagggtaagggttgggctcatctcccgtcaaatatctccctgcacaccccaagatttaggggaacactcgagctgagtgaattagtttattttattgggtcccatgtgtatgtgtgtgtgtgtgtgtgtgtgtctgagcgtgagcctgcacgcacacgcaggggcaaacaccatccattgtaaaatatcagtgttttcatgggtgagtagtaattactgggtaatgctttaaaacctttcctgaaggagcgcaaagctgtttttttctaaagtcaggagtacattaaaaggattaccatgtagatttgatttttagataacactaaaatggatcccaaatggacttcagcaaaaggatgctatctccttaatggaaagtgcatggcctgagg

SEQ ID NO: 64642 - DNA, 710 bp, Bovine  19866880631534
cccagagtgggccagactcatcttacatgtaacagttatgatgagagggtgttgagttttttcctgaccttgactctgagcccaggatggaataccagttaaatgttgaaatatcctctgtacgaatgatactacgttcctcctcctccagtaactgtttccttttttattttcttttgtgtttttccaggactcagaaaaaactctcctgtagtctcgaagacttgagaagtgaatctgtggacaaggtcagtccgtcagtctatccataaagatgactgagttatttctttgaggtcagcacagtgccgcgacatgcaggccaggcgctgtccctacctgatggaggcttttatcaagttgttgaggaggcaggaattttatgaacattttgagaaaactggtcagctatggcccaaggcatcctaaaggcacggtgagtcagaacacactgcctggagttgatgagaaaagatgttgaggtgggcatgggtaggtttggagaaatggtttggggagcaggaggcggtaaggtcagaggcgggagtcagatggagccagagttcttaaatcctggccctatttccccagggcacttggaatgttgcagaggttttgaatgaggatataatgtggataaagatgcccctgggagtgggttatggaataaagtagaagattggagaggaagcttcttaaagagtctaaaa

SEQ ID NO: 64643 - DNA, 3621 bp, Bovine  19866880636512
atttaggagctgaatactgaagggaagactgaagggttgcaccaacatgaacccaggcctcctgcctcctccttcccaggaggcacccaggctgggctgcagagaggcaggcctagttcccagaacttgcccggcaggtggtcagctgtgttctgtcccaggcaggggccactccactgccctccttctctgcccacaaaagtagatggaataggccacagacaggtagcaagtcctgagtgtcatgtctagcttgaagcccagagacccagggcccacgactcacatagcagacagcagccagctcctgacgcaaggttccactttccaaagtagaggctgatgctttctgagggttgactccattgtcatacacggtgaacttggtgcccatgaggttggacctgaaggacagacacaaccattgtaaggtcgtgcatcctctgtccctgggcagggagtagctcagaggctatcctagggagggaagactcgaggggacctttgtgacctttgtgggcagacagcagcggacctggggtacactgttcacagaatcatctcagaaggcgcttcatggacagaaggcctcgacttgctccgagtttaatcaaagggcatctcagctgagctcagggaaatcggagttccacagaaggtctccctggaggaactggagtggcccccctcatggaaggtgagccaccacaggggcacctggcaagactgcagaggggactcagcaccccatggagggtggagacgatccgctctgtcccgtcagcctgggagttatggtccagccccatctccagctctaagcttgagttatgctcccgaatctgccacacttctcagcacgccctccctcacctgaggcctagctcagagccttcgccccacccctaggttgcttcctcttccctcaagggctcactcctgccccttggcaccaaccatgagaccaaggcggctcttccacggtggcctacatcatccctgacattgtggagtttgacttgtcccccctagtgggcctgcgccccttctacctgggagcagcttagggtaggatgagtgaggctcatcttcaaatctggctgtaagctagcacagatctgagcctgtggttgatctgatggacagagagaaccctgggagaggatccaatgcttgacctccttcaggggcagcagcagccctctacagagcctgccccagcctgccccacccccgctggcctcctgggggcgtgctggtaccgcagtttcccgatgtagctgtcccctcctctagacaagtctgtagggtccacggagatgaggtaatttggaagttttactcttctttctcttccttcccgccaggaggaacaccttggggagtggagcaaagtcatgcatgttccaggcccagcctccagtccacatgcaatcccaggaccactcacacaagcgatcccctcgcttcagctcttgaacatacacatgtgcacacatatgcaccaatggggacacaggcttctgtctctttgggggaactggcaggtcagtgctggagctgaggcttccagtcccactccagcccccaggacttcaagcccacaggatgaaactgcacgtccaagccaacctcaccttcttcccgtcctcacggtccaggtgcaggaagtaggtggggtacatgccccggtccatgcccttcttgtcccgtgtgatgcggcacttgatggtgatcccctggggggccggcctcagggcaaactcttcgagatcctggacctcaacatccaccgacggctcgggggctgtggggctgggggccgaggctgcctcctacgaaggagagaggaggagcctaagacccaggcagggaccccgagctgctgacgatgatggtctggaatccaaagctgcccccatatggtggtggtgggagacaacgctggcaccctgggatgtgggcacagagatcttgcccctgggccagcacacggcttcctagctgttccttcagctcagcaccccagggtagggatggagggaacaggcaggctctcagaagccatgctgtccaactccagctcccccgccctctaacttgactgaagactgggaggacagaagagccccaggggaaaaaactcttgacaggcacctcggcccagccctcggtccaggaaagccaactccgcctcacttcacttcgttcccctcccacctgggtggcactgctgtctgccctcctgctgagcaggagctcctcactcaccctggtggacttcctgctcgtggcggagctggggcgggtgttgctattcagctgggaggagctggagctgttctcgtcctcctcctccctcctcctcctcctcctcctcctcgaagctcatgctgctggagatgcctgggccgggcagaggagtgggaggggacgagtggtcacacaggcacacccagtcactcacccgtccactggctccaagtcacccattcacacaacacacacggacacacacacgcagagtggcacgtacacacgtacatccacgcactcccacgcacacattcagatgcacactaggatgctctctctctggtgcatatgtgagctggggctggtcactgtccccgggtgcagccccctgcccagcctcagctgtcagaccctatctgacagccagggtgccctgtctcctgggtagcaaggcctgaactgagctggccctgcctgggagcctccgtctctggcctcaagtctactggaggccttggctggcaaaacctataaaatctcgagtaaggcccaactcctcactcagtctgatgctcagggcccaccaatcctctccaaagaaagtgaaagtcgctcagttgtgtctaactctttgcgaccccatggctcctctgtccacggggattctccaggtaagaagactggagtgagtggccattcccttctccaggggatctttctgacccaggaatcgaaccagggtttccagcactgcaggtggattctttaccaactgagctaccagggcggcccatcctctccaaaacctgccctgtctacatgccttcacatcttcaccccagctcaacagcccttcctccaggaagctgtccctcatgcaacatctcagaacgtgtgcactgcgggctctccctacaccacctccctggggcagagctcactctctgggcagcaggtctcctgggacggtatgccttgcctctcagcctcctggccctgctccctctagctcaacagagtggggacattttgtaagaaaagaactttctcagagggacaaaagggaaaggaaatctgtccccacacctgggcctccctgtgggcaggagatggggatggggacccagggctgggttgtgggctcactggttccttgagccacacttctctccctcaacgcagccttctcaggggtccctgcccaagctgctcactggtctccaagtgtgcccccaaccagggcctgggaggagctgaaacagacacaggagggccatgctccctgagaaaggtgcaccggagaacctggggctgagctttggggggtgtctctggacccccacggggctcacccttcctctgcat

SEQ ID NO: 64644 - DNA, 1926 bp, Bovine  19866880752691
cgtgcacaggcttctcattgtggtcgcgtctcgttgcagagcacaggctctaggctctcaggcttcagtagttacagcagtagttgcaacacatgggcatgggattctctaggcaacaatactagaatgggtttccagtcccttctccaggggatcttcccaacccaggaatcgaacctggatctctggcattgcaggcagactctttactgttggagccacagggaagcctgccttgaaaagtagattcttaaccactggaccatcagggaaatcctcatcctcagacttttgaagtggaattttattgctcaatctagtgtgtcacatatatcctaagaccctttcaacattaaccctcacccaatttttttatcataacttttttcttccttctctgatttgagtagatggagctaccactgcacacgcatgcacacacacatacacaggcgtgtagcacttagcagttacaaatgagcttcttgatgagacttcatttactttcccttttctttctcatcagccttagttctcaagtcatctactgacaactgtgagctcttcaagagaagggtgtgtattggtcatctttgtgtttctagtgcctggtgctcagtaaatgcttgtgggacaaattaagaataaatgtactgaatgtaaacttggagtaaccaaccccaaaagtcctcttcatcaactggaataagtttttccttgcagcagttccctaacttgccccttcatctgaaaagccatgacaacggtcttcttatcttttgaacaatgccacacttatagcccttgcttcttttttctgatgaatccctcttagtaacagcctgtatgtcacacatgtcaccattcaccgccttcccttcaaggttgacttgacagtggatcttaacactttcctatgaactctggactgttcagaattcctttctgaacagagattcctttttagaagggcaccataatggagttggcattcaaggtgtcataatttgctgtcccgggcacaggacctaagagcacacatttggatccatacacatatgatggcagctcctggctctgctatttacaacctttgttgttgtttggcttttctcagactcagttacctttgtaagaaaaaaaaaaaagcaatttaacatctatcacagagggtcaaggcaaggactgaacgagataaggtttgcaaatctcttagggcaaagcagggtgcttgagtgctcaataaatagtaattaatacccaaatggatgtttccgttttctgtctttggccccagtcacctggctgggtttgatccctgggttgggaagatcccctgaagaaggaaatagcaacccactccaatattcttgcctggagattccatggacagaggagcctggcaggctccagttgcaaagtgttggacacgactgagcaactaacacagcatacacacacctggctggaaatgcagttaccttcacactttctttaacatgctgattcttcaagaggcaaaggaaagtgaagacagccctccttggggaaattgaaaagggaagactcagattttaagcgggcaggggatggtgtttcttcatatatttgcagatctgtgttaagtagtaaataagaagcaaaatcccaagatttttatgctttttaaataaaattttaaagtacaagtttaacagttttaagtacaataagattgaatcatgtaatgagtcacttcaattttcaacaggcttcctatttcaaagcccttagatacttcctgtaatcaaaacccattttccaattcacaggcagatattatctaatgatccactcaatcttttcatgttcttaatttggggtcagtctcaatggcctgactcacatcagctgtcatttttgtgatcgaaatgtcacttcacatta

SEQ ID NO: 64645 - DNA, 696 bp, Bovine  19866880765754
ttttacttttctgtggaccaaatcaaatcaatcattttttctgtgattttgctcctttggtggaactctcctgttctgacatcagtatccctgcagctgtcccctcatttacggctggctccatcgttgtgatcacagtgactgtcatagctgtatcctacacctacatcctcatcaccgtcctgaggatgcactccaccaaggggcgccacaaagccttctccacctgcacgtcccacctcacagcagtcactctgttctacgggaccatcacgttcatttacgtgatgcccaagtccagctactcaactgaccagaacaaggtggtgtctgtgttctacatggtggtgatccccatgttgaaccccctcatctacagcctcaggaacaatgagattaagggggctctgaagagagagctttgttaaaaaacttctcacttcctgctctgtgcatccatcctcctaagttttttaatcattcttaggatcattactctgaactcttttttgggtagattgcctatcttcactggagaaggcaatggcaacccattccagtactcttgcctgggaaatcccatggacggaggagcctggtaggctgcaatccatgggtcacgaagagtctgacacgactgagtgacttcactttcacttttcactttcatgcattggagaaggaaatggcaaccca

SEQ ID NO: 64646 - DNA, 1629 bp, Bovine  19866880880024
tgggtagctttttgttgtcccgatcgcctcagaccatcaactagaaccctggaggtgggactctggcatctgtagaggatttcagtatgtatataaaactgaagccctttgtgttaatctatcttctccaaagaatgctttattgttcaagataaagtaattgagagattgcccccaaagagaaactctattagggcttgaacaggaggtgagttgctgttttctgagaggcactttagggatcaacatcttgccttctgttattgtcacttttgttttgttaaaccaggtatgagggtatgcattttcttatttgttgcgtctgatagtcctgtttttgtgtgtttgcctctgtgattgtagtttttccgtagccgtcagttggctgtagagaatgtgtgtggcatgtggaattgagtcttctgggtaattgttacctttgctagtgctaggcctaagaagtttcaccattttggaccattttctgagcctatgtattgatgtaaattgtaaagaaatagaaattaaagtcttttatgtatgtacacattacatgcaaaaatggacacagatacacgtgcactcatacacctttacacacacgtaaaatatttgaaaagtaagaaaaaatcccaaggctttaggggcagggagtggcccacagaatggaagggacttgtccaaggcctcactgatagaaaatgaatgaaaatctcagtcttcccacatacttctggcctgacttatcctacatttgtaaatatgtgtgtgtgtgtgtgtgtgtgtatgtgtgtgtgtgttggagtgtattcaggatggagaggcatgacttagcatttgtttagagattgggggtcttgctctacttctgtccattttctctcctgaagtttttgactgtgacctttcctaggcaactcttaattggatttgtagaagccagaaactggtgagcacacatcagagtgggggtaacggggccgtctcctagctccccagagccacggacttgtttgtggattgtgatccacaattccctctaacctgcactttcagaaagcaaaccagcaatctaaaagtaattgtttccttctgtgtggatttctcattccaaagactgccatggcaagtaggaagttggctttggagagagtagaggaacctggaattagacgacaggcctgcagtgtaaccgtggatatggtggctctacagcccacattttccagcaagagtcctgatttcaaggattttattctgttggctttataaacaattcaaatgccctggaaattccaccatgagccatattttctaaaatgtttcttaactgatgaaagaagcacagaaatcctttgttagactctgttgccccagttttggtttagaaaatatatcaccatctatgcaaagaaggcttttttccccttcttttttaatggtggggtttagaaaggcaaacacagtcctatttgggacataccaatttagaaaaagctgacccagtatcccagatctctgtggaaatcaggcattcttcctcttagctattcatccaagcatatgtacagacattcagccagttcccctcacagtctgctgggcagggggcacgataactgtgtcagc

SEQ ID NO: 64647 - DNA, 1926 bp, Bovine  19866880929038
tttcaaaatgcatataagcaagaagaagctcattttactatttggaataatctttttggaacagagtaaatctgcaactctctctctccccaaaggtaagttctaggaagtctatcactatctttgaagaaataacctttgctggcagtgggtattacagtttcactccgtattcctttgggagaacaggagaagcaaatatattctggagatctaattagatttcatgtaattaatttggacttctctcctgcaatcatcattggagaaggaaatggcaacccactccagtgttattgcctggagaatcccagggacaggggagcctggtgggctgccgtctatggggtcgcacagagtcagacatgactgaagcaacttagcagcagcagcagcagcctgcaatcatcatattaaagtgaatagaaaatttatggaatacaaaatacaacttggataagttgcactgatctggaaaagactggaattattcatttatttgaacacattctacaatcccatctcctttaatggaacaaattcgagaaatgagcataaatttggaagcatttgtaatcttttaaaaaattatactttttactgtagtttggtcttccctggtggctcagctggtaaagaatccatctgcaatgcaggagacctgggttcaatccctggattgggaagatcccttggagaagggaaaggctacccactccagtattttggcctggagaattccacggagcgtatagtccatagagtcacaaagagtcagacacaactgagcaactttcacttactgtactttatacaatatactgctataaatagaaggtgtgaagcctgtttactgcagtatattttgtatataaatgatgtttttttcttcaagtaacataagctaagaacagttcttggcaatcttcttcatagtcagatttgtacttcaagaatcatcgtattttttttatttttccttcaatgggttcaggaaatactaaatgttatgtatacaaaggtatttatgattcacttaactgaaacagctagaaaataagcttttgattcagcattatgcctgctctggattcagaatcaaaagacagggttacatccgtgctttgtcattaattaactgtgcatctctttgattcttcattttcccatctgtactgtggggataatagtgcttgatttatagtcagagaatggaaattaaatgagaagctatttgaaaaagttttggatattttaacatattgatctaaatagctatgctttcacagatattttctcaagaaaagtcatttgtccatccttccaatttttctaagtgtccactgtatgctaggaatgtgctaagtgttggaaatacagagatgaataaaacagatttttttcattttcatagtaaatgaggatacaggaaaagaattttctatcccactatttcatggtgaaaactataaaaagggagaggaaagggttttacacaggagagacacttaagacagtttgaggaaatcaaggaagatgcctcaattgaagtgatctccaagctgaagaatagggattagaggattcaactaggtaaagaagtggggcaaatgtgaggcagggcattcaggccttccaagagaacatgtggagaagaatgacctgcagtagggacagaaggtggatcttccctgattaccaagcagaatgataagtcttgggaggttcacttatactgttctctctacttttggagagattttcacttttccatcacaaaaaggtaaaagcataaacaaccaagtagaaataggagcaaagatataaaacttcaatacatggaaaaataaatttttccatgtaaataaatttgaaaaatttgatgtcaccgataattaggcaaactaaaaattaacaatgcatttt

SEQ ID NO: 64648 - DNA, 1573 bp, Bovine  19866880951269
atcagactccccaggacctcattgcccacatgtcctcctcctgggccgggtggcgtcctgtctggagctcctaccatccactgggatcccaccatggcctctctctcctgcttggattttccagattttgtgtgggagacaaattcttcatgaagaacaacatgatcttgtgtcagatggaatatgaggaggggcagcttaatggcacctttgactcccacgttcagtaacgcccagcacctggcctccaggcccgtctgtctgtccatccacccgcctgcccatccgcctggccggccagccgctctcctgccgatgagaactcctccgtcctcgatgggagggacggccctccctccgccgctgcccgtctgtgtgtgacccctcctggggccaggctgggcctgtacagtctgtcttctgtatataaatgggaacatttattttatgagaaatgtaatgcgattttattactggcgtggattaaacttatgaatgtttccggggaggttactctgcattgatcacatgactacagacctgggggaccctcccctcagcttgggagtaaaacaaggccctccctcagttcttggcagggaggagggccctagaacaggacgtgggggctctagtgtgtgctgttgtggggcaagggagttccaggtgggctttacggagaaaagctggaggggaagggacaacccccagtaccccccaaccagaagtgggagctaaactgtccactccccatcctctggcaaccatataccctggtccccaaatgaaaacttccctttcctgggatcctgtgttacatcccccctacactgctcagtcagggacccagctctgatctacctccgtggtaagaccccaaatcccaggctccctacgatgggagcgcaatcctgaaacctctcttcatcttcagggggatgaacagcatttgctgtctcttccttacagcctgggtcttggcattctgctcctctgggtgagagagaaaatcctatttctctgtaactcaacccacgcatgctggaggttttcattcattcagtcggcaaaccttaatccgctctgtctcagccctgtgcttcaagtaccagacatgaggatgaatcatggataggacacagtccgtgcccttgaggacgagggggaaagccaagaaaacaaacagatcacatcaaggtgaggacaaatgccacagggagacctgggacaggcccgtttcctccagcagacacaggactgtttgggatgactccagagagtcagacagacaagtcagcaccacacagacagatacgtgtgctgacaagaagaagagatggacacacacgtaggtgggtgtgtcagcagagataggtagggacagccaggtagctggcaggtattcagactggaagatagccagacaaccagtgaccgagtgaggccatgactgtagccacagtgccaagcacatggcctggaactgaaaaggtatcactgagcagtattaaagagagagcctccttggatccaaagccgaaacagagaaggccgaatggatgggctcctccaa

SEQ ID NO: 64649 - DNA, 1011 bp, Bovine  19866881004995
ctagagaaaagccgacagagcaacaaagacccagcacagccaaagaaatacataaataaataaaattctttttaaaaaagtttaaggcaaattgtagtatcacccattcaaccaattaattgagcaacatctgggcatcagtctagtggatttgaaagaataaccacaatggaatgtaataagtgacacagaagcacagagcgctctgaggagcctgtaaggggccaaatggcttagaatcaaaaggggactgcattcgtgctaacctggtggagatctacctctaaggccctaaatcttcatatctgaaaagtagatcttcacaatatgcaggttctatgtgaaaaagctgaacaattgcttatactgcaaatcacagtaaatcccacaagtaatttaaagccattttgtactatttctacctgctctatgtcttccagtatttcttgctcggaagagtttcctatatacctcagaactaagagctatctaatctccaaatttttgtctttgccctccccagtttccacttgtgggcagagtccagtgaagtcacagcctttgaattacctgaacattttcagtcgcatcgttgggggaaggcaagtggcaaagggttcctacccttggcaggtgagttcaggaaaccttctctggtgggattatgagctgcctcaattggatctctcagaatcccatgctactcatcagtatgctccgttctgcttagttcatcaccagagatctcatgagtgtgtacaaggatccaagagcctcctgatgttcgttagttgacttctagaaaagatgtgttcagaatagttacaagcactattctctgactccaaaatttagaaatgccatcccaaactttcagtccctaagacaaaaatcccgcttcaaatttgtaatttaaaaaataattttctgattcaataaacatatttaaaatatacctatcttgttatcgttaaagatgatgagggaagtcaaaggtgtcatatccagggt

SEQ ID NO: 64650 - DNA, 1354 bp, Bovine  19866881041605
tgaggatttagcctctatttttaatagcaagacttgaactccctagggaccattcactatcctttcatttattcaaaaaatattccttggcagctatgggctgaatgctgtgtgaggctctgtggatatgctctcaggtaagacagtcacagtccctgccaccaaggaaggatgacagtctattcaaagggactttaaaaaacacagcactggttatagtaaatgctatgagagaaacaacaggaatgatgattctgagaaaagtaggggcacctagttgaggtaggatggccaggttaggtctttccgagagctaacacttaagttgagatccaaaggacgagaaatgatggatttgtttcgtcactctggcccttgagtgtgtatcaggcggggaaccattccatgaccaaatgaattgctaaagcctcttctgtggcgatgacacaaagacaagtccttgcactgaagggggagtaaacactccagaggaagaggcccagagagctccagtggtgacggcacatctgaggaaagcctccagaggtgaggcctcgaacaggggaagagttcacggccatggctcaacaagagagctgggctttacagacccatgcgtgcacacacgaacatacacacatgtatgtgcacaccacgtgcctgctcacacagctgttcacatacccagagactcacaagcccacttataagagagaacccaggctgaggggcgactgcactctgtcacggccgagccagttacctttttctgcgtggtcaccgtgcagagctgctgacctggagagctggctgtgcagacgctcaatttctgcatccttcagggccacctgctcttgcagctgggctacctcagcctggaagagaaaaaggcatccaaccagctcagagggaccaccagaccataagaaagcaattccagtcagagtccagagcccacgggtcctaggacccgttaggaagttaacaggtcagagcaaagtaggaagaggcaagcagtgagaggtgtttaccgccctccccacaaggtggcgctctggggaataaacatgctcttcctggccattctggacactggccctcccctctccacttccccaccctgctctgaccatcctagctgctctttctcctgcttcttcctccctgactggactgaactctttccctcccctgccttctgtagtccacacaccactgaggcctgaggaggtgcgagcgtgtgtaattggagggctgcccttggtccaaagatgaattctctttctggacatggtcttcttcctcccaagatactcctgcgacagcatgtacgtacaccactgaataagtacgt

SEQ ID NO: 64651 - DNA, 3364 bp, Bovine  19866881049382
ccttcctggttctgtttgctcccttctggtctctgatactttgggcagggctgtgcccatcaggacactgactcagggaagtgtcaggagatccacctctgcttcctggagactcagctcagttacctgcttttgattttgatgcctgggaattttgcctaaatggaatctctcaaaggcagagtaaagccatgtctgttcaggctggtttgggggaaaaaaaatacactagggttactgcctatgtcatagctgttgctcagactcctaacaaaactttagagccatccaccaatcaatcccccatgttcatgatctggtgatagacccttcataaaactgggacagacccatcagccttctttgttcttcacgttgaatccctgtacaatcgtaacatagccacctccatactacagagcacctatctggcacaaaggtcagctctaaggatcacagccctgcattttacagaccaggaaaccgagattcaaagtgcttgagtagtgttgcccaatggtcaggtaacagcagatagcggagccaaggtcatacccacgtttatctaactctgaaattcgtgtgtcgtcccaagtccccagcctttgctggggaagaattgatcccctccggaaatttcctctgttatgtaaggaatctcagactccttaggtattgagataaatatgacagctttattttagtctttttttttttttttggcatgtagcttcagaggacaatgggcttcccatgtggctcagtggtaaagaatgtcacctgccaagcaggaggcacaggttcagtccctgagttggaaagatacgctagagaaggaaatggcaactgactctagtattcttcctgggcaatcccatggacagaaggagcctggcagggctacagtccatcgggtcgcaaagagtcagacatgactgagcgactaagcaacggcaaatagaggacagtacttgggtcaggaggcaggtttcagtggctacatcaggggggtagggagacagtttcttgcttcaggaaacgtttgagacgttcgaaggctgtgtcaaatgggggttgttttataagtagagattggactcctagccttcagggagagcaggagtgtttacgacggccaaggaggcagaccactgagaacccagggcctgggcactctgtctccctttgaggtgttctagaggttccacccagcttttcctttctgtgtgcgcagaacgtagcctgggccccacatgaaatcgcctcaggtgccagtgttgctgtttacatggtaatctgttttgccctgtgacaggaccgtcggatagaggagcttacggggctgttaaaccagtaccgaagggtgaatgagatcgtgatggcaacccaaggtaagagcagcggggagcttaccatcttctccccaaggtattccatctccactgtgttaaatgccgggcagtcctgccagaagagtcttcattttcatttggaaaaatgctctgcaggaagatggagctggttagactgccctggatggtgggaaactggcagctcttgatttccagaaattttgtcaaatggcagacagttcagtacttccagggactaaactttccagaccatcaagagaagaaagccttcaacttgaaccactgggaatccccaccctcaggagatctgtgcatctgcctggcatactttttagaggcagtgagtgtagccaaacctggatccgaaggcaatttagtaccctcactgggaattagagcctatccacctcctggagagtctaaaagcatccctagcagtggccaggacactcggggagccttctttgagtttctgggtgcttgggttcccataggaagtcacagggcagggagagctgtttgtgtttcatacttgctgcccaggcagcatccgtgttgtgtgggcaccctggggcagatgcccgatggctgccttgttggtcacgctgttgacccggggctcccattacagatcccgagaaagcagctgtttcacaggagagggctgctatgagggtgctcaggaacctctccattcgggctgagctgctgctccctcttggggaagagccaacccctagtttgggttgtggctgccggttgtcacccagggccactgccaagccctgcacgcatgtcacaggctaatttcctctaatccttctggatcttgggttaggtgagggcctgaatgcctgtggccaaggaatgagaagattggagaggaataattggggggtggggacttctcttggttcccccagcttgagctttgaccttgaaacggcctcctggaagcccttgcttagatctgaatcacacttttaatgtcccttaatgtttttctttatccctcttaatgaaggagagactgtgttagaattttgtggtacaattataggtttctaaacaagccatgtcgtggtaatgatctgcattaatgcttccagggccttcagaaagaactctctccatcaatgaggaagacctggagggaggtttcaggaactggaacactgcgaataaaggccccgaagacctatttaaatcagaggtactgtgtttccattaatgatgtggggtttcagcaggccccgggagcttgccctgaacctgggggaggatcaggaacctgccaggtataaatcttgacaggtaaaaaaaattaaaccagtggagtcaccgcagaggctttggggagacactgagggtggaaggagccagggcataggcctgtgttcctgttggggagaacagcagagtggatactagacttctgaggatgggaattttctcttttctaagctttgttttggccatgctgggtcttggttgctgtgagggcttttctctagttgcagccagcgtgggctgctctctagctgtggggtgcggacttctcttgtcgcggggcacaggctctagagcgcatgggcttcagtagttgcggttcccgggctcgagagcacaggctcagtagttgtggtgcacaggcttcgttgctccgtggcatgtgcagtcttcccagaccagggatagaacccatgtcttctgcattgacaggcagattctttaccactgagccaccagggaagccccaacttttctttttcaattggtttccttgtttatttttgcctttactctctggaatttgagcatagaccaaaggggtatttttatttaccactgcctctccaggatctgcagtgatgcctgatacccagttgtattcaacaaatatttcttaatgaatgcatcttgcacatttggagggataatgaacttttgaagtgatacattcctgtttcatagacaacctctcttccctg

SEQ ID NO: 64652 - DNA, 665 bp, Bovine  19866881121915
cagcaaaagaccaccccatagtgttattgtcaggatttaatgacttggtctttgaagagcccctagattagcacctggcatatagctaatgctatgtaggcattcactgaaggagctgtggctaagaggttacacttttcacaacaagcctgtgaaggctatgtttcagttcccattttacagttgaaataaatcaggctcagagaaactcaatgacttgcttaaggacacacagcccatgactgacagactgtgtctaagtttgagcttgtgtaagcctggaatccttgctcagggcccagcctactgttctggtatccccaggtgcttgagagacccagtgggagccctcattgtcagcaaagccaggggacaggcatatcaaccaactcccgagtccccacaggctccttcctgagtgctgtgtcagtttctctgaagcctgctctcttagcagaagttagacactgtcatctgtgcatcttccttctggcccgggcccacctgctgaactacaggggtagagggcaaggtgggcccccaagtcgaggcaactcccctgccccccacagccccccacaggcgcctgagccctctgcacccttccctctgcaggctctttggcaccacaggaaactgcgctgcttgcagcaagctgattccag

SEQ ID NO: 64653 - DNA, 3005 bp, Bovine  19866881132130
cagattactttccagaagaatggtataaatttttagtcctaccagtgataaaaaaaactcccatcttctcgcatcctcaccagcactacagtagtgtgtcaagaatctcaccaatgcagtctgatagttcccaggtttaacttactgtggacagtatgctggatgaactggagcttagctacccaaggtcctcacagtctctttggtcaaaggcagaggctggggaggtccacttctagttagctcctagccactgaatgcttaagagtgaagtctgttttctggcatgtttctgccttctccctacaccaagaacaaagcttatgttggaatttcatgactatctgccttggtttatgatggggaagcctgctgaagaaaatcaaacagtgactctcataactacttgagtagcccatatcagccaacgtactgattatgcaagaacttaaaacataagcaagaaacaaaaactcactggtcctacgaggaagtccgcagttcaaaatgggaaccaaactaagcaaactatgtaactgcaactgctaagtcgcttcaatcgtgcccgactctgtgcgaccccatagacggcagcccaccaggctcccccgtccctgggattctccaggcaagaacactggagtgggttgccatttcctcctccaatgcatgaaagtgaaaagtgaaagtcaagtcgctcagtcgtgtccgactcttagcaaccccatgggactgcagcctaccaggctcctccgtccatgggattttccaggcaagaatactggagtggagtgccattgccttctccgaaaccatgtaaagagccccttaaaaaagtcaatgcaggaaacaggagttaagatcagtcagcttttaactgacatttccagtaatattcaactggttattatgtataaaaccaatcaggcttcagtataaaaaaaggagcaaacagaatataagaaagagctgtcagaaactgaaaatcctaattgcaaaaaaaaaaaaaaattgccctgaataaggaagaaaagagtaggttgaaatagacatgactgagaaccaaattaatatattattagaagttcaaggtgaagaattctcctaggacaaagataaatatgacaaagaaatggaaattatgagaaaaaagataagctgcacggaagacctatccaagatccaatcttagaattactacaattctacagtgagagggcacagtagattaaatgggagcaataatcaaagaaattataagaaaatattcttgagttgaaaaaaagtcccaagtcttcagatggataaatgctaggtaaaaatactttgaaaaatccatacattaatacatagtcagatatatgctgatgaacttgtacaaattcaaacttttaaatataaaaagaatacgaatttccagacagaaaacgatactagctaaccaaaaacaggatgcccattgagaaaaagaataagactgggataagagttatcattttcaacatcaaatgaaagtagagaatgaagcaatgttttcagacttataagggaaacttataaggcaaaaaatgatcatataattttatatccatccaaaaaattacttgtatcaagatgaaaaatggttaagtccaatacttagaaagcatacccttctattttgggggagctgggggagggccttaaggaagtattctgacatacaaaaattaatcaaaagtttaaattaaagaaagaagatactgtatacaagaaagtggtaaaagatgaaatctgtaagaattatcaatgtaaaataattattaataatgtggttagaaatttaatgacattgttaaattctcagaaaaggctaatatctttaaaagctacacaaatcatttggagcttaaactctatataatttcaaaaaaacctaagtagtaggtagaaaataaataagaataattttaccttatttgggaacatgttatataatgaagatttgcaatttggaagaaaataaataattccatttttcatttcattgattactactgagaatgaaataatttttcttctgttttgtgagccagttgaatttttttcttttgtgcaccgcatagctaggtggatatcagtgtttcctaaattagttgtagaactttttatatattaaagatatcagcttctttgctgattaccagtcatatttgttacagatatttttccaatttagtgttggttctgaaaacttttcaaccttgtctgatctacagaaagtaaaaattttatgtataccatataagttttatgttatactatcctctcccttataatttcttgcattgttttttaattagttttttaaattttgtgttaattgtagattcatgtgtagttataagaaatacagaaaccccatgtactctctatctagttttttctagtgataacaccttacaaaactatacactataatgtcacaaccaggatgttaatactgatatagtcagtatacaggaacatttctatcaccacaaggatcccttatattgccctttaatggccacatctactccctcctgcccctaattccctccttaacctctggcaagtttcatttctataattttgccatttcaagactgttatataaatagaatcacattacataataaccttttacaattaggtttttttttaattcaacataatctggaaattcatccaaactgctgcatttatcagtagtccattcctttttattgctacaatctttcccagccaacagagtctttcaaatgagttggctcttcacatcacctggccaaagtatcagagcttcagcttcagcatcagtcctttcaatgaatattcaggattgatttcctttagaattgactgatttgatctccttgcagtccaaagtgaaagtgaagtcactcagtcatgtccaactctttgcgaccccatggactatagcctaccagctcctctgttccatgggattttccaggcaagaa

SEQ ID NO: 64654 - DNA, 1498 bp, Bovine  19866881155927
cttttaaggcatatccacagactgtcactctggctgctttacagctgtctgactcaatgaaacttatgaaatactgaaagggcactcactaattttcctgtgggtgtttccaggtgtggcagtagagcacttccgatcctctgcagtacttttcccccttgagagctgagaagtgaaggaggtacagcacatcaacagcagctcagaacctcaaagtcacggaacccctcatattaaattaaaaaaaacaaaaaggttgggagaaatcaaatcaagcagcaacgttagagaaacacctcaaaaaacaaaagccaacagaaggttcccaagtaaaaaattactgaggcacaagaaaacactctcttcacaagtcatgtgctttgcccatgctcactgaagactcaacctaggctgccagtagaattcctaggcaggagaaaagtgacctcgtactcgagttaggaggtcaaaaagaatctgcttcctctgcttgcagcgctaaggcctgtggcctgcctagacatggaacttaattaggagtctactttcaaaaggacccaaatcatgtctcctcagaactaggaaatatcaggcttagtttcaggatgtggcagttctgtttcaggagaaccactactattaggatttccctggtggctcagatggtaaagggcccacctgcgatgcaggagacccgggttcaatccctgggtcaggaagatcccctggagaaggaaatggcaacccatttcagtattctggcctggagaattccatggacagaggaacctggcagactatagtccatggagtcatagagtcgacacaactgagtgaattactccaactgacattaaaaatagcactcctggtaaaaggaggaaaaagtggtgttggcacagtcactatttggcctcagtgattacctggaaatcacaatgccaacccttatgataaagttcttcttagaacttctttatgcctttacagcttgcaaagatgcccagtcaaaaaaccaggtagggcagcaagagggtaggctttgaactttattgctcaatggattaggcattagaaggatccaggttcaagccctgcttctacatttttagttgtgaattctggggcaaattatttgggttctgagtgaagattttctcatctatgaaactgagataacagctatcttaagtatcttctaaagaagaggcaaaatttaaagagacggtagatttgaaaaagggctctgaaatacaaagggttttaatgctgacaatgattctcattatgatgataacagattttcactgatgtaatacaatcaggatgattccacttaccttaaacagaatgtacagtatatataaaaaaattccaaaaccatagatgggaataatttgccccatcaggcctcttccaccacttcctgctccagcgcctccacctgatcccttggcctttgcaaaggcttctgcgaggtgagacctctggaaacgag

SEQ ID NO: 64655 - DNA, 1166 bp, Bovine  19866881235912
tccgtgggtcgcaaagagtcggacacgactgagcgacttcactttcactttcacataatgctactgtgcatttctttctttctttttttaccccaaatcaaacagataatcttaatttcttatacaacagacagtaacatcaacttttttttttttaacacaaatctcaggtcatttgaaaggccaattagatccaaggaagaaagacaataaacagttgaattaatcaataggcactataacaccacctaaaacctactaccgtggtggtagtgggctaagggagattaagctacaaataatctcatgttaatgttacagattatatagcaggagtttgagcttgctttccagaagactatggtacaatcacatggcaccaagggatatttggccggggaaagaagttcaggccaaatgaaaaggaaaagggacaaaagagaatccaagtgacagaatccaagcaaagggtgatggatcatgctttttcgtgcacatgcattttatttctctgagaatctaaacagtgagcttaagtcggggaaggaagtaatgtacttttttatatctttatctccagggcccttagtttgcactcaatacatgtttgttgattaagtgaatgaacgtgtggtttgggatctgaaagttttgctattttaaggttaatatttcaatcattttagagttcctctccatagacagcactgcttttcaaaagagcaagttcactggaattgtgaggcagactgcaggctgattactagggctgtgcaatgaagggcggatgaggaaacggcatcaaaccgatccttttcaaaggaggcaatgaaagccaggagaggggcgacccaggtgcgcctgtcctgcggagggagacaagacaggtttgaagaggtttacaggctgaacggaggggaccagtaaagagggaaagatgaagattgatggggtcagtgggaggtgagacccaggagggagggaaggaggggtcccaggggaattagcctgaggcaggagggacacctgttcctttgaatctttgaacacagggctgtcagagatgcaggaaggttttaagcagaggagagaggaggaaggcaggaagcaagacttcagggagatgagagcagcctggctactgaagtttctcttccaggcctcac

SEQ ID NO: 64656 - DNA, 1036 bp, Bovine  19866881259226
taatgggcattttaaaaaaactaccacatttacttgtcattggttctcttttacaaacgaagacactaaaaagctcagtgagggagctggacggaacatgcagtccagtttcaaagccgatgctgccatgtgaaaatgagaagggcttttgatggactattgcattagaagagaaaaccaagatgaagggtagttctgcactttgagttttgggcacagaagtgagaaaagtaattgagatcaaggcaacctgtgaagctgctgcagagcagagactatgggcatcagggggaggggaagccagcctgcctgctctctgtgttccagggatcacgcctatgctgcagctcatccgctgcatcgccaggaagcccagtgacaagaccgtgatgtcccttatcttcgccaaccaggtcagttctgctaaatcagccctgagcagggaaataatatcccactgttgtggcccttccctgctcaccgagctcatgctgatctgtgcctgtggctgtggaagggcttactgggctcaaggagggctgctggcagccagagaaactgagtctaggcactaagctttccttctttaatacatagttctgtgcttttccccaatataaaatcatagatgcctttagtggaaatttcgggaaatacagaagcatataaataatttacttcattttcttgtctttgtcctatacgtgctgtatagtcacaattagtttttcatttttttccactcaacattacctcacaggcattttcttctcagtctatatcaagttgtaccatcatttactaaatctccttttccaggctattctcagttttcatggttatacatgatacagtgatgaataactgtgcctaagcttgatcacagttggattattttcttaaacagaatcctagacgtgagattgttaggacaatgattgtgacacgttttaaggtccaggactcgtgtgcagcaaatctctgagcctgcaacagatcttctggcttgctcactttccctagtgggggctacagc

SEQ ID NO: 64657 - DNA, 3483 bp, Bovine  19866881267505
caggcctacccaagtcttcgagggcccatattcccaagattgaccaagctggattaagtgtccgctcttggtccactttgctagaggtcaaggtcatggaaatgcaacctggtcccattccagcaggagtgttgaaaagtagacttcctgagaaaggtccgccccttctgagggaaatggacacaagtgacctcacctgattcccagaagattttgaagtgaggaagtcagaggctttagcactctgggccagctgttgctcatagtagatttaggaaagaggagagattccccagaaagaggaggggttgagtggaagaaaccaagcaggagatcaagtttccatcatggagtctgagcggtgtgtagggctttgggtcccggtaaggattagacccgcagagaaggaaacagagaccaggaaaacaaaaaaacaaaaaaaacccacaatgctaggcacaaaatgggaaggcccagggaaagttgccgctctctctccttcctcctcccaagctggcgcctggtgaggaaagcataaaggccctggtgatgggggagagcagtgtgcttgcatctgactgggcttgttgtcctgcttgtctttggccagcagatgctgttgtcactgcctgtgctgatggaaccccctcaaagctgatgaggccccactgcacctcccgactgccctgaggtctctgaggcctgtcagcacctcatttgatgccaggctcaagaggtcttccgtgcagccctggtggtacagggtcgctttccgcacttgctggatgcccgccccccaacagaaatcttgttggccaatttgtcatctccttttcacatcctgggagcattcagggacgtgcaggaactgcaggagactcaggagttacgtggccatttctaccttcttcctctagcttcatgttggctcaggggccataggtgccttcagctccctcaacccacctgaaacttgaggcttcaagcttgaggggtgaatctgtacctcacatcaagtaccctccatctctcctaacaggctctctgcttcctctttctgactagtagaaacttcctttatatcagagcgttgtttcctttaacctataacatgttcagatctccaaggtttcctctcaacattgggattccaatgtgtctcttttctcttgacaaggcctagctttagagactccattttggaggggttgtctgatcattgacctcatgctgtttgtcctcagtttgcaggacatgtagcattgatgcctttgaatgtaacaacatagtttacagagaaccgaaatactgtccctgttacacaggcattgaattagtatctgtggaatgaatgaatgaatgagacataatgaaagcagttgtgttcctttagttctaaagttcaacagtttctcagtccaaagtagaagtcagttcagagtaaaatataaaaggtattaagactgaatttacagtgagctcttcaaatggagatggtccttattaagctccaagctctgattaccttttctttatttaggagaagaatgtgagaagagctcatttctgcacccccaaccctgtcacttggttcccatgaactgccctctgatggtagtgactgtatttcgagtgcacttgggaaatgttcataacaataatttaggcaccttagtaaattatgaaggtcccccctcatgcgtgatatgggtggtcaggttctgaagaactttgtatcttctttcataagagacagaggagcagagaccacagatgtccctgtggcaaatggcagagtgctgcaccccacataagaattgatcaggaagggtgacaaggacatcagtctgcaagttgacttttctcaccagggaaccattttagcagcaattttacatcaggcaatgattagctcggcctacctgtgaaaattttaaaaaaagaggaaagtagtgggaaggtactttttggacaaaataaaggccttatgattgagattttttttttttttttcaaaaactaaattttttattgggggatttaatatgccaatatccataaacacctgcaaagcccctgaagcaacactgattgcaaagaacatagaaatgtacttcatgttgggatctgaaaaacatgtaacaaacttgttagaatctgtgccagttgatgtaagtggccagaatgcagtttggaccaggaggcatggttagtgttaatggggccttgtgtttccagctgtggagggaatggtcaacaaacaaagcaaagagcattcagtgtttccaagcaagtcctctttcctatgtagaattatctgatttagggggggaaaaatggatgctaagcattttctcatctttaactagtatacaaaatctatgactcttccagtggtctgtagagataggaatcatataaaccatggaagcattaaggtaagaactagaggtatgaataccttgggaaataccaaatgcaaaagtagaagtcaggagatacctagagtaacaggcaagtttggccttggagtacaaaatgaagcagggcaaaggctaacagagttttgccatgagaacgcacggtcatagcaaacaccctcttttaacaacataagagacaactacacatggacatcaccaggtggaaatactgcccctgttatataggcattgaattagtatctgaggaatgaatgaaaaaatgaatgaatgagacataatgaaaggtccgtctagtcaaagctatggtttttccagtagtcatgtgtggatgtgagagttgaaccataaggaagattgagtggtgaacaactgatgcttttgaattgtggtgctggagaagagtcttgagagtcccttggactgcaaggagatcaaaccagtcaatcctaaaggaaatcaaccctgaatattcattggaaggactgatgctgaatctgaagcttcagtactttggccacctgacacaaagagccaactcattagaaaagaccctgatgctgggaaagattgaaggcaggaggagaagatgatgagatggttggatcacatcaccaacttgatggacatgagtttgagtaagctccaggagatggtgaaggacagggatgcctggtgtgctgcagtccatggggtcacaagagttggacagaacttagcgactgaacaacaacaacaatatacagaggtttcctaggtggcgctagtggtaaagaacccgcctgctggagattcaggagacataagacacagggggtttcgatccctgggtagggaagatcccctggaggagggcatggcaacccattccagtactcttgcttggaaaatcccatgggcagaggagcctggtaggctgcagtccatgcagttgtgaagagttggacatgattgagcgacttcactttcgcttttcactttcatgcttttggagaaggaaatggcaacccactccagtgttcttgctggagaatcccacgga

SEQ ID NO: 64658 - DNA, 1076 bp, Bovine  19866881276687
tgattttatccttggccctgtgccctgtacttcattgtccgtgtttaagtatcatagccaatcaggccactgccatggatatcatgtatccttcctggtgcttgcacacctgtcaccttataaaacatcatagaaattagtatgaacacaagacaacctcccttctttctcttccttctttgctccatcagagattcgatccactgagtaatttttgatctatcataattacagatgggaccactcagggcagaggtctgactctccatgttagaagtaacagatggtttacctgtgatgaacatcaaattacacatgatgaggacttaaggttgcaagagtaaagatttcagagtccagggtgctttattctgtgggccttgagcaggttagtggtctgctgggttcaaggaggagaacattttgtttgtggggatggtggggccagagtggggactcttgcctgagctgaagccccttacagcgagggccttttgcagagccccgaggctgcctcaaacctccacttttctccggcatagaagactctcactgacctgagaatgagcccagaggcttgctagtaatagaagtagtagtgttagacactcagttgtgtctgactctctgtgaccccatggactatagcctgccaggctcgtctgtccatagaaatctccaggcaataatactggagtgggtggccatttccttctccagggacaggccgggaaacagtttttctctaataatgcctggatctttagcttcctttgtccttgttctgcttaacagaactgccaaaacatagaagcaccttcatacctctggtcttctgtggctagaggaagcttgagatagagactttagtccttaccctgtggagccaaggtttgaagcttcaggaaaggctgctgaagggtggaagtcctgccatgagatgctcacagggccgaggggcagctgacggagagtaaacccacgcactgacaggtagtccttgcttagatgctgttgctgaatgttgtgccctctgggaaattgttcttcaacaaattaaacagaaacgaggagga

SEQ ID NO: 64659 - DNA, 1181 bp, Bovine  19866881370380
cttaaaatccttcagttactctgctttgtcctgaacaagatcaagttctttatcttgacattcaaggtcctctgtgactccttccccccacctcctcctgttatgttgaggctgggcccaattatcagtggtccacatcatgcttttttattcactccgtggcccctgctcctgctttcccttctttttgtgtgtgtgctgtcctgtccacccctttttgcctggctggatccagcttatcttttaagcatcttatcacttgtcattttcttcaggaagcactctgaagatccgcccactatgagttaaatgtctctggtctgagttctcctggtcccctgtgttcaccccgtacttagcatttgatgacacttgatgttatctgtgtacgagtcacctgcagcacatccaattgctccctgaggatagagactgttattcatcattatgtaaccagtacctggcaaaacgcctggcacaaagtcagtgtcgaataatttcttgttggatagaattccggtttcttctgtcttacaacttggaaaatgattgctgatttgttagaaagactctggatgtcatattttcaaacatacaggcatatggttctattaatgtatacaagtaacccagtgctagctctgaaagctgaagaagctccctttttttgaggactaaatgagctctaccttccttccagcacccagttctccaagtgaaagacggcagccatagagctattcagtgcaggcaagttctcagtcatcgtctcaggtgatatttgtggcaaaacaaaagaacggacagttctcacaaagatctctgcaaaagaatcacctgagtttaaaagtacaatggaagatccgtgactgtttcctccaggaagctcagaattccttcacccttgtgctcaccatactggctgcttgtctcaacaacctttcaagattctccttgcattcctgcatcatttgttatattgtggcattctgtccaagtaatgatcagtccagctgcctttaaaacaatcactttgagagggaagtgggggactcagtcatttacttattcatcagtgaatattaattgagtgccatactactctgagtatccatctgcgagaaagaaatagacaaaaacttttgtcctcataaagcttatatttatgatgctgggaggga

SEQ ID NO: 64660 - DNA, 626 bp, Bovine  19866881385946
aacctgtgtctatggccctctgttcttttctgcacatggcctaaaaccggttggctttttagcctaaagaaaatctcctgaagagaaagatgggaggcaggggaggagacatggtgtatcccttgagcctacttcagaggcttctggggaggaggaggggtgtaaggattgaaccccagggggcagactctgctgtatgacgcaaatgaggctcgaggacttcagctcatttgtcttctgcagctgatgcaatttgagtgatgtgagctgatgagaccccctctggcacccaccacccatacactgtcaaggacacaaggaacctctgagatcaccctttgattaacagcaaaacaaaggcctcagggtagggtcacactgcaagttgacagcagagtcaggatttgaacccaggcgccctgctcatggctctttctctgcagtgcaggcctgggagccacttcactgtgtaggagtcaaggggcctgttaggagtgagtggtcctttggttatgacctttcctcctgtgcatggaggccctgagcttactgtgggctatatgtccacagtgatgcctggctggcagggactcctggccataccaggtatgactctttctggggtt

SEQ ID NO: 64661 - DNA, 915 bp, Bovine  19866881810356
tctggaaagtatctggcagagtataaaacaggcttttaaaatgtcctcccgtttggtctagttttcatatttctaaaagtctgtcttaaaaaaatagggaaatggacatggatttatattcagagatcttaactaatatgaaacttataatggaaaattggaaagaatctgaatgtcttacagaaggggcatggtaaatcatgtcagttatgtagctgtatgatgggatattttgcagccaacttttaaatgcctaataatatgaagaagtactcatgatataatgttgaaggaaaagaatctgggtacaatattttatgtacagtatgatccctctttgttacaaaagagaaaaatatatgttatcacttgcagtgataaaaaggccagaggtggtacaacacattgttatcagtgatgggattctaggtgatttgttttcttttttaaaacttgtctgggtttttcagattttctacaataagcctgtgtgactttgtttttttttcccccttgatcataaatgttgtaaaaatgtgtctccacactctgcatggcaccaaaaaagacccctacttttcagaatttgtaggcaaaaaaaaaaaatggtttatgttagggttcaatttgccaattatcataatgtgcaaatgggttttggattctctggctttcacgttgtacggtgagcacggctgctgttgccaacagcggcatatgagctccagccggcccatctgctgcttaggctcggcttggctgacacagatttatttcatttcattctttaatttggcaacattttctcttttctcattatcattgctgggattcattttgtttaccagtttgctgttttcttttgttccctgtcagaagacgaagaagccaacaatgggaattctgtcttctcaa

SEQ ID NO: 64662 - DNA, 1049 bp, Bovine  19866881920443
actcctaatttattcatcattcccctttccctttcggtaaccagaatttattttcaatgtctgtgacttataccatttttaaagatgatttttaaaaagtaatgtatagttctaaagaacagactatcattttctggggactgcgggtcccctagggcaataacatgtaggatttggaaacacccatgaactcgtgtgaaccatggcagcctcctctataaaagcctctgagctgctattttaaggaagtgaaagcgaactgaagagtgtcctgttgtaacacaactcttgtgggccccagccttcctctgctggctttgcccttggcctgcctctggccgggttcctgcagtgaccagagtctcatgtttgccagggtggcttaagttttgttctcatgtacaagtcttctgggcacactggtaatttcagaccatcaggataatatacaaaaagatgtgtcttgtggagttgatgaacaatccagcctgtagaaatgtagataaaaactgaggttagggagatagtgactcctgccagagctggggactatgccagagtccttggtgtcgatgccatctgaggcccacagggattttaatccgctgaactgagcaaccaagtcttgtgggcccagacagggcaacaatctagcagtaccaccaaaggggattcatgccctacaccgggggaaggccttggcctaggtccccaaaggcccagtcctacaatccattcctgtgctcagcaaagcttttgttgtgcctgtggaacccccgcctaaatgctgggcacaggacaggactatttgtccctagctgttcacaagaacgggtgccggcgcctttgattgacgctgaccgctagagggacctccactccaggtcgcggggttcgagagcggccagattctagggtgactcagtcttccgaactgggggcgctcagagacaagaaatgagattgccttcaggccaacctcaatttgaactagatcgcctgggctcagaagctgggactgcctctaaaacattctttctatgacatct

SEQ ID NO: 64663 - DNA, 1388 bp, Bovine  19866880364231
cttaggagcttctttctccctaaaagagaatagggctacttaagaagaaagcccgatcctaggtctaggtaaagaaatttacaaaatgaacctgtaaccctatcatgcctgacatcaaagatgatatgcaagggtattacatcatttcataaggactccagggccaacctgcaaaagctcctcctggccagagatggataaacttaaatatcaataaggacattagaaacagctatatcacagcagtgtgattaatacagtgaaaatacaaacacacacaaactggccactctaggatagaaaggaataaatttttattttgaaggcaaataaagcaaaatcaacaagcatctatcctattttttgtatacaaactttactactagatgatcaaattgtagaagtgggtaaatttttatttagaagtatccaagataataaagaactcagagctgaaatatcacttttataatctctaaagaattaatgcatctagggtagtcagcatcaacacctgctaccaccacaaaaaaaaaaggaaattatgtgccttctgatggaattttaccacttatgaaataatctcacaaaaaactaaaaacacgacatttggaacaactggaaatttgaacactggctatttggttctattgaattgtttgtttctttttaagatatgacaatggcacttatggttttaagataaggaattatcttcagaaattacatactgataaacttttggacaaaatggtaagtctgaaatatccttcaaaataacattgaaggaagaaaaggcaggtgtttatgaagatgaaacaagatgagttatgaaaaaatttaccacagtaaaaagttagagaacaattttgacatttttctaccacaattaaaatatatcccaatccattactaaaatatatgtatatgattatttataccactaaaaatttaactatgtgtaaataaccatatagatatattttcatagatataaacaatattaatagatatcctaaaacaaacctaaatatgcctagtggtacctctgggacaaccactcttcgcttccaagcctgcaggtcacgctccgtagccatctgactgcgcggagcattctggtgcatctgacggacaccttccacttgtccactacgacgcagaccaatatttggaggagactggatgtctaagcttagtcttctaaaacctaggaaaaaattgtaaagaatgactgcaaaacaaacgtcaatctaatatgcatacacattcctcctaatatgatacaaaccaaaataaaacgatctactgaaaaaactttggaaaaaagaattaatgtgacttagataaaaatgtagaatacagaacatgattattaacatcatttt

SEQ ID NO: 64664 - DNA, 1003 bp, Bovine  19866880450302
cagaagtgttgatgactctctgcccaacccctcactcccacccaggttggctcagtgggccttggagttgttcacttatggttctcaggtatgaatcaagacaggctaggcctcgtagacgcttgcctaactccagctctgcaggtgagattacgccccatcaggcacaccccagcagggctttagggggaaatccagtgatgcgttcaggcattattcactcttgctaatgaataagtcatcttgggtagacaacagaggtctagggaagtgactccagggccttagaagaaagttatgagccatgttgagtctgaaccttaaagcaaattacccgtttggtgtccaggctaaatgccaggcacaggccactgggctgagtcttcttgcagcaagcagctgtgtcgaattaccctgatgccagctcatagggacgcagtccagcacatgtttcagtccttacacacagaaacttctgtgtcatggggccagtggcctatggacctgaagatctctgagaaccaaggtggcagagagcagggagggcaacggtctacctgcagggtccagagagtccaaaagcacccgtttcgactctgggacatcaacagtggtgccactcacaccactgacaccaccaggtgtcatgagctgacaacctgccgtttgtccttggcagcccttgcccggtgcttaaggccaagagctggaggaaaatgtgaattcatgcagggaggaaagaaaaggatgaatacctcctccagaaaagatcagcccaaaactgccaagggttagggagccccctgctttgtttcagtggctaaatctctgactaggcctgccaaaggtaacaaataaaaatacaagatgccgggaaaaagtggtgctgggacagctaaatgtccatatgaaaagtgtgaagttggagtctttcttatgtcatataccaaatgtgctcatggacttaagcctaagaactaaaactgtaaaatgggcttccctg

SEQ ID NO: 64665 - DNA, 1780 bp, Bovine  19866880489569
aagccctttggcctcccgggttggagctccagtcctcccacgtcataaaacttgtgcttgtctgcactgaatataaaacacaaaatacagaaacctgtaaaactcatcatttctgagcactgtggactttctgcaaaaggcacagaagagccagcttactcaactttcccaagtgactcatggaaaacccatcttacctgcatcagagaaaaatagaggacaaattcagaagaaaataatgaatactatgaacaaaaatattcattttccagaaagtttggaaattcccaaccaagaaattacaagatggaagcagagagtccagaaaaaggagaatgaggaaaaagactggagtagtcaaacacagaaacggaacaaatcctgaatgataaagtcaaccaactaacatcagtggctgaacccatgctgaaaaccacccttttgcttggcctccttagagatcatgtggatgatggaaacttgaaagcccagcagtagagagaagccggaaatggctatcaatggatccattcttaggccagaagctgatacgaacatgtcattgatgatgctgacttcaaagtgttccttcagagtcctgaaaagaagcagtaagaaatagcccaacaactgtgggaggaagagcaaatgaatggagaccttccaggacaaatatccagtctccacacaggagcatctgttcactgtgagaattcctagctagaaagaaattcggcagctgaggctgaagctgagaattctgcctgaagtgcatgaagatcattgaacacaacttcacaaaaattgtttgaagagaagatctaatgcttagaagaaaacaaacaaagaaacaaacaaataaacttcccagcatgtgtaggaacatgaaagccaaagttttatcagaattgcaacctctacaagaagatggtgaaacctgggcaaagagttgaaagaagtacttcctaccattgaaaggagatctgtgtcagtgagaaagacctcaagactgctgggtggcagctgtgttgactgaaggaagattcaaagagctaagaaaagcaaatgaacacaatgggcagatgctagccaaggttgagtccaagttccagtcttttccaagagaccattttgcgcctgctgctccacttgcaacccatagaggccccaaagtgttaggagatccccagtgctatgagcccaccttgggagcaggagggtcacaaactgaggtcttgggaacctgatgtcacctgcgggtttgactcagctgccacagaagctaggttgtgaacacccagaaccatagcacacaattgcctgagttttctttttaatgtaatttgaatgtttctgtttttattttggctactgttactcatttgattgctattattgaattagataaagcaagataatttgtaaaagttttttcaaatgaaattgtattaaatgtagtttctttgaataattcgtgtaagtccttagatcatcttgaataagatactgtaagttgtattttgattaaatcaaaattactattaagccaaatgacatatgccataaatagagatgcttaaaataataaagccatttctatatgctatgggctataattaaaaatctggacaagtaacctaatatttgtcataattaggttggctttaagaaccaatgcaatattaaaaaaatacaaatcacagacatcagaaattatatcaatttagttctaaaaccactgattaatttgggaggagtttacattttatactcatctatt

SEQ ID NO: 64666 - DNA, 1737 bp, Bovine  19866880501871
cagtttcccctccgtaaagtggggagtgggtggatgatccactgttggtttaggactgaggggagtcgatggcctggaggttccacggaagtcacggccacagccttccagcaggagttctgcaaaacacagatggcttctgacagccacgctctttccagaagcatcgtaggttcagagttcagtgataaagctgacactgagcagaactgggactcaaacccaggtcttctgtctcctgatgcttctcccttgccgagataaccagactgagttttgctgatgtcgttgaaactgctacccaggactcccccaggcttctgtgactgcccttggctttgaattttaaatgacccaggagcttccaaccagagccctcggacacacagcagctggcagcagctcagtcctctgagtggatgagagagtcccataacctgggctagatgttaacatgtcttttctgtaagaacgcgacagaagagtgagactcatgcagggaaggaggaaaccccttattgtgtaaacccttttgcaattcctgggcaaggttagaacatgtgatgatgcttgaaatctaactttaggggagagaccatttttggtcatagctggtgtgttgacacctttgcaactggaaatggcatagcctctgtccatgtgctatgagtaactgacccctcctgcttgccaaattcgtgttcagatggcaaaacagcctgagactgccacattggacccctgccagttgttcctgtgctgtgtacatatgaccagggcttagcacgcacctgtgtgtttacatggcagggagccagctaggctgattcaaggtggacccacggcctgggcaggctggaaggacagagacagtagtggggggaaaagggtaaatagaaaatggacaaaaatattgtgtatcagccatgattcatctccatgtaaagcccttcagaaacaattttatcatttgctggtaaactccaccaaataaggtctgggaagaggtcattcatcatcacaatgcaaataggactgtgggtcctatttggtgggtctcaccactttgcactgacttgctcttgtgctccgacccgcaaggttcgctgtagggccagctgtgcctatagggcccacctccaagctgagatcagctgtttccacctcccccagggcctgtgtaggggattagatctctatttcagagcacttagggagaactgtttcctagaacctggctggcctcccctcccctagcctaactgacagccctggttgtccggcacatgtttaccttggagacggaacacttcgcagggttctcagtggtctgctgaggtccccgggacactggatctcagagacagagcagtggagccctcgcagacatggagggcctgctgcctgccctgggatctgccttccagctgatgctggagcatttatggggcactctgctggtggtttctgagagctggacacacgactcaggtctccctgagtttccctgggagatcctggtatgtgctatggtgctggttctcatgataaagagatggcacaatttaagaagtgtgaagtcgctagggaaaaggtcttctgcccgtgaggaagtctgcggaaaatgtagtgagaatgttgggccacgggctcaggctgacgaagccctcaagccacctcgggtggaggccagttctcccacgtcacaaaccttgtgcttgtcggccgtgaacgcaa

SEQ ID NO: 64667 - DNA, 500 bp, Bovine  19866880512890
acagagcttgggatcaatccataaaacagactctttatggacaaaacaataggaccaaagtgccgaatatttattgttcctaggatgacacatgaaccttaaaatgtataatatttggattattcaagagagcccagcaagaaggatgtcccacggatttttggcagggacatgcctgagattgtagataaggatcagtcctctggagcagcccccacaatggaaaactacatcattcagtggaacttttccgtctctatcaattggaggatttgcctgagaacacaggcagcataaggcactcttagccccaaggtcacccatcgtctactcggcaaggaccacttttccattcgaagcagacctcacgagtacagtttcattaggtaagacggtatgtggcatgccctccagccacacatgaagaaataatccaatttccatttaaataactaatgtttcaacaggtttctctaagtggttaatgcattctttagcgt

SEQ ID NO: 64668 - DNA, 1253 bp, Bovine  19866880516097
cgcctcctgcgttccactgagccactcgggaagcccttactaacaccgatttgcaaggagtcacaaagagtcagacacaaccgagcaaccgaacaactcacaaggcaattttgagggttaaaaaaggtaatgtgcataaaacaatggcaacagagcctgggtcatactatgatcatacaatgacaacagcctgggtcgtactatgagtgtgacttattatttttattctttaaaatagctcatacggggtcatttccttagttcagaggcagtgctcaataaactacaggtatcgccttctcacgtcccagtaatagtacaggaagaaggttccagaatgcccattttacagatgaggagactgaggttttgagagataataacattaccatggccacattggactcaaactgtccaactccaaaagcaaaacttatatttcttcaatcatcaaaactttgatgatatctggttgataacctttctcatatacacaggtaacatgcacatacatcaagttagtgtaataatctagcttatttttcggtcaggtcatatccatatatgtccttatattgttatcagggtcacaaggactctttgtatcctaaaaaatagatttctgccttctggcttattcttcaagatttacataaatttaggtcctggaacagatctactcagcccaaaatttggggctcaccacctaaaatgatggaaataacttagttttgtagtaatttccgggcaacttcagattaaatttctttcaatctacaaagaggtgtaaatatttctcctggggaacaattggttttggttttctaatttgatttcgaaaaaaaggaagtggaatctctgtgttttgcagagagcaaggcatttcagtgcatttgggagatgttcagatatccgtgtaggtgtttttaataagttagttcacctaattgtatttcctctctactaaagaagaagcatcctaccctaatgggtttaatcttcctaaattattttctggttttaattgtgctctttcccacaagcacctaatttcattataagattgtaatgctttgctgtgaaaagcttgcttgcacattaggaatgctgggattcaaatgtttacagggggataaaaatgcaaacttactcactttctcaagagggagcagcaaagtacttgaatgcccacctgccccagtccttggggtctttgggaggtgcataatgggaggggcctgactcgctcaggg

SEQ ID NO: 64669 - DNA, 1261 bp, Bovine  19866880531723
aattaaggaagtaaagagcattccttaatttttttcgggccctagtcaaggacaattatcctgactcaatctgtcaacaatatagttaacgcgaactttgagaaggaaagcatcatacttttgaagtggtgatagctctctcaacaaccaaaggagaggcaggcagaccacctatcttacttggtaatgtctaagaatatccttccccttacaccagagtagaaagagaaagaaccttctaccatgtcaactggaatagagaaccaagaaataccaacacttcagaacattctaacactgatatcagagtctgatgcttttcaatgtctaccaccttaaggatacacaggagagaaaagggttaattttgtctgaaaccaaacacaattagggccaataaataacaaagggtgggggtactgtaacacaccctttagctacaaaatatgtaaaccacttgagtcaagtccatcttcaggcacaaacaagctaggaatggccacctacactgtttggagtagcacagcctatcaagtaaaaatatttggctcgaaaataagtgtactatggtatttgatgatgtggcaaaagtcacgctttaagtgaatttcaaaattattttcccacaacagtttcttagatttatactagaggtcactaataaagatacttagttgcaacagcaaagaatgcttgggattgcacatggcagcagtagactaagagagatggagaatgacaaggattttcctatataaatgagatttgcaattgcactcttaccaaaactctacaatttaagagatgggggaacactacatataatttaaatactcttttagccctgtacactctattaaagaacacactttatctaaatctaaggcacacaaactctatttcacagagtaagactatggaagaccaagattttggttaaattccataaatggaaaacaggagatcttggaaagacaaattatataatattttgttagtgcacaatttaaaagaaaatgctagctatggtctggccttagagatttaaaatatacaatcaaacatttaaaaaaaaataatttaccagcactttatgaattcaagtttataaaataaagtagatgatattttccttaaaaataaagagaaaaagaagacccaacaggacttggaaagaaaaactggaaaccatttcaatgaaaatgataaaatctggtaaaatgcaatctactcaagtagccagggaaagaaaaaaagggca

SEQ ID NO: 64670 - DNA, 1225 bp, Bovine  19866880581039
cgcccgatggatacagctggatcccattggcactaacgttgtttcccctccagtaaaaatggaaatatattaaacaacaaaccaaccccaaagacactctgagctgaaaccaaaaatcaatcagaaagagaaaaacacttgggttggtgtcaagagaaacaaacccacgccagcacagacttttatgaaaatggtcaccgaatagtatttccatgaacaggcagctgactcagaggtggagggtgagtgttctgagcactgtctgagcggcccgcccacgcctggagctgacgggacgcttactcgaagggacccagggatgccgaaaataggaaaaactgcacgaaggaaaaagaaaaaaaaaaacagattcttaggaagggaggggtgggcatgctgtgaaaccagaggggtttgggaagaagctcagagtgtgtttgagtttcccctcgttaccagcagtcctgacagatctctggttctcaaagccagtgcaagtatccagcatcccttctcctctagaaaaaaatcacacgatgaatacatctctgtgagagcagaaggcccaaaggtgaagttttgttttttcttcagctaagacagtttgaaagagacagttcattgtacatgttacattcggccacgactgagaacagaactggtctatccagggcagaggacccagagggaccgttctgatgcgagaaggtggatctctcaaaggggtcgaggcaatcagcctagccatcgatgtttcagatccagcgagacatatctagatggcaggcttactgtccagcactctgtccccgcgtccctggcctctggctcctcttgtttctgcttctgtggcttccctgggtgcgcagggctcctgggacccctccctgcctcatcttctgtcttcggagcttcagcccgtgctctcgcttccttcactttgctctcgaggcgcggaggtgtctcagaagatggtgctagggccaggaggaggcgaggtggtttccagtgcttccctccagctcgtggtattcggaggagtcatggtattttctgggagtttgcttcttcctggaacatggctgggagatttgcttccgttgagataggaggtccgggtggtcctgggcctctccgaccccttgacgtgatgcagagcctggctgttccttctaccccgcctctgatgctgtctgtgctgtgcatttggaaggtagaaggtgcg

SEQ ID NO: 64671 - DNA, 1683 bp, Bovine  19866880665614
tgtttagcctggaaaggggaaaaagaacctccacagctgacacgttcaatccaaatttgactaaacagagcagtttgcaagagcacacttcagccatcgcacacccgcaaacacccagctggagaagccggtgggggatccatatggggctggggtaggggaccccatcacctgctctgtgccccagcccagagctgccaccatgagcgatcagtcattcaggagtttgtctccagggtcttactcaagaagcagtaaactgtgaggatcccgggtagaagtaaccggacttcaatctccccttccgagccacgctgcccatcggaggcgcggggtgccagcgatgacacggtttttcctccgagggcttacacacacgtggctcccatcactgtggtctcacattccctctgtgtttagaccacttgcctcgcacgttctcatatttacacatgttcactgaacgtaaccccgagtgaattatttaagaaggcttaatgtgcttcagacttctcaaatacaattgagactttaaaattgaatttgcactcccgtgggggaaaagagtgtggagctacccgcagggcatccagtggacgtgcagtaggtctcggaacagaactgcaggtaccccgacggcctctcccctggcagctgatgctccgggtcaaatgaatcaggactgagctacaaggtttaaacgtgttgcccgcctttgaaagcactgagccccactacacgcctcacagaccacaaacatcctcatgttctgacttatccttctaggccgatccaaaatgaagcatcggacaataagagattcgtcacatgcagaccagcacacaaagccctgtttgggagttgtgtgttttctggctctttttttttccttttaataaatcgcaatatcctttctctctgtgttcagttgccctgaattaggcgttaagattctgtgcagcaaattagagttgagaaaaggcacgcattttatttaactcagtcttgctaagtttgcggtaagcactgcccatgaggaaaacaaaccagaacaagggaaggacgttccctccagcttgggtggggatgagcacagaactacccagagcaggtcctgaatcctacacaaaacctctcattcaggggaaactctgggagacagtgaagggcaggagaggctggcgtgctgcagtccatggggtctcagagttggacacgcctaagcaacggaacaacaacaaaaccattcacacggtaaaagggctgagttgctccacgactacattacacaaggtacatcggtaatcagaagcagcatgcgagcgaggcgactgactttgtaagacgtgccgtgaaactcagtgctcagcaccacagaaaggtctgcgctggatgtgccctgccttcatggaacccgtgaacgaacatgtggtcttgggagctaattccgtagcaatccatccgacggttatcctttctttctctggggctccagcacctcatgaatgctgttcctcaaaatgaccaatagcattattctcaacacactgtccgcgtgcaaaaaaatgacatatgtcatctgtcgacatcagcattaaacagggaatactcaagatgtttacacctgaggttgtcagaagacgattctaacaaaaactatgcatcaccgggcatacaaagttt

SEQ ID NO: 64672 - DNA, 1514 bp, Bovine  19866880675563
aaaagaaatgttttctccccagatcccagcctctgtctgacttttcatacaaagattcaagacatcaaatgtgcatcccttacgaccggtaatctatgaactgagatccttagcgacatcacgctcaattcatcaagtctgagtaaccaattaccatgagaaatcgaatccaagccggttggcacttcctggagtgtttgctcttcatttagggaagggaaaaccgcaagcagggacccatcaaaggtgtcaaaggcggcctggcgctgcaaaggaaagagggaaagaaaacggaaacgttggcatttacacttagttaatgacctgttttaaaagtggtccatgggcagcctcaccaaaacaccctgattcaatttgccaggtataaagccacgcgtggcattgaccagttggcactctgagcagacttctgagaagatgcaagtgacccaaaggatctctttactctggatcacttacaggcacaccttggagatgctgcaggcttggttccagaccaccgaaataaagtaaccatcacagtaacgtgagtcacagaaatttcttggcttcccaatacatatacaagttactcttacagtattaagtgtgcaatagcatggtgtctaaaaactgtgcacatactttaattaaaaaatactttattgctaaaaaatgctaaccatcatctgagccttggtaatccttttgctagcagagggtttaaaacatgtcgaggattaccaatatgtgacacagagacacgaagtgatcaaatgctgttggaaaaatggtgccaatcaatgctagactgcagggttagcacaagccttcaatctgtaaaaaaaaaaaaactcagtatagcaaagtgcagtctatcaaggtctgcctgtcatcaaccacagaatcagaatgactgggaatttacttttaatggcctaatcaagttaaatgtataagttaagcaaacaaacctaaaacccagagagtcttagaacagtgcctggagggactcggagaccacctcaatccaaacacctggcccttctcagctaaatgggtgagacacgcagggccatgtgcataaggaaaatgcctcttacgctgttgtacagcagaaactaacacaacaatgtaacattatcccctaattaaaaagaaaaaatcctatgagaaatcataatggaaaataatgtttaaaatgtacatgtatatctatgtatatatgtgtaaatatatatacatatatatataaaccaaaccactttgctgtataacaggaattaacaacaatgtaaagtaactacgtgtgtgtacaggtaatagtatctgactttttgcaaccctatggactgtagccctccaggcacctctgtccgtggaattttccaagcaagaatactggagtgggttgccatttccccctccaaaggatcttccagacccagggatcaaacctgtgtctcctgcctctcatgcctggcaggcaaattgtttccaccacaccgcctagg

SEQ ID NO: 64673 - DNA, 850 bp, Bovine  19866880692571
ttttctatttcttttattcaacaggcagggataggtgcacagagctggctgctgtcttgcagtcagttcctcccttccaaccaccgcgggcatttgcatgagagaggcagcttgtggtcactgaaaggagatttttctttttatctctgagaagttattagctttcatgtggagcaaacctgtgatcttgcctttatcagcaaatgctgtaaccgattgagttaaccaagctgccccacgtaaatccgtgagtggttgaggtggctcagatggctaaaaaatccacctaccaatgcaggagacctggtttcaatccctgtcttgggaagatcccctggagaagggaatggctacccactccagtattcttgcctggagaatcccaaggacagagcagcctggcggctatagtccatgggctcacaaagagtcggacacaattgagcaactaacaatttcccttcaattctggacattaaccacctacaactgaaaataactttcacgacactttcaagacacactccgaggtcatttaacttattgctcagcccatagccctctttagcatcagtttatacagagccattgggttatctatatccaagacaataacaatgaacagacaaaggagaagccctctgaatcttagaaccgatgacaaaccaacctggatgcatcatataccccacatatggcatttaaagaaggaaaatatttaagtgcatgtattaagtagtaggaaggacagatgttctatgtaactaaccctccactgagccaagttatttcagtcatgtctcttttcaaccttacggactgaagcccaccgggctcctctgcccatgaa

SEQ ID NO: 64674 - DNA, 1624 bp, Bovine  19866880694240
cagtgcccacgtgacgctgatggctggcgtgggctgccctaaccttggcacatttcttgacatttaccaagtaaaacgatgagatcagggaaaccacaacttcaaacccggtatcttgtgaaactgaaacagagtaaacacttgcctgacagtgatttttgttttgatcatcagacttgattgaaccacggggcgattgacatccatgctgtggagtcatatatttttttcagtgaaacaaattgcatttacccattccaaactggtatggacacttgactgatttctacctaagcatgaatgtaagaatcccagcgcttcagttgtaggctttaccactgagtaaacctctcctggtaggcaggcaacgtgcagaagagaagatccaccttgaaacctgatttgtcgccttcctacctaaagagtggcccccaaacctgcctgaacttcataatgtgatcttattgggaaataggatctttccagatataagtaaggatacagatgagattggactagattagcaaagaccctaaatccaaggagaccaagaagtacagacagagactcaaataaggtgatgtcaagacagaggcagagatgaacgtgacatagctatatttccaggaaggtaaggattgtggacgaccgcccagagctggatcagaggcatggaatggattctttcacagagctctcagaaccagccctgggacatcttgattttggacttcaggtctcctaaactccaagacaatacatttctgtattttaaacccttgctgctgctgctgctaagtcgcttcagtcgtgtccgactctgtgcgaccccatagacggcagcccaccaggctcctccgtccctgggatactccaggcaagaacactggagtgggttgccatttcctcctccaatgcatgaaagtgaaaagtgaaagtgaaggtgctcagtcgtgtccgactcttagcgaccccatggaccgtggcccaccaggctcctccgtccatgggattttccaggcaagagtccctagtttgtggttatttccatggaaaccctagaacactaacacactacatgtagatactgtttttaacaaactttttgccatttcaaggtgttacaccgcccattaattgccttatagggttaggacagcttccaaaagggcttcaaggttaactcccagcttgcagcaaccagacagcttaaatttttcagaacaaaattacttttgcaaaattttccatataaactcctttgtctgaccatgccctgattttcatgcttgggaaaatgtgtctcttgtaccacttgcggggaaaatgtctgatttacattttaattcaagtcttgatgatacggggggcagggcgtgttttaacaaacatctttaaatctctcaatatttgtttgaaaagaaagttacaagttgaaggaaaaaaaaaaacagaaaaaatttaatttaattaggtaaattaaaacctaatttctttagtatgtttttccagccaacatttatgggcaaatttgtcaagttatgatagaagtagagtgatttacaatgctgtgttagtgtcagatgcacagcaaaggattcagttgtacatgtatacatacacc

SEQ ID NO: 64675 - DNA, 1326 bp, Bovine  19866880710500
acagaagagcctggcaggctaccgtccatggggtcacaaagaatctgacatgactgagtgactaacactactactactaaagcatctctgcaggtgacttcaaggcctgctttgaagtcaatctccaaagcacaaaaggattctttctgcacctctttacttcggggtgggggggggggacttacaaaccaagatctgataagggcagttgatgattcaacgcaatgaactggctgccccttagagctttgattggctctgacaaaggctccttgaacttggttgcaaataagattggttttgttttttttggtctcagccttttctgctggagaccttcacttaagtcttgagaggctggaggtttgctggaaggttctgtaggttgagatctgtccttggtggggatggctgaggggcctacatgaaatggtcatccagtcacttcaaggaacacccggggatggtgccagccaaggacattttgggagatggtttttatacaatgaatcttttaatatttaaatatgtgatttcaaaaattagaatgggttagaaaacatagaagggattcaggaggaagaggagtatcgtagagaagtgatatcatgactgtaatcctggaatagccaggtttgaattgactttctcataaaggtgttatcacgtggttgaatttatatgagttatctacatttgtaatgaagttccagcatttttttcagatttatattttattctataagcatagctttaataataaaaaaaaacacaataaatgggatatttgaattttttttaaaaaaggtgttagagttttctttcattatttattgatctgttcatttctgtcccaaagctcccaggcacggacaaggggctcccatgggggctttttgaaatgtactgtcatgggttcccccaccagaaagtctgacacagccaggatggtgggggtggggggcaaagaactcttcagacataaatcataccttttttttgtaactcagacacggctgggcgggggtgggggtgggggcggaaatcaaccagtagaaaactagagttctctgcacttgagctctacagaaataaccatttcaaatgaaattttagactacttctcttcctagtcctttgagaatcactgccaagttgctaagtaaagtatgtgcaccactttaaaaaaaagacccatttgtggcaatacctatagacttgctgtcatgggaaatgaaaatgtccttctctctttcggctctcccaccaatataattatgaaacaatttggctttttcagctggttgactttgcaagttaaagtaa

SEQ ID NO: 64676 - DNA, 2370 bp, Bovine  19866880776834
ccctccctacagatacaaagaagtatctgaatctttagggagcacacgcattttcacaaagcaccccccaatccagtgtgtaccccctcccattatacctccccccacctacccagggagcaacttcatcactctgcaagtgcatgaacttcacagccagcagggcacagtgtgctatgaatcagtgagtggggaaaatcacaaggacaaactcaatgctctggatctgagtggtagccactcagggtactgtgcggaggtaacagcccccgctccccactgacatggctaaaatcccttagaaccagagccctgtgatgtttggggaaacagtgagctgaggatttaaacagtaacacgaactctacaaaaccgtgtgctgggccaactggagagcccgaagcaggcacaggaaagacaaaaagaacacaaagcaggcatcttgaccacccagcaaaagcaaacacatcagcaaacagcaccaatctgagaaacgggcatggcagatggggagtggggcggtaggttgaggggggaacctgaatctaggggctccctggacagatcacaaacggagcaagcggatgtaaggagtctcaactcacagatgctgggttaaaaatcaaatcggcaccacggacttagtgcagtcctgctaatccacaaaggcaaaattagagcttcttcaataaagtttgcaaaacagggtctgccttcccatagcagcactggagagaatgctttttacacactcaggacaaagaaaacaaggctctcctgcctggtcctgcagaccccaccaagcctcggaggggaataacatactatgtaatgttagcattggctcactggcttaagagaaacacgaataaactggcagaaatgggctaaatgcgagggacagacttcacatcatgaatgagtaagaagaaggctttcacagcacaaagagtaacgatgtgaaaataggagtgtatcccctagataaagcaggatattctggcaaacacacccaatgaccaaagatgtaaacgcagtataggatttagacactgggccagcttacgagaactgaaacaacgcttcagtgtgtgtttggggcgggaggaacctatcctcacatctggcatagcattatttcaccacatggtcttctaaagaaagaaatcaaagttaacggagatcgatttaggggaagaaattgataaaagctagagatacggggggcacacagctttcctgcacatctgaaaaactctcctctgcatgaatccttcatgaggacggccatagccttcgaaagagcaaaagttgcttttcttcgctagaggagaagtcgtctaaaaatgagacagctttaggataaaacgtttcatttcaaaaggggtgacgtgtggtccgtattctggaaagacaagagagcgtgcccaggagggatgcagagcgtgcccaggagggatgctaagtaagccaaagcagccaaacatctaggacttagtacaagtgaggaaaaaataaataataaatggaatcagatacacacacactcacacacacacacaccaactcagcacatcagaacaatgaaggggtagaaagaaactaagggtggctttcagagacctgcttcaaacgaggaggctccctaaagctgacggctgttctttagaagaaaaggaaggccgtacaccaacagcaagcctttgttcacccacgtgactttgcctactgcctgcaggtttcatcatccctttggtcccaggatgaatgacaaaggctgaggcataggattctcccaccccagcggccctgggacttcaaagctgggaaacgagcgagcccagtgggattaaaaccagaatggaccgctgcacagggcctggtaaccaggaccacgtgaggcccttgtctccagctctgcaactgactgttcttggcctcgacgggtgctctccgtgctcccctgacacctggcttccctcctcatccacagccatctcacctacctacctgcctacctgccaaaggtgtgggcagatgccttagttaacatgtatggcttattccctcagaaccttcggccagcctcggggactcgggaactgttttggttgctttataacagagaattaaaagaaaaaaaaaaagaagtccaaacctggcagaaatgtggcataataatttaatatgcctgcctctatgttactataaaaagatgtgaactttagattggtgtgtgctggtgtgtaggggtgtttttctgtagcttcagaaagctggaatattctgatgtggccggtggcaggtgaccaatgccgtttttatgaacttaggagaaacgcataaattctaagcaaaggcccccaaaga

SEQ ID NO: 64677 - DNA, 1474 bp, Bovine  19866880822459
ccggggtctgcgctattactcgacaagaatatcatccacaagacgtcagggaagcgctacgtgtaccgcttcgtgtgcgacctgcagaacttgctgggctttacgcccgaggaactgcacgccatcctgggcgtccagccggacacggaggactgagcccacccgggctgggggcggggctgtcaaagcgccccgtcccaggaccctgaaaggccggaccggctcatccggcacgcctattggaagcagtggccttattccatcggacaccgcagttcttcgccgaaagcagcacggtttctcgcttctgaaagcctgctgctgggaacccgccacttaacgatgctattccattctgtcggcccaggaagaagcttggggcccccgggcctagccctgggcaggctgtacggtgacaggatcggtcaggctgttgggtcttctcaaaggagggagcgtgtcacagacgcacacttcttggatttttcttttgcctttttgcagccaggaatcgcacaagagctctctttggttctgagggggaggagggggcaaagacacattctgtttcgaagttagtttgtatatatgactgtaaccttgtaattgttatcagagtcccctaacagacctatttaacagaaactgtatattgtaatttaaaataattatataactgtatgtgaaaataggaatgcagatggcattttgccgtgttcgctggttttcaagagcactggcgtccttttgcaaacatttaatctgctggtgcagattaagagaagttgtaaagtgtgtattatttacatttaatatgcctacaggaataaggtctaagaaggttcattcctgttttgttttgttttgcctaggttgttatctatggcaaggactttgtacatttgggaatttttataagaaacttaatgttattatctgggggcctctcctggcctctctgcttctcctttaattgtaatgtaaaagctataaagcagtatttttcttgacagatggcatatgttttccatttctatgcatgccttgaaataagtttataacaaaacttactttattttttagttcaactatgttttccccagcgacacacctcccctgaccaggcatttccttccccagccccacccccacaccccaaattatgctgtgtgattaaaataggaatactatttttggaaatatgcgactccttttcagagatcaggagggatttatgtagcagctatttttactgcaaaagtaactcactggaaaaaaaatgtaatttgttagaaagttttatttttactgcagcaccatgagccatacagagctgaagatgcagggggaggggaggcttaattaataaacttctccggcatgagtggagcctgattttgtcccatcttgtttacctgtggagtctcaggatttcccaacaccaagctgctcctttctgtgagtgtccaccgtt

SEQ ID NO: 64678 - DNA, 1668 bp, Bovine  19866880904489
ctgaactgctgcaaaatcgagtaattcgtcgacgagatgatgttcgtaaaggaggctgcaggtggatgcctgcgtcagctgtccaatcagaatacctagaggaagagtcactggaaaaggaaaagttgtaagttgtatggaaccagaatctaagcctgaatagcaaattaatccaccttaagagagacagagacaacaaggaggaaagaaaagatcctaggaagattcaactaccctcaccatcaacaaatactgacatgaccaaagatcatgagaagagaaaaatcttcactgacactggaaattagaaaaggatgtaagcctgagtaaatgtttttaagtataatttagatgagacctcaagaaagacaacatcaaaagccaactaataatttccccttccaaaaatgaagtgtagttatgaaaacagtagagaccagaagagcagcacttcccctaaactgcaggaagctcagaaatggactagaaatgttaactggaatgacagatccgtcagtgagtatactgagaagcacaaggaaagcagagccacatcaaacagaaagctataagtgggcacggcttcttgccaagaaggggattctccctgatatgaggaaagatcccacagagggactagtctcggcctactctggagcaaaagcagtcaaataggaaactcaatctagaaaactagcccctgccactgccagctttagcaaacacagaagaggataaagaccctctaactggggccatcattacccaaccacatacctcccaggctccgtaaaacccatatccaaaagctatttactataaatgttatttctgcattatcttttacgctataaaaagagctgttttaaaaatcttaagagcatgtgctttgtataataaaattcacaataagctgaattcaaacataatgaatacagagacagaaaggcaagggtggtagttgccagggtaggtggggtggagtgatgaattgctgttcagtgggtatatgtctcagtactgcaagatgaaacgagctctggagactgggtgcacaacactgtgaatgtacttaacactactgaactctacagttaaaaacaattacgacgatcaatttcatgttctgtatatttccaatcaaaattaaataaaaaagactgagcaccaaagaattgatgccttcgaactgtggtgctagagaagactcttttgagagtcccttggacagcaaagagatcaaaccagtccaatcctaaaggaaatcaaccctgaatactgactggaaggactgattccaatacgttggccacctgatgtgaagagccgactcactggagaagaccctgatgctgggaaagattgaaggcagcaggagaagagggtgacagaggatgagatggttggatggtatcactgactagatggacatgagtttgataaacctccaggatgtccatcaccatcgaaggacagggaagcctggggtgctgcagtccatgtggtcacaaaaagttggacacgactgagtgactacaacaaacaaaactaaacaagtattctagaaatcactccagctcctaagcataatggaataaaaagaagacaagaaaagaagccaggggtatgatataatagtctgtaaagcaaagtatcaatggaaattaa

SEQ ID NO: 64679 - DNA, 1167 bp, Bovine  19866880915562
tgctaacgcagacccacatcccaaactgagaaaatgtttaagaagaacgtcctaaggctctgggggcaggagggagctgatgataaaacactcattggagtcctcatgaattccctgtttgatcttgggttgctcacttccaggtgagatctagacctttccggatctcagattctcccctctgggggatgggaagtccagaccagaaggttgccatagttttccatttttaaaaaaatgtgtgatgcaaacagcatttgcttctccaaagctaatagcagtaccaaggtgtttaagaaatgaaataaacgtgaattcccatacggactttttttttttttaactatagaaagcagaattggattgcgttgtattctgtgtagctgctgcatgaggtatcattcaagcagctgagagttcccagtcatatttggctttgtggatttggctatagaatgtcagcctggccataggctaaccacttgtttgacttaaagcctcagaagaatggttcaacaatggcacattgctgtttcttttcaacaaatcatgcaaaatgagcagagataggaatagaaatcaagggtgaaaaagagctattcactggtataggtattttaaacatcctagaggcctctggttaattcacagcatttttttttttttttggttcatttatcatccagatgttcgccatcatggaagcaccacttgaaactctatctcagctaataacttagaaatggaaaaattcgtatctttgtctgtctgtcctttggtgccccatttcccccacactcttcttctaagtagctcttctttaaaatctcctgggaatgtggcagttttgccagatgcttaggtgttagtgggcacatgtctgctttttaatcttcgtgaccatgctgtaccctgtctggttgaattatagattgcatttgtcaaataatgacacatgcaattggatgtcttctaagacctttgaaattcaacttccttgagtcgagattaaagtggatattatctgcacggctgcagtcaggcctgggatgtttggggacctgcaggaaagtttttctgggtctgccagttccaacttttaccttcttgggaaagaaagccagctccttttttcttcgaaaggtagaaacagacaccagaaaaggt

SEQ ID NO: 64680 - DNA, 1223 bp, Bovine  19866880962495
atctaagtaaaagcagagctttgacatctccagatcaaacgtgctattgcttacctggacattcattcagcacacctgcataaaaacgcctttccagaaaggttgctggcccccctgcttctgttcagagcaccaaatacccatcacgtgtgattttaggaatcagtgaggatcaacaataaaaaataaagggacccaaatgctcctccgggctgtactggtgaccagctcattcagaaagtttgctcttggggtgaataccacccaccaccactcgccaggtgtccacgcccagacaaacagggaaggagggacgaatccctccacagctctggaaatagattctgggtgtgcaagccatttggccaagttaagcattaaacatttggaaagtccagttttgagagagtccatggaactgcatttccatgcacctcccaaaatttcaaaccaagaagaacaacagacagttcaaattagacaaaacattggaatcttgtgaaaattccaaagaaaaacatttacagaactgcagaattgttctcctttctttccttttttttaaagactagaacataacagacactggtcccctttgcaaaggcattgggtgtctgatgggcttcccaggtagctctagcggtaaagcacccacctgcttacacaggaaacgtaagagacatgggttcgatccttgggttgggaagatcccctggaggagagcatggcaaccccctccagtaatcttggctggaaaatcccatggatagaggagcctggcaggctggagtcaatcgggtcgcaaagagttagatgtgactgaagagacttagcatgcacgcacacagggtgtcctacagaggaccacaccggagcctcaagaaccctgggaccttgcagaatggcagtcagcacagttacaaggcacagcttttagatttaaccacagggcgcctctggcaagctgcttggtgaccaaagcattgagtaatgatagaggaggttggtgttcactgttgcctgcaggtagagagccctcttctctgggtcctcatcctagaggaggctcagtggtttgccaccctcccctgggttgcccccccaccactgtcagcctcagcccacctggcacaccatctacggaaagcaccagtgggaagtcctgggtccaccttctgaagctggagatgttgacaatacacgaaccgatctcttttacaaaa

SEQ ID NO: 64681 - DNA, 1165 bp, Bovine  19866881012375
gtatgaagatccttgtgattacattgggcccaccctgataatccaggaccacctccctatctcaaaagccattcctttaatcatatctgtggagtccctttggccacagtcgcaggtttttgggaccaagatgtagatatgattctgcctactatgttatccagtgtgggtacattcatatgcgtgtgaaacattttttaaacttaggagataagtggtagaatgaaaatgtgcttttggagtaacagatatgacagtattgtgttttgttttttttttaatggacttttgcctaagtagatagaaaatcgtataatgacatattttgacatagtacagaagacaactgttcagttagatttttaccattactataccataccattccctggtggctcagatggtaaagcgtctgcctacaatgcgggagacatgggttcaatccctggattgggaagatctggagaaggaaatggcaacccactccagtattcttgcctggaaaatcccatggatggaggagcctggtaggttatagtccatggggtcgcaaaagagttggacacaactgagcaacttatgactatgataccataccatatcatagtgcagcttttccaaggctgagaaagcgtttaatattataaatgtatttttaggttcatgattggaaaaaaaggagcatcaaaacaaccaattatgttgaaaacaactggaagaaacagtgtaaggaactagtgaacttaatttttcaatgtgaagattctgaaccatttagacaacctgttgatttggttgaatatccagtaagttgtcattatttgaatgtttggtgcttttcttattggtgtagagattagggtagaggtgtttaaatgaaaaagtaagatgtctagaattccctggtggcctaatgcttagaattccaggctttcactgctatggcccaggttagtctctggttgggatactgagagagatctcacaagcctcaaggcatagccacaaaaaaagaaaaagtaaacaaccagcacctcctgccccttgcaacccagcaaccaaaaagtgacatctgggcttaaggttaactttgtctcttaccactaagtcagcgatggaagagttgttttaaaggttcttaattaatagaattcaagaaattgta

SEQ ID NO: 64682 - DNA, 1425 bp, Bovine  19866881033729
acctcccccccacggaaagctccttgccggtgtgtgagaatgcgtgccagcacaagcgtgtgtgcacgcacatgtttgtgcatgcatgtgtgtgtttaacgaaaagtggcctgaagagttggtcacagtcttcaggaatcaaatgcagctttgagcctctcactgcggagccagcccgcgtcgaggggaggcctggagggagcagaacacgaaggctggaaagccgcccactcgaaccctggcacggcccgaggcaggagcacacgggcatttcatgtctccgtgtttgttttgtcttccaccaagaatgtagacgcagaaggggaaagaatctgagaccagaaagtctgattattacctgaaaaagagggtcagtgggactgactaaagccattgaaatgctttgaagattaataggcccgtataaacattaatttgttatgaggtttctcagaggacattaaacagagcgcagaaagcttgcatataaaactccgcatggagtcctcggctataattaacgtctgcagggtttacttgacgccattccagcacgggggagggcgtgatgaggaggtacaccagccctctttctttgaggtgagaaagtggaattgggggtttctaagtccttctaaaaccgtcactgcctgggaagcaagaaccccagtgaggagttagtgccagtccccagaaggggggttgagcagagccccttctggagaacttagggccctcgaggggacagaggaagaaaacgctggcaaggaggaaattttgccatttgcggcaacaggggtggatttggggggcattatgctaaatgaaatgtcagttaaagacaagcactatacaatatcacttatatgtggaatctgaaaaatacaacatacgtgaacaatacaaaaaaaagaagcagactcagttgtagagaacaaacgcgtggttaccagtggggagagggaaacggggcaatacaggagtgcatgcatgctcagactctctgtcatttgactctttgcgaccccatggactacagcctgccaggctgctttgtccatgggatttcccagacaagagtactggagcgggttgccatttcctcctccaggggatcttctccatccagggatttaaccccatctcctgaatctcctgtgttgacaggtatattcttttccactgagccacctggagaaaaaaggggttactatgggattttatgatatcatgtgtgtgaaacgtttgaaaattgtaaagctctacagaacgtgaaaaatctttccaccagtaaaaaagaataataaataaacttgtttaccatcaacagcagcaagcttgctcgctcccatctgcttaatgaggacgaaactcaagatgtctcagtaaccacagtcctttcaaagggactcatcatctgggaaa

SEQ ID NO: 64683 - DNA, 1188 bp, Bovine  19866881066618
tcttgatatcagccttggtctttgagttgacaaatggtctcaataaaaaatagttccaaacactggcatgcagtcaggttcctggatgccttctgccactcattagagctttcatttgcaattgtttttcgatcacttatccattgtgttaattatgctttgtcggtttattaatgtctcatatttgctgtcacatgtgatcatagtattgtaataaaagccagtaatttgtaggtgatagcaggcggtaggcatccaaatgtgacctagagggagaagtgaatttatagattgcatcacaatatttttctcttcaaagttcccataatgttctcttgcaaagcctttttttttttttttttggtgtgtttgtcttgaggacacaagcctttgaaataatttttctccaggaagtttctctggtgccaattctccatgacaactgtttaaaataccctgagatgttttataaaaaagaaaccccaaacccaataatagtaataaaattactggaagcaagggtagagatcatccaaggcaattaaaaagtttctgagtagcagagcagtcatttctgcagttgcaattttaatcatgttgaaaattgtcattggtcttgaatccctttgatgagaaatctccctgggtcgcttgtaacgcctctggtatgagtgtcttggaaaaacaagtctaatttcaggcttcccttagggtagtggaagatggaatattttttccttttcttgagcagcatgtaattttgccagattccctctgagaagctccacatggcatcagtgtgataaatggctatgtggctctgcaaataatttgaaattctggggaaatcctgctgggttggcaggaagaagtgggggtctgtgccacattttggggaaagtagatatttgaaatgagccccccatctgaagtacacaccactggagtacacacgtattttatgtcagttgcccacctagacagggcagaccaagaggacattgaccatctctcagcgggggtactgatcaatctcagtccctggaggtggctgaactctccttggaaggcctgcctacagagaaggcagcttcatcccacacctggaacttcagaaagttggcagagggcttcaattatgtcgggaaagcatgcagatgaaggtttccctgggaactcttggtctga

SEQ ID NO: 64684 - DNA, 1458 bp, Bovine  19866881179049
ctccagtttgttacaaaatgttttctatttttcagtcatattttccatttcattatggagtcatttaagggcttccttggtggctcagtggtaaagaatctacctgccagtgcaggagatgtaggttccatccctgggtcaggaacatcacctgagaaagaaatggctacccactctagtattcttgcatgggaaatcccatggacagaggagcctggtgggctacagtccatggggtcacaaaggagtcagacatgacttagctgctgaagaatatggagtcataaaatatatgtaacaggcttaaattgatacattgtattgccacggttttaaatggacatatacctccactgtggagaaagcaatggcaccccactccagtactcttgcctcgaaaatcccatggacggaggagcctggtgggctgccgtctatgggatcgcacagagtcggacacgactgaagcaacttagcagcagcagcagcataactccattgtactgatagaagataaagatagttgattgattactactggtaattggtatgttttcccagagttttttgttgaagtcattttttgtaatgtatgatttagtttccttctgtttgtactttaaaagtttcattttactttgaatttttggattatcacttttaaggatttcttttaaaattttggagaaattctttgtctttacattttatattacttagagtaagctgtcaaataaaaatatttttgactgcagagtttcatcattaataatgccttacatttttaaaacacctttttcaaagaacagagttctcctgctttttcattacacagtttttacatttcacttatcctagttctgcatatgtcaccaacgaaacaagattagaacccaggtctccagactacaaagataattctcttagctaaagtaaattaaggcttctaagtttgatttaatttttcactcctcttgttaaatttctttaatatttttatcatagctcagctttagaaacatgtaccaacattttgtcagcctacatgcatttttcagcatcctacactcctagaatatgtagaaaacataatttgggagggggagttatttttcaaaatcgttctgtatacattattgcttttcctgggttaaatatgtgtaaagtgataaaacatggaatatgggccttcttagactctagcatccttgatagcttttccataagactttttttttcctttggtttattacacactcagttccaaacgttgactgccctggggcctggcgcgtcctccacacagtggacagagggtggaaagaagggctggaaaaaatgtggggtttcatgatgttacagaaatgagacctttactctggcaataggaattcacatttcaaaagttgatggttgtcaagctgatctaaaaaactttatgagaatgccaaaatagtt

SEQ ID NO: 64685 - DNA, 944 bp, Bovine  19866881355981
ggaaggcttttttgaactgcaacctttacaccccaatccaatagttctttcggctttgaaatgtccacaatctgaattttatagggattactttttattataggtagagcaattaaatctcccatattgaaggatgtaaaccttttaaggcccttctccaagtatcaaaagaaaaggaggcttatatttaacaggtgtgacaacccaatgcaggacatttcattgaccaagagcttgacgttctccagtaacaaatacttaaattaatccgagacatctttcagataaaagggatttcagaaagaattaagtcgaccacaaaacttcatacagaaagatcatctcatgtatgaaatacttaaaaatgctaattcttgaggaatgtgtcaaggggtgtttttataaaatctttccttttaaattatattttatgaactttaaatgatcgtatttcctatccatcccatagcatagataatgaacgtgtcttcattacttgtatcctgttgacctttcaaattaattaactggtggaaattgcccttgaccttgattatggcccagactgaagggagtgctctggtagagggtaagattatatcatatgagagaaaaaatttcctaactgcaactgcaagatacaatcagttggaggagatggtgtcctaactttgcaaaactctgagattcttggttctaagatttttcactgttaatagactcagctttgaaagtggtctcagtatgaggttttgttttttacaaaacaattctctcccccttctcctcccctctccccgctcctctggaaaatgtgtgaggtgggcatgtttgtgatggctttctctgtggggtgtattttgaggaaggggagaaaagtatcaaaagggagccacagataacattggttcaaatattgtgttttttctaactcatgttttttt

SEQ ID NO: 64686 - DNA, 1080 bp, Bovine  19866881391255
tccccatcccatcctcagggtcatcccagtgcactggccctgagtgccctgtctcttccattgaacctggactggcaatctgtttcacatatgataatatacatgtttcaatgctattctctcaaatcatcccaccctcaccttctcccacagagtggtttcctcgtctttgcgaccccgtagactgtagcccaccaggctccttggtccgtggggattctccaggtaaggatcctggagtggggtgccatgccctcctccagagatcttccccgacccaaggactgaatccttgtctcttacatctcctgcattggcaggcgggttctttatccctcctgccacctgggaagccccatttttcaggagagggctggtcacttttgtttttgcagagccacctgagtttctttgtggcctgaacacctgttgtaccataagaaagcattttgccccttaaataaagggaccagagactaccggactcctggctctgggatgtgtcggggttagaactgctgcctagctctgtgtctccctgcaggcttgcaggttcagggcctgttgggtgggaggctcgtggagtgcatgcgtgctcactaggtatgtccagaaagatgtttttgtttcccacttggggttttatccctgagactgccaattaaaccatcccataaatcctccgctataggtagtaaaacctaattttagatttcctgcttgctccagtgtcctgcttgcttgctacttgctggcgaaaggctggccctgggcggcaggcacttagttcacgctgcaccacgtgttcaagcctttttctcacatctttggggttgggtctgaattcactgattgcttttaccttgagtttcaagaccttctgaggatcgtgatttgcagaactctgcagcgtacttggttctttttggtgaacaactttaatgcaagagaatgagggcagggggcaacaagaagggggtggatcaatgaagaagggtgaaaacctctgcagtttttgttcagaatatgagatctgtcccctgcaggtcgttcatgctccgtatctgtaattcagacccg

SEQ ID NO: 64687 - DNA, 1056 bp, Bovine  19866881588719
agtctttgttcctaaagaaccaaactcctttaactctcttccctagtaacttctctccttgagacgaatagaccaaaacacacactctctactcaacggatggaattttccaaggggataggaaacttaagtctcaagtgaagacattcagtgttttgatattaggatgggtcttttagagataaatgttggaagccaggaaaaatagcatcaagaggaaataatgcatgtgtaggcagcgtcggaaatatagagggttcacaccatgggaactctgaccgctattatttttgaatttccttcatgttagtacagctgtgcagatgccatgaagcagggttatgtatttcccggcccacggtacgggctcagtccgggcgatcccagctatgacctccatccacagatatacctgctccatcctcattgttagccctgagctccctccatcagcacctgtacaaaggatgctgagaatgaatctgtagtttcaaagttcccagatgctgaatgaactctttccagggcctatggtccatccttcctgtccactccccagccacaactcttgggtccagaatgactttctccattgcatctcagtcctgccccacccagagagtgcccttctgctttggtagctccttaggcttgaaggctgcatccatgccaggcctctagttccaagattctgcagactggctgcagagttccagctgacatggtatggagacaaaggaagacccactggggtggagcccacaaccatcagggcctcagacattgggatggaaatctaaaatccagtagattgtatagattgccaagagtacaaaaaaccctgtgttgggtaatgcttatgaggacattttcagaaatctgccttagatgacataactcaactctcaggatccttcagctacagggatcttgtgttagtgatctctgacttaaccatctaagaaggcattgacacgttcttctgttccctggttaaaccagagttttctgtttggagtttacctgttacatatgggaatgatggagggcggaagg

SEQ ID NO: 64688 - DNA, 1172 bp, Bovine  19866881815967
caattagcatgataatgttgttaaaatctcatctacccagagggcactttatctgacaaggtaaattacccgtaagccagctgagcggcctcaaaggatccaaagacatgtcacgaagtctggggagagagaagctttgccagagaaaggcacgctaccagccgcgtgaggttaacagccggcccaatcaaagcagaaacgtcagacaattatgcaaaccagactcaggaactcaaaaaaacatagccatttgagaactttgctatgagagcaagctgctcaagccagctgaatagagcccctggtcccacagaaagcagataacaaggaacacagcgcccaaccctgtcaagggcaagtggtaggaaccctggtacctcccagacggggtgagcccggcgttctgcacagtgacaggtagaggaacacacgtgatcatcgtcagtggaaaattctcctcggaaatggtctaagccagacacggttgagcatctcaagggcagagtttaatttgcaaagcagccatggcacacagagagaccctgacttggagccaggttggtactgaccatcagcagccaggagactgcccaactgcaatggacagttgtttgtggccgtgccatgcagacagacacaagcgtctcgtgttcaaagaactgcaaccttctcgttccccaaacacgctggaccagaggtcgcctcctacacagagattttcctggccatctatgtcagcaacagtgaatgcatcataagcttaacctctgggaagatagacaaccagctatcccagagagttgccttctcgtcaaaaaaaccctggaccttgactgaacaacagccatcattggtgaaaaggcaccatacccaccagcaacaccagggacagtgacactgtcacagaggaccccattcatccgattacagccccgtccccataggtggggttcccaggtggctcagatgggaaagaatctgcctgcaatgctggagacccgggttgaatccctgggttggggggagatcccctggagaagggaatggcaacccgctccagtatccttgcctgaagaattccatggataggagagcctagtgggctacagtccatgtgttgcaaggagttggacacgactgagcaactaacactttcactttccacgtaaatg

SEQ ID NO: 64689 - DNA, 866 bp, Bovine  19866881864367
aagctagtcgggataatcagaaacagttcacaaataaaataagccataagattctccatcttctctgggtaccctcccccatccggtgacatcactcgacatgtggccatacggtttttccaggacatccccccctcccaaggctggaatctggcggccggctaaaattaccacttaaagcaaggattgacccttccttgacacttctgaagaaggatccatgtgaaaatctaccctcgctcctgggacgggccagagggaaagcctctgctttcattcggtaaaagattaaaaaaggaaaaaaaatcctaaatgaataaagagatgccatttttaattgttctagaagtctggcatggctatattaagacaattgctcttttatatgtagaacaggggcaaacaaatctccagggattaaaaaccatgttcttgtggtttgcttttaaaagctgcaaatttgaattcaattaaaaaaaaaatcatggcacagggacaaaatgagaatgaacaaagctggggaaaacgtccgtccccagtcttcagagcgaaggaccgctgtgagtctgcatgtttccaattacacatgttcagacagaaccaacgtgcggggtgttaagcagaacctgatccagagaaagattcccagagtcactctttcatttgaaacaaccacatagacacttcagttcattaaagagaaaaatatgttaaaaaagaaaaaagaaaagaaaaatattatcatatgatttctctctttctcctctcaatacaaagccagcctaggcgcatcagtgtaagaactaatattttgtattttcttgggtgcttttaaaacaatagtaaggagcaaagagaagaagcat

SEQ ID NO: 64690 - DNA, 724 bp, Bovine  19866881970082
agtatatgagccgccttcaaaatccactgtgatattaagctgcatgatgacaggctctaggcaagtctgaacaacaaaaatagtaagagggacccgttgtattctgaagaactgataatccctaaataaatgtgtctgcaatgtgagtcagatctgaggagatataggatttcagaggtgtgcatgtgtgttctgaatcacaaaatgattcccacagtacacgctggactgaatgatgctttgagcaccagcatgactatttatcttgcaaactggacaccgagctgctagtcttcacacaaacgaagagttagtcactgctgcacccgccagtccagccagtgattaaggaaggctaattcacgttgccgctcttggtgacaacgtaaaacctggattagcattgtaaagcccaggaatgtgacagaagcaacacgtgaataatcattaaaaccgggtatttatgttatgtccatttgaaactgctcccctcaggctgggactcgaacccagtcaaagcccagattaggatttgaacccctttcgttgagatcacacacctggtcccaggacttaatgaggctcaggttctttttacgttctttatgttcttcaggttctttatgcacagaaggaattccgtgaaagccaaagtgataggtaagaagtgaatttattgagagaggtacacattccatagacagaattcagtccatctaaaagg

SEQ ID NO: 64691 - DNA, 967 bp, Bovine  19866880449385
agagaaaggcccagattatctgggggagaaagtctgttcattgctggatgtaaaagatcagatcaaaggttaaaggacagagttagatacatggagacataaaattatatgagtgatacccatgaaagttgatgagctgaacaagggactgagaagacagaagcaaatggtcagtaaaagagcactggggcacctgagatcctacagattcaaactgacaagagttaaagggactcaaaatgaggtagacaggaaaaagcaaatcaatgaacaaataatatcgtaaactataaataagtaacaaaacctcacaaaagtgaaaaagtatttccctacaaattagtaatgttactatagtccaacagactttatacttagaatgaattaataataaatatgcattagaaactgccattaaatttaccagtaagataggatgttcttctgtcccaagatatgcttttccataagcagtttcatttaatatcataagtgagaagaaaatccaaattttaaaatataatcaagtaaattggcatatagtacaggaaatcctctaatattatctcaagttttaaataagtaatatactattttgccatttaaaatgttatgtaattttgtggataaaatgaagccagccataaaagagttaagtgaatgaaaattaaaacactaagctcacaaggctcatgggaatacacttcataataaaattttatgagattcttagcaaggaaaatagtttttaatatttatttgcacttaaaaatttgtttacactggaaatatatattagcatgttaaaaatattatttgcatggccatataagatcaatttgataatttaaagtagaatgaatatagcccgattagagtttccagtgatgataacttgatacatacacataaaagagacaacttttatacgaagagttagatacactaaacaggatttttaggattc

SEQ ID NO: 64692 - DNA, 787 bp, Bovine  19866880501882
tttaagacagctttggaaggattcattttagttgtctaaccaaaacaaagctgaaagaaaaatgtacattctaatggatctgtgcttctcaatatctacatttagagacatatacccatcacttttgcatagcaacaactgggcatatgtgtgtaacatacctggtgttcaattaaatgccctcaataatatagagcaactacagaggcaaacagcactataaatggaagaattatataaataatttttgctaaataaaatgcatatgttgaaacattcatatgaatatgcatatatgcaaaacacatatgctggtatgcattgccccaaaatagttttcaacatttgccatgagtataattagcaccccaattttaccaccatactacccagtttggtttattctgtgtgagggttttttgacctgagcactattcatattctggaccagaaaattctttgttgtggggactcacttgtgagttgtaagatgttcaggaccacccctgacctttgcctgcaaatgagaataatattcttccctcagttgtgacaaccaaacacttcatcagacattgccaaatgtccccaggtagggggtactttggggattcccaggtggctccgtgataaagaatccgcctgccaatgcaggagacacagattccacccctgggtcaggaagatcccctggagaaggaaatggaacaatctccagtattcttgcctgggaaatcccattggcagagaagcccagtgggctacagtccctggggtttcaaaggaa
